United States Patent 11,931,406 (FLAVIVIRUS VACCINE) - sequence listing, part 72

SEQ ID NO: 24869 - RNA, 9876 nt, Artificial Sequence
  derived and/or modified CDS sequence (opt11) from DENV-2__KX380838__SS-prME
accgcugggaucauaaucaugaugauuccgaccgugauggcauuccaccuuaccacacggaacggggaaccgcacaugaucgugagccggcaggaaaagggcaaaucucuccuguucaagacagagaauggggugaacaugugcacccucauggccauggaccugggcgagcugugcgaagauacuauuaccuacaauugcccacugcuacgccaaaacgagcccgaggacaucgacuguugguguaauagcaccagcaccugggucaccuaugggaccugcaccgcuacgggcgagcacaggcgagagaagagaagcgucgcacuuguaccccacguggggaugggccuggagacgcgaacggagaccuggaugucuagcgagggggccuggaagcacgcccagcggaucgagacauggguccuccgccaccccggcuucacggugauggcugcgauccuagcauacaccaucggcaccacauacuuucagcgggugcugaucuuuauccuacugacggccguggcgcccucgaugacgaugagauguaucgggaucagcaaccgggauuuuguggagggcgugagcggcggguccuggguagacaucgucuuagaacacggguccugcgugacaaccauggccaagaacaagccgacgcuggacuucgaauuaauuaagacggaagcaaagcauccggccacccugcgcaaguacugcauagaggccaaacucaccaauacuaccaccgcgagccgaugcccgacgcaaggggagccgucccugaaugaagaacaggauaagcgcuucgucugcaagcacucaaugguggaccgaggcugggggaaugggugcggccuguucgggaagggugggaucguuacgugcgccauguucacgugcaagaaaaacauggaggguaagaucguccagcccgagaaucucgaguauaccaucgugaucacaccccauuccggagaagaaaacgcgguggggaacgacacaggcaaacacggaaaggagaucaaggucaccccacagucaaguauuaccgaggccgagcucacggguuacgggaccgcuaccauggaguguagcccccguaccggccuggauuucaaugagaugguccuccuacagauggagaacaaggcauggcuggugcaccggcagugguuccucgaucuccccuugcccuggcucccgggugcugauacacaggguuccaacuggauccaaaaggagacccuggucaccuuuaagaacccgcacgccaagaaacaggacguagucguucugggcagccaggagggggccaugcacaccgcauugaccggcgcgacggagauacagaugaguuccgggaaccuccuguuuacaggacaccucaaguguaggcuucggauggacaagcugcagcucaagggaaugagcuauagcaugugcaccgggaaguucaagguagugaaggagaucgccgagacgcaacacggcaccaucguuauacgcgugcaguacgaaggggauggaagcccaugcaagauccccuucgagaucauggaccucgagaaacggcacguccuuggacgcuugaucacggugaacccaauugugacugagaaggauucccccgucaacaucgaagccgagccgcccuuuggggacucauacaucaucauaggcguggagccgggccagcugaagcuguccugguucaaaaaggguaguuccauugggcagauguucgagacuaccaugcgcggcgcuaagagaauggcaauucucggagacacugccugggauuucggaagccuaggcgggguguuuacguccaucggaaaggcgcugcaccaagucuucggcgccauuuacggugccgcuuucagcggcgugucuuggaccaugaagauccucauaggggucgucaucaccuggauuggaaugaacagccgaaguacgucacuguccgugagccugguacuggucgguaucgugacccuguaccuaggugugaugguccaagccgacuccgggugcguggugagcuggaagaacaaagagcugaaaugcgggaguggcaucuucaucacagacaacguucacacuuggacggagcaguauaaguuucagcccgagucccccucgaagcucgccuccgcgauucagaaggcccacgaggaggggauaugcggcauccgaagcgugaccagacuggaaaaucuaauguggaagcagauaaccccugagcucaaccacauccugucagagaacgaggugaaacuuaccaucaugacgggcgauaucaaagguauuaugcaggcgggaaagcggagccuccgcccgcaacccaccgaacugaaguauuccuggaaggcauggggcaaggcuaagauguuaaguaccgagcuccacaaccacacauuucuaauugacggcccugagacggcagagugccccaacacuaaccgggccuggaacagucuagagguugaggacuacggauuuggggucuucacgaccaacaucuggcuuaagcugaaggagcgccaggacguguuuugcgacagcaaacuuauguccgcggcgaucaaggacaaccgcgccguucacgccgacaugggguacuggaucgagucagcccucaacgacacguggaaaauagagaaggcauccuucauugagguaaagagcugccacuggcccaagucccacacccuguggucgaacggcgugcuggaguccgaaaugauuauacccaaaaacuuugccggcccgguaagccagcacaacuaccgcccgggauaccacacucagaccgccggccccuggcaccucgggcggcuggagauggacuucgacuucugcgaggguaccacugugguaguuacugaggauugcgggaaccgcggcccgucgcugcggacaacaacugccuccggcaagcuaauuaccgaguggugcugucgcagcuguacccugcccccacugagguaccgaggcgaggauggcugcugguacgggauggagauucggccccugaaagagaaggaggaaaaccuggucaauucccuggucacagcgggccaugggcagauagauaacuucucuuugggcgugcugggcauggcgcuauuccucgaggaaaugcucaggacacgcguggggacaaagcacgccauccuacucguggcggucuccuuugugacccugaucaccgguaauaugagcuucagagaccuggggaggguaauggucauggugggcgcaaccaugaccgacgacaucgggaugggcgugaccuaccucgccuuacuggcagcguucaaaguccggccuacauucgcugccggccuuuugcugcguaagcucacguccaaggagcucaugaugaccaccauugggaucguguuacucucccagucaaccaucccggaaaccaucuuagagcuuaccgacgcucucgccuugggcaugauggugcugaagaucguucggaacauggaaaaguaccagcucgccgugacuauaauggccacgcugugcguccccaacgccgugauccugcaaaacgcguggaagguaagcugcacgauccucgccgucgucuccgugucuccccucuuacuaaccagcagccagcagaaggcggauuggauacccuuagcgcugaccauaaagggacucaacccaaccgcgauuuuccucacgaccuuaagucggaccucaaagaagcgaucuuggccccucaacgaggcaauaauggcugucggaaugguaucuauccuggccuccucgcuauugaagaacgacaucccuaugaccggaccacuuguagcggguggacuguuaaccgucuguuacguguugaccgggcgcucggcagaccuggaauuagaaagagccgcugacgugcggugggaggagcaggcagagaucuccgggagcucgcccauccuuucaauuacaauauccgaggacggcagcauguccauuaaaaacgaagaagaggagcaaacccugacgaucuugauucggacuggauugcuagugaucucaggacucuucccuguguccauccccauuacugccgcagccugguaccugugggagguuaagaagcagcgcgccggggugcuaugggacgugcccucgccaccgccaguaggaaaggccgagcuugaggacggggccuaccgaaucaagcagaagggcauacugggguacucccagaucggcgcgggcgucuacaaggagggcacguuccacacaauguggcaugugacccgcggugccguccugaugcauaaggggaagagaaucgagcccucaugggccgacgugaagaaggaccuaaucuccuacggcggaggguggaaguuagagggcgaauggaaagagggagaggagguccagguucuugcucuggaacccggcaagaacccccgcgccgugcaaaccaagcccggucuguucaagaccaacaccgggacgaucggagcggugucacuagacuuuucgcccggcacgagcggcuccccaaucgucgacaagaaggggaaggucguaggccuauaugggaacggcguggucaccaggagcggcacguacgugucggccaucgcccagacggagaagucgaucgaagacaaccccgagaucgaggaugacaucuuucgcaaaaagaggcugaccauuauggaccugcacccuggggccggcaaaaccaaaagauauuugccugcgauugugcgggaggcuaucaaacgcgggcuccggacccuuauacuggcgccgacacgcgucguggcggccgagauggaagaggcccuccgcggccugcccaucagauaccagacccccgccauccgcgcugagcacacugggcgugaaauaguugaucuuaugugccacgcgacguuuacaaugcgccuacuuagccccauacgcgugccuaacuacaaccugaucaucauggaugaggcacauuuuaccgaccccgcgucgaucgccgcgagaggguacaucagcaccagaguggaaaugggugaagccgccggcaucuucaugacggcgacuccgcccggcucgcgcgacccguucccacaaagcaaugcacccauuauggacgaggaacgagaaauucccgagcgcuccuggaacagcggccacgaaugggugaccgacuucaaaggcaaaacgguaugguucguuccguccauuaaagccgggaaugacaucgcagccugcuuacggaaaaacggcaagaaagugauucaguuaucacgcaagacuuucgacuccgaguacaucaaaacacggaccaacgauugggacuuuguggugacuaccgacauuucagagaugggcgccaacuuuaaggcggagcgcgugaucgaccccaggcgcugcaugaagcccgugauccugacggacggggaggagcgagugauccucgccggccccaugccggugacgcauuccuccgcagcgcagagacgugggcgggucggccggaacccuaagaaugaaaacgaccaauacaucuacaugggggagccccuggaaaaugaugaggauugcgcccacuggaaggaagccaagaugcugcucgacaacaucaauacgcccgaagguauaaucccguccauguuugagccagagcgggagaagguagacgcaaucgauggugaguaccgccuccggggugaggcccgcaaaaccuuuguggaccugaugagacgcggcgaucuccccgucuggcuggcauacaggguggccgcggaagguaucaacuacgcugacagacggugguguuucgacggcgucaaaaacaaccaaauccuggaagagaauguggaggucgagauuuggacgaaggagggggaaaggaagaagcucaagccucgauggcuggaugcccgcauauacagcgaucccuuagcccucaaggaguuuaaggaguucgcugcuggccggaagucucugacccugaaccuuaucaccgagaugggacgucugcccacguucaugacucagaaggcccggaacgcgcucgacaaucucgccgucuuacacacugcagaggccgggggccgcgcuuauaaccaugcacuaagcgagcugcccgagacccuagagacccugcuccugcugacgcuccuggccaccgugacaggggguaucuuccuguuucucaugucugguaagggcaucggcaagaugacccugggcaugugcugcauuauaacggccagcauccuccuaugguacgcacaaauccagccacacuggaucgcugccuccaucauauuggaguucuuucugauagugcuauugaucccggaaccugagaagcagcgcacaccucaggacaaccagcuuaccuacgucgugaucgccauacugaccgucgucgcugccaccauggccaacgaaauggguuuccuggagaaaacgaagaaggacuucgggcugggcaguauuaccacccaacaaccugacucgaacaucuuagacaucgaccugcgcccagcguccgccuggacucuuuacgcgguggcaacgacauucaucaccccaaugcuccggcauucaaucgagaacaguuccgugaacguuagucuuacugcuauugcgaaccaggcgacggugcugaugggcuuggggaagggguggcccuugucgaagauggacaucgggguaccgcugcucgccaucggcuguuacucccaggucaacccgaucacccuaacagccgcgcuguuguugcugguggcccauuacgcgaucaucgggccaggccuccaagccaaggccacccgcgaggcgcagaagcgggccgcugcuggcauaaugaagauccccgccgcggacgguaucaccgugaucgaccuggacccgauucccuacgaccccaaauucgaaaagcagcugggacaggugauguugcugguguuaugugugacgcagguacucaugaugaggaccaccugggcccugugcgaagcucugacgcuugccaccgggcccaucagcacccuuugggaaggaaacccggggcgcuuuuggaacacaacaaucgccguaagcauggcgaacaucuuccggggcagcuaccuggccggcgcuggguuauuauucaguaucaugaagaacaccgccaauacaagacggggcaccggcaacacgggcgaaacacugggcgaaaaguggaagaaccgacucaacgcucuuggcaagagcgaguuccaaauuuacaagaagagugguauacaggagguggaccggacgcuggccaaagagggcaucaaacgcggcgaaaccgaccaccacgcagucucgcggggaucagccaagcuccgcugguucguggagcggaaccuggucacacccgagggcaaggucgucgaucugggcugcgggcggggcggguggaguuacuacugcggcggucucaagaacgugaaagaagucaagggcuugaccaagggcggucccggccacgaggaaccuauaccgauguccacauacggguggaaccucguucggcuucagucgggcgucgacgucuucuuuacgccgcccgaaaaaugcgacacucugcucugcgacauuggggagagcagccccaaccccaccguggaggccggccguacccugcgagugcugaacuuagucgaaaacuggcuaaacaacaacacccaauucugcaucaaggugcugaacccauacaugcccagugugauagaaaagauggaagcccugcagcgcaaguauggaggggcacuggugcggaacccccugagccggaacagcacacacgaaauguacuggguguccaacgcaagcggcaacaucguguccagcgucaauaugaucucccgaaugcugauuaaccgcuucacgaugaagcauaagaaggcgacauaugagcccgacguggaucuggggagcgguacacggaacaucgggaucgaaucagaaacccccaaccuggacaucaucggcaagcggaucgagaagaucaagcaggagcacgagacgucauggcauuacgaucaagaccaucccuauaagaccugggccuaucacggcuccuacgagacuaagcagacugggucagcuucgagcauggugaauggcgucgugcgcuuguugacuaagccgugggaugucauacccauggucacccagauggccaugacggacaccacgccauucgggcagcagagaguguuuaaagaaaaaguggauacgcgcacccaggagccgaaagagggaacuaaaaaguuaaugaagaucacggcggaauggcucuggaaggaacugggcaagaaaaagacaccgagaaugugcacccgcgaggaguucacccggaaaguccgcuccaacgccgcccuuggggcgaucuuuacagacgagaacaaauggaaguccgcccgcgaggcuguggaagacuccggcuucugggaacucgucgacaaggagcgcaaucugcaucucgagggaaagugcgagaccuguguguacaauaugaugggcaagcgggagaaaaagcugggcgaguucggcaaggcgaaggggagccgcgcgauaugguacauguggcugggggcccgguuccucgaguucgaggcgcugggcuuucuaaaugaggaccacugguucucgagggagaacagcuugucuggcguugaaggcgaaggauuacacaagcuggguuacaucuuacgggacgucuccaaaaaggaaggcggggccauguacgccgacgauaccgcuggaugggacaccaggaucacgcuggaggaccugaagaacgaggagauggugaccaaccauauggagggggagcaucggaaguuagccgaggccaucuuccgccuuaccuaucagaacaaggugguucgggugcaacgccccacucccagaggcacggugauggauauaaucucucgccgcgaccagcgaggauccggacaggucgugacuuacggccuaaacacuuucaccaauauggaggcccagcucauacggcagauggaaggggaaggcguauucaaaucaauccagcaccuuacagucaccgaggaaaucgcggugaagaacuggcuggagagaguggggcgcgagcggcucuccaggauggcaaucagcggcgacgacugcgucgugaagccccuggaugaccgguuugccagugccuuaaccgcccucaacgacauggggaaggugcgcaaggacauucagcagugggagccuagucggggcuggaacgacuggacgcaggucccuuucugcucccaccacuuccacgaguugauaaugaaggacggucgcguccuggugguccccugccguaaccaggacgaguugauaggacgcgcccggaucagccaaggugcgggguggagccuacgcgagaccgccugccugggcaaguccuacgcccaaauguggucccucauguacuuccaccggcgcgaccugaggcuugcggccaacgcgaucugcagcgccgugcccucccauuggguuccuaucucccggaccaccugguccauccacgccacccacgaguggaugaccacggaggacaugcucacuguuuggaaccgaguguggauccaggagaaccccuggauggaggacaagacuccaguugagagcugggaggagauaccauaccuagguaagagagaggaccagugguguggcagccugaucggccuuacaucucgggccacgugggccaaaaauauccagacugcuauuaaccagguccgcagccugauagggaaugaggaguacaccgacuacaugccguccaugaaacgauuccgccgcgaggaggaagaggccgguguguugugguga

SEQ ID NO: 24870 - RNA, 9876 nt, Artificial Sequence
  derived and/or modified CDS sequence (opt11) from DENV-2__KM279515__SS-prME
accgcgggcauuauaauaaugaugaucccaacugugauggcauuccacuugacaacgagaaacggggagccccacaugaucgucagccgucaagaaaagggcaagucccuucuuuucaagaccgaaaacgggguuaacaugugcaccuugauggccauggacuuaggggagcuaugugaggacaccaucacuuacaacugcccccugcucaggcagaacgagcccgaggacauagacugcuggugcaacaguaccagcaccugggugaccuacgggacguguaccgccaccggcgagcaucggagggagaagcguagcgucgcccuggucccgcauguggggauggggcuugagacccgcacggagaccuggaugucuagugagggagccuggaagcacgcgcagcggauugagacuuggauccuacgacaccccggguucaccaucauggccgcuauccuggccuacaccaucgggaccaccuacuuucagcggguccuaauauuuauccugcuuaccgccgugaccccauccauggcaaugcgcugcauagguaucagcaauagagacuucguagaaggggugagcggagggagcuggguggacaucgugcuagagcacggcucuugcgucaccaccauggccaagaauaagccaacgcuggacuucgagcugaucaagaccgaggcgaagcaccuggcaacccuccgcaaguacugcguagaggccaaacuuacgaacaccaccacggcgucccgcugucccacccagggggagccguccuugaacgaggagcaggacaagcgcuuuguguguaagcacagcauggucgacagagguugggggaauggaugcggccucuucgggaagggugggaucgugacgugcgccauguucacgugcaagaagaacauggaagggaagguagugcaacccgagaaucuggaguacaccaucgucauaacgccucacuccggcgaggagaacgcagugggaaacgauacggggaagcacgggaaagaaaucaaagucacuccacagagcaguauaaccgaggcggagcugaccggcuauggaaccgucaccauggaauguaguccgcgcaccggacucgacuucaaugagauggugcugcugcaaauggagaacaaggccuggcucguccacaggcagugguuccuggaucugccccugccauggcugccgggcgcggacacccaaggguccaauuggauucagaaagaaacacuggugaccuucaaaaacccgcaugccaagaagcaggacguaguggugcucggcagccaggaaggggcaaugcacaccgcccucacuggcgcuaccgaaauccaaaugucgagcgggaauuuacucuucaccggccaccugaagugccguuugcguauggauaagcuccaguuaaaggguaugucuuacuccaugugcacggggaaguucaagguagugaaagagauagcggagacucagcaugguaccauuguaauccgcgugcaauacgagggagauggcagccccuguaagauccccuucgagaucauggacuuggaaaagagacacgcacucgggcguuugaucacggugaaccccauugugacggagaaggauuccccggucaacaucgaggccgagccgccuuuuggggacucauacaucaucaucggcgucgaacccggacaacucaagcucuccugguucaagaagggcagcucgaucggucagauguucgagaccaccaugcgcggcgccaaaagaauggcaauccuaggcgauaccgcgugggacuuugguucgcuuggcgggguguuuaccuccaucggcaaagcccuccaccaggucuuuggggccaucuauggagccgcguuuucagggguauccuggaccaugaagauccugaucggcguagucaucaccuggaucgggaugaacagccgcucaacgagccugucaguaagccugguucucguaggggugguaacgcuguaucuaggcgucauggugcaggcagauuccgggugcguagucagcuggaagaauaaggagcuaaaaugcggcagcggcaucuucaucaccgauaacguucauacuuggacggagcaauacaaguuccagccggaguccccgagcaagcuggcguccgcaauccaaaaggcccaugaggaagggaucugcggcauucggagcguaacccgccuggaaaaccucauguggaagcagaucacgccggagcucaaccauauccuuacggaaaaugaggucaagcucacgaucaugacgggggauaucaaggggaucaugcaagcaggaaaacggucauuacgcccacaaccgaccgagcugaaguauucguggaaggccugggguaaggccaaaaugcucuccaccgagcugcacaaucauacguuccuuaucgacggccccgaaaccgccgagugcccgaacacuaacagggcguggaacagccucgagguggaggacuacggguucggcgucuucaccacgaauaucuggcugaagcugaaggagcgccaagacgucuucugugacucaaaauugaugagcgcggccauuaaagacaaccgugcgguucacgccgacaugggguacuggauagaguccgcccugaacgacaccuggaagaucgagaaggcgagcuucauugaggucaaauccugccacuggccuaagagccauaccuuauggaguaauggcgugcuggagucggaaaugaucaucccaaagaacuucgccgggcccgugucccagcacaacuaccgccccgguuaccacacgcaaaccgccggcccguggcaccuggggcggcuggagauggacuucgacuucugcgagggaacuaccguggucgugacagaagacugugggaacaggggaccuagccuacggaccacgaccgccuccgguaagcugaucaccgaguggugcugccgcaguuguacccugcccccgcuccgcuaccgcggugaagacggaugcugguacgggauggagauccggccgcuaaaggaaaaagaggagaacuuggugaacagccuggucacggcgggacacgggcagaucgauaacuuuagccugggcgugcugggaauggcucuguuccuggaggagaugcugcgcacccggguggggaccaagcacgcgauccuccugguggcagugaguuucguaacucugauuacggggaacauguccuuucgcgaccucgggcgcgucauggugauggugggugcuaccaugacugaugacaucggcaugggcgucacauaucuggcgcuccuugccgccuucaagguacggcccacguuugccgcggggcuccuguuacggaaacugacgagcaaggagcugaugaugaccacuaucgggaucgugcuacugucacaaagcacgaucccggaaagcauauuggagcucaccgaugcucuggcccugggcaugaugguccucaagauaguacggaacauggagaaguaccaguuagccguuacaauuauggccauacugugcgugccgaacgccgugauccuucagaacgcguggaagguaagcuguaccacgcuagccgugguuucagucucgccccugcuucugacuuccagccagcaaaaggcggacuggaucccccuggcccugacaaucaaggggcugaacccgaccgcaaucuuccugacgaccuugucccgcaccagcaagaaaagaucuuggccccugaacgaggccauuauggccgugggcaugguaagcauacuugccuccagccuccugaagaacgacaucccaaugacgggcccacugguagcggguggccuccugacggugugcuacguguuaaccggucgcagcgcagaccucgagcuagagcgcgcggccgacguacguugggaggaacaggccgagaucuccggcagcucgcccauccugagcauaaccaucagcgaagacgguagcauguccaucaagaaugaggaagaagaacagacgcucacgauucugauccggaccggcuuacucgugaucagcggccuuuucccaguguccauuccgaucaccgcagccgccugguaccugugggaagugaagaagcagcgugccgggguccucugggauguucccuccccgccgcccguaggcaaggccgagcuggaggauggugccuaucgaaucaagcagaaaggcauccugggguacucccagaucggcgccgggguguacaaggaggggacguuccacacuauguggcacgugacgcguggcgccguacugaugcauaaggggaagcggaucgagccaucaugggcggacgugaagaaggaccugauuuccuacggcgggggcuggaagcuagagggcgaguggaaggagggggaagagguucaagucuuagcccuugaacccgguaaaaacccgcgcgccgugcagaccaagccgggguuauucaagaccaacaccgguacgaucggggccguaagucucgacuuuagccccggcacgagcggcucccccaucgucgacaagaagggcaaaguggugggauuauaugguaauggcgucguaaccaggagcgguacauaugucagcgcuaucgcccaaacggagaaguccauugaggauaauccggaaaucgaggacgauaucuuccgcaaaaagcggcugaccaucauggaucugcauccaggggccggcaagacgaaacgcuauuugcccgcaaucguccgggaggccaucaagcgcggauugcgcaccuuaauauuggcccccacacgcguaguagccgccgagauggaggaagcgcugcgaggccuaccgauucgguaccagacacccgccauccgcgccgagcacaccggcagagagaucguggacuugaugugucacgccaccuuuacgaugagacuccugagccccauccgggugccgaacuacaacuuaauuaucauggacgaggcccacuucacugauccggcuuccauugcagcccguggcuacaucaguacccggguggagaugggcgaagccgcgggaaucuucaugaccgcaacgccacccggcucucgcgaccccuuuccgcagagcaacgccccaauaauggacgaagaacgggagauacccgagcguuccuggaacagcgggcacgaauggguaaccgauuucaaggggaagaccguuugguucguccccuccauaaaggcagggaacgacauugccgccugccugcggaagaacggcaagaaagucauacagcugucgcgcaagaccuuugacuccgaguacaucaaaacgcggaccaacgauugggauuuuguggugaccaccgacaucagugagaugggugccaacuuuaaagccgaacgcguaaucgacccgcgacgcuguaugaaacccgugauccucacggauggagaagaaagagugaucuuagccggacccaugcccguaacccacuccagcgccgcgcagaggcggggucgcguugggcgcaauccgaagaacgagaacgaccaguauaucuacaugggagagccccuggagaacgacgaagacugcgcccacuggaaggaagccaagaugcucuuggauaacaucaacacgccggagggcauuauaccauccauguucgagccugagcgggagaaaguggacgcgaucgacggugaguacagacugaggggugaagcuaggaaaacguucguggaucuuaugaggcgcggcgaccugccugugugguuggcguaucgagucgccgcggaggggaucaacuacgccgaccgccgcuggugcuucgacggaguaaagaacaaccagauucucgaggagaauguggagguugagaucuggacgaaggaaggcgagaggaagaagcugaagccccgguggcuggacgcccgcaucuacagcgacccgcucgcgcugaaggaguucaaagaguucgccgcggggagaaaguccuugacccucaaucuuaucaccgagaugggcagacugcccaccuuuaugacucagaaggcaaagaaugcgcucgacaaccuggcgguucugcacaccgcugaggccgggggccgcgcauacaaucacgcccucagcgagcuccccgagacucuggagacccugcuacugcucacgcugcuggcaacggugacugggggcaucuuccuuuuccugauguccggaaaggguaucggaaaaaugacacuugggaugugcugcauaaucaccgccagcaucuuacugugguacgcccagauccagccucacuggauagccgcguccaucauccuggaguucuuucucauuguccugcugauaccugagcccgaaaagcagcgaacgccccaggacaaccagcuaaccuacgucgugaucgccauccugacgguuguggcugccacgauggcgaacgagaugggcuuucuggaaaagacgaagaaggacuuugggcucggcagcaucacuacacagcagccugagagcaauauccuggacaucgaccugagaccugcuucagccuggaccuuguacgccguggccaccaccuucauuaccccgaugcugcgccacucuaucgaaaauuccagcgucaacgugagcuugaccgccaucgcgaaccaagcuacgguguugauggggcuggggaagggcuggccccugagcaagauggauauaggggucccccuccuggccaucggaugcuacucccagguaaacccgaucacguuaaccgcggcccuccuguuauuaguugcccauuaugccauaaucgggccggggcugcaggccaaagcuacaagagaggcgcagaagcgggccgcggccggcauaaugaagaaucccacagucgacgggaugacugugaucgaccuggaccccaucccguacgacccuaaguucgagaagcagcucggccaagugauguuacugguccucugugugacccaggugcucaugaugcggaccacaugggcccugugcgaggcgcugacccuggcgaccggacccaucagcacccucugggagggcaaccccggacgcuucuggaacacgaccaucgcggucucaauggccaauauauuuaggggcucguacuuggccggagcggggcuucucuucucaaucaugaagaacaccgccaacacgcggcggggcacgggcaacaccggcgagaccuugggcgagaaauggaagaacaggcucaaugcccugggaaagagcgaguuccagaucuacaaaaaguccggcauccaggagguugacaggacccucgcuaaggaggggaucaagcgaggcgagacagaccaccaugcagugagccgcgggucugccaaacuucggugguucguggagcgcaauuugguaaccccugagggcaaagugguggaucuggggugcgggcggggcggauggaguuauuacugcggcggacugaagaacgugaaggaggugaagggccuaaccaagggcggacccggccaugaggagccgauccccaugucgaccuacggguggaaccuuguccggcugcagagcggaguggacguguuuuucacuccgcccgagaagugcgacacacugcuaugcgauaucggggaauccucgcccaaccccacggucgaagccggccgcaccuugcgcguguugaaccucguagagaacuggcugaacaacaauacccaguucuguaucaagguauugaacccguauaugccuagcgugaucgaaaagauggaggcccugcaaaggaaguacgguggggcccuagugcggaaccccuugucgcgcaacagcacacacgagauguacuggguuagcaacgcgagcgguaauaucguguccaguguaaacaugauuucacguaugcuuaucaaccgguucaccaugcgccacaagaaggcgaccuacgagccggacgucgaccucgggagcggcacccggaauaucggcaucgagucggaaaccccgaaucuggacaucaucgguaagcgcaucgagaagaucaaacaagagcaugaaaccucuuggcacuacgaccaagaccaccccuauaagaccugggccuaucacggcuccuacgagacgaagcagacagggagcgccuccucgauggugaacggcgugguucgccugcucacaaagcccugggacgugaucccaaugguuacgcagauggccaugaccgacacgacgcccuucgggcaacagaggguauucaaggagaagguggauacccgcacacaggaacccaaggagggcacuaagaaguugaugaagauaacggcggaauggcucuggaaggagcucggaaagaagaaaacgccacgcauguguacccgcgaggaauuuacgcguaaaguccgcagcaacgccgcguugggggccaucuucaccgacgagaacaaauggaaguccgccagagaggccgucgaggacuccggcuucugggagcugguggacaaggagcgcaaccuccaccuggaggggaagugcgaaaccugugucuacaacaugaugggcaagcgggagaaaaagcugggagaguucggaaaggccaaggguagccgcgcuauuugguacauguggcuuggggcccgguucuuggaguucgaggcacugggcuuccucaaugaggaucacugguuuucccgcgagaacagccugagcgggguggagggcgaagggcugcacaagcucgguuacauccugagggauguguccaagaaggaagguggggcuauguacgccgacgauaccgccgggugggacacgcggaucacccuggaggacuugaaaaacgaggagauggugacgaaucacauggagggcgagcacaagaaguuggccgaggcgauuuucaagcuaaccuaccaaaauaagguggugcggguccagcgcccgacaccccgggggacuguuauggacauaauuagccgccgggaccaacgcggcaguggacaaguggucaccuacgguuugaacaccuucacuaauauggaggcccagcugaucagacagauggagggagaggggguguucaagagcauccagcaacuaaccgugaaggaggagaucgccgucaagaacugguuaauacgcguagguagagagcggcugucccgcauggccaucucgggggacgacugcgugguaaagccccuagaugaccgguucgccuccgcgcucacagcauuaaacgacaugggcaaggugcgcaaggacauccaacagugggagccuagcagggguuggaacgacuggacccagguaccguucugcucccaccacuuccacgagcuuauuaugaaggacggucgaguguugguggugcccugccggaaccaggacgagcugauugggcgugcacgaauaagccagggcgccggcuggagccuucgcgagacggccugccucggcaagagcuacgcacagauguggucucugauguacuuucaccgccgagaccuucggcucgcagcuaacgccauaugcagcgccguucccucccauuggauccccaccucucgaacuacuugguccauacacgcgacgcaugaguggaugaccaccgaagacaugcugacuguuuggaaucgcguguggauccaggagaacccuuggauggaggacaagacccccguugagacuugggaagagauccccuaccucgggaagcgagaggaccaguggugcgggagccucaucggucugacgagccgggcgaccugggcaaagaauauccagaccgccaucaaccaagugcguucccugaucggcaaugaggaguacaccgacuauaugcccuccaugaaacgguuccgccgcgaagaggaggaggcgggcguacucugguga

SEQ ID NO: 24871 - RNA, 9876 nt, Artificial Sequence
  derived and/or modified CDS sequence (opt11) from DENV-2__KM279516__SS-prME
accgcuggaaucauaaucaugaugaucccgaccgugauggccuuccaccugaccacccgaaauggggagccacacaugaucgucagccgacaggagaagggcaagagucuuuuauucaagaccgagaacggggugaauaugugcacccugauggccauggaccucggcgagcugugcgaggacaccaucacguacaauugcccacuacuucgucaaaaugagcccgaggacaucgacugcuggugcaacucaaccuccaccugggugaccuacgggaccugcaccgccaccggcgagcaccgccgcgagaaacgaucagucgcccuggugccacaugugggcauggggcuggagacccgcaccgagaccuggauguccuccgagggcgccuggaagcacgcccagcguaucgagaccuggauccuccgccaccccgguuucacgauuauggcggcgauccuggcauacaccaucggcaccaccuacuuccaacgaguccugaucuucauucuccugacggcagucacaccuuccauggcgaugcgcuguaucgggauuucuaaccgggauuucguugagggcguaucugggggcagcuggguggauaucgugcuggagcacggcuccugcgucaccaccauggccaagaacaagcccacgcucgauuucgagcugaucaagaccgaggcgaagcaccuggccacccuccgcaaguacuguguggaggccaagcugaccaauacgacgaccgcgagccggugcccaacccagggggagcccucccugaacgaagaacaggacaagcgcuucgugugcaagcacagcauggucgaucggggcuggggaaaugggugcggcuuguucgggaaaggcgggaucgugaccugugcaauguuuacguguaagaagaacauggagggaaaggugguccagcccgagaaucuggaguacacaaucgugaucacuccucauucgggugaagagaacgccgugggcaacgacaccgggaagcacgguaaggaaaucaagguuacgccccagagcucgauaaccgaggccgaauuaacgggcuacgggaccgugacgauggagugcucuccgcgcacuggccucgacuucaacgagaugguucugcugcagauggagaauaaggccuggcucgugcaccggcagugguucuuagaccuuccgcuccccuggcugcccggcgcggacacccaggguuccaacuggauccagaaggagacccuggugaccuuuaagaacccacacgccaaaaagcaggacgucgucgugcucggaagccaggaaggcgccaugcacaccgcgcugaccggcgccaccgagauccagaugagcuccggcaaccugcuguucacgggccacuugaagugccgccugaggauggacaagcuucagcugaagggcaugucguauucuauguguaccgggaaguuuaagguaguuaaggaaauugcugaaacccaacacggcaccauugugauccgcguccaguacgagggggaugguagccccugcaagaucccauucgagaucauggaccucgaaaagcggcacgugcucggccggcugaucacggugaacccuaucgugaccgaaaaggacucgcccgugaacaucgaggccgaaccucccuucggggacucauacaucauaauuggagucgagcccgggcagcuuaagcuguccugguucaaaaaggguucauccaucgggcagauguucgagaccaccaugcgcggggccaagcguauggccauccugggcgacacggccugggauuucgggucccucggcggggucuucaccagcauugggaaggcgcuccaccagguguucggagccaucuacggcgccgcauucagcgguguuuccuggacaaugaaaauccugaucggggucgugauuaccuggaucgguaugaacagcagguccacuagucugagugugucccugguacucguggguguggucacgcucuaccugggagugauggugcaagccgauuccgggugcguugugagcuggaagaacaaggagcucaaguguggcagcggcauauucauuaccgauaacgugcauaccuggacggagcaauacaaauuccagccggagucccccagcaagcuggcauccgccauccagaaggcccaugaggagggcaucugcggaaucagauccgugacccgccuggagaaucucauguggaagcagaucacccccgagcuuaaccacauccugaccgagaacgagguaaaacucacgaucaugacgggagauaucaagggcaucaugcaggcugggaagcgcuccuugcgaccacagccaacagagcuaaaguacagcuggaaagcguggggcaaggccaagaugcucuccaccgagcugcacaaccacacguuccugaucgauggccccgagaccgccgagugccccaacaccaaccgggccuggaauucgcucgaaguggaggauuacggauucggcguuuucacuacgaacaucuggcuaaagcugaaggagcgccaggauguuuuuugcgacuccaaacugaugagcgccgcgaucaaggacaacagagcugugcacgccgacaugggguacuggaucgaguccgcccugaaugacaccuggaaaaucgaaaaggccagcuucaucgaggucaaguccugccacuggccaaagagccacacacugugguccaacggcgugcucgagagcgagaugaucaucccgaagaauuucgcaggccccgugucccagcacaauuaccgccccggguaccacacccagaccgcgggcccguggcaccugggacggcuggagauggacuucgacuucugcgagggcacuaccgucguagugaccgaggacugcgggaaccgcggacccagccuccggacaacuaccgccucaggcaagcuuaucacggaguggugcugccgcucgugcacccucccgcccuuacgguaccgaggggaagacggcugcugguacggaauggagauucggccacugaaagagaaggaagagaaccugguaaacagccucgugacggccggacacgggcagauugauaacuucucacucggcguacuagguauggcacucuuccuggaagagaugcugcgcacccggguggguacaaagcacgcuauccuccugguggcugugagcuucgucaccuuaaucacgggcaacauguccuuccgcgaccucgggcgcgucauggugauggucggcgccacuaugacggaugauaucgggaugggcgugaccuaccuggcacuguuagcggcguucaaggugcgaccgacguucgccgcgggacuccugcuccgcaagcugaccagcaaggagcuuaugaugacaacaauuggcauaguccuccuuucccagucgacgauccccgagaacauauuagagcucaccgacgcacuggcgcuaggcaugauggugcucaagauuguccggaauauggagaaguaccagcuggccgugaccaucauggccauccugugcguacccaaugcagucauccuccagaaugccuggaagguguccugcaccacgcuggcgguggucagcguuuccccccuguuacugaccuccucccagcagaaggccgauuggaucccccuggcccucacgauaaagggauuaaacccaaccgccaucuuccugacgacccuuagccgcaccuccaaaaagcggagcuggcccuugaacgaagcgaucauggccgugggcauggucuccauccuggcuagcuccuuacugaagaacgacaucccgaugaccggcccccugguggcggggggacuccugacggugugcuacguccugacugggcgcucugccgaucucgagcucgaacgggcggccgacgugcgcugggaggagcaggccgagaucagcggcucgagcccuauccuuuccaucacaaucagcgaagacggcuccaugagcauuaaaaacgaagaggaggaacagacccucacgaucuugauccggaccggccuccucgugauauccggucuguuccccgucagcaucccgaucaccgccgccgcuugguacuuaugggagguaaagaagcagagagccggggugcuuugggacguccccagcccgccgcccguuggcaaggccgagcuggaggacggagccuaccggaucaagcaaaaaggcaucuuaggcuauagccagaucggcgcuggcguguacaaggaagggacuuuucacaccauguggcacgucacgcggggcgcgguguuaaugcacaagggaaaacggaucgagcccuccugggccgacgugaagaaggaccugaucucguacggcggcgguuggaagcuggagggcgaguggaaagagggggaggagguccaggugcucgcccuggagcccggcaagaacccgcgcgcugugcagaccaagcccgggcuguucaaaaccaacacaggcacgaucggggcagugucccucgacuucagccccggaacauccggcucccccaucguagacaagaaagggaagguggucggucuguacgggaacggcgugguaacucgguccggcacguacguuagcgcgaucgcccagacggagaaauccaucgaggacaauccggagauugaggacgacaucuucagaaagaagaggcuaacaaucauggaucuucacccuggggcuggcaagaccaagcgcuaccuucccgcgaucguucgcgaagcgaucaaacgcgggcugcggacucugauacucgcccccacgagggugguugcagccgagauggaggaggccuuacgcggccuuccgauacgguaccagacccccgcaauccgggccgagcacaccgggcgggagauaguggaccucaugugccacgcaacguuuacgaugcgccuuuuaagcccaauaaggguaccuaacuacaauuugauaauuauggacgaggcccacuucaccgacccggcgagcauugcggccagaggcuauaucuccaccagggucgaaaugggcgaagccgccggaauauucaugaccgcaacgccgccgggcagccgcgaucccuucccgcaauccaacgccccgaucauggacgaggagcgggagauccccgagcgcucuuggaauucuggucacgagugggugaccgacuucaaaggcaagacagugugguucguccccagcaucaaggcaggaaacgacaucgccgccugccugcggaagaacggcaaaaaggugauccagcuuucccgcaaaaccuucgacagcgaguacaucaagacgagaacgaaugauugggacuucguggugaccacggacauuucggaaaugggcgcgaacuucaaggcagagcgcgugauugacccgcggaggugcaugaagcccgugauccucacggacggagaagaacguguaauucuggccggccccaugcccgugacgcacagcuccgcagcccaacgccgggggcgcgugggccggaacccgaagaacgaaaacgaucaguacaucuacaugggggagccccuggagaacgaugaagacugcgcccacuggaaggaggccaaaaugcuccuggacaauaucaacacccccgagggcaucauccccucaauguuugagccggagcgagagaaaguggacgccauugacggugaguaccgccugaggggggaagcccgcaaaaccuucguagaccucaugagacgcggcgacuuacccguguggcuggcauaccggguggcggccgaggggaucaacuacgccgaucgccggugguguuucgacggcgugaagaauaaccagauccucgaagaaaacgucgagguggagauauggacuaaagagggggagcgaaagaagcugaagccccgguggcuggaugcccggauauacuccgacccgcuugcucugaaggaguucaaggaguucgcagccggccgaaagagccugacccucaaccugaucaccgagaugggucgucugcccacuuucaugacgcagaaggcuaagaacgcccuagauaaccuggcgguguuacacacggccgaggccggcggccgggcguacaaccacgccuuaucagagcugcccgaaacucuugagacucuccugcugcuaacgcuuuuggcaaccguuaccgggggcaucuuccucuucuuaaugagcggcaaggggaucgguaagaugacccuggggauguguugcaucaucaccgccuccauccuccugugguacgcccagauccagccucacuggaucgccgccucaaucauccuggaauucuucuuaaucguccugcugaucccagagcccgagaaacagcgcacgccccaggacaaccagcucaccuacguggucaucgccauccuaacugugguggccgcaaccauggccaaugagaugggcuuccuggaaaagacgaagaaggacuucgggcucgguuccaucacuacccagcagcccgaaagcaacauccuggacaucgaucugcggccugccucggcguggacccucuacgccgucgcgacaaccuucauuacccccauguuacgccacucgaucgagaacagcuccguaaacgucagccugaccgcuaucgcaaaccaggcgacgguccucaugggauuagggaaagguuggccccugucuaagauggacauuggggugccccuccuggccaucgguuguuauagccagguaaauccgaucacccugaccgccgccuuacugcugcucgucgcacacuaugccaucaucgguccgggccugcaggccaaagcuacccgggaggcccagaagcgcgcggccgccggcauaaugaaaaacccaacuguggacggcaugaccguuauugaucuggacccuaucccguacgaccccaaguucgaaaagcagcucggucaagucaugcugcuuguucucugcgugacccagguccugaugaugcggacaacgugggcccugugugaggcucucaccuuggcgaccggcccuaucuccacucugugggaaggcaaccccggccgcuucuggaacacgacaaucgccguuuccauggccaacaucuuccgcggcagcuaccucgcgggcgccggauuacuguuuagcaucaugaagaacaccgcgaacacgagacgcggaacggggaacacgggugagacccucggcgagaaauggaagaaccggcugaacgcccuugggaaguccgaauuccaaaucuacaagaaaaguggcauccaggaaguggaucgcaccuuagccaaggaggggauuaaacggggcgagacggaccaucaugccguuagccgcgggagcgcgaaguugcggugguucguggagcgcaaccuggugacaccugaaggcaaggucguugaccucggcugcggacggggcggaugguccuacuacugcggcggccugaaaaaugugaaagaggucaaggggcugaccaaaggcgggccaggccacgaagagcccauccccaugagcaccuacggguggaaccucgucagacugcaguccggcguggacgucuuuuucacgccucccgagaagugcgacacccugcugugcgacauuggggagucgucccccaacccgacugucgaggccgggcggacccugcgagugcugaaccucgucgagaacuggcugaacaacaacacccaguucuguaucaaagugcugaacccuuacaugcccagcguuauagagaaaauggaggcccugcagcggaaguacgguggugcuuuggugcgcaaccccuugagccggaacuccacgcacgagauguacugggugucuaacgccucuggcaauaucgugagcucggucaacaugauaucccgcauguuaaucaaccgguuuaccaugagacacaagaaggcgaccuacgaaccggaugucgacuuaggguccggcacccggaacaucgggauagagucagagacgcccaaucucgacauaaucggcaaaagaauagagaagauaaagcaagagcaugagaccuccuggcauuacgaccaggaccaccccuauaagacaugggcauaccacggcuccuacgagacaaagcagacugguuccgcaagcuccauggucaacggagugguccggcugcucaccaagccgugggacgugaucccgauggucacccagauggcaaugacggacacaacccccuucgggcaacagagagucuucaaggagaaggucgauacccggacccaagagcccaaggagggcacgaagaagcucaugaagauuacagcggaguggcuguggaaggagcucggcaagaagaagacgccccggaugugcacccgggaggaauucacccggaaggugcgcagcaacgcggccuuaggugccauuuucaccgaugaaaacaaguggaaguccgcucgggaggcugucgaggauucuggcuucugggaguuaguagacaaggagcgcaaccuccaccuugagggaaagugcgagacuugcguguacaacaugaugggaaagcgggagaagaagcugggggaguucggcaaagcaaagggcucuagggccaucugguacauguggcucggggcccgguuccuugaguucgaggcgcuggguuuucucaacgaggaccacugguucagccgcgagaacucccugagcggagucgagggggaggggcuccacaaacuaggcuacauccugcgggaugugagcaagaaggaaggcggggcgauguacgcggacgacaccgccggcugggacacccgcauuacacuggaggaccuaaagaacgaggaaauggugacaaaccacauggagggggagcacaaaaagcuggccgaggccaucuucaagcuuaccuaccagaacaaagugguccgugugcagcgaccgacacccagagguacggugauggacaucaucagucgccgagaccagcgcgggagcggccaggucgugacguacggccucaacaccuuuacgaacauggaggcucagcugauccggcagauggagggggagggcguauucaaguccauccagcagcugaccguaaaagaggagaucgccgugaagaacuggcugauucgcguggggcgcgagcggcugagccgcauggccauaucaggcgacgacugcgucguuaagccgcuagacgaccgguucgccagcgcccucacagcccugaacgacaugggcaaaguucgcaaggacauccaacaaugggagcccucucggggguggaacgacuggacccaggucccguucugcucccaccacuuccaugagcugaucaugaaggauggccgcgugcucgugguccccugccggaaucaggaugagcugaucgggcgggcccggauaucccaaggugccggguggagccugcgcgaaacggccugccuuggcaagucuuacgcccagauguggucacugauguacuuccaccggcgcgaccugcggcucgcggcaaacgccaucuguagcgccgugcccagccacuggauccccaccucccgcacuaccuggagcauacacgccacccacgaauggaugacgaccgaggacaugcugaccgucuggaaccggguauggauccaggagaauccguggauggaggauaagacucccguggaaaguugggaggagauccccuaccugggcaagcgcgaggaccaguggugcggaucccucaucggacugacgagccgugcaaccugggcgaaaaauauccagaccgcaaucaaccaggugcgcucccugaucggcaaugaggaguacaccgacuacaugcccaguaugaagagguucagacgcgaggaggaggaggccggcgucuugugguga

SEQ ID NO: 24872 - RNA, 9876 nt, Artificial Sequence
  derived and/or modified CDS sequence (opt11) from DENV-2__KM279517__SS-prME
accgcgggcaucaucaucaugaugauucccaccguaauggccuuucaccugaccaccagaaacggggagccccauaugaucgucucccggcaggagaagggcaagagucuccuauucaagaccgagaauggcguaaacaugugcacccugauggcgauggaccuaggcgagcugugugaagacaccaucacauacaacuguccuuuauuacgccagaacgagccggaggacauugacugcuggugcaauucgaccaguaccuggguaaccuacgggaccuguaccgcgaccggcgagcaccggcgcgagaagcgaagcguggcccuggugccccacguggggaugggguuagagacacgcaccgaaacguggaugucgucggagggcgcuuggaagcacgcccagcggaucgagaccuggaucuuaagacacccaggauuuacuaucauggcagcuauccuagccuauaccauagggaccaccuauuuucagcgcguucugaucuucauucuccugacugccgugacaccaaguauggcuaugcgcugcauugggaucagcaaccgggauuucguggagggagucuccggcgggagcuggguggacauugugcuagagcacgguuccugcgucacaaccauggccaagaacaagcccacgcuggacuuugagcugauuaagaccgaggcgaagcaucuugccacccuacgcaaguacugcguagaggccaaguuaaccaacacgaccaccgcgagccgguguccaacccagggcgaacccagcuugaaugaagagcaggacaaaagguuugugugcaagcacagcaugguagaucggggguggggcaacgggugugggcuuuucggcaagggcgggaucgugacgugugccauguucacguguaagaagaacauggagggaaaggugguccagcccgagaaccuggaauauacuaucguuaucacaccgcauuccggcgaggagaacgccguagggaacgacacggguaagcacggaaaggagaucaagguuacaccccaaagcaguauuaccgaggcagagcugaccggcuacgggacggugacuauggagugcagcccgcgcacuggccucgacuucaacgagaugguacuacugcagauggagaacaaggccuggcucguccaucggcagugguuccuggaccugccgcugcccuggcuuccuggcgccgauacccaggggaguaacuggauccagaaggagacccugguaacguucaaaaacccgcacgcgaaaaaacaagacguuguggugcucgggagccaggagggggccaugcacaccgcccugaccggggccaccgagauccaaaugagcucgggcaaucuucuguucacggggcaucugaagugccgccugagaauggacaagcuccagcucaaagggaugagcuacuccaugugcaccggcaaguucaaagucgugaaagagaucgcggagacccagcacggcacgauuguaauccgcguccaguaugagggggacggcagccccuguaagauccccuucgagaucauggaccuggaaaagcggcacgugcucggucgccugaucacggugaacccuaucgucaccgagaaggacucgccaguaaacaucgaggccgaaccgcccuucggggauucauauaucaucauugguguggagccuggccagcucaagcucuccugguucaagaagggcagcucuaucggccagauguucgagacuacgaugcgcggugcgaagaggauggccauccuaggugauacggcaugggacuucggcagucugggcggggucuucacaaguauaggcaaagcccuccaccaaguauucggggcaaucuacggugccgccuucucgggcgucuccuggaccaugaagauccugauaggggucguaaucaccuggaucggcaugaacagcagguccacuagccuauccguaagccuggucuuagugggggugguaacccuguauuuaggggucauggugcaggcugacucggggugcgucgucagcuggaagaacaaagaguugaagugcggcucgggcaucuuuaucacagauaacgugcacaccuggacugagcaguacaaguuccagccggagaguccgcccaaguuagcgagcgcaauccaaaaggcccacgaggaggggaucugcggcauccgauccguuacccgccuggagaacuuaauguggaagcagaucacgccugagcugaaucacauccugaccgaaaacgagguuaaacuuacgaucaugaccggggacaucaaaggcaucaugcaggccgggaagcguagccuccgaccgcagcccacggagcugaaguauucuuggaaggcuuggggcaaggccaagaugcucagcaccgagcugcacaaucacacguuccuuaucgacggccccgagaccgccgagugcccaaacaccaaccgggccuggaacagccucgaaguggaagacuacggguucggggucuucaccacaaacauuuggcugaagcugaaggaaaggcaggauguuuucugcgacagcaagcuaauguccgcggcgauaaaggacaauagggccgugcacgccgacaugggguacuggaucgagagcgcucugaaugacaccuggaagauagaaaaagcuuccuucaucgaggucaagagcugccacuggccaaagucacauacccuauggagcaacggcgugcuagaguccgaaaugaucauccccaagaacuucgcgggccccguaagccagcacaacuaccgcccgggguaccacacgcagaccgcaggaccuuggcaccucggucggcuggaaauggacuucgacuuuugcgaaggcacgaccguuguagugaccgaagauugcggaaacaggggcccuucccuacggaccacaaccgcgagcgguaaacugaucacagaguggugcugccgcagcuguacccuuccgccccugcgguaccgcggggaggacggcugcugguaugggauggagauacggccccugaaggagaaagaggaaaaucuagucaauucccucgugaccgccggccacggacagaucgacaauuuuagccugggcguccuaggcauggccuuauuccuagaggagaugcugcgcacccggguggguacaaagcacgcaauccuccugguggccguguccuucguaaccuugauuaccggcaacaugagcuuucgcgacuugggacgagugaugguuauggucggcgccaccaugacggacgacauugggaugggagugacguaccuggcacugcucgcggcuuucaagguaagacccacguucgcagccggcuugcugcuucguaagcugacgucuaaggagcugaugaugaccacgaucgggaucguacucuuaagccaguccacaauccccgagucgauccuugagcucaccgacgcccucgcccugggaaugauggugcucaagaucguccguaacauggagaaauaccagcuggcgguaacgauuauggcaauacugugugugccgaacgcggucauccuccagaacgccuggaaggucuccuguaccacucuggccguggucagcgucagcccacugcucuuaacaagcucccaacagaaggccgacuggauaccacuggcccuaaccaucaagggacuaaauccgaccgcgaucuuccugacuaccuugagccgaacuuccaagaagcggagcuggccgcugaaugaggcgaucauggccguggggauggucuccauccuggcgagcuccuugcugaagaacgacauccccaugacgggcccucugguagccgggggauugcucacgguaugcuacguccugaccgggcgcagcgcagauuuagaguuggagcgggcggccgacguucgcugggaggagcaggccgagaucagcgggucaagccccauccuaaguaucaccauaagcgaggauggguccaugagcaucaagaacgaagaggaggagcaaacccucacuauccugauacggaccggauuacucgugauuuccggccuguucccggugaguauccccauaacugcugcagcuugguaccugugggaggugaagaaacaacgcgcugggguguuaugggacguacccagccccccgcccgugggcaaggccgaguuggaggacggggcauaccgaaucaagcagaaagggauccugggguacagccagauaggcgcgggcguauauaaggaggggacuuuccauacuauguggcacgucacgcgcggcgcggugcucaugcacaaggggaagcggaucgagccguccugggccgacguaaagaaagaccugaucagcuacggagggggcuggaaacuggagggcgaauggaaggagggggaggaaguccaagugcucgcccuggagccagguaagaauccccgcgccgugcagacgaagccuggacuuuucaagaccaacacgggcacgaucggggccgucucccucgacuucucgcccgguaccuccgguagccccaucguggacaagaaggggaaggucgugggccuguacgggaauggagugguuacacgguccggcaccuacgucucagccauugcccagacggagaagucaaucgaggacaaccccgagaucgaagaugacaucuucaggaagaagcggcugacgaucauggacuuacaccccggagcaggcaaaaccaagcgauaccuccccgcaauugugagggaagcaauaaagaggggacuccggacgcugauccucgccccgaccaggguggucgccgccgagauggaagaggcccugcguggccugcccauccgguaccagaccccggcaauccgcgccgagcacaccgggagagagauaguagaccucaugugccacgcuaccuuuacgaugcgccugcugagccccauccggguaccgaacuacaaccuuaucauuauggacgaggcccacuucacugaccccgccuccaucgcggcccgcggauacaucuccacccgggucgaaaugggcgaggcagcagguaucuucaugacagcgacgccgccgggcagccgcgacccguucccccaguccaacgcaccuaucauggacgaagaacgugagaucccugagcgcagcuggaacucagggcacgagugggugacggacuucaaagguaaaaccguaugguucgucccuagcaucaaggcggguaacgacauugcagccugucugcggaagaacggaaagaagguaauucaguuaagccgcaagaccuuugacagcgaguacaucaagacgcggaccaacgacugggauuucguugucacaaccgacaucucugagaugggcgcgaacuucaaggccgaacgcgugaucgaccccaggcgcugcaugaagcccgucauacucacggacggggaggagcgggucauccuggccggccccaugccggugacccacucguccgccgcucagcgccgggggagagugggccguaaccccaagaacgagaacgaccaguacaucuacaugggggaaccucuggagaacgacgaggacugugcacacuggaaggaggcgaagaugcuccuggauaacaucaauacccccgaagguaucauaccgagcauguucgagcccgagcgggaaaagguggacgccaucgacggagaguaccgccuccgaggggaggcccgcaagacauucguggaucuaaugagacgcggcgaucugcccguauggcuggccuaucggguggcggccgaagggauaaacuacgccgauaggaggugguguuuugacggcgugaagaacaaccaaauccucgaggaaaacguggagguugagaucuggacgaaggagggggagcgcaaaaagcugaagccccgguggcucgacgcccgcaucuacuccgacccuuuggcacugaaggaauucaaggaguucgcggcgggccggaagucccuuacccucaaccugauaaccgaaaugggccgccugcccacauuuaugacgcagaaggccaagaacgcccucgacaacuuagccguacugcauaccgccgaggccgggggcagagccuacaaccaugcccucucugaacuuccggagacccuggagacucucuugcugcucacgcugcuugcaaccgucacagggggcauauuccucuucuugaugagcggcaaggggaucggcaagaugacccugggcauguguugcaucaucaccgcuucaauccuccugugguacgcacagauccagccgcauuggaucgccgccucgauaauacuggaguuuuuccucaucgugcugcuaauacccgaacccgaaaagcagcgcacgccccaggauaaucagcucaccuacguggucaucgcgauccugacagucguggccgcaaccauggccaacgagaugggcuucuuagagaagacgaagaaggacuucgggcuuggcagcaucaccacccagcagccugagucaaauauacucgacaucgacuugcggcccgccucugccuggacacuauacgcaguagccacgacuuucaucacccccaugcugcgccacagcaucgagaauucauccgugaaugugucccugaccgccaucgccaaccaggccacgguccucaugggucuggggaagggauggccccugaguaagauggacaucggagugccauuacuagccaucggcugcuauucacagguaaaccccauaacccuaaccgccgcccuccuguugcuggucgcccacuaugccaucaucgggcccggcuuacaggcgaaagccacccgggaggcccaaaagcgcgcggcagccggaaucaugaagaaccccacuguggacggcaugaccgugaucgaccuggacccgaucccguacgacccgaaguuugagaagcagcucgggcaaguuaugcuccugguguugugcguuacacaaguacugaugaugcgaaccacgugggccuugugcgaggcccucacccuggccacagggcccaucuccacccugugggagggaaacccgggccgcuucuggaacacuacaaucgcugucaguauggcaaacaucuuccgcggcuccuaucuugccggugccgggcugcuguucagcauaaugaagaacaccgccaacacccggcgcggcacgggcaacacaggcgagacccugggcgagaaguggaagaaccgccugaacgcccugggaaaguccgaguuucagauauacaagaaauccggcauccaggagguggacaggacucuugccaaggaggggaucaagcggggcgagacggaucaccacgcagucagucgcgggagcgcuaagcugcggugguucguggagcgcaaccuugugacccccgagggcaaagucguggaucucgggugcgggcggggcgggugguccuauuacugcggcgggcugaagaaugucaaggaggucaagggccugaccaaaggcggaccgggccacgaagagccaaucccgauguccacuuauggguggaacuuagugcgccugcaguccggaguggacgucuuuuucacaccgcccgagaagugugacacccuccucugcgauauaggggaaagcucccccaacccgaccguggaggcuggccggacccugagggugcuaaaccucguagaaaacuggcugaacaacaacacccaauuuugcaucaaaguguugaacccauacaugccgucggugauagagaaaauggagacgcuacagcggaaguacggcggggcccugguucgcaauccgcugucucgcaacucgacccaugagauguauugggugagcaacgcguccggcaacaucgugagcucagugaacaugauaucacgaaugcugaucaaccgguuuaccaugcgucacaagaaggccaccuaugagcccgauguggaccucggguccgguacgcggaacauugggauagagagugagacacccaaccuggacauaaucggcaagcgcauagagaagauuaagcaggagcacgaaacaucauggcacuacgaccaggaccaccccuacaagaccugggcguaccacggcucauacgagacgaaacagaccggguccgccagcucaauggugaacggaguuguucgccuacucaccaagccgugggacgugauccccauggucacucagauggcuaugacggacaccacccccuucggacagcagcgcguuuucaaggagaaggucgauacccgcacgcaggagccaaaggaaggcaccaagaaauuaaugaagaucaccgcugaauggcuguggaaagagcugggcaaaaagaagaccccucgaaugugcacgagagaggaguucacacgcaaggugcgcagcaacgcugcucugggggcgaucuuuaccgacgaaaacaaguggaaauccgcacgggaggccguggaggacagcggcuuuugggagcugguagacaaggaacggaaccuccaccuggaggggaagugcgaaaccugcguguacaacaugauggggaagagagagaaaaagcugggggaauuugggaaggccaaaggcucccgcgcaauaugguacaugugguugggggcccgauuccuggaauucgaggcccuggguuuccuuaacgaggaccauugguucagcagggagaacagccugagcggggucgagggcgaggggcugcauaagcucggguacauccugcgggacgucagcaaaaaggagggcggugcaauguacgcugacgauacugcgggcugggacacccgcaucacccuggaggaucucaagaaugaggagauggugaccaaccacauggagggggagcacaagaagcuugcagaggccaucuucaagcugaccuaccagaauaaggugguccgggugcaacgcccgacgccccggggcaccgugauggacaucaucagucgccgggaccagcgggggucgggccaggucgugaccuacggucucaauacuuucaccaacauggaggcccagcugauccggcagauggaaggggagggcguguucaaauccauccagcaguugacagucaaggaggagaucgcggugaagaacuggcucauacgugugggccgcgaaaggcuuagccgcauggccauuuccggcgacgacugcgucgucaagccucuggaugaccgguucgccagcgcccuaaccgcccugaaugacaugggaaaggugcgcaaggacauucaacaaugggagccgucccggggguggaaugacuggacgcagguccccuucugcagccaccauuuccacgagcugaucaugaaggauggacgcgugcuaguggucccaugccggaaucaggaugagcugaucgggcgcgcgcgaauaucacagggagccggguggucccugcgcgagaccgccugccucggcaaguccuaugcccagauguggagccugauguacuuucaccggcgggaccugcggcucgcggcgaacgcuaucugcucggcggugcccagccauuggaucccaaccucccgcaccacauggucaauacacgcgacgcacgaguggaugacuaccgaggacaugcugaccguguggaaccgggucuggauccaggagaaucccuggauggaggacaagacgccgguggaguccugggaggaaaucccauaucucggaaagcgggaggaccaguggugugggagccucauaggccugacuagccgggcgaccugggcgaagaacauccagacugccaucaaccagguacgcucccugaucgguaacgaggaguauacugacuacaugccgucaaugaagcgguuucgccgagaggaagaggaggcgggcgugcucugguaa

SEQ ID NO: 24873 - RNA, 9876 nt, Artificial Sequence
  derived and/or modified CDS sequence (opt11) from DENV-2__KM279518__SS-prME
acagcggguauuaucaucaugaugauccccacagugauggccuuucacuuaaccacccggaacggggagccucacaugaucgucagccggcaggagaagggcaagagccuuuuauucaagacagagaacggagugaacaugugcacccugauggcgauggaucucggcgagcucugcgaggacacuaucaccuacaauuguccccuguuacggcaaaacgaacccgaggacaucgacuguuggugcaacagcacgagcaccugggugaccuacggaaccugcaccgccaccggcgagcaucggcgggagaagcggagcguugcacuggugccccacgugggcaugggguuggagacccgcaccgagaccuggaugagcagcgagggugccuggaagcacgcccaacggaucgaaaccuggaucuuacgccaccccggguucaccaucauggcagcuaucuuggccuacaccauugguaccaccuacuuccagcggguccugauuuuuauccuccugacagcugugaccccauccauggcgaugcgcugcauagggauauccaaccgggacuuuguggagggcgucuccggcggguccuggguggacauugugcuugagcacggcuccugcguuacuacaauggccaaaaacaagcccacgcucgacuucgagcuaaucaagacggaggcuaaacaccuggccaccuugcguaaguacugcguggaggccaagcuaacuaacacgacuaccgcgucccgguguccaacacagggagagccuucccugaacgaggagcaagacaaacgcuucgucugcaaacacagcauggucgacaggggcuggggcaauggcuguggauuauucgggaagggcgggaucguaaccugcgccauguucacgugcaaaaaaaacauggagggcaagguuguccagcccgagaaccuagaguacaccaucgugauuacaccccacuccggcgaggagaaugccgugggcaacgauacaggcaaacacggcaaggagaucaaggugaccccucaguccuccauaaccgaggcagaacugaccggguacgggacagugacuauggagugcaguccgcggaccggucucgacuucaacgagauggugcugcugcagauggagaauaaggccuggcucguccaucggcaaugguuucuggaccucccgcuaccuuggcugcccggcgcggacacccagggguccaacuggauccagaaggagacgcuggugacguucaagaacccacacgccaaaaagcaggacgucgucguucuaggcagccaggagggggcuaugcacaccgcccuaacgggcgccacagagauccagaugagcagcgggaaucugcuguucacgggccaccugaaaugccgccugcguauggacaagcuccagcucaaaggcaugagcuacuccaugugcaccgggaaguucaagguuguaaaggagaucgcggagacgcagcauggcacuauugugauucgcgugcaguacgagggggacggcagccccugcaagauccccuucgagaucauggaucuggagaagcgccacgugcucggccgcuugaucacugugaaccccaucgucaccgaaaaagacuccccggugaauauagaggccgaaccgcccuucggugacagcuacaucaucauuggcguggaaccuggccaacuaaaacucucuugguucaaaaagggcagcuccauagggcagauguucgaaacaaccaugaggggggccaaacggauggcuaucuugggagacacagcuugggauuucgggucgcuaggagggguguuuaccuccaucggaaaggcacuccaucagguguucggggcaauuuacggcgcggccuucuccggcguguccuggacaaugaaaauccugauaggugucgucaucacauggauaggcaugaacagccgauccacuagccucucugugagccugguccucgugggagugguaacccuguaccugggcgugauggugcaagcagacuccggaugcgucgucagcuggaagaauaaagagcucaaguguggcagcgggaucuucaucaccgacaaugugcauacguggacggagcaguacaaguuccagccggagucaccaucaaaguuggccuccgccauccaaaaggcccacgaggaggggaucugcgguauccggaguguuacacgccuggagaaccucauguggaagcagauaacccccgagcugaaccacauccugacagagaacgaggugaagcucacuaucaugaccggggauaucaaaggcauaaugcaggccgggaagaggucccugcgcccccagccgaccgagcugaaauauagcuggaaggcguggggcaaggccaaaaugcucuccaccgagcugcauaaccacacuuuccugaucgacggccccgaaaccgccgaaugccccaacaccaaccgagccuggaacagcuuggaaguagaggacuauggguuuggggucuucaccacgaacaucuggcugaagcugaaggagcgccaggacgucuucugugacucaaagcucaugagcgccgcgaucaaagacaaucgagccgugcacgccgacaugggguacuggaucgaaucagcccuaaaugacacguggaagauugagaaggcuagcuuuaucgaggugaaauccugccacuggcccaagucucacacccugugguccaacggugugcucgagagcgagaugauaauccccaagaauuucgcgggcccagugucccaacauaacuaccgccccggauaccacacccaaaccgcuggcccguggcaccuggggcgacuggagauggacuucgacuucugugaaggcacgaccguugucguaaccgaggacugcgggaaccgcggcccaagccugcggaccacgacggcaagcggcaagcucaucaccgaguggugcugccgcucuugcacauuaccgccacugcgguaccggggggaagacggcugcugguacgggauggagauacggccguuaaaggagaaggaggagaaccuggugaacagccucgugaccgccggccauggccagaucgacaacuucucccugggcguucugggcauggcccucuuccuggaggaaaugcugcgaacccggguuggaaccaagcacgccauucuccuggucgcugugagcuucguuacccugauuacgggcaacauguccuuucgugaccucggacgcgugauggugauggucggcgccacgaugacagacgacauuggcaugggggugacguaccuggcucugcucgcggccuucaagguccggcccacguucgccgccggucugcuacuccgaaagcuaaccagcaaggaacugaugaugacuacaaucgggaucguccuccugucccagagcacgauccccgaguccauccuagagcugacugaugcgcuggcgcuugggaugaugguguugaaaauaguucggaacauggagaaauaccagcuugcagugacgaucauggcaaucuuaugcgugcccaacgccgucauccuccagaaugcuuggaaggugagcuguaccacgcuagcgguggucuccgugagcccgcugcuccugaccuccagccagcaaaaggcagacuggaucccccuggcacucaccaucaaagggcugaaccccaccgccauuuuccugacgacccucucucgcacuagcaagaagcgguccuggcccuugaacgaagcgauuauggcgguaggaaugguuaguaucuuggccaguagccuccugaagaacgacaucccgaugaccggcccccugguugccgguggccuguuaaccguuugcuacguacuaaccgggcgcagcgcugaccuagagcuggagagggcggcggaugugaggugggaggagcaggccgaaaucuccggcagcucccccauacugagcaucaccaucagcgaggacggaagcaugucuauuaagaacgaagaagaagaacaaacccucacgauucugauucggaccggccugcucgugaucucaggccuguuucccguuaguauuccgaucaccgccgccgcgugguauuuaugggaagugaagaagcagcgcgccggggugcuuugggacguccccuccccgccccccgugggcaaggcugaguuagaggacggcgccuaccggaucaaacagaagggaauccugggguacucccagaucggcgccggcguguauaaggaggggacuuuccacaccauguggcacgucacccgcggcgcgguguuaaugcacaaagguaagcgcauagagcccucaugggccgaugugaagaaggaccugaucuccuauggcggcggcuggaagcuggagggcgaguggaaggagggggaagagguccaggugcucgcacucgagccuggaaagaauccccgcgccgugcagacgaagcccgggcuuuucaagaccaacaccggcacgaucggggccgucagccucgacuucucccccgguaccagcggcucgcccaucguggacaagaaggggaaaguggucggccuguacgggaacggcguggugacccggagcggcaccuacguguccgcgaucgcccagacggagaaguccaucgaggacaacccugagaucgaagacgacaucuuccgcaagaagcggcugaccauaauggaucuccauccuggugccggcaagacuaagcgcuaccuccccgccaucgugcgggaggcgauuaagcgcgggcugcggacccuaauccucgcccccacgcgcgugguugccgccgaaauggaagaggcccugcgcggccuaccaaucagauaccagacgcccgcgauccgugccgaacacaccgggcgggaaauaguggacuuaaugugucacgccacauucacaaugcgcuuacugucccccauucgggugcccaacuacaaccucauuaucauggacgaggcgcauuucaccgacccggccuccaucgcggcccgcggcuacaucagcacccgagucgagaugggcgaggccgccggcauauuuaugaccgccacgccgcccggcucacgcgaccccuucccacagagcaacgcgcccaucauggacgaagagcgggagauccccgagcgcuccuggaacagcgggcacgagugggugaccgacuucaagggcaagaccgugugguuuguaccauccaucaaggccgggaaugacaucgccgccugcuugcguaagaauggcaagaaggugauucagcugagccgcaagacguuugacucugaguacauaaagacgcggaccaaugauugggacuucguagucaccacagacaucucagagaugggcgcaaacuucaaggccgaacgggugaucgacccgcggcgcugcaugaagcccgugauauugacggacggggaagagcgggucauucuggcuggacccaugcccguaacucacucgagcgcugcccaacgccgggggcgcguaggccggaacccgaagaacgaaaacgaccaguacaucuacaugggggagccccuagagaacgacgaggacugcgcccauuggaaggaggccaagaugcuccuagacaacaucaacacucccgagggaauaauaccauccauguucgaaccggagagagagaagguugacgccaucgauggcgaguaccgccugaggggggaggcccgcaagaccuuuguggaccucaugcggcgcggcgaucugccugucuggcuggccuaccggguggcggcugaggggaucaacuaugcugaucguagguggugcuucgacggcgugaagaauaaccagauccucgaggagaacgucgagguggagauauggacaaaggagggggagcgcaagaagcugaagccacgcuggcuggacgcccgcauuuacagcgacccgcucgcccugaaagaguucaaggaguucgcggcugggcguaaaucccuuacccucaaccugaucacugagaugggccgccugcccaccuucaugacgcagaaagccaagaacgcacucgacaaccuggcgguguugcacaccgcggaagccgggggcagagccuauaaccacgcccuaagcgaauugccagaaacccuggagacccucuuguugcuaacgcuacuggcuacugucaccgggggaaucuuccuauucuugauguccggcaaaggaauuggcaagaugaccuuggggauguguugcaucauuacugccucgauccuccugugguacgcucagauccagccucacuggaucgccgccucuaucauccuggaguucuuucucaucguucucuugaucccagagcccgaaaagcaacgcacgccccaagacaaccagcuaacguacgucgucaucgcgauccugaccgugguagcagccaccauggcgaaugagaugggcuuccuggaaaagacgaagaaggacuucgggcuuggcuccaucaccacacagcaaccggagagcaacauccuggacaucgaccuccggccggccagugcauggacgcucuacgccguggcgacgacauuuaucaccccuaugcugcggcacagcaucgagaacuccucagucaacgugagccugaccgcuaucgcaaaucaggcgacgguccugaugggccugggaaaaggcuggccccugagcaagauggacaucggugugccccuacuugccauaggcugcuauucccaagugaacccgaucacacugaccgcggcgcuccugcugcucgucgcgcacuacgccaucaucgggcccgggcugcaggccaaagccacccgggaggcccagaagcgcgcggccgcgggcauuaugaagaaucccacgguggaugggaugaccgucaucgaccuugaucccaucccuuacgaucccaaguucgagaagcagcucggacaggucauguugcuggugcucugugugacccaaguucugaugaugcggaccacgugggcccuuugcgaggcacucacgcuggcgaccgggccgaucagcacccugugggagggcaaccccgggcguuucuggaacacgaccaucgccgugucuauggccaacaucuuccgcggcagcuaccucgcaggcgccgggcugcuguucucuaucaugaagaacaccgcgaacacccggcgcggaacggggaacaccggcgaaacccucggcgagaaguggaaaaacagacucaacgcccuuggcaaaucagaguuccagauauauaagaaguccggaauacaggagguagaccgcacccucgccaaggaagggaucaagaggggcgagacugaccaccacgccgucagccgcggguccgcgaagcuucggugguucguggagcgcaaccugguuaccccagagggcaagguaguggacuuggguugcgggcgcggaggguggagcuacuauugcggcggucuuaaaaacgugaaggagguuaagggacuuaccaagggcgggcccggccacgaagagccgauccccaugaguacguauggguggaacuugguucgccugcagaguggcgucgacgucuucuucacgccccccgagaagugugacacccuguuaugugacauaggggaguccagccccaaccccacaguggaggccggccguacccugcgcgugcugaaccuuguagagaacuggcugaauaacaacacccaguucugcaucaagguucugaacccguacaugcccucugugaucgagaagauggaggcccugcagcggaaguauggaggcgcucucgugcgcaauccccugucccggaacagcacgcacgaaauguacuggguauccaaugcaagcggcaacaucguguccagcgugaacaugauuucccgaaugcugaucaaucgguuuacaaugcgacacaagaaggcgaccuacgaaccugacguggaucuagggucuggcacccggaacaucgguaucgaguccgagacgcccaaucuggacaucaucggcaagcgcaucgagaagaucaagcaggagcacgaaaccucuuggcauuacgaccaggaucacccuuacaagaccugggccuaccauggcuccuacgagacuaagcaaaccgggagcgccuccucaauggugaacggcguaguccgccugcucaccaaaccgugggacgugauccccauggugacccagauggccaugacugacacgaccccuuucggacaacagcggguguucaaggagaaaguggauacccguacccaggaacccaaggagggcacgaagaaguugaugaagauaaccgccgaguggcuguggaaggagcucggcaagaaaaagacgccacggaugugcacccgcgaggaauucacccggaaggugcgcucaaacgcggcccuuggggccaucuucaccgacgagaauaaguggaagucggccagggaggccgucgaggacuccggcuucugggagcuggucgauaaggaacgcaaccuccacuuagaggggaaaugcgagaccugcgucuacaacaugaugggcaagcgggagaagaagcugggggaauucgggaaggcgaagggcagccgcgcgaucugguacauguggcucggggcaagauuccuugaguucgaggcgcugggauucuugaaugaggaccacugguuuucccgagagaacucacugagcgggguggagggcgagggucugcacaaacucggcuacauccugcgggacgucuccaagaaggagggcggagcgauguacgccgacgacaccgccggaugggacacgcgcaucacccucgaggaccucaagaaugaggagauggugaccaaccauauggaaggggagcauaagaaguuagccgaggccaucuucaagcugacauaccagaacaagguggugcggguucagcgccagacgccgcgugguaccguuauggauauaaucagccgccgggaucagcgcggguccggccaggucguuaccuauggccucaacaccuuuacuaacauggaagcgcagcugauacggcagauggaaggggagggcguguucaagagcauccagcagcucaccguuaaagaagagauugcagugaagaacugguugauccgggucgguagggaacgucugucccgcauggccauaagcggcgaugacugcguggucaagccccucgacgaccgguucgccuccgcccuaaccgcgcugaacgacaugggcaaaguacgcaaagacauccagcagugggagccaucacggggguggaacgacuggacccagguucccuucugcucccaucacuuccacgagcugaucaugaaggacggccgcguccucguuguuccgugucggaaccaggacgagcucauugggcgcgcucggauuagucagggcgccggguggucccugcgcgagacggccugccucggcaagagcuacgcccaaauguggagccugauguacuuccaccggcgcgaccugcggcucgcggcaaacgccaucugcagcgccgugccaagccacuggauccccaccucucgaaccacuugguccauccaugccacccacgaguggaugacgaccgaggacaugcugaccguguggaaccggguguggauccaggagaaccccuggauggaggacaagacccccgucgagagcugggaggagauucccuaccugggcaagcgcgaggaucaauggugcgggagccuuaucggccugacgucccgggccaccugggcaaagaacauccaaaccgccaucaaccaggugcgcagccuaaucggaaacgaggaguacaccgacuacaugcccuccaugaagcgguuccgcagggaggaggaggaggccggcguccucugguga

SEQ ID NO: 24874 - RNA, 9876 nt, Artificial Sequence
  derived and/or modified CDS sequence (opt11) from DENV-2__KM279519__SS-prME
accgcggggaucaucaucaugaugauccccaccgugauggcauuccacuuaacuacgcgcaacggggagccccacaugaucgucucucggcaggaaaagggcaagagccucuuguucaaaaccgagaacggggugaacaugugcacccuuauggcgauggaccuuggcgaacucugcgaggacaccaucaccuacaacuguccacugcuccgccagaacgagcccgaggacaucgacugcuggugcaacagcaccucuacuuggguaacguacggaaccugcacagcuaccggugagcacaggcgcgagaagcggagcgucgcccuggugccccacgucggaauggggcuggagacucgcaccgagaccuggaugagcagcgagggcgccuggaagcacgcccagcguaucgagacuuggauacuccgccaccccggguucacuauuauggcggccauuuuggccuacaccaucgggaccaccuacuuccagcggguucugaucuuuaucuuacugacagccguaacccccuccauggcgaugagauguauaggcaucucaaaccgggacuucgucgagggcguguccggagggagcuggguugauaucgugcuggagcacggcuccugcguaaccacuauggccaagaacaagccuacacucgacuucgaguugaucaagacugaggccaagcacuuggcgacacuccgcaaguacugcguggaggccaagcucaccaacacgaccacggcgagccggugucccacccagggcgagcccucccugaaugaggaacaggacaagcgcuucguguguaagcacagcauggucgaccggggcuggggcaacgggugcggacucuucgggaagggcggcaucgugacgugugccauguucacgugcaagaaaaacauggagggcaaggugguucagcccgaaaaccuggaguacaccaucgugaucacgccucacucuggcgaggagaacgccguggggaacgauacgggcaagcauggaaaggagaucaaggucacgccccagagcuccaucaccgaggccgagcugaccggcuacgggaccgugaccauggagugcagcccgcggaccggccucgacuucaacgagauggugcuguuacagauggagaacaaggcuuggcucguccacaggcagugguuccuagaccugccccuccccuggcugcccggcgcugacacccagggguccaacuggauccagaaggagaccuuagugacguucaagaacccgcacgccaagaagcaggacguaguaguucuuggcagccaggagggggccaugcacaccgcccugacuggcgccaccgaaauccagaugagcuccgggaaccucuuguucacugggcaccugaaaugcagguuacguauggauaagcuccagcugaagggcaugagcuacucgaugugcaccgggaaguucaaggucgugaaggagaucgcggagacccagcacgguacaaucgugauucgcguacaguacgagggggacgguagcccuugcaagaucccauucgagaucauggaccuggagaagcggcacguucucgguaggcuuauaacggugaacccuaucgucaccgagaaggauuccccggugaacaucgaagccgagccgccauucggggacagcuacaucauuaucggcguggagcccgggcagcugaagcucucuugguuuaagaagggcagcuccaucgggcagauguuugagacgaccaugcguggcgcaaagcggauggccauccugggcgacacggccugggacuucgguucccuagguggggucuucaccuccaucgggaaggcgcuccaccagguguucggggccaucuacggcgccgcguucagcgguguguccuggaccaugaagauccugaucggggucgugaucaccuggaucggcaugaacagccgcaguacgagccuguccgugagccugguccucgugggggugguuacgcuguaccugggcgugaugguccaggcggacuccgggugcgucguuagcuggaagaacaaggaguuaaagugcggaucgggcauauucauuaccgacaacguucacacuuggacggagcaguacaaguuccaacccgagucccccagcaagcuggccuccgccauacagaaggcccaugaggaggggaucuguggcauccggagcgucacccgcuuggagaaccucauguggaagcaaaucacccccgaacugaaccauauccugaccgagaacgaggugaaguugaccaucaugaccggugauaucaagggaaucaugcaggccgggaagcggucccugcgcccccagccaacugagcugaaguacagcuggaaggcguggggcaaagccaagaugcucuccacugagcugcacaaccacacauuccuuaucgauggcccagagaccgccgagugccccaauacaaacagggccuggaacagccucgaggucgaggauuacggguucggaguauucaccacgaauaucuggcugaaacugaaggagcgccaggauguguucugcgacuccaagcucaugagcgcagcgaucaaggauaaccgggcggugcaugccgauaugggguacuggauugagucugcccugaacgacaccuggaagaucgagaaggccucauucaucgaggucaaguccugccacuggcccaagagccacacccugugguccaacggcguguuagagagcgagaugaucaucccgaagaacuucgcgggacccgugagucagcauaacuaccgccccggguaccacacccagaccgccggcccauggcaccuggggcgccuggagauggauuucgauuucugcgagggcacgaccgucgucgugaccgaggacugcgggaaucgcggccccagccuccguacgacgaccgccuccggaaaguuaauuacggaguggugcugccgcuccugcacucugccgccccuccguuaccgcggggaagacggcuguugguacgguauggagauccgaccgcugaaggagaaagaggagaaccuggucaacucacucgugacggcuggccacggucagaucgacaacuucucccugggcgugcugggcauggcacucuuccuggaggagaugcugcgcacccggguugggaccaagcacgccauccuccugguagccgucagcuucgucacccugauuacgggcaacauguccuuccgcgaccucgggcgcguuauggugaugguuggcgccaccaugaccgaugacaucgggaugggcgugaccuaccuggcccugcucgccgcuuucaaggugcggcccacguucgcggcgggcuuacuccuucgcaagcugaccagcaaggaacugaugaugaccaccaucggcaucguccuccuuucgcagagcacgauccccgaguccauccuggaacucacggaugcccuggcgcugggcaugaugguacuaaagaucguuagaaauauggagaaguaccagcuggccgugaccaucauggccauccugugcgugcccaaugccgucauccuucagaacgccuggaaagucagcugcacgacguuagcgguggucuccgugagcccacugcuccugaccuccagccagcagaaggccgacuggaucccccuggcacucaccauaaaagggcugaaccccaccgccaucuuccugacgacccucucccguaccagcaagaagcgguccuggccccugaacgaggccaucauggccguggguauggucucaauccucgccucuucgcuccuuaagaacgacauuccuaugaccggcccccugguagccgggggccuacugacggugugcuacguccugacugggagauccgccgaucuagaguuagagcgggcggccgacguacgcugggaggagcaagcagaaauuuccggcaguagcccuauccugucgaucaccaucuccgaggacgggagcauguccaucaagaacgaggaggaggagcaaacccucacgauacugauucggaccggcuugcucgugaucagcggccuguucccugucuccaucccgaucaccgccgccgcgugguaucugugggaggugaaaaagcagcgcgcgggggugcucugggaugucccauccccaccgcccgugggcaaggccgagcuggaggacggugccuaccgaaucaagcagaagggcauccugggguacucccaaauaggggccggcguguacaaggaggggaccuuccacaccauguggcacgucacacgcggcgcggugcucaugcacaaggggaagcggauugagccuagcugggcugacgugaagaaggacuugaucuccuacggcggggguuggaagcuggagggcgaguggaaggagggggaggagguccaggugcuagcccuagagcccggcaagaacccgcgcgccgugcagaccaagcccgggcuguucaagaccaacaccggcacgauaggggccgucagccucgacuucucccccggcaccagcggcucccccaucguggacaaaaaggggaagguggucggccuguacggcaacggcguagugacccgcagcggcacauaugucuccgcgaucgcccagacggaaaaguccaucgaggacaacccugaaaucgaagacgacaucuuccgcaagaagcgguugaccauaauggaccugcaccccggggcuggaaagaccaagcgcuaccuccccgcaaucguucgcgaggcgaucaagcguggccugcggacgcugauccucgcgcccacgagaguggucgccgcugagauggaggaggcccugcgcggucugcccauacguuaccagaccccagcgauccgugcugagcacacuggccgggagauuguggaccucaugugccacgccaccuucacgaugcgccugcucagccccauccgagugcccaauuacaaccucaucaucauggacgaggcgcacuucacugacccggcauccaucgcggcccgcggcuacauuagcacacgggucgagaugggcgaggccgcugggaucuucaugaccgccacuccgcccggcucccgcgacccguucccccagucuaacgccccgauaauggaugaggagaaggagauccccgaacgguccuggaacagcgggcacgaaugggugaccgacuuuaaagggaagaccgugugguucgucccauccaucaaggccgggaacgacaucgccgcaugccugcgcaagaacggcaagaaggugauccaguuaagccggaagaccuucgacagugaguacaucaagacgcgcacuaacgacugggacuucguggugacgaccgacaucuccgagaugggcgcgaacuuuaaggccgagcgggugauugacccgcggcggugcaugaagcccgugauccucacggacggggaggagcgcgucauccuggcaggccccaugccagugacccacuccucugcugcccagcggcggggccgggugggacgcaauccuaagaacgagaacgaccaguacaucuacaugggugaaccucuggagaacgacgaggacugugcacacuggaaggaggccaagaugcucuuggacaauaucaacacgcccgagggcaucaucccuucuauguucgagccagagagggaaaaagucgaugccaucgauggcgaguacagacugcgcggcgaggcccggaagaccuucguggacuuaaugcgccggggcgaccuacccgucuggcuugccuaccgaguggcggccgaggggaucaauuacgccgaccggcgcugguguuucgacggcguaaagaauaaccagauccucgaggagaacgucgaaguggagauuuggacgaaggagggggagcggaagaagcugaagccccgcuggcuggacgcccggauuuauuccgacccgcucgcacugaaggaguucaaggaguuugcggccggccgcaaaucccugacgcucaaucugaucacggagaugggccggcugcccacauucaugacgcagaaggccaaaaacgcacucgacaaccuugcggugcuccacaccgccgaggccggagggcgcgccuacaaccacgcccucagcgaacuucccgagacccuggagacucuccuguuacucacgcugcuggcgaccgucaccgggggcaucuuccucuuccugaugagcggaaaggggaucgggaaaaugacguuggggaugugcugcaucaucacagcgagcauccuccugugguacgcccagauccagccccacuggaucgccgccuccaucaucuuagaguucuuccucaucgugcugcugauaccggaaccagagaagcagcggacgccccaggacaaccagcucaccuauguggucaucgcgauccugaccguggucgccgccaccauggccaacgagaugggcuuccuggagaagacgaagaaggacuuugggcucgguuccaucacgacccagcagcccgagagcaauauccuggauaucgaccugcgcccggccuccgcguggacucucuaugccguagcgacgacuuucaucacccccaugcugcgccacagcaucgagaacucaagcgugaacgugagucucaccgcuaucgccaaccaggcgacgguccugaugggucuaggcaagggcuggccacuuagcaagauggacaucggagugcccuuacuagccaucggcugcuacucccaggugaauccgauuacccugaccgccgcccuccugcugcucgucgcgcauuacgccaucaucgggccuggccugcaggccaaggccacccgcgaagcccagaaacgugcagcugcgggcaucaugaagaacccgacgguggacggcaugaccguuaucgaccuggaccccauaccuuacgaucccaaguucgagaagcagcucggccaggugauguuauuagugcucugcgucacccagguccugaugaugcgcacuacuugggcacugugcgaggcccucacccuggcuaccgggcccauaagcacccugugggagggcaaccccgggagguuuuggaacacgacuaucgcaguguccauggccaacaucuuucgcggcuccuaccucgccggcgccggucugcuguucuccaucaugaagaacaccgcuaauacccgccggggcacgggaaacaccggcgaaacccugggcgaaaaguggaaaaaccgccugaaugcguugggcaagagcgaguuccagaucuacaagaaauccggcauccaggagguagaccggacacucgccaaggaggggauuaagcguggcgagacggaccaccacgccgucagcagaggcuccgcgaaguugagaugguucguggagcggaaccuggugacuccggaaggcaaggucguugaccucggcugugggcgcggcggguggagcuacuacugugggggccugaagaacgugaaagaggucaagggccugaccaagggcgggcccggccacgaggagccuaucccgauguccaccuacggguggaaccucgugcggcugcagagcggcgucgacgucuucuucacaccgcccgagaagugcgauacccugcucugcgacaucggggaauccagccccaacccaaccguugaggccggccgcacccugcgggugcugaacuuaguugagaacuggcugaacaauaacacccaguuuugcaucaaggugcugaacccguacaugccaagcgugaucgagaagauggaggccuugcagcgcaaguauggcggggcccucguccggaacccccugucccgcaacagcacucacgagauguacuggguauccaacgccaguggaaacauugucagcagcgucaacaugaucagucggaugcugaucaaccguuucacuaugcggcacaagaaggcgaccuaugaaccggacgucgaccuggggucgggcacgcgcaacaucgggaucgaguccgagacgcccaaucuggacaucaucgggaaacggauugagaagaucaagcaggagcacgaaaccuccuggcacuacgaccaggaccacccauauaaaacaugggccuaccacgggucguacgagacgaagcagacggggagcgccuccagcauggugaacggcguugugcgccugcucacuaagccuugggacgugaucccuaugguaacccagauggccaugaccgacacgacccccuuuggacaacagcgcguguucaaggagaaggucgacacccgcacccaggagccgaaggagggcacgaagaaacucaugaagaucaccgccgaguggcuguggaaggagcugggcaagaagaagacgccccgcaugugcacccgggaggaguucacacguaagguacgguccaacgcggcgcugggggcuaucuucacggacgaaaacaaguggaagucugcccgugaggccguggaggacuccggcuucugggagcuggucgacaaagagagaaaucuccaccuggaggggaagugugagaccugcguguacaauaugaugggcaaacgcgagaagaaacuuggggaguucggcaaggcgaaggguagccgggccaucugguacauguggcucggggcccgcuucuuggaguuugaggcccugggguuccuuaacgaggaccacugguucucccgagagaacagccugagcgggguugagggcgaggggcugcacaaacucggcuacauccugcgcgacgucuccaagaaggagggcggcgcgauguacgccgacgacaccgccggaugggauacgcguaucacccuggaggacuugaaaaacgaggagauggugacaaaccacauggagggggagcacaagaagcuggcugaggccaucuucaagcugaccuaccagaacaagguggucagagugcagcgaccgacgccccgcggcacugugauggacaucaucagccggagagaucagcggggauccggccaggucgugaccuacggccucaacaccuucacgaacauggaagcgcagcugaucagacagauggagggugagggcguguuuaagagcauccagcagcucaccgucaaggaggagauagcggugaagaacuggcucauccggguggggcgcgagagacugagccggauggccaucagcggcgacgacugcgucguuaagccgcuggaugauagguucgcauccgcccucaccgcccugaaugacaugggcaagguccggaaagacauccagcagugggagcccagccgcggguggaacgacuggacgcaagucccuuucuguucccaccacuuccacgagcugaucaugaaagacggccgaguccucgcggugcccugccgcaaccaggaugaacugaucgggcgggcccgcaucucccagggcgcaggguggucccugagggagacagccugccucggaaagagcuacgcgcagauguggucccuaauguacuuccaccgccgggaccuacgccucgccgccaacgccaucuguagcgcuguccccucccacuggauucccaccagccggaccacauggucuauccacgcgacccacgaguggaugacgaccgaagacaugcugaccguguggaaucgcguguggauccaagaaaacccguggauggaggacaagaccccggucgagagcugggaggagauccccuaucuaggcaagcgggaggaucaguggugcggaagccucauuggccuaacgucccgcgccaccugggcaaagaacauccagacagccauuaaccaaguccguagccugaucgggaaugaggaauauacugacuacaugccaaguaugaagcguuuccggcgugaggaggaggaggcgggcgugcucugguaa

SEQ ID NO: 24875 - RNA, 9876 nt, Artificial Sequence
  derived and/or modified CDS sequence (opt11) from DENV-2__KM279520__SS-prME
accgccgggauaaucaucaugaugauccccaccgugauggcauuccaucugaccacgaggaauggcgaaccccacaugauagucagucggcaggaaaaaggcaagucgcuccuguucaaaacugagaacggugugaauaugugcacccugauggcgauggaucucggcgagcugugcgaggacaccaucacguacaacugcccacuguugcgucagaacgagcccgaggacauugacuguuggugcaauuccacgagcaccugggugaccuacgggacgugcaccgccacgggugagcaucggcgcgaaaagagaagcgucgcacuggugccccacguggguaugggguuggagacccgcaccgagacauggaugagcagcgagggcgccuggaagcacgcgcagcggaucgagaccuggauccuucgccaccccggguucaccaucauggcggccauacuggccuacaccaucgguaccaccuacuuucagcggguccugaucuucauccugcugaccgccgugacuccauccauggcaaugcgaugcauagguaucucaaaccgggacuucguggagggggucuccggcggcagcuggguggauaucguacuggagcauggcaguugcgucacuaccauggcccgaaacaagcccacacuggacuucgagcugaucaagaccgaggcaaagcaucucgccacccuccggaaguauuguguggaggccaagcugaccaacacuaccacugcaucccgcugucccacccagggggagccguccuugaacgaggaacaggacaagcgguucgugugcaagcacagcaugguagaucgcggaugggguaacggcugcggccucuucgggaaaggagggaucguaacuugcgcaauguucacgugcaagaagaacauggaggggaaggugguccagccagagaaccuggaguacaccaucgucaucacuccccacuccggcgaggaaaaugcagugggaaacgauacgggcaagcacgggaaagagauuaaggucacaccccaaagcuccauuaccgaagccgaacugaccggcuaugguaccgugacgauggagugcagcccgcggaccgggcuagacuucaacgaaaugguccuccugcagauggagaacaaggccuggcucguccacagacaaugguuccuggaccugccacuuccuuggcugccaggcgcggacacccagggguccaacuggauccagaaggagaccuuaguaacuuucaagaauccgcaugcgaagaagcaggacgucguggugcuuggcucacaggaaggggcgaugcacaccgcccugaccggcgccacagagauccagaugagcuccgggaacuuacuguucacgggccacuugaagugccggcuacgaauggauaagcuccagcugaagggaauguccuacucgaugugcacggggaaguucaaagucguuaaggaaauagccgaaacccagcacggcaccauaguuaucagaguccaguacgagggggacggcagccccugcaagaucccauucgaaauaauggaccuggagaaacgccaugcccucggacgccugaucacggugaaccccaucgugaccgaaaaagacuccccggucaacauagaggccgagccacccuuuggggacucauauaucauuaucggcguggaacccgggcagcugaaguugucgugguucaaaaagggcagcuccaucgggcagauguucgagaccaccaugcggggcgccaagcgcauggccauccugggagacacggcuugggacuucgggagcuugggcggaguguucaccuccaucggcaaggcccuccaccaggucuucggggccaucuacggcgccgcguucagcggcgucucuuggaccaugaagauccugauuggcguagucauaaccuggaucggcaugaacagccgcagcacgagccuuuccgugucgcuggugcucguggggguggugacucuguaccugggcgucauggugcaggccgacagugggugcguggucagcuggaagaauaaggaauugaagugcggcagcggcauauucaucacugacaacgugcacaccuggacggagcaguauaaguuccagccggagucccccaguaagcuggcauccgcgauucagaaggcccacgaggagggcaucugcggcauccgcagcgugacccgacuggagaaucucauguggaaacagaucaccccggaguugaaccacauccugaccgagaaugaggucaagcucacgaucaugaccggcgacaucaagggcaucaugcaggcggggaagcgcucccugcggccccaaccgaccgagcugaaguacagcuggaaggccuggggcaaggccaaaauguugucaaccgaguuacacaaucacacguuccugaucgacggcccagagaccgccgagugucccaacaccaaucgcgcuuggaacagccuggagguagaagacuacggguucggcguguucaccacgaacauuuggcugaagcugaaggaacggcaagaugucuucugugacucuaaguugaugagcgcugccaucaaagauaaccgcgcgguacacgccgacaugggguacuggaucgaguccgcccuuaacgauacuuggaagaucgagaaggcgagcuuuauugaggugaaguccugucacuggcccaagagccacacccugugguccaacggaguccucgaguccgagaugaucauccccaagaacuucgccggccccguaucccagcauaacuaucggcccggcuaucacacccagacugccggcccguggcacuugggacgccuggagauggauuucgacuuuugcgagggcacgacgguggucgugaccgaagacugcgggaaccggggcccgagccuccgcaccacaacugccucgggcaagcugaucaccgagugguguugccggagcugcacccugccaccacugcgcuaccgcggggaagacggcugcugguacgggauggagauacgcccgcugaaggagaaagaggagaaccuggugaacagccuggucacggccggccacgggcagaucgacaacuucucccugggcgugcuggguauggccuuauuccuggaagagaugcugcggacccgcguaggcaccaagcacgcgauccuccuggucgccgugaguuucgucacccugaucacaggcaauauguccuuccgcgaucucgggcguguaauggugauggugggcgcgaccaugacugacgacaucgggaugggcgucaccuaccuagcgcugcucgccgccuucaaaguacgcccgacuuucgccgcuggcuuguugcucaggaagcugaccagcaaggagcucaugaugacgaccauuggaauaguacuccugucccagagcacgauacccgaaaguauccuggaauugaccgacgcacuggcacuggggaugaugguccuuaagaucguucgcaacauggagaaguaccagcuagcaguuaccaucauggcaaucuugugcguuccuaacgcugugauccuccagaacgcguggaaggucagcugcaccacgcuggcaguggucagcgucucgccguuacuccugaccucaagccagcagaaagcagacuggaucccccuggcccucaccauaaagggacugaacccgaccgcgaucuuccuuacuacucucucucguaccagcaaaaagcgcuccuggcccuugaacgaggcuaucauggccguggggauggugagcauacuggcgucgagccucuuaaagaacgacaucccgaugacaggcccccugguugccgggggccuccugacggugugcuacgugcugaccgggcggagcgcggacuuagagcuggagcgcgccgccgacguaaggugggaggaacaagccgagaucuccggcagcucccccauccuuagcaucaccaucucugaggacgggucuaugucgaucaagaaugaagaggaggagcagacgcucacgauccugauccgcaccgguuugcuugugaucaguggccuguuccccgugucuaucccaaucacugccgccgcuugguaccugugggagguuaagaagcaacgggccggggugcucugggacgugcccagcccgccgccggucggcaaggccgagcuggaggauggcgccuaccggaucaaacagaagggcauccugggguacucccagauaggcgccggcguguacaaggaggggaccuuccacaccauguggcacgugacaaggggagccguccucaugcacaaaggaaagcgcauagagcccagcugggcagacguuaagaaggaccucaucuccuacggcgggggcuggaagcuggagggagaguggaaggaaggggaggaggugcagguccuggccuuggagcccggaaagaacccgagggcaguucagacuaagcccgggcuguucaagaccaacaccgguacgaucggugcugugagccucgacuucagucccggcaccuccggcucccccaucguagacaagaagggcaaggugguugggcuguacgggaauggagucgugacgaggagcggcaccuacguguccgcuaucgcacaaacugagaaguccaucgaggacaacccugagaucgaggacgacauauuccggaagaagcggcuaacgaucauggaccugcaccccggcgccggcaagaccaagcgguaccuccccgcaaucguuagggaagccauaaagcggggccuacgcacccugauucucgcccccacgcgcgugguggccgcggaaauggaggaggcacugcgcggccugccgauacgcuaccagacucccgccauccgugccgagcacacaggccgggagauagucgaccucaugugccacgccacauucacgaugcggcuucugucgccgauccgcgugccaaacuacaaccucaucaucauggacgaggcccacuucaccgaccccgcguccauugccgcccgaggcuacaucagcacccgcguggagaugggcgaggcagcagggaucuuuaugaccgcgacgccgcccgggucccgggaucccuucccacagucaaacgcccccaucauggacgaagaacgcgagauccccgagcgguccuggaacagcggucaugagugggucacagacuucaagggaaagaccgugugguucguccccuccaucaaggccgggaacgacaucgcggcgugccuccggaagaacggcaagaagguuauccaacugagcagaaagaccuucgacucggaguauauuaaaacacgcaccaaugacugggacuucguggugacuacugacaucagcgaaaugggcgcgaacuucaaggccgagcgggucaucgauccgcgucgguguaugaagcccguaauucucacggacggggaggagcgcgugaucuuagcgggccccaugcccgucacccauucaagcgcugcgcagagaagagggcgcgugggccguaacccgaagaaugagaacgaccaguacaucuacaugggugaaccccuggagaacgacgaggacugcgcgcacuggaaggaagccaagaugcuccuggacaacaucaacacacccgaggggaucaucccguccauguucgaaccggaacgcgagaaaguugacgccaucgacggcgaguaccggcugagaggggaagcgcggaagaccuucgucgaccucaugcgacgaggcgaccugcccguguggcuggcauaccgcguggccgcggaggggauuaacuaugccgaucggcgcuggugcuucgacggcgugaaaaacaaccagauccucgaggaaaauguggaagucgagauuuggacgaaggaaggggagcggaagaagcugaagccccgcuggcuggacgcccguaucuacucugauccucucgccuugaaggaguucaaggaguucgccgccggccgcaagucccugacccucaacuugaucacagagaugggccggcugcccacuuucaugacgcagaaggccaagaacgcgcucgacaaccuggccguguugcacaccgccgaggccgggggccgugcuuacaaccacgcgcucucagagcugcccgagacucuggagacucuccugcugcuuacgcugcuggccaccguaaccgggggcaucuuucucuuccuuaugucgggcaaagggauuggcaagaugacccuggguaugugcugcaucaucaccgccagcauccuccuaugguacgcccaaauccagccccacuggaucgccgccuccaucauccuggaguucuuccucaucguccuucugauaccggagccagaaaagcaacgaacgccccaggacaaucagcuuaccuacguugugauugcgauccugaccgucguggccgccacuauggccaacgagaugggcuuccuagagaaaacgaagaaggacuucggguuaggcagcaucaccacccagcagcccgaguccaacauccuagacauugacuuacgcccggcgucagccuggacccucuacgccguggcaacgaccuuuauaaccccuauguuacggcauagcaucgagaacaguucuguuaacguaucccugaccgcuaucgcgaaccaggccaccguccucaugggccuggggaagggguggccccugagcaaaauggacaucggggugccccuauuggccaucggcugcuauucccaggugaacccgaucaccuuaaccgccgcgcuucuacuccucguggcccacuaugccaucaucgggcccggucugcaggccaaagccacucgcgaggcgcagaaaagagccgccgcgggaaucaugaagaacccgacgguagacgggaugacggugaucgaccuggaccccauaccauacgaccccaaauucgaaaaacagcucggccaggugauguuauuaguccugugcgugacucagguccuuaugaugcguaccacgugggcucuuugcgaggcgcuaacccuagcaaccgggcccaucagcaccuuaugggagggcaacccuggucgcuucuggaacacgacgauugccgucucuauggcaaacauauuccggggaagcuaccucgccggcgcggggcugcuguucuccauaaugaagaauaccgccaacacacgccggggcacggggaacacuggggagacgcucggagagaaguggaagaaucggcucaacgcccugggaaagagcgaguuccagaucuacaagaaguccggcauccaggagguggaucggaccuuggcgaaggaggggaucaagcgcggcgagacggaccaccacgcggugucccggggguccgccaagcugcgcugguucgucgagcggaaccuggugacuccggagggcaaagugguggaucucggcugcgggcgcggcggguggucguacuacugcggcgggcugaagaacgucaaggaggugaaggggcugaccaaaggagggccgggccacgaggagcccauccccauguccacuuacggguggaaccucguccggcugcagagcggcguggauguuuucuucacgccgcccgaaaagugugacaccuuacucugcgacauaggggaaucuagcccaaaccccaccgucgaggcaggcagaacacugcggguguuaaacuuaguggaaaacuggcugaacaauaacacccaguucugcaucaagguccuaaacccguacaugcccuccguuaucgagaagauggaggcccugcagcgcaaauacggcggggcccucgugcggaauccccugagucgcaauagcacgcacgagauguacuggguuucuaacgcaucuggcaacaucguguccagcguaaacaugaucucgcggaugcugauaaaccgcuucaccaugcgacacaagaaggcaaccuacgaaccggaugucgaccuagggucaggcacccgcaauaucgggauagaguccgagacucccaaccuggacauaaucgguaaacgcaucgagaagauuaaacaagagcacgagacuagcuggcauuaugaccaggaccaccccuacaagaccugggcguaccacggcuccuacgagacgaagcagacggggagcgccuccaguauggugaacggggugguacggcugcucaccaagccgugggacguuauaccgauggugacccaaauggccaugaccgacacgacccccuucgggcagcagcgagucuucaaggagaagguggacacucggacccaggagcccaaggagggcacgaagaaacugaugaaaauuacggcagaguggcuguggaaggaguugggcaagaagaagacaccccggauguguacucgggaggaguucacgcgcaaaguccggucuaaugccgcucugggagccauuuucaccgaugaaaacaaguggaaguccgcacgugaggcaguggaggacuccggauucugggagcugguggacaaggaacggaaccuccaccuagaagggaagugugagaccugcgucuauaacaugauggguaagcgcgagaagaagcugggggaguucggcaaggcaaagggcagccgagcaaucugguacauguggcucggggcgcgauuccuggaguucgaggcuuuaggcuuccucaacgaggaucacugguucagcagagagaacagccugagcgggguggaaggcgaaggucuucacaaauuaggcuacauccugagggacguaucaaagaaggagggcggggcuauguaugcugaugacacggccggcugggacacacgaaucacgcuggaggaucucaagaacgaggaaauggucacgaaucauauggagggggagcacaagaagcuggcggaggcgaucuucaagcuaacauaccagaacaagguggugcgcguccagagaccgacaccccgcggcacugugauggacaucaucagccggcgggaucagcgggggucuggccaggugguuaccuacggccucaauaccuucaccaacauggaggcccagcugauccgccagauggagggggaaggcguguuuaagagcauccaacagcuaaccgugaaggaggagauugccgucaagaacuggcucauacgcguggggcgggagcgauuaucccggauggcuaucagcggcgacgacugcgugguaaagccacuggacgacagguucgcauccgcguugaccgcccugaaugacauggguaaaguucggaaggacauccagcaaugggaacccagccgcggcuggaacgacuggacccaagucccguucuguucccaccauuuccacgaacugaucaugaaagaugguagaguucucgucguacccugcagaaaccaggacgagcugaucgggcgggcucgcauuagccagggcgcuggguggucucuacgggagacggcgugccucggcaagagcuacgcgcagauguggucccugauguacuuccaccgccgggaccugcgccucgccgcuaacgcuauauguagcgccgugcccucccauuggaucccgacaucgcggaccaccuggaguauccacgcuacacacgaguggaugacgaccgaggacaugcucaccguguggaaccgcguguggauccaggaaaacccguggauggaggacaagacccccgucgagacgugggaggaaauccccuacuuaggcaagcgggaggaccaguggugugggagccucaucggccugaccagccgcgccaccugggccaagaacauacaaacugccauaaaccaggugcggagucuaaucggaaacgaggaguacacggacuauaugccuaguaugaaacgcuuccgccgggaggaggaggaggcgggcguccuaugguga

SEQ ID NO: 24876 - RNA, 9876 nt, Artificial Sequence
  derived and/or modified CDS sequence (opt11) from DENV-2__KM279521__SS-prME
accgcgggcaucaucaucaugaugauccccaccgugauggcauuccacuuaacuacccggaauggugagccucacaugaucguaagccggcaggagaagggcaagagccuuuuauucaagaccgaaaaugggguaaacaugugcacccuuauggccauggaccucggggagcugugugaagacaccauuaccuacaacuguccauuacucaggcagaacgagccagaggacaucgauuguuggugcaauucgacgagcaccuggguaaccuacgggaccugcaccgcuacgggcgagcaccggagggagaagcguagcguagcgcuggugccccacguugggauggggcuggaaaccaggacagagaccuggaugucuagugagggcgccuggaagcacgcccagcggauagagaccuggauccuccgccauccuggguucaccaucauggccgccaucuuggccuauaccauaggaaccacguacuuccaacggguccugaucuucauacuccucacugcggugaccccaaguauggcgaugaggugcaucgggaucagcaaccgggacuuuguggaaggcguaagcggcgguucuuggguggacaucgugcuggaacacggaaguugcgucacuacgauggcuaagaacaagccgacgcuugacuuugagcugaucaagaccgaggcgaagcacuuagcaacccuccgcaaauauugcguggaggccaagcugacuaacacgaccaccgcgagccgguguccaacgcagggagaacccucgcugaaugaggaacaagacaagcgauuuguuugcaagcacagcaugguagaccggggauggggaaauggcuguggccucuucgggaagggcgggaucgucacaugcgcaauguucacaugcaagaagaacauggagggcaaagugguucagccagaaaacuuggaguacaccaucgugauuacaccccacucuggugaggagaacgcugucgguaacgauacggguaagcacggaaaggaaauuaagguuacaccccagucuuccauaaccgaggccgagcugaccggcuacgguacagugacgauggaguguucgccucgcacgggucuugacuucaacgagauggugcuccuucagauggaaaacaaggccuggcucgugcauaggcaaugguucuuggaccugccgcuacccugguugcccggagcggacacacaaggaucaaacuggauccagaaggagacacuggugacguuuaagaacccucacgcuaagaagcaagacgucguagugcuuggcagccaggagggggccaugcacaccgcccugaccggcgccacagagauccagaugucuuccgggaaccuccuguuuaccggacauuuaaagugccgccugcggauggauaaacuucaauuaaagggcaugagcuauaguauguguacugggaaguucaaaguugugaaggagaucgcggagacccagcaugggaccaucgucauccgcguccaguacgagggggacggcagccccugcaaaauccccuucgagaucauggaccuagagaagcggcacgucuuaggacgccugauuacgguaaaucccaucgucaccgaaaaggacuccaccgugaacaucgaggccgaaccgcccuuuggggacagcuauaucaucaucggcguggagcccgggcagcugaaguuauccugguucaaaaagggcagcuccauugggcaaauguucgaaacgacaaugcggggcgcuaagcguauggccauauuaggcgauaccgccugggacuuugggagucuuggcgggguuuucacauccaucggcaaggcgcuccaccagguguucggcgcuaucuacggcgccgccuucucaggcguguccuggaccaugaagauccugaucggagucgugauaacguggaucggaaugaacucgcguuccacaucgcuguccgugucucugguauuaguggggguugucacccuguaccugggugugauggugcaggcggauucagggugcguggugagcuggaagaacaaggagcucaaaugugguagcggcauuuucaucaccgacaaugugcauacguggacggagcaguacaaauuccagcccgagucgccgaguaagcuggcuuccgcuauccagaaggcucacgaggaggguaucugcggcaucaggagcguuacaaggcucgagaaccuuauguggaagcaaaucacccccgagcugaaccauauccugacggagaacgaagugaagcucaccaucaugaccggcgacauaaaaggcauaaugcaggccgggaagcggucccugcgaccgcaacccacggaguugaaguacucauggaaggcgugggggaaagccaagauguuguccacggaguuacacaaccauaccuucuuaaucgacgguccggaaaccgccgaaugcccgaacacgaaucgggcauggaacagccucgagguugaagauuacggguucggcgucuucacaaccaauaucuggcugaaacugaaggagcgccaggacguauuuugcgauaguaagcucauguccgcagcaauuaaagacaaccgggccgugcaugcagacaugggguacuggaucgaauccgcccuaaacgacacuuggaaaauagaaaaggccucuuucauugagguuaaauccugccacuggcccaagucucacacacugugguccaacgguguccucgagagugaaaugaucaucccgaagaacuucgcggggcccgugucccaacacaacuaucgacccgguuaccauacacagacggccggucccuggcaccuggggcggcuagagauggacuucgacuuuugcgaaggcacaaccgucguggugaccgaagacugcgggaauagaggacccagccuccggacgaccaccgccagcggcaaguugauaaccgaguggugcugccgcaguugcacgcugccgccccuccgguaccgcggggaggacgguugcugguacgggauggagaucaggccgcugaaggaaaaggaagagaaccuggucaauagucuugugaccgccggccaugggcagaucgacaacuuuaguuugggcgugcugggcauggcgcucuuucucgaagagaugcuucgcacgcguguggggaccaagcacgccauacuacugguggcugucagcuucgugacccuaaucaccggcaacauguccuuccgcgaccucggccgcgugauggugaugguaggcgcgaccaugaccgacgacauugggaugggagugacguaccuggccuuacuggccgccuucaaggugcggccaacauucgccgccggccuguugcuacgcaaacuaacuucaaaggagcugaugaugacuacgauugggauaguccuccuaucgcagagcacgaucccggaguccauucuggagcucaccgacgcccuggcguugggaaugaugguguugaagaucguccggaacauggagaaguaucagcuggcgguaacuaucauggcaauccugugcguccccaacgcagucauccuccagaaugccuggaagguuucgugcacgacgcuugccgugguaagcguuagcccccugcucuugaccuccagucagcagaaagcggacuggaucccguuggcgcucacaaucaaagggcugaauccgacggccaucuucuuaaccacuuugagccgcacuagcaagaagcgguccuggccgcugaacgaggcaaucauggccgugggcaugguaagcaucuuagcauccagccugcugaaaaaugacauccccaugacuggcccguugguggcuggugggcugcuaacgguguguuauguccugaccgggcggagcgccgaucucgagcucgagcgggcggcugacgugcgcugggaggagcaggcggagaucuccggcagcuccccaauccugagcaucaccaucuccgaggacgggagcauguccaucaagaacgaggaggaggagcagacgcucacuauccugauccgaacaggccugcucgugaucagcggucuguuucccgucaguauucccauaaccgcagccgccugguacuuaugggaggugaagaagcaacgggccgguguacucugggacguaccaaguccaccucccguuggcaaagccgagcuggaggacggugcauaccgaaucaaacagaaagggauccugggcuacagccaaaucggagccggaguguacaaggaagggaccuuccacacgauguggcaugucacccgcggcgccgugcugaugcauaagggcaagcggaucgagccaucaugggccgacgucaagaaagaccuaauauccuacggcgggggauggaaacucgagggcgaguggaaagaaggggaagagguacaaguauuggcccuggagcccgguaagaacccccgugccgugcaaaccaagccggggcuguucaagacaaauacgggcaccauaggagcagucagcuuagauuucuccccgggcacgagcggcuccccuaucguggacaagaagggcaagguuguuggcuuauaugggaauggcguggugacgcgaucaggcaccuaugucuccgccaucgcacaaaccgagaaguccaucgaggacaacccagaaaucgaggacgacauuuuuagaaagaaacggcugaccauuauggaucugcacccgggcgcgggcaagaccaagagauaccuucccgcgaucguacgcgaggcgaucaagcgcggccuaagaacgcugaucuuggccccgacccgugugguggccgcggaaauggaagaggcccugcgcggccugcccauucgguaccagacuccggcgauacgagccgaacacacgggucgggagaucguggaucucaugugucacgccacguucaccaugagacugcucucucccauccgugugccgaacuacaaucucaucauuauggaugaggcccacuucaccgaccccgcauccaucgcggcccgcggcuauaucagcacucggguagagaugggagaggccgccggcauuuucaugacggccacaccgccaggcucccgcgaucccuucccucagucuaacgccccaaucauggacgaggagcgugagauccccgagcgauccuggaacagcggccacgaauggguuaccgacuuuaagggcaagacagugugguuugucccuuccaucaaggccgggaacgauaucgccgccugccugcggaaaaacggcaagaaaguaauccaacugucgcgcaaaacuuucgacuccgaguauaucaagacacggaccaacgauugggauuucgucguuaccacggacaucagcgaaaugggcgcgaacuucaaagcugaacgcgugaucgacccccggcgcugcaugaagccaguuauccuuaccgauggggaggagaggguaauuuuagccgggcccaugcccgugacgcacuccagcgccgcccagcgccggggccgcgugggccgcaacccaaagaaugagaaugaccaguauaucuacaugggugaaccgcuggaaaaugaugaggacugcgcgcacuggaaggaagcgaagaugcuccuggacaacaucaacaccccagagggcauuaucccgucaauguucgaacccgaacgggagaaggucgaugccaucgacggcgaguauagacuucgcggggaggcgagaaagacguucguggaucucaugcgccgaggcgaccugccuguauggcuggcuuaucggguggccgccgaggggauuaacuacgccgaccgccggugguguuucgacggugugaagaacaaccagauccuggaagagaaugucgagguggagaucuggaccaaggaaggggagcguaagaaauuaaagccccgguggcuggaugccagaauuuacagcgaucccuuagcccugaaggaguucaaggaguucgcagccggcaggaagucccugacccucaaccugaucacugagaugggccgccuuccgacguucaugacacagaaggccaagaacgcccucgauaaccucgcggugcugcacacggccgaagccggagggcgggcguacaaccacgcccucuccgagcugcccgagacauuagagacucuuuugcuguuaacccugcuggcgaccgucaccgggggaaucuuccucuuccugaugaguggcaaagggaucgggaagaugaccuuggguaugugcugcaucauaacggccagcauucugcucugguacgcgcagauccagccccacuggaucgcagcauccauaaucuuggaguucuuucucaucgugcuguuaauacccgaaccagagaagcagcgcacgccccaggauaaccaacucaccuacguagucaucgcgauccugaccguuguggccgccacgauggccaacgagaugggcuucuuggagaagaccaagaaggacuucggacucgguucaauaaccacccaacagcccgagucaaauauccuggacauagacuugcggccggccagcgcguggacgcucuacgccgucgccaccacguuuauuaccccgauguuacgccacaguauagaaaacuccagcguuaacgugucccugacggcgaucgccaaccaggcgacgguccucaugggcuuggguaagggcuggccccuaagcaaaauggacaucggggugccgcuacuggcaaucggcugcuacucacaggucaaccccauuacccucacagccgcccuacugcuacucguugcgcacuacgccauaaucgggccuggucugcaggccaaggccacacgcgaggcccaaaagcgagcagccgcaggcauaaugaagaaccccaccguggacgggaugaccguuaucgacuuagaccccaucccguacgacccgaaauucgaaaagcagcucggccagguuaugcugcucgugcucugcgugacacaaguccugaugaugaggacuaccugggcccugugugaggcgcuuacuuuggcgacagggccuauaucuacgcugugggagggcaacccggggcgcuucuggaauaccacuaucgccguuuccauggccaacaucuuccgcggcagcuaccuggcgggcgccgggcuucuauucagcaucaugaagaacacagcgaauacgcggcgcggcacagggaacacuggugaaacccugggcgagaaguggaagaaccggcugaaugcgcugggcaaauccgaguuccagaucuauaaaaaguccgguauccaggagguggaccgcacgcucgcaaaggaggggauaaagcguggcgagacugaccaccacgccgucagucgcggguccgcgaagcugagaugguucguggagagaaacuuagugacgccggagggaaagguaguggaccucgggugcgggcggggcggauggagcuacuacugcggcggauuaaagaacgugaaggaagugaaagggcugaccaagggcgggccagggcacgaggagccaaucccgaugaguacguaugguuggaaucuuguucgccugcagagcggaguggacgucuucuucacaccucccgagaagugcgacacccuauuaugcgacaucggagagucgagucccaaccccaccguggaggccggccgaacgcugcgcgugcugaacuuggucgaaaacuggcuuaacaauaacacgcaguucuguaucaaaguacugaacccguacaugcccagugugaucgagaagauggaagccuuacagcggaaauacggcggggcccucguccgcaacccccuuagccggaauagcacgcacgagauguacuggguguccaacgccagcggaaacaucguuagcagcgucaauaugaucucuagaaugcugauuaaucgguucaccaugaggcacaaaaaggcaaccuacgagcccgacguggaccucgguaguggcacccggaacauugggaucgagucggagaccccgaauuuggacauuaucgguaaacgcauagaaaagaucaaacaagaacacgagaccagcuggcacuaugaucaagaccacccguauaagacaugggccuaucacggguccuacgagacuaagcagacagggucagcguccagcauggugaacggcguagugcgccuacucaccaagcccugggacgugauccccaugguaacccagauggcuaugacggacaccaccccguucgggcagcagcggguguucaaggagaaggucgacacccgcacgcaggagcccaaggaaggcacuaagaaacuuaugaagauuacagccgaguggcuuuggaaggagcucggcaagaaaaagacgccccgaaugugcacgcgggaggaguucacccggaagguacgcuccaacgcggcacucggugccauuuuuaccgacgagaauaaguggaaguccgcccgggaggccgucgaggacuccgguuucugggagcuggucgauaaggagcgcaaccugcaccuggaaggaaagugcgagaccugcguuuacaauaugaugggcaagcgggagaagaagcugggugaguucgggaaggcgaagggcucgcgcgccaucugguacaugugguuaggggccagauuuuuggaguucgaagcucugggcuucuugaacgaggaccauugguuuucuagggaaaacagccugagcgggguggagggcgaagggcugcauaaacucggcuacauccugagagacgucuccaagaaggagggcggggcgauguaugccgacgacacggccgggugggacacccgaaucacccuggaggaccucaagaaugaagaaaugguaaccaaccauauggagggcgaacacaagaagcuggcugaagcgauauucaagcucacguaccaaaacaagguggugcgugugcaacgcccgacuccacggggaaccguaauggacaucauuucacggcgggaccagcgcgggucggggcaggucgugaccuacggccuaaacacguucaccaacauggaagcccaacugauccggcagauggaaggcgagggcguguucaagagcauccagcagcucacuguaaaagaggagaucgcugugaagaauugguuaaucaggguggggcgcgagcggcucucccgcauggcgaucucgggggaugacugcgucguaaagccuuuagacgaccgauucgccuccgcacucaccgcacuaaaugauaugggcaaagugcgcaaggacauacagcagugggagcccagccggggguggaacgauuggacgcaaguccccuucugcagccaccacuuccacgagcugaucaugaaggauggccgugugcucguggucccgugcaggaaccaggacgagcugauugggcgcgcccgcauuucucagggugcaggguggucccugcgcgagacagccugucucggcaaaagcuaugcucagauguggucgcugauguauuuccaccggagagaccugcggcucgcggcaaacgcuaucugcagcgcagucccaucccacuggaucccgaccagccgcacaacguggucgauacacgccacucacgaauggaugacaacugaagauaugcugacuguguggaaccggguauggauccaagagaauccauggauggaagacaagacgccggucgagagcugggaggagauucccuaccuuggcaaacgcgaggaccaauggugcgggucucuaaucggcuuaaccucccgggcaacaugggccaagaauauccagacugccaucaaccaagugagaucacugauagggaaugaagaguacacggauuacaugcccaguaugaaacgcuuccgccgagaagaggaggaggccgguguccugugguag

SEQ ID NO: 24877 - RNA, 9876 nt, Artificial Sequence
  derived and/or modified CDS sequence (opt11) from DENV-2__KM279583__SS-prME
accgccgggauaaucaucaugaugaucccaaccgugauggccuuccaccucaccacccggaacggggagccccauaugaucgucagccgccaggagaagggcaagagcuuacuguucaagaccgaaaauggggugaacaugugcacccugauggcgauggaccucggcgagcugugcgaggacaccaucaccuacaacugcccauuguugcgccagaacgagcccgaggacaucgacugcuggugcaacagcaccagcaccuggguaacauacggcaccugcaccgcuaccggagagcaccggcgagagaagcggagcgucgcccuagugccccacguaggcauggggcuggagacucgcacagagaccuggauguccagcgaaggcgccuggaagcacgcccagcggaucgagaccuggauucuccgccaccccggauucacgaucauggccgccauccucgccuacaccaucgggaccaccuacuuccagaggguuuugauuuucauccuccugacugccgugacccccuccauggcgaugcgcuguaucgggaucagcaaucgggauuucguugaaggcgucucuggcgguucauggguggacaucgugcuggagcacggcuccugugucaccaccauggccaagaacaagcccacucucgacuuugagcugauaaagacugaggcaaagcaccuggccacccuccgcaaguacuguguggaggccaagcugaccaacacgacgaccgcgucacggugccccacccagggggagcccucccugaacgaggagcaagacaagcgcuucguguguaagcauucaauggucgaccggggcuggggcaacggaugcggccucuucgggaagggcgggaucguaacgugcgccauguucacuugcaagaagaacauggagggcaagguggugcaacccgagaaccuggaguacacgaucgucaucacgccccacuccggcgaggagaacgccgucgggaacgacacgggaaagcacgggaaggagaucaaggucacgccccaaagcucaauaaccgaagccgagcugacgggcuacgggacugugacgauggagugcagcccgcgcaccggccucgacuucaacgagauggcccugcugcagauggagaacaaggcguggcucgugcaccggcagugguuccuggaccugccccucccauggcuucccggagccgacacgcagggguccaacuggauccagaaagagacccuggucacguucaaaaacccgcacgccaagaagcaggacgugguaguucucggcagccaggagggagcuaugcacacagcccugaccggcgcgaccgagauccagaugagcucagggaaccuucuauucacgggccaccugaagugccgccuacggauggacaagcuccagcugaaggggaugagcuauuccaugugcaccgggaaguucaagguagucaaggagaucgccgaaacccagcacggcacgauugugauccgcgugcaguacgagggggacggcagccccuguaagauccccuuugaaaucauggaccuugaaaagaggcauguccucggccgccugauuacggucaacccuaucgugacugagaaggacuccccggucaacaucgaggccgagccgcccuucggggacucuuacauaaucaucggcgucgagcccgggcagcugaagcuauccugguucaagaagggcuccuccaucgggcagauguucgagaccacuaugcgcggugccaaacggauggccauccugggcgauacggcgugggauuucgguagccuaggcggggucuucaccucuauaggcaaggcccuccaccaggucuuuggggccaucuacggcgcggcguucagcggcgugagcuggaccaugaagauccugaucgggguggucaucaccuggaucgggaugaacagccgcuccacgagccuguccgucagccuggugcucgucgggguggugacccuguaccugggcgucaugguacaagccgacuccgggugugugguuagcuggaagaacaaggaguugaagugcggcagcggcaucuucaucacagacaacgugcacaccuggaccgagcaguacaaguuccagccggagucccccagcaagcuagccucugccauccagaaggcccacgaggaggggaucugcggcauccggucagugacccgccuggagaaccucauguggaagcaaaucacccccgagcugaaccacauccuuaccgaaaacgaggucaagcucacgaucaugaccggcgacaucaagggcaucaugcaggcgggcaagagaucccugcgcccccagccgaccgagcuuaaguacagcuggaaagccuggggcaaggccaagaugcucucaaccgagcugcacaaccacacguuccugaucgacggccccgagaccgcggaaugccccaacaccaaccgggccuggaacagccucgagguggaggacuacggguucggcguguuuacaacaaacaucuggcugaagcugaaggagcgccaggacgucuucugugacaguaagcucaugucugcggcaaucaaagacaaucgggccguccacgcagacaugggcuacuggaucgaguccgcccugaacgacaccuggaagaucgagaaggcuagcuucaucgaggugaaguccugccauuggccuaagagccauacacuguggucuaacggcguccucgagagcgagaugaucaucccuaagaauuucgccggccccguuucccagcacaacuaccgcccgggguaccacacccagaccgccggcccguggcacuuggggcgucucgagauggacuucgacuucugcgaaggcacgaccguaguagugaccgaggacugcgggaacagaggccccagcuuacggaccacaacggccagcggcaagcugaucacggagugguguugccgcuccugcacgcucccgccccucagauaccgaggagaagacgggugcugguacgggauggaaauucggccgcugaaggagaaggaggagaacuuagugaacagccucgucaccgcgggccaugggcagaucgauaacuucagucugggugugcuggguauggcccuguuccuggaagagaugcugcggacgcggguggguaccaaacacgccauucuccuggucgcggugagcuucgucacccugauuacuggaaauauguccuuccgcgaccuggggcgcgucauggugauggugggcgccaccaugaccgacgacaucgggaugggcgucaccuaccuggcguuacuugccgccuucaaagugaggcccacguuugccgccggccugcugcuacguaagcuaaccagcaaagagcuuaugaugaccaccauaggcaucgugcuccugucccaaucgacaauccccgaguccauccuggagcucaccgacgcucuggcuuuagggaugaugguccucaagaucguucggaauauggagaaauaucagcuugccguaacaauuauggccauccucuguguacccaacgccgugauccuccagaacgcguggaaggucucgugcaccaccuuagcugugguguccgucaguccgcugcuccucaccuccagccagcaaaaggccgacuggaucccccucgcauugaccaucaaaggacugaacccgaccgcuaucuuccugacgacccucucccgcacuagcaagaagcgguccuggccacugaacgaggccaucauggccguuggcauggugagcauucuggccuccagccuccuaaagaacgacaucccgaugaccggcccccuggucgcugggggccuccugacgguguguuacgugcugaccgggcgcagugcggacuuagagcuggagcgggccgccgauguccguugggaggagcaagccgagauaucuggcucgucccccauucuuagcaucacaaucagugaggauggguccauguccaucaagaacgaggaagaggagcagacccuuacgauacugaucagaaccggccuauuagugaucagcggcuuguucccgguuagcauuccgaucacagccgcggccugguacuugugggaggucaagaaacagcgugccggggugcucugggaugugcccucaccgccacccgucggcaaggcugagcuggaggacggggcguaccggauaaagcagaagggcauccuggguuacucucagauuggcgcuggcguauacaaggaggggaccuuccacaccauguggcaugugacgcgcggcgccguccucaugcacaaggguaagcggaucgagcccucaugggccgacgugaagaaggaccugaucuccuacggcggaggauggaagcuggaaggcgaguggaaggagggggaggaagugcaaguccucgcccucgagcccggcaagaacccgcgcgccgugcagaccaagcccgggcuguucaagaccaacacgggcacaaucggggcggugagccucgacuucucccccggcaccagcggcucccccaucgucgacaaaaaggggaagguggugggccuguacgggaacggcgucgugacccgaagcggcaccuacgucuccgccaucgcccagacggagaagagcauugaggacaacccggagaucgaggacgauaucuuccgcaagaagcggcugacuaucauggaccugcaucccggggcgggcaagacaaagcgcuaccuccccgcgaucguccgggaagccaucaagagggggcugagaaccuuaauccuagcccccacgcgcguuguggccgccgagauggaggaggcgcuucgcggccugccaauccgguaccagacccccgccauccgcgccgagcacacugggagggagaucgucgaccucaugugccacgcaaccuucacgaugcgccugcugagccccauccgggugcccaauuacaaccucauuaucauggacgaggcacacuucacggaccccgcguccaucgccgcccgcggcuacaucaguaccagaguagagaugggcgaggccgccgggaucuucaugaccgcgacgccgccuggcuccagggaccccuucccgcaaagcaacgcccccaucauggacgaggagcgggagauaccagagcgcuccuggaauagcgggcaugagugggucaccgacuuuaagggcaagaccgugugguuugugccauccaucaaggccggcaacgacaucgccgcgugccugaggaagaacggcaagaaggucauccagcugagcaggaagaccuucgacuccgaguacauaaagacucggaccaacgacugggacuucguggugaccaccgauaucagcgagaugggcgccaacuucaaggccgaacgcgucauugacccccggcgcuguaugaagcccgugauccuaacggacggugaggagcgagugauacuggcaggccccaugcccguaacccacuccagcgccgcgcaaaggcgggggcgcgucggccgcaacccgaaaaacgagaacgaccaauacaucuacaugggggagccgcuagagaacgacgaggacugugcccauuggaaggaggccaagaugcuccucgacaacaucaacacacccgagggcaucauccccaguauguucgagccggagcgggagaagguggacgccaucgacggcgaguaccgccugcgcggagaggccagaaaaaccuucgucgaccucaugcgacgcggugaccugcccguguggcuggcguaccgggucgccgccgaggggauaaacuacgcagaccgccgguggugcuucgacggcguaaagaacaaccagauccucgaggaaaacguagagguagagaucuggacaaaggagggugagcgcaagaagcuuaagccucgguggcuggacgcccgcaucuacuccgauccgcucgcguugaaagaauucaaggaguucgccgccgggcggaaaucccugacccucaacuugaucaccgagaugggccgccugcccaccuucaugacgcagaaggccaaaaaugcgcuggacaacuuggcaguucugcacaccgcggaggccgggggccgggccuacaaccacgcgcucagcgaacugccugagacgcuggagacucuccugcuguuaacgcugcuggccaccgugaccgggggcauuuuccuuuuccugaugaguggcaagggaaucggcaagaugacccugggaaugugcugcaucaucaccgccaguauccuccugugguacgcccagauccagccccacuggauugcggcguccaucauccuggaguucuuccucaucguccuucugaucccggagcccgaaaagcagaggacgccccaggauaaccagcuaacauacguggugaucgccauccugaccgucguugccgccaccauggccaacgagauggguuuccuggagaagacgaagaaggacuucggccucggcagcaucaccacccaacagcccgagagcaauauccuggacauugaccugcggcccgcguccgccuggacacucuacgccguggcgacgaccuucaucacccccauguuacgccacagcaucgagaacuccucugucaacgugucccugaccgcgaucgcgaaccaggccacggucuugauggggcuggggaagggauggccucugagcaagauggacaucggggucccauuacuggccaucggcugcuacucccaaguuaaucccaucaccuugaccgccgcgcuccuguuacucguggcccacuacgccaucaucgggcccggucugcaggccaaggcuacccgggaggcgcagaagcgcgccgccgccggcaucaugaagaaccccacggucgacgggaugaccgugaucgacuuagaucccaucccguacgaccccaaguucgagaagcagcucggccaggugaugcuuuuaguccucugcguaacccaggugcugaugaugcgcacaacuugggcucugugcgaggcucucacccuggccaccgggcccaucagcacccugugggagggaaauccaggucgcuucuggaacaccaccauugccgucucgauggccaauauuuuccgcggcagcuaccuugcuggcgcagggcugcuguucucaaucaugaagaacacagcgaauacccgccgcggcacggggaacaccggugagacccucggcgagaaguggaagaaccggcugaacgccuuggguaagagugaauuccagaucuacaagaagucuggcauccaggagguugaccgcacccuggccaaggaagggaucaagcggggcgagacggaccaccacgcggugagccgcggguccgccaaacugcgcugguucguggagcgaaaccuggugaccccugaggguaagguggucgaccucggcugcgggcggggcggguggagcuacuacuguggcggcuuaaagaacgucaaggaggugaagggccugacgaagggcgggcccggccacgaggagcccauccccauguccaccuacgguuggaaccucguccgccuacagagcggcguagacgucuucuucacgccgcccgaaaagugcgacacccuacucugcgauaucggcgaguccagcccgaaucccaccgucgaggccggccggacgcugcgcgugcugaaccucguggagaacuggcugaacaacaacacccaguucugcaucaagguacugaaccccuacaugcccagcguuaucgagaaaauggaagcccugcagcggaaguacggcggggcauuggugcgcaacccccucagccggaacagcacgcaugaaauguacugggucuccaaugcgagcggcaacaucgugagcagcgugaacaugaucucacgcaugcugaucaacagauucaccaugcgccacaagaaggccaccuacgagccggacgucgaccucgggagcggcacccggaacaucgggaucgagucggaaacucccaaccuggacaucauaggcaagcgaaucgagaagaucaagcaggagcacgagaccucauggcacuacgaccaggaccaccccuacaagaccugggcguaccacgguuccuacgaaacaaagcagacggggucggcguccagcauggugaacggagugguccgccugcucaccaagcccugggacgugaucccgauggugacccagauggccaugacugacacgacccccuucgggcagcagcgggucuuuaaggagaagguggacacuagaacacaagagcccaaggaaggcacgaagaagcugaugaagaucaccgcggaguggcuguggaaggagcucggcaagaagaagacgccacggauguguacccgcgaagaguucacgcggaaagucagauccaacgcagcccugggugccaucuucaccgaugaaaacaaguggaagucggccagagaggcgguggaggacuccggcuucugggagcugguggacaaggagcgcaaccuccaccuagaagggaagugcgagaccuguguuuacaacaugaugggaaaacgggaaaagaagcugggggaguucggcaaggccaagggcagccgcgcuaucugguacauguggcugggagcccgguuccuggaauucgaggcgcugggcuuccucaacgaggaccacugguucagccgcgagaacucucuaagcggaguagaaggcgaggggcugcacaagcucggcuacauccugcgggacguguccaagaaagagggcggugccauguacgccgacgacaccgccggaugggauacgcgcauuacccuggaagaccucaagaacgaggagaugguaaccaaccacauggagggggagcacaagaagcuugccgaggcgaucuuuaaguuaacguaccagaacaaggucguccggguacagcgaccgacgccccggggcaccgugauggauaucaucucccgccgggaccagcgcgggucgggccagguggucacguauggccucaacaccuucacgaacauggaggcccaguuaauccggcagauggaaggggaggguguguucaagucaauucagcagcugacggugaaggaggagaucgccgucaagaauuggcucauucgcgugggccgugagcggcugucccgcauggccaucagcggcgaugacuguguggugaagccccuggacgaccgguucgccagugcgcugacggcguugaacgacaugggcaaggugcgcaaggacauucagcagugggagcccagccgaggcuggaacgacuggacgcaggugccguucugcagccaccacuuccacgaacugaucaugaaggauggacgcguucucguggugccaugccggaaccaggacgagcucaucgggcgcgcccggauuagucagggcgccggguggucccugcgcgagacggccugccucggcaagucauacgcgcagauguggucccugauguacuuccaccggcgugaccugcggcuggccgccaacgccauuugcagcgccguuccgucgcacuggauccccaccagccgcaccaccugguccauccaugcgacccacgaguggaugacgaccgaggauaugcugacgguguggaaccggguguggauacaggagaacccguggauggaggacaagaccccagucgagagcugggaagaaaucccauacuuaggcaagcgcgaggaccaauggugcggaucccucaucggccucacgucccgggccacuugggccaagaacauccagacagccaucaaccaggugcgcagucugaucgggaacgaggaguacaccgacuacaugcccucuaugaagcgguucagacgcgaggaggaggaggcgggcgugcucugguga

SEQ ID NO: 24878 - RNA, 9876 nt, Artificial Sequence
  derived and/or modified CDS sequence (opt11) from DENV-2__KM279585__SS-prME
accgcggggaucauaauaaugaugauacccaccgugauggcguuccaccuaacgacccggaacggggaaccgcacaugaucgugucucggcaagagaaagguaagucucuccuguucaaaaccgagaacggggugaauaugugcacccugauggcgauggaccucggcgagcugugcgaagacaccaucaccuacaacugcccucugcuucgccaaaacgagcccgaggacaucgacugcuggugcaauagcaccagcaccuggguaaccuacgggacuugcaccgccacaggcgagcaccggagggagaagcggucaguggcauuggugccccacgugggcaugggccuggaaacgagaaccgagaccuggaugagcagcgagggcgccuggaagcaugcccagcgcaucgagacauggauccuacgccaccccggguuuacuauaauggcggccauccuggccuauacaaucggcaccacauacuuccagcguguccugauauucauacuucugacggccgugacccccagcauggcgaugcgcugcaucgggaucuccaaccgcgauuucguggagggcguuuccggagggucauggguggauauaguucuggagcacggcuccugcgucacgacaauggccaagaacaagccgacguuagacuucgaguugauaaagaccgaggcaaagcaccuggccacacuccgcaaauacugcguggaggccaagcugaccaacacgaccaccgcgagccggugccccacccaaggggagcccucgcuuaacgaggaacaagacaagcguuucguuugcaagcacagcauggucgacaggggcuggggcaauggguguggucucuucgggaagggcgggaucgugacgugcgcgauguucacgugcaagaagaacauggaagggaagguuguccagcccgaaaaccuggaguacaccaucgugaucacgccacacagcggcgaggagaaugccgugggaaacgacacgggcaagcacgggaaggaaaucaaagucacaccccaauccuccaucaccgaggccgagcugacaggcuacgggacagugaccauggaaugcucgccgcgcaccggccucgacuucaacgagaugguccugcugcagauggagaacaaagccuggcuaguccaccggcaaugguuccuggaccuaccacucccuuggcugccgggcgcggacacccaggguuccaacuggauccagaaggaaacgcucgugacauucaaaaauccgcacgccaagaagcaagaugucguggugcucggcagccaggagggcgcaaugcacacagcgcugacgggcgccacagagauacagaugagcuccgggaaccuccuguucacgggccaccugaagugccgccugcggauggacaagcuccaguugaagggcaugagcuacuccaugugcaccgguaaauuuaaagucgugaaggagaucgcggagacccagcacgguaccaucgucguccgcgugcaguacgagggggacggcagccccugcaagauucccuucgagaucauggaccuugagaagcggcacgugcuaggacgccugauaacggucaauccuaucgugacugagaaggacuccccggugaacaucgaggcggagccgccauucggcgacuccuacaucaucaucggagucgagcccggacagcugaagcuguccugguucaagaaagggagcuccauaggucagauguucgagaccaccaugcgcggcgccaagagaauggcaauacugggugacacggcuugggauuucggaucacugggcggaguguuuaccaguaucggcaaggcgcuucaccagguauucggggccaucuacggagccgccuuuagcggcgucucauggaccaugaagauucugaucgggguggugaucaccuggauaggcaugaacagcagguccacgagccuguccgucagccuggugcucgucggggucguuacccuguauuugggugugaugguccaggcggacuccgggugcgugguguccuggaagaacaaggagcuuaaguguggcucggggaucuuuauaacagacaacguccauaccuggacggaacaguauaaguuucagccggaguccccuagcaagcuggccuccgccauacagaaagcacacgaggaggggauuuguggcauccggagcgugacucgccuggagaaccucauguggaagcaaaucacccccgaguuaaaccacauccugaccgagaacgaggugaaacuuacgauuaugaccggggacaucaagggaaucaugcaggccgggaaacggucauugcgcccgcagccaaccgaauugaaauauucuuggaaggcguggggaaaggccaagaugcucuccacagagcugcacaaucacacguuccucaucgacgggcccgagaccgccgagugccccaacaccaaccgcgccuggaacagccuagaaguggaggacuacggguucggcguguucaccacgaacauuuggcugaagcugaaggagaggcaggacguguucugcgacuccaagcucaugagcgcggccaucaaagacaaccgggcaguccacgccgacauggguuacuggaucgaguccgcgcugaacgacaccuggaagaucgagaaggccucuuucaucgagguaaaguccugccacuggcccaagagccacacucuguggaguaacggcgugcucgagagcgagaugaucaucccaaagaacuucgccggccccguuucccagcacaacuacagaccuggguaucacacccagacggccggaccguggcaucugggaagacuggagauggauuucgacuucugcgagggcacgaccgugguggugaccgaggacugcgguaaccgaggccccucgcugaggaccacgaccgcgagcgguaagcugaucacggaguggugcugcagauccugcacgcugccaccccuccgguaucgcggagaagauggcugcugguaugggauggagauacguccgcugaaggagaaggaagagaaccucgugaacucgcucguaacggccggacacggccagaucgacaacuucagccuuggcguccuggguauggcucucuuucuggaggagaugcugcgaacccggguggggaccaaacacgcgaucuuacugguggccgucucguucgugacccugauaacgggcaacaugucuuuccgggaccuuggucgcgugauggucauggugggggccaccaugaccgacgauaucgggaugggcgugaccuaccuggcccuguuagcggccuucaagguccggcccacguucgccgccggacugcuacuccguaagcugaccucaaaggagcucaugaugacgaccauugggaucguacugcugucccagagcacgauccccgaauccauccuggagcucaccgacgcucuggcgcugggcaugaugguccucaagauagugcggaacauggagaaguaccagcuggccgugaccauaauggccauccugugugucccaaacgccgugaucuuacaaaaugccuggaaggugucguguaccacgcucgcagucgugucgguaagcccgcugcugcugaccuccagccaacagaaggcagacuggauccccuuggcccucaccaucaaggggcugaaucccacagccaucuucuuaacgacccuuucccgcaccucuaaaaagcgguccuggccucugaacgaggcgaucauggcuguaggcauggugagcauucuggccuccagccuccugaagaacgacaucccuaugaccggcccccugguggcuggagggcucuugacggucuguuauguacugaccggucgcucggcggaccucgaacuggagcgggcggcagacgugcgcugggaggagcaggccgagaucuccggcagcucccccauccuaucaaucaccaucuccgaggacggcagcaugagcaucaaaaacgaggaagaggagcagacccucacuauccugauucggaccgggcuccucgucaucagcggacuguuccccguauccaucccgaucaccgccgccgcgugguacuugugggaagugaagaaacagcgugccgggguccucugggacgugcccuccccgccaccagugggaaaggcggagcuggaggacggggcauaccggaucaagcagaagggcauccugggguacucacagaucggugcuggcgucuacaaggaagggaccuuccacaccauguggcacgugacacgcggcgcggugcugaugcacaaaggaaagcggaucgagcccagcugggccgacgucaaaaaggaccuuaucuccuacggugggggcuggaagcuggagggcgaguggaaagagggggaggagguccagguccucgcccuggagcccggcaaaaacccgcgcgcuguccagaccaagcccgggcuguucaagaccaacaccggcacaaucggggccguuagccuagacuucucacccggcaccagcggcucucccaucguggacaagaaggggaaggucguaggccuguacgggaauggggugguaaccaggagcgggaccuaugugucugcgaucgcucagacugaaaagagcauugaggacaacccagagaucgaggacgauaucuuccgcaaaaagcggcugaccauuauggaucugcaucccggugccggaaagaccaagcgcuaccuacccgccaucgugcgcgaggcgaucaagcgcgggcugcggacccuuauccucgcccccacccgcgucguggccgcugagauggaggaggcuuuacgcggucuaccaauccgguaccagacccccgcgauccgggccgagcauaccgggcgcgaaauuguggaccugaugugccacgcaaccuucacgaugagacuucugagccccauucggguccccaacuauaacuugaucauaauggacgaggcccacuucaccgacccggccuccaucgcggcccgcggcuacauaagcacucggguggagaugggcgaggccgccgggaucuucaugacugccacgccgcccgggucucgcgaccccuucccgcagagcaacgcuccaaucauggacgaggagcgggagauccccgagcgcuccuggaacagcggacaugaaugggucacugacuuuaagggcaagaccgucugguucguacccuccauaaaagccggaaacgacaucgccgcuugccugcggaagaacgggaagaaggugauccagcugagccgcaagaccuuugacuccgaguauaucaaaacgcggaccaacgacugggauuucgucgugacuacagacaucucugaaaugggcgcgaacuucaaggccgagcgcguuaucgacccgcggcgcuguaugaagcccgucauccucaccgacggggaggagcgggugaucuuggccggccccaugcccguaacccacagcagcgcggcccagcgccgggggcgagucggccgcaacccgaagaacgagaacgaccaguacaucuauaugggggagccccuggagaacgacgaagacugcgcgcauuggaaagaggccaagauguugcuggacaacaucaacacgcccgaaggaauuauccccuccauguucgagccggagcgggagaagguggacgccaucgauggcgaauaucgcuuaagaggagaggcccguaagacauucgucgaccucaugcggcgcggcgaccugccuguguggcuggcauaucgggucgcagcagaggggauaaacuaugcggaccgccgguggugcuucgauggggucaaaaacaaccagauccucgaggaaaacguggagguggagauuuggacgaaggagggugagcgcaagaagcugaagccacgcuggcuggacgcccgcauuuauagcgauccgcucgcccugaaggaguuuaaggaguucgcggccggucggaaaucccugacacucaaucugaucaccgaaaugggccgccuaccgaccuucaugacgcagaaagccaagaacgcccucgacaaccuggcgguccugcauacagccgaggccgggggacgagccuacaaucacgcccuaagugagcugcccgagacccuggagacccuccugcugcucacucugcuggcgaccgugaccgggggcaucuuccuuuuucugaugucgggcaaagggaucggcaagaugacccuggggaugugcugcaucauaaccgccagcauccuccuaugguaugcgcagauccagccccauuggauugccgccaguauaauccuggaauuuuuccucauugugcuacuaaucccggagcccgagaagcagcgaacaccccaggacaaccagcucaccuacgucgugaucgcgaucuuaacaguggucgccgcaacaauggccaacgagaugggcuuccuggagaagaccaaaaaggacuucgggcucggcucuaucacaacacaacagcccgaaagcaacauccuggacaucgaccugcgcccggccagcgcauggacucuguacgccguggccacgaccuucaucacgcccauguuacgccauagcaucgagaacuccagcgugaacgucucccugaccgccaucgcgaaccaggcgacgguguugaugggccugggaaaaggcuggccacugucaaagauggauaucggagugccacuccuggcuauuggcugcuacucucaggucaacccgauaacccugaccgccgcccucuuacugcuuguggcccacuacgcgaucaucgggcccggccugcaggcgaaggccacucgggaggcccagaagcgcgcugcagccgguaucaugaagaaccccacaguggacgggaugacggucaucgaucuggacccgaucccguacgaccccaaauucgagaaacaguugggacaagugaugcuguuggugcugugcgucacccagguguugaugaugcgcaccaccugggcccugugugaggcccucacccuggcgacggggcccaucagcacgcugugggaagggaaccccgggcgcuucuggaauacgaccaucgccguauccauggccaacaucuuccgcggcagcuaccucgccggagcggggcugcuguuuuccaucaugaagaauaccgcgaacacccgacgcggcacagggaacacaggugaaacccucggcgagaaguggaagaaccggcucaacgcccuaggaaagagcgaguuccaaaucuacaagaaguccggcauucaagaagucgaccgcacccuagccaaagagggaauuaagcgcggcgagacggaucaccacgcugugagccgcggaucagcgaagcugcggugguucguggagcggaaccuagucaccccggagggcaagguaguugaccucggcugcgggcgggguggguggagcuacuacugcggcggacugaagaacguaaaggaggugaagggccugaccaagggcgggcccggucacgaggagccgauacccaugucaacauacggcuggaaccucguacgccugcagagcggcgucgacguguucuuuaccccacccgagaagugcgacacccuguugugcgauaucggggaguccagccccaaccccaccguggaggccggacgcacucugcgcgugcucaacuuaguggacaacuggcuaaacaacaauacccaauuuugcaucaaggugcugaacccguacaugcccagcgucaucgagaagauggaggccuuacagcggaaguacgguggggcccucgugcgcaacccccuguccaggaauagcacucacgagauguacuggguguccaacgcgagcgguaauaucguguccagcgugaauaugaucuccaggaugcugaucaaucgguucacuaugcgccacaagaaggcgaccuacgagcccgacguggaccucgggagcggcacccggaacaucgggauugaaagcgagacgcccaaccuugacaucaucggcaagcgcauagagaagaucaaacaagagcacgagacuagcuggcacuacgaccaggaccaccccuauaagaccugggccuaccacggcucguacgagaccaagcagacggggagcgccuccucuauggucaacggcguggugcgccugcuuaccaaaccgugggacgucauccccaugguaacccaaauggccaugaccgauacgaccccuuucgggcagcagcgggucuucaaggagaaaguggacacacgcacacaggagcccaaggagggcacuaagaagcugaugaagaucacagccgagugguuguggaaggaacucgguaagaagaagacgccaagaaugugcacacgcgaggaauuuacucggaagguccgcuccaacgcggcccucggggcaaucuucacagacgagaacaaguggaagucugcccgggaggcuguugaggacuccggcuuuugggaacugguggacaaggagcgcaaccuccaccuggaggggaaaugcgagaccugcguguacaacaugaugggcaagcgggagaagaagcucggggaguucgggaaagcgaaggguagccgcgcaaucugguacauguggcucggagcgcgguuucucgaguucgaggcucugggcuucuuaaaugaggaccauugguuuagucgcgaaaacagccugagcggggucgagggcgaggggcuacacaagcucggcuacauucugcgggauguguccaagaaggagggcggggcgauguacgccgacgacaccgccgguugggauacgcgcaucacccuggaggaccucaagaacgaggagauggugacuaaccacauggaaggggagcacaagaagcuggcugaggccaucuucaagcugacauaccagaacaaaguaguccggguacagcggccaacaccccgcggcaccguuauggauauaaucucacgccgggaccagcgcggcucuggccaaguggugaccuacgggcucaacaccuucacuaacauggaggcacaguugauccggcagauggagggggaaggcguguucaaguccauccagcagcugacggugaaggaggaaaucgccgugaagaacuggcucauccgcgucgggcgcgagcggcugucccgcauggccauaagcggugacgacugcguugugaagccccuggacgaccguuucgccuccgcacucaccgcguuaaacgauaugggcaagguccgcaaggacauacagcagugggagcccucucgaggguggaaugacuggacccaggugccauucuguucccaccauuuucacgagcugaucaugaaagacgggcgcgugcucgucgugcccugccggaaccaggacgagcugaucgggcgcgcccggauaagccagggcgccggcuggucccugagagagacggccugucucggcaaguccuacgcgcagauguggaaccugauguacuuccaucggcgcgaccugcggcucgcggcgaacgccauaugcuccgccguaccaucacacuggauccccacuucccgcaccacguggagcauccaugcgacucacgaguggaugacgacugaagacaugcuaaccguuuggaacaggguauggauccaggagaacccguggauggaggacaaaacccccgucgaauccugggaagaaauacccuaucuaggcaaacgcgaggaccaguggugcgggucgcucauaggccugacgagccgggcgacaugggcaaagaacauucagaccgccaucaaucaggugcgcucccugauugggaacgaggaguacaccgauuauaugcccucgaugaagcgguuuaggcgcgaagaggaggaggcgggcgugcucugguga

SEQ ID NO: 24879 - RNA, 9876 nt, Artificial Sequence
  derived and/or modified CDS sequence (opt11) from DENV-2__KM279525__SS-prME
accgccggcaucaucaucaugaugauccccaccgucauggccuuccaccugaccacccggaacggggaaccccacaugaucgucagccgucaggagaagggcaagucccucuuguucaagaccgagaacggagugaacaugugcacccugauggcgauggacuuaggcgagcuuugcgaggacacaaucacguacaacugcccccugcucagacagaacgagccagaggacaucgacugcugguguaacagcacuucgaccugggugaccuacgggaccugcaccgccaccggcgaacaccgacgggaaaagcggagcgucgcccuaguaccccacgugggcauggggcuggagacccgcaccgagaccuggauguccagugagggcgccuggaagcacgcccagcggaucgagaccuggauucuccgccacccaggguucaccaucauggcggccauacuggcauacaccaucggcacuaccuacuuccagcggguccucaucuucauccuccugaccgcggugaccccguccauggccaugaggugcaucgggauaagcaaucgggacuuuguggagggcgucuccggcgggagcuggguggacaucgugcuggaacacggcuccugugucaccaccauggcaaagaacaaacccacgcucgacuucgagcugaucaagacggaagccaagcaccuggccacacuccgcaaguacugcguggaggccaagcugaccaacacgaccaccgcgagucggugccccacccagggggagcccucccugaacgaggagcaggacaagcgcuucgugugcaaacacagcauggucgaccggggguggggcaacgggugcggccucuucggcaagggcggaaucguuacgugcgccauguucacgugcaagaagaacauggagggaaaggugguccagcccgagaaccuagaguacaccaucgugaucacgccccacuccggagaggagaacgcgguggggaacgacacaggcaagcacgggaaggagaucaaaguaacgccccagagcuccaucacagaggccgagcuaaccggguacggaacugugacgauggagugcagcccgcggaccgggcucgacuucaacgaaaugguguugcugcagauggagaacaaggccuggcucguccacaggcagugguuccuggaccugccccuccccuggcugcccggcgcggacacccagggguccaacuggauccagaaggagacccuggugacguucaagaacccgcacgccaagaagcaagacgugguaguucucggcucacaagaaggggccaugcacaccgcccugaccggcgcuaccgagauccagaugagcuccgggaaccuccuguucacgggccaccugaagugcagacugcgaauggacaagcuccaguugaagggaaugagcuacagcaugugcaccgggaaguuuaagguagugaaggagauagcggagacccagcacggcaccaucgugauccgcguccaguacgagggggacggaagccccugcaaaauccccuucgagaucauggaccuagagaagcggcacgugcucggacgccugaucacggugaaccccaucgucacugagaaggacucuccggucaauauugaggccgagccgcccuucggggacagcuacaucaucauugguguggaacccgggcagcugaaguuguccugguucaagaagggcuccuccaucggccagauguucgagacgaccaugaggggcgccaagcggauggccauccugggcgacacggccugggauuucgggagccugggcggggucuuuaccagcaucggcaaggcgcuccaccagguuuucggagccauuuacggcgcagcauuuagcggagugucuuggaccaugaagauccugaucggugucguaauuaccuggaucggcaugaacagccgcuccacgagccuauccgugagccugguccucguggggguugucacccuguaccugggagugauggugcaggcugacuccgggugcgucgugaguuggaagaacaaggagcuuaaaugcggaucuggcaucuuuaucacggacaacguacacacguggacggagcaguacaaguuccagccggagucccccagcaaguuggccucugccauccagaaggcccacgaggagggaaucugcggcauuagaagugucacacgccuggagaaccucauguggaaacagaucacccccgagcugaaucauauccugaccgagaacgagguaaagcucacgaucaugacaggggacaucaagggcaucaugcaggccgggaagcggucgcugcgcccccaaccgaccgagcugaaguacagcuggaaggccuggggcaaagcaaagauguugagcaccgagcugcacaaccacacguuccuaaucgacggccccgagacugccgagugccccaacaccaaccgggccuggaacagcuuggaggucgaggacuauggguucggcgucuucaccacgaacauauggcugaagcugaaggagcgccaggacguguucugcgauuccaagcuaaugagcgccgcgaucaaggacaauagagccguacacgccgacaugggguacuggaucgaguccgcccuuaacgacaccuggaagaucgagaaggcuagcuucaucgaggucaaguccugccauuggcccaagucucauacccugugguccaacggcgugcucgagucagagaugaucaucccuaagaacuuugcgggccccgugucccagcacaacuaccgccccggguaccacacccagacagccggaccguggcaccuggggcggcuggagauggacuucgacuucugcgagggcaccaccguaguagugaccgaggacugcgggaaucgcggcccgucucuacggaccacgaccgcuucgggcaagcugaucacggaauggugcugccgcucgugcacccugccgccacuccgguaccgcggcgaggacggcuguugguacggaauggagauccggccccucaaggagaaggaagagaacuuagucaacagccucgugacggccggccacgggcagaucgacaacuucucccugggcgugcugggcauggcucucuuccuggaggagaugcuucgcacacgggucgggaccaagcacgccauacuccuuguggccguguccuucgucaucuuaaucaccggcaacaugucguuccgcgaucucgggcgcguuauggugauggugggagccacgaugaccgacgacaucgggaugggcguaacguaccuggcccugcucgcggccuucaaagugcggcccaccuucgccgccggccugcugcuccgcaagcugacgagcaaggagcucaugaugaccaccaucgggaucguacuuuuaucccagagcacgauucccgagaauauccuggagcucacggacgcucuggcgcugggcaugauggugcucaaaaucguucggaacauggagaaguaucagcuggccguaaccaucauggccauccugugcgucccuaacgcggugauccuacagaacgccuggaaggucaguugcaccacccuggcgguggucuccguguccccgcuccuccugacgagcucccagcagaaagcagacuggaucccccuagccuuaaccaucaagggccucaaccccaccgccaucuuccugaccacgcucagccgcaccuccaagaagcggagcuggccgcugaacgaggccaucauggccguuggcauggucuccauauuggccagcucccuccugaagaacgacauuccgaugaccgggccacugguggcugggggacucuugaccguauguuacguccugacggggcgcagcgccgaucucgagcuggagcgggcggccgacgugcgcugggaggaacaggccgagaucagcggcuccagccccauccuauccauaaccaucuccgaggacggauccaugaguauuaagaacgaggaggaggagcagacccuuacaauacugauccguacgggccugcucgugaucuccggccuguuccccguuagcaucccaauuacagccgccgcuugguaccugugggagguuaaaaagcagcgcgcaggaguacucugggacguccccagcccgccgcccguggguaaggccgagcuggaggacggggccuaccggaucaagcaaaaaggcaucuuaggguacagccagaucggugccggcguguauaaggagggcaccuuccacaccauguggcacgucaccaggggcgcgguacucaugcauaagggcaaacgcauagagccauccugggccgauguuaagaaagauuuaaucagcuacggcgggggguggaagcuggaaggcgaguggaaggagggagaggagguucaggugcucgcccuggagccuggcaaaaacccaagggccguacaaacgaagccuggguuguucaaaaccaacaccggcaccaucggggccgucagucucgacuucagcccaggcacguccgguagccccaucgucgauaagaagggaaagguagucggucuuuaugggaauggcgucguaacccgguccggaaccuaugucucagcgaucgcccagaccgaaaaguccauugaggacaacccggagaucgaggacgacaucuuccgcaagaagaggcucacgaucauggaccugcacccuggugccgguaagaccaagcgcuaccuccccgcuaucgugcgggaggcgaucaagcgcgggcugcguacccugauccucgcacccacccgcguggucgccgccgagauggaggaggccuugcgggggcugccaauucgguaccagacgcccgcgaucagagccgagcacaccgggcgggagauaguggaccucaugugccaugccacguucaccaugcgccuacuguccccuaucagaguaccaaacuacaaccucaucauaauggacgaggcacacuucacggaccccgcuagcauagcagcccgcggcuacaucuccacccgggucgagaugggcgaggccgccggaaucuucaugacagccacgccgcccggcagccgcgaccccuucccgcaguccaaugcccccauuauggacgaggagcgggagauccccgagcgcuccuggaauuccggucacgagugggugacggauuucaagggcaagaccgucugguuugucccaagcauaaaggcugggaacgacaucgccgcgugccugcggaagaacggcaagaaggugauccaacugucccgcaagaccuuugauagcgaguacaucaagacccggacgaacgacugggacuuuguggugaccaccgacaucagcgagaugggugcgaacuucaaggccgagcgcgugauagacccgcggcgcugcaugaagcccguaauccucacggacggggaggagcgugucauccuggccgggccuaugccugugacgcacagcuccgccgcucaacgccgggggcgcgucggccgcaacccgaagaacgagaacgaccaguauauuuauaugggugagccccuugagaacgaugaggacugcgcgcacuggaaggaggccaagaugcuccuggauaacaucaacacgcccgagggcaucauccccagcauguuugagccggagcgggagaaggucgacgccaucgacggcgaguacaggcugcgcggggaagcccgcaaaaccuucguagaccucaugaggcgcggcgaccuacccgucuggcuggccuaccgaguggcggccgaggggaucaacuacgccgaccgccgcuggugcuucgacggcgugaagaauaaccagauacucgaggagaacgucgagguggaaauauggacaaaggagggugaacgcaaaaaacugaagcccagauggcuggacgcccggaucuacuccgacccgcucgcacuaaaggaguucaaagaguucgcggcgggccgcaaaagcuugacgcucaaccugaucaccgagaugggcaggcugcccaccuuuaugacccagaaagcaaagaaugcccucgacaacuuagcgguguugcacacagccgaggccgggggccgggccuacaaccacgcgcucuccgagcuccccgaaacccuggagacccuccugcuacucacgcugcuggcaacgguuaccgggggcauauuccuauuccugaugagcggcaaggggauaggcaagaugacccuggggaugugcugcaucaucacagcuucuauccuccugugguacgcccaaauccagccccacuggauagccgcuagcauaauucuggaguucuuucucaucguuuugcugaucccggaacccgaaaagcagcgaacgccccaagacaaccagcucacguacguggucaucgcgauccucaccgugguggcagcgacaauggccaacgagaugggcuucuuggagaagacaaagaaggauuucgggcucggcuccaucacgacgcagcagcccgaguccaacauccuggacaucgauuugcggccggcaucagccuggacccuauacgccguggccaccacuuucaucacaccaaugcugcgacacuccaucgagaauagcucggugaacgugucccugaccgccaucgccaaccaggcgaccguccucaugggccuggggaaaggcuggccccuguccaagauggacaucggcguaccauuacuggcgaucgguugcuacagccaggugaacccuaucacguuaacugccgcccuccugcuuuuagucgcgcacuaugcgaucauagggccgggcuuacaggccaaggcgacccgagaggcccagaaacgcgcggccgcgggaaucaugaagaacccuaccguggacgggaugacgguaaucgauuuagaccccaucccguacgaccccaaguucgagaaacagcuuggucaggucaugcugcugguucucugcgugacccagguacuuaugaugcggaccaccugggcccugugugaggcccucacgcuggcaaccggacccauuuccacccugugggaaggcaaucccgggcgcuucuggaauaccacgauagccgucuccauggccaacaucuucaggggaucguaccucgcgggugccgggcugcuauucagcaucaugaaaaacacggcgaacacccgccgcggcaccgggaacacgggcgagacguugggcgagaaauggaaaaaccggcugaaugcacuagggaaguccgaauuucaaauuuacaagaaguccggcauccaggaaguggaccgcacccucgcuaaggaggggauuaagcggggagagaccgaccaccacgccgucucucgcgggagcgccaagcugcggugguuuguggagcgcaaccucgugacgccggagggaaaggucgucgaccucggcugugggaggggcgggugguccuacuacugcggcgggcugaagaaugugaaggaggucaagggucugacuaagggcgggccuggccacgaagagcccauccccaugagcacauacggguggaaucucgugcgccugcaguccggcguggacgucuucuucaccccgccugaaaaaugcgacacgcugcucugcgacaucggggagagcucccccaaccccaccguggaggcuggccgaacuuugcgcgugcugaaucucgucgagaacuggcugaacaacaacacccaguucuguaucaaggugcugaacccguauaugcccagcgugaucgaaaagauggaggcccugcagcggaaguauggcggggcccuaguccgcaacccgcugagccgaaacuccacccacgaaauguacugggugucuaaugccuccggaaacaucguaagcuccgucaacaugaucagccgcaugcugaucaaucgauucacgaugcgccacaagaaggcgaccuacgagccggacguggaccucggguccggcacccggaacaucgggaucgagagcgaaacccccaaccuagacaucaucggcaagcgcaucgaaaagaucaagcaggagcacgagacguccuggcacuacgaucaggaccaucccuacaagaccugggcguaucacggcagcuacgagaccaagcagaccgguuccgcuagcuccauggugaacggugucguccggcuguuaacgaaacccugggaugugauccccauggucacccagauggccaugaccgacaccacgccauucgggcagcagcggguguucaaggagaaggucgauacccgcacgcaggaacccaaggagggcaccaagaagcugaugaagaucacggccgagugguuauggaaagagcucggcaagaagaagacgccccggaugugcacgcgcgaggaguucacccggaaggugcgcucuaacgcggcccugggggcgaucuuuacggaugaaaacaaguggaaguccgccagggaggccguggaggacagcggcuucugggaguuagucgacaaggaacgcaaccuccaccuggaagggaagugcgagacuugcguguauaacaugaugggcaagagggagaagaagcugggggaguucggaaaagcgaagggcucccgcgccaucugguauauguggcucggggcccgguuccuggaguucgaggcacugggcuuccucaaugaggaccacugguucagccgcgagaacucccugucuggugucgagggggaggggcugcacaagcucgguuacauccugcgggauguuagcaaaaaggagggaggggcgauguacgccgacgacaccgcuggcugggacacccgcaucacgcuggaggaccucaagaacgaggagauggugacgaaccacauggagggggagcacaaaaagcuggccgaggccaucuucaagcugacauaucagaacaaggugguccggguacagagaccgacgccucggggcacagugauggacaucaucucccgccgggaccaacgcggcagcgggcagguggugaccuacggcuuaaacaccuucaccaacauggaggcucagcugauccggcaaauggagggggagggcguguucaaauccauacagcagcugacggucaaggaggagaucgccgugaaaaacuggcugauacguguggggcgcgaacggcugagccguauggccaucucuggcgacgacugcguaguuaagccccuggaugaccguuucgccagcgcccucaccgcucugaacgacaugggcaaggugcggaaagacauccaacagugggagcccucccggggguggaaugacuggacccaggucccguucugcagccaccacuuccacgagcugaucaugaaggacggaagagugcucgugguccccugccgaaaccaggacgagcugaucgggcgcgcccggaucucccagggcgccggguggucccugcgcgagaccgccugccucggcaaauccuacgcccagauguggucacugauguauuuccaucggcgcgaccugcggcucgcagccaacgccaucugcucugcuguucccucccacuggauccccacgucccgcaccacguggucgauccacgcgacgcacgaguggaugaccacggaggacaugcugaccguguggaaccgggucuggauccaggagaacccguggauggaggacaagacccccguggagucuugggaggagauacccuaccugggcaagcgcgaggaccaguggugcgggagcuuaaucggacugaccagccgggcgacgugggccaagaacauccagacagccaucaaucagguucggucacuuaucgggaacgaggaguacaccgacuacaugcccagcaugaagcgguuccgcagagaggaggaggaagcuggcgugcugugguga

SEQ ID NO: 24880 - RNA, 9876 nt, Artificial Sequence
  derived and/or modified CDS sequence (opt11) from DENV-2__KM279528__SS-prME
acagcgggcaucauaaucaugaugauccccaccguaauggccuuucaucuaaccacccggaauggggaaccccacaugauuguaagccggcaggaaaagggcaagagccuccucuuuaagacggagaauggggugaacaugugcacccugauggcgauggaucucggcgagcucugugaggacaccaucaccuacaacugucccuugcuccgccagaacgagcccgaggacaucgacugcuggugcaauaguacaagcaccugggugaccuacggaaccugcaccgccaccggcgagcaccggcgcgaaaagcggagcguugcccugguuccccacgucgguauggguuuggagacgcgaaccgagaccuggaugagcagcgaaggugccuggaaacacgcacaacggaucgagaccuggaucuugagacaccccggguucacgauaauggcggccauccuagccuauaccaucggcaccaccuacuuccagcggguccugaucuucauccucuugacggcggugacccccucaauggcgaugagaugcaucgggauuagcaaccgggacuuuguggagggcgucuccggagggagcuggguggacauagugcuggagcacggcucaugcgucacgaccauggcgaagaacaagccuacgcucgacuuugaacugaucaagaccgaagccaagcaccuagcuacgcuccgcaaguacuguguggaggcuaagcugacaaacacgaccaccgcgagccggugucccacacagggggagccaucccugaacgaggagcaggacaagcgcuuuguguguaagcacucgauggucgaccggggcuggggcaacgggugcggccuauucgggaaaggagggaucguuacaugcgccauguucacgugcaagaagaacauggagggcaaggugguacagccggaaaaccuggaguauacuaucgugauaacuccccacucgggcgaggagaaugccgucgggaaugacacgggcaagcacgggaaggagaucaaagucaccccgcagagcuccaucaccgaggccgaguugacgggauacgggacuguuacgauggagugcucuccucgcaccggccucgacuucaacgaaaugguccugcuacagauggagaacaaggcuuggcucguccaccgccagugguucuuagaccugccccuccccuggcugcccggcgcggauacucagggguccaacuggauucaaaaggaaaccuugguaaccuuuaagaacccccaugccaagaaacaggaugugguggugcucggcagccaggagggggcgaugcacaccgcccugacgggcgcaaccgaaauccagaugucgagugggaaucuccuguucacggggcaccugaagugccgacuccggauggacaaacuccagcugaaggguaugagcuacaguaugugcaccgguaaguucaagguagugaaggaaaucgccgagacacaacacggcaccaucgugaucaggguccaguaugagggggacgggagccccugcaagauucccuucgagaucauggaccuggagaaacggcacguccuaggccgccugauuacggugaaccccaucgugacugaaaaagacucgccaguaaacaucgaggcagagccgcccuucggagacagcuacaucauaaucggaguggaacccgggcaacucaagcucucuugguucaagaagggcagcaguaucgggcagauguuugagacuaccaugcgcggagccaagcgaauggccauccucggcgacacugccugggacuucgggagccucgggggcgucuuuaccuccaucggcaaggcguuacaccaaguguucggggccaucuacggugccgcguuuucuggcgugaguuggaccaugaagaucuugauugggguugugaucaccuggaucggcaugaacagccgguccacgagcuugucggucagcuuaguucucguggggguggucacccuguaccuuggagugauggugcaggcugacuccgggugcgucgucucauggaagaacaaggagcucaaaugcgguucuggcaucuucaucaccgacaacgugcacaccuggacagagcaauauaaguuccaaccggaaucgccgagcaagcuggccucggccauccagaaggcccacgaggaggggaucugcggcauccggagcgucacacgacuggaaaaccucauguggaagcagaucacuccagaguuaaaccacauuuuaaccgagaaugaggugaagcucacgaucaugacuggggauaucaagggcaucaugcaagccgggaaacggucccugcguccgcaaccgacugagcugaaguacagcuggaaggcauggggcaaagccaaaaugcucuccaccgaacugcacaaccacacguuucugaucgacggacccgagaccgcggagugccccaacacuaaccgagcauggaacagcuuagagguugaggacuacggguucggcgucuucacuacuaacaucuggcuaaaacugaaggagcgccaggauguguucugcgacuccaagcucaugagcgcugcgaucaaggacaaccgcgccgugcacgcagacaugggcuacuggaucgaguccgcucugaacgacacauggaaaauugagaaggccagcuuuauagaggucaaauccugccacuggcccaaaagccacacccucugguccaacggugugcucgagagcgagaugaucauccccaagaacuucgcaggccccgugucccaacauaauuaccgccccggguaucacacccagacugcaggcccguggcaccuugggcggcuggaaauggacuucgauuucugcgaggggacgacuguuguggugacagaggacugcggcaaccgcggcccuucgcuacgaaccacaaccgcaucaggcaaacuuaucaccgaguggugcugcagguccuguacccugccgccgcuccgguaccgcggggaagacggcuguugguauggaauggagauccggccgcugaaggagaaggaggagaaccuggucaacagccucgugacggccggccacgggcaaaucgacaacuucucuuuaggcgugcuaggcauggcccucuuccuggaggagaugcucaggacccgcgucggcaccaagcacgccauucuccuuguggccgugucuuuugucaccuuaaucacaggaaacauguccuuccgugaccucggccguguuaugguuauggucggcgccaccaugacagacgauaucgggaugggcgugaccuaccuggcccuguuagcggccuuuaaggugaggcccacuuucgccgccgggcugcugcuacgcaaacugaccucaaaggagcugaugaugaccaccaucgggaucguucuccuaucccagucuacgauccccaaguccauucuggaauuaaccgaugcccuugcguuaggcaugaugguguugaaaaucgugcgaaacauggagaaguaccagcucgcuguuacuaucauggccaucuuguguguucccaacgcagucauuuugcagaacgccuggaaagugaguuguacgacuuuggcaguggucuccguuagcccgcuccuauuaaccagcucucagcagaaggccgacuggaucccauuggcccugacgaucaagggacugaacccgaccgcuauauuccugacgacccucagccgcacgucaaagaagcgguccuggccccucaacgaggcgaucauggccguggggauggucagcauacuagccucgagccugcuaaagaacgacaucccgaugaccggcccccugguggccgggggccuccugaccgucugcuacguccugacggggcggucagccgaucucgagcuggagcgcgcggcggacgugcgcugggaggagcaggccgagaucuccggcaguucaccuauccuauccaucaccauuagcgaggacggaagcauguccaucaagaacgaggaggaagaacagacccucacgaucuuaaucaggaccggucugcuugugaucagcggccuguucccagucucuaucccgaucacggccgccgcgugguaccucugggaagucaagaagcagcgcgccggggugcucugggacguccccuccccgccgcccgugggcaaggcagaacuggaggauggugccuaccggauuaagcagaaggggauucucggguacucccagaucggcgccgguguauauaaagaggggacuuuccauaccauguggcacgucacgcgcggggcggugcucaugcacaaggggaagcguaucgaaccuucaugggccgacgugaagaaggaccugaucuccuauggcgggggcuggaagcucgagggagaguggaaggaaggggaagaaguacagguguuagcucuggaaccagguaagaauccgcgugccgugcagaccaaacccgggcuuuuuaagaccaauaccggcacgauuggggccgucagucucgacuucucaccaggcaccagcggauccccuaucguggacaaaaagggaaaaguggucggacuguacggaaacggaguggugacccggagcggcaccuacgucucagcgaucgcccagacggaaaaguccaucgaggacaacccagagaucgaggaugauauuuuucgcaagaaacgacugacgauaauggaccugcaccccggggcaggcaagaccaagagguaucuccccgcuaucguucgggaggcgaucaaaagagggcuacggacccugauucucgccccgacucgcguggucgcagccgaaauggaggaggcccugcgcgggcugccuauccgauaccagacucccgcgauucgugccgaacacacugggcgggagaucguggaccucaugugccaugccaccuucaccaugagacugcugucccccauccgggugccgaacuacaaccucaucaucauggacgaggcccacuucaccgacccggcuuccaucgcggcccgcggcuauauuagcacgcggguagagaugggagaagccgccggaauauucaugaccgccaccccuccaggcucccgcgaccccuuuccgcagagcaaugcgccuaucauggacgaggagcgggaaaucccggagcgcucauggaacucugggcaugaguggguaaccgacuucaagggcaagacuguuugguucguacccuccaucaaagcugggaacgacaucgccgccugccugcggaagaacggcaagaaggugauccagcugucacgaaagacguucgacucagaguacaucaaaacgcggacgaacgauugggacuucguugucaccaccgauaucagcgaaaugggcgcgaacuuuaaggcggagcgcgugauagacccgcggcggugcaugaaaccggugauacucacugacggggaggagcgggucauccuggccggccccaugccagugacccacuccagcgccgcucagagacgggggagaguggggcgcaacccgaagaacgagaacgaucaguauauuuauaugggagagccuuuggagaacgacgaggacugcgcgcacuggaaggaggcuaaaaugcuccuggauaacauaaacacgccugaagggaucauccccuccauguucgaaccagaaagagagaaggucgacgcuaucgauggcgaguacagguuacgcggugaggcccguaaaaccuucguggacuuaaugcggagaggggaccuacccguuuggcuagccuauagagucgccgccgaggggaucaacuaugccgaucgucggugguguuucgacggcgugaagaacaaucagauccucgaggagaacguagaaguggaaaucuggacgaaagagggugaacgcaagaaacucaaaccgagauggcuggacgcccgcaucuacagcgacccgcucgcccugaaagaguucaaagaguucgcggccggacgcaaaucccuaacccugaacuuaauuaccgagaugggccgcuugcccaccuuuaugacgcagaaggccaaaaacgcccucgacaaucuggcggugcugcauaccgccgaggcaggcggccgugcuuacaaccacgcccuuagcgaguugcccgaaacucuggaaacucuccuccuguuaacgcuguuagcuacagugaccgggggcaucuuccuguuccuaauguccggcaaggggaucggcaagaugaccuuagggaugugcugcaucauuaccgccagcauacuccuaugguacgcccagauccagccccacuggaucgccgccucgaucauccuggaguucuucuugaucgugcugcugauucccgagccugaaaagcaacgcacuccucaggacaaucagcucaccuauguugucaucgcgauacugaccguuguggccgcaaccauggccaacgagaugggcuuccuggagaagacgaagaaggacuucgggcuaggaagcaucaccacccaacaaccugagucaaacauacuugacaucgaccugcggcccgccuccgcguggacacucuacgccgucgccacgaccuuuaucacccccaugcugcgccacagcaucgagaacuccagcgugaacgugucacuaaccgccauugccaaccaggcgacgguucuaaugggcuuggggaagggcuggccucugagcaagauggauaucgggguaccccuccuggccaucggcugcuacucccaggucaacccgauuacgcugacugccgcccucuugcuauuaguugcucacuacgcgauaaucgggccgggccugcaagccaaggcgacccgagaagcccagaagcgcgcugccgccggcauuaugaaaaauccaaccguggaugggaugaccgugauagaccuagaccccaucccguaugacccgaaauuugagaaacaacucgggcagguuaugcuguuagugcugugcguuacccagguccugaugaugcggaccacaugggcguuaugcgaggcccucacucuggcaacggggcccaucaguacacugugggagggcaaccccgggcgguuuuggaacacaaccaucgccguguccauggcaaacaucuuccgcggcagcuaucucgccggcgccgggcugcuguucucuauuaugaagaauaccgcaaacacucggcgcggcaccggcaacacgggcgaaacccucggggaaaaguggaagaaucgguuaaacgcccugggcaaaucugaguuccagaucuacaagaagucuggcauucaggagguggaccgcacacucgccaaggagggcauuaagcggggcgaaacggaucaucacgccgucucacgcggguccgcgaaacugcggugguucguggagaggaaccuggugacaccagagggcaaggucguggaccucggcugcgggcggggcggcuggagcuacuacuguggcggguugaaaaauguaaaggaggucaaggggcugaccaaaggcggucccggccacgaggagcccauacccauguccaccuacgguuggaaucucguccgccugcagagcgggguugacgucuucuuuacgccgccugagaagugcgauacccugcucugcgauauaggggagucgagccccaaccccaccguggaggccggccggacccugcgcgugcucaaccuagucgaaaacuggcugaacaacaacacccaauucugcauaaaagugcuaaauccguacaugcccagugugaucgagaagauggaggcccugcagaggaaguacggcggggcgcuuguccgcaacccccugucgagaaacagcacgcaugagauguauugggugucgaacgcgagcgguaacauugugucuagcgucaacaugaucucccguauguuaaucaaccgguucaccaugagacauaagaaggcgacuuacgaaccggacguagaccuuggaagcggcacgcgcaacaucgggauagaauccgagacgcccaaccuagacaucaucggcaagcgcauagagaagauaaagcaggagcacgagacgucuuggcacuacgaccaggaccacccauacaagaccugggcguaccacggcuccuaugagaccaagcagacagggagcgcuaguaguauggugaacggcgucgucagacugcucaccaaaccuugggacgugauuccgauggucacccaaauggccaugaccgacacgacgcccuucggacagcagaggguguucaaagagaaggucgacacacgcacccaggagcccaaggaagggacaaagaagcugaugaagaucaccgccgaguggcuuuggaaagaacucggcaaaaagaagacgccgcggaugugcacgcgcgaggaguucacgcggaaggugcgcuccaaugcggcucuuggggcaaucuucacagacgaaaacaaguggaaaucagcccgggaggccguggaagacuccggcuuuugggaacuggucgauaaggagcggaaucuacaccuggaggggaagugcgagaccugcguguauaacaugaugggcaagcgcgagaagaagcugggggaguucggcaaggcgaaggggagccgcgccaucugguacauguggcucggggcccgguuucuggaauuugaggcucugggcuuccugaaugaggaucacugguuuucccgcgaaaauagccugagcgggguugaaggcgaagggcuacacaaguuaggcuacauacuacgggacguauccaagaaggaaggaggggcgauguacgccgaugacaccgccggcugggacacgcgcauaacccuggaggaccuuaaaaacgaggaaaugguaaccaaccacauggaaggggagcacaagaaacuggccgaagcuaucuucaaacugacuuaccagaacaaggugguccgggugcagaggccgacgccacggggcaccgugauggacauaauaagccgccgggaccagcgcgggucgggccaaguagugaccuacggccucaacaccuucacgaauauggaggcgcagcugauacgacagauggagggggaaggcguauucaagagcauacagcaguugaccgucaaggaggagaucgccgugaagaacuggcuuauccgcgucgggagagaacgccucucccgcauggccaucucuggugacgacugcgucgugaagccccuggaugaucgguucgccuccgcguuaacagcucugaaugacaugggcaaggugcggaaggacauccaacagugggagcccagccgcggguggaacgacuggacccagguccccuuuuguucccaccacuuucacgagcucauuaugaaagacggccgugugcucgugguaccgugucggaaccaggacgaguugaucgggcgcgcccggauaagccagggcgcaggaugguccuugcgcgagacugccuguuugggcaagagcuacgcgcaaauguggucccucauguacuuccaccggagagaucugcggcucgcggccaacgcuaucugcuccgcggugcccucccacuggauacccacuagccgaacaacguggucgauccacgcaacacacgaguggaugacgacggaagauauguugaccguguggaaccgcgucuggauccaggagaacccguggauggaagacaagacccccguugagagcugggaggaaauucccuaccugggcaagcgcgaggaccaauggugcgguucgcucauugggcugacaucgcgggcgaccugggccaagaacauccagacggccaucaaccagguccgcagccuaaucgggaaugaggaguacaccgacuacaugcccagcaugaagcgguuccggcgcgaggaagaggaggcuggcguguugugguga

SEQ ID NO: 24881 - RNA, 9876 nt, Artificial Sequence
  derived and/or modified CDS sequence (opt11) from DENV-2__KM279533__SS-prME
accgcggggaucaucaucaugaugaucccuaccgugauggccuuccaccugaccacccggaacggagagccccacaugauagucagucggcaggagaaaggcaaaagccuccuguucaagacagagaacggcgugaacauguguacccugauggccauggaccucggcgaacugugugaggacacuauuaccuauaacugcccgcugcugcgucagaacgaacccgaggacauagacugcuggugcaacagcacaucaacaugggugacauacgggacgugcacagcaacgggcgagcaccggcgcgagaagaggagcgucgcguugguaccccacgugggcaugggucuggagaccaggaccgagaccuggaugucgagcgaaggugccuggaagcacgcccaacguaucgagaccuggauucuccgccaccccggguucacgaucauggcggcgauucuggccuacaccauuggaaccacuuacuuccagcggguccuaaucuucauccuccugacggcuguuacccccuccauggcgaugcgcugcauugguaucagcaaccgggacuucguugagggcguaucaggcggcaguugggucgacauagugcuagagcacggguccugugugaccacuauggccaagaacaagcccacgcucgauuucgagcuaaucaagaccgaggccaagcaccucgccacccuccgcaaguacugcguggaggccaaguugaccaacacgaccaccgcgucgcggugccccacccagggugaacccucccuuaaugaggagcaggacaaacgcuucguuugcaagcacucuauggucgaccggggcuggggcaacggguguggccucuucgggaaaggcggcaucgugacgugugcaauguucacgugcaaaaagaacauggaaggcaaggugguccagcccgaaaaccuggaauauaccaucgucaucacuccucauuccggagaggagaacgcaguggggaacgauacgggaaagcacgggaaggaaaucaaggucaccccccagucuuccauaaccgaggcggaacugacuggcuacgggaccgugacgauggagugcagcccgagaaccggucucgacuucaacgagauggugcugcugcagauggagaacaaagccuggcucguccaccggcagugguucuuggaccugccccuccccuggcugcccggcgcggauacccaagggucgaacuggauucagaaggagacgcuggugacguucaaaaacccgcaugccaagaagcaggacguggugguacugggcagccaagagggcgccaugcacaccgcccuaaccggcgccaccgaaauccagaugucguccgggaaccuccuuuuuacgggccaucugaaaugccgccucagaauggacaagcuccagcugaagggcaugucguacuccaugugcacugggaaguucaaggucguaaaggagauugcugaaacgcagcacggcacaauugugauacguguccaguacgagggggacggcagccccugcaaaauccccuucgagauuauggaccuggagaagaggcaugugcugggcaggcugaucacggugaaccccaucgucacggagaaggacuccccggugaauaucgaagccgagccgccuuuuggcgacucuuacauuaucauuggcguggagcccgggcagcugaaacucuccugguucaagaagggcagcuccauugggcagauguucgaaaccacuaugcgcggugcgaagcggauggccauucugggggacacggccugggacuuuggcucgcuaggcggggucuucacguccaucggcaaggcgcuccaccagguauucggggcgauuuacggcgccgcuuucagcggugugucauggaccaugaagauccugauagggguagugaucacguggaucggcaugaacagccgcuccacaagccugucagugagccugguccucguggguguagucacauuauaccucggcgucauggugcaagcggauaguggcugcgucguuagcuggaagaauaaagagcucaagugcggcagcggcaucuucaucaccgacaacgugcacaccuggacggagcaguacaaguuccagccugagucgcccucuaaacuagcgucggcaauccaaaaggcccacgaggaggggauaugcggcaucagaagcguuacacgccuagagaaucugauguggaagcagaucacucccgagcugaaccauauauuaaccgagaaugaaguaaagcucaccaucaugaccggggacauaaaggggaucaugcaggccgggaaacgaucacugcgcccccagccuaccgaacugaaguauaguuggaaggcauggggcaaggcuaaaaugcucuccacagagcugcacaaccauacguucuugaucgacggcccugagacugcggagugccccaauaccaaccgggccuggaacagucucgagguggaggacuauggguucggcguuuucacuaccaauaucuggcucaagcuaaaggagcgccaggauguguuuugugacuccaagcucaugagcgccgcgaucaaggacaaccgggcagugcaugccgacaugggauacuggaucgaaucagcccugaaugacaccuggaagaucgagaaggccucauucaucgaggucaaguccugucacuggcccaaaucccacacccuguggucgaacggggugcuagagagcgagaugaucauaccgaagaacuuugcaggccccgugucccagcacaauuaccgcccuggguaucacacccagaccgcuggcccguggcaccucgggcggcuggagauggacuucgacuuuugcgaagggacgaccguagugguuaccgaggacugcgggaaccguggccccagccucagaacaacgacagccagcggcaagcugaucaccgaguggugcugccgcucaugcaccuuaccgccccuccgguaccgcggagaagacggcugcugguacgggauggagauccggccccugaaggagaaggaggagaacuuaguaaacagccucgugacggcuggccaugggcagaucgacaacuucucccugggcgugcuuggcauggcccucuuccucgaagagaugcugcgcacgagagucggaacuaagcacgccauccuccuaguugcugugagcuucgucacguugaucacgggcaacauguccuucagggaccucgggcgcguaaugguaauggucggcgcgacaaugaccgacgacaucgggaugggcgugaccuaccuagcacugcucgcggccuucaaggugcggccaacuuuugcugccggccugcugcuccgcaaacugaccagcaaggaguuaaugaugaccaccaucggaaucguacucuuaucccaguccaccaucccggagucuauccuggaacucacagacgcauuggcccugggcaugauggugcucaagaucguccggaauauggaaaaguaccaacuggccguaaccauaauggccauccugugcgugcccaacgccguaaucuuacaaaacgccuggaaggugagcugcaccacgcuggcgguggucuccgugagcccgcugcuccugaccuccucacaacagaaggccgauuggauacccuuagcccucaccaucaagggucuaaacccgacugcuaucuuccuuacaacccugucccgcacgagcaagaagagauccuggccacugaaugaggcgaucauggccguggggauggucagcauacucgccuccagcuugcugaagaaugacaucccgaugaccggcccccugguagccgguggccucuuaacgguguguuauguacugaccggacgcagcgcugaccuagaguuagagcgggcagccgacgugcgcugggaggagcaggccgagaucucgggcagcuccccgaucuugagcauaaccauauccgaggacgggucaauguccaucaagaacgaggaggaagagcagacccucacuauucugauuaggaccggccugcucgugaucagcggguuauuccccgucuccaucccuaucaccgccgccgcgugguaccugugggaaguaaagaagcagcgcgccgggguacucugggauguccccaguccgcccccagucggcaaggccgagcucgaggacggggcuuaccguaucaagcagaaagggauccugggguacucacagaucggcgcgggcguauauaaagagggcaccuuucacacgauguggcacgucacucgcggugcggugcucaugcacaaggguaagcggaucgagcccucaugggcugacgugaagaaggaucugaucaguuacggcggcggguggaaguuagagggcgaguggaaggagggcgaggaggugcagguacucgcccuggagccgggcaagaacccgagagcgguucagaccaaacccgggcuguucaagaccaauacaggcacgaucggggccgucagcuuggauuucucccccgggaccucgggcucccccauagucgacaagaaggggaaaguggugggccuguaugggaacggcguggugacacggagcggcaccuacgucuccgcgaucgcgcaaacggagaaguccauugaggacaaccccgaaaucgaagacgacaucuuccgcaagaaacggcucacgaucauggaccugcaccccggggcaggcaagaccaagcgauaucuacccgccaucgugcgugaggcgaucaagcgcgggcuucggacauuaauucuugcccccacgcgcguggucgcugcagagauggaggaggcacugcgcggccuaccaauccgguaccaaacccccgccauccgagcggaacacaccgggcgugagauugucgaccucaugugccacgccaccuuuacgaugcgccugcugagcccgauucgggucccgaacuacaaccucauuaucauggacgaggcccacuucaccgacccggccagcaucgcugcacgcgguuacaucagcacccgagucgagaugggcgaagccgccggaaucuucaugaccgccacgccucccggcucacgcgaucccuucccccagagcaacgcgcccaucauggacgaggagagggagauccccgagcgcucguggaacagcgggcacgagugggugaccgacuucaagggaaagaccgugugguucguacccuccaucaaggccgggaacgacauugccgccugucugcggaaaaacggcaagaagguaauccagcugagccguaagaccuucgacuccgaguacauaaaaacacggacgaacgacugggauuucguggucaccacagacaucagcgagaugggagcgaacuucaaggccgaacgcguuauagauccgcggcgguguaugaagcccgugauccuuaccgacggggaagagcgggucauccuugccggccccaugccgguuacccacuccagcgccgcccagcgacgggggcgcgugggcaggaaccccaaaaacgagaacgaccaguacaucuacaugggggagccgcuggagaacgaugaagauugugcgcacuggaaggaggcgaagauguuacuggacaacauuaauacacccgagggcaucaucccgucuauguucgaaccggagcgggaaaaggucgaugccaucgacggcgaguaccggcugcgcggggaggccaggaagaccuuuguagaccucaugcggcgcggcgaccugccggucuggcuggccuaccgcguggcggccgaggggaucaacuacgccgaccgccgguggugcuucgacggugucaaaaauaaucaaauucucgaagagaacgucgaggucgagaucuggacaaaggagggcgaaaggaagaagcuaaaaccucgguggcucgacgcaaggauuuacagcgauccgcucgccuugaaagaguucaaggaauucgcggccggccggaagucgcuuacacucaacuuaauaacugagaugggccgcuugccaacauucaugacacagaaggcgaagaacgcucucgacaaccuggcggugcuucauaccgcggaggcggggggucgggccuacaaccaugcccucagcgaauugccagagacacucgagacucucuugcugcucacucugcuggcgaccgucaccggggggauuuuccucuuucugaugaguggcaaggggaucggaaagaugacucuggggaugugcugcaucaucaccgcgaguauccuuuuaugguacgcucagauccagccccacuggaucgccgccucaauuauccuggaguucuuccuuauugucuugcugaucccggagcccgagaagcagcgcacaccccaggacaaccaacucaccuacgugguuauugcgaucuugaccgugguggcugcgaccauggccaacgagaugggcuuccuggagaagacgaagaaggacuucggacucgggagcaucaccacucagcagcccgagagcaauaucuuagacaucgacuugcguccagccagcgcguggacucucuacgccgucgccacaaccuucaucacccccaugcugagacacucuaucgagaacuccagcgugaaugucucccugaccgccaucgcaaaccaagcgacgguccucaugggccugggcaagggcuggccccugagcaagauggacauugggguaccccuccuagccaucgggugcuacucccagguaaacccgaucacucuuaccgccgcccucuuguuacucgucgcacacuacgcuauaaucgggcccggccugcaggcaaaggccacccgugaagcccagaagcgggccgcagccgggauuaugaagaacccaacgguugacgggaugaccgugaucgaucuggaccccaucccguacgaucccaaguucgaaaaacaguuaggccaggucaugcugcugguccucugcgugacacagguucugaugaugcgcaccacaugggcccugugcgaggccuuaacccuagcgaccgggcccaucucuacccuaugggagggcaacccggggcguuucuggaacacaaccaucgcuguguccauggcaaacaucuucagaggcuccuaccucgccggggccgggcugcuguucuccaucaugaagaacacugccaauacccggcgaggcacugggaacaccggcgaaacccucggugagaaguggaagaaccggcugaacgcucuaggaaaaagcgaguuccagaucuacaaaaaauccgggauccaggagguugaccgcacgcuagcuaaggaggggaucaaacgcggcgagacagaucaccacgccgugagccggggguccgcuaagcuucggugguucguggagcgcaacuuagugaccccggaaggaaaggucguggaccucggcugcgguagaggcgguuggucauauuacuguggggggcuuaaaaacgugaaggaggucaagggccugacuaagggcgggcccggccaugaggaacccaucccgauguccaccuacggguggaaccucgugcggcugcaaaguggcguggacguguucuucacgccgcccgaaaaaugugacacccugcucugcgacauuggugagucgagccccaaccccacuguggaggccggccggaccuuacgcgugcugaaccuaguggaaaacuggcugaacaacaacacacaguucuguaucaaaguguuaaacccauacaugccauccgugauugagaagauggaggcacugcagagaaaauauggcggggccuuaguccgcaauccacugucccggaacagcacgcaugaaauguauuggguguccaacgccagcggcaacaucguauccuccgugaacaugauuucccgcaugcuaauaaaccgauucaccaugcgccacaagaaggcgaccuacgagccggacguggaccuggguaguggcacacgcaauauuggaauugaguccgagacccccaaccuggacaucauuggcaaaagaaucgagaagaucaaacaggagcacgagacgucguggcacuacgaccaggaucaccccuacaagaccugggccuaccacggcuccuacgaaacgaagcaaacggguagcgccucaagcauggucaacggcguggugcgccugcucacaaagcccugggacgugauaccgauggucacccagauggccaugaccgacacgacccccuucgggcagcagcggguguuuaaagagaagguagauacccguacucaggagccgaaggagggcacaaagaagcugaugaaaaucacugcggaguggcuguggaaggaguugggcaagaagaagacgccccggauguguacccgugaggaguuuacucggaaggugcggucgaacgcggcgcugggggccaucuucaccgacgagaacaaguggaaguccgcccgggaagccgucgaggacucaggcuucugggagcucguugacaaggagcgcaaccuccaucuggaggguaagugugagaccugcguauacaacaugaugggcaagcgcgagaagaaacucggcgaguucgguaaggccaagggcagccgugccaucugguacauguggcucggggcccgguuccuggaguucgaggcgcugggauuccucaacgaagaccacugguucuccagggagaauagccugagcgggguagaaggcgagggguuacacaaacuaggcuacauuuugcgggacgucucaaagaaggagggaggggcgauguacgcugacgacaccgccggcugggacacacgcaucacccuggaggaccugaagaacgaggaaauggugaccaaccacauggaaggagagcacaagaagcuggccgaggcaaucuucaaacugacguaccagaacaaggucgugcggguccagcgcccaacgccccggggcacugucauggacaucaucagccgacgggaccaacgcggguccggccaggucgucaccuacggcuuaaacaccuucacaaauauggaagcccaacuaauccggcagauggagggggaaggcguguucaagagcauccaacaacugaccguaaaggaagagaucgcagugaaaaauuggcucauacggguuggucgcgagcggcuguccagaauggccaucagcggcgaugacuguguagugaagcccuuagaugaccgguucgccuccgcccucacagcgcuaaacgacaugggcaaagugcgcaaggacauccagcagugggagccgucucgcggguggaacgauuggacccaggucccguucugcucccaccacuuccacgagcugaucaugaaagacggacgcgugcucgucguccccugccggaaccaagacgagcucaucgggcgugcccggauaucgcagggcgcuggguggucacugcgcgagacggccugccucggcaagagcuacgcccagauguggucccugauguacuuucacaggcgcgacuuacggcuggcugcaaaugccaucugcagugcgguaccgagucacuggauucccaccagccguaccacaugguccauccacgccacccaugaguggaugacgacugagaacaugcugacgguguggaaccgggucuggauccaagagaacccguggauggaagacaagacgccgguggagagcugggaggagauaccguaccuggggaagcgcgaagaccaguggugcgggagccucaucggcuugaccucccgggcaacuugggccaagaacauccagacugcgaucaaucaggugcgcagcuugaucgggaacgaggaguacaccgacuacaugcccucuaugaagcgguuccgccgcgaagaagaggaggccggcgugcucugguag

SEQ ID NO: 24882 - RNA, 9876 nt, Artificial Sequence
  derived and/or modified CDS sequence (opt11) from DENV-2__KM279535__SS-prME
acggcgggaaucaucauuaugaugauacccacugugauggccuuccaccugaccacucggaauggggagccucauaugaucguaagccgccaggagaaagggaagagccuccuguucaagacagagaacggcgugaauaugugcacccugauggcgauggaccucggcgaguuaugcgaggacaccauaaccuacaacugcccacuguugcgacagaacgagccagaagauauagauugcuggugcaauagcacuuccaccuggguaacauacgggaccugcaccgccaccggcgagcaucgccgcgagaagcggagcguggcccuggugccccacgugggcauggggcuggagacccgcaccgagacuuggaugagcagcgagggcgcuuggaagcacgcccagcggaucgagaccuggauccugcgccaucccggguucacgaucauggcggccauuuuagccuacaccaucggcacgaccuacuuucaacggguccugauauuuauccuucugacggccgucacccccucaauggcgaugcgaugcaucgguaucucaaaccgggacuucguggaggguguauccggcggaagcugggucgacaucgugcuggagcacggcuccuguguaaccacgauggccaagaacaagcccacucucgauuucgaguuaaucaaaaccgaggccaagcaccuagcuacgcuccgcaaauacugcguagaggccaagcucaccaacacgaccaccgcgagccggugccccacacagggggagcccuccuuaaaugaagagcaggauaaacgcuucgugugcaagcacucaauggucgaccggggcuggggaaaugggugcggccuuuucgggaagggcgggauugugacuugcgccauguuuacaugcaagaagaacauggaggguaaggugguccagcccgagaacuuggaguacacuauagugaucacgccccauuccggcgaggagaacgccguagggaacgacacgggaaagcacgggaaggagaucaagguaaccccucagagcucuaucaccgaggccgagcugaccggcuacgggaccgugacuauggaaugcagcccucgcaccggcuuagacuucaacgagauggugcugcugcagauggagaauaaggcguggcuaguccaccgccagugguuccucgaccugccucuucccuggcugcccggagccgacacccagggguccaacuggauccagaaggagacccuugugaccuucaagaauccgcacgccaaaaagcaggacgucgugguuuugggcagccaggagggagccaugcacaccgcccuuaccggcgccaccgagauccagaugagcuccggaaaccucuuguucacggggcaccugaagugccgcuuacgcauggauaaacuccaguugaagggcaugagcuacuccaugugcaccggcaaguucaaagucgugaaggagaucgcggagacccagcacggaaccaucgugauccgcguccaauacgagggggacggcagcccuugcaagauccccuucgaaaucauggaccuggagaagcggcacgugcucggacggcucaucacuguaaacccgauaguuaccgagaaggacuccccggugaacaucgaggcggagccgcccuucggggauagcuacauuaucaucggaguagaacccgggcaacugaagcuauccugguuuaaaaagggcagcuccaucgggcaaauguuugagaccaccaugcgcggcgcgaagcgaauggccauucugggagacacugcgugggacuuugggagucugggcgggguuuuuacaagcauuggcaaggcgcugcaucagguguuuggggcgaucuauggcgccgccuucucugggguguccuggaccaugaagauccugauaggggucgucauaacguggauuggcaugaacagccgcucgacgagccuguccgugagccugguccucguggguguggucacccuguaccuaggcguaauggugcaggcagacuccgggugugucguauccuggaagaacaaggagcucaaaugcggaagcggcauauucaucaccgacaacguacacaccuggacggagcaguacaaguuccaaccggagagucccagcaaacuggccuccgcgauccagaaggcgcaugaggaggguaucugugggauccggucugucacccgccuggaaaaccucauguggaagcagaucaccccugagcuaaaccacauccuuaccgagaaugaggugaagcucacgauaaugaccggggauaucaagggcaucaugcaggcggggaaacggucccugcgcccgcagccgaccgaguugaaguacagcuggaaggcguggggcaaggcuaaaauguuguccacagagcugcacaaccacacguucuuaaucgacggccccgagacagccgagugcccgaacaccaaccgggccuggaacagccuugaaguggaggacuacggguucggcguauucaccacgaacaucuggcugaagcugaaagagcgccaggaugucuucugugacuccaagcuaaugagcgccgcgauuaaggacaaccgcgccgugcacgccgacaugggguacuggauugaaagugcccugaacgauaccuggaagaucgaaaaagccagcuucaucgagguaaagucgugccacuggcccaagagccacacucugugguccaacggcgugcucgaaucggagaugaucauccccaagaacuucgccggcccggugucccaacacaacuacagaccaggguaucacacccagaccgcugggccguggcaccuugggcggcuggagauggauuucgacuuuugcgagggcacgaccgucguggugacugaggacugcgggaacaggggcccaucuuuaagaaccacgaccgccagcgggaaguuaauaacggaguggugcugccgcuccuguacccugccgccccuccgguaccgcggggaggacggcugcugguacgggauggaaauccggccgcuuaaggagaaggaggagaaccugguuaauagccucgugacggccggucauggacagauagacaacuucucccucggcguccugggcauggcccucuucuuagaagagaugcugcgcacccgggucgguaccaagcacgccauccuccucguggccgugagcuucgucacccugaucacgggaaacauguccuuccgcgacuuagggcgagugaugguaaugguuggagccaccaugaccgaugacaucgggaugggagugaccuaucuugccuuauuagcagccuucaaggugagacccacguucgccgccggacugcuuuuacgcaagcugaccagcaaagagcucaugaugacuaccaucgggaucguauugcugucccagucaacgauccccgaauccauccucgaacucaccgacgccuuagcgcugggaaugaugguacucaagaucguccggaacauggagaaguaccagcuggccgucaccaucauggcuaucagcugcguacccaacgccgucaucuuacagaacgccuggaaggugaguuguaccacucucgcgguggucagcguguccccgcugcugcuaaccagcucccagcaaaaagccgacuggaucccacuggcccugaccaucaagggucuuaaucccaccgccaucuucuugacgacccugagccgcacaucaaagaagcgaaguuggccccucaacgaggcgauaauggcaguaggaauggucuccauccuggcuaguucauugcuuaagaacgacaucccgaugaccggcccccugguggcagggggccugcucacggucugcuacguccugaccgggcgaagcgcggaccuugagcucgaaagggcggccgacguuagaugggaggagcaggccgagauuucagguuccucucccaucuuaucuaucaccaucucggaggacggguccauguccaucaagaaugaagaggaagaacaaacccugacgauucucauccggaccggacugcuagugaucuccgggcucuuccccguaagcaucccgaucaccgccgcggcgugguaccugugggaggugaaaaagcagcgcgccggaguccugugggacguacccucaccgccgcccguggguaaagccgagcucgaggacggggccuaucgcaucaagcagaagggcauacuuggauacucgcagaucggcgccggcguuuacaaggaagggaccuuucacaccauguggcacgucacgcgaggcgcggugcugaugcacaaagggaagcggaucgagcccuccugggccgacgugaagaaggaccugaucagcuacgggggggguuggaagcuggagggugaguggaaggaaggggaggagguccagguccuggcccucgagcccgguaagaacccgcgcgcaguccagaccaaaccugggcuguucaagaccaacacgggcacgaucggcgccgucucccuggacuuuuccccgggcaccagcggaagcccaaucguggacaagaaggggaaggugguaggacucuacgggaacggcgucguuacucgcuccggaaccuacguaagcgcgauagcccaaacggagaaguccaucgaagacaacccugaaaucgaggacgacaucuuccguaagaagcggcugaccaucauggaccugcacccuggggccggcaagacaaagcgguaccugcccgccauugugcgcgaggcgauaaagcguggacuccggacacugauccuggccccgacacgcguggucgccgccgaaauggaagaggcccuccgcggacuuccaauccgcuaccagaccccagcgauaagggccgagcacacugggcgggagauuguagaccugaugugccaugcgaccuucacgaugcgccucuuaagccccauacgggugcccaauuacaaccugaucaucauggacgaggcccacuucaccgacccggccuccauagcggcccgcggcuacauaucgacccgggucgagaugggcgaggccgcggguaucuucaugacggccacgccgcccggcagccgcgaccccuucccgcagagcaacgcucccaucauggacgaagagcgugagaucccugaacgaagcuggaacagcgggcacgagugggugaccgacuucaagggaaagaccgugugguucguccccagcaucaaagcggggaacgacaucgccgcuugccuccggaagaacggcaagaagguaauccagcugucgcgcaagaccuucgacagcgaguacauaaagacgcggaccaacgacugggacuucguggucaccaccgacaucuccgagaugggagcgaacuucaaggccgagcgcgugaucgauccgcggcgcugcaugaaacccgugauccuaacggacggggaggagcgggucauccuggccggccccaugcccgugacccacaguuccgcagcucagcgccgugguagggugggccgcaauccgaagaacgagaaugaccaguacaucuacaugggggagccucuggagaacgacgaggacugcgcgcacuggaaggaggccaagaugcugcucgacaacaucaacaccccugagggcaucauucccucgauguuugagccggagcgggagaagguagacgcgaucgacggcgaguaccggcugcguggggaggcacgcaaaacguucguggaccugaugagaagaggcgaccuccccgucuggcuggccuaccggguagcggccgaaggaaucaacuacgccgaccgccgguggugcuucgacggggugaagaacaaccaaauccuugaagaaaauguagagguggagaucuggacgaaagagggagagcgcaagaagcucaagccccggugguuagacgccaggauuuacuccgauccccuggcguugaaggaauucaaggaguucgccgccggucggaagucccugacccuuaaccucaucacugaaaugggccgccugcccaccuucaugacgcagaaagccaaaaacgcccuggacaaccucgcggugcugcacaccgccgaggccgggggccgcgccuacaaccaugcgcuguccgagcuccccgaaacccuggagacucugcuuuugcugacguugcucgcgacaguaaccggcggcauauuuuuguuccucauguccggcaaggggauaggcaaaaugacacuggguauguguugcauuaucacugccucgaucuugcucugguacgcccagauccagccccacuggaucgccgccagcaucauccuggaguucuuccugaucgugcucuugauuccagagcccgagaaacagcgcacgccccaagacaaccagcugaccuacguggucauugcaauccucacgguggucgccgccacaauggccaacgagaugggcuucuuggaaaagacgaagaaggacuucgggcugggcucaaucaccacccaacaacccgaguccaacauucucgacauagauuuacggccggccagcgcguggacccucuacgccgucgccacgaccuucauuacccccaugcuccgccacucgaucgagaacagcuccguaaacgugagcuugacagcuaucgccaaccaggcaacgguccugaugggccucggcaagggcuggccccugucgaagauggacaucggggugccauugcucgccaucggcugcuauagccaggugaacccgaucacucugaccgccgcccugcuccugcuggucgcgcauuacgccauuaucgggcccggccuccaggcaaaggcaacacgggaggcucagaagcgcgcagcagccggcaucaugaagaaucccacaguggaugggaugaccgugaucgaccuugauccuaucccguacgauccgaaguuugaaaagcagcugggucaagucaugcuccugguucugugcgugacccagguccucaugaugcgcaccacuugggcccuuugcgaggcccugacccucgcaaccgggcccaucagcacacugugggagggcaacccggggcgcuucuggaacacgacgaucgccgugagcauggcgaacaucuuccgcggcuccuaccuggcaggcgcuggguugcuguucagcaucaugaagaauacggcuaacacucgucgcggcacugguaauaccggcgagacacugggggagaaauggaaaaacaggcucaacgcccucgggaaguccgaguuccaaaucuacaagaagucuggcauccaggagguggauagaacccuggcgaaggaggggauuaagaggggcgagacggaccaccacgccgucucccgcgguagcgcgaagcuccggugguucguagagcgcaaucuggugaccccggagggcaaaguaguggaccugggcugcgggcgaggcgggugguccuacuauugcggcgggcuaaagaacgucaaggaagucaagggccugacgaagggcggccccgggcacgaggagcccauccccaugagcaccuacggauggaaucucgugcgauugcaguccggcguugacgucuucuucacgccaccggagaagugcgacacccuccugugcgacaucggggagagcucgcccaaucccaccguggaagccggucguaccuuacgcguguugaaccucgucgaaaacuggcucaacaacaacacucaguucugcauaaaggugcugaacccguacaugcccagugugaucgagaagauggaggcucugcagcguaaguacggcggcgcccugguucgcaacccccugagccggaacuccacgcacgagauguacugggucucuaacgccucagguaacaucgugucuuccgucaacaugaucagcagaaugcugauuaaucgguucacuaugcgccacaagaaggcgaccuacgagccggauguagaccugggguccggcacucggaauaucgguaucgagagcgaaacgcccaacuuagauaucaucgguaagcgcaucgagaaaaucaagcaggagcacgagacaucuuggcacuacgaccaggaccacccguacaagaccugggccuaccacggcagcuacgagaccaagcagacugguuccgccaguucuauggugaauggugucgugcgccuucugaccaagcccugggauguuaucccgauggugacacagauggccaugaccgacacgacacccuucggacagcagcggguguucaaggagaagguagauaccaggacccaggagcccaaggagggcacgaagaagcucaugaagaucaccgccgaguggcuguggaaggagcugggcaagaagaagacgccccgaauguguacacgcgaagaguucacgcggaaggugcgcuccaacgccgcccucggggccaucuucaccgacgagaacaaguggaaguccgcccgagaggcgguggaggacagcggcuucugggaacuggucgacaaagagagaaaucugcaccucgaggggaagugcgagaccugcguauacaauaugaugggcaagcgagagaagaagcugggggaguucggcaaggcgaaaggcucccgcgcuaucugguacauguggcucggggcgcgguuccucgaguucgaggcucuggguuuccugaacgaagaccacugguucagccgggagaacucucucuccgggguggagggcgagggacugcacaaguuaggcuacauccuccgggacguaagcaaaaaggagggcggggcgauguacgccgacgacacggcagguugggacacgcgcaucacccuagaggaccugaagaacgaggagauggucaccaaccacauggaaggggagcauaagaagcucgcugaggccaucuucaagcuuacuuaccaaaacaaggugguacgugugcagcgccccacgccccguggaaccgugauggacaucaucucccgaagagaccagcgggggagcggccagguugugacuuacggccugaacacauuuaccaacauggaagcgcaacuuauccggcaaauggagggggagggcguguucaagucuauccagcagcugaccgugaaggaggaaaucgcagugaagaauuggcugauccgcguggggcgcgaacggcucagcagaauggccaucucuggugacgacugcgucgugaagccgcuggacgaccgguuugccucggcccucaccgcgcucaaugacaugggcaagguaaggaaggauauacagcagugggaacccucaagggguuggaacgacuggacccaggucccguucugcagccaccacuuucacgagcugaucaugaaggacggcaggguauuggugguccccugccggaaccaggacgagcugaucgguagggcacggauuucccagggcgccggcuggagccugcgcgagacggccugccuaggcaaguccuacgcccaaauguggagccucauguacuuccaucgacgcgaccugcggcuggccgcgaacgcgaucuguuccgcaguaccaucacacuggauucccaccucccgcaccaccuggagcauccacgccacccaugaguggaugacgaccgaggacauguugaccguguggaaucgggucuggauccaggagaaccccuggauggaggacaagacccccguagagaguugggaggagauacccuaccugggcaagagggaagaccaguggugcgggucccugaucggccucacgagccgggcgacuugggcaaagaacauccaaaccgcuaucaaccaggugaggucccugaucgguaacgaggaguauacagacuacaugcccagcaugaagcgguuccgaagggaggaagaggaagccgguguccugugguga

SEQ ID NO: 24883 - RNA, 9876 nt, Artificial Sequence
  derived and/or modified CDS sequence (opt11) from DENV-2__KM279539__SS-prME
acagcaggcauuauuaucaugaugauucccaccguaauggccuuccaccugaccacccgcaacggggagccccacaugaucgucagccggcaggagaagggcaagagcuugcuguucaagaccgagaauggggugaacaugugcacccuuauggcgauggaccucggcgagcugugcgaagacacaaucacauacaauuguccccugcuccggcagaacgagcccgaggacaucgauugcugguguaacagcaccagcaccuggguuaccuacgggaccugcacagccacuggcgagcaccggagggaaaagcggucagucgcucuugugccccauguagggauggggcuugagacccgcaccgaaaccuggauguccagcgagggcgccuggaagcacgcccagcggauugagacguggauccuaaggcaccccggguucacgaucauggcggcuauccuggccuacaccaucggcaccaccuacuuccagcggguccugaucuuuauccuccugacagcggugacucccuccauggcgaugcggugcauugggaucagcaaccgagacuucguggagggcgucuccggcgggaguuggguggacaucguucuggaacauggguccugcgucaccaccauggccaagaauaagcccacgcucgacuucgagcugaucaagacagaggcgaagcaccuggcaacccuucgcaaguacugcguggaggccaaguuaaccaacacuacuacggcgagccggugcccgacccaaggggagcccuccuuaaaugaggagcaggacaagcgcuucgugugcaagcauagcauggucgaccggggcugggguaacggguguggcuuguucgggaagggcgggaucgugaccugugccauguucacgugcaagaagaacauggagggcaaggugguccagcccgagaacuuagaguacacgauaguaaucacgccccacuccggcgaggagaacgccguggggaacgacacaggaaagcacggaaaggagaucaaggucacgccucagagcuccaucaccgaagcggagcugacggguuacgggaccgugacaauggaauguucuccgcgcaccggcuuggauuucaacgagauggugcugcuacagauggagaauaaagcauggcucguccaucggcagugguuccucgacuuaccacucccaugguugccaggcgcggauacccagggguccaacuggauccagaaggagaccuuagucacuuucaagaauccucacgcuaagaagcaggacgucguugugcucggcagccaggaaggggcgaugcacaccgcccucaccggggccaccgaaauccagaugagcucagggaaccuccuguucacaggccaccugaagugccgccuccgaauggacaaguuacagcugaagggaaugagcuacuccaugugcaccgggaaguuuaaagucgugaaagagaucgcggagacccagcacggcaccaucgugauccgaguccaguacgagggagacggcagccccugcaagauucccuucgagauaauggaccuggaaaagcggcauguccugggcaggcugaucacuguaaaccccauugucacugaaaaggacuccccgguaaauauagaggccgagccgcccuucggggacagcuacaucaucaucggggucgagcccgggcaguuaaagcucuccugguucaaaaagggcagcaguaucggccagauguuugagaccaccaugcggggcgccaagcgaauggccauccugggcgauacagccugggauuucgggagccugggcggggucuucaccuccaucggcaaggcccuccaccagguguuuggggcaauuuacggcgccgccuucagcggcgugucauggacaaugaaaauacugaucggggucgugaucaccuggaucggcaugaacucucgcaguacgucucuguccgugagccucguccucgugggcgucgucacccuguacuugggcgugauggugcaggcugacagcgggugcgucgugagcuggaagaauaaggagcucaagugcgguagcggcaucuucaucaccgacaacguccacacauggacagagcaguacaaauuccaaccggagucccccagcaaacuugcauccgccauacagaaggcgcacgaggaggggaucugcggcaucagguccgucacccgccuggagaaucucauguggaagcaaaucacccccgagcugaaccacauccugacggaaaacgagguuaagcucaccauuaugacaggggacaucaagggcauaaugcaggcgggcaaacggucccugcgcccccagccgaccgaguuaaaguacaguuggaaggcguggggcaaggccaagaugcucucuaccgagcugcacaaccacacguuccugaucgacgguccugagaccgccgagugcccaaacacuaaccgggccuggaacagccucgagguggaggacuacggguuuggcguauucaccacgaacauauggcugaagcucaaggagaggcaggacguuuucugcgacuccaagcuaaugagcgccgcaauaaaggacaaccgggccgugcacgcagacaugggguacuggauugaauccgcccugaaugacaccuggaagaucgagaaggccagcuucauugaagucaaauccugccauuggcccaagagccacacccuuuggucuaacggcguucucgaguccgaaaugaucauccccaagaacuucgccggccccguaucccaacacaauuaccgccccggguaccauacccagaccgcagguccguggcaucuggggcgccuggagauggacuucgauuuuugcgagggcacgaccgucgucgugacggaagauugcgggaaccgcggccccagccuucggacaacgaccgccagcggaaagcugaucaccgaauggugcugccgauccuguacccugccgccgcuccgguacagaggggaagacggcuguugguacggaauggagauccggccgcugaaggaaaaggaggagaaccugguaaacucacucgugacggcaggccacgggcagauugauaacuucuccuugggcgugcuggguauggcccucuuccuggaggagaugcugcgcacccgggucgggaccaagcacgccauacuacuuguggccgugagcuucgugacauugaucacaggcaacauguccuuucgcgaccucgggcgcgugauggugauggucggggccacaaugaccgacgacaucgguaugggcgugacguaucuggcccugcucgcagccuucaaggugcggcccacauucgcugcgggccuucuucuccgcaagcuaaccucuaaagagcugaugaugaccaccaucgggaucguccuccugucccaaucgacgauccccgaguccaucuuggaguugaccgacgcccuggcgcugggaaugauggugcuaaaaaucgugcgaaacauggaaaaauaccaguuggcugugaccaucauggccauccugugcgugcccaacgccgucauccuccagaacgcauggaaggugucgugcaccacccuggcgguagucuccgugagcccucugcucuugaccucaucacagcagaaggccgacuggauaccccuggcccucacuauaaaggggcugaaccccaccgccauuuuccugacgacccucucccguaccagcaagaagcggucguggcccuuaaacgaggcgaucauggccguaggcauggucucaaucuuggccaguucgcuccugaagaaugacaucccaaugacaggcccccuggucgcuggcggacuccucacggugugcuacguccugaccggacgcagcgccgaccucgaauuggagcgggcggccgacgugcgcugggaggaacaagccgagaucagugguucaucuccaauccuuuccaucaccaucuccgaggaugggucuauguccauaaagaacgaggaggaggagcaaaccuugacgauccugauacggacgggccugcucgugaucagcggucuguuuccagucuccaucccgauuaccgccgccgcgugguaccugugggaggucaagaaacaacgcgccgggguacuaugggacguccccaguccgccgccaguuggcaaagccgagcucgaggacggggccuaucggaucaagcagaagggcauacugggguauucccagaucggcgccggcguauauaaagaggggacauuccacaccauguggcacgucacgcgaggugcgguacugaugcacaaggguaaaaggaucgagcccaguugggcugaugugaagaaggaccugaucuccuauggagggggcuggaagcuggaaggcgaguggaaggagggugaggagguccagguacuagcccuggagcccgguaagaacccgcgcgcugugcagaccaaacccgggcuguuuaagacaaacaccgggacgaucggggccgucagccucgacuucucccccggcacaagcgguuccccaauaguggacaagaaggggaagguggucggccuguacgggaacgguguagugacccggagcggcacauacgucuccgcgaucgcccagacggaggagagcaucgaggacaacccugagaucgaggacgacaucuuccgcaaaaagcggcugacuaucauggaccugcacccaggagcuggcaaaacuaagcgcuaucucccugccaucguacgggaggcgaucaagcgcggucuucggacucugauucucgcccccacgcgcgugguugccgccgagauggaagaggcccugcgcggccugccuauccgguaucagacccccgcgauccgcgccgaacacaccgggagggagaucguggaccucaugugccacgccaccuucacgaugcgccuacugagucccauccgugugccgaauuacaaccucauuauuauggacgaggcccacuucaccgacccggccuccaucgcugcccgcggcuacaucucgacccggguggagaugggcgaggccgccgggaucuuuaugacugccacuccucccggcucucgggacccauuuccgcagagcaaugcgcccauaauggaugaggagcgggagauccccgaacgcuccuggaacagcgggcacgagugggucacugacuuuaagggcaaaaccgucugguucguccccuccaucaaggccgggaacgacauugccgccugcuugcggaaaaauggcaagaaggugauccagcugucccgcaagacuuucgacuccgaguauauaaagacccggacuaaugacugggacuucguugucaccaccgacaucuccgagaugggcgcuaacuucaaagccgaacgcguuaucgauccgcggcgcugcaugaagcccgugauuuugacggacggggaggaacgggucauccuggccgggcccaugcccgugacucauagcucagccgcccagcgccgggggcgcgugggccgcaacccgaagaacgagaacgaccaguacauauacaugggggagccccuggagaaugacgaggacugcgcgcacuggaaggaggccaagaugcuccuggacaacaucaacacccccgagggaaucaucccuaguauguuugagccggaacgggagaaaguugacgcaaucgacggugaguaccgccuccgcggugaggcccguaagaccuucguggacuugaugcggagaggggaccugcccguauggcuggccuaccggguggcggccgaggggaucaacuacgcugauagaaggugguguuucgacggcguuaaaaacaaccaaauccucgaggagaacgucgaaguggaaaucuggacgaaggagggggagcggaagaagcugaagcccagauggcuggacgcccgcauuuacagcgacccucucgccuuaaaggaguucaaggaguucgcagcaggccggaagucccugacccucaaccugauuaccgagaugggccgcuuacccaccuucaugacgcagaaggccaagaacgcccucgacaauuuggcuguguugcacaccgcggaggcagggggccgggccuacaaccaugcccucagcgagcugcccgaaacccuggagaccuugcugcugcucacgcuucuggcgaccgucacugggggcauauuccucuuccugauguccgggaaggggaucggaaagaugacccuggggaugugcugcaucauaaccgcuagcauccugcugugguacgcccagauccaaccccacuggauugccgccuccaucauccuggaguuuuuccucaucgugcuacugaucccugagcccgagaagcagcggacgccgcaggacaaccaguuaacuuacgucgucauagcgauacugaccgugguggccgcgaccauggccaacgagaugggcuuccuggagaaaacgaagaaggacuucggguuaggaaguaucacgacgcagcaaccggaaucgaacaucuuagauaucgaccuucggccggccuccgcguggacccucuaugccgucgcaacgacguuuaucaccccaaugcugcgccacagcauagagaacuccagcguuaacgugucccugaccgcuauugcaaaccaggcgacgguccucaugggcuuagguaagggguggccccugagcaagauggacaucgggguuccuuuacuggcgaucggcuguuacucccaagucaauccgaucacacugaccgccgcccuccugcugcucgucgcgcacuacgccaucauugggccaggccuacaggcgaaggcgacccgggaggcccaaaagcgcgcggccgcagggaucaugaagaauccuacggucgacgggaugaccgugaucgaccuggaccccaucccauacgaccccaaguucgagaagcaguuggggcagguaaugcuauuggugcucugcguaacccaggugcugaugaugcggaccacgugggcccugugcgaggcacucacuuuagcgaccgggccgauuagcacccugugggagggaaaucccgggcgguucuggaacacgaccaucgccguaucaauggcaaacaucuuccgcgggucauaucucgccggggccggcuuguuguucuccaucaugaagaacaccgccaacacgcggaggggcacgggcaacaccggugagacccucggcgagaaguggaagaaccgguugaaugcgcugggcaagagcgaguuccagaucuacaagaaaucgggcauacaggagguugaccgaacccucgcaaaggaggggauaaagcgcggugagacagaccaccacgccgucagccgagggagcgcgaaacuacggugguuuguggagcgcaaccugguaaccccugaagguaaggucguggacuugggcugcggccgcggaggguggucauacuacugcggcggucucaagaauguuaaggaggucaagggccugaccaagggcgggccggggcacgaggagcccauccccaugagcaccuacggcuggaaccucgugcgccugcaaagcggcgucgacgucuucuuuaccccgcccgagaagugugacacccugcucugcgacaucggggagaguagccccaaucccaccguggaggccggccggacacugcgcguguuaaaccuaguagagaacuggcugaacaacaacacccaguucugcaucaaggugcugaacccguacaugcccagugugauagagaagauggaggcccuccagcggaaguauggcggagcgcuggugcgcaaccccuuauccagaaauucaacacacgagauguacuggguguccaacgcaagcggcaauaucgucuccagcguaaauaugaucucccgcaugcugaucaaccgguucacaaugcgccacaagaaggcgaccuacgagccggacguggaccucgggagcggcacacggaacaucgggauugagucggaaacgcccaaccucgacaucauaggcaagcggaucgagaagaucaaacaggagcacgagaccucauggcauuacgaucaagaccaccccuacaagacuugggcguaccacggcuccuaugagaccaagcagacgggguccgccagcagcauggugaauggaguggugcgccugcuuaccaagcccugggacgugauuccgauggucacccagauggccaugaccgauacgacacccuucgggcagcaacggguauucaaggagaagguggacacccggacccaggaacccaaggagggcacgaagaaguugaugaagaucaccgccgaauggcuguggaaggagcucggcaagaagaagacgccuagaaugugcacccgcgaggaguucacgcggaaagugcgcuccaaugcggcccugggugccaucuucaccgaugaaaacaaguggaaguccgcccgggaggcaguggaggacuccggguuuugggaacuggucgacaaggaacguaaucuccaucuugaggggaagugcgagaccugcgucuacaacaugaugggcaagcgggagaagaaacuaggcgaguucggcaaagcgaagggaagccgcgccaucugguacaugugguugggggccagguuccuggaguucgaggcccugggcuuucuuaacgaagaccacugguucucccgcgagaauagucugagcgggguagagggcgaaggacugcacaagcucgguuauauccugcgugacgucaguaaaaaggagggcggggcuauguacgccgacgacaccgcgggcugggacacgcgcaucacgcucgaggaucucaagaacgaggagaugguuacaaaccauauggagggggagcacaagaagcuggcggaggccaucuucaagcugaccuaccagaacaaagugguccgggugcaaagaccaacgccuaggggaaccguaauggacaucaucagccgccgugaccagcgcgguucgggccaggucguaaccuaugggcucaacaccuucacgaacauggaggcucaacugauacggcagauggagggagagggcguguucaaaaguauucagcaacuuaccgucaaggaggagaucgccgugaagaacuggcucauccgcgucggacgcgagcggcugucacggauggccaucagcggugacgacugugucgugaaaccccuggacgaccguuucgcuucugcccugaccgcccugaacgacaugggaaagguccgcaaggacauccagcaaugggagccaagccggggguggaacgauuggacccaagucccuuucugcucccaccauuuccacgagcugaucaugaaagacggccgcguccuagugguccccugccggaaccaagacgagcucaucgggcgcgcccgcaucagccagggcgccggguggucucugcgcgaaacugccugucugggcaagaguuacgcacagauguggucacugauguacuuccaucggagggaccuacggcucgcggccaacgccaucuguucugccgugcccucccacuggaucccgacuagccgaaccaccugguccauccacgccacccacgaguggaugacgaccgaggacaugcugaccguguggaaccgggucuggauccaggagaacccauggauggaggacaaaacccccguggagucuugggaagaaaucccuuaccugggcaagagggaggaccaguggugcgggagccucauuggccugacgucccgggcgacuugggccaagaauauccagaccgccaucaaccagguuaggucgcuaaucgggaacgaggaguacaccgacuauaugcccuccaugaagcguuuccgccgcgaggaggaggaggcuggugucuuaugguga

SEQ ID NO: 24884 - RNA, 9876 nt, Artificial Sequence
  derived and/or modified CDS sequence (opt11) from DENV-2__KM279543__SS-prME
accgcagggaucaucauuaugaugauccccacagugauggccuuucaccugaccacgcguaacggggagccccacaugaucgucagccggcaggagaagggcaagagccuccuguucaaaacggagaauggggugaacaugugcacccuuauggcgauggaccucggcgagcugugcgaggacaccauaaccuacaacugcccccuacuucgccagaacgagcccgaggacaucgauuguuggugcaacucuaccagcaccuggguaacguacgggacuugcaccgcgaccggcgagcaucggcgcgagaagcggagcgucgccuuagugccccacgugggcauggguuuagagacccgcaccgaaaccuggaugucaucugagggcgccuggaagcacgcccagcggauagagaccuggauacuccgccauccuggguuuacgauaauggcggcgauucuggccuacaccaucggcaccaccuacuuccagcggguucuuaucuucauucuccuuacagccgugacccccuccauggcaaugcgcugcaucgggauuuccaaucgggauuucguugagggagucuccggcgggagcuggguggacaucgugcuggaacacgguuccugcgucacaaccauggccaagaauaagcccacgcucgacuucgaguuaaucaagaccgaggcuaagcaccucgccacuuugcgcaaguacugcguggaggccaaguugacuaacacgacaaccgcgagccggugccccacccaaggcgagcccucccugaacgaggagcaggacaagcgcuucguuugcaaacauucgauggucgaccggggcuggggcaacgggugcggccucuucgggaagggcgggaucgugacuugugcuauguucacgugcaagaagaacauggagggcaaggucguccagcccgaaaaccuggaauacaccaucgugaucacgccccacuccggcgaggagaacgccguggggaaugacacaggcaaacacgggaaggagaucaaggucacgccccaauccuccaucacugaggcugagcugaccggcuacgggacagugacgauggagugcagcccgcgaacgggucucgacuucaaugagauggugcuacugcagauggagaacaaggccuggcucguacaccggcagugguuucuggaccugccacuccccugguugccaggcgcggacacgcagggguccaacuggauccaaaaggagacccuggugacuuucaagaauccgcaugccaagaaacaagacgucguggugcucggcucccaggagggggccaugcacaccgcccugacgggcgccaccgagauccagaugagcuccggcaaccucuuauucaccggccaccugaaaugccgccugcggauggacaagcugcagcugaagggcaugucauacuccauguguaccgggaaauucaaggucguuaaggagauagcggagacccagcacggcaccaucgugauccgcguccaguaugagggugacggaucucccugcaagauucccuucgagaucauggacuuggagaagaggcacguacucggccgccugauaacuguaaaccccaucguuaccgagaaggacuccccggugaacaucgaggccgagccucccuucggggauagcuacaucauaaucggcguggaaccagggcagcugaaauuguccugguucaagaagggcaguuccaucgggcagauguucgagaccaccaugcguggcgcaaagaggauggcuauccugggcgacacggccugggacuucgggagucuaggagggauguucaccuccaucggcaaagcgcuucaucaaguuuucggggccaucuauggcgcggccuucagcggaguguccuggaccaugaaaaucuuaauuggggugguaaucaccuggaucggcaugaacagccgcucgacuagucuguccgucagccuggugcuagucggggugguuacccuguaccuuggcgucauggugcaggcggacuccgggugcguggucucguggaagaacaaggagcucaagugcgguagcggcauauucaucaccgacaacguccauaccuggacggagcaguacaaguuccagccggagucccccucgaaacuggccuccgccauccagaaggcccacgaggaggggaucuguggcaucagaucagugacucgcuuagagaaccucauguggaagcagaucacccccgagcugaaccacauacuaaccgagaacgaggucaaguuaacgaucaugaccggggacaucaagggcaucaugcaggccggaaagcggucccugcgcccccagccgaccgaacugaaguacagcuggaaggcguggggcaaggcuaagaugcuuuccaccgaguuacacaaucacacauuccugaucgacggccccgagaccgccgagugccccaacaccaaccgggccuggaacucucucgagguggaggacuacgguuucggcgucuucaccacgaacauauggcugaagcugaaggaaaggcaagacgucuucugcgauaguaagcucauguccgccgcgaucaaggacaaucgcgccgugcacgcggacaugggguauuggaucgaauccgcccuaaacgauaccuggaagaucgagaaggccagcuucaucgaggugaaguccugccauuggcccaagagccacacgcugugguccaacggcguccuagagagcgagaugaucauccccaagaacuucgcgggccccgugucccagcacaacuaccggccuggguaccacacccagacagccggcccguggcaucucggccggcuggagauggauuucgacuucugcgagggcaccaccguggucgugacugaggacuguggcaaccgcggccccagcuuacggaccaccaccgccaguggcaagcugaucaccgaguggugcugccgcucaugcaccuuaccgccucuucgauaccggggggaggacggcuguugguacgggauggagauccggccgcugaaggagaaggaggagaaccuggugaacagccucgucacggccggccacgggcagaucgacaacuucucccugggcgugcugggcauggcgcucuuccuggaggagaugcugcgcacccggguggggaccaagcacgccauccuccucgucgccgugaguuucgugacccugaucacgggcaacauguccuuccgcgaccucgggcgaguaauggugauggugggcgccacgaugaccgacgacaucgggaugggggucaccuaccuugcacuguuagcggccuucaaggugcggcccacguucgccgccggccuccugcuccgcaagcugaccagcaaggagcugaugaugaccaccaucgggaucguccuccugucacagagcacgaucccugaguccauccuggagcucaccgacgcccuggcacuggguaugaugguccucaagaucgugcggaacauggagaaguaccagcuggcugucacuauaauggcgauucugugcguaccgaacgccgugauccuccagaacgccuggaaggucagcuguaccacgcuggcgguagugucagucagcccucugcuccugaccucaagccagcagaaggcugacuggaucccccuggcccucacuauuaaggggcugaacccaaccgccauuuuccugacgaccuugucuagaaccagcaagaagcguuccuggccccugaacgaggcuaucauggcugucgguauggugagcaucuuggccuccagccucuuaaagaacgacaucccgaugaccggcccgcuggucgccgggggccuccugacggugugcuacgucuuaacagggcgcagcgccgaccucgagcucgagcgcgcggccgacguccgcugggaggagcaggcugagauauccggcagcucccccauccugagcauuaccaucuccgaagaugggagcaugagcaucaaaaacgaggaggaagagcagacccucacaauccuaauacggaccggccugcucguaaucagcggccuguuccccguuuccaucccgauuacagcugccgcgugguaccugugggaagucaagaaacagcgugcgggggugcucugggacgugcccuccccgccgcccgucggcaaggccgagcuggaggacggggccuaccggauaaagcagaagggcauccugggguacucacagaucggagccggaguguacaaggaggggaccuuccacaccauguggcacgugacccgcggagcgguccucaugcacaaggggaagcggaucgagcccuccugggcggauguaaaaaaggaucugaucuccuacggcggaggcuggaagcuggagggcgaguggaaggaaggggaggaggugcagguccucgcccuggagccgggcaagaacccgcgagccgugcagacgaaaccgggucuguucaaaacgaacaccggcacgaucggggccgugagccuugacuucucccccggcaccagcggcucuccgaucgucgacaaaaaggggaaggugguggggcuguacgggaacggcguugugacccgcagcggcaccuaugugagugcgaucgcccagacugagaaguccaucgaagacaacccggaaaucgaggaugacauuuuucgcaagaagcggcuaaccaucauggaccugcaccccggggccggaaagaccaagcgcuaccuccccgccaucguucgugaggcgaucaagagggggcugaggacccugauccucgccccuacgcgcgugguagcggccgagauggaggaagcccugcgcggccugccgauacgguaccagacccccgcuauccgcgccgagcacacuggacgugagaucgucgaccucaugugucacgcgaccuucacgaugcgacugcugagccccauucgggugcccaacuacaaccugaucaucauggacgaggcgcacuucaccgauccggccuccauagcugcacguggcuacaucagcaccagaguugagaugggcgaggcggccggcauuuuuaugacggccacgccgccgggcucccgcgacccauucccgcagagcaacgcccccaucauggacgaagagcgggagaucccagagcgauccuggaacuccgggcacgaaugggucaccgacuucaaaggcaagacagugugguucgugcccuccaucaaggccgggaacgacaucgccgccugccugcggaagaacgguaagaaggucauccagcugagccgcaagacauucgacuccgaguacaucaagacccggaccaacgacugggacuucguggugaccaccgacaucucagagaugggcgcuaacuucaaggcugaacgcguuauugacccacggcgcuguaugaagcccgugauccucacggacggggaagagcgggugauccuggccggccccaugcccgucacccacuccucagcggcccaacgucgggggcggguuggccgcaaucccaagaaugagaaugaccaguauaucuacaugggugagccccuggagaacgacgaggacugcgcgcacuggaaagaggccaaaaugcucuuggacaacaucaacacgccagagggcaucauccccuccauguucgagccggagcgggagaagguggacgccaucgauggcgaauaucgccugcgcggggaggcccguaagacuuucgucgaccuuaugcggcgcggcgaccuccccgugugguuggccuaccgggucgcugccgaggggaucaauuacgccgaccgccgguggugcuucgacggagugaaaaacaaccagaucuuagaggagaacguagaggucgagaucuggacgaaggaaggggagcgcaaaaaacugaagccccgguggcuggacgcgcgcaucuacagcgacccgcucgccuuaaaggaguucaaggaauuugcggccggccggaagucccugacccucaaucugaucaccgagaugggccgccugcccacuuuuaugacacagaaggcgaagaaugcccucgacaacuuagcgguccugcacaccgcagaggcagggggccgggccuacaaccacgcccucagcgagcugcccgagacccuggagacccuccugcugcucacgcugcuggcgaccgugacuggggguaucuuccucuuccugauguccggcaaggggaucggcaagaugacccuagggauguguuguaucaucacagccagcauccuccuaugguacgcccaaauccagccccacuggaucgccgccuccauaauauuagaguucuuccucaucguacugcugaucccagagcccgagaagcaacgcacgccccaggacaaccaacucaccuacguggugaucgcgauccugaccguaguggccgccaccauggcuaacgagaugggguuccuggagaagacgaagaaggacuucgggcucggaagcaucaccacccagcagcccgagucaaacauccuggauaucgacuuacggccggccuccgcguggacccuauacgcaguagccacgaccuuuaucaccccuaugcugcggcauagcaucgagaacagcagcguuaacgucucccugaccgccaucgccaaccaggcgacggugcucauggggcuggggaagggauggccucuuucuaagauggacaucggcgucccccuccuggccaucggcugcuacucccagguuaauccgauuacccugaccgccgcccuacuguugcucguggcucacuaugccaucauaggccccggucugcaggccaaagccacccgggaggcccaaaaacgcgcggccgccggcaucaugaaaaaccccacagucgacggcaugaccguaaucgaccuggaccccauuccguacgaccccaaguucgagaaacagcuuggccagguuaugcugcuaguacucugcgugacccaggugcugaugaugcguaccacgugggcccugugcgaggcccucacccuggcgacagggcccaucagcacccuuugggaaggcaaccccgggagguucuggaacacgaccauagccguuaguauggcaaacaucuuccgcggcaguuaccucgccggcgccggacugcuguucuccaucaugaaaaacaccgcgaacacucgccgcggcacgggcaacacgggcgagacacucggcgagaaauggaagaaucggcugaacgcccugggcaaaagcgaguuccagauauacaagaaauccggcauccaagagguggaccgcacccucgcaaaggaagggauaaaacggggcgagacggaccaccaugccgugucgcgcggguccgcgaagcugcggugguucgucgagcgcaaccuggugaccccggagggcaaggucgucgaccucgguugcgggcggggcgguuggagcuacuacugcggugggcucaagaacgugaaagagguuaagggccugaccaagggcgggcccggccaugaggagcccauccccauguccaccuacggguggaaccucgucaggcugcagagcgggguggacguuuuuuucacgccgccagagaagugcgacacccuccugugcgacaucggggaguccagccccaacccgacggucgaggccggacggacgcugcgcguacucaacuuaguagagaacugguugaacaacaacacccaguucugcaucaaagugcugaacccguauaugcccagcgugaucgagaagauggaagcccugcagcggaaguacggcggcgcccucguucgcaacccccuguccaggaacagcacgcaugagauguacugggucuccaacgcgagcgguaauaucguuuccagcgugaauaugaucucgcgcaugcuaaucaaccgauuuaccaugcggcacaagaaggcgaccuacgagccggaugucgaccucggcagcggcacccggaacauagggaucgaauccgagacccccaaucuggacaucaucgguaagcgcaucgagaagaucaagcaggagcacgaaaccagcuggcauuacgaccaggaccaccccuacaagaccugggccuaccacggcuccuacgagaccaagcagacggggagcgccuccucgauggugaacggcgugguacgccugcuaaccaagcccugggacgucauuccgauggugacccagauggccaugaccgacacgacccccuucgggcagcagagagucuucaaggaaaaaguggauacccgcacgcaggagccaaaggagggcacgaaaaagcugaugaagaucaccgcugaguggcuguggaaagagcucgguaagaagaagacgccccggaugugcacccgcgaggaguucacucggaagguccgcuccaacgcggcucugggggccaucuucaccgacgagaauaaguggaaauccgcccgcgaggccguggaggacucgggcuucugggagcugguggacaaggaacguaaccuccaccuggaggggaagugugagaccugcgucuacaauaugaugggcaaacgggagaagaagcuuggggaauucggcaaggccaaaggcagccgcgcuaucugguacauguggcucggggcccgguuccuggaguucgaggcccugggcuuccucaacgaggaccacugguucucccgcgagaacagccugagcgggguugagggggaagggcugcacaagcucgguuacauccuucgggacguguccaagaaggagggcggggcuauguacgccgaugacaccgccgggugggacacgcgcaucacccuggaggaccucaaaaacgaggagauggucaccaaccauauggaaggggagcacaagaagcuggccgaagcaaucuucaagcugacauaucagaacaagguggugcggguccagcgcccgacgccccggggaaccgugauggacaucaucagccgccgggaccagcgcggcuccggucaggucguaaccuacggccucaacaccuucacgaacauggaggcgcaguuaauacggcagauggagggggagggcguguucaagagcauccagcaguugaccgugaaggaggagaucgccgucaaaaacuggcucauccgcguggggcgcgaacgguuguccaggauggccauaagcggcgacgauugcguggugaagccccuagacgaccgguucgccuccgcacucaccgcgcugaacgacaugggcaaggugcgcaaggacauccagcagugggagccuagccggggguggaacgauuggacccaggugccguucugcucccaccacuuccacgagcugaucaugaaggacggacgaguccucgucgugcccuguagaaaccaggacgaacugaucgggcgcgcccggauaagccagggcgcuggguggucucuaagggagacggccugccucggcaaaaguuacgcccagauguggucccugauguacuuccaccggcgcgaccugcggcucgcggccaaugccaucugcagcgccgucccgagucacuggauccccaccagccguacgaccugguccauacacgccacccacgaguggaugacgaccgaggacaugcuaaccguuuggaacaggguguggauacaggagaacccguggauggaggacaagacucccgucgagagcugggaggagaucccuuaccuggggaagcgcgaggaccaguggugcgggagccucaucggucugacgucccgggcgaccugggccaaaaacauccagacagccauuaaccaggugcgcagccugaucgggaacgaggaguauaccgacuacaugccgaguaugaagcgguuccgccgcgaggaggaggaagccggggugcucugguga

SEQ ID NO: 24885 - RNA, 9876 nt, Artificial Sequence
  derived and/or modified CDS sequence (opt11) from DENV-2__KM279571__SS-prME
accgcgggcaucaucauuaugaugauccccaccgugauggcauuccaucugaccacccgcaacggggaaccccacaugaucgucucccggcaggaaaagggcaagucccuccuuuucaagaccgagaacgggguuaacaugugcacccugauggcgauggaccuaggcgagcuaugcgaggauaccauuacuuacaacugcccccugcuccgccagaacgagcccgaggacaucgacugcuggugcaacagcaccucaaccugggugaccuauggcacaugcacggcaaccggggagcauaggcgcgagaagcgcagcgucgcccugguuccccacgugggcauggggcuggaaacccgcacagagacguggauguccucagagggcgccuggaagcacgcucagcggaucgagaccuggauacuccgccaucccgguuucaccauuauggcggccauccuggcuuacaccaucggcacgaccuacuuucagcggguccugauuuucauucuucugacggccguaacccccuccauggcaaugcgcugcaucgggaucagcaaucgcgacuucguggagggcguguccggaggaagcuggguggacaucgugcuggaacacggcuccugcgucacuaccauggccaagaacaagcccacacucgacuucgagcugaucaaaaccgaggccaaacaccuggcuacacuccgcaaguacugcguggaggccaaguuaaccaacacgacgacagcgagccgguguccgacccagggggagccaucccugaacgaggaacaggacaagcgcuucgucuguaaacacagcauggucgauaggggcuggggcaacgggugcggccuauucgggaaaggagggauugugacgugugccauguuuacgugcaagaaaaacauggagggcaagguggugcaacccgagaacuuagaguacaccaucguuaucacgccccacuccggggaggagaacgccgugggaaacgacacgggcaagcacgggaaagagauaaaggucacgccccagagcuccauuaccgaagcggaguuaaccggcuacgggaccgugacgauggagugcagcccgcgaaccggccucgacuucaacgagauggugcugcugcagauggaaaacaaggccuggcucguccaccggcagugguuccuggaccugccccuucccuggcuucccggcgcggacacccagggguccaacuggauucaaaaggaaacucuggugacguucaagaacccucacgccaagaagcaggacguagucguuuuaggcagccaggagggggccaugcauaccgcccugacgggcgccaccgaaauccagaugagcagcgggaacuuacucuucacuggccaccugaagugcagacugcgaauggauaagcuccagcugaaaggcaugagcuacuccaugugcacagggaaguucaaggucgugaaagagauagcggagacacagcacggcaccauugugauccgcguccaguaugaaggugacggaagccccugcaagauccccuuugagauuauggaccuggagaagcggcaugugcucggucgcuugaucacagugaaccccaucgucaccgagaaggacuccccugugaauaucgaggccgagccgccuuucggggacagcuacaucauaaucggcguggagcccgggcaauugaagcucucgugguucaagaagggcagcuccaucggccagauguucgagaccaccaugcgcggcgccaaacggauggccauucugggagacacugcaugggacuuugggagucugggagggguauucacauccauaggcaaggcgcuccaccagguguucggggcuauuuauggcgcggccuucaguggcguguccuggaccaugaagaucuuaauugggguggugauaaccuggaucgguaugaacagccgcuccacaagccugagugugagccucguccucguaggggugguuacccuauaccugggaguaauggugcaagccgacuccggaugcguagugagcuggaagaacaaggaacucaagugcggaagcgguauuuucaucaccgacaaugugcacaccuggacagaacaauacaaguuccaaccggagucccccagcaagcuggccuccgccauccaaaaggcccacgaagaggggaucugcggcauucggagcgugacccgccucgagaaccucauguggaaacaaauuacccccgaguuaaaccauauucuaaccgagaaugagguaaagcucacuauaaugaccggagacauaaaggguauuaugcaggccgggaagcggacccugcgcccgcagccgaccgaacugaaguacuccuggaaggcguggggaaaagccaaaaugcucagcacggagcugcacaaccacaccuuccugaucgacggccccgagaccgccgagugccccaacaccaaccgggcguggaacucccuggaaguugaggacuauggguucggcgucuucaccaccaacaucugguugaagcugaaggagcgccaggacguuuucugcgacagcaagcugauguccgcagcgaucaaggacaaccgggccgugcaugccgacaugggguauuggaucgaguccgcccugaacgacaccuggaagaucgagaaggcaucguucaucgagguuaagagcugccauuggccgaagagucacacccuauggaguaacggcgugcuagagucggagaugauaauccccaaaaacuucgccggccccgugagccagcacaacuaccgccccggguaccauacccagacggccggcccguggcaccuggggaggcuggaaauggauuucgacuuuugugagggcaccacggucgucgugaccgaggacugugggaaccgcggccccuccuugcggacgaccaccgccuccggcaagcugaucacggaguggugcugccggagcugcacgcuaccgccccuccgauacagaggagaagacggcuguugguacgggauggagauccggccgcugaaggagaaggaggagaaccuggucaacucucucgugaccgccggccacgggcagaucgauaacuuuucccugggcgugcugggcauggccuuguuccuagaggagaugcugcgcacaagggucgggaccaagcaugccauccucuugguggccgugaguuucgucacgcugaucacuggcaacauguccuuccgcgaccucgggcgcguuauggucauggugggggcuaccaugaccgaugauauugggauggguguuacguaccuugcacugcucgcggccuucaagauccggcccaccuucgccgcaggccuauuacuccgcaagcugaccaguaaggaguuaaugaugacuacgauugggauugugcuccugucccaauccaccauucccgaaagcauccuggagcucacugacgcccuggcccuuggcaugaugguccucaagaucgugcgcaacauggagaaauaccaguuagccgucaccaucauggccaucuugugcgugcccaacgccgugaucuugcagaacgcauggaaaguuucuugcacgacccuagcgguuguaucagucuccccgcuguuacuuacaagcucccagcagaaagccgacuggaucccccuggcucucacuaucaaggggcugaaccccacugccauauuucucaccacgcucucucgcaccucgaagaagcggagcuggccccuaaacgaggcgaucauggccguggggaugguauccauccuagccaguagccuccugaagaacgacauaccgaugacgggcccacucgucgcagggggucucuugaccguaugcuacguguuaaccgggcgcagcgccgaccucgaguuagaacgggcggccgacguccguugggaagaacaggccgagaucagcgggucuucgccaauacuguccaucacaaucagugaggacggguccauguccaucaagaacgaagaggaggaacagacgcucaccauccuuauccgcaccggccugcucguuaucucgggccuguuccccgugagcaucccgaucaccgccgccgcgugguaucuaugggaggucaagaagcagcgcgccgguguguugugggacguacccaguccgccgccugucggcaaggcagagcuugaggacggagcguaccggauuaagcagaaaggcauucuaggguacagccaaaucggcgcaggcguuuacaaagaggggaccuuccacacgauguggcauguuacccgaggcgcuguccucaugcacaaggggaagcggaucgagccuaguugggcagacgugaagaaggaccugauaagcuauggagggggcuggaaauuagaaggcgaguggaaagagggggaggaggugcaaguccuggcacuugagcccggcaagaacccgcgugccgugcaaaccaagccuggacucuucaaaacaaauacagguaccaucggcgccgucagccucgacuucucgcccggcaccuccgggucucccaucgucgacaaaaaggggaagguggugggccuguacgggaacggcgucgugacccguuccggcaccuacgugagugcgaucgcccagaccgaaaagagcaucgaggacaacccggaaaucgaggacgacaucuuuaggaagaagcggcugacaaucauggaccuccaucccggggcaggcaaaaccaagcgcuaccucccagccaucguccgggaggcgaucaagcgagggcugcggacgcugauacuagccccuacucgcguaguggccgccgagauggaagaggcccugcgcggcuuacccauccgguaccagacgcccgcgauccgcgcugagcacaccgggcgugagauugucgaccucaugugccacgcuacauucacuaugcgucuacugagccccauacgggugcccaacuacaacuugaucauuauggacgaagcccauuucaccgacccggcuagcaucgcggcccgcgguuacauuuccacccggguggagaugggcgaagcagccgguaucuuuaugacggccacaccgcccgguagccgcgaucccuucccgcagaguaaugcgccuauuauggaugaggagaaggagauacccgagcggagcuggaacuccgggcacgagugggucacugacuucaagggcaagaccgugugguucguccccagcaucaaggccgggaaugacaucgccgcuugccugcgcaagaacggcaagaaggucauccagcugucccggaagacguuugacagcgaguacaucaaaacgcgcacaaacgacugggacuucgucgugaccacagacaucuccgagaugggcgcgaacuucaaggccgagcggguaaucgacccgagacggugcaugaagcccgugauccucacugacggggaggagcgcgugauccuggccggucccaugcccgucacccacucauccgccgcgcagcggcgagggcgggucggccgcaacccgaagaacgagaacgaccaguacaucuacaugggggagcccuuggagaacgaugaagauugugcgcacuggaaagaggcaaagaugcucuuagacaauauaaauacccccgagggcauaauccccagcauguucgagccugagcgcgagaaggucgacgccaucgacggcgaguaccggcugcgcggggaggcccggaagacguucguagaccucaugcgccggggcgaccugcccguguggcuagccuaccgcgucgcggccgaggggaucaacuaugcugaccggcgcuggugcuucgacggcgucaagaauaaccagauccucgaggagaacgucgaagucgagaucuggaccaaggagggggagcggaagaagcugaagccccgcuggcuggacgcacggauauauuccgacccgcucgcacugaaagaguuuaaggaguucgccgcgggucgcaaaagccugacccucaaccucaucaccgagaugggccggcugcccacguucaugacccagaaggccaaaaacgcccucgacaaccuggcggugcugcauaccgccgaagccggaggccgcgccuauaaccacgcccucuccgaacugccugagacacuggagacguugcugcugcuaacacugcuggcgacagugaccgggggcaucuuccucuuccugauguccgguaagggaaucggcaagaugacccugggcaugugcuguaucauuacggcuagcauccucuuaugguaugcccagauucagccccacuggauugcggcuagcaucauccuggaguucuuccucaucguccugcugaucccggagccggagaagcagcgaacgccccaggacaaccagcucacguacguggugaucgcgauccugacugucguggccgccaccauggcuaacgagaugggcuuccuggagaagaccaagaaggauuucggccucggcuccaucacgacucagcagcccgaaagcaacauccuggacaucgaccugcgcccggccagcgcguggacgcucuaugccguggccacaaccuucaucacacccaugcugcgccauuccaucgaaaacagcuccgucaacguaagccucacggccaucgccaaucaggcaaccgugcucaugggacuugggaagggcuggccccuguccaaaauggacauaggggucccacuccuggcgaucggcuguuacucucagguaaacccgauuacuuuaaccgccgcccuccuuuugcucguggcgcacuacgccauuauuggacccggcuuacaggccaaagcaacacgcgaggcccagaagagagcugccgccgggauuaugaagaaccccacggucgacggcaugaccguuauugacuuagaccccauccccuaugaccccaaguucgagaagcagcuuggccaggugaugcuucugguuuugugcgugacucagguguugaugaugaggacgaccugggcccugugcgaggcccucacccuggccacgggacccaucucgacacugugggagggcaaccccgggcgcuucuggaacacaaccauagccgucaguauggccaacaucuuccgcggcuccuaucuggccggcgccggacugcuguuuagcaucaugaagaacaccgccaacacgcgccggggcaccgggaacaccggcgagacgcucggcgagaaguggaagaacaggcuuaaugcccugggcaagagcgaguuucagaucuacaagaaguccggcauccaagagguggaccgcacgcuggccaaggaggggauuaagaggggcgagaccgaccaucacgccgugagccgggggucugcgaagcuacguugguucgucgagcggaaccugguaacuccugagggcaaggucguugaucucggcugcgggcgcggcgggugguccuacuacugcggagggcucaagaacgugaaagaggugaaggggcucacaaagggcgggcccggccacgaggagcccauccccaugagcacguacggguggaaccucgugcggcugcagucgggcguagacguguucuucaccccgcccgagaagugcgacacauuauuaugugacauuggagagagcuccccgaaccccaccguggaggccggccgcacccuacgggugcugaaccucguggagaacuggcugaauaacaacacucaauucugcaucaagguucugaauccguauaugccaucagugaucgagaagauggaagcccugcagaggaaguacggaggggcccucgugcggaacccgcugagccgcaauuccacccacgagauguacuggguuucaaacgccaguggcaacaucguuagcuccgugaacaugaucucucguaugcugaucaaccgauucaccaugcggcauaagaaggcgacauacgagccggacguggaccucgggucuggcacgcgcaacaucggaauagagagcgagacucccaaccuggacaucauaggcaaacggaucgagaagaucaagcaggagcacgagacauccuggcacuaugaccaggaccacccauacaagaccugggcguaccacggcagcuacgaaacgaagcagaccgguuccgccagcuccauggugaacggcgugguacgccuucucaccaagcccugggacguuaucccgaugguaacccagauggcaaugacggauaccacaccguuugggcaacagcgcgucuucaaggagaagguagacacccggacgcaggagccuaaggaaggcaccaagaaacuuaugaagaucaccgccgaguggcuguggaaggaacucggcaaaaagaagacgccccggaugugcacccgggaagaguucacccgcaagguccgaagcaacgcggcccugggugcaaucuuuacagacgagaacaaguggaaaagcgcccgcgaggccguggaagacagcggcuucugggaacugguggacaaggagcguaaccuccauuuagaagggaaaugcgaaacaugcgucuacaacaugaugggaaagcgugagaagaaacugggagaguucgggaaggcgaaggggucccgggcaaucugguauauguggcucggggcccgcuuccuggaguucgaggcccugggauuccucaacgaggaccacugguucagccgggaaaauucgcugagcgggguugagggcgaggggcugcacaaacuuggcuacauucugcgugacguguccaaaaaggagggcggggcgauguacgcugacgacacggccggcugggacaccagaaucaccuuggaggaccucaagaacgaggagauggucaccaaccacauggagggggagcacaaaaagcuggccgaagcgaucuuuaaacugacuuaccagaacaaggucgugcgcguccaacgaccgacgccucgcggcaccgucauggacaucaucuccagacgcgaucagagagggaguggacaaguggucaccuauggccucaacaccuucacuaacauggaggcacagcuaauacgccagauggagggggaagguguauucaaguccauccagcagcugaccgugaaggaggagaucgcgguuaaaaacuggcuaauccggguggggagggagcgauugagccggauggccauaagcggugacgauugcguggugaaaccccuggacgaccgcuuugccagcgcucucaccgccuugaacgauauggggaagguccggaaggacauacaacagugggagcccagccgcggcuggaacgacuggacucaggugccuuucuguucccaucacuuucacgagcugaucaugaaggacggccggguccucguugugccuugccgcaaccaggacgagcugaucgggcgggcccgcauaucccagggagccggguggagcuuacgggagaccgcgugucuuggcaaaagcuaugcccaaauguggagccugauguacuuccaccggcgggaccuucgucucgcggccaacgccaucugcagugccguccccagucacuggaucccgacgucucgaaccacauggucaauacacgccacccacgaguggaugaccaccgaggacaugcugaccguuuggaaucggguguggauccaggagaauccauggauggaagacaagacccccgucgagucuugggaggagauacccuaccuaggcaagcgggaggaucaguggugcgggagccuuaucggucucaccagccgcgcgacaugggcgaagaacauccagaccgccaucaaccaggugcggucccucaucgggaacgaggaguacacggauuauaugcccagcaugaaaagguuccggcgugaggaggaggaggcgggcguacucugguga

SEQ ID NO: 24886 - RNA, 9876 nt, Artificial Sequence
  derived and/or modified CDS sequence (opt11) from DENV-2__KM279544__SS-prME
acggcggggauaaucaucaugaugauccccaccguuauggcguuccaccugaccacccguaacggggaaccccacaugaucguuucccgacaggaaaaggggaaaagccuccuguucaagaccgaaaacggggugaacaugugcacacugauggcaauggaccucggcgagcugugcgaggacacgaucacguauaacugccccuugcuaagacagaacgaacccgaggacaucgacuguuggugcaacagcaccagcacgugggugaccuacgguaccugcaccgcgacaggcgagcaucggcgggaaaagagguccgucgcacuggugccccacguugggaugggccuugaaacccggacagagaccuggaugagcagcgagggggccuggaagcacgcgcaaagaaucgagaccuggauccugcgucaccccggauucacgaucauggcugccaucuuggccuacacaaucggcaccacauauuuucagcggguccucauuuuuauccuccuuaccgccguuaccccguccauggcgaugaggugcauuggcaccuccaaccgggacuucguggagggagucagcggcggcucauggguggacaucgugcuugagcacggcagcugcgucaccacgauggcaaagaacaagcccacccuagacuuugaguuaaucaagacagaggccaaacaccuggcuacccucagaaaguacugcgucgaagcgaaacuuacgaacaccacuacugcgucgagaugucccacccaaggcgagccaucucugaacgaggaacaggacaagcgcuuuguaugcaaacacagcauggucgauaggggcuggggcaacggcugcggacucuucgggaagggcgggaucguuaccugcgccauguuuacguguaagaagaacauggagggcaaggugguccagcccgagaacuuagaguacacaaucgugauaacaccccacucaggugaggagaacgcuguggggaacgauacaggcaagcaugggaaggagaucaaagucacgccccagucguccauuaccgaggccgagcuaacgggcuacgggacggugacgauggagugcucaccgcgcacaggccuggacuuuaaugagaugguguuauuacaaauggagaauaaagccuggcucguccaccggcagugguucuuggaccugccccugccauggcuacccggcgcggacacgcaggggagcaacuggauucagaaggaaacgcuggugacauucaagaacccccacgccaagaagcaggacguugugguucucggcucacaggagggggccaugcacacugcccuaaccggagccacggagauccaaaugagcucugggaaccuccuuuucaccggccaccuuaagugccgccugaggauggacaaacuccagcugaaaggcaugagcuacuccaugugcaccgggaaguuuaagguugugaaggaaaucgcggaaacccagcacggaaccaucguaauucgcguccaauacgagggggacggcucccccuguaaaauccccuucgaaaucauggauuuagaaaagcgccaugugcucggccgccugaucaccguaaauccgauagucaccgagaaggacuccccgguaaacaucgaggccgagccuccguucggggacagcuauaucaucaucggcguggagccggggcagcugaaacuuucuugguuuaagaagggcucauccauaggucagauguucgagacuacaaugcgcggagcaaagagaauggccauccuuggggacaccgccugggacuucgguucucugggcgguauguucaccuccauugggaaggcguugcaccaggucuucggugcaaucuacggcgccgcuuuuagcggcguguccuggacaaugaagauacugaucgguguugucaucacguggauuggcaugaacucucgcuccaccagcuugucagugagccuggugcuagucgggguggugacacuguauuuaggcgucauggugcaggcggacagcggguguguggucagcuggaagaacaaggagcucaagugcggcagcggcauuuucaucaccgauaacguucauacguggacggagcaguacaaguuccagccagagagucccucuaagcuggccagcgcgauccaaaaggcccacgaggaaggaaucuguggcauacgcagcgugacccggcucgagaaucucauguggaagcagaucacccccgagcuuaaccacauacugacagagaacgagguaaagcucacgaucaugacuggggacauuaagggcaucaugcaagccgguaaaaggucccuccgcccccagcccaccgagcugaaauacagcuggaaggcguggggaaaggcgaagaugcuguccacggagcugcacaaucauaccuuccucaucgauggcccugagacagccgagugccccaacaccaaccgggcauggaacucguuagagguugaggauuacggguucggcguguuuacgacaaauaucuggcugaagcugaaagaacgacaggacgucuucugcgacuccaagcucaugucggccgcuaucaaggacaaccgcgcuguccaugccgauaugggguacuggaucgaguccgcccugaacgacaccuggaagaucgagaaggccagcuucaucgagguaaaauccugucacuggcccaagagccacacccuguggucgaacggcguucucgaaagcgagaugaucaucccuaagaacuuugccggucccgucucccaacacaauuaucgcccuggauaucacacucagacugccggaccauggcaucuggggcgucuggaaauggacuuugauuucugcgagggcaccaccgugguagugaccgaagacugcgggaaucgugggcccagccuccggacuaccacggccucgggcaaguugaucaccgaguggugcugccggucauguacgcugccgccgcuccgguaccgcggggaggacggcugcugguacgguauggaaauccggccguugaaagagaaagaggaaaaucuuguaaauagccuugugaccgcgggccacggccagauugauaacuuuucccucggcguuuuaggcauggcucucuuccuggaggagaugcugcgcacaaggguugguaccaagcacgccauccugcugguggccgugagcuucgugacgcugauuaccggcaacauguccuuucgcgaucucggccgagucauggucaugguuggcgccaccaugacggacgacauagggaugggagucacauaccuggcccuuuuagcggccuucaaagugcggcccacauucgccgcgggccugcuacugcgcaaacuuaccucuaaggaacucaugaugacaacgaucggaauuguccucuuaucgcagagcaccauucccgagucaauauuggagcugaccgaugcccuagcgcugggaaugauggucuugaagaucgugcggaacauggagaaguaccagcuugccgucaccaucauggcgauccuguguguuccgaaugcggugauacugcagaacgccuggaagguaaguugcacgacuuuagcuguggucuccgucucgccguugcucuugaccuccagccagcagaaggcggacuggaucccacuggccuuaaccaucaaggggcuaaaccccacggccauuuuccugaccacccucucccgcacauccaagaagcgguccuggccccuaaaugaggcgaucauggcugugggcauggugagcauccuggcguccaguuuacuaaagaacgacauaccgaugacggguccccuggucgccgguggguugcucaccgugugcuacguacugaccgggcgcuccgccgaucucgaacuggagagagccgcugacgugcguugggaggaacaggccgaaaucuccggcagcagucccauacuuucuauuaccaucucagaggacgggucgauguccaucaaaaacgaagaagaggagcagacgcucaccauccugauccggaccgggcuucucgugaucagcggccuguuccccguauccauuccgaucaccgccgccgccugguaccucugggaggucaagaagcagcgcgccggggugcuaugggacgugccuuccccgccucccgucgguaaggccgagcuggaggacggggccuaccggaucaagcagaagggaauacuuggcuacucccagaucggagccgguguauauaaagaggggaccuuccacacgauguggcacgugacacgcggcgcgguccuuaugcacaaggggaagagaauagagcccagcugggcugacgugaaaaaggaccugaucuccuacggagggggcuggaagcuagagggcgaauggaaagagggggaggaggugcagguauuagccuuggaacccggcaaaaacccccgcgcggugcagaccaaacccggacuguuuaagacuaauacgggcacgaucggcgccgugagcuuagacuucucccccggcaccaguggcucccccauagucgacaagaaggggaaaguggugggccuguacggaaacgggguaguuacccggagcggcacauacguauccgcgaucgcgcaaaccgagaagaguaucgaggacaauccggagauagaggacgacaucuuucgcaagaagcggcugacaaucauggaccugcaucccggggcgggcaaaaccaaacguuaucuaccagccaucguacgugaggcaauaaagcgaggccugcggacccugauucuggcgcccacccgcgucguugcugcggagauggaggaggcucugaggggccugccgauccgguaccagacccccgcgauccgggccgagcauaccgggcgcgaaaucguggaucuuaugugccaugcaacauucaccaugcgccugcugucacccauccgggugccgaacuauaaccucauuaucauggacgaagcccacuucaccgauccggcauccaucgcggcccgcggcuacauaagcacccggguggagaugggcgaagccgcuggaaucuucaugacagccacuccgcccggaagucgcgaccccuuuccacaaucaaacgcgcccaucauggacgaggagcgggagauccccgagcgguccuggaacagcgggcaugagugggucacggauuucaaagggaagaccgugugguucgugcccuccauuaaggcggggaaugacaucgccgccugccugcggaagaacgggaagaagguuauccaacugagccggaagacuuuugacucugaguacaucaagacccggaccaaugacugggacuucguggugaccacggacaucucugagaugggcgcaaauuucaaagccgagcgcguuauugauccgcggcgcugcaugaagcccgugauccucaccgacggugaggagcggguaauccuggccggucccaugccuguuacccacuccagcgccgcccagcgaagaggccgcguaggucgcaauccgaagaacgagaaugaucaauacaucuacaugggggagccccuggagaacgaugaggacugcgcgcacuggaaggaagccaagaugcuccuugacaacaucaacaccccagagggaaucauccccuccauguuugagccggagcgggagaagguggacgccaucgacggcgaguaccgcuuaagaggggaggcgcgcaagacguucgucgauuuaaugcgacgcggcgaccuucccguguggcuggcguaccgggucgcggcggaggggaucaacuacgcggaccgccgcuggugcuuugacggcgugaaaaauaaucagauccuggaggagaacguagagguggaaaucuggaccaaagagggagagcgcaaaaagcugaaaccccgguggcuggaugcuaggaucuacucagauccccucgcccugaaggaguucaaagaguucgcggccggccggaagucgcugacccucaaccugaucaccgaaaugggccgacugccuacuuucaugacacaaaaagcaaagaacgcccucgacaaccuggcggugcugcacaccgccgaggccggagggcgugccuacaaccaugcccuuucggaacugcccgagacucuagagacucuccugcugcuaacacugcuggcgaccgugacuggggguauuuuucucuuccugauguccggaaaggggaucggaaagaugacacuggggaugugcuguauuauuacugccucuauccucuugugguaugcccaaauccagccccacuggauagccgccuccaucauacuggaguucuuuuugauuguccugcuaauaccggagccggagaagcagcgcacuccacaggacaaccaacuuaccuacgugguuaucgcgauccugacugucguggccgcaacuauggccaaugagauggguuuccuggagaagaccaagaaggacuucggacuaggcagcauaaccacccagcaacccgaaucgaacauccucgacaucgacuuacgaccggcauccgcuuggacgcuauacgccguugccaccaccuuuaucaccccgauguuacgacacagcaucgagaacuccagcgucaauguuucccucacagcuauugccaaccaagcuacgguucuaaugggccuagguaagggcuggccacugagcaagauggacauaggggucccacuccuggcaaucgggugcuacucccaggugaaccccaucacauugaccgccgcacucuugcugcucguggcgcacuacgcaaucaucgggcccggccuucaggccaaagccacacgggaggcccagaagcgcgcagccgccggcaucaugaaaaauccuaccguggaugggaugaccgugaucgauuuagaccccauuccauaugaucccaaguuugagaagcagcuuggccaggucauguugcuaguccucugcgugacccaggugcuaaugaugagaacgacuugggcccuuugcgaggcccucacccuggcaaccgggcccaucucaacacugugggagggcaaccccgggagguucuggaauacaaccaucgccgucucgauggcgaacaucuuccgggggagcuaccucgccggcgccgggcugcuguucuccauaaugaagaacaccgcgaacacgcgucgcggcacuggcaauaccggagaaaccuugggugagaaguggaagaaccggcugaacgcccugggcaaaagcgaguuccaaaucuacaagaaguccggcauccaagaaguggaucgcacgcuagccaaggagggaaucaaacggggcgaaaccgaccaccacgccguuucgaggggguccgcgaaauugcggugguucgucgagaggaaccugguaacacccgaaggcaaggugguagaccucggcugugguagaggcggguggucguacuacugcggcggccugaaaaacguuaaggaagugaagggccugaccaaaggcgggcccggccacgaagaacccauccccauguccacguacggguggaaccucguccgucuacaaagcgguguggacguguucuucaccccgccggagaagugcgauacccugcuuugcgauauuggggagaguagccccaaccccacggucgaggccggacgaacccugcgcguauuaaacuugguggagaacuggcugaacaacaacacgcaguucugcaucaagguccucaacccguauaugccaagcgugaucgagaagauggaggcacugcagcgcaaguacgguggggcccucgugcgcaacccccucucgcggaauagcacacaugaaauguacugggucuccaaugcgagcggcaauaucgugucuucggugaacaugaucuccaggauguuaaucaaccgguucaccaugcgccacaagaaggcuaccuacgagccggacguugaccucgggagcgguacgcguaacaucgguaucgaguccgaaaccccgaaccuggacauuaucggcaaacgcauugagaagaucaagcaggaacacgagaccagcuggcacuacgaccaggaccaccccuauaagaccugggcauaccacggcucuuacgagacgaagcagaccgggucggcauccagcaugguaaacggcgucguccgccuccucaccaaacccugggaugugaucccaaugguaacccagauggcuaugacugacaccacccccuuugggcagcaacgcgucuucaaggagaagguggacacccgcacgcaggagcccaaagagggaacaaagaaguuaaugaaaaucacugccgaauggcuauggaaggaacucggaaagaagaaaacaccccggaugugcacgcgggaggaguucacacggaaaguccgaagcaacgcggcauugggggcgaucuucaccgacgagaacaaguggaaguccgcccgugaggcgguggaagacucaggcuuuugggagcugguggacaaggagcgcaaccuccaccuggaggguaagugcgagaccugcgucuacaacaugaugggaaagcgugagaagaagcugggggaguuuggcaaagccaaggggucgcgcgccauuugguauauguggcugggcgcgcgauuccuggaguucgaagcccugggauuccuaaacgaggaccacugguuuucccgcgagaacagccugagugggguggagggggaaggacugcacaagcucggauacauccuucgggacguaaguaagaaggagggcggggcaauguaugccgacgacacggccggcugggacacccggaucaccuuagaagaccucaagaacgaagagaugguuaccaaucacauggagggagagcacaagaagcuggccgaagccauauucaagcugacguaccaaaacaaggugguccggguucagcgccccacgcccagaggcaccgugauggacauaaucagccgccgggaucagcgcgguuccggacaggugguaaccuacggcuuaaacaccuucacgaauauggaggcgcaacucauucggcagauggagggggaggguguguucaagagcauccagcagcugaccguaaaagaagagaucgcggucaagaauugguugauacgcguggggcgagagcgccucucccgcauggcaaucagcggcgacgacugugugguuaagccccuggacgacagauucgcgucugccuugaccgcccugaaugacaugggaaagguucgaaaggacauccagcagugggagcccagccggggguggaaugacuggacccaggugccguuuugcagucaccacuuccacgagcugauaaugaaggacggccgcguguugguagugcccugccgaaaccaagacgaguuaaucgggcgcgcccggauaagccagggugccggguggucccugcgcgagaccgcuugccucggcaagagcuaugcacagauguggucccugauguauuuccacagaagagaccuucgccucgcagcgaaugcuaucugcuccgccgucccuucccacuggauacccacuucacguaccaccugguccauccaugcgacccaugaauggaugacaaccgaagacaugcugaccguguggaaucgggucuggauccaggagaauccguggauggaagacaagacgcuggucgagagcugggaagagauuccauaccuggggaagcgagaggaccaguggugcggcagccugaucggccugacuucccgcgcgacuugggccaagaacauacagacagccaucaaucaggugcgcucucucaucggaaacgaggaguauacagauuacaugcccagcaugaagcgcuuucgcagagaggaggaggaagcuggcguacugugguga

SEQ ID NO: 24887 - RNA, 9876 nt, Artificial Sequence
  derived and/or modified CDS sequence (opt11) from DENV-2__KM279549__SS-prME
acugcgggcaucauuaucaugaugauccccaccgugauggcguuucaccuaacaacucggaauggcgagccucacaugauagucagccggcaagagaagggcaagagccugcuauuuaagaccgagaacggggucaacauguguacccugauggcgauggaccugggcgagcuuugcgaggacaccaucacguacaacuguccccugcuccgccagaacgaacccgaggauaucgacuguuggugcaacagcacguccaccugggugaccuacgguacaugcaccgccaccggugagcacaggagagaaaagaggucggucgcgcuaguuccccauguuggcaugggccuggagacccgcacggaaaccuggaugucgagugagggugccuggaagcaugcacagcggaucgagacauggauucuacgucacccaggguucacgaucauggccgcuaucuuggccuauaccauuggcacaacuuacuuucagcggguccugauuuucauucuucugacggcagugacccccuccauggcgaugaggugcauaggcauaucaaaccgggacuucguagaaggugucuccggcggaucguggguggacaucguguuggagcacggcuccugugucaccaccauggcuaaaaacaagcccacgcucgacuucgagcucaucaagaccgaggccaagcacuuggcgacccuccgcaaauauugcguugaggccaaacugaccaacacgaccaccgccucuagguguccuacccagggcgagcccucacugaacgaggaacaggacaagcgcuuugugugcaagcauagcauggucgaccggggcuggggaaacgggugcggccuguucgggaagggcgguaucgugacgugcgcgauguuuaccugcaagaagaauauggagggcaaggugguccaaccggaaaacuuggaguacaccaucguuaucaccccccacuccggugaggagaaugccguggggaacgacacgggcaaacauggcaaagagaucaagguuacgccccagagcaguaucaccgaggccgagcuuaccggauacgggacgguuacgauggagugcucaccccgcacaggacuugacuuuaaugagaugguacugcugcagauggagaacaaggccugguugguccacagacaaugguuccuggaccugccccuccccuggcuacccggcgcugacacacaaggcagcaacuggauacaaaaggagacucugguaacguucaaaaacccacacgcaaaaaaacaggacgucgugguguugggcagccaagagggggcaaugcacaccgcccucaccggcgcgaccgagauccagaugagcucagggaaccucuuguuuacgggccacuuaaagugucgccuacggauggacaaacuccaauugaagggcaugagcuacuccauguguacggguaaauuuaagguggugaaagagaucgcugagacccagcacggcacgauugugauccgcguccaguacgagggagacggcucgccuuguaagauucccuucgagaucauggaccucgaaaagagacacgugcucggccgccucaucacgguuaacccuaucguuaccgaaaaggacuccccagugaacaucgaggccgagccgccuuucggggacucguacaucaucaucggcgucgagcccgggcaguuaaagcucuccugguucaaaaaagggagcuccaucggacagauguuugagacaaccaugcgcggugccaaacggauggccaucuugggcgacacggccugggacuucggaagccugggcgggguguucaccuccaucggcaaagcgcuccaccaggucuuuggggcuaucuacggcgccgcauucaguggcguguccuggaccaugaagauccugauaggggucguuaucaccuggauuggcaugaacagccgcuccacgagccugucugugucuuuaguacucgugggaguugucacccuguaccugggggucaugguucaggcggacucagggugugucgugucauggaaaaauaaggagcucaagugcggaaguggaaucuucaucacagacaacguucauacguggacagagcaguacaaguuccaaccagagucccccagcaaauuagcauccgccauccagaaagcccacgaggaggggaucugcggcauccgaucagucacacgcuuagaaaaccucauguggaagcagaucacccccgagcuaaaucacauccugaccgagaacgaaguuaaguuaacgaucaugaccggugacauaaaaggcaucaugcaggcugggaaaaggucccugcgcccccagccgaccgagcugaaguacaguuggaaggcgugggguaaggccaagaugcucuccaccgagcuucauaaccauacauuccugaucgacggccccgaaacugccgagugucccaacacgaaucgggcuuggaauagucuagagguugaggacuauggguuuggcgucuucacaacgaacaucuggcugaaacucaaggagcgccaggacgucuuuugugacaguaagcuuaugagcgccgcgaucaaggacaaucgggccguccaugccgacauggguuacuggaucgaguccgcucugaaugacacauggaagauugaaaaggccagcuucaucgaagugaaguccugccacuggcccaagagccacacccugugguccaacggcgugcuugagucggagaugauuauacccaagaauuuugcgggcccggugucccagcauaacuaccgcccuggguaccacacccagaccgcggggcccuggcaucuggggcggcuggagauggacuucgacuucugcgagggcacgaccguggucguaaccgaggacugugggaaccgcgggcccucucuccgcaccacaaccgccagcggcaagcugaucaccgaguggugcugcagaaguuguacacugccgccucuucguuaccgcggugaggacggcugcugguacggaauggagauccggccguuaaaggagaaggaggaaaaccuggucaacagccuggugacggccggacacgggcaaaucgacaacuucucccugggcguacugggcauggcacuuuuucuggaggagaugcugcgcacucgggucgggaccaaacaugccauucucuuaguggccgugagcuucgugacgcugaucacuggaaacaugagcuuucgcgaccucggacgcguuauggucauggucggagccaccaugaccgacgacauugggaugggagugacauauuuggcguuacuugcggcauucaaggugcguccuacauucgccgccggucuacuccuccgcaaacuuaccagcaaggagcugaugaugaccacuaucgggauaguccuacugucucagucaacaaucccggaguccauccucgagcucacugacgcccuggcgcuaggcaugaugguguuaaagaucguccguaacauggagaaauaccagcuugccgucaccaucauggccauccugugugugcccaacgcagucauccuacaaaacgccuggaagguguccugcaccacccuggcgguuguauccgugagcccguuacuccugaccuccagccagcagaaggccgacuggaucccgcuggcccugacaauuaaggggcugaaucccacagccaucuuccugacgacccucucccguaccagcaagaaacggucguggccccucaacgaggccaucauggccgucgguaugguaucaauccuggccucuagcuuacugaaaaacgacaucccgaugaccgggcccuuaguggccggcgggcuccugacggucugcuauguccugaccgggcgcuccgcggaccucgaacuggagcgagcggccgaugugcgaugggaggagcaggcagaaaucuccgguagcagcccuaucuugagcaucacaauauccgaggacgggagcaugagcaucaaaaaugaagaggaggagcagacccuuacuauccucauacguaccggccuucucgugaucagcggccuguuccccgucucuaucccgauuaccgccgcagcgugguauuuaugggaggugaagaagcagcgagcuggggugcucugggacgucccgagcccgccgcccgugggcaaggccgaacucgaggauggggcguaccgcaucaagcaaaagggcauccugggguacucccagaucggcgccgguguguacaaggaggggaccuuccacacgauguggcaugucacgcguggcgccgugcuuaugcacaaggggaaacguaucgagccaagcugggccgacgugaagaaggaccuaaucuccuacggagguggauggaagcuggaaggcgaguggaaggagggugaggagguccaagugcucgcccuugagcccggcaagaauccgcgggccgugcagacaaagcccggucuguuuaagaccaacacugguacgaucggugccguuucccucgacuuuuccccuggcaccaguggcucaccuaucgucgacaagaaggggaagguggucggccucuacgggaacggcguggucacccggucgggcaccuacgucuccgcgauugcccaaacggagaaaaguaucgaggacaacccagagaucgaggacgacauuuuccgcaaaaaacgccugaccaucauggaucugcaccccggggccggcaaaacaaagcgcuaucuccccgccaucgugcgcgaagcgauuaagcgggggcuacggacucugaucuuggcaccaacgcgcguagucgccgcugaaauggaagaagcgcuuagaggccuuccgauccgauaucagaccccugccauucgcgccgagcacacugggagagagaucguggaucuuaugugccacgccaccuucacgaugcgccuacuaagcccuauccgggugccaaauuauaaccugaucauuauggaugaggcccacuucaccgaccccgccucaaucgcagcgcgcggguacaucagcaccagaguagagaugggagaagcggccgggauauucaugacugccacuccgccggguucucgagaccccuuuccccagucgaacgcgcccauaauggacgaggagcgggaaauccccgagcgcuccuggaacagcgggcaugagugggugaccgacuucaagggcaagaccgugugguucgucccuuccaucaaagccgggaaugacaucgccgccugccugagaaaaaacgguaaaaaggugauacagcugagucguaagaccuucgacuccgaauacauaaagacgcggacaaacgacugggacuucgucgugacuaccgacauuagcgagaugggagcuaacuucaaggccgagagagucauagacccccggcgcugcaugaagcccgugauccucacggacggagaggagcgugugauccuggccgggcccaugcccgucacgcacuccucggcugcucagcgcagagggcgcgucggucgcaaucccaagaaugaaaaugaccaauacaucuacaugggagagccccuggagaaugaugaggacugcgcgcacuggaaggaagccaagaugcuucuggacaacauuaacacccccgagggcaucaucccuuccauguucgagccggagcgggagaaggucgacgcgauugacggcgaauaccgccuccgcggugaggcccgcaagacauucguugaucucaugagaagaggagaccugccuguuuggcuggccuaccggguggcugccgaagggauaaacuacguggaccgccguuggugcuucgacggcgucaaaaacaaccagauccucgaagaaaacguggagguggagauuuggaccaaggagggagagcgcaagaaacugaaaccccgguggcuggacgcccguauuuacagcgacccgcuagccuugaaggaguucaaggaauucgccgcgggccgcaagucccuaacguuaaaccugaucacagagaugggacggcuacccacauuuaugacgcagaaggcuaagaaugcccucgauaaucuugccguccugcacaccgcagaggccgguggcagggccuacaaccacgcgcucagcgaguugccggagacgcuggagacucugcugcugcugacucugcuugcgaccgucaccgggggcaucuuccucuuccugauguccggcaaggggaucgggaaaaugacucuggggaugugcuguauuaucacugcgagcauccuguuaugguacgcccagauccagccccacuggaucgccgccagcaucauccuggaguucuuccucauugugcuacucaucccggagccugagaagcagcgcaccccccaggacaaccaacucacuuacguaguaauugccauacugaccguugucgccgccacuauggccaacgagaugggauuccuggagaagacgaagaaggauuucgggcuaggcagcauuacgacccagcagcccgaaagcaacauccuggacaucgaccugcggccugccuccgccuggacccucuacgcgguggccacaaccuuuauuacccccaugcugcgccacuccaucgagaauuccuccgugaacguauccuuaaccgccaucgcaaaccaggcuacggugcuuaugggcuugggcaagggcuggccgcucagcaagauggacaucggagugccgcuccuggcgauaggcuguuacucccaggucaauccgaucacgcugacggcagcccuccugcugcucgucgcccacuacgcgaucaucggaccuggcuuacaggccaaagcgaccagggaggcacagaagcgcgcugcggccgggaucaugaagaaucccacgguggacgggaugaccgucaucgaccucgaccccauucccuacgacccgaaguucgagaagcaguuggggcagguaauguuguugguccucugcgucacccaggugcuaaugaugcggaccacgugggcgcugugugaggcccuaacauuagccaccggcccgaucagcacauuaugggagggcaaccccggacgcuucuggaacacgaccaucgcugugucuauggccaacaucuucagagggucguaucucgccggcgcugggcuccuguuuuccaucaugaagaacacagcaaacaccaggcgcggcacagggaauaccggggaaacacucggugagaaauggaagaaccgucugaaugcgcuaggcaagagcgaguuucagaucuacaagaagagugggauccaggagguggaccguacccucgccaaggaggguaucaagcggggcgagacggaccaccaugccgugagccgcggaucggcaaaguuacgaugguucgucgaacgcaaccuggucacuccggagggcaaagugguggaccuagggugcggccggggcggauggucguacuacugcggcgggcuuaaaaacgucaaggaggugaagggccugacuaagggaggucccggccacgaagagcccaucccuaugucuacuuacggguggaaccucgugcgccugcagagcggcgucgacguguucuucacgccucccgagaagugcgauacguugcucugcgacaucggggaguccagccccaacccuaccguugaggcgggcagaaccuuacguguucuaaaccuuguagaaaacugguuaaacaacaauacccaauucugcaucaagguacucaacccguacaugccgucgguaaucgagaagauggaagcacugcagcggaaguacggcggggcacucguucguaaccccuuaucccggaacuccacgcacgagauguacuggguguccaacgcuuccgggaauaucgucucuucagugaauaugauuucccgcaugcugauaaaccgguuuaccaugagacacaagaaggccaccuacgaacccgacguugaccuugggagcggcaccagaaacaucggaaucgaguccgagacccccaacuuggacauaaucggcaaacgcaucgagaagaucaagcaggagcacgaaaccucguggcacuacgaccaagaccacccuuacaagaccugggcguaucacggcuccuaugagacgaagcagacggggagugccucaagcauggucaacgguguagugagacugcucacuaagcccugggacguaaucccgauggugacccagauggccaugacugauacgacacccuucgggcagcagcgggucuucaaagaaaaaguggauaccagaacccaggagcccaaggagggcacgaagaagcugaugaagaucaccgcugaguggcuguggaaggagcucggcaagaagaagacgccccggaugugcacccgcgaagaguucacacgaaagguuaggucaaacgccgcgcugggcgccaucuucaccgacgaaaacaaguggaagagcgcgcgggaggccgucgaggacaguggcuucugggagcuuguggauaaggagcguaaccuccaucuggagggcaagugcgagacgugcguguacaauaugaugggcaagcgggaaaagaagcugggggaguucggcaaggccaagggcagccgugcuaucugguacauguggcugggggccagauuucuggaguucgaggcccugggauucuugaacgaggaucauugguucuccagagagaacagccucucgggugucgagggcgagggacuacacaagcucggauauauccugcgcgacguuuccaaaaaagagggcggugccauguacgcggacgacacagccggcugggauaccagaaucacccuggaagaccucaagaacgaggagauggugaccaaccauauggagggggaacauaagaagcuggccgaagccaucuuuaagcugacuuaccaaaacaagguagugcggguucagcgcccgacuccccgggguaccgucauggacauaauaucgcgccgagaccagcguggaucugggcaagugguaacauacggccucaacaccuucaccaauauggaggcccaguuaauccggcagauggagggugaaggcguuuucaagucuauucagcaacuuacugugaaagaggagaucgccgugaagaacugguuaauccgagucgggcgcgaacgacugagucgcauggcaaucuccggcgaugauugcguggugaagcccuuggacgacagauuugccagugcucucaccgcccugaacgacauggguaagguucgcaaggacauacaacaaugggagccuagccggggauggaacgacuggacccagguuccguucugcucacaccacuuccaugagcugaucaugaaggacggucgcgugcuggucgugcccugucggaaccaagaugaauugaucgggcgcgcuaggaucucucagggcgccggaugguccuuacgugagacugcaugcuuggggaagucauacgcucagauguggucacugauguacuuccaucggagagaccugcgccucgccgcaaacgcgauuugcagcgccguucccucacacuggaucccaacgucucggaccaccuggucgauccacgccacccacgaguggaugacuaccgaggacaugcuaaccguguggaaccggguauggauccaggaaaauccguggauggaggacaaaacccccguggagaguugggaggagauaccguaccucggcaaacgcgaggaucaguggugcggaucccucaucggccuaacguccagggccaccugggcgaagaacauccagacugccaucaaucagguccggucgcuuaucgguaaugaggaauacaccgacuacaugcccuccaugaaacgguucaggagggaggaagaggaagccggcguucucugguga

SEQ ID NO: 24888 - RNA, 9876 nt, Artificial Sequence
  derived and/or modified CDS sequence (opt11) from DENV-2__KM279552__SS-prME
accgcggggauuaucauaaugaugauuccuacggugauggccuuccaccuuaccacccggaacggggagccccauaugauugucagccggcaggaaaagggcaagucccuucuguucaagacagagaacggggugaacaugugcacccugauggcgauggaucucggcgaacugugcgaggauacgauuacguacaauugcccccugcuuagacagaacgaacccgaagacaucgacugcuggugcaacagcaccagcacuugggugaccuacgggacuugcaccgcaacaggcgagcaccgccgcgagaagcggagcguugcccugguaccucaugugggcauggggcuagagacacgaaccgagaccuggaugucaagcgagggcgcauggaagcaugcacagagaaucgagacauggauccuccgccaccccgguuucacaaucauggcugccauauuggcguacaccaucggcaccaccuacuuccagcgggugcugaucuucauuuuacugacggcggugaccccgucgauggcgaugcgaugcaucgggaucagcaaccgggacuucguggagggcgucucgggcgggagcuggguagacaucgugcuggagcacggcuccugcgucacgaccauggccaagaacaagcccacgcuggacuucgagcugaucaagaccgaggccaagcacuuggccacccuccgaaaguacugcguggaagcaaagcugacaaacaccaccacggcuagccgaugccccacccagggggagcccucucuuaacgaagaacaggacaagcgcuucguguguaagcacagcauggucgaccggggcuggggcaacgggugcggucucuucgggaaaggagggaucgugacgugcgccauguucacguguaagaagaacauggagggcaaggugguccaaccugagaaccuagaguacacaaucguaaucacgccucacuccggcgaagagaacgccgucgggaaugauacgggcaaacauggcaaggagaucaaggucacgccgcaaagcucgauaaccgaggcggaacucaccggcuacgguaccgugacgauggaguguuccccgcgcaccggccucgauuuuaaugagauggugcuccuucagauggagaacaaggccuggcucguacaccggcagugguuucuggaccugccccuccccuggcugccuggugcggacacccagggcucgaacuggauucaaaaggagacccuggucacguucaagaacccgcacgccaagaagcaggacgucguugugcuaggcagucaggaaggggccaugcacaccgcccucacgggagcgacggagauccagaugagcucagggaaccucuuguucacgggccaccugaagugccgccuacggauggauaaguuacagcuuaagggcaugagcuacuccaugugcaccgggaaguucaaggucgugaaggagaucgcggagacucagcacggaacuaucgucauccgcguacaguacgagggggacggcagcccuugcaagaucccuuucgagauaauggaccuggagaagcggcacgucuuaggcaggcugauaacggugaacccaauagucaccgagaaggacuccccggugaacaucgaggccgagccgcccuucggggacagcuacaucauuauaggcguggagccugggcagcugaagcucuccugguuuaagaaagggagcuccauugggcagauguucgaaaccaccaugcgcggcgcaaagcggauggccauccugggcgacacggcuugggacuucgggagccugggcggugucuucaccuccauuggcaaggcgcuccaccaagucuucggggccaucuacggcgccgccuuuagcggugugagcuggaccaugaagauacugaucggugucgugaucacuuggauaggaaugaacagccgcuccacaagucuguccgugagccugguccucguugggguaguaacccuuuaccugggcguuaugguacaggccgauuccgggugcgucguuuccuggaaaaacaaagagcucaaguguggcuccggaaucuucaucaccgauaacgugcacaccuggacggagcaguacaaguuccagcccgagucgcccagcaagcuggccucagcaauccagaaggcccacgaagaggggaucugcggcauucgguccgucacgcggcuggagaaccuaauguggaagcagaucacucccgagcugaaccacauccugacagagaacgaagugaagcucacgauaaugaccggggacaucaagggcauuaugcaggcggggaagcggucccugagaccccagccgacagagcugaaguacagcuggaaggcguggggaaaagccaagaugcucuccacggagcugcacaaccacacguuucugauagacggaccugagacugccgaaugucccaacaccaaucgggccuggaacagccucgagguugaagauuacgguuucggcguauucaccacgaacaucuggcugaaauugaaagagcgccaggauguguucugcgacuccaaauuaaugagcgccgccaucaaagacaaccgggccguacaugccgacaugggguacuggaucgagagcgcccugaaugacacauggaaaaucgagaaggccuccuucaucgaggucaagucgugccacuggccaaaaagccacacacuguggucaaacggcguccucgagucggagaugaucaucccaaagaacuuugcgggacccgugucccagcauaacuauagaccaggguaucacacccagacagccggaccuuggcaccugggacgucucgagauggauuucgacuucugcgagggcacgacgguugugguaacagaggacugcggaaaucgcggcccuagccucagaacgacgaccgccaguggcaaguugaucaccgaguggugcugcagauccugcacccugccgccccuacgguaccgcggggaggacggcugcugguacgggauggaaauacggccguugaaggagaaggaggagaaccuaguuaacucgcucguaacggcgggucacgggcaaauugacaacuucagucuagguguccuuggcauggcacucuuccuggaggaaaugcugcgcacccgggucgggacgaaacacgcaauacugcuaguggccguuagcuuugucacguuaaucacgggcaacaugucguuucgcgaccucgggcgcguuauggugauggucggcgcuaccaugaccgacgacauugggaugggcgucaccuaucuugccuuacucgccgccuuuaaaguccggcccacguucgccgccggccuccugcuccgcaagcugacuagcaaggagcugaugaugaccaccaucgguaucguucuccuaagucauaguacuaucccggaguccauucuggagcucacugacgccuuggcucugggcaugaugguucucaaaaucguccgcaacauggagaaauaucagcuggcaguuaccauuauggccauccugugcguccccaacgcugucauccuccagaacgccuggaaggucagcuguaccacgcuggcggugguuuccgugagcccgcugcuccugacauccucccagcagaaggccgacuggaucccccuugccuuaacuauuaaaggacugaaccccaccgcuaucuuccugacgacccucucccgcacaaguaagaagcgguccuggccccucaacgaagcgaucauggccguggggauggugagcauucucgccaguucgcuacugaaaaacgacaucccgaugaccggcccccugguugccgguggacuacuaacgguuugcuacgugcugaccgggaggagcgcagaccuggaacuggagcgggcugcagacgugcgcugggaggagcaggccgaaaucuccgggagcucccccauccugucaaucaccauuuccgaggauggcagcauguccaucaagaaugaagaggaggagcaaaccuugacgauccugaucagaaccggccugcucgucaucucaggcuuauucccggucucuauaccgaucaccgccgccgcaugguaccugugggaggugaagaagcagcgcgcgggggugcucugggacguccccagcccgccucccgugggcaaggcagagcuggaggacggggcuuaucggaucaaacagaaggggauccuuggguacucccagaucggugccggaguguacaaagaagggacauuccauaccauguggcacgugacgcgcggcgcagugcugaugcacaaggggaagcggaucgagcccagcugggccgacgucaagaaggacuugaucagcuacggagguggauggaaacuggagggcgaauggaaagagggggaggaaguccaggugcucgccuuggagcccggcaagaacccgcgcgccguccagaccaagccuggguuauucaagacaaacaccggcacgauuggagccgugucccucgacuuuucacccggaacuagcggcucccccaucguggacaagaaagguaaggugguaggccuguacgggaacggcguggugacccguagcggcaccuauguaagugcuaucgcccagacggagaaauccaucgaggacaaccccgagauagaggacgacauuuuccgcaaaaagcggcuaaccaucauggaccugcaccccggagccggcaagaccaaacgauaccuacccgccauugugcgcgaagcgaucaagcgagggcugcggacccugauacuagcccccacgcggguggucgccgccgagauggaggaagccuuacgugggcugccgauccgguaccagaccccugcuauccgcgcggaacauaccgggcgggaaauaguggaccucaugugucacgccaccuucacgaugcgccugcugucgcccauacggguacccaacuacaaccucaucaucauggacgaggcccacuuuacagacccggccuccaucgcugcccgcgguuacaucagcacccgcgucgaaaugggcgaggccgccgggaucuucaugaccgcuacgccgccgggcucccgcgauccauucccgcagucuaacgcucccaucauggacgaggagcgggagauacccgagcgcuccuggaacagcgggcacgagugggugacggauuucaaggguaagaccgucugguucguccccuccaucaaggcagggaacgacaucgccgccugccuccggaagaacgggaagaaggugauacagcugagucggaagaccuucgacucagaguacaucaagacgcggaccaacgacugggacuucguugucaccaccgauaucagcgaaaugggcgcuaacuuuaaggcugagagaguuaucgacccgcggcgcugcaugaaacccgugauccucacggacggggaggagcggguaauccuggccggcccgaugccugugacucacuccagcgccgcccaacggcgggguagagugggacgcaacccgaagaacgagaacgaucaguacaucuacaugggggaaccccuggagaacgacgaggauugcgcgcacuggaaagaggccaaaaugcuccucgacaauaucaacacccccgagggcaucauccccuccauguucgagccggagcgggagaaagucgacgccaucgacggcgaguaccgacuacgcggagaggcacgcaagaccuucgucgaccucaugcggcggggcgaccuucccguuuggcuagccuaccguguggcggcugagggaauuaacuacgcggacagacggugguguuucgacggcgugaaaaacaaucagauccucgaggagaacguggagguggagaucuggacgaaggagggugagcguaagaagcugaagccccgguggcuggacgcgcgcauuuacagcgacccccuugccuugaaggaguucaaggaguucgcggcagguaggaagucccugacccucaaccugaucaccgagauggggcgccugccaaccuucaugacgcagaaggccaagaacgcucucgacaacuuggcgguccugcauaccgccgaggcagggggccgggccuacaaccaugcgcucagcgagcugcccgagacccuagagacccucuugcugcuuacguuacuagcgaccguaacagggggcaucuuccucuuccuaauguccgguaagggaaucggcaagaugacccuggggaugugcugcaucauuaccgccucgauccuccugugguaugcgcagauccagccccacuggaucgccgccucuaucauccuggaguucuuucucaucgugcuguugaucccggagcccgagaagcagagaacgccccaggacaaccagcuaaccuauguggucaucgcgauccugacugugguggccgccaccauggcuaacgagaugggauuccuggagaagacgaagaaggauuucggucucggcuccaucaccacccagcagccugaaagcaacauccuggacauugaucuaagaccggccucggcuuggacccuauaugcugucgcuacgaccuucauaacucccauguugaggcacagcaucgagaacuccagcguuaacgucucacugaccgcgaucgccaaccaggcuacgguucucaugggccuggggaagggguggccgcuaucaaagauggacaucggugugccccuccucgccauuggcugcuacagccaggugaaccccaucaccuugacugccgcccuccugcugcucgucgcucauuacgcgaucauugggcccggacugcaggccaaggccacccgggaggcccagaagcgcgcggcugcgggcaucaugaagaacccaacggucgacgggaugaccgugaucgaccuggaucccaucccguacgaccccaaguucgagaaacagcucggccaaguaaugcugcugguacugugugugacccaggugcugaugaugcguaccacgugggcccugugcgaggcgcuuacccuggcaaccggccccaucuccacucuuugggagggcaaucccgggcgcuuuuggaauacgaccauagccgucaguauggccaauaucuuccgcggcucguaccucgccggagccgggcugcuguucuccaucaugaagaacacagcgaacacccggcgcggcacggguaacaccggagagacccucggagagaaauggaagaauagauuaaaugcccuggggaaaagcgaguuccagaucuacaagaaguccggcauucaagaggucgaccggacccucgcuaaagagggaaucaagcggggagagacggaccaucacgccgucucccgcggguccgcgaagcugcggugguucguggagcgcaaccuggugacgccggaggguaaggucguggaccuagguugcggucggggcggcuggaguuacuacugcggcgggcugaagaacguaaaggaaguaaagggucugaccaagggcgguccgggccacgaggagcccauacccauguccaccuauggguggaaccucguucgccugcagagugggguugaugucuucuucacgccgcccgagaagugcgacacccuucucugcgacauaggggaguccagcccuaaccccaccguagaagccggacgaacucugcgcgugcuaaaccucguggagaauuggcugaacaauaacacucaauuuugcaucaaggugcugaacccauacaugccuucugugaucgagaagauggaggcacugcagcgcaaguauggcggggcccucguucgcaauccccugucccggaacagcacgcacgaaauguacuggguguccaaugcaucggggaacaucguguccagcgucaauaugaucucccgcaugcuaaucaaccgguucacgaugcgacauaagaaggcaacuuaugagcccgauguggaccucgguagcggcaccaggaacauuggcaucgaguccgagacgccaaaccuggacauaaucggcaagcguaucgagaagauuaagcaggagcacgagacuagcuggcacuacgaccaggaccaucccuacaaaacgugggccuaccacggcucauaugagaccaagcagacaggguccgccuccagcauggucaacggcgucguaagguuguugaccaagcccugggacgugauuccaauggucacccaaauggcuaugaccgauacuacccccuucgggcagcagcggguguucaaggagaagguagacaccagaacccaggagcccaaggagggcacgaagaagcugaugaagauaaccgccgaguggcuguggaaagagcucggcaagaagaagacgccacggaugugcacacgcgaggaguucacccggaaggugcgcuccaacgccgcccugggggccaucuucaccgacgagaauaaguggaaguccgcccgggaagcgguagaggacuccggcuucugggagcugguagacaaggagcguaaucuccaccuagaagggaagugcgagaccugcguguacaacaugauggguaagcgggagaaaaagcugggagaguucggcaaggcgaagggcucgagggccaucugguacauguggcucggggccagguuccuggaguucgaggcucugggcuuccucaacgaggaccacugguucucccgcgagaauagccugucagggguugaaggcgagggccugcacaagcuaggcuacauccugcgggacgucagcaagaaggaaggcggggcuauguacgccgaugacaccgcaggcugggacacgcguaucacccuggaggaccucaaaaacgaggaaauggugaccaaucacauggagggugagcauaagaagcuggccgaggccaucuucaagcucacuuaucagaauaaggucgugagagugcagcgcccaaccccgcgggggacugucauggacaucauaucccgccgggaccagcgcggauccggccaaguggugaccuacggcuugaauacauuuacaaauauggaggcgcaacugauccgccagauggagggugaaggaguguucaaauccauccaacaacugaccgugaaagaagagaucgccgugaaaaacuggcucauacgggucggacgcgagcgguuauccaggauggcgaucagcggcgacgacugcguagugaagccgcuggacgaccgguucgcaucugcccucaccgcccugaacgauaugggcaaggugcgcaaagauauccagcagugggagccgagccggggguggaacgacuggacccaaguaccguucugcagccaccacuuucacgagcugaucaugaaggacggccgcguguuagugguccccugccggaaccaagacgagcugauagggcgcgcccggaucagccagggcgcgggguggucccuacgggagacggccugcuuaggcaagagcuaugcccagauguggucccuuauguacuuccaccgacgcgaccugcggcucgcggcuaaugccauaugcagcgccgugcccagucauuggauccccaccagccgcaccacaugguccauucacgccacccacgaguggaugaccaccgaagacaugcugaccguuuggaacagggucuggauacaggagaaccccuggauggaggacaagacccccguggagagcugggaggaaauccccuaccugggcaagcgcgaagaccaguggugugggagccucaucggccugacgucccgggcaacaugggccaagaacauccagacagcaaucaaccagguacgaagccugaucgguaacgaggaguacacugacuacaugcccaguaugaagagauuucgccgcgaggaggaggaagccggcgucuuaugguga

SEQ ID NO: 24889 - RNA, 9876 nt, Artificial Sequence
  derived and/or modified CDS sequence (opt11) from DENV-2__KM279557__SS-prME
acugccgggaucaucaucaugaugauccccacugugauggccuuucaucugaccacucggaacggggaaccccacaugaucgucucacggcaggaaaaaggcaaaagccuccuguucaagacagaaaacgggguuaacauguguacacugauggcgauggaccucggcgagcugugcgaggauaccaucacguauaauugcccccugcugcgccagaacgagccagaagacaucgacugcuggugcaacagcaccagcacgugggugaccuacggaaccugcaccgccacaggcgaacaucggcgcgagaaaaggucagucgcccuggugccccacgugggcauggggcuggagacccgcacugagaccuggaugaguagcgagggcgcauggaagcacgcccagcggaucgagaccuggaucuugcgccacccuggguucacgauaauggcagccauacuugccuacacaaucggcaccacuuacuuccaacggguccugaucuucauacuccugacggccgugacaccaucuauggcgaugcggugcaucgggaucaguaaccgggacuucguggaaggugucuccggcgggucauggguggacaucguccuggagcacggcuccugcgucaccaccauggcgaaaaacaaaccgacccucgauuucgaacugauuaaaaccgaggccaagcaucuggcgacccuccgcaaguacugcguggaggcaaagcucaccaacacgaccaccgcgagcagaugucccacccaaggggagcccucccugaacgaggagcaggauaagcgcuucguguguaagcacagcaugguugaccggggcuggggcaacgguugcggccuauucgggaagggcgggauagugacgugugcuauguucacguguaaaaagaacauggaggggaaggugguacaaccugagaacuuagaguacaccaucgugaucacgccgcacucgggggaggagaacgccguggggaaugauacggggaagcacgggaaggaaaucaaggucacaccccagaguuccaucaccgaggcggagcugaccggcuacggcacagugacgauggagugcagcccgcgcaccggccucgacuucaacgagaugguucugcugcaaauggaaaacaaggccugguugguccaccggcagugguuccuggaccugccccuacccuggcuucccggcgccgauacacaaggguccaacuggauccaaaaggagacccugguuacguucaaaaacccgcaugccaagaagcaggacgucguggugcucggcagccaggagggggcaaugcacaccgcgcugaccggcgccacugagauucagaugagcuccgggaaccuccuguucacgggccaccugaaaugucgccugcgcauggacaagcuccaacugaagggcaugaguuacucaaugugcaccgggaaguuuaaagucgugaaggagaucgcagagacccagcacggcacaauagugauccggguacaguacgagggggacggcagccccugcaagauccccuucgagaucauggauuuagagaagcggcacguacucggccgccugaucacugugaauccgaucgucaccgagaaggauuccccggugaacauagaggccgagccgcccuucggggacagcuauaucauaaucggcguggagccagggcagcugaaacucuccugguucaagaagggcagcuccaucgggcagauguucgagaccaccaugcgcggcgcuaagcgaauggccauccuuggcgacacggccugggacuucgggagccuaggaggggucuucaccuccaucggcaaagcauugcaccagguguucggggccaucuacggcgccgcauucaguggcguguccuggaccaugaagauccugaucggugugguuaucaccuggaucggcaugaacucacgcuccacgucgcuguccguaagccuaguccugguggggguagugacccuguaucugggcgucauggugcaggcagacuccggaugugucgugagcuggaaaaacaaagagcuuaagugcggcucaggaauauucaucaccgacaacgugcacacguggacggagcaauacaaguuccagccggagucacccucgaagcuggccagugccauccagaaggcucacgaggaggggaucugcggcauccggagcgucacccgucuggaaaaccucauguggaagcagaucacucccgagcugaaccacauucugaccgagaaugaggugaaacucacgaucaugacuggagacaucaagggcaucaugcaggccgggaagcggucccugcgcccucaaccgacagaguugaaguacucauggaaggcguggggcaaggccaagauguuaucuacggaacuucacaaccacacguuccuaaucgacggccccgagaccgccgagugucccaacaccaaucgggcguggaacagccucgagguugaagacuacggauucggcgucuucaccacgaacauauggcugaagcugaaggagagacaggacguguucugugacuccaagcucaugagcgccgcaauuaaggacaacagggccguccacgccgacaugggguacuggaucgaauccgcguuaaacgacaccuggaagaucgagaaggccaguuucauagaggucaaauccugccacuggccaaagagccacaccuuauggagcaacggcguucucgaaagcgaaaugaucauccccaagaacuuugcuggccccgugucccagcacaacuaccgccccgguuaccacacccagaccgccgggccguggcaccugggccggcuggagauggacuucgacuucugcgaaggcacaaccgugguagugaccgaggacugugggaaucgcggcccgagccuccgaaccaccaccgccagcggcaagcugaucacggaguggugcugccgguccuguacgcugccgccccugcgguaucgcggggaggacggcugcugguacgggauggagauucgaccgcugaaagagaaggaggagaaccuggucaauucacucguaacggccggccacgggcagauugacaacuucagucugggggugcugggcauggcacucuucuuggaggagaugcuucguacccgggucgggaccaagcacgccaucuugcuuguggccgugagcuucgucacccugaucacgggcaacauguccuuccgcgaccucgggcgcgugauggucauggugggcgccaccaugaccgaugacaucgggaugggcgugaccuaccuggcccugcucgccgcuuuuaaagugcggccuacguucgccgccggccuccuccuccgcaaacugaccagcaaggagcugaugaugaccaccauaggaaucguccuccugagccaguccacaauccccgaauccauccuggagcuaaccgacgcacuugcacugggcaugaugguacucaagaucguccggaacauggagaaguaccaacuggccguaaccaucauggccauacugugcgugcccaaugccguaauccuccagaacgcuuggaaggugagcugcaccacgcuggcgguggucuccgugagcccgcuacuccugaccucuucucagcagaaggccgacuggaucccccuggccuuaaccaucaagggccugaaucccaccgccaucuuucucacgacacucucccgcacgagcaagaagcgguccuggccccuaaacgaggcuaucauggccguaggcaugguuagcauccuggccucuagcuuacugaagaacgacaucccgaugacaggccccuuaguggccggcgggcugcugacgguguguuacgugcucaccggucgcagcgcugaccucgagcuggagcgggcggccgacgugcgcugggaggagcaggccgaaauauccggcucguccccuauccugucuaucaccaucuccgaagacgguucaauguccaucaagaacgaggaggaggagcagacgcucacgauccucauccggaccggccugcucgugaucuccggacuguuccccgucucaaucccgaucaccgccgccgccugguaucugugggaggucaagaagcagagagcugggguauuaugggacgucccuuccccgccucccguggguaaggccgagcuggaggauggcgccuaccggaucaaacagaaaggaauacugggguacucccagauaggggcagggguguacaaggaggggaccuuccacaccauguggcacgucacgcgcggcgcgguucucaugcacaaggggaagagaaucgagcccucaugggccgacgugaagaaagaccugauauccuacggcgggggcuggaagcuggagggcgaguggaaggagggggaggagguccaggugcuagccuuagagccgggcaaaaacccgcgcgccgugcaaaccaagcccgggcuguucaaaaccaauaccggcacgaucggggccguuagccucgacuuuucccccggcaccagcggcucccccaucguggacaagaaggggaagguggucggcuuauacgggaacggagucgugacgcggagcggcaccuacguauccgcgaucgcccaaacggaaaaguccauugaggacaacccagaaaucgaagacgacaucuuucguaagaagagguuaacaaucauggaccuccaccccggggccggcaagaccaagagauaccuaccugccaucgugcgggaggcgauaaagcgcgggcuucgcacccugauucucgccccuacucgggugguggcugccgaaauggaagaggcccugaggggccugccgauucgguaucagacgcccgcgauucgcgccgaacauacggggcgggaaaucguagaccucaugugccacgccaccuucacaaugcgacuucugagccccauccgggugcccaacuauaaccucaucaucauggacgaggcccacuucaccgauccggccucgaucgcggcuagaggcuacaucaguaccagagucgagaugggagaggccgccgggaucuucaugacggcuacgccuccuggcucccgcgaccccuucccucagagcaacgcgcccaucauggacgaggaacgggagauccccgagcgcuccuggaacagcgggcacgagugggugaccgacuucaagggcaagacagugugguucguccccuccaucaaggccggcaaugacauugccgcuugccugagaaagaacggcaagaagguuauucagcugagccgcaagaccuuugacuccgaguacaucaagacgaggaccaacgacugggacuucguggucaccacagacauuuccgagaugggcgcgaauuucaaggcugagcgcgucaucgauccucggcgcugcaugaagcccgugauccucacggauggggaggagcgggucauccuggcaggucccaugcccgugacccauaguucagccgcccagcgccgggggagggugggccgcaacccgaagaacgagaaugaccaguacaucuacaugggcgagccccuggagaacgacgaggacugcgcgcacuggaaggaggccaagaugcuccuggacaacauuaauacccccgaaggcauuauaccaucaauguucgagccggagcgggagaaggucgaugccaucgacggagaguaccgccugcgcggggaagcccgcaaaaccuucguggaccucaugcggcgaggcgaccugcccgucuggcucgccuaccggguggcggcagaggggaucaacuacgccgaccgacguuggugcuucgauggugugaagaacaaccaaauccucgaggagaacgucgagguggagaucuggacgaaggagggagagcgcaagaagcugaagccccgauggcuggaugcucgcaucuauagcgacccgcucgcgcugaaggaguuuaaggaguucgcggccggacggaagucccuuacccucaaccugaucaccgagaugggccgcuuacccaccuuuaugacgcagaaggccaagaacgccuuggacaaucuggcggugcugcacacugccgaggcgggcgggcgggccuacaaccacgcccuuagcgaacugcccgaaacccuggaaacccuacugcugcucacguuauuggcaaccgucaccggagggaucuuccucuuccugauguccggcaaggggaucggaaagaugacccuggggaugugcuguauaaucaccgcgagcauccuccugugguacgcgcagauccagccccacuggaucgccgccucgauaaucuuggaguucuuccucaucguacugcucauccccgagccggagaagcagcgcacgccccaagacaaucagcucaccuacgugguuaucgcgauccugacagugguggcugccaccauggcuaacgagaugggcuuucuagagaagacaaagaaggacuuuggucuggguagcaucacaacccagcagccugagagcaauauccuggacauugaccugcggccggccucagcguggacccucuaugcagucgccacgaccuucaucacccccauguugcgccacucuaucgagaacucgagcguaaacgugucccugaccgccauugcgaaccaggccacgguccucaugggccuugggaagggcuggccccugagcaaaauggacaucggcgucccccuccuggcuaucggcugcuauucccaggugaacccgauaacccuaacugccgccuuacugcugcucgucgcgcacuacgccaucauaggacccgggcugcaggcgaaggccacccgggaggcccaaaagcgcgccgccgccgggaucaugaaaaaccccacgguugacgggaugaccgugaucgaccuggaccccauaccguacgaucccaaguucgagaagcaguuggggcaggucaugcugcuggugcucugcgugacccagguacuaaugaugcguaccacaugggcccuaugcgaggcccuaacccuggcgaccgggcccaucagcacccugugggagggcaacccggggcgcuucuggaauaccaccauagccguguccauggccaacaucuuucgcgggucauacuuagccggggccgggcuucuguuuuccaucaugaagaauaccgcgaacacccgucgcggcacugggaacaccggggaaacccuuggcgagaaguggaaaaaccggcugaacgcccugggcaaguccgaguuccaaaucuacaaaaaguccggaauccaggagguggaccgcacgcuagccaaggaggggaucaagcguggcgagacugaccaccaugcgguaucucgcgggucugcgaaacuucggugguucguagagagaaaucuggucacgccggaggguaaggucguggaccucggcugcgggcggggcggguggucguacuauuguggcgggcugaagaacguaaaggaggucaagggacuuaccaagggcggucccgggcacgaagaacccauucccauguccaccuacggguggaaccuuguucgcuugcagagcggcguggacguauuuuucacaccaccagagaagugcgacacgcuccucugcgacauuggggagucaagccccaaccccaccguggaggccgggcggacccuacgcguguuaaaccucgucgagaacuggcuuaacaauaacacccaguucugcaucaaagugcugaacccguacaugcccaguguuaucgagaagauggaggcgcugcagcggaaguaugggggagccuuagugcgaaacccccugucgagaaauuccacgcacgagauguacugggugucgaacgccuccgggaacaucguuucuucagucaacaugauaucucgcaugcugaucaacagauuuaccaugcgucauaagaaggcgaccuacgagccggauguggaccuaggaagcgguacacggaacaucgggaucgaaagcgagacuccgaaccuugacaucaucggcaaacgaaucgaaaagaucaagcaggagcacgagacgagcuggcacuacgaucaggaucacccguacaaaacgugggcuuaccauggcaguuacgagaccaagcagacggggagcgccuccaguauggugaacggcgucguacgccugcucaccaagccaugggaugucaucccgauggucacgcagauggcgaugacagauaccacccccuucgggcaacaacggguguuuaaggagaagguugacacccgcacucaggagcccaaggaagggacgaaaaaguuaaugaaaaucaccgccgaauggcuauggaaggagcucggaaagaagaagacgccacggaugugcacccgcgaagaguucacucguaaaguucgcagcaacgcagcccugggggccaucuucaccgaugagaacaaguggaaguccgcccgagaggccguggaggacagcggcuuuugggagcuggucgauaaggaacgcaacuugcacuuggagggcaagugcgagaccugcguguacaacaugaugggcaagcgggagaagaagcugggcgaguucggcaaggcgaagggcucccgcgcgaucugguacaugugguugggcgcacgguuccuggaguucgaggcccugggcuuccucaaugaagaucacugguucucccgugagaauagccugagcgggguggagggcgaggggcuccacaagcucggcuauauccugcgggacguauccaagaaagagggcggggcgauguaugccgaugacaccgccgguugggacacgcgcauaacgcuggaggaucucaagaacgaggaaaugguuaccaaccacauggagggugagcacaagaagcucgccgaggccaucuucaaacuuaccuaccagaacaaggucguccgcgugcagcgcccgacgccccggggcaccgucauggauaucaucagccgccgggaccagcgcgguuccggccaagugguaacuuacggacucaacacuuucacuaacauggaggcccagcugauucggcagauggagggugaggguguguucaagagcauccagcagcugacagucaaggaagagaucgcuguuaagaacuggcucauccgcguggguagggagagacugagucgcauggccaucucgggagaugacugcgucgugaagccccuggacgaccgcuuugccucugcccucaccgcgcucaacgauaugggcaaggugcgcaaggacauccaacagugggagccaucacggggcuggaaugacuggacacaagucccguuuuguagccaccauuuucacgagcugauaaugaaggacgggcgcgugcucgugguccccugccgaaaccaggacgagcugaucggacgcgcucgaaucagccagggcgccggauggucccugcgcgagacggccugccucggcaagagcuacgcccagauguggucccugauguacuuccaccggcgcgaccugcggcucgcggccaacagcaucugcucagccgugcccagccacuggauccccaccucccgcaccaccuggucgauccacgccacccaugaguggaugacaaccgaagacaugcugaccguguggaaccggguuuggauccaagaaaacccguggauggaggauaagacccccguugaaagcugggaggagaucccguaccuaggcaagcgcgaggaccaauggugcgggucucucauuggccugacgucacgggccacaugggcgaagaauauccagaccgccaucaaccaggugcgcucacugaucggcaacgaggaguauaccgauuacaugccuucuaugaagagauuccgcagggaagaggaggaggccgggguccucugguga

SEQ ID NO: 24890 - RNA, 9876 nt, Artificial Sequence
  derived and/or modified CDS sequence (opt11) from DENV-2__KM279591__SS-prME
accgcaggcaucaucaucaugaugauucccacggugauggccuuucaucuuaccacgcggaacggcgaaccccacaugauugugagccggcaggagaaggguaagagucucuuguucaagacagagaauggggugaauaugugcacucugauggcgauggaucucggcgagcuuugcgaggacaccauuacauacaauugcccuuugcuccgccaaaacgagcccgaggacauugacugcuggugcaacagcaccuccaccugggugacauacgggaccugcaccgccaccggcgaacaccggcgugaaaagcggucagucgcgcuggugccccacgugggaauggggcuggagacccgcaccgagacauggaugaguagcgaaggggcguggaagcacgcacagagaaucgagaccuggauacuucgccaccccggauucaccaucauggccgcuauacuggccuacacuaucggcaccacguauuuccaacggguccugaucuucauucuccugacugccguaacaccguccauggcgaugcgcugcauaggaauauccaaucgggacuucguggagggcgucucaggcgggaguuggguggacaucgugcuggagcacgguuccugugucaccacgauggccaagaauaagcccacgcucgacuuugagcugaucaagaccgaggccaagcaucuggcuacccuccgcaaguacuguguggaggcgaagcugaccaauacgaccaccgcgucucggugccccacccaaggagaacccucccugaacgaggaacaggacaagcgcuucgugugcaagcacagcaugguagaccggggcuggggaaaugggugcggucuuuucgggaagggggggaucgugacgugugccauguucacgugcaaaaagaacauggagggaaaggugguccagcccgagaacuuagaguacaccaucgugaucacgccccacuccggcgaggagaacgcaguugggaaugauacgggcaagcacgggaaagagaucaaggucacaccccagagcuccaucacugaggcagagcugaccgguuacgggaccgugacgauggagugcuccccgcgaacaggccucgauuucaacgagauggugcugcuucaaauggagaauaaagccuggcuuguucaccggcagugguucuuggaccugccucuccccuggcugccuggcgcggauacccagggcaguaauuggauccaaaaagagacccuggugacguucaaaaacccgcacgcaaaaaagcaggacguaguaguucucgguucacaggagggggcgaugcacacggcauuaaccggcgccaccgagauccagaugagcuccgggaaucuccuuuucacuggccaccugaagugccgccugcggauggauaagcuccagcuuaaggguauguccuacuccauguguaccggaaaauucaaaguggugaaagagaucgcggagacucagcacggcaccauagugauccgcguccaauacgaaggggacggcucuccgugcaagauucccuucgaaauaauggaccucgagaagagacauguacucggccgcuuaaucacggugaaucccaucguuaccgaaaaggacucaccagugaauaucgaggccgagccgcccuucggugacagcuacauaaucauuggagucgagcccgggcagcugaagcucucgugguucaagaagggcagcuccaucggccagauguucgagaccaccaugcgcggggccaaacggauggcgauccugggcgacacggccugggacuucggaagccugggcggcgucuucaccucuauuggcaaggcgcuccaccagguguucggggccaucuauggggcagcguuuuccggagugagcuggacuaugaaaauccugaucggggugguaaucaccuggaucggcaugaacagccguagcacaagccugucagugucucugguccucguugggguaguuacccucuacuuaggcgugauggugcaagcggacuccggcugcgugguuagcuggaagaacaaggaguuaaagugcggaagcggcauuuucaucacagauaacgugcacaccuggacggagcaauacaaguuucagccagaauccccaagcaaacuggccucagccauacagaaggcacacgaggaggguaucuguggcaucagaagugucacccgccuggagaaccucauguggaagcagaucacuccggaacugaaccacauccugaccgaaaacgaggugaagcugacaauaaugaccggugacauaaaaggcauaaugcaggccggaaagcggacccuucgcccucaaccuaccgaacugaaauacuccuggaaagcguggggcaaggccaagaugcucucuacggagcuucacaaccauaccuuccugauugacggcccggagaccgccgagugccccaacacgaacagggccuggaacucccucgagguggaagacuacggauucggggucuuuacgaccaacaucuggcugaagcugaaggagcgccaagacguguucugugauagcaagcugauguccgccgcgaucaaggacaacagggccguacacgccgacaugggcuauuggaucgagucugcccugaacgauaccuggaagaucgagaaggcuucguucaucgaggucaagagcugccauuggccgaagucgcacacacuguggagcaacggcgugcucgagagcgagaugaucauaccgaagaacuucgcgggccccgugagccagcacaacuaccgcccaggauaccacacacagacggccggcccguggcaccuggggcggcuggagauggacuucgauuucugcgagggcacuaccgucguugugacagaagacuguggaaaucgcggaccaucccugcggacgaccacagcgucuggcaagcugaucacagaguggugcugcagaagcugcacgcugccgccccuccgauaccgaggugaggacggaugcugguacgggauggagauccggccgcugaaggagaaggaagagaaucugguaaacucccucgugaccgccggccacgggcagaucgacaauuucucuuugggcgugcugggaauggcccuauuccuggaggagaugcugagaacccguguaggaaccaagcacgccauccuccuggucgccgugagcuucguuacguugauuaccggaaacaugucuuuccgcgacuugggacgcgucaugguaauggucggcgccacgaugacagacgauaucgggaugggcgucacuuaccuggcccuguuagcggcauucaaggugcgccccacuuuugcagccggucugcuacuccgcaaauugaccuccaaggagcugaugaugaccacgaucgguaucguccuucugagccaguccacgauacccgagagcauucuggagcuaaccgacgcucuagcacuggggaugaugguguugaaaauuguccgcaacauggagaaauaucagcuggccgugaccauuauggccauccugugcgugcccaacgcagugauccugcaaaacgccuggaagguguccuguacaacgcuggcgguugucagcguguccccgcucuuacuaaccaguucacagcagaaagcagacuggaucccccuggcacugacaauaaaagggcuuaaccccaccgccaucuuccugaccacccuuagccgcacauccaagaagcguucuuggccccuaaacgaggcgaucauggcuguggguauggucaguauacuggccucgucccucuuaaagaaugacaucccgaugacugguccccuuguagccgggggccuucugacggugugcuacguccugacggggcgcagcgccgaccuggaacuggagcgggcggccgacguucgcugggaggagcaagcggagaucagcgguagcagccccauucugucgauuaccauaagcgaagacggcuccaugagcaucaaaaacgaggaggaggagcagacgcuaaccauccuaauuaggaccgggcuucucgugauuuccggccuauuccccguuucaaucccgaucaccgcagccgcaugguaucugugggagguuaagaagcaacgcgccgggguucucugggacgucccaagcccuccaccuguaggaaaagccgagcuggaggacggcgccuaccggaucaagcaaaagggcauacuuggguacagccaaaucggggcgggcguguacaaagaggggaccuuccacacgauguggcacguaaccagaggcgcagugcucaugcacaaagggaaaaggaucgaaccguccugggccgacguuaagaaggaucugaucucguacggaggaggcuggaagcuggagggcgaguggaaggagggggaggaaguccagguguuagcgcuggagcccggcaaaaauccgcgagccgugcagaccaagcccgggcuguucaagaccaacacgggcacuaucggggccgugucccuggacuucagccccgggacguccggcucgcccauaguugacaagaaggggaaagugguaggacuguacgggaauggaguggugacccggucaggcacguacgucagcgcaauagcacagaccgagaaguccaucgaagacaauccugagaucgaggacgacaucuuccgaaagaaacggcuaacaaucauggaccugcacccaggagccgggaaaaccaagcgcuaccuccccgcaaucgugcgggaagcgaucaaacgcggucugcggacgcugauccucgcccccacucgcguggucgccgccgagauggaggaggcccugcgcgggcugccgauccguuaccagacccccgcgauccgcgccgagcauaccgggagagagauaguggauuuaaugugccacgccacguucaccaugagguuacugagcccgauucgggugcccaacuauaaccuuaucaucauggacgaggcccacuucaccgacccggcaagcauugcggcacggggcuacauuuccacgcgggucgagaugggcgaggccgcgggaauuuucaugacugccacaccacccggcagccgugaccccuucccgcagagcaaugcgcccaucauggacgaggagcgggagaucccagagcgcagcuggaacuccgggcacgaguggguaaccgacuucaagggaaagacugugugguucguccccagcauaaaagccgggaacgacauagccgcaugccugcggaaaaauggcaagaagguuauccagcugucccgcaagacguuugacagcgaguacaucaagacacgaacaaaugauugggacuucguagucaccacagauaucuccgagaugggcgcaaauuucaaggccgagcgggucaucgauccacggcgcugcaugaaaccagucauccucaccgacggugaagagcggguaauucuggccggucccaugcccgugacccacagcucugcugcucagcgccgggggcgcgugggccggaacccaaagaacgagaacgaucaguauaucuauaugggggagccucuugaaaacgacgaggacugcgcgcacuggaaggaagccaagaugcucuuagacaacaucaacaccccagaggguaucauccccagcauguucgaaccggagcgggagaagguagacgcaauagacggcgaguaccgucuccggggggaagcccguaagacauucguagacuugaugcggcgcggagaccucccagucuggcuugcauaccggguggccgcggaggguaucaauuaugucgaucgccgguggugcuucgacggcguuaaaaacaaccagauccucgaggaaaacgucgagguggagaucuggaccaaggagggggaacgcaagaagcugaaaccccgauggcucgacgcucgcaucuacucugacccgcuggcuuuaaaggaguuuaaggaguucgccgcgggucgcaagagccugacccucaaucucauuaccgaaaugggccggcugccuacauucaugacccagaaggcgaagaacgcccucgauaaccuggccguccuucacaccgcggaggcuggcggcagagccuauaaccacgcucucagcgagcugcccgagacucucgagacgcuccugcugcucacccugcuggccaccgucaccgggggcauuuuccuauucuuaaugagcggcaaggggaucggaaaaaugacccuggggaugugcugcaucaucaccgcaucuauccuccugugguacgcacagauucagccacacuggaucgccgcuucgauuaucuuagaguucuuccucauugugcugcuaaucccggagccagagaagcagagaacgccccaggacaaccagcucaccuaugucgucaucgccauucuuaccgucgucgcagccacgauggccaacgagaugggcuuucuggagaaaaccaagaaggacuucggccucggcucuauaacgacucaacagcccgagagcaacauccuagacaucgaccuucgcccugccagcgccuggacgcucuacgcagucgcgaccaccuucaucacccccaugcugcgucacuccaucgaaaacaguuccgugaacgucucucucaccgccauagccaaccaggccacagugcucaugggccucgggaagggcuggccccuguccaagauggauaucggagugccccugcuggcgauuggcugcuacagccaggucaacccgaucacgcugaccgcggcccuccugcuguuaguagcgcacuacgcgaucaucgggcccggccugcaggccaaagccacucgggaggcccaaaagcgugcagccgccgggaucaugaagaaccccaccguggacggcaugaccgucaucgaucuggaucccaucccguaugaccccaaguucgagaaacagcuugggcaggugaugcuccuugugcuuugcgucacccaggugcuuaugaugcgcacgaccugggcccugugcgaggcccucacccuggccacagggccgauauccacgcugugggagggcaaccccgggcguuucuggaauacuaccaucgcggucagcauggccaacaucuuccgcggcuccuaucucgccggcgccggacugcuguuuagcaucaugaaaaacacggcuaacacgcggcgaggcacugggaauaccggggagacccucggcgagaaauggaagaaucggcucaacgcacuggggaagucggaguuccagaucuacaagaaguccggcauccaggaagucgaucgcacgcucgccaaggaggguaucaagcggggagagaccgaccaccacgccgugucccgcgggagcgcuaaacuucggugguucguggagcgaaaccuugucaccccggagggcaaaguuguggaccucggcuguggacggggcgggugguccuacuacugcggcgguuuaaagaacgugaaggaggugaagggccugacaaaaggugggcccggccacgaagagcccauccccaugagcacguacggguggaaccuugugcgcuugcaauccggugucgacguguucuucacgccgcccgagaaaugcgauacucugcucugugacaucggggagagcucccccaaucccaccguggaggcgggccggacgcugcgcguccugaaccucguggagaacuggcuaaacaacaacacgcaauucugcaucaagguucugaacccguacaugccgagcgucaucgagaagauggaggcccugcagcgaaaguauggcggugcccucguacgaaacccccucucucggaacucuacccacgagauguacugggugagcaaugccuccgggaauaucgucagcuccgugaacaugaucagccgcaugcuaaucaaccgauucacaaugaggcauaagaaggccaccuaugagccggacguggaccuuggguccggcacgcggaacaucgggaucgagucugagacucccaaccuggacaucaucggcaaacguaucgaaaagauuaagcaggagcacgaaaccagcuggcacuacgaccaggaccaucccuauaagaccugggcguaucacggcagcuaugagacaaagcagacgggguccgccagcuccaugguaaauggcgugguccgacugcucaccaagcccugggauguuaucccgaugguaacgcaaauggccaugacggacaccacacccuucgggcaacaaagggucuucaaagagaaggucgauacuagaacacaggagcccaaagagggcacaaaaaagcugaugaagauaacugcggagugguuguggaaggagcucgggaagaagaagacgccccggaugugcacccgcgaggaguucacccggaaaguucgaucaaacgcugcgcugggggcuaucuucacggaugagaacaaguggaagucagcccgggaggcagucgaggacagcggcuucugggaacuuguggauaaggagcgcaaucuccaccuggaagggaaaugugaaaccuguguguacaacaugaugggcaaacgggaaaagaagcugggggaguucgggaaggccaagggcucccgcgcaaucugguacauguggcucggggcccgcuuccuggaguucgaggcacuggguuuucugaacgaggaccauugguuuagccgcgaaaauagucucagcggggucgaaggugaggguuugcacaagcucggcuauauucugcgggacgucuccaagaaggagggcggggccauguacgcggacgacaccgccggcugggacacccgaaucacauuagaagaccucaagaacgaggagauggucaccaaccacauggagggggagcacaagaaacuugccgaggccaucuucaaguugacguaccagaacaaagucguuagggugcagcggccaacgcccagagggaccgucauggauaucaucucccgcagagaucagcgcgggagcggucaaguugugaccuacggccucaacaccuucacuaauauggaggcucagcugauccggcagauggaaggugagggagucuuuaaaucgauccagcaguuaaccguaaaggaggagaucgcggucaagaauuggcucauccgcgucgggcgcgagcggcugagccgcauggccaucaguggggacgauugcguggugaagcccuuagacgaccgguucgcaagcgcccucaccgcccuuaacgacaugggcaagguccgcaaggacauccagcagugggagcccucccggggauggaaugauuggacgcaggugccguuuugcucucaccacuuccacgagcugaucaugaaagacggacgcguguuggucgugcccugccguaaccaagacgagcuuaucggccgcgcgcggauuucccagggggccggcuggagccugcgcgagaccgcgugccucggcaaguccuaugcccagauguggagccugauguacuuccacagacgcgaucuucggcucgcugccaaugcuaucugcuccgccgugccuucucacuggauccccaccucccgaaccacuuggagcauacacgccacgcacgaguggaugaccaccgaagacaugcugacgguuuggaaccggguguggauacaggagaacccguggauggaagacaagacgccgguggagucgugggaggagaucccguaucugggcaagcgugaggaccaguggugcgggucgcugaucggacugaccucgcgggccaccugggcuaagaacauccaaaccgccaucaaccaggugcgcucccugaucgguaacgaagaauacacggacuauaugcccagcaugaagcgguuccgccgcgaggaggaggaagcuggcguuuugugguga

SEQ ID NO: 24891 - RNA, 9876 nt, Artificial Sequence
  derived and/or modified CDS sequence (opt11) from DENV-2__KM279558__SS-prME
acugccgguaucaucaucaugaugauacccacagucauggccuuucacuugacgacccgaaauggggaaccucauaugauugugagucgccaagaaaaaggaaaaucgcugcuauucaaaacagaaaacggaguaaacauguguacccugauggcaauggauuuaggagaacuaugugaagauacaauuacauacaacugcccccucuugcgccagaacgaacccgaagauauagacugcuggugcaacucaaccuccacaugggucacguauggaacaugcacagccacaggagaacaccgaagagagaaaagaagugucgcgcuagucccccauguaggaauggggcuggaaacacggacagaaacguggaugucgagcgaaggggccuggaaacacgcccaacgcauagaaacguggauauuacgccaccccggauucacuauaauggcggccauacucgccuauaccaucgguaccacauacuuccagcggguacugauauuuauacugcucacagcggucaccccaagcauggcuaugaggugcaucggcaucucaaaccgcgacuucgucgaagggguuuccggcggaucauggguggauauagugcuagagcacggaucgugcguaacaacaauggccaaaaacaaaccgacgcuggacuucgaacuaauaaagacagaggcaaaacaccuggccacccugcgaaaauacugcguugaagcaaaacucacgaacacaacuaccgcgaguagauguccuacccagggggagcccagcuugaacgaagaacaagauaagagauucgugugcaagcauucgaugguggacagaggcuggggaaacggcugcgggcuauuuggcaaaggagggaucguaacaugugcaauguucaccuguaagaaaaacauggaggggaaagugguucagcccgagaacuuggaguacacgauugugauaacaccgcacagcggagaagagaacgcaguggguaacgauacagggaagcacggcaaagagaucaaaauaacaccccagagcucaaucaccgaagcggagcuaacaggguacggaaccgucacuauggaaugcucgccacgaacgggauuggacuucaaugagaugguacucuuacaaauggagaacaaggcgugguuaguacaccgccaaugguuccucgaucucccccugccuuggcuaccaggggccgacacacaaggaucaaacuggauccaaaaggagacccuugucaccuucaagaacccccacgcgaagaaacaggaugugguagucuuaggaagucaagaaggagcaaugcauaccgcccuaacaggggcgacugaaauccagauguccuccggaaaccuacucuucaccggacaccuuaaaugucgacuacgaauggauaaacuucagcuuaaaggcaugaguuacuccaugugcacagggaaguucaaagugguaaaagagaucgcagaaacacaacacggaacaaucguaauucgaguucaauacgaaggcgauggaagccccugcaaaauaccauucgagaucauggaccuagaaaaacgccacguacuaggacgguuaauaaccguaaacccgauagugacugagaaagacagucccguaaacaucgaagcagaaccgccauucggcgauagcuacauaaucaucgguguagagccgggccagcucaagcugagcugguucaagaaaggcuccagcauugggcaaauguucgagaccacgaugcggggugcgaaacgcauggcuauccuuggggacaccgcgugggacuucggcucacuaggcgggguguucacaucgaucggaaaagcacuucaccaaguauucggggcaauauacggggccgcguucaguggagugagcuggacgaugaagauccuuauaggagugguaauaaccuggaucgguaugaacagccgauccacaagccugagcgucagucuaguacugguuggggugguaacccuuuacuuggggguuaugguccaggcagacagcggguguguaguauccuggaagaacaaagaacuaaaguguggaucgggcaucuucaucacagacaacgugcacaccuggaccgaacaauauaaauuucaaccagagagcccgagcaaacucgcuucagccauacagaaagcacacgaggaaggaauaugugggauccggagugucacacgccuagaaaaccuaauguggaagcagaucacgccagaacucaaccauauacugacagagaaugaaguaaagcucacaauaaugaccggagacauaaaggggauaaugcaagccggcaaaaggagccuccgaccacagccgaccgagcucaaguacaguuggaaggccuggggaaaagccaagaugcuaagcacggaacuacacaaucacacguuucugauagacgggccagaaaccgcggagugcccaaacaccaaucgcgcguggaacagucuagagguugaagacuaugguuucgguguguucacaacgaacaucuggcucaaacuuaaggaaaggcaagacgucuucugcgacagcaaacugaugagugcagcgaucaaagacaaccgggccguccacgcugacaugggauacuggaucgaauccgcauuaaaugacaccuggaagaucgagaaagccaguuuuauagaagugaaaucaugucauuggccaaagagccauacucucuggucaaacgguguucuggaaagcgagaugauaauucccaaaaacuucgcggggcccguuucgcagcacaacuaccggccgggauaccacacgcaaacagccgggccguggcaccuaggcaggcuagagauggacuucgacuucugcgaggggacgacgguggucgucacggaggauugcggaaacagagggccaucgcugcgaaccaccacggcgaguggcaaacuuaucaccgaguggugcugccgaagcugcacccuaccaccccucagguaccggggagaagacggaugcugguacggcauggagauaaggccgcuaaaggaaaaggaggaaaaccugguaaauucacucgugacagcgggacauggacagauagauaacuucuccuugggaguacuagggauggcauuguucuuagaggagaugcuaagaacgaggguagggaccaaacacgccauauugcucguagccgucuccuucguaacgcugaucacaggaaacaugucuuuucgcgaccucggacgugucauggugaugguuggagcgacaaugaccgacgacauuggcaugggagucacauaccuagcgcuccucgcagcguucaaaguccgcccuacauucgcggcagguuuacuccuacgcaaacuuacaucaaaagaguuaaugaugaccacgauaggcaucguacugcuaucacagagcacgaucccagagucaauccuagagcuaaccgaugcacuagcguuaggaaugaugguacuaaaaauaguucggaacauggaaaaguaccagcucgccgugacaauaauggcaaucucaugugugccaaaugcggugaucuuacagaacgcuuggaaggugagcugcacgacacuggccgucguaagcgucaguccauuacuacuaaccucaagccagcaaaaagcugacuggauuccucucgcacuuacaaucaagggccuaaaccccacagccaucuuccuuacgacgcuaucgcggacaucuaagaaacggagcuggccccucaaugaagcaauaauggcagugggaauggucucgauacucgccagcucccugcuuaagaacgacauacccaugacugggcccuuagucgccggcggccuccugacgguaugcuacguucugaccggacgaucagcagaccucgaacuagagcgggccgcugauguccggugggaagaacaggcggaaauaucgggaaguaguccaaucuugaguaucaccauaagcgaggacggaagcauguccaucaagaaugaggaagaagaacaaacccuuacgauccucauccggacaggccugcuaguaaucuccggauuauuccccgugucgauuccaaucaccgcagcagcgugguaucucugggaaguaaagaaacagagagccggcgucuuaugggacguacccagcccgccacccguaggcaaagccgaacuagaggacggugccuaccgaauuaaacagaaaggcauucuaggauacagccaaauaggagccggaguauacaaagaggguacuuuccauacgauguggcacguuacccggggcgccguacuaaugcacaagggcaaacgaaucgaacccaguugggcggacgucaagaaagaccugauaucauacggcggcggcuggaagcucgaaggcgaguggaaggagggggaggagguccagguccucgcccucgaaccuggcaaaaauccucgcgcagugcagacaaaaccgggacuguucaagaccaacacgggaacuaucggcgcgguaucucuggauuuuaguccgggcacgucaggcagucccaucguagacaagaaaggcaaagugguuggguuauaugguaacggcgucgucacacggagcggcacguacgucucggcaaucgcucaaacagagaaaaguauagaagacaacccggaaauugaggacgacaucuucaggaagaaacgacuaacaaucauggaccuacacccgggugccgggaagacaaagcgauaucuuccagcaaucguacgcgaagccauuaagcggggccuaaggacccuaauccuagcacccaccagggucguggcagcagaaauggaagaggcucuaagagggcuccccauacgcuaccaaacuccagcgauaagggcagaacauacugggcgcgaaauaguagaccucaugugccaugccacauucaccaugcgccucuuaucaccgauaagggugcccaacuauaaccugauaaucauggaugaggcucacuuuaccgacccggcaagcauagcagcccgcggcuacauaagcacacgaguagagaugggcgaagcagccggcaucuuuaugaccgccaccccucccggaucgcgagacccuuucccccaaagcaacgcacccauaauggacgaagaacgggagauucccgaacgaagcuggaacucgggccacgaaugggugacagacuucaaagguaaaacugugugguucguuccaagcauaaaggcaggaaacgauaucgcugcaugccucagaaagaacgggaagaaaguaauacaacucucacggaagaccuuugauagugaguacaucaagacccgaacgaacgacugggacuucgugguaaccaccgauauaagugaaaugggagcaaacuucaaagcagaacgggucaucgacccccgccgcugcaugaagcccgugauacuaacggacggcgaggaacguguaauccuugccggaccgaugcccgucacccauucaagcgcggcgcagcgacgaggaagagucggacgcaaccccaaaaacgagaacgaccaauauaucuacaugggugagccacuggaaaacgacgaagacugugcgcauuggaaggaggccaaaauguuacucgacaacaucaacacgcccgagggaauaauaccgagcauguuugagccugagcgggaaaaaguggacgccauagauggggaauaucggcuacgcggggaagcccguaagaccuucguagaucuaaugcgacguggagaccuuccaguauggcuggcauaccgugucgcagcggaaggaaucaauuacgcagauagacgauggugcuuugacggggucaagaacaaccagauucuggaggaaaacguugaagucgaaauauggacaaaagaaggcgagagaaagaaauuaaagccaaggugguuagaugcgagaauauacagugauccccucgcgcucaaggaguucaaagaguucgcagccggucggaaaucacuuacacuaaaccuaaucacugaaauggggcguuuacccaccuucaugacgcagaaagccaaaaacgcacuagacaaccuggcuguucuccacaccgccgaggccggaggccgggcuuacaaccaugcgcucucugaauuaccagaaacacuggaaacgcuacuacuacugacacugcuagcgaccgucacugggggaauauuccucuuccuaaugucaggcaaagguaucgguaagaugacauuagggaugugcugcauaaucacggcuagcauauuauuaugguacgcccagauccaaccgcauuggaucgccgccagcauaauacuugaguucuuccugauagugcuacugaucccggaacccgagaaacaacggacaccucaagacaaccagcuuacuuacguggugauagcaauacuuaccguugucgcggccacaauggcgaacgagaugggcuuccuugaaaagacgaagaaagauuuuggccucgguuccauaacaacgcagcagccagaaaguaacauccuggacauagaccuucgacccgccuccgccuggacacucuacgcuguagcgaccacguucauaacaccuaugcucaggcacucaauagaaaauucauccguaaaugucucccuaacagccaucgccaaccaagccacaguucucaugggacucggcaaaggcuggccuuuaaguaagauggacaucggaguuccccuucuagcgauuggcuguuacagccaaguaaacccgauaacccuuacagcggcacuacuccucuuagucgcucauuacgccaucauaggaccuggccuacaagccaaagcaacccgagaagcccagaagcgagcagcagcgggaauaaugaagaaccccaccguggacggaaugaccgucaucgaccuggaccccauaccguacgacccaaaguucgagaaacaacuagggcaaguaauguuacucgugcucugcgugacacagguacuuaugaugcgcacaacuugggcacucugcgaagcauugacccuagcaaccggcccaauaagcacguugugggagggaaacccaggccgcuuuuggaauacaacaaucgcgguaagcauggcaaacaucuuccgggguagcuaccuagcaggagcuggacugcuuuuuagcauaaugaaaaacacagcaaacaccaggcguggcacgggcaauacaggugaaaccuugggcgagaaguggaaaaacaggcuaaaugcccuagguaaaagcgaguuccagauuuauaagaaaagcgggauucaggagguggacagaacgcuugcaaaggaggggaucaaacgcggcgagacagaucaccacgcgguaagccgcgguagcgccaagcuaagaugguucguggagcggaaucuagugacgcccgagggaaagguaguagaccugggcugcggacgagggggaugguccuacuauugcggagguuugaaaaacgucaaggagguaaaaggccugacgaagggcggcccggggcaugaagaacccaucccaauguccacguauggcuggaacuugguaagguuacaauccgguguggaugucuucuucaccccacccgaaaagugugacacccucuuaugcgacaucggagaaagcagucccaacccaaccguagaagccgggaggacacuacgggugcuuaaucuaguugaaaauugguuaaacaacaacacccaguucugcaucaaaguccuaaacccuuacaugccuucggucauagagaagauggaagcauuacaacggaaauacgguggcgcacugguucgcaacccgcucagccgaaacuccacccacgagauguacuggguuucgaaugcgagcggaaacauagugagcucagugaacaugaucucaagaaugcugauaaauagauucacaaugcgccacaagaaagcgaccuacgaaccggacguggauuuggguagcggcacgagaaacaucgggauagaaucugaaacaccuaaccuugauaucauuggcaagcgaauagagaaaaucaagcaagagcacgagacaagcuggcacuaugaccaagaccaccccuacaaaaccugggcauaucacgguagcuacgaaacgaaacaaacgggaagcgcguccagcaugguuaacggggugguaagguugcucacaaaaccuugggaugugauaccgauggugacgcagauggccaugacggacacaacccccuuuggacaacagaggguguucaaagaaaaggucgacacacggacacaagaaccaaaagaaggcacaaagaaacucaugaaaauaacggcggaauggcucuggaaagaguuagggaaaaagaaaacaccucggauguguacccgcgaggaauuuacgcguaaaguacggucgaaugcagcacuaggggcuauuuucacggacgaaaacaaauggaaaagugcaagagaggcuguagaagacucuggauuuugggaauugguagauaaggaacgcaaccuacaccuagaggguaaaugcgaaaccugcguauauaacaugaugggaaaacgagagaaaaagcucggagaguucggcaaagcgaaagguagcagagccaucugguauauguggcuuggcgcgagauuccuagaguucgaggcccuaggauucuuaaacgaagaucacugguucagucgcgagaacagccugagcgggguggagggggaggggcugcauaaacuaggguacauucugagggacguuagcaagaaagaaggcggagccauguacgcugaugauacagcgggaugggacaccaggauaacacuagaggaccucaaaaacgaagaaauggucacaaaucacauggagggcgaacacaagaaauuggcagaggccauauucaaacugacguaucagaauaaggugguacgcgugcagaggccgacaccccgagggacggugauggauaucaucaguagaagagaucaaagaggauccggucagguagucacguacggacuaaacaccuucacuaacauggaggcgcaacuuauacgacagauggaaggggaagggguauuuaaaucgauucaacagcugacgguaaaagaagaaaucgcagugaaaaauuggcuuauaagaguaggaagagagcggcucaguagaauggcaaucuccggggaugacugcguagucaagccguuagacgaccgcuucgcaagcgcccuaacagcacuaaacgacaugggaaaaguacgcaaagacauucagcaaugggaacccucuagggguuggaacgacuggacucaagugcccuucuguagccaucacuuccacgagcugauaaugaaggauggucgcguacucguggucccauguaggaaccaggaugaacuaaucggacgggccaggauuagccaaggggcaggauggagccuaagagagacagccugccuaggaaaauccuacgcgcaaauguggucgcugauguacuuccaccggagagaccuccgcuuagccgccaacgcaauauguucagcagugccgucacacuggauaccaacaucuagaacaacaugguccauccaugcuacucaugaguggaugacgaccgaggauaugcuaacagucuggaacagaguguggauacaagagaacccguggauggaagauaagacccccguagaauccugggaggaaauaccguaccugggcaaaagagaggaucaguggugugggucucuaaucggccuuacgucgagagcgaccugggcaaagaacauacaaacugcaauaaaucaagugaggagccucaucgggaacgaagaauacaccgacuacaugccuagcaugaagagauuccgucgcgaagaagaagaggcgggcguacucugguga

SEQ ID NO: 24892 - RNA, 9876 nt, Artificial Sequence
  derived and/or modified CDS sequence (opt11) from DENV-2__KM279564__SS-prME
accgcggguaucaucaucaugaugaucccgacaguuauggccuuccaccugaccacccggaacggggagccacacaugaucgucagccggcaggaaaaggggaagagccuccuguucaagaccgagaacggcgugaacauguguacgcugauggcuauggaccucggagagcugugcgaggacacaauuaccuacaacuguccgcugcuccgccagaaugagcccgaggacauagauugcuggugcaauagcaccuccacauggguaaccuacgggaccugcaccgcuaccggcgagcaccggcgcgagaagcggagcgucgcccuggugccccacgugggcaugggacuggagacccguaccgagaccuggauguccagcgagggagccuggaagcacgcccaacggaucgagaccuggauccuccgccacccgggguuuaccauuauggcggccauccuggccuacaccaucggcaccacuuacuuccagcggguccugauuuuuauccucuuaacggccguuacccccuccauggcgaugcgcugcaucgggaucucuaaccgggauuucguggagggcgucuccggggggagcuggguggauaucgugcuggagcacggguccugcgucacuaccauggcgaagaauaagcccacgcuagacuucgaguugaucaaaacugaggcaaagcaccuggccacccuccgcaaguacugcguggaagccaaguugacgaacacgaccacagcgucgcggugccccacccagggugaaccuagcuuaaacgaggagcaggacaagcguuucguaugcaagcacaguauggucgaccggggcuggggaaacgggugcggacucuucggcaagggcgggaucgugacgugcgccauguucacaugcaagaaaaacauggagggcaaggugguccaacccgagaaccuggaguauaccaucgugauaacgccacacuccggcgaggagaacgccgugggcaacgacacgggaaagcacgggaaggaaaucaagauaacgccccagagcaguaucacagaggcggagcugaccggguacgguaccguuacgauggaaugcaguccacgcaccggccuagacuucaacgagaugguucugcugcagauggaaaacaaggccuggcucgugcaccggcagugguuccuggaccuuccucuacccuggcugcccggcgcggacacacaggguuccaacuggauccagaaggagaccuuagucacuuucaagaacccgcacgccaaaaaacaggacguggucguucucggcagucaggagggggcuaugcacaccgcucugaccggcgccacggaaauucaaaugagcucagggaauuuacuguucacgggccaccugaagugucgccugcgaauggacaagcuacaacuuaagggcaugagcuacuccauguguaccgggaaauucaagguggucaaggagauugcggagacccagcacggcaccaucgugaucagagugcaguacgaaggggacggcucuccgugcaagaucccuuucgaaauaauggaccuggagaagcggcacgugcucggccgucugaucacggugaaccccauagugacggagaaagacaguccggucaacaucgaggccgagccgcccuucggggacagcuacaucaucaucggcguggaacccgggcagcugaagcucuccugguucaagaagggcucauccauugggcagauguucgagaccacuaugaggggcgccaagagaauggccauucuuggggacacggccugggacuucgguagccugggcgggguguucaccuccaucgguaaggcgcuccaccaggucuuuggggccaucuacggagccgcguucuccgguguguccuggaccaugaagauccugaucgggguggucaucaccuggauuggcaugaacagccgcuccacgucgcuguccgugucgcuggugcucgucgguguagugacccuguaccucggcgucauggugcaagcggacuccgggugcgugguuagcuggaagaauaaggagcugaagugcggcagcgguaucuucauuaccgacaacgugcacaccuggacggagcaauacaaguuucaaccggaguccccuucgaagcuggccagugccauccagaaggcgcacgaggagggcaucuguggcauccggucugugacccgccuggagaaccucauguggaagcagauaacgcccgagcugaaccacauccugaccgagaacgaaguuaagcucacaauaaugacgggggauaucaagggcauaaugcaagcagggaagcgaucgcugcgcccccagccgaccgaguuaaaguacucguggaaagcgugggguaaggccaagaugcuuuccacugagcuccacaaccacacguuccugaucgacggccccgagaccgccgagugccccaacacuaaccgggccuggaacagccuugagguggaagacuacggguucggcguguucaccacgaacaucuggcucaagcugaaggagcgccaggacgucuuuugcgacaguaagcucaugagcgccgcgaucaaggacaaccgggcuguccacgccgacaugggguacuggaucgaauccgcacugaaugacaccuggaaaaucgagaaggcuagcuucaucgaaguaaaguccugccauuggccgaagagccacacccugugguccaacggcguccucgagagcgagaugaucauccccaagaacuucgcgggcccgguaucccagcacaacuaccgccccggcuaccacacccagaccgccgguccguggcaccuggggcggcuggagauggacuucgacuucugcgaggggacaacuguggucgugaccgaggacugcgggaaccgaggccccagccuccgcacuacgaccgccucgggcaagcuaaucacggaguggugcugccgcucaugcacccugccgccccuccgguaucgcggggaggacggcugcugguacgggauggagauccggccucugaaagagaaggaggaaaaucuagugaauagccuugucaccgccggccacgggcaaaucgauaauuuuagucugggcgugcugggcauggcccucuuccucgaggaaaugcugcgcacccggguggggaccaagcaugccauccuccuggucgcugugucuuucgugacccuaaucacggguaauauguccuuccgcgaccucgggcgcguuauggugauggucggcgccaccaugacggacgacaucgggaugggugucacauaucuggcacugcucgcggccuucaaggugcggccuacguucgccgccggccugcugcuccgcaagcugaccagcaaggagcugaugaugaccacaauuggcauaguuuuguugucucagagcacgauccccgaguccauacuggaacucacugacgcccuggcacugggaaugaugguccucaaaauugugcggaacauggaaaaguaccagcuggccguuaccaucauggccaucagcugcgugcccaacgccgugauccugcagaacgccuggaaaguuuccugcaccacgcucgcgguggugagcguauccccgcugcugcucaccuccagucaacaaaaggccgacuggauacccuuggcccugaccauuaaggggcucaacccuaccgccaucuuccugacgacccugucaagaaccuccaagaagcggagcuggccccuaaacgaggcaauuauggccgugggcaugguguccauacuggcaagcucgcugcucaagaacgauaucccuaugaccggcccccuggucgccgggggccugcucacgguguguuacgugcugaccgggagguccgccgaucuggagcucgagcgggcagcugacguucgcugggaggagcaggcugagaucagcggcucgagccccauccuguccaucacgaucagcgaggacggguccaugagcauaaaaaacgaggaggaagagcagacacugacgauccuaauacggaccggccugcugguuaucuccggccucuucccaguuagcaucccgaucaccgccgcagcgugguaccugugggaggugaagaagcagcgcgccgggguacugugggacgugcccucuccgccgcccgucggcaaggccgagcucgaggacggggccuaucggauaaagcagaagggcauccugggguacucgcagauuggcgccggcguguacaaagaggggaccuuccacaccauguggcaugucacgagaggcgcgguccucaugcacaaggggaagcggaucgagcccuccugggccgacgucaaaaaggaccucauuagcuauggggggggguggaagcuagagggggaguggaaggagggggaggagguacaggucuuggcccuagagcccggcaagaacccucgagccguucaaacuaagcccgggcuauucaagaccaacacgggcacaaucggggccgugucccuggauuucucucccggcaccuccggcucacccaucgucgacaagaaggggaaggugguggggcucuacgggaacggcgucgugacccgauccggcaccuaugucagcgccauagcccagacggagaaguccaucgaggacaauccggagaucgaggacgacaucuuccgcaagaagcgucugaccauaauggaccugcaccccggagcgggcaaaaccaaacgcuaccugcccgcgaucgugcgugaggccaucaagcgcgggcucagaacccugauccuggccccaacgcgggugguggccgccgagauggaggaagcccuccgaggccugccuauccgguaccagacccccgcgauccgcgccgagcacaccgggcgggagaucgucgaccugaugugccacgccaccuucacgaugcgcuugcugagccccauuagagugccaaacuacaaccugaucauaauggaugaggcgcacuucaccgacccggcuagcaucgcggcgcgcggauacaucuccacccggguggaaaugggcgaggccgccgggaucuucaugaccgccacgccacccggcagccgcgaccccuuuccgcaguccaaugcgcccaucauggaugaggagcgagagauccccgagaggagcuggaacuccgggcacgaaugggugaccgacuucaagggcaagaccgugugguucgugcccagcauuaaggccggaaacgacaucgccgccugccuccggaagaaugggaagaaggucauucagcugucgcgcaagacauuugacagcgaguacauuaagacgcggaccaacgacugggacuuugugguuaccacggacaucuccgaaaugggcgccaacuucaaggccgagcgcgucaucgacccacggcgaugcaugaaacccgugauccugacugacggggaggaacgugugauucucgccggucccaugcccgucacccacagcuccgccgcccagcgccggggccgcgugggccgaaacccgaaaaacgagaacgaccaauauaucuacaugggcgagccccuagagaacgacgaggacugcgcgcacuggaaggaggccaagaugcuacucgacaacaucaacacccccgagggcaucauccccagcauguucgagccggagcgugagaagguggacgccaucgacggcgaguacagacugcgcggggaggcccgcaagaccuucguugaccugaugcggcgcggcgaucuccccguauggcuggccuaccgggucgcggcggaggggaucaacuacgccgaccggagauggugcuucgauggcgucaagaacaaucagauccuggaggagaacguggaggucgagaucuggacuaaggaaggcgaacguaagaaguugaagcccagauggcuggaugcccgaaucuauuccgacccccuggcccucaaggaguucaaggaauucgcggcgggccgcaagucccugacacugaaccucaucacagaaaugggccgccuccccaccuucaugacgcagaaagcuaagaacgcccucgauaaccucgcgguucugcacaccgccgaggcgggggggcgggccuacaaccacgcccugagugagcuccccgagacccuggagacccugcuccugcugacgcuccuggcgaccgugaccgggggcaucuuuuuguuccucaugucaggcaaggggaucggcaaaaugacgcuggggaugugcugcauuaucaccgccucgaucuuacucugguacgcacaaauccagccccacuggaucgccgcaagcauaauccucgaguucuucuuaauuguccucuugauccccgagccggagaagcagcgcacgccccaggacaaccaacugaccuacguggugaucgcgauccucaccgucguggcugccaccauggccaacgagaugggauuccuagaaaagacgaagaaggacuucgggcugggcagcaucacuacucagcagcccgaguccaacauccucgacaucgaucuacggccggcgagcgcauggacucuguacgccguggccacgaccuucauaacucccaugcuccggcacuccaucgagaacucuuccgucaacgugagccugaccgcaaucgccaaccaggcgaccgugcucaugggacucgggaagggcuggccccugucaaagauggacaucggggucccccugcucgcgaucggcugcuacagccaggugaacccgaucacccugaccgccgcccuacuccuccugguggcgcauuacgccaucaucgggccgggccugcaggccaaggccacccgggaggcucagaagcgcgcggccgccgguaucaugaaaaaucccacggucgacgggaugaccgugaucgaccuggaccccauccccuacgauccaaaauuugagaagcagcugggccagguaaugcugcugguccugugcgugacccaggugcucaugaugcgcaccacgugggcccugugcgaggcccugacccucgccacggggcccaucaguacccugugggagggcaacccggggcgcuucuggaacacgaccaucgccgucagcauggccaacaucuucagaggcucguaccuggccggcgccggucucuuguucagcaucaugaagaacacugcgaacaccaggcgcggcacggggaacaccggugagacccuuggggagaaguggaagaaccggcucaacgcccuggggaaguccgaguuccagauuuacaagaaguccggcauccaggagguggaccgcacccuagccaaggaggggaucaagcggggcgagacagaccaccacgccgugucccgcggcagcgcgaagcuccggugguucgucgagcgcaaccuggugaccccagagggaaagguggucgaccucggcugcgggcggggcgggugguccuauuauugcggcggguuaaagaacgugaaggaggugaagggccugacuaagggcggaccuggccacgaggaaccaauaccaaugagcaccuacggguggaaucugguccgucuccagucgggcguggacguguuuuucacgccacccgagaaaugcgacacccugcugugcgacaucggggagucaagccccaaucccaccgucgaggccggccggacccuccgcgugcugaaccugguggaaaauuggcuuaacaacaauacccaauucugcaucaaggugcugaacccguacaugcccucuguuaucgagaagauggaggcccugcagcguaaguacggcggcgcccugguacgcaauccgcucagccggaacuccacacacgagauguacugggucagcaacgccuccggcaacaucguuucuaguguaaacaugaucagccgcaugcugauaaaccgguucaccaugcggcacaagaaggcgacauaugagcccgacgucgaccuggggucuggcacacggaacauagggaucgagagcgaaacgcccaaccucgacaucaucggaaagcgcaucgagaagaucaaacaagagcacgagaccuccuggcacuacgaccaggaccaccccuacaagaccugggccuaccauggcagcuacgagaccaagcagacgggguccgccagcuccauggugaauggcguggucagguuguugacaaaacccugggacgugaucccgauggucacccagauggcuaugacagauaccacccccuucgggcaacagagggucuucaaggagaaaguggacacacgcacccaggagcccaaagagggcacuaagaaacuaaugaagauuacugcagagugguuauggaaagagcugggcaagaaaaagacgccccggauguguacacgcgaggaguucacacggaaaguccgcagcaacgcggccuuaggggccaucuucaccgacgaaaacaaguggaaguccgcccgggaggccguggaggacuccggcuuuugggagcugguggauaaggaacguaacuuacacuuagaggggaagugcgagaccugcguuuacaacaugaugggcaagagggagaaaaaacugggggaguuuggcaaggcgaagggcucccgcgccauuugguacauguggcugggggcccgguuccucgaguuugaggcauugggcuuccugaacgaggaccacugguucagccgugagaacagccucucggguguggagggcgaggggcugcacaagcuaggcuacauccuccgggacgugagcaagaaggagggcggggcgauguacgccgacgauacagccggcugggacacgcgaaucacccuggaggaccugaagaacgaggagauggucaccaaucacauggagggggagcauaagaagcuugccgaggcaaucuucaaacugaccuaccagaacaagguggugcggguacaaaggccgacgccacgugggacgguaauggacauuaucucacgccgggaccagcgggggagcggccagguggugaccuauggacugaacacguucacgaacauggaggcgcaguuaaucagacagauggagggggaggguguguucaaguccauccagcagcugaccgugaaggaggagaucgccgucaagaacuggcugauccgcguggggcgcgagcggcuaagccgcauggcgaucagcggcgacgacuguguggucaagccccuggacgaucgguucgccagcgccuuaaccgcgcucaacgacaugggcaaggugcgcaaggauauccagcagugggagcccucccgaggguggaacgacuggacccagguuccguucugcagccaccacuuccacgagcugaucaugaaagacggacgcgugcugguuguaccuugccggaaccaggaugagcucaucggucgcgcccguaucucccagggcgcaggguggagccugcgcgagacggccugucugggcaaguccuacgcgcagauguggagccucauguauuuccaccggcgcgaccugcggcuggcggccaacgccauuugcuccgccguccccucacacuggauccccaccucccgcacgaccuggagcauacacgcgacccacgaguggaugacgaccgaagacaugcucaccguguggaaccggguguggauccaggagaacccguggauggaggacaagacccccgucgaaucgugggaagaaauccccuacuugggcaaacgcgaggaccaguggugcgggucccucaucggccuuacuucgcgggcgaccugggccaagaacauccagacggccaucaaucaggugcgcucccugauugggaacgaggaguauaccgacuacaugccuagcaugaagcgguuccgcauugaggaggaggaggccggcgugcugugguaa

SEQ ID NO: 24893 - RNA, 9876 nt, Artificial Sequence
  derived and/or modified CDS sequence (opt11) from DENV-2__KM279595__SS-prME
accgcaggcaucaucauaaugaugauacccacugucauggccuuucaccugaccacacgcaacggggagccccacaugaucguaucgcggcaagagaagggcaaaucccucuuauucaagaccgagaauggggugaacaugugcacccugauggcgauggaucucggcgagcugugcgaggacaccaucacauacaacugcccgcugcuccgacagaacgagcccgaagacauagacugcugguguaacagcaccaguaccugggugaccuacggaaccuguaccgccaccggugagcaccggcgcgagaaaagaagcguggccuuaguuccucauguaggcaugggucuugagacacgcaccgagaccuggaugagcagcgagggcgcuuggaagcacgcccagcgaauagaaaccuggauacuccgccauccaggguucaccaucauggcggccauccuggcauacaccauaggcaccaccuacuuccagcggguccuaaucuucauccuucuaacggccgugacccccucaauggcaaugagauguauagggaucagcaaucgagacuucgucgagggugucuccggcggcagcuggguggacaucgugcuagagcacggcuccugcgucaccaccauggccaagaacaagcccacgcucgacuucgagcugauaaagaccgaggccaaacaccuggccacccuccgcaaguacugcguggaggcgaagcuuacgaauacgaccaccgcgagccggugcccgacccaaggggaacccucccucaacgaggagcaggacaagagguucgugugcaagcacagcaugguggaccggggcuggggcaauggcugcggucucuucgggaagggcggaaucguaacgugcgccauguucacgugcaagaagaacauggagggcaaggucguacagcccgagaaucuggaauacacuauagugaucacgccccacucuggcgaggaaaaugccguggggaaugacacaggcaaacacgggaaggagaucaaggucacgccccagagcuccauuaccgaggccgagcugacaggauacgggaccgugacgauggagugcucaccuagaaccggccucgacuuuaacgagaugguucuguugcagauggaaaacaaagccuggcuaguccaccggcaaugguuccuggacuuaccacuuccauggcugcccggggccgacacccaaggcuccaacuggauccagaaggagacccuggugacuuucaagaacccucacgccaagaagcaggacgucgugguucucggcagccaggagggggcaaugcacacggcccugaccggcgccaccgagauccagauguccuccggcaaccuacuuuucacgggccauuugaaaugucgacugcgcauggacaagcuccagcugaagggcaugagcuacuccauguguaccgguaaguucaagguagucaaggagauagcggagacacagcacggcacgaucgugauccgcguccaauaugagggggacggcagcccaugcaagaucccuuucgaaaucauggaccuggagaagcgucauguguuggggcgacugaucacggugaaccccaucgucaccgagaaggacucgccgguaaauaucgaggccgagccgcccuucggagacagcuacaucaucaucggggucgagcccgggcagcugaagcuuuccugguucaagaaggggagcuccaucgggcagauguucgagacgaccaugcgcggugccaagcgcauggcgauucugggcgacacagcuugggauuucgggagccugggcggagucuucacauccauuggcaaggcgcuccaucagguguucggcgccaucuacggcgccgcauucagcggcgugucguggaccaugaaaauacucaucgggguggugaucaccuggaucgggaugaacagccgcuccacgagccuguccgugagccugguccucgugggaguaguuacccuguaccugggagugauggugcaggcggacuccgggugcgucgucucguggaagaauaaggagcucaagugcgguagcgguaucuucaucaccgacaaugugcacacauggacggagcaguacaaguuccagcccgaaucucccucaaagcuggcauccgccauacagaaggcacacgaggaggggauaugcggcauccgcagcgucacccgccuggagaaccucauguggaagcagaucacccccgaacuuaaccauauccugaccgagaaugaggugaaguugacgaucaugaccggggacaucaagggcauuaugcaggccgggaagcggacccugcgaccccaacccaccgagcugaaguauuccuggaaggccuggggcaaggccaagaugcucucgacugagcugcacaaccacaccuuccugauugacggcccagagaccgccgagugcccgaauacuaacagggcauggaauagccucgaaguggaggauuacggguucggagucuucacgaccaacaucuggcugaagcugaaggagcgccaggauguguucugugauucuaagcucaugucagccgcgaucaaggacaaccgagccgugcaugccgacaugggguacuggaucgagucugcucugaacgacaccuggaagaucgagaaggcuuccuucaucgaggucaagagcugccacuggccgaagucccacacacuguggagcaacggcguacucgagucagagaugaucauucccaagaacuucgcgggcccugugucgcaacacaacuaccgccccggguaccauacccagacggccggcccguggcaccugggccggcuagaaauggacuuugacuucugcgagggcacgacggucguggugacagaagacugcgggaaucgcggcccaucccugcggacgaccacggccagcggcaagcuaaucacggaguggugcugccgcucuugcacacugccgccgcuccgguaccgcggggaagauggcugcugguacgggauggagauccggccgcuuaaggagaaggaggagaaccucgucaacucccucgugaccgccggccacgggcagaucgacaacuuuagccuuggcgugcugggcauggcccucuuccuggaagaaaugcugcguaccagaguagggaccaagcacgccauccuccugguggccguuuccuuugucacgcugaucaccgggaauaugagcuuccgcgaucucgggcgcgugauggugauggucggagccaccaugaccgacgacauagguaugggcgucacuuauuuggcccuacucgcggccuucaaagugcguccgaccuucgccgcuggccugcuacuccguaagcuuaccuccaaggaguugaugaugaccacuaucgggaucguccuacugagucaguccaccauucccgagagcaucuuagagcucacagacgccuuagcacugggcaugauggugcugaagaucguccggaacauggagaaguaccagcuggccguuacaaucauggccauccugugugugcccaacgccgucauuuugcagaacgccuggaaaguguccugcacgacccuggcuguggucagcguauccccgcugcuccugaccagcucccagcagaaggcugacuggaucccgcuggcguuaaccaucaaggggcucaaccccacggccaucuuccugaccacccucucgcguaccuccaagaagaggagcuggccccugaacgaggcgauuauggccgugggcauggucuccauccuggcaucaucccugcuaaagaaugacaucccgaugaccggccccuugguggccgggggccuccugacggugugcuaugugcugaccgggcgcagcgccgaccuugagcuggagagagcggccgacgugagaugggaggagcaggccgagaucagcgggucgagccccauccucucuaucaccaucagcgaggauggguccaugucaaucaagaacgaggaggaagagcaaacgcugaccauccugauccggaccggcuuacucgugaucuccggccuguuucccgucagcaucccgauuacagccgcugcgugguaccugugggaggugaagaagcagcgcgccgggguucucugggaugucccgagcccgccgcccguugguaaggcugagcuagaagacggggcauaccggaucaagcagaagggcauccucggguacagccagauaggcgcaggcguguacaaagagggaaccuuccacacuauguggcacgugacgaggggcgccgugcucaugcacaagggaaagcggaucgaaccgucaugggcggacgugaagaaagaccugaucagcuacggcgggggcuggaaacuggagggcgaguggaaggagggggaggaaguccagguacucgccuuagagccgggcaagaacccccgcgcuguacagaccaagcccgggcuauucaagaccaacacgggcaccaucggggccguaucccuugauuucaguccuggcacgaguggaagccccauuguggacaagaaggggaagguagucggccuguacgggaauggcgucguuacccgguccggcacguacgucagcgcgaucgcgcaaaccgagaaaaacaucgaggauaacccggagaucgaagacgacaucuuccguaagaaaaggcugaccaucauggaccugcacccgggggccggcaagaccaagagguaucuccccgccaucguacgggaggccauaaaacgcggacugcggacgcugauacucgcccccacccgaguggucgcagcugagauggaggaagcucugcgcggcuuaccaauccgguaucagacccccgcgauccgcgccgagcacaccgggcgagagaucguugacuuaaugugucaugcuaccuucaccaugcgccugcuguccccgauucgggugccuaacuacaaccucaucauuauggaugaagcucacuucaccgacccagccaguauugcggcccgcggcuacauaagcaccagaguagagaugggugaggccgcggggaucuucaugacggccacuccgcccggcucgcgcgaccccuucccgcagagcaaugcgcccaucauggacgaagagaaagagauccccgagcgguccuggaacucagggcacgaguggguuaccgacuuuaaggggaaaaccguaugguucguccccuccaucaaagccgggaacgacaucgccgccugcuuacgcaagaacggcaagaagguaauccaacugucucguaaaacguuugacuccgaguacauuaagacucgcaccaacgauugggacuucgugguuaccaccgacaucuccgagaugggggcgaacuucaaagcggagcgggugaucgacccgcggcggugcaugaaaccugugauccucaccgacggggaagaaagggucauccuggccggccccaugcccgugacgcacuccucugcggcacagcggcgcgggaggguuggccgcaauccuaagaacgaaaacgaucaauacaucuauaugggcgagccccuggagaaugacgaggacugcgcgcacuggaaggaagccaagaugcuacuggacaacaucaacacuccggagggcaucauucccucaauguucgagccagagcgggagaagguggacgccaucgacggcgaauaccggcugagaggggaggcccggaagacguucguggaccucaugcgacggggcgaccugcccgucuggcuggcuuaccgcguggcggccgaggggaucaauuacgccgaccggcgcuggugcuucgauggugugaaaaacaaccagauccucgaggagaacgucgagguggagaucuggaccaaggagggggagcggaaaaagcugaagccccgcugguuggacgcccggaucuauagugauccgcucgccuuaaaagaguuuaaggaguuugcagccggccgcaagucucugacgcuaaaccugauaaccgagaugggccggcugcccacguucaugacccagaaggcuaagaacgcccuugacaaccuggcaguucugcacaccgccgaggccgggggccgugccuacaaccacgcccucagcgaacugccggagacccuggagacgcugcuguugcucaccuuacuggcaaccguuacugguggcaucuuccucuuccugauguccggcaaggggaucgguaagaugaccuuagggaugugcugcaucaucacggccucuauccuacugugguacgcgcagauacaaccccacuggaucgccgccuccaucauccuugaguucuuucucaucgugcuccugauuccggagcccgagaagcagcguacuccgcaagacaaccaacucaccuacguagucauugcaauucugaccgugguggccgccacgauggccaaugagauggguuuccuggagaagaccaagaaggacuucggucucggcagcaucaccacccagcaaccagaguccaacauccuggacaucgaccugcgcccggccagcgcauggacgcucuaugcaguggcgaccaccuucaucacgcccaugcugcgacacucaaucgagaacuccagcguuaacgugucccuuacagccauugcgaaccaggcgacgguccucaugggcuuggggaagggcuggccccugagcaagauggacaucgggguccccuuacuggccauaggcuguuauucccaggugaaccccaucacccuaaccgccgcgcuccugcugcucgucgcucacuacgcgaucaucgggcccggacugcaggcgaaagcuacgagggaggcccagaagcgggcggccgccggcaucaugaaaaaucccaccguggacggcaugaccgugaucgaucuggaccccaucccguacgacccuaaguuugagaagcagcucggccaggucaugcugcuggugcucugcgugacccagguucugaugaugcgcacaacaugggcccugugcgaggcacuaaccuuggcgaccgggccgauaagcacguuaugggagggcaaccccgggcgguuuuggaacaccacuaucgccguguccauggccaacaucuuucgcgggucauaccucgccggggccgggcugcuguucagcaucaugaagaacaccgcgaacacgcguaggggcaccggaaacacuggggagacccucggugaaaaguggaagaacagacuaaacgcccugggcaaguccgaguuccagaucuacaaaaaguccgggauucaggagguggaucggacgcuggccaaggaggggaucaagcgcggugagacugaccaccacgccguaucgagagguuccgcgaagcugcguugguucgucgagcgaaaccuggugaccccggagggcaaagugguggaccucggcugcgggcgugggggguggucuuacuacugcggcgggcugaagaacgugaaggaggugaagggccugaccaaaggcggacccggucacgaggaacccauccccauguccacguacggguggaaccucgugcgucugcagagcggcguggacgucuucuucaccccgcccgagaagugcgacaccuuguugugcgacaucggggaaucuagcccgaaccccaccguggaggccggccgcacccugcgggugcucaaccuggucgagaacuggcugaacaacaauacgcaguucugcaucaagguccucaauccuuacaugcccagugugauugagaagauggaggcucugcaacggaaguauggcggggccuugguccggaacccacugucucgcaacucgacacacgagauguacuggguguccaaugccagcgguaacaucguguccagcgucaacaugaucucccgcauguugauaaaccgcuuuaccaugcggcacaagaaggcaacuuacgagccggacguugauuuaggcucgggcacgcgcaacaucggaaucgaauccgaaacgcccaaccucgacaucaucggcaagcggaucgagaagaucaagcaggagcaugagaccagcuggcacuacgaccaggaccaccccuacaagaccugggccuaccacggcuccuacgaaacgaaacagaccgggagcgccuccagcauggugaauggcgucgugcgccuguuaacaaagccaugggacgugauacccauggucacccagauggccaugacggacaccacacccuucgggcagcagcgcguguucaaggagaaagucgacacccggacgcaggagcccaaggagggcacgaaaaagcugaugaagaucaccgccgaguggcucuggaaggaguuaggcaagaagaagacgccccgcaugugcacgcgggaagaguucacccgcaaggugcgguccaacgcggcccugggggccaucuucaccgacgagaacaaguggaagucagcccgagaggccguggaggacucaggguuuugggagcucguagacaaggaacggaaccuccauuuagaggggaagugcgagaccugcguguauaacaugaugggaaaaagagaaaagaagcugggugaauuuggcaaagcgaagggcagccgggccaucugguacauguggcucggagcacgguuccuagaguucgaggcccugggguuucuuaacgaagaccacugguucagucgggagaacucgcugucugggguggagggcgagggacugcacaagcucggcuacauccuacgcgacgucagcaaaaaggagggcggggcuauguaugccgacgacaccgccggaugggauacccggaucacgcuggaagaccucaagaacgaggagauggugaccaaccacauggagggggagcauaagaaguuagcagaggcaauauucaaacugacguaucagaacaagguaguucgcguacaacgaccgacuccccgcggcacggugauggacauuaucucucggcgugaccagagaggguccggccaggucgugaccuauggcuugaacaccuucaccaauauggaggcgcagcucauacgccagauggaaggcgagggcguguuuaagagcauccagcagcucacgguaaaggaggagaucgccgugaaggacuggcucauccgggugggccgugagcgccuuucccggauggccaucagcggcgacgacugugucgugaagccccuggacgaccgcuuugccuccgcacucaccgcgcucaacgacaugggcaaggugcgaaaagacauccagcagugggagcccucacgaggguggaacgacuggacgcaggucccauucugcucucaccacuuccaugagcugaucaugaaggacggacgggugcucguuguucccugccgcaaccaggacgaauugaucgggcgggcccgaaucucccaaggcgccggguggucccugcgggagaccgcgugccucggcaagucguacgcccagauguggucccugauguacuuccaccgccgggaccugcgccuagcggccaacgccaucugcagcgccguaccgucccacuggauucccaccucccggaccaccugguccauccaugccacacacgaauggaugacgaccgaggacaugcugacgguauggaaucgcgucuggauccaagaaaacccguggauggaggacaaaacgcccguggagucuugggaggagauuccauaccugggcaaacgugaagaccaguggugcgggucccugauugggcugaccagcagagccacgugggccaaaaauauucagaccgcuaucaaccaggugcguagccugauagggaacgaagaguacacggacuacaugccauccaugaagcgcuucagacgggaggaggaggaggccgggguccucugguga

SEQ ID NO: 24894 - RNA, 9876 nt, Artificial Sequence
  derived and/or modified CDS sequence (opt11) from DENV-2__KM279566__SS-prME
accgcgggcaucauuaucaugaugauccccaccgucauggcauuccaucucaccacucgcaauggggaaccccacaugauagucucucggcaagagaagggcaagucauuacuguucaagacggagaacggagugaauaugugcacccucauggcgauggaccucggugagcugugcgaagauacgaucaccuauaacugcccccugcuccgccagaacgagcccgaggauaucgacugcugguguaauagcaccuccaccugggugaccuacgggacuugcaccgccacgggcgagcaccggcgcgagaagcggagcgucgcacuggugccucacguggggauggggcuugaaacgcgcacggaaaccuggaugucuagcgagggcgcauggaagcaugcccagcggauugaaaccuggauccuccgacauccuggguucaccaucauggcggccauccuggccuacaccaucggaaccaccuacuuccagagaguccugaucuucauccucuuaaccgccgugaccccguccauggcgaugcgcugcauagggaucagcaaccgugacuucguggagggaguauccgguggguccuggguagacauaguguuagagcacggcuccugcguuaccaccauggccaagaauaagcccacucuugauuucgaauuaaucaagaccgaggccaaacaccuggccacccuacgcaaguauugcguggaggccaagcugaccaacacgacgaccgcgagccggugccccacccagggggagcccucccuaaacgaggaacaggacaagcgcuuuguaugcaagcacagcauggucgaccggggcuggggcaacgggugcggucuauucgggaaggguggcaucguaacuugcgcaauguucacaugcaagaaaaacauggagggcaaggucguccagcccgagaaccuggaauacacaaucgugaucacgccgcacuccggcgaggaaaacgccguggggaacgauacugguaagcacgguaaggagaucaaggucacgccucagucauccaucacggaggccgagcugacuggcuacgggacugugacgauggagugcuccccgcgcaccggucucgacuuuaaugagauggugcugcugcagauggagaauaaggccuggcuuguccaccggcagugguuccuggaccucccccuucccuggcugcccggcgcggacacucaggggaguaacuggauccagaaagagacccugguuacguucaagaacccgcacgccaaaaagcaggacgucguggugcucggcagccaagagggggccaugcauaccgcccugacuggcgccaccgagauccagaugagcuccgggaauuugcuuuuuacgggccaccuuaagugucgacugcggauggauaagcuacaacugaagggaaugagcuauagcaugugcaccgggaaguucaaggucgugaaggagaucgcugagacgcagcacggcaccaucgugaucaggguucaguacgagggggauggcagccccugcaagaucccuuucgagauuauggaucuggagaagcgccaugugcucggccgccugaucacggucaaucccaucgucaccgagaaggacuccccuguuaacaucgaggccgagccgcccuucggggacagcuacaucauaauaggcguggagcccgggcagcugaagcucuccugguucaagaagggcagcuccaucggucagauguuugagaccacaaugcgcggcgcaaaacguauggccauccuuggcgacacggccugggacuucggcagccuggguggagucuucaccuccaucggcaaggcccuccaccagguguuuggagccaucuacggcgccgccuucagcggcguguccuggaccaugaagauucugauagggguagucauaaccuggaucgggaugaacagccgcuccacgucucuguccgugagccuuguccucguaggggucgucacccuguacuuaggagugauggugcaggcggacucuggaugcguugugagcuggaagaacaaggagcucaagugcggguccgggaucuucaucacugacaacgugcacacauggacggagcaguacaaguuucagccggagucccccagcaagcuggcgagugccauucagaaggcccacgaggaggggaucuguggcauccgcagcgucacccgucuggagaauuuaauguggaagcagaucaccccugagcugaaucacauccugaccgagaacgaggugaagcucacaauuaugaccggggacauuaagggcaucaugcaggcuggaaagcgcacguuacguccccaaccaacugaguuaaaguacucauggaaagcguggggcaaggcuaaaaugcucagcacggaacugcauaaccauaccuuccugauugacggccccgagacggccgagugcccaaacaccaaccgggccuggaauucacucgagguggaagacuacggauuuggcgucuucacgaccaauauaugguugaagcugaaggagcgucaggacguguucugugauucuaaacucauguccgccgccauaaaggacaaccgggccgugcacgccgacaugggguauuggaucgagagcgcucugaacgacaccuggaagaucgagaaggccuccuucauagagguuaagaguugccacuggccgaagucccacacccuguggagcaacggggugcuugaguccgagaugauuauccccaagaauuucgcgggccccgugagccagcacaacuaucgcccaggguaccacacccagacggccggcccguggcaccuggggcgacuggagauggacuuugacuucugugagggcaccaccguggugguuaccgaggacugcgggaaucgcggccccagucucagaacgaccaccgccagcggcaagcugaucaccgaguggugcugccgcagcugcacgcugccgcccuugcgguaccgcggggaggacggcugcugguacgggauggagauccggccgcugaaggagaaggaggaaaaccugguuaacagucucgugaccgccggccacgggcagaucgacaauuucucacugggcguccugggcauggcccucuuccuggaggagaugcuucguacccggguggggaccaagcacgccauccuccuggucgccguauccuuugucacgcugaucaccgggaacaugucauuccgcgaccuaggacgcguuaugguaauggucggggccaccaugacggacgacauagguaugggugugacguaucuggcccugcucgcggccuucaaggugcggcccacguucgccgccggguuacugcucagaaagcugacuaguaaggaguuaaugaugaccacgaucgggauaguccugcugagccaauccaccauccccgagucuauccuggagcucaccgacgccuuagcccuuggcaugaugguccuuaagaucgucagaaacauggagaaguaccaacuggccgucacgaucauggcaaucuuaugcguucccaacgccgucauccuccagaacgccuggaagguguccugcacgacccuagcgguggucagcguguccccgcugcuucugaccagcucccagcagaaggcugacuggaucccccuggcccucaccaucaagggacugaaccccacggcaaucuuccucaccacccucucccguaccuccaagaagcggagcuggccccugaacgaagcuaucauggccgugggcaugguuuccauucuggcaagcagccuccugaagaaugacaucccgaugacgggcccccuaguggccggcggucuccugaccgugugcuauguccucaccgggcgcucggccgaccucgagcucgagcgggcggccgacgugcgcugggaggagcaagcugagaucagcggauccagcccgauccugucuaucaccaucagcgaagacggguccaugagcaucaagaacgaggaagaggaacagacgcugaccauacugauccggaccggccugcucguaaucucuggccuguuucccguuucuauuccgaucaccgccgcugccugguaccuuugggaggugaagaagcaacgcgccggcgugcucugggacgucccuagcccgccgcccguugggaaggccgaacuggaggacggggcguaccggaucaagcagaaaggaauccugggauauucucagauaggcgccggcguguacaaggaggggaccuuccacacgauguggcacgucacccgcggcgcugugcucaugcacaagggaaagcggaucgagcccuccugggccgacgucaagaaggaucugaucagcuauggcggaggguggaagcuggagggugaguggaaggagggagaggagguccaggugcucgccuuagagccaggcaagaacccccgcgcuguccaaacgaagccagggcuguucaagaccaacacaggcaccauuggagccgucucacucgacuuuagccccggaaccuccggcagccccaucguggacaagaagggaaagguggucggccuguacgggaacggcguggugacccgguccgguacguacgucagugcgauagcccagaccgagaaauccaucgaggacaacccagaaaucgaggaugacauauuccgcaagaagagguuaacuaucauggaucugcauccaggggcuggcaagaccaagcgcuaccuccccgccaucguacgggaagcgaucaagcgcgggcugcggacgcugauccucgcccccacccgcgugguugccgccgagauggaggaggcacugcgaggccugccgauccgguaccaaacgccagcgauccgcgccgagcacaccgggcgggaaaucguggaucucaugugccacgccacguucaccaugcggcuccugagccccauccgggugcccaacuacaacuugaucaucauggaugaagcccacuucacugacccggcaagcauagcggcccgcggcuacaucuccacccggguugagaugggcgaagccgccgggauauucaugacggccacgccgccgggcagcagggaccccuucccgcaguccaacgcgcccauuauggacgaggagaaggagauucccgaacggagcuggaacuccggccacgagugggugaccgacuucaagggcaagaccgugugguucguccccucgaucaaggccgggaaugacauagccgccuguuugcgcaagaacggcaagaaggugauccagcugucacgaaagacguucgacagcgaguacauaaagacccggaccaacgacugggauuucguagucaccacggacaucuccgagaugggcgcgaacuucaaggcugagcgggugaucgauccgcgccgaugcaugaaacccgucauacucaccgacggggaggagcgcgugauccucgcuggccccaugccgguuacccacagcuccgccgcccagcggcgcgguagggucggacgcaauccgaagaacgagaaugaucaguacaucuacaugggggagccccuggagaacgacgaagacugcgcgcacuggaaggaggccaaaaugcuccucgacaauaucaacacgccggaaggcaucaucccaagcauguuugagccggaacgagagaaggucgacgcgaucgauggcgaguaccggcugcgaggggaagccagaaagacguucguggaucucaugcgccggggcgaccugcccgucuggcuggccuaccguguggcugcggaggggaucaauuaugccgaccggcgcugguguuucgacggcgugaagaauaaccagauccucgaggagaacgucgagguugagaucuggaccaaagagggggagagaaagaagcuuaagccgcgcuggcuggacgcccggaucuacuccgacccgcucgcccugaaggaguucaaggaguucgccgccggccgcaagagccugacccucaaccugaucaccgagaugggccggcugccaacguucaugacacagaaggccaagaacgcgcucgauaacuuagcgguacugcacaccgccgaggcugggggccgcgccuacaaccacgcccucuccgagcugcccgagacucuugaaacgcuccuguuacucacucugcuggcuacgguaacugggggcaucuuccuauuccuuaugagcggcaaggggaucgggaaaaugacccuggggaugugcugcaucaucacggccuccauccuucuaugguacgcccagauccagccccacuggaucgccgccucaauaauccuggaguucuuccuaaucgugcugcugauuccggagcccgaaaagcagcggacgccccaggacaaccaacucacauacguggucaucgccauccugacggugguggccgccacuauggccaacgaaaugggguuucuggagaagacuaagaaagacuucgggcucggcuccauaacgacccagcagcccgagucuaacauccuggacauugaccugcgccccgccagcgcguggacgcucuacgccgucgcaaccaccuucaucacucccaugcugcggcacuccaucgagaacagcagcgucaacgugucccugacggccaucgcuaaccaggcuacuguccucaugggcuuggggaagggguggccccuguccaaaauggauaucggggucccccuccuggccaucggcugcuacagccaggugaacccgaucacccugacagccgccuuacucuuacucguagcucacuacgccaucauagggcccggcuuacaggccaaggccacacgagaagcgcagaagagagcggcagcgggcaucaugaagaaccccacuguggacgggaugaccgucaucgaucucgaccccaucccuuacgaccccaaguucgagaagcaacucggacaggucaugcugcuuguccucugcguuacccagguccugaugaugcgcacgaccugggcccugugcgaagcgcuaacacuggcgacagguccgaucuccacgcuaugggagggcaaccccggccgguucuggaauaccaccaucgcugugagcauggccaacauauuccgcggcucauaccuggccggggccgggcugcuguucucuaucaugaaaaacacugcgaacacgcgucggggcaccgguaauaccggcgagacccugggugagaaguggaaaaaucgcuugaacgcccuggggaagucagaguuccagaucuacaagaaaaguggcauccaggaaguggaccggacgcucgccaaggaaggcaucaagcgcggcgagacagaccaccaugcugucagccggggaagcgccaagcuucguugguucguggagaggaaccuggucaccccggagggcaagguaguggacuugggcugcgggcgcggcgguugguccuacuacuguggcgggcugaagaacgugaaggaggucaagggccugaccaagggcgggccuggacaugaagaacccauccccaugagcacguacggguggaaccucgugcggcugcaguccggcguggaugucuucuuuacgccgccggagaaaugcgacacccuucucugcgacaucggggaaucaucccccaacccgacgguggaggccgguaggacccugagggugcugaacuuagucgaaaacuggcugaacaauaacacgcaguucugcaucaagguacugaacccauacaugcccuccguaauugaaaagauggaggccuuacagcgaaaguacggcggugcccucguacgaaacccacucucucgcaauagcacucaugagauguacuggguaagcaacgcauccggcaacauagugagcuccguaaauaugauaagccgaaugcugaucaacagguucaccaugcgucacaagaaggcgacauacgagcccgacgucgaccugggguccgggacaaggaauauugggaucgagagcgagacgccaaaccuugacaucaucggcaagcggaucgagaagaucaagcaggagcaugagacaaguuggcacuacgaccaggaccaccccuauaagaccugggccuaccacgggagcuaugagacaaaacaaaccggguccgccaguuccauggugaacggcgucgugcgccuguuaaccaagccuugggacgugauaccuaugguaacccagauggcgaugaccgacaccacccccuucgggcagcagcgcguguucaaggagaaggucgacacccguacccaggagccgaaagagggcaccaagaagcugaugaagaucaccgccgaauggcuguggaaggagcucggcaagaagaagacgccccgcaugugcacacgcgaagaguucacucguaaggugcggagcaacgcggcccuuggggcaaucuuuaccgaugagaacaaguggaaaagugccagggaggccguagaggacagcggcuucugggagcuugucgacaaagagcggaacuugcaccuggagggcaagugcgaaaccugcguauacaacaugaugggcaaacgcgagaagaagcugggagaguucggcaaggcgaaaggcucccgugccaucugguacauguggcuaggggcgcgcuuucuggaguucgaggcucuggguuuccucaaugaggaccacugguucucgcgugagaacucacuaagcgggguugagggcgaagguuuacacaagcugggcuacauccugcgcgacgucuccaagaaggagggaggcgcgauguacgccgacgauacggccggcugggauacgcggaucacucuugaggaccuaaagaacgaggaaauggugacgaaccacauggagggcgagcauaagaagcuggccgaagccaucuucaagcugaccuaccagaacaaggugguccgcgugcagcggccgacgccccggggcaccgugauggacaucauaucccgccgcgaccaaaggggaagcggccaggucgugaccuacggucucaacacauuuacaaacauggaggcgcaacugauccgccagauggaaggugagggcguguucaaguccauccagcaacugaccguaaaggaagaaauugccguuaagaacuggcucauccggguugggcgcgagcgccugagccguauggcuaucuccggcgacgacugcgucgugaagccccuggacgacagguucgcuucagcccucacggcgcuaaacgacauggggaaagugcggaaagacauacagcagugggagccaagccgcggguggaacgacuggacgcagguccccuucugcagucaucacuuccacgagcugaucaugaaggacggccggguguuaguggugccaugccgcaaccaggacgaguuaauuggucgagcccgcaucucgcagggcgcaggguggucacugcgagagaccgccugccugggcaaguccuacgcccagauguggagccugauguacuuccaucgcagggaccuacgccuagcggcgaacgcgaucugcuccgccgugccuagccauuggauccccacgagucguacgaccuggagcauccacgccacucaugaguggaugacuaccgaggauaugcugaccguguggaacagagucuggauacaggagaacccguggauggaggacaagacgcccguggagucuugggaggagauccccuaccugggcaagcgggaggaccaguggugugggagccucaucggccugaccagcagagcgaccugggccaagaacauccagaccgccaucaaucaggugcggagccugaucggcaacgaggaguacacugauuacaugcccagcaugaaaagguuccgccgcgaggaggaggaggccggcguauuaugguaa

SEQ ID NO: 24895 - RNA, 9876 nt, Artificial Sequence
  derived and/or modified CDS sequence (opt11) from DENV-2__KM279574__SS-prME
accgcgggcaucaucaucaugaugauccccaccgugauggccuuucacuuaaccacgcggaauggggaaccccacaugauugugagccggcaggagaagggcaagucccuccuguucaagaccgagaauggggucaacaugugcacccugauggcuauggacuugggcgagcuaugugaggacaccaucaccuacaauugcccgcugcuccgccagaacgagccugaggacaucgacugcuggugcaacagcaccagcaccuggguuaccuacgguaccugcaccgccaccggcgagcaccggcgcgagaagcguagugucgcccuggugccgcacgugggcaugggacuggagacccgaacagagaccuggaugagcuccgagggugcuuggaagcacgcccagcguaucgaaaccuggauccuacgacaccccggguucaccaucauggcugcaauccuggccuacacgaucgggaccaccuacuuucaacggguucugauuuucauacucuuaacagccgugacccccuccauggcaaugcgcuguauagggauaucgaacagggacuuuguggaaggcgucuccggcgggucauggguugacauaguacuggaacacggcucgugugucacuaccauggccaagaacaagccgacucuugacuucgagcucaucaagaccgaggccaaacaccucgccaccuuacggaaauacugcguggaggccaaacuuaccaacacgaccaccgcgagccggugcccuacccaaggggagcccucccugaacgaggagcaggacaagcgcuuuguguguaagcauagcaugguagaccggggcuggggcaacgggugcggccucuucgggaagggcgggauuguaaccugcgcuauguucacaugcaagaagaacauggagggcaaagugguccagcccgagaaccuggaauacaccaucguuaucacgccccacagcggggaggagaacgccguggggaaugacacugguaagcacgggaaggaaaucaaggucacuccccagagcagcaucaccgaggccgagcugaccggcuacgggaccguaacaauggagugcagcccgaggaccggucuugauuucaacgagaugguguuacugcaaauggagaauaaggccuggcucguccaccggcagugguucuuagacuuaccccuccccuggcuaccgggcgccgacacccaggggaguaacuggauccaaaaggagacacuggugacuuucaagaacccgcaugccaaaaagcaggacgucguggugcucggcucgcaggagggggccaugcacaccgcgcugaccggcgcaacagagauucagaugagcuccgggaaccucuuguucacgggccaccucaaguguagguuacggauggacaagcuccaacugaagggcaugagcuacagcauguguacggguaaguucaaggucgucaaggagaucgcugagacccaacacgggaccaucgugauccgcguccaauacgagggggacggcagucccugcaagauccccuuugagauaauggaccuggagaagcggcauguccucggccgccuaaucacgguaaaccccaucgucacggaaaaggacuccccggugaacaucgaggccgaaccgccuuucggugacucauacaucaucauaggcguugaacccgggcaguuaaaacucuccugguucaagaagggaaguuccaucggucagauguucgagacaacgaugcgcggcgccaagcggauggccauauuaggugacacggccugggacuucgggucccugggcggcguuuucaccuccaucggcaaggcgcuccaccagguguucggggccaucuacggggcggcauucagcgguguguccuggacuaugaagaucuuaaucggggucgugauuaccuggaucggcaugaacuccagguccacgagccuguccgucagccugguccucguggggguggucacccuguaccugggagugaugguacaggccgacuccgggugcguaguuucuuggaagaacaaagaacuaaagugcggcagcggcaucuucaucaccgauaacgugcacacuuggacggagcaguacaaguuucagccggagucccccagcaagcuggcuuccgccauccagaaggcccacgaggaagguaucugcggaauccguagcguuacccgccuggagaacuuaauguggaagcagaucacccccgagcuaaaccacauacugaccgagaacgaggugaagcucacgauaaugacaggagacauuaaggguaucaugcaggccgggaaacggacucugcgcccccagccgaccgaacuuaaguacuccuggaaggcguggggcaaggccaagaugcucagcacagagcugcacaaccacaccuucuugaucgauggcccugagaccgccgaaugccccaauaccaaccgggccuggaacucccuggaggucgaggauuacggguucggcguauucacaaccaacaucuggcugaaguugaaggaacgccaggacguguucugcgacucuaagcucauguccgccgcgaucaaggacaaccgcgccgugcacgccgacaugggguacuggaucgagagcgcccuaaacgauaccuggaagaucgagaaggccucguuuaucgaggucaagagcugucacuggccgaagucccacacccuguggucgaacgguguguuagaguccgagaugaucauacccaagaacuucgcgggccccgugagccaacacaauuaccgccccggauaucacacccagacggccggcccuuggcaucuggggaggcuugagauggacuucgacuucugcgaggguacaacggucguugugaccgaggacugcgggaaccgcgggcccucccuacggacgacuacugcaagcggcaagcugaucaccgaguggugcugucgcuccugcacuuugccuccucuacgguauaggggcgaggacgggugcugguacgggauggagauccggccgcugaaagagaaggaggagaaccuggucaacucccucgucacggcgggccacggucagaucgauaacuuuagccugggcguauuaggcauggcccucuuucuggaggagauguuaagaacccggguugggaccaaacaugccauccuccuggucgcagugucuuucgucacgcuaaucaccggaaacaugucauuccgcgaccucgggcgcgugauggugauggugggcgccaccaugaccgacgacaucggcaugggcguuacauaccuggcccugcuagcagccuucaagauucgccccaccuuugccgcaggccugcugcuccguaagcugacguccaaggagcugaugaugacgacgaucgguaucguccuccugucacaguccaccauccccgagaguauccuugagcucacagacgccuuagcucugggcaugauggucuuaaaaauugugcggaacauggaaaaguaccaacuggccgucacgauuauggcgauacuuugugucccgaaugcggugauccuccagaacgccuggaaggucucuugcacgaccuuagcgguggugagcgucuccccucugcuccugaccucgucccagcaaaaagccgacuggauccccuuggcccucaccaucaaggggcuaaaucccacggcuauuuucuuaaccacccucagccgcacuuccaagaaacggagcuggccacugaacgaggccaucauggcgguggggaugguuuccauccuggccucuuccuugcuuaagaacgacaucccgaugacgggucccuuggucgccgggggcuugcugaccgugugcuacgugcugacagggcgcucagccgauuuagaguuggagcgugcggccgacgucagaugggaggagcaagccgagaucucaggcuccuccccaaucuuaagcaucaccaucagcgaagacggauccaugagcaucaagaaugaagaggaggaacagacucucacaauauugauucggaccggucugcucgugaucucgggacuguuuccugugaguaucccgauuaccgccgccgccugguacuugugggaggucaagaagcaacgggcuggggugcucugggacgugcccagcccuccacccgucggcaaagccgaacuggaggacggugccuaccggauaaagcagaagggcauccugggguacucucagaucggcgccggcguuuacaaggaggggaccuuccacaccauguggcacguuaccagaggcgcgguguuaaugcacaaagggaagcggaucgagccuuccugggcagacgugaagaaggaccugaucagcuauggcgggggcuggaagcuggagggcgaguggaaagaaggggaggagguacagguccucgcccuggagcccggcaagaacccuagggcugugcaaaccaagccaggguuauucaagaccaacacaggcaccaucggugccgugucccuagacuucagccccggaaccuccggcagccccaucguugauaagaaggggaagguggugggcuuguaugggaauggcgucguaacccgcucuggcaccuacgugagcgcuaucgcccagaccgaaaaaucgaucgaagacaacccggagaucgaggacgauaucuuucgcaaaaagcggcugaccaucauggaucuucaccccggcgccggcaagaccaagcgauaccucccugcgaucguccgggaagcgauuaaacgcggucugcggacauuaauucucgcucccacacgcgugguagccgccgagauggaggaggcccugcgcggccugccaauccgguaccagacuccagcgauccgcgcagagcacacggggagagagauuguggaccucaugugccacgccacguucaccaugcguuuacugagucccauccgggugcccaacuacaaccucaucauaauggacgaggcccacuucaccgaccccgcgucuaucgccgcccgcggcuauauaaguacccgcguggagaugggggaggccgcggggauuuucaugacggccacgccgcccggaagcagggaucccuucccucaguccaacgcgcccaucauggacgaggagaaagagaucccagagcggagcuggaacuccgggcacgagugggucaccgacuuuaagggcaagaccguuugguucgugcccagcaucaaggccgggaacgacaucgcggccugcuuacgcaagaaugggaagaagguaauccaacugucccggaagacguucgacagcgaguacaucaagacccgcacgaaugacugggacuucguggugacaacggacaucucugagaugggcgcgaacuucaaggccgagcggguuaucgacccgcgccgguguaugaagccugugauacucaccgacggcgaggagcgcgucauauuagccggccccaugcccgucacccacaguucugccgcccaacggcgcggacgggugggccgcaauccgaagaacgagaacgaccaguacaucuacaugggggagccccucgaaaacgacgaagacugcgcgcacuggaaggaggccaagaugcuccuggacaauaucaacacucccgagggaaucauccccaguauguucgagccugagcgcgagaagguagacgccaucgacggcgaguacagguugagaggggaggcccggaagacguucgucgaucucaugcgccguggcgacuuacccguuuggcuggcuuaccgggucgcggccgaggggauuaacuaugccgaccggcgcuggugcuuugaugggguuaagaauaaucagauccucgaggagaauguggaggucgagaucuggaccaaggagggggagcggaagaaguuaaagccuagauggcucgaugcccggauuuacagugauccgcucgcccugaaggaguucaaggaguucgcagccggcagaaagagcuuaacccucaaccugauaaccgagauggggcggcugcccacguuuaugacccaaaaggcgaagaacgcccucgacaaccuggcggugcugcacaccgccgaggccggaggccgagccuacaaucacgcucucucugagcugccugagacccuggagacgcuccuccugcuuacccugcuggcgaccgugaccggaggcaucuucuuauuccugaugucgggcaagggcaucgggaagaugacccugggaaugugcugcaucaucacggccucaaucuuguuaugguacgcccagauccagccacacuggaucgcagcuagcaucauucuggaguucuuccucauuguccuucugaucccggagccagagaagcagcggacaccccaagacaaccagcucacuuauguggugauugcgauccuuaccgucguggccgccacgauggcgaacgagaugggcuuccuggagaagaccaagaaggacuucggacucgguuccauaaccacccagcagcccgagagcaauauucuggacaucgaccugcgcccggccagcgcguggacacucuacgcaguggcaacgacauucaucaccccaaugcuccggcacuccaucgagaacagcuccgucaacgugagccugaccgccauagcgaaccaggcgacaguacucaugggccuggggaagggauggccauuguccaagauggacauaggggucccacucuuagccaucggcugcuacagccagguaaaccccauaacuuuaaccgcagcccuccugcugcucguggcgcauuaugccaucaucggucccgggcugcaggccaaggccacgcgcgaggcccagaagcgggcggccgccgggaucaugaagaaucccacugucgacgggaugacggugaucgacuuagaccccaucccguacgaccccaaguucgagaagcagcucggccaggugaugcuucugguucucugcgugacccaaguacugaugaugcgcacgaccugggcccugugcgaggcccucacucuagcuaccggacccaucuccacgcugugggaaggcaaccccgggcgguucuggaacaccaccaucgccgucagcauggccaacauauuccgcggcaguuaccucgcuggggccgggcuacuguucagcaucaugaagaacacggcgaauacgcgcagaggcacggggaacaccggcgaaacccucggugagaaguggaagaaucgccugaacgccuuggggaaauccgaguuccagaucuacaagaaguccggcauccaggaggucgaucggacucucgccaaagagggaaucaagagaggggagaccgaucaccacgccgugagcagagguagcgcgaagcuacgcugguuugucgagcggaaccugguaaccccggaaggcaaggugguggaccucggcugcgggcgcggaggguggucauauuacugcggcgggcugaagaaugugaaggaggucaaaggccugaccaagggcggacccggacacgaggagcccauucccaugagcacguacggguggaaccucgugagacugcaguccgguguggacguguucuucaccagcccggagaagugugauacgcugcucugugacauuggcgaguccucccccaaccccaccgucgaggccggaagaacccugcgggugcugaaccucgucgagaacuggcuaaacaacaauacacaguucuguaucaagguccugaaccccuacaugccguccgugauugagaagauggaggcccugcagcgcaaguacggaggggcccucguccggaauccccuguccagaaacagcacacacgaaauguacugggucucgaacgccagcgggaacaucgucuccagcgugaacaugaucagucggaugcugaucaaccgcuuuacgaugcggcacaagaaggcgaccuacgaacccgacgucgaccucgggagcggcacgcgaaacauuggcaucgaguccgaaaccccgaaucuggacauaaucggcaagcgcaucgagaagaucaagcaggagcacgagaccagcuggcacuacgaccaagaccaucccuauaaaaccugggccuaccacggcucuuacgagacgaagcagaccgggagcgcuuccagcauggugaacggcgucguccgguugcucacuaagcccugggacgugauccccauggugacucagauggccaugacugacacgaccccguucgggcagcagcgagucuucaaggagaagguggacacucgaacacaggagcccaaggaggggaccaagaaacugaugaagaucacggcugaguggcuuuggaaggagcugggaaagaagaagacuccucguauguguacgcgggaggaguucacccgcaagguccgcuccaacgcggccuugggugccaucuucaccgacgagaacaaguggaaguccgcccgcgaggccguggaggacuccggcuucugggagcuuguggauaaggagcggaacuugcaccuggaggggaagugcgaaaccugugucuacaacaugauggguaagcgcgagaagaagcugggggaguuugggaaggcgaaggggagccgggcaauuugguacauguggcucggggcccgcuuccuggaauuugaggcccucggauuccucaaugaagaccacugguucagucgggaaaauucacugagcggcguggagggcgaggggcugcacaaacucgguuacauccugcgugaugugucuaagaaagaaggaggggcgauguacgccgacgacacggccgguugggacacccggauaacccuggaggaccucgagaacgaggagauggucacgaaucacauggagggagaacacaaaaagcuggccgaggcuaucuucaagcucacguaccagaacaaaguggugcgcguccagcggccgacacccagagguaccguuauggacaucaucagucggcgcgaucagcggggguccggccaggucgugaccuacgggcuaaauacguucacgaauauggaagcgcagcugauccgccagauggaaggggagggcguguucaagagcauacagcaguuaacugucaaggaggagauagccguaaagaacuggcucacccggguggggcgggaacggcugucccggauggccaucaguggugacgauugcgugguaaagccccuggacgaccgcuucgccuccgcccucacagcgcugaacgacaugggcaaagugcgaaaggauauccagcagugggagccaagccgcgguuggaacgacuggacccaagugccauucugcagccaccacuuccacgaacugauaaugaaggauggccggguccucguggugccgugccgcaaccaggacgagcugaucggacgggcccgcaucagccagggcgcgggguggagucugcgggagaccgccugccugggcaaaucauacgcacagauguggucccugauguauuuucaccgccgggaccugcgcuuggcggccaaugccaucugcagugccguccccucccauuggauuccgacgagccggaccacguggaguauccacgccacccaugaauggaugaccaccgaggauaugcugacgguguggaaccgcguguggauccaggagaacccauggauggaggacaaaaccccggucgaaucuugggaggagauccccuaccugggcaagagagaggaccaguggugcgggagcuugaucggcuuaaccuccagagcgaccugggccaagaacauccagacggccaucaaccaggugcggagccugaucgggaacgaggaguacacagacuacaugccauccaugaagcguuucagacgcgaggaggaggaggccggcgugcucugguga

SEQ ID NO: 24896 - RNA, 9876 nt, Artificial Sequence
  derived and/or modified CDS sequence (opt11) from DENV-2__KM279568__SS-prME
accgcgggcaucaucaucaugaugauucccaccgugauggcguuucacuugaccacccggaacggggagccccacaugaucgugagccggcaagaaaaggggaagucacuccuguucaagaccgagaacggcgugaacaugugcacccugauggcgauggaccuuggggagcugugcgaggacaccaucacauacaacugcccacugcuccgccagaacgagcccgaggauaucgauugcuggugcaacucaaccuccaccugggugaccuacgggaccugcaccgcaaccggcgagcaccggcgggagaagcggagcgucgcccuggugccccacguggguauggggcuggagacucgcaccgagacuuggauguccagcgagggcgccuggaagcacgcacaacggaucgagaccuggauucuccgccaccccggauucacaaucauggcggccauccuugccuauaccauuggcacaacguacuuccagcggguccugaucuuuauccuccugacggcagugacccccuccauggcgaugcgcugcaucggaaucagcaaccgggacuucgucgaggguguguccggcgggucguggguggacaucguacuggagcacggcagcugugucacaaccauggccaaaaacaagcccacgcucgacuucgagcugaucaaaaccgaggccaagcaccuggcgaccuuacgcaaguacugcguggaggccaaacugaccaacacgaccaccgcgagccggugccccacccagggggagcccucccugaacgaggaacaggacaagcgcuucguuugcaagcacuccauggucgaccggggcuggggaaacgggugcggccuauucgggaaaggcggcaucgugacgugcgccauguuuacuugcaagaagaacauggaagggaaggugguacaacccgaaaaccuggaguacacaaucguaauuacgccgcacuccggcgaggagaacgccguggggaaugacacgggcaagcauggaaaggaaaucaagaucacuccccagagcuccaucaccgaggccgaauuaaccggcuacgggaccgucacgauggagugcagcccaagaaccggccucgacuucaacgagauggugcuacugcagauggagaacaaggccuggcucguccaccggcagugguuccuggacuuaccccuccccugguuacccggcgccgacacucagggguccaauuggauccagaaagaaacccuggugacguucaagaauccgcacgcgaagaagcaggacaucgugguccucggcagccaggagggggcaaugcacaccgcccugacaggcgccacagaaauccagaugagcuccggaaacuugcuguuuaccggccaucugaagugccggcuacguauggacaagcuccagcugaaaggcaugucguacucgaugugcaccgggaaguucaagguggugaaggagauagcggaaacccaacacggcacgaucgucauccgcgugcaguaugagggggacggaagccccugcaaaaucccuuucgagaucauggaccuggagaagcggcacgugcugggucgccugaucacugucaaccccauaguaacugagaaggacuccccggucaacauugaggcugaaccgccguucggagacagcuacaucaucauugguguugagccagggcagcuaaaacucuccugguucaagaagggcucguccaucgggcagauguucgagaccaccaugcgaggcgccaagcggauggccauccugggcgacaccgccugggacuucgggagccugggcgggguguuuacgagcaucggcaaggcguuacaccagguauucggggcuaucuacggcgccgccuuuaguggcgucagcuggaccaugaagauccuuauagggguggugaucaccuggaucggcaugaacagccgcuccacgagccuguccgucagccuggugcucguggggguggugacccuauacuugggcgugaugguccaggccgauuccgggugcguggucagcuggaagaacaaggagcuaaaaugcggaagcggcaucuucaucacggacaacguccacacguggacggagcaguacaaguuucagccggagucccccagcaagcuggccagugccauccagaaggcccacgaggaagggaucugcggcauccggagcguuacccgccuggagaaccucauguggaagcagaucaccccggaguugaaccacauccugacugagaaugaggugaagcucacgaucaugacgggggacaucaaaggcaucaugcaggccggcaaacgaucccugcgcccccagccuaccgagcucaaguacucguggaaggccuggggcaaggcgaagaugcuauccacagagcugcauaaucacacguucuuaaucgacggccccgagaccgcugagugccccaacacgaaccgggccuggaacagucuagagguggaggacuacggguucggcguauucaccacgaacaucuggcugaagcugaaggagcgacaggacguguuuugcgauuccaagcucaugagcgccgcgaucaaggacaaccgcgccguccaugcagacaugggguauuggaucgagucggcucugaacgauaccuggaagaucgagaaagccagcuucauagaggugaaauccugucauuggccaaagucucacacuuuaugguccaacggcguacucgaguccgaaaugaucauucccaaaaacuucgcgggcccagucagccagcacaacuaccgccccggguaccacacccaaacugccggcccguggcacuuaggucggcuggagauggacuucgacuucugcgagggcacgaccgugguggucaccgaggacugcgggaaccgcggccccagccuccggaccacgacagcaaguggcaaguuaaucaccgaguggugcugccgcaguugcacccugccgccccuacgguaccgcggcgaggacggcuguugguacggaauggagauccggccgcuuaaggaaaaggaggagaaucuggugaacagccucguaacagccggccacggucagauagacaacuuuucgcugggcguucugggcauggcccuguuccuggaggagaugcuucgcacccggguggggaccaagcacgcuauccuccugguggccgucucauucgugacccugauaacgggcaacauguccuuccgcgaccucgggcgcguaauggucauggugggcgcuacuaugaccgacgacaucgggaugggggugacauaccuggccuugcucgcugccuucaaaguccggcccacguucgccgccggccugcugcuccgcaagcugaccagcaaagagcugaugaugaccacuaucgguaucguccuccugucccagagcacgauccccgaguccauacuggagcugaccgacgcccuggcgcuggggaugaugguacuaaaaaucguccggaauauggagaaguaccaacuggcggugaccaucauggccaucagcugcguccccaacgccgugauccugcagaacgcuuggaagguauccuguaccacgcuggcggucguaagcguguccccgcugcugcucaccagcucacagcagaaggccgacuggauccccuuggcccucaccaucaaggggcucaaccccacggccaucuuccugacgacccuuagccguaccuccaagaaacgcucauggccccucaacgaggcgaucauggccgucggcaugguguccauccuggccucgagccugcucaagaacgacaucccuaugaccggacccuugguugccgguggccugcucacggucugcuacgugcuaaccgggcgcuccgccgacuuagaacucgagcgggccgccgauguucgcugggaggagcaggccgagauuagcggcaguagcccaauccuguccaucacuaucagcgaggacggguccauguccaucaagaacgaggaggaggagcagacccugacgauccucauccggaccggcuuacuggucaucuccggucuauuccccgugucgaucccgauuaccgccgccgcgugguauuugugggaggugaagaaacagcgcgccgggguccugugggacgugcccagcccaccgcccgugggcaaggccgagcucgaggacggggccuaccggaucaagcaaaagggcauccuaggguacagccagaucggggccggugucuacaaagagggaaccuuccacaccauguggcacgugacgcggggugcaguucugaugcacaaggggaagcggaucgagcccuccugggccgacgucaagaaggaccucaucagcuacggcgggggcuggaagcuggagggcgaguggaaggagggggaggagguccagguccuugcccucgagcccggcaagaacccgcgcgccguccagacuaaacccgggcuguucaagaccaauaccgggacaaucggggccguuucccuggacuucucacccggcaccaguggcucucccaucguggacaagaaggggaagguagugggccucuacgggaacggggucgucacgcgcuccgggaccuacguaagcgcgaucgcccagacggagaaguccaucgaggauaacccggagauugaggacgauaucuuccgcaagaagcggcugacuaucauggaccugcaccccggggccggcaagaccaagcgauaccugcccgccaucgugcgagaggcuaucaaacgcgggcuccggacccugauccuagcccccacgcgcgucguggccgccgaaauggaggaggcccucaggggccugccgauccgguaccaaaccccggcgauucgcgccgagcacaccgggcgggaaaucguggaccugaugugucacgcaacuuucacgaugcgccuccugagucccauucggguccccaauuacaaccugaucaucauggacgaggcccauuucaccgacccggccagcaucgcggcgagaggauacaucucuacccggguagagaugggcgaggccgccgggaucuucaugaccgccacgccgcccggcagccgcgaccccuucccgcaguccaacgcgcccaucauggacgaggagcgcgagauccccgaacgcagcuggaacagcgggcacgagugggugaccgacuucaaggguaagaccguaugguucgugcccagcauuaaggccgggaacgacaucgccgccugccuccgaaagaauggcaagaagguuauccagcugucccgcaagaccuuugacagcgaauacaucaagacgcggacaaaugacugggauuuugucgugacuaccgacaucucagagaugggcgccaacuucaaggccgagcgcgugauagacccgcggcgcuguaugaagcccgucauucugacagacggggaggagcgggugauccucgccggacccaugcccgugacccacagcuccgcagcacagcgccgggggagaguaggucgcaacccgaaaaacgagaacgaccaguacaucuacaugggcgagccacuggaaaacgaugaagacugcgcgcacuggaaggaggcuaagaugcuauuggacaacaucaacacccccgaggggauaauccccucgauguucgagccggagcgggagaagguggacgccauagacggagaguaucgccugcgcggggaagcccgcaagaccuucguggaccugaugcggcgcggcgaccuccccguuuggcuggcuuaccggguggcggccgaggggaucaacuaugccgaccgcagguggugcuucgacggcgucaagaacaaccagauccuggaggaaaacguggagguggagaucuggacgaaggagggggagcgcaagaagcucaagcccagauggcuggaugccaggaucuacuccgacccgcuggcccucaaggaguucaaggaguuugcggccggccggaagucccugacacugaaccucauaaccgagaugggccgccugcccaccuucaugacgcagaaggccaagaaugcccuggacaaucucgcgguccugcacaccgccgaggccgggggccgggccuacaaccacgccuugucugaguugcccgaaacccuggagacccucuuacugcugacgcuccuggcgaccgugaccggugggauuuuucuguuccucaugagcggcaaggguaucggcaaaaugacccuggggaugugcuguauaaucaccgccuccauucugcucugguacgcucagauccagccccacuggaucgccgccucgauuauccuggaauucuuucucaucgugcuccuuaucccugagccggagaagcagcgcacgccccaggacaaccagcuaaccuacguaguuauagcgauccuaaccguaguagcagccacuauggccaacgagaugggcuuccuugagaagacgaagaaggacuucgggcugggcaguauaaccacacagcagccggaguccaauauacuggauaucgaccuacggccugccagcgcguggacucuguaugccguggccacuaccuucaucacccccaugcuccgccacaguaucgaaaacucauccgugaacgucucguugacugcuaucgccaaccaggcgacgguacugaugggcuugggaaagggcuggccacuauccaagauggacaucggcguuccccuguuagcgaucggcuguuacagccaggucaacccgauuacccugaccgccgcccugcuccuguugguugcgcauuacgccaucaucgggcccggccugcaagccaaggcuacccgggaagcccagaagagggcggcugcuggcaucaugaaaaaccccaccguggacgggaugaccgucauugaucuggaccccauuccguacgacccaaaguucgagaagcaacugggccaggugauguuacugguucucugugucacgcagguacugaugaugcggacgacgugggcauugugcgaggcccugacccucgcgaccgggcccauauccacccugugggagggcaaccccgggcgcuucuggaacacgaccauagccguaagcauggccaauaucuuccguggcucuuaccuggccggcgccggguugcuguuuagcaucaugaagaacacugcgaacacgcggcgcggaaccgggaacaccggcgaaacccugggcgagaaguggaagaaccggcuuaaugcccuggggaaguccgaguuccagaucuacaagaagucgggcauucaggaggucgaucgcacccuggccaaagagggcaucaagcggggcgagacggaccaccaugccgugucucgcggaagcgcgaaguugcgaugguuuguugagcgcaaccuggugacccccgagggcaaggugguagaccugggcugcggacggggcgggugguccuacuacugcgggggucucaaaaacguuaaggaggugaagggccugaccaagggugggccuggccacgaggagcccauccccaugagcaccuacggguggaaccugguacggcuccaguccggggucgacguguucuucaccccgccugagaagugcgacacccugcucugcgacaucggggagagcagccccaaccccacgguggaggccggccggacccuccgcguccugaaccugguggagaacuggcucaauaacaacacccaguuuugcaucaagguucucaacccguauaugccguccgucaucgagaaaauggaggcccugcaacggaaguauggcggggccuuggugcgcaacccccucagccggaacuccacgcacgagauguacugggugagcaacgccagcggcaauaucgucucgagugugaauaugaucagccgcaugcucaucaaccgguucacaaugcgccauaagaaggcgaccuacgagccggacguggaccuaggauccggcacacggaauaucgggaucgagagcgagacccccaaccucgacauuaucggcaagcgcaucgagaagaucaaacaagaacacgaaacuucauggcacuaugaccaagaccaccccuacaagaccugggccuaccacgguagcuacgagaccaagcaaacgggguccgcaaguuccauggugaacggcgugguucgccugcugacuaagcccugggacgucaucccaauggugacccagauggcuaugacggacacaacucccuucggccagcagcggguguucaaggagaagguugacacuagaacacaggaacccaaggagggcacgaagaagcugaugaagaucaccgccgaguggcuguggaaggaguugggcaagaagaagacaccccggauguguacccgggaagaauucacgcggaagguucgcuccaacgcggcccucggagcgaucuuuaccgaugagaacaaguggaaguccgcccgggaggccguugaggauagcggcuucugggaguugguggacaaggagcgcaaccugcacuuagaggggaagugcgagaccuguguguacaacaugaugggcaaaagagaaaagaagcugggggaguucggcaaggccaagggcucccgcgcgaucugguacauguggcugggggcccgguuccucgaguucgaggcccugggcuuccugaaugaggaccacugguucucacgcgagaauucucucuccggggucgagggagaagggcugcacaagcugggcuacauccuucgggacgucucaaagaaggaaggcggugcaauguacgccgacgacacggcgggcugggacacgcgcauaaccuuagaggaccugaaaaacgaagagauggugaccaaccauauggagggugagcacaagaaacucgccgaggccaucuucaagcugaccuaucagaacaaggucguacggguacagcgcccgacgccccgggggacugucauggacaucauuucccgccgggaccagcgagggagcggacagguggugaccuacggccuaaacaccuucacgaacauggaagcgcagcucauccggcagauggagggggagggcgucuucaaguccauccaacaacucaccguaaaggaggagaucgcugugaaaaauugguuaauccgugucgggcgcgagcguuugagccgcauggccaucuccggggacgacuguguggugaagccacuggacgaccgguucgcauccgcucugaccgcgcucaacgacaugggcaagguucgcaaggacauccaacagugggagccaucuagaggguggaaugacuggacccaggugcccuucugcucccaccacuuccacgaguugaucaugaaagacggccgcgugcuggucgugccaugccggaaccaggacgagcucaucgggcgggccaggaucagccagggcgccgggugguccuugcgcgagacggcuugccuggggaagaguuacgcccagauguggucccucauguacuuccaccggcgcgaccugcggcuggcggcuaacgccaucugcagugcagugcccucacacuggauccccacaucccgcaccaccuggucaauccacgccacccacgaguggaugacgaccgaggacaugcuaacugucuggaaccggguguggauucaagagaauccguggauggaggacaagacacccguggagagcugggaggagauccccuaucucggcaagcgagaggaccaaugguguggaucacugaucggccucaccagccgugcgaccugggccaagaacauacaaaccgccaucaaccagguccgcucccugaucgggaacgaggaguauaccgacuacaugcccagcaugaaacguuuccgccgagaggaggaggaggccggugugcugugguga

SEQ ID NO: 24897 - RNA, 9876 nt, Artificial Sequence
  derived and/or modified CDS sequence (opt11) from DENV-2__KM279569__SS-prME
accgccggcaucaucaucaugaugauccccaccgucauggccuuccaccugaccacccgcaauggggaaccccacaugaucgucucccggcaggaaaagggcaaaucccuccuguucaagaccgagaacggggugaacaugugcacccugauggcgauggaccucggcgagcucugcgaggacacaaucaccuacaacugcccccugcuccgccagaacgagcccgaggacaucgacugcuggugcaacagcaccuccaccugggucaccuacgggacaugcaccgccaccggcgagcaccgccgcgagaagcggagcgucgcacuggugccucacgugggcauggggcuggagaccaggaccgagacuuggauguccagcgagggcgccuggaagcacgcgcagcggaucgagacuuggauccuccgccaccccggguucaccaucauggcugcaaucuuagcuuacaccaucggcaccaccuacuuccagcggguccugaucuuuauccuccuuaccgccgugacccccuccauggcgaugcgaugcaucgggaucagcaacagggacuuuguggagggcguuuccggcgggucauggguggauaucgugcuggagcacggcagcugcgucaccaccauggccaaaaacaagcccacgcuugacuucgagcugaucaagaccgaggccaagcaccuggccacccuccgcaaguauugcguugaggccaaacugaccaacacgaccaccgcgaguaggugccccacccaaggggagcccuccuugaacgaggagcaggacaagcgcuucgugugcaagcacagcauggucgacagaggguggggcaacgggugcgggcuguucgggaagggcgggaucgugacgugcgccauguucacgugcaagaagaacauggaggguaaggugguccaacccgagaaccucgaguauaccaucgugaucacuccccacuccggcgaggagaaugccguggguaacgacacgggcaagcacgggaaggagauaaaggucacgccccagagcucgaucaccgaggccgagcuuaccggcuacgguaccgugacgauggagugcagcccgcgcaccggccucgacuucaacgagauggugcugcugcagauggagaacaaggccuggcucguccaccggcagugguuccuggaucugccgcuccccuggcugcccggcgcggacacgcagggauccaacuggauccagaaggagacccucgugacguucaagaacccgcacgccaaaaagcaggacgucguggugcucggcagccaggagggggccaugcacaccgcccugacuggcgccaccgagauucagaugagcuccggaaaccuccuguucacgggccaccugaagugccgccugaggauggacaagcuccagcugaagggcaugaguuacuccaugugcaccgggaaguucaaggucgugaaggagaucgcagagacccaacacggcaccaucgugauccgcguacaguacgagggggacggcuccccaugcaagauccccuucgagaucauggacuuggagaagcggcacgugcuuggccgccugauaacggugaaccccaucgucacagagaaggacuccccgguaaacaucgaggccgagccgcccuucggggauagcuacaucaucaucggcguggagccaggccagcugaagcucucuugguucaagaagggcaguaguaucgggcagauguucgagaccaccaugcgcggggccaaacggauggccauccugggcgacaccgccugggacuucgggagccugggcggcgucuucaccuccaucggcaaagcgcuccaucagguguucggggcaaucuacggcgccgccuucucaggagucuccuggacaaugaagauucugaucggugucgugaucaccuggauugggaugaacagcagguccacgagccugucugugagccugguccuagugggggugguaacccuguacuuaggggugauggugcaggcagacuccggcugcgucgugucguggaagaacaaggagcucaagugcggaucgggcaucuucaucaccgacaacguccacaccuggacggagcaauacaaguuccagccggagucccccagcaaacuugccucggccauccaaaaggcgcacgaggaggggaucugcggaauccggagcgucacccgccuggaaaaccucauguggaagcagaucacgcccgaacugaaucacauccugaccgagaacgagguaaagcucacgaucaugaccggcgacaucaagggcauuaugcaggccgggaaacggacacugcgcccccagccgaccgagcugaaguacuccuggaaggcguggggcaaggccaagaugcucucuacggaguuacacaaccacaccuuccugauugauggccccgagaccgccgagugccccaacaccaaccgggcuuggaacucccucgagguggaggacuacggguucggcgucuucacuaccaacaucuggcucaagcugaaggagcgccaggacguguucugcgacagcaaguuaauguccgccgcgaucaaagacaaccgggccguucacgccgacaugggguauuggaucgagucggcccugaacgacacguggaagaucgaaaaggccuccuucaucgaggucaagagcugccacuggccgaagucccauacccuguggagcaacggggugcucgaguccgagaugaucauccccaagaacuuugcgggccccgugagccagcacaacuaccgccccggguaccacacccagacggccggcccguggcaccuggggcggcuggagauggauuucgacuucugcgagggcaccaccgucguggucaccgaggacugcgggaaccgcggccccucccuccggacgaccaccgccagcggcaaacugauaacugaguggugcugccgcagcugcacgcugccgccccuccgguaccgcggugaggauggcugcugguacgggauggagaucaggccgcugaaggagaaggaggagaaccuggugaacucccucgugaccgccggccacggacagaucgacaacuucagccugggcguguuaggcauggcccucuuccuggaggagaugcugcgcacaagagucgggaccaagcaugccauccucuuaguggccgugaguuucguaacgcugaucaccggcaacaugagcuuccgcgaccucggucgcgugaugguaauggucggcgccacaaugaccgaugacaucgggaugggcgugacguaucuggcccuguuggcugccuucaaggugcggcccacguuugccgccggccuguuacuccgcaagcugaccucaaaggagcugaugaugacgacgaucgggaucgugcugcugagccaauccaccaucccagagagcauccuggagcucacagacgcucuggcgcugggcaugaugguacucaagaucguccgaaacauggagaaguaccaacuggccgugacuaucauggccauccugugugugcccaacgccgucauccuccagaaugccuggaagguauccugcacgacgcuagcggugguaagcguguccccgcugcuccugaccagcucccagcagaaggccgacuggaucccccuggcccucaccaucaaggggcugaaccccacugccaucuuucugaccacccucucgcgcaccucaaagaagcggagcuggccccugaacgaggcgaucauggcggugggcaugguauccauccucgcaagcucccuccugaagaaugacauccccaugacgggccccuugguggccgguggccuccugaccgugugcuacguccugaccgggcgcuccgccgaccucgagcuggagcgggcggccgacguacgcugggaggaacaggccgagauuagcggcuccucuccgauccuguccauaaccaucagcgaggacggaagcaugagcaucaagaacgaggaggaggagcagacgcugaccauccugauccggaccggccugcuggugaucuccggccuguuucccgugucgaucccgaucaccgccgcggcgugguaccugugggaagugaagaagcagcgcgccggggugcucugggacguccccuccccgccgcccgucggcaaggccgagcuggaagacggggccuaccgcaucaagcaaaagggcauucugggguacagccagaucggcgcaggcgucuauaaggaggggaccuuccacacgauguggcacgucacgcgcggcgcgguccucaugcacaaggggaagcggauagagccaucaugggccgacgugaagaaggaccugaucagcuauggcgggggcuggaagcuggagggcgaguggaaagagggggaggaaguccaggugcucgcucuggagcccggcaagaacccccgcgccgugcaaaccaagccuggucuguucaagaccaacacgggcacgaucggggccgucuccuuggacuuuagccccggaaccuccggcagcccgaucguggacaagaaggggaagguggucggccuguacgggaacggaguggugacccguuccggcaccuacgucagcgccaucgcucaaaccgaaaaguccaucgaggacaacccugagaucgaagacgacaucuuccgcaagaagagacugaccauuauggaccugcaccccggggccgggaagaccaagcgcuaccuccccgccaucgugcgggaggcgaucaagcgcgggcugcggacauugauccucgcccccacgcgcguggucgcugccgagauggaggaggccuuacgcggccugccgauccgguaccagacccccgccaucagagccgagcacacgggucgggagaucgucgaccucaugugccacgccacguucaccaugagacuucugagccccauacgggugcccaacuacaaccugaucaucauggacgaggcccacuucaccgacccggcuagcaucgccgcccgcggcuacauauccacccgggucgagaugggagaggccgccgggaucuucaugacggccacgccgcccgggagccgcgaccccuucccgcaguccaacgcgcccaucauggacgaggagaaggagauucccgagcggagcuggaacagcgggcaugaguggguaaccgacuucaaaggcaagaccgugugguucguccccagcaucaaggcagggaacgacaucgccgcaugccugcgcaagaacggcaagaaggugauccagcugucucggaagacguucgacagcgaguauaucaagacccgcaccaacgacugggauuucgugguaaccacugacaucuccgagaugggcgcgaacuuuaaggccgagcgugugaucgacccgcgccggugcaugaagcccgucauucucaccgacggggaggagcgcgucauccuggccggccccaugccugucacccacagcuccgccgcccaaaggcgcgggcgggugggucgcaacccgaaaaacgagaacgaccaguacaucuacaugggggagccacuggagaacgacgaagacugcgcacacuggaaggaggccaaaaugcuccuggauaacaucaauacccccgagggcaucauccccagcauguucgaaccggagagggagaaggucgacgccaucgacggcgaguaccgacugcgaggcgaggcccgcaagacguucgucgaccucaugcgccggggcgaccuacccgucuggcuagccuaccgcguggcggccgaggggaucaacuacgccgaccgucgcuggugcuucgacggagugaagaacaaccagauccuggaggagaacgucgagguggagaucuggacaaaggagggggagcggaagaagcugaagccccgcuggcuggacgcccggauuuacuccgacccgcucgcccugaaggaguucaaggaguucgcggccggccgcaagagccuuacccucaaccuaaucacagagaugggccggcugcccacguucaugacccagaaggcuaagaacgcccucgacaaccuagcggugcugcacaccgccgaggccgggggccgcgcuuauaaccacgcccucuccgagcugccagaaacccuggagacguugcuucugcucacccugcuagcgacggucacaggggguaucuucuuauuccugaugaguggcaaagggaucggcaagaugacuuuagggaugugcugcaucaucacggccuccauccuccugugguacgcccagauccaaccccauuggauagccgcuagcauaauccuggaguucuuccucaucgugcugcugauccccgagcccgaaaagcagcggacuccccaggacaaccagcucaccuacguggucaucgcuauccuaaccgugguggcugcgacgauggcuaacgagaugggcuuccuggagaaaaccaaaaaggacuucggccucggcuccaucaccacccagcagccugagucaaacauccuggacaucgaccugcgcccggccagcgcguggacgcuuuacgccguugccaccaccuucaucacccccauguugcggcacuccaucgagaacagcuccgugaaugugagccugacggccauugccaaccaggcuacuguccuuaugggccuggggaagggcuggccucuguccaagauggacaucggggugccccuccuggccauaggcugcuacagccaggucaacccgaucacccugaccgccgcccuccugcuguuagucgcgcacuacgccaucaucgggcccggccugcaggccaaggccacccgugaggcccagaagcgggcggcugccgggaucaugaagaaucccaccguagacgggaugaccgugaucgacuuagaccccauuccguacgauccaaaguucgagaagcagcucggccaggucaugcugcugguacucugcgugacccaggucuuaaugaugcgcacgaccugggcccuaugcgaggcccuaacccuggcgaccgggcccauauccacgcuaugggagggcaaccccgggcgguucuggaacaccaccaucgccgugagcauggccaauaucuuccggggcuccuaccuggccggugccgguuuguuauucagcaucaugaagaacaccgcgaacacgcgccggggcaccgggaacaccggggagacccucggcgagaaguggaagaaccgcuugaacgcccugggcaaguccgaguuccagaucuacaagaaguccggcauccaggagguggaccggacgcucgccaaggaggggaucaagcgcggcgagacggaccaccacgcugucagccgggggagcgcgaagcugcgcugguucguggagagaaacuugguuacaccggagggcaaggucguggacuuggggugcgggcgcggcgggugguccuacuacugcggcgggcuaaagaacgugaaggaggucaagggcuugaccaaaggagggcccgggcacgaggagccgauccccaugucgacguacgguuggaaccuagugcggcugcaguccggcguggacguguucuucaccccgcccgaaaagugcgacacccugcucugcgacaucggggagagcuccccaaaccccaccguggaggccggacguacacuccgggugcugaaccucgucgagaacuggcugaacaauaacacgcaguucugcaucaagguucuaaaucccuacaugccuagcgucauagagaagauggaggcccugcagcgcaaguauggcggggcccucguccggaacccccugagccgcaacuccacccacgagauguacugggugagcaacgccuccggcaauaucgugagcagugucaacaugauaagccggaugcuaaucaaccgcuucaccaugcggcacaagaaggcgaccuacgagccggacguggaccucggguccgguacgcgcaacaucgggaucgagagcgagacccccaacuuagacauaaucggcaagcggaucgagaagaucaagcaggaacacgagacuuccuggcacuacgaccaggaccaccccuacaaaaccugggccuaccacggaagcuaugagacgaagcagaccggguccgccagcuccauggugaacggcgucgugcgccugcucaccaagcccugggaugugauccccaugguaacccagauggccaugacugauaccacccccuucgggcagcaaagaguauuuaaggaaaagguugacacucggacgcaggagcccaaggaaggcaccaagaagcugaugaaaaucaccgccgagugguuguggaaggagcucggcaagaagaagacgccgcgcauguguacgcgggaggaguucacgcgcaaggugcggagcaacgcggcucugggugccauuuucaccgacgagaacaaguggaaguccgcccgcgaggccguggaggacagcggcuucugggagcuggucgacaaggagcggaaccuccaccuggaggggaagugugagaccugcguguacaacaugaugggcaagcgggagaagaaguuaggggaguucggcaaagcgaagggcucccgugcgaucugguacauguggcucggggcccgcuuccuggaguucgaggcccugggcuucuugaacgaggaccacugguucagccgggaaaauucccugagcgggguggaaggcgaggggcugcacaagcucggcuacauucugcgcgacgucuccaagaaagaaggcggggcgauguacgccgacgacacggccggcugggauacccggaucaccuuagaggaccucaagaacgaggaaaugguaaccaaccauauggagggugagcacaagaagcuggcugaggccaucuucaagcugacguaccagaacaaggugguccgagugcagcggccgacgcccagaggcaccgugauggauaucauuucccggcgcgaccagcgggggagcgggcagguugugaccuacggccucaauaccuucaccaacauggaggcccagcugauccgccagauggagggggagggcguguucaaguccauccagcagcucaccgucaaggaggagaucgcggugaaagacuggcucauccggguggggcgcgaacgcuuaagucgcauggccaucuccggcgacgauugcguagugaagccccuggacgaccgcuucgccagcgcccucacugcgcugaacgacaugggcaaggugaggaaggacauucagcagugggaacccucccgcggguggaacgacuggacucaggucccguucugcagccaccacuuccaugaacugaucaugaaggacggccgggugcucguggucccaugccgcaaccaggacgaacugauugggcgggcccgcaucucccagggugccgguuggagccugcgggagacggccugccucggcaaguccuacgcccagauguggagccugauguacuuccaccgccgggaccugcgccucgcagccaacgccauaugcuccgccgugcccucccacuggauucccaccuccaggaccacuuggucgauccacgccacgcacgaguggaugaccaccgaggacaugcugaccguguggaaccgcgucuggauccaggagaaucccuggauggaggacaagacccccguagaguccugggaggagauccccuaccugggcaagcgggaggaccaguggugcgggucccucaucggccugaccagccgcgcaacuugggcaaagaacauacagacggccaucaaccaggugcgguccuugaucgggaacgaggaguacacagacuacaugccuagcaugaagcgcuuccggcgcgaggaggaggaggccgguguccucugguga

SEQ ID NO: 24898 - RNA, 9876 nt, Artificial Sequence
  derived and/or modified CDS sequence (opt11) from DENV-2__KM279570__SS-prME
accgccgggaucaucaucaugaugauccccacagucauggcguuccaucugaccaccagaaacggggagccacacaugaucgucagccggcaggagaaggguaagagucuccuguucaagacggaaaacgggguaaacaugugcacccugauggcgauggaccugggcgaacuaugcgaggacaccaucaccuacaacugcccacugcuccgccagaacgagcccgaggacaucgacugcuggugcaacagcacaagcaccugggugaccuacgggaccuguaccgccacaggcgagcacaggcgcgagaagcggagcgucgcgcuggugccacacgugggcauggggcuggagacccgcacggagaccuggaugagcagcgaaggcgccuggaagcacgcgcagcggaucgagacguggauccuccgccaccccggguucacgaucauggcggccauccuggcuuacacaaucggcaccaccuacuuccagcgggucuuaaucuucauccuccugacggcagugacucccuccauggcgaugcguugcauagggaucuccaaccgcgacuucguggagggcgucuccggcgggagcuggguggacauugugcuggaacauggcuccugugucaccaccauggccaagaacaagcccacgcucgacuucgaacugaucaagaccgaggccaagcaccuggccacccuccgcaaguacugcguggaagccaagcugaccaacacgaccaccgcgagcagaugccccacccagggggagcccucccugaacgaggagcaggacaagcgcuuugugugcaagcauucaauggucgaccggggcuggggcaacgggugcggucuauucgggaagggggggaucgugacgugcgccauguucacgugcaagaagaauauggagggcaaggugguccagcccgaaaaccucgaauacaccaucgugaucacgccccacuccggcgaggagaacgccguggggaacgacacgggcaagcacggcaaagagaucaaggucacgccccaguccuccaucaccgaggcugagcugaccggcuacgggaccgugacgauggagugcagcccgcgcaccggccucgauuucaacgaaaugguacugcugcagauggagaacaaggccuggcucguccaccggcagugguuccuggaccugccccuucccuggcugcccggcgcggacacccaggguuccaacuggauccagaaggagacccuggugacguuuaagaacccgcacgccaagaagcaggacgucguggugcucggcagccaggagggggcaaugcacaccgcccugaccggcgccacugaaauccagaugagcucugggaaccuccucuucacgggccaccugaagugccgccugcggauggacaagcuccaguuaaagggcaugagcuauuccauguguaccgggaaguucaaggucgugaaagagauugcggagacccagcacgguaccaucgugauccgcguccaguacgagggggacggcagccccuguaagaucccauuugagaucauggaccuggagaagcggcacguguugggccgccuaaucacggucaaccccaucgugaccgagaaggacucccccgugaacauugaggcggagccgccguucggggacagcuacaucaucaucggcguggagcccgggcagcucaagcucuccugguucaagaagggcagcuccaucgggcagauguucgagaccaccaugcgcggcgccaaacggauggccauucuuggcgacacggcaugggacuucgggagccugggcggcgucuucacauccaucggcaaggcgcuccaccagguguucggggccaucuacggcgccgccuucagcggcguguccuggaccaugaagauccugaucggggucgugaucaccuggaucggcaugaauucgcgcuccacgagccuguccgugagccuaguucucguggggguagucacccuguaccugggcgugaugguccaggcugacuccgggugcgucgugagcuggaaaaacaaagagcuuaagugcgguagcggcaucuucaucaccgacaacgugcacacguggacggagcaguacaaguuucagccggagagucccagcaagcuggccucagccauacagaaggcccacgaagaggggaucugcggcauccggagcgucacccgccuggagaaccucauguggaagcagaucacccccgaacugaaccacauccugaccgagaacgaggugaagcuaacgauaaugaccggcgauaucaagggcaucaugcaggccgggaagcggucccugcgcccccagccgaccgagcugaaguacagcuggaaggcguggggcaaagccaagaugcucuccaccgaacugcacaaccacacauuccugaucgacggcccggagaccgccgagugccccaacaccaaccgcgccuggaauagucucgagguggaggacuacggguucggcgucuucaccacgaacaucuggcugaagcugaaggagcgccaggacguguucugcgacucuaagcucaugagcgccgcgauaaaggacaaccgggcggugcacgccgacaugggguacuggauagaguccgccuuaaaugacaccuggaaaaucgagaaggccagcuucauagaggugaaguccugccacuggcccaagagccacacccugugguccaacggcgugcucgaaagcgagaugaucauccccaagaacuucgcgggacccgugucccagcacaacuaccgcccuggguaccacacccagaccgcgggcccguggcaccuggggagacuggagauggacuucgacuucugugagggcacgacagucgccgugaccgaggacugcgggaaccgcggccccucgcuccggacaacgaccgccagcggaaagcugaucaccgaguggugcugucgcuccugcacacugccgccccuccgguaccgcggggaggacggcuguugguacgggauggaaauccggccgcugaaggagaaagaggagaaccucgugaacaguuuagucacggcgggccacgggcagaucgacaacuucucccugggcgugcuggguauggcccucuuccuggaagagaugcugcgcacccggguggggaccaagcacgcuauccuccugguugcggugagcuucgugacccuuaucacgggcaacauguccuuccgcgaccucgggcgcguuauggugauggugggugcaaccaugacggacgacaucggaaugggcgucaccuaccuagcguuacucgcugcuuucaaggugcggcccacguucgccgccggccugcugcucaggaagcugaccagcaaagagcugaugaugacuaccaucgggaucgugcuccugucccagagcacgaucccugaguccauccuggagcucaccgaugcgcuggcccugggcaugaugguccucaagaucgugcggaacauggagaaguaccagcuggccgucaccaucauggcgauccugugcgugcccaaugccgugauucuccagaacgcguggaaagucucgugcacaacgcuggccgugguguccgucuccccucugcuccucaccuccagccagcagaaggcggacuggaucccccuggcccuuaccaucaaggggcugaaucccacagcgaucuuccugacgacccucagccgcacaagcaagaaacgguccuggccccugaacgaggccauaauggcggugggcauggugagcauccucgccuccagccuccugaaaaacgacauuccgaugaccggcccccuggucgccgggggccuccugacggugugcuacgugcugaccgggcgcagcgcggaccucgagcuggagcgggccgcggaugucaggugggaggagcaggccgagaucagcggcagcuccccgauccugagcaucaccaucuccgaggacgggagcauguccaucaagaacgaggaggaggagcaaacauuaacgauccugauccggaccggccuguugguuaucuccggcuuauuuccaguguccaucccgaucaccgccgccgccugguaucuuugggaggucaagaagcagcgcgccggggugcucugggacgugcccaguccgccgcccgugggcaaggccgagcuggaggacggggcuuaccggaucaagcagaagggcauucucggguacucccagaucggcgcggggguguacaaggaggggaccuuccauaccauguggcacgugacgcggggcgccguccucaugcacaaggggaagcguaucgagcccaguugggccgacgugaagaaggaccugaucuccuacggcgggggcuggaagcucgaaggcgaguggaaggagggggaggagguccagguucuagcccucgagccaggcaaaaauccgcgcgccgugcagaccaagcccgggcuguucaagaccaacacuggcacgaucggggcggugucccucgauuuuucccccggcaccagcggcucccccaucguugacaagaaggggaagguggugggccucuacgggaacggcguugugacccgcagcggcacguacguguccgccaucgcccagacggagaaguccauugaggacaaccccgagaucgaggacgauauauuucgcaagaaacggcuuaccaucauggaccugcaccccggggcuggcaagacgaagcgcuaccuccccgcgauagucagggaggccaucaagcgcgggcuucggacccucauccucgcucccacgcgcgugguggccgccgagauggaggaggcccugcgcggccugccgauucgguaccagaccccagccauccgcgccgagcauaccgggcgggagaucguagaccucaugugucacgccaccuucacgaugcgcuuauuaagccccauuaggguccccaacuacaaccucaucaucauggacgaggcccacuuuacugacccggcuuccaucgcggcccgcggcuacaucagcacccgaguggagaugggggaagcugccgggaucuucaugaccgcuacgccgcccggaagccgcgaccccuucccgcaaagcaacgcccccaucauggacgaggagcgggagauccccgagcgcuccuggaacagcggucacgaaugggucaccgacuucaaagggaagacaguaugguuuguccccuccaucaaggccgggaacgacaucgccgcgugucugcggaagaacggcaagaaggucauccagcugucaaggaaaacauucgacuccgaguauaucaagacgcggaccaacgauugggacuucguggugaccaccgacauaagcgagaugggcgccaacuucaaggcugagcgcgucaucgacccgcgccgcugcaugaagcccguuauacucacggacggggaggagcggguaauccuggcaggccccaugcccgucacccacuccagcgcugcgcagcgccgggggcgcguuggacgcaaccccaagaacgaaaacgaccaguacaucuacaugggagagccccuugaaaacgacgaagacugcgcgcacuggaaagaggccaagauguuguuagacaacaucaauacacccgagggaaucaucccauccauguucgagccggagagggagaaggucgacgccauugacggcgaguacaggcugaggggugaggcccgcaagaccuucgucgaccucaugcggcgcggcgaucuuccgguguggcuggcguaccgaguagcagcggaggggaucaacuacgccgaucgacggugguguuucgacggcgugaagaacaaccagauccucgaggagaacgucgaggucgaaauauggacgaaagaaggggagcgcaagaagcugaagccccguuggcuggacgcacgcaucuauagcgacccgcucgcgcugaaggaguucaaagaguucgccgccggccggaagagccugacccucaaccugaucaccgagaugggccgccuccccaccuucaugacgcagaaggccaagaacgcgcuagauaaccuggccguacuacacaccgccgaagccgggggccgcgccuacaaccacgcgcucagcgaguuacccgagacgcuagagacccuccuccuguuaacgcugcuggccaccgugaccgggggcaucuuccucuuccugauguccggcaaggggaucggcaagaugacccuggggaugugcuguaucauuaccgccagcauacuucugugguaugcccagauccagccccacuggaucgccgcguccaucauccuggaguucuuccucauagucuugcugaucccggagcccgagaagcagcgcacgccccaggacaaccagcucaccuacguggugaucgccauccugaccguaguggccgccaccauggccaacgagaugggcuuucucgaaaagacgaagaaggacuuugggcucggcagcaucaccacccagcagcccgagagcaacauccuggacaucgaucugcggccggcguccgccuggacccucuacgccguggccacgaccuucauaacccccaugcugcgccacucaaucgagaacaguucugucaaugugucccugaccgccaucgcgaaccaggcuaccguacucaugggacuggggaagggcuggccccugagcaagauggacaucggagucccacuccuggccaucggcugcuacucccaagugaacccgaucacccugacagccgcucuucugcugcucguggcucacuacgccaucaucgggcccggccugcaagccaaggccacccgggaggcacagaagcgcgccgccgccggcaucaugaagaaccccacgguagacgggaugaccgugaucgaucuggaccccaucccguacgaccccaaauucgagaagcagcugggccaggugauguuacugguccuuugcgugacucaggugcugaugaugcggaccacgugggcccucugugaggcgcucacccuggccaccgggcccauuagcacccugugggagggcaaucccgggcgcuucuggaacacgaccaucgccgucuccauggccaauaucuuccgcggcaguuaccucgccggcgcgggucuccuguucuccaucaugaagaacaccgccaacacccgucgcggcacggggaacaccggcgagacccucggugagaaguggaagaaccggcugaacgcccugggcaagagcgaguuccaaaucuauaagaaguccggcauacaggagguggaccguacccuggccaaggaggggauaaagagaggcgagacggaccaccacgcggugagccgcgggucugccaagcugcggugguuugucgagcgcaaccuggugaccccggagggcaagguggucgaccucggaugcgggcggggaggguggagcuauuauugcggcgggcugaagaacgugaaggagguuaagggccuuaccaagggcgggcccggccacgaagaaccgauccccauguccaccuacggguggaaucucguccgccugcagagcgggguagacguguucuucacgccgcccgagaagugcgacacucuguuaugcgacauuggugaguccagccccaaccccacagucgaggccggccggacacugagggugcugaaccucguggagaacuggcucaacaacaacacucaguucugcaucaagguccugaacccguacaugccaagcgugaucgagaagauggaggcccugcagcggaaguacggcggggcccuagugcgcaacccccugucccggaacagcacacacgagauguacugggucucuaacgcgucaggcaacauagugucuagcgugaacaugaucucccgcaugcugaucaaccgguucaccaugcgccacaagaaggcgaccuacgaaccggacguugaccucgggagcggcacccggaacauuggcaucgaauccgagacucccaaccuggacaucaucggcaagcggaucgagaagaucaagcaagagcacgagaccagcuggcacuacgaccaggaccaccccuacaagaccugggccuaccacggcuccuacgagacgaagcaaacggggagcgccaguagcauggugaacggcguggugcgccugcucacaaaacccugggacgugaucccgauggugacgcagauggccaugacggacacgaccccguucgggcagcagcgggucuucaaggagaagguggauacccgcacccaggagcccaaggagggcacgaagaagcugaugaagaucaccgcagaguggcuauggaaggagcucggcaagaagaagacaccccggaugugcacccgcgaggaguuuacgaggaaaguucguuccaacgcggcccugggggccaucuuuaccgacgagaacaaguggaaguccgcccgggaggcuguagaggacuccggcuuuugggagcugguggacaaagagcgcaaccuccaccuggaggggaagugcgagaccugcguguacaacaugauggggaagcgcgagaagaagcugggggaauuuggcaaggccaagggcagccgcgccaucugguacauguggcucggggcccgguuucuggaguucgaagcgcugggcuuccuuaaugaagaucacugguucucccgcgagaacagccugagcgggguagagggcgaggggcuacauaagcucggcuauauucugcgggacguuucaaaaaaggagggcggggcuauguacgccgacgacaccgccggcugggacacccgcaucacccuggaggaccucaaaaacgaggaaauggucacgaaccacauggaaggagagcacaagaagcuggccgaggcgaucuucaagcugacauaccagaacaagguggugcggguucagcgcccgaccccccgggggaccgugauggacaucaucagccgccgggaccagcgcggguccggccagguggucacguacggccucaacaccuucaccaacauggaggcccagcugauacggcagauggagggggagggcguguucaagagcauccagcaguuaaccguuaaggaggagaucgcggucaaaaacuggcucauccgcgucgggcgcgagcgguuaucccgcauggccaucagcggcgacgauugcguggucaagcccuuagacgacagguucgccuccgcgcucaccgcccugaacgacaugggaaaggugagaaaggacauccagcagugggagcccagcagggguuggaacgacuggacccagguuccguucugcucccaccacuuccacgagcugaucaugaaggacggccgcguuuugguggugcccugccggaaccaggacgaguugauagggcgcgccaggaucagccagggagccggguggucccugcgcgagacggccugccucggcaaaagcuacgcccaaauguggucccugauguacuuccaccggcgcgaccugcggcucgccgcaaacgccaucugcagugcgguccccucccacuggauccccaccagccgcaccaccuggucgauccacgcgacccacgaguggaugaccaccgaggauauguugaccguguggaaccggguguggauccaggagaacccguggauggaggacaaaacccccguggagagcugggaggagaucccguaccuggggaagagggaagaccaguggugcggcagccucauagggcugacgucucgggccaccugggccaaaaauauccagaccgccaucaaccaggugcgcagccugaucgggaacgaggaguacaccgacuacaugcccuccaugaagcgguuucgccgcgaggaggaggaggcgggcguacucugguga

SEQ ID NO: 24899 - RNA, 9876 nt, Artificial Sequence
  derived and/or modified CDS sequence (opt11) from DENV-2__KM279596__SS-prME
accgccgguauuaucauaaugaugauucccacuguuauggcuuuucacuuaaccacgcguaacggggaaccccacaugaucgucagcaggcaggagaagggcaagagccuccuauucaagaccgagaacggugugaacauguguacccugauggcgauggaccucggcgagcugugcgaggacacaaucaccuacaauugcccccugcucagacaaaacgagcccgaggacaucgacugcuggugcaacagcacgaguaccugggugaccuacgggacuugcaccgccaccggcgagcaucggcgcgagaagcggagcgucgcccuggugccccacguaggcaugggucuggagacccgcaccgaaaccuggaugagcuccgagggcgccuggaagcaugcacaacggaucgagaccuggauucuccggcacccagguuucaccaucauggcggcaauccuugccuauaccauuggaacgaccuacuuccagcggguccugaucuuuauccuccugacggccguaaccccauccauggcgaugcgcuguaucggaaucagcaaccgggauuucguggagggcgucucaggggggagcuggguggacaucguucucgagcacggaucaugcgugaccaccauggccaagaacaagcccacgcuggauuucgaacugaucaagacggaagcgaagcaccuggccacccugcguaaguacugcguggaggcaaagcugaccaacacgaccacagcgucucggugccccacacagggggagcccucccugaacgaggaacaggacaagcgcuucguauguaagcacagcaugguagaccggggcuggggcaacggguguggccuauucggcaaaggagggaucgugacaugcgccauguucacguguaaaaagaacauggagggcaaggugguccagcccgaaaaccuggaguacacuaucgugauaacgccccacuccggcgaagagaaugccguggguaacgacacgggcaaacauggaaaggagauaaaggucacaccccagagcagcauaaccgaggccgagcugaccggauaugggaccgugaccauggagugcagcccacgcaccggacucgacuucaaugaaauggugcugcugcagauggagaacaaggccuggcucguucaccgccagugguuccucgaccuuccucuccccuggcuuccgggcgcggacacgcagggcuccaacuggauccagaaagagacccuggucacguucaagaauccgcacgccaaaaagcaggacgucgugguacugggcagccaggaaggggcaaugcacaccgcuuugaccggugccacagagauccagaugagcuccggaaaucuacuguucaccggccaccugaagugccgccugcggauggacaagcuccagcugaaaggcaugucuuacuccaugugcaccggaaaauucaaagucgugaaggagaucgccgagacccagcacggaaccaucgugauccgcguucaguacgagggggacggcagccccuguaagaucccguucgaaauaauggauuuagagaagcggcacguucucggccgccugaucacggucaaccccaucguuacagagaaggauucgccggugaacauagaagccgaaccgccauucggagacaguuacaucauuauuggcgucgagcccgggcagcugaaguuauccugguuuaagaaaggaucaaguaucgggcagauguucgagacuaccaugagaggcgccaagcguauggccauucugggcgacacagccugggacuuugggagccugggcggaguuuucaccuccaucggcaaggcucuccaccagguuuuuggggcgaucuacggcgccgcuuucaguggggugagcuggacgaugaagauccugauaggggucgugaucaccuggaucggcaugaauagccgcuccacgagccuauccguuagccugguccucgugggcgucgucacacuguaucugggggugauggugcaggccgauuccggauguguagugagcuggaagaacaaggagcucaagugcggcagcggcauuuucauaacagacaacgugcacaccuggacggagcaguacaaguuccagccggaaucccccuccaaguuagccuccgccauccagaaggcccacgaagaggggaucugcgguauccggucugucacccgccuggagaacuuaauguggaagcaaauuacaccugagcuaaaccauauacugaccgagaacgaagucaaacucacaauaaugaccggggacaucaaagggaucaugcaggccgggaagcggucacugagaccgcagccuaccgaguugaaguacagcuggaaggcguggggcaaggccaagaugcucuccaccgaacugcacaaucacacguuucugaucgacggucccgagaccgccgagugccccaacaccaaucgugccuggaacucucucgagguagaggacuacggguucggcgucuucaccaccaacauuugguuaaagcugaaggagcgccaggacguguuuugugauuccaagcuaaugagcgcagcgauuaaggauaaucgggccguucacgccgacauggguuacuggauugaauccgcacugaacgacacguggaagaucgagaaggcaagcuucaucgaggugaaguccugucacuggcccaagagccacacacuuugguccaauggcguacucgagagcgagaugauaaucccgaagaacuuugcgggccccguaucgcagcacaacuaucgccccggguaucacacccagaccgcuggcccguggcaccuggggcggcuggagauggauuucgacuucugcgaaggcacgaccgucgcggugaccgaggacugcgggaaccgcggccccagccucagaacaacgaccgcuagcggcaaacugauaaccgaguggugcugccgcuccugcacccugccuccucuccgguaccgcggggaggauggcugcugguacgggauggagauccggccacugaaggagaaggaggagaaucuaguaaacaguuuagucaccgcuggccacgggcagaucgacaauuucucccugggcguauuagguauggcccucuuccuggaggagaugcugcgcaccagaguagguacgaagcacgccauacuccuggucgccgugucguucguaacucugaucacgggcaauauguccuuucgcgaccucggcagggucaugguaauggugggcgccaccaugaccgacgacaucgggaugggcgucaccuaccuggcgcuguuggccgccuucaaggugcggcccacguucgccgcugggcucuuguugaggaagcugaccagcaaggagcugaugaugacuaccaucgggaucgugcuccugucccagagcacgaucccagaguccauacuggagcugacagacgcauuggcccuggggaugauggucuuaaagaucgugcggaacauggagaaguaucagcuggcagucaccaucauggccauccugugcguaccgaacgccgucauccuccagaacgcguggaaggucagcugcacaacccuugcggugguguccgucagcccgcuauuacucaccucgucccaacaaaaggccgacuggaucccauuggcgcugacuaucaaaggccugaacccuacagcgaucuuccugacgaccuuauccagaacaagcaagaaacgguccuggccccugaacgaagcgauaauggcggugggcaugguuagcauacuggccagcuccuuauugaagaacgauaucccgaugaccggcccccuggucgccggcggucuccugaccgugugcuacguguugacugggcgcagcgcagaccuggagcuggagcgggcugcugacguccgcugggaggagcaggcagagauauccggcucaucacccauccugaguaucaccaucuccgaggacggaucgauguccaucaagaacgaggaggaagagcagacgcucacgauacugauccgcacuggccuuuuagugauuagcggcuuauuucccguuagcaucccgaucaccgccgcggccugguaucucugggagguaaagaagcagcgcgcgggcguucucugggaugugcccuccccgccgccggucggcaaggccgaacuggaggacggggcguaccguauaaagcagaaaggaauucuggguuauucccagaucggcgcggggguguacaaggaggggaccuuccauacaauguggcacgucacucggggcgccguacucaugcacaagggcaagcggaucgagccgucgugggcggacguuaagaaggaccucaucuccuacggcgggggcuggaagcuggagggcgaguggaaagagggagaggaggugcagguacucgcccuugagcccggaaagaacccgcgcgcugugcagacuaagcccgggcuguucaagaccaacaccgggacgaucggggcggugagucucgacuuuucccccggcaccagcggguccccuauuguggacaagaaggguaagguagucggccuguacgggaauggcgucgugacccgguccggcaccuacgugucugccaucgcccagacggagaagagcauugaagacaacccggagaucgaggacgacauuuucagaaaaaagcggcuuaccaucauggaucuucaccccggugcuggcaagaccaagcgcuauuuaccagcgauuguccgagaggcaaucaaaagggggcucagaacccugauccucgcgcccacgcgcgugguggccgccgagauggaagaggcgcugcgcggccugccgauaagauaccagacccccgccauccgcgccgagcacaccgggcgagagauugucgaucucaugugccaugccaccuucacgaugagacuguugagccccauucggguucccaacuacaaucucaucaucauggacgaggcacacuuuaccgacccugcgagcaucgccgccagaggcuauaucucaacccguguagagaugggcgaggccgccggcaucuucaugacugcgaccccacccgggucgcgcgacccguucccgcagucuaacgcacccaucauggacgaggagcgagagauccccgagcgcucguggaacagcgggcacgaguggguuacggacuucaaggggaagaccguaugguucguucccuccauuaaggcggggaacgacaucgccgcgugccuccggaagaacggcaaaaaggucauccagcugagccgcaagacguucgacuccgaguacauaaagacgcggaccaacgauugggauuucgugguaacaaccgacaucagcgagaugggcgccaacuucaaggccgagcgcgugauagacccgcggcgcuguaugaagcccguaaucuuaaccgacggggaagagagagugauacuggccggccccaugccagucacccauucaagcgcggcacagcgaagagggaggguaggccgcaacccuaagaacgagaacgaccaguacaucuauaugggggagccacuggagaacgaugaggacugugcccacuggaaggaggccaaaauguuacuggauaacauaaacacccccgaaggcaucaucccuucuauguucgagccagaacgggagaagguggacgccaucgauggcgaguaucgauugcgcggggaggcccgcaagaccuucgucgaccucaugcgucgcggugaucugccaguguggcuggccuaccgggucgccgccgaagggaucaacuaugccgauagacgguggugcuucgauggcgugaagaauaaucaaauucucgaggagaacgucgaagucgagaucuggacuaaggagggggaacgaaagaagcuaaagccccguuggcuggacgcgcggaucuacuccgacccgcucgcccugaaggaguucaaggaauucgcggccggaagaaagucccugacccucaaccugauaaccgagaugggucgccugcccacguucaugacucagaaggccaagaacgcgcucgacaaccuggccgugcugcacacugccgaggccgggggccgugccuacaaccacgcgcucagcgagcugcccgagacgcuugagacacugcugcugcugacacugcuggcaaccgugaccgggggcaucuuucucuuccugauguccggaaaggguaucgggaagaugacccucgggauguguugcaucaucacagccucgauccuccucugguacgcccagauccagccacacuggaucgccgcguccaucauccucgaguucuuccuaaucguuuugcugauaccggagccagaaaaacaacgcacgccacaggauaaccagcucaccuacguagugaucgccauuuugaccguuguggcggccaccauggcaaacgagaugggcuuuuuggagaagacgaaaaaggauuuuggacucggcuccauagcgacccagcagccggagucuaauauccuggacaucgaccugcgccccgcguccgcauggacacucuacgccguggccacuacguuuaucaccccgaugcuucgccauagcaucgagaacucgagugucaacgugucgcuaacugcgauugcuaaucaggcaaccguauugaugggccuggggaaaggcuggccccuuuccaagauggacaucggggucccccuccuggccaucggaugcuacucccagguuaacccaaucacgcugaccgccgcacuccuguuacugguagcgcacuaugccaucaucgggcccggucugcaagccaaagcgacccgggaggcccagaagcgcgccgccgccggcaucaugaagaaccccacagucgacgggaugacggugaucgaccuggacccgaucccauacgacccgaaguucgagaagcagcucggccagguuauguuacugguacucugcgugacccaggugcuaaugaugcggaccaccugggcucugugcgaggcucugacgcuggcaaccgggccuaucucgacgcucugggagggaaaccccggccguuucuggaacaccacuauugcggucuccauggccaauaucuuccgggguagcuaucucgcaggcgcagggcuucuguucuccaucaugaagaacaccgcuaacacccggcgcgguaccgggaacacgggugagacccucggcgaaaaguggaaaaaccggcugaacgcccucgguaagagcgaguuccagaucuauaagaaguccggcauacaggagguggauagaacgcucgcgaaagaggggauaaaacggggcgagaccgaccaucacgcuguuucccggggcuccgccaagcugagaugguucgucgagcgcaaccucgugacgccggagggcaagguaguggaucuuggcugcgggcggggcggguggagcuacuacugcggcggucugaaaaauguaaaagaggugaagggccugaccaagggcgggccaggacacgaggagccaauccccaugaguaccuauggguggaaccucgugagacugcagucuggcguggauguguucuucacuccgccagagaagugugacacuuuacucugcgacauuggggagucuucgcccaaccccaccguagaggccgggcggacccugagggugcugaacuuaguggagaacuggcugaauaacaacacgcaguucuguauaaaggugcucaacccguacaugcccucugucaucgaaaagauggaggcccugcagcggaaauacggaggggcguuggugcgcaacccccugagcaggaacagcacgcacgaaauguacugggucucaaaugccagcgguaauaucgugucgucagugaauaugaucucccgcaugcugauuaaccguuucacgaugcgacacaagaaagcuaccuacgaaccugacgucgaccucgggagcggcacgcgaaacaucgggaucgagucagagacucccaacuuagacaucauagggaagcgcaucgagaagaucaagcaggaacaugaaacgagcuggcacuacgaccaagaucaccccuacaagacaugggcauaccacggcuccuacgaaaccaaacaaacagggagcgcaaguucgaugguuaacggggugguccgccuguuaacaaaacccugggacgucauccccauggugacccagauggcgaugaccgacacaaccccauucgggcagcagcgggucuucaaggagaagguggauacaagaacccaggaaccuaaggagggcaccaagaaacugaugaagaucacugccgaguggcuguggaaggaacucggcaaaaagaagaccccccguaugugcacgcgcgaggaguucacccggaaggugcgcuccaacgccgccuugggggccaucuucaccgacgaaaacaaguggaaguccgcacgggaggccguggaggauucuggcuucugggaacucguggacaaagagcgcaaccuccaccuggaaggaaagugcgagacgugcguguacaacaugauggggaagcgggagaagaagcuuggggaguucggcaaagcuaagggcucaagggccaucugguauauguggcucggggcgcgguucuuagaguucgaagcccugggauuuuugaacgaggaccacugguucucccgcgagaauagccugagcggcgucgaaggcgaggggcuacacaagcucggcuacauucugcgggacguauccaagaaggagggcggggccauguacgccgacgauaccgcaggaugggacacccgcaucacguuggaggacuugaagaacgaggagauggucaccaaucacauggaaggggagcauaagaaguuagcagaggccaucuucaagcuaacguaccagaauaagguggugcggguccagcguccgacgccccguggcaccgugauggauaucauaucccgccgcgaccagaggggguccgggcaaguggucaccuacggcuugaacaccuuuacaaauauggaggcccaauugauccggcagauggagggcgagggaguuuucaagagcauucagcaguugacggugaaggaggagaucgccguaaagaacuggcuuauccgagucgguagagaacggcuaagccgcauggccauaagcggcgacgacuguguugugaagccgcuggacgaucgguucgcauccgcccucacagcacucaaugauaugggaaaagugcgcaaggacauccagcagugggagccuucccggggguggaacgacuggacccaggugccauuuugcucccaccauuuccacgaacugaucaugaaggacggcagaguccucguggucccaugccggaaccaggacgaguuaauaggucgcgcccgaauuagccagggcgcuggguggucccuacgcgagaccgcgugucucgggaaaucuuaugcucaaauguggucgcuaauguauuuccacagacgcgaccugcggcucgcagccaacgcgaucugcagcgcggucccuucccacuggauccccacgagccgcaccaccugguccauccaugccacccacgaguggaugaccacggaggacaugcucacggucuggaacagggucuggauccaagagaacccguggauggaggacaagacgcccgucgaaagcugggaggagaucccauaccucggaaagcgcgaggaccaguggugcggcagucucaucggccuaaccucccgggcaacuugggccaagaacauucagaccgcgauuaaccaggugagaagccuaaucgggaacgaggaauauaccgacuacaugccaucaaugaaacgguuuagacgcgaggaggaggaagccggcguucucugguga

SEQ ID NO: 24900 - RNA, 9876 nt, Artificial Sequence
  derived and/or modified CDS sequence (opt11) from DENV-2__FJ850072__SS-prME
acugcggggguuaucaucauguugauccccaccgcaauggcauuccaccucacgacccgcaacggggaaccucacaugaucguugggcgccaggagaagggcaaaucucuccuguucaagaccgaggacggcgugaauaugugcacucucauggcaauggaccugggugagcugugugaggacacgaucaccuacaagugcccccuccuccgucagaaugaacccgaggauaucgacugcuggugcaacuccaccagcacaugggugaccuacgggacauguacaacgacgggcgagcaccggcgggagaagagguccguggcacuggugccucauguggggauggggcucgaaaccaggaccgagacguggaugagcagcgagggggcguggaagcacgugcaaaggaucgagaccuggaucuuacgccacccgggauucgcgaucauggccgccauccuggcauacacaaucgggacaacacauuuccagcgggcccuaauuuucauucuucugaccgcgguggccccgagcaugaccaugcgcugcaucggcaucucaaaccgggacuucgucgagggaguaucugggggcuccugggucgacauagugcuagagcacgggagcugcguaaccacaauggccaaaaacaagcccacgcuagacuucgagcugaucaagaccgaggccaagcagcccgccacccuccgcaaguacugcaucgaggcgaaacuuacaaacacgacaaccgagucacggugcccgacccagggcgagcccagccugaacgaggagcaagacaaaagauucaucugcaagcacucaaugguggaccggggcugggggaacggcuguggccucuuuggcaagggagguauugugaccugugccauguuuacuuguaaaaagaacauggagggcaaggugguacugcccgagaaccuagaauacacuaucguuauaaccccgcacagcggagaagaacacgccguuggcaaugauacugggaagcauggggaggagaucaagauaacaccccagucuucuaucaccgaagcugagcuaacaggguauggcaccguuacgauggagugcagcccccgaaccggacucgacuucaacgagaugguguugcuccaaauggaagagaaggccuggcugguccacaggcaaugguuccucgaccuaccccugccuuggcugcccggggcggauacgcagggcagcaacuggauccagaaggaaaccuuagugacguucaagaacccccaugccaagaaacaagacguagucgugcuggggagucaggagggggcgaugcacaccgcgcugaccggagcgaccgagauccagaugagcagcggcaaucuucuguuuacuggacacuuaaaaugccgccuccgcauggacaagcugcagcuuaaggggauguccuacagcaugugcacaggcaaauucaagaucguuaaggagaucgcugagacccagcaugggaccauagugaucagagugcaguacgaaggggauggcucccccuguaaaauaccauuugagauuauggaccucgagaagcggcaugcccuuggacgccugaucacagucaacccaaucgugaccgaaaaagacucaccggugaauaucgaggccgaaccacccuucggcgauuccuacaucaucaucggggucgaacccggccagcuuaagcucaacugguucaagaaagguagcuccauuggccaaauguucgagaccaccaugcguggcgcgaagcggauggccauuuugggggacacggccugggacuucggcucgcuuggcggcguguucacguccaucgguaaggcgcugcaccagguuuuuggcgccaucuacggcgccgcguucucaggggucucguggacuaugaaaauucugauaggcgugaucauaacguggaucggaaugaacagccgaucgacgagccuguccgugucgcuagugcuggucggcguaguaacccucuacuuaggcgccauggugcaggcagacuccggcugcguugugagcuggaagaauaaggaacucaaguguggcucggggaucuucaucacagacaaugugcacacauggacggagcaauacaaguuccaaccugagagcccgucgaagcuggccuccgccauccagaaggcgcacgaggaagguaucugcgggaucagaagcgugacccgacuagaaaaccuaauguggaaacaaaucacccccgaguugaaccacaucuuguccgagaacgagguuaagcugaccaucaugaccggcgacauaaaggggaucaugcaggccggcaagcgaagucugcgcccccagccgacugaacucaaauacaguuggaagaccuggggcaaagcaaagaugcuaagcaccgaaucucauaaucagaccuuucucauagaugggccugagaccgccgaguguccgaacacuaaccgggccuggaacagcuuggagguggaggauuacggcuuuggcgucuuuaccacuaauauuuggcucaagcuccgcgaaaagcaggacguauucugugauucaaaacugauguccgcggccauaaaggacaaccgggccgugcacgccgacauggguuacuggaucgaguccgcgcuuaaugacacauggaagauggaaaaggcgucuuucauugagguuaaguccugccacuggccaaagagucacacccuuugguccaacggcguccuugagucagagaugauaauccccaaaaacuuugccgggcccgucucccaacacaacuaccgcccgggcuaccauacucagaccgccgggcccuggcaucugggcaaacuggaaauggacuuugacuucugcgaggggacgaccguugucguuaccgaagacugcggcaacagggggccaucauugcgcaccacaaccgccagcgggaaacugauaaccgaguggugcuguagaagcugcaccuuacccccacuccgguaccggggagaggacggcugcugguacggcauggagauccgcccccugaaggagaaggaggagaacuuggugaacucacucgucacggcagggcacggccaaauugacaacuucucccugggggugcuagguauggcgcuuuuucuugaagagaugcugcgcacgcgggugggaacgaagcaugcgauccuccuggucgcgguuagcuucgugacccugaucacggggaacaugaguuuccgggaccucggccgcgucaugguaauggugggggucgcgaugacugacgacaucgguauggguguuaccuaucuggcccugcuagccgccuucaaaguacgccccaccuucgccgcggggcuguuacuccggaaacuuacaagcaaggagcugaugauggccaccaucggcaucacccuccuaucccagaguaccauucccgagacaaucuuggaauuaacggacgcucuggcccucgggaugaugguccuuaaaaucgugcgcaauauggagaaauaucagcucgccgucacuauuaugaccaucuccugcgucccuaacgccaugauccugcuaaaugcguggaaggugucuuguacaauccuggccguggucuccgugagcccucugcuucugaccuccagccagcaaaagaccgauuggaucccauuagcgcucacaauaaagggccugaaccccacugcgaucuuucugaccacccucagccggaccagcaaaaagcgaucguggccgcugaacgaagcugucauggccguggggauggugagcauccucgcuucaagccuccugaagaacgauaucccgaugacuggcccgcuggucgccggugggcugcuuaccgugugcuaugugcugaccggaaggagcgcagaccucgaacuggaaagggcaacugacgugaagugggaggaucaggcugagauuuccgggagcucccccaucuuauccaucacgaucucugaggacggaagcauguccaucaagaaugaggaggaagaacagacgcuuaccauacuuauccggaccggcuugcucgucauuucggguguguucccggucucuauuccaaucacggcggccgcgugguaccugugggagguuaagaagcaacgcgcaggcguguuaugggacgugccuuccccacccccgguggaaaaagccgagcucgaggauggggccuaccggaucaagcagagagguauccuggguuacucccagaucggagccggaguuuacaaagaggggacauuccacaccauguggcacgucacccguggcgccguacucaugcaccgcgggaagaggauagagccguccugggcggacgugaagaaagaccucaucuccuacggagggggcuggaagcuggaaggcgaguggaaggagggggaggagguacagguacuggcccucgagcccggaaagaaccccagggccgugcaaaccaaaccugggcuauucaaaacgaacaccggcaccauuggggccguaucacuggacuucagccccgguaccucuggcucuccaaucguggaccgcaaggggaaggugguggguuuauacgggaacggcguggugacgcgcagcggggccuacgucagugccaucgcccagaccgagaaguccauagaggacaaccccgagauugaggacgauauuuuccggaagaaacgccuaacaaucauggaccuccaccccggcgccgggaagacgaaacgguaccuacccgccauagugcgcgaggcgauuaagcggggccuccgcacguuaaucuuagccccaacgagaguggucgccgccgaaauggaggaggcucuccggggccugcccauccguuaccagacccccgcgauccgggccgagcacaccggaagagaaaucguggaccugaugugccacgcaacguucacgaugaggcugcugagccccguccguguccccaacuauaaccugauaaucauggaugaagcgcauuucaccgacccugccuccaucgcugccagaggcuauauuagcacgcgcguagagaugggcgaggccgccggaaucuuuaugacggcgaccccgccuggcucccgggacccuuuuccccaaagcaaugcgcccauaauggacgaggagcgcgaaauccccgaaaggagcuggaacagcgggcaugagugggugaccgacuucaagggcaagaccguaugguucgugcccuccauaaaagccgggaacgauaucgcggccugccucagaaagaaugggaagaaggucauccagcugagccggaagacguuugacuccgaauacguaaaaacucgcgcgaaugacugggacuucguggucaccaccgauaucucugagaugggcgcaaacuuucgggccgagagggucaucgauccccgacgcugcaugaagccaguaaucuugacagacggggaggagcgggugauccucgccggcccaaugccgguaacccacuccagcgcagcgcagagacgugggcggguaggccggaacccuaagaacgagaacgaccaguauauauauaugggcgagccccuggagaacgacgaagacugcgcccauuggaaggaggccaagaugcugcuagacaauauuaacacccccgagggcaucaucccuagcauguucgagcccgaacgggaaaaaguggaugcaaucgacggggaguaccgccugcgcggcgaggcccgcaagaccuuugucgaccuuaugcggaggggugaccuccccguguggcuggcguaccgcguugccgcggaggggaucaacuacgcggaucgccgguggugcuucgacggaaucaaaaacaaccagaucuuggaggagaacgucgagguggagauauggaccaaagagggggagcggaaaaaguugaaaccgcgcugguuagacgcccgcaucuacagcgacccacuggcgcuuaaagaguucaaagaguucgcggccggccggaagucccugacccugaacuugaucaccgagaugggacgguugcccaccuucaugacgcaaaaggcccguaacgcgcuggacaaccucgcuguacugcauaccgccgaggccgggggccgcgcguauaaccacgcucugagcgaguugcccgagacccuggagacguugcuauuacugacgcuccucgccacagugaccggaggcauuuuccuguuccuaaugagcggcaaggggauuggcaagaugacccuggggauguguugcauaaucaccgccagcauccugcuaugguaugcccaaauucagccgcauuggaucgcggcguccaucauacuggaguuuuuccugaucguccuccuuauacccgagcccgagaagcaaaggacgccccaggacaaccagcugacuuaugucguaaucgcuauucucaccguggucgccgcaaccauggccaacgagaugggcuuccuagagaagacgaagaaagaucugggccucggcucgaucacuacccaggagagcgaguccaacauccuggauaucgaucugcggccggccucggcguggacccucuacgcagucgcaacgaccuucaucaccccaauguugcggcauuccaucgagaauagcuccgugaauguaucucugaccgcuaucgcgaaucaggccacgguccucauggggcugggaaagggcuggccgcugucaaagauggacauaggugugccacuacuagcaaucggaugcuacucccagguaaacccgaucacgcugacugccgcguugcuaucacugguagcacacuacgccauaaucgggcccggccuccaggccaaggccacccgugaggcgcaaaagcgagcggccgccggcaucaugaagaauccgacgguggacgggauaacagucauagaccuggagcccaucccguacgaucccaaauucgagaaacagcugggccagguaaugcuccugauccugugcguaacccaaguccucaugaugagaaccacgugggcgcugugcgaggcgcugacgcuggcaaccgggcccaucagcaccuuaugggaaggcaacccagggcgauuuuggaacacgacaaucgcggucuccauggccaacaucuuucgcggcagcuaccuggccggcgcugggcuccucuucuccaucaugaagaacaccaccaacacgcgccgggguaccgggaacaucggcgaaaccuuaggcgaaaaauggaagucccgccucaacgccuuggggaaguccgaguuccaaaucuauaagcggagcggaauccaagagguggaucguacucuggcaaaggagggcaucaagagaggugaaacagaccaccacgccgucuccagggggagcgcgaagcucagaugguucguggagagaaacauggugaccccggagggcaaggucguugaccugggcugcgggcgggguggguggucauauuauugcggcggccugaagaacgugcgggaggucaagggacugaccaaaggagggcccggacacgaggagcccaucccaauguccacauacggauggaaccuggugcggcugcagagcggcguggaugucuuuuucacgccucccgagaagugcgacacccucuugugcgacaucggggagagcucucccaacccuacgaucgaggcaggccguacccuucguguguuaaaccugguugaaaacuggcuuaauaacaacacgcaguuuugcaucaaggucuugaacccguacaugcccuccgucaucgagaagauggaaaccuugcagcggaaauacggcggagcucugguucggaauccccugucgcgcaacuccacucacgagauguacugggugagcaacgccacaggcaauaucgucagcucagugaacaugaucucccgcaugcucauaaaccgauucacuaugaaacauaagaaggccacguacgaaccggacguugaccuggggucgggcacccgcaacaucggcaucgaaagugagaucccgaaccuggacaucaucggcaaacggauugagaagaucaagcaagagcacgaaaccagcuggcacuacgaccaagaccauccauauaagaccugggcguaccacggcuccuaugaaacaaaacagaccggaagcgcguccuccauggugaauggagugguccgcuugcucacaaagcccugggacguugugccgaugguaacgcagauggccaugacggacaccacccccuucgggcagcagcggguguucaaagagaaaguggauaccagaacccaggagccuaaggaaggcaccaagaaauuaaugcggaucaccgccgaaugguuauggaaagaacugggaaagaaaaagacgccccgcauguguacucgagaggaguucacccgcaagguccgaucgaaugccgcacuaggagccauuuuuacagaugagaacaaguggaaguccgcgcgcgaggccguggaagauucucgguucugggaacucguggaccgcgagcggaaccugcaccucgaaggaaagugugagacuugcguguacaauaugaugggaaaacgcgagaagaagcucggagaguucgggaaggcuaagggcucccgcgcgauaugguacauguggcucggcgcccgauuucuagaguucgaggcuuugggguucuuaaacgaagaccacugguucagccggggcaacucucugagcgggguagagggugaagggcuacaucgccuuggcuauauccugcgggacguaaguaaaaaggaggguggggccauguacgcggacgacacggccggcugggauacccgcauaacacuugaggaccucaagaacgaggaaauggugacaaaccacaugaagggcgaacacaaaaagcuggccgaagccguauucaaacucacguaccagaacaaggucgugcgcguucaacgaccgacgccccgcggcacagucauggauauuauuagucggcgagaucaacgcggguccggccaggugggaaccuacgguuugaacacguucacaaacauggaggcccagcugauccgacagauggagggcgaggggaucuucaagucuauccagcaccuuaccgugacugaggagaucgcugugcagaauugguuagcccgggugggucgagaaaggcugagcaggauggccaucagcggcgacgacuguguugucaagccccucgacgacagguucgccagcgcccugacggcguugaacgacauggggaaggugaggaaggacauccagcagugggaaccuagccggggauggaacgacuggacccagguuccguucugcucccaccacuuccacgagcucgucaugaaagacgggcggaugcugguggugcccugucggaaccaggacgagcugaucgggcgugcacggauaagccagggggccgguuggucccucaaggagacugcaugccuagguaaaucguacgcucagauguggacgcugauguacuuucaccgccgggaucuccgcuuagcagccaaugccaucuguuccgcggucccaagccacuggguacccaccucccgcacgaccuggagcauacacgccaagcaugaguggaugacaacggaggauaugcuagccguguggaaccgggucuggauccaggagaacccguggauggaagauaaaacgcccguggagucgugggaggaggucccuuacuuggguaagcgcgaagaucagugguguggcagcuugaucggacugaccucccgggccacaugggcgaaaaauauccagaccgccauaaaccaggugagaagccucaucggaaacgaggaauauacggauuacaugcccucgaugaagcgguuccgccgggaggaggaggaagcugguguguugugguga

SEQ ID NO: 24901 - RNA, 9876 nt, Artificial Sequence
  derived and/or modified CDS sequence (opt11) from DENV-2__JN819419__SS-prME
accgccggcgugaucgucaugcugauccccacggccauggccuuccaccucaccacccggaacggggagccucacaugaucgugggccgacaagagaagggcaagucccugcuguucaagacagaagacggagucaacaugugcacgcucauggcgauugaccugggggagcugugcgaggacaccaucacuuacaagugcccccucuuacgccaaaacgagccagaggacaucgauugcuggugcaacagcacgagcaccugggucaccuacgggacaugcaccaccacgggcgaacaccggcgcgaaaaacgguccguggcccuggugccccacgucggcaugggcuuggagacacgcaccgaaaccuggaugucauccgagggggccuggaagcacgugcagcgaaucgagaccuggauacugagacacccgggcuucaccaucauggccgcgauuuuagccuacacuaucgggaccacgcacuuccagcgggcccucaucuuuauucugcucaccgccguugcgcccucuaugacgaugcgcugcaucgggauauccaaccgggacuucguagagggggugagcgguggcucauggguggacauaguccuggagcacgggagcugcgugaccacgauggccaaaaacaagcccacccuggacuucgagcucaucaagaccgaggccaaacagcccgcgacccuccgcaaauacugcguggaggccaagcugacgaacaccaccaccgaaucccgguguccgacgcagggugaaccaucuuuaaacgaagaacaggacaagcgcuucauuugcaagcacuccaugguagauaggggcugggguaauggcugcgggcuauucgguaaaggcgggaucguaaccugcgcgauguucaccuguaagaagaacauggagggcaaggugguacaaccagagaaccuggaguacaccaucgugaucacgccccauagcggggaggaacacgccgucggcaacgacaccgggaaacauggaaaggagaucaagaucaccccgcagucuagcaucaccgaggccgagcugaccggguacggaacggucaccauggagugcagcccccgcacgggccuagacuucaaugagauggugcuccugcagauggaggacaaggccugguuagugcaccggcagugguuucuggaccucccccucccuuggcugccuggagccgacacccagggcaguaacuggauacagaaggagacgcuggucaccuucaagaacccccacgcgaagaaacaggacguggucgugcucgguucccaggagggcgccaugcacaccgccuugaccggggccacggagauccagaugagcagugggaaccuccuguucaccggccaccugaagugccgccugcgcauggacaagcuccaguugaaggggaugagcuacagcaugugcaccggcaaguucaaaaucgugaaggagaucgcugagacccaacacgggacuaucguaauccgcgugcaguaugagggcgacggcagcccgugcaagauccccuucgaaaucauggauuuagaaaagcggcacgugcucgggcgcuuaauuaccguaaacccaaucgugaccgagaaggacagccccgugaacaucgaggcggaaccgcccuucggggacuccuacaucauaaucgggguagagccggggcagcugaagcugaacugguucaagaaagggagcuccaucggccaaauguuugagaccacgaugcgcggcgccaagcggauggccauccugggggacaccgccugggacuuuggcucgcuaggugggguguucacuuccauugguaaggccuuacaccaagucuucggggcgaucuacggggccgccuucagcggggucuccuggaccaugaagauucugauaggugugaucaucacguggaucgggaugaacagccgcuccaccagccuguccgugagccuuguacucgugggcgugguuacgcuguaucugggagccaugguccaggccgacuccgguugcguggugagcuggaagaacaaggagcugaagugcggaucggggaucuuuauuaccgacaacgugcacacguggaccgagcaguacaaguuccagcccgagagcccaagcaagcuggccagcgccauccagaaggcccacgaggagggaaucugugggauccggagcgugacccgccuggagaaccucauguggaagcaaaucacucccgagcugaaccauauacugagugagaacgaggucaagcucacgaucaugacgggugauaucaaggggaucaugcaggcgggcaagaggagcuuaagaccgcagcccaccgagcugaaguauuccuggaagaccuggggcaaggcaaagaugcuuucaacggagagccacaaccagaccuuucugaucgacggucccgagacggcagaguguccgaacaccaaccgggccuggaacagccuggagguugaagacuacggcuucgggguguucacgaccaauaucuggcuaaagcugcgcgagaagcaggacgucuucugcgacuccaagcugaugagcgccgccaucaaggacaaccgggcggugcacgccgacaugggcuacuggauagagucagcccucaaugacaccuggaagauggagaaagccagcuuuaucgaggugaaaagcugccacuggccaaagagccacacccugugguccaacggcguccuggagagcgaaaugaucauccccaagaacuucgcgggccccgucucccagcacaacuaccgcccggguuaccacacccagaccgcggggcccuggcaucucggcaagcuggagauggacuucgacuuuugcgaggggacaaccgugguugugacagaggacugcggaaaccggggccccagccugcgcacgaccaccgccagcgggaagcucauaaccgagugguguugccgguccugcacgcuacccccgcugcgcuacagaggggaggacggaugcugguacggcauggaaauccgcccccucaaggagaaagaggagaacuuaguaaacucacuggucaccgccgggcacggccagaucgacaacuuuucccucggcguuuuagguauggcccuguucuuggaggagaugcugcggacccgcgugggaaccaagcacgcgauccugcuugucgcagugagcuuugugacgcugaucaccgggaacauguccuuucgggaccugggucgcgucauggugauggugggggccaccaugaccgacgacaucggcaugggagucacauaccucgcucugcuggcugcguucaaggugcgccccaccuucgcagccgggcuccugcugcguaagcucaccagcaaggagcuaaugauggcgaccaucgggguggcccugcucucccagagcacgaucccugagaccauccuggagcugaccgaugcgcucgcccuggggaugauggcccugaaaaucgucaagaacauggagaaguaccagcucgcugugaccauuauggcuaucuccugcgugccgaacgcggucauccugcagaacgccuggaaggugagcuguaccauccuggcagccgucuccgugagcccccuccugcugacauccagccaacagaaagcggacuggauuccuuuagcccugaccaucaaaggacugaaccccaccgccaucuuccuuacgacacucucccgcaccagcaagaagcgguccuggccgcugaacgaggccauuauggccgugggcauggugucaauccuggcauccagccugcugaagaacgauauucccaugaccgguccccucguggccggcgggcugcuaacggugugcuacguccucaccggcagaagcgcggaccuggagcuggagcgggccgccgacgugaagugggaggaccaggcugagaucuccgggagcucccccauucucagcaucaccauuuccgaggacggcagcauguccaucaagaacgaggaagaagaacagaccuuaacaauccugauccgcacgggccuccuggugauaagcggggucuuuccgguuuccauucccaucacugccgccgccugguaucuaugggaggugaagaagcagcgagccggcguuuugugggacguacccucaccuccacccguggggaaagcggaguuggaggacggcgccuaccgcauaaagcagcgggggauccugggcuacucccagauuggcgccggggucuacaaggagggcacauuccauaccauguggcacguaacacggggugcuguccucaugcacaggggcaagcgaauagagcccagcugggccgacgucaagaaagaccugguguccuacgggggcggcuggaaacuggagggggaguggaaggaaggcgaggaggugcaggucuuggcgcucgagccuggaaagaaccccagggccguucagacuaaaccgggcaucuuuaagacaaacacagggaacaucggugccgucagccuggacuucucccccggcacuagcgggucccccaucgucgaucgcaaaggcaaaguugugggacucuacgggaacggcgucguaacccggagcggggccuacgugucggcgaucgcgcagaccgagaaguccaucgaggacaaccccgaaauagaggacgacauauuccgcaagaagcggcugaccauaauggauuugcaccccggcgccggaaaaacgaagcgcuaccuccccgccaucguccgggaggccaucaagcgaggccugcggacccugauccuggccccgacccgcgugguggcagccgaaauggaagaagcccuacgagggcugccaauuagguaccagacccccgccauccgcgcugagcacaccggccgggagaucgucgaccugaugugccacgcgaccuucaccaugcgccuccugucaccggugcgggugccuaacuacaaccugaucaucauggacgaggcccacuucacagaucccgccuccauagccgcgcgcggcuacaucagcacgcggguagagaugggggaggccgccggcaucuucaugaccgcgacgccgcccgggucccgcgacccguucccccagagcaacgcgcccaucauggacgaggagagggagaucccugagcgguccuggaacucaggacacgagugggucacagacuucaaggggaagacggugugguucgucccauccaucaaggccggcaacgacaucgccgccugucugcggaagaauggcaaaaaggugauccagcugagccgcaagaccuucgacuccgaguacgugaagacacgggcaaacgacugggauuucgucgugaccacggacaucagcgagaugggggcgaacuucaaggcggagcgcgugaucgacccccggcgcugcaugaagccugucauccugaccgacggcgaggagcgggugaucuuggccgguccuaugccagugacccacuccagcgccgcccagcgucggggccgcauugggcguaauccgaagaacgagaacgaccaguacauuuacaugggcgagccccuugagaacgacgaagacugcgcgcacuggaaagaggccaaaaugcugcucgacaauaucaacaccccggagggcaucaucccguccauguuugagcccgagcgggagaaggucgacgccaucgacggggaguaccgccuccggggagaggcucgcaagacguucguggaccugaugcggcgcggggaucuccccguguggcuggccuacaagguggcggccgagggcaucaacuaugccgaccggagaugguguuucgacgggaucaagaacaaccagauccuugaggagaacguggaagucgaaaucuggaccaaggagggggagcgcaagaagcucaagccgcgcuggcuggacgcccggaucuacagcgacccccuggcgcucaaagaauuuaaggaguucgccgccggccgcaaaucccugacccugaaccucaucaccgaaauggggaggcugccuacuuucaugacgcaaaaggcucgcaacgcccuggacaaccucgcggugcuucacaccgccgaagcaggcgggaaggcuuacaaccacgccuuaagcgagcuccccgagaccuuagagacgcugcucuuacugacccuccuggcgaccgugacugggggcaucuuccuguuucuaauguccgggaagggcaucgggaagaugacgcuggguaugugcugcaucaucacagccucaauccugcucugguacgcccagauccaaccacacuggauugcugccuccaucauccucgaguucuuucugaucgucuugcugauccccgagcccgagaagcagcggacgccucaggacaaccaguuaaccuacgugguuaucgcgauucuuaccgucguggccgccacgauggccaaugagaugggguuccuggaaaagaccaagaaggaccugggucuuggcagcaucaccacccaggagagcgaguccaauauccuggacauagaccugcgcccggcgagcgcguggacacucuacgccguggccaccacauucguuacccccaugcugcggcauuccaucgaaaacagcuccgugaacgucagccugacagccauugcgaaccaggcaaccguccucaugggccugggcaagggguggccucuauccaagauggacaucggcgcgccccuccuggccaucggguguuauagccaggugaauccgaucacguugaccgcagcgcuccugcugcucgucgcccauuacgcaaucaucgggcccggccugcaggccaaggcaacgcgcgaggcgcagaagcgggccgccgccgggaucaugaagaacccaaccgucgacggcauaacagugauugaccuugaaccgaucccauacgaccccaaauucgagaaacagcucggccaggugauguuacugauccucugcguaacccaggugcugaugaugcgcacgaccugggcucugugcgaagcgcucacccuggccaccggccccaucuccacgcucugggaggggaaccccggccgguucuggaacacuaccaucgcugugucuauggccaacaucuuucgcggcuccuacuuagcgggggccggacugcuguucagcauaaugaaaaacaccacgaacacccgccgggggaccggcaacaucggcgagacccuaggggagaaguggaagucgcgccugaacgcccuuggcaagagcgaguuccagauuuacaaaaaguccgggauccaggaggucgaccggacgcucgcaaaggagggcaucaagcgaggggagaccgaccaccacgccguaagucgaggcuccgcaaagcugcgcugguucguggagcggaacauggugacgccugagggcaaggugguggaccuugggugcggacgcgggggcuggagcuacuacuguggcggccucaagaacguccgggaggugaagggccugaccaaaggugggcccgggcacgaggagccuauccccauguccacuuacgguuggaaccuggugcggcuccagaguggggucgacgucuucuucaccccgcccgagaaaugcgauacccuacugugugacaucggcgagagcucccccaaccccacgaucgaggccggccggacgcuccgcguguugaacuuggucgagaacuggcucaacaacaacacucaguuuugcaucaaggugcugaacccguauaugcccucagugauagagaagauggagacccugcaacguaaguacgggggagccuuaguccgcaacccgcuguccagaaauuccacccacgagauguauugggucuccaaugcaacugggaacaucgucagcuccgucaacaugaucagccgcaugcugaucaaccgauucacgaugaaacauaaaaaggcuaccuacgagccggacguggaccuuggcuccgguacccgcaacaucggcaucgaguccgaaaucccuaaccucgacaucauuggcaagcggauugagaagauaaagcaggagcaugagaccuccuggcacuacgaccaggaccaccccuacaagacgugggcguaccaugggagcuacgagaccaagcaaaccgguucugccagcuccauggugaacggcgucguacgcuugcugaccaaaccaugggacgugguuccgaugguaacgcagauggccaugaccgacaccaccccauuuggccaacaacgcguguucaaagagaaagucgacacgcggacccaggagcccaaagagggcaccaagaaguuaaugaagaucaccgccgagugguuguggaaggagcuggggaagaagaagaucccccgcaugugcacccgggaggaguucacccgcaaggugcggagcaacgcggcgcucggcgcaauauucaccgacgagaacaaguggaaguccgcccgcgaggccguggaggacggucgguucugggaacuggucgaccgggagcgaaaucugcaccucgaaggcaagugcgagaccugcguauacaacaugauggggaagcgcgagaagaagcugggcgaguucggcaaggcgaaagggagccgggccauaugguacauguggcugggugcccgcuuucucgaguucgaggcccugggauuccugaacgaagaccacugguucucccggggcaacagccucuccggggucgagggcgaggggcuucaccgccugggguacauacuccgugacguguccaaaaaggagggcggggccauguaugcggacgacacggcgggcugggacacccgaaucacccuggaggaccugaagaacgaggagauggugaccaaccacaugaagggagagcacaagaagcucgccgaggcuaucuucaaguugacguaccaaaacaaggucgugcgggugcagcgcccgacgccccgggguaccguuauggacaucaucagccgccgugaucagcgcggcuccggccaggugggcaccuacgggcugaacaccuucacaaauauggaagcccagcucauccgccagauggaaggcgaggguaucuucaagaguauccagcaccuuaccgugacggaagagaucgcgguccaaaacuggcuggcccgcguggggcgcgagcgcuugacgagaauggccaucuccggggacgacugcguagugaaacccaucgacgauagauucgcgaacgcccuaaccgcguuaaaugacauggggaaggugcgcaaggacauccaacagugggagcccagccggggcuggaacgauuggacccaggugccguucuguucccaccacuuccacgagcuugucaugaaggacgggcguguccuggugguccccugccggaaccaagacgagcugaucggccgcgcccggaucucccagggcgccggguggucccucaaggagaccgccugccugggcaagucguacgcccagauguggacacugauguacuuccauaggcgggacuugcgcuuggcggccaacgcuaucugcuccgccgugccuagccacugggugcccaccucccggaccaccuggagcauccacgcgaagcacgaguggaugaccacagaagauaugcuggccgucuggaaccgcguguggauccaggagaacccuuggauggaggacaagacacccguggagaguugggaggaggucccauaccucgggaagcgggaggaccaguggugcggcucacugaucgggcugaccucccgcgccacaugggcuaagaacauccagacagccaucaaucagguucggagccucaucggcaaugaggaguacacagacuauaugcccagcaugaagcgcuuccgacgugaggaggaggaggcgggugugcugugguag

SEQ ID NO: 24902 - RNA, 9876 nt, Artificial Sequence
  derived and/or modified CDS sequence (opt11) from DENV-2__FJ850074__SS-prME
acugccggugucauaguaaugcugauccccaccgucauggccuuccaucucaccaccaggaacggggaaccccauaugauuguggggcggcaagagaaagggaaaucccuauuauucaagaccgaggacggcgucaacaugugcacccucauggcgaucgaccugggugagcugugcgaggauacuaucaccuacaagugccccuugcuuagacagaacgaacccgaggacauagauugcugguguaacuccacuuccaccuggguaaccuacgggaccugcaccaccacgggcgagcaucggcgggagaagcgguccguagcacugguuccgcacguggggaugggcuuagaaacccgcaccgagacauggaugagcuccgagggggccuggaagcaugugcagcggaucgagacguggauccugaggcaccccggcuucaccaugauggccgccauccucgcguacacaaucgguacgacgcacuuccagcgagcccuuauauucauccugcugaccgccgucgcccccagcaugaccaugcgcuguauuggcaucuccaaccgggacuucguggagggcguuagcgguggcaguuggguugacauaguucucgagcacgggagcugcgugaccacgauggcgaaaaauaagcccacccuggacuucgagcugaucaagaccgaggcgaaacagcccgcaacccuccgaaaguacugcgucgaggcgaagcugacuaacaccaccacagagucccggugcccgacacagggagagcccaguuugaacgaagaacaggacaagagguucaucugcaaacacuccaugguggaccggggcuggggcaacggcugcggacuguucgggaagggcgggaucgugacaugugcaauguucacguguaagaagaacauggagggaaaggucguccagcccgagaaccuggaguacaccauugugaucacgccccacagcggggaagaacacgccgucggcaacgacaccggcaagcacggcaaggagauaaagaucacaccccaguccagcaucaccgaggccgagcugacuggguauggcaccgugaccauggagugcucaccccgcaccgggcuugacuuuaacgagauggugcugcugcagauggaggacaaggccugguugguccaccggcagugguuccuggaccugccccucccgugguuaccuggggccgauacccagggcagcaacuggauccagaaggagacgcuggugacguucaagaauccccacgccaagaagcaggacguggugguacuugggucacaggagggcgcgaugcacaccgcccuaacaggagccacugagauccagaugagcagcggcaaucuucuguucaccggccaccugaagugccgacugcggauggacaagcuccaacucaaggggauguccuacagcaugugcaccggcaaauucaagaucguaaaggagaucgcagagacccagcacgggacaaucgugauccgcguucaauaugagggcgacggcucucccuguaaaauccccuucgagaucauggaccuggagaaaaggcacguccucgggagacucaucaccgucaacccuaucgugaccgagaaagacucgcccgucaauaucgaggcagagccacccuucggcgauuccuacaucaucaucgggguugagccgggccagcugaagcucaacugguuuaagaaagggagcuccaucggccagauguucgagaccacgaugcgcggcgccaaacguauggccauccugggcgacaccgccugggacuucggcagccuaggcgggguguucaccaguaucgggaaggcccuccaccaaguauuuggagccaucuauggcgcggccuucagcggggucuccuggacgaugaagauccuuauaggcguuaucaucacuuggaucgggaugaacagccgcucgaccagccugucugugagccugguccucgugggggucgucacccuguacuuaggggccauggugcaggccgacuccggcugcgucgugagcuggaagaacaaagaacucaagugcggauccgggauuuucaucaccgauaacgugcauacguggacugaacaguacaaguuccagcccgagagcccgagcaaacuggcgagugccauccagaaggcccacgaagagggaaucugcgggauccgaagcgucacucgccuggagaaccuaauguggaagcagaucacccccgaacugaaucacauccuguccgagaacgaggucaaacucacgauuaugacgggugacauuaaggguauuaugcaggccggcaagcgaagccugcgcccgcaacccaccgagcugaaguacuccuggaagaccuggggcaaggccaagaugcuacccacggagagccacaaccagacguuucuaaucgauggucccgagacagcggaaugcccaaacaccaaccgugccuggaacagccucgagguggaagacuauggcuucggggucuuuacgaccaacaucuggcucaagcugcgagaaaagcaggacguguucugcgacagcaagcugaugucugcugcuauaaaggacaaccgggccgugcaugcggacaugggcuauuggaucgagagcgcccuaaacgacaccuggaagauggagaaggcuuccuucaucgaggucaagagcugccacuggcccaaaucccacacccuguggagcaacggugugcuggagucugagaugauuaucccaaagaacuucgccgggccggucagccagcacaacuaccgccccggcuaccacacccagacggccgggcccuggcaccuagguaagcuggagauggacuucgacuucugugagggcaccaccguagugguuaccgaagacugcggcaaccggggucccucccugcgaacaacuacagcgagcgggaaguuaaucacggaguggugcugucggucuugcacgcugccgccgcugcgcuaccggggcgaggaugggugcugguacggcauggaaauacgaccccuaaaggagaaggaagagaaccucguaaauucucuugugaccgccgggcacggucagaucgauaacuucucccugggcgugcuaggaauggcccuguuccucgaggagaugcugcggacccgcguaggcaccaaacaugccaucuuacucguggcggugaguuuugucacgcugaucaccgggaacaugagcuuccgggaucugggccgagugauggugauggucggugccaccaugacugacgacaucggcaugggggugacuuaccuugcccuguuagccgcuuucaaggugaggcccaccuucgcggccgggcucuuacuucggaagcucaccuccaaggaacugaugauggccaccaucggagucgccuuacucagccaguccacgaucccugaaacaaucuuggagcugacagacgcccucgcgcugggcaugauggcccugaagaucgugaagaacauggagaaguaccagcuugccgugaccauuauggccaucagcugcguacccaacgccgugauccugcagaaugcguggaagguauccuguacgauucucgccgcugugagcguaagcccucugcuccugaccagcucccaacagaaagccgacuggauaccuuuagcgcugaccauaaagggccugaacccuaccgcaaucuuccucacuacacugagccgcaccucgaagaagagaagcuggccccugaacgaggcgaucauggccgucggcauggucuccauacuugccagcucccugcugaagaacgacauacccaugaccggcccccucguggcgggagggcugcugacggucugcuacguguugaccggacgcagcgcugaccuggagcucgaacgggccgccgacgugaagugggaagaccaggccgagaucagcggcuccagcccgauccucuccauaacgauuagcgaggacggcuccauguccaucaagaacgaagaggaggagcaaacucugacgauucugauacgcaccggccugcuggucauaucggggguguuucccgugagcauaccuaucaccgcggccgcaugguaccugugggaggucaagaaacagcgggcugggguguugugggaugugcccucgccgccacccguagggaaggccgagcuggaagacggugcguaucggauaaagcaacgggggaucuugggcuacagccagaucggcgccggcguguauaaggaggguacguuccacaccauguggcacgugacccgcggagccguccucaugcaccggggcaagcgcaucgagccgucgugggccgacgugaagaaggaccuggugagcuaugguggcggauggaagcuggagggggaguggaaggagggggaggagguccaggugcucgcauuggagccgggcaagaacccccgggcaguacagaccaagccuggcaucuucaagacgaacaccgggacgauaggcgccgucucccuggacuucagcccuggaaccuccgguuccccgaucguggaccgcaagggcaagguggucgggcucuacggcaacggcguggugacccgguccggcgcguaugugagcgccaucgcgcaaaccgagaaguccaucgaggacaacccugagaucgaggacgauaucuuccgcaagaaaagacugacgaucauggaccugcaccccggcgcagggaagaccaagagauaccuaccggccaucgugcgggaggccauuaagcgcggccugaggacccuuauccucgcgcccaccaggguggucgcggcggagauggaggaggcccuccggggacugcccauccgguaucagacgcccgccauccgggccgagcacaccggacgggagaucguggaccugaugugccacgcgaccuucacuaugcgacuacugagcccggugcggguccccaacuacaaccugaucauuauggaugaggcacacuucacggacccggcaaguauugccgcccgcggcuacaucuccacccggguggagaugggggaagcugccggcaucuucaugaccgcgacgccgccagggagcagggaccccuuuccccaguccaacgcgcccaucauggacgaggaacgggaaauccccgaacgcagcuggaacuccggccacgagugggugacggacuuuaaagggaaaaccgucugguucgugccaagcauaaaggcgggcaacgacaucgccgccugccucagaaagaacggcaagaaaguaauccagcugucaaggaagaccuucgacagcgaguaugucaagacccggucuaacgacugggacuucgugguuacuaccgacaucagcgagaugggggccaauuuuaaagcggagcgcguuaucgacccccggcgcugcaugaagccugugauccugaccgauggcgaggagcgggugauccucgcggggccgaugcccgucacccacuccagcgccgcccagcgccggggccgcauuggccgcaaccccaagaacgagaacgaccaauacaucuacaugggugagccccuagaaaacgaugaggacugugcccauuggaaggaagccaagaugcugcucgauaacauaaacacgccggaggguaucauacccuccauguucgagcccgaacgcgaaaaaguagacgcgaucgacggagaguaccgcuugcggggugaagcccgcaagaccuuuguggaccugaugcggcgcggggaccugccggucuggcuggccuacaagguggccgccgagggcauuaauuaugcggaucggcguuggugcuuugacgggaucaaaaacaaccaaauccuagaggagaacgucgagguggagaucuggaccaaagagggggaacgaaagaaguugaaaccacgcuggcuggaugcccgaaucuacagcgacccccuggcccugaaggaguuuaaggaguucgccgccggccggaagucccugacacugaaucuuaucacggagauggguaggcugccaaccuucaugacccagaaggcacgcaacgcccuggacaaccucgccguucugcacaccgcugaggcgggcgggaaggcguacaaccacgcccuaagugagcucccggagacgcuggagacccuguuauuguuaacauuacuggccacaguaacgggcgggauuuuccuguuucuuauguccgggaaggggaucggaaagaugacccugggcaugugcugcauaaucaccgcuagcauccugcucugguaugcgcagauccagccccacuggaucgcagcauccauaauccuggaguucuuccuaaucguguuacugauaccagagcccgagaagcagcggaccccucaggacaaccagcugaccuacguagucaucgccauccucacggucguggcagccacgauggccaacgagauggguuuccucgagaaaacgaagaaggaccuuggccucgguagcauaacaacgcaagagucggagaguaauauccucgacaucgaucugcgacccgccucugccuggacccucuacgccgucgcgacaacauuugugaccccgaugcugcgccacucgaucgagaacagcucugugaacgucucccugaccgccaucgcuaaccaggccaccguguugaugggguugggcaagggauggccccuguccaaaauggacaucggcgugccgcuccucgcgaucgggugcuacagccaggucaaccccauuacccuaacggcggcccuccugcugcucguagcgcacuacgccaucauaggccccgggcugcaggcgaaggccacccgcgaggcccagaagcgagcugcugcagguaucaugaagaacccaacgguggacggcaucaccguaaucgaucuggagccgauccccuaugacccuaaauuugagaagcagcucggccaggugaugcugcugauccucugcguaacgcagguccugaugaugcgcacuaccugggccuuaugcgaggcccucacgcuggccacgggccccaucuccacccugugggagggaaacccgggccgguucuggaauacuacgaucgccgugagcauggcgaacaucuuccgcgguuccuaccuggccggcgccggucugcuguucucaauuaugaaaaauacgaccaacacccggcgggggaccggcaauaucggcgagacgcucggcgagaaguggaagucccgccugaacgccuuaggcaagagcgaguuccagaucuacaagaagucggggauucaagaaguggaccggaccuuagcuaaggaggggaucaagcgcggggaaaccgaccaucacgcagucucgcguggcuccgcuaaacuccgcugguucguggagaggaacauggugacccccgagggcaaggucguggacuuagggugcggccgcggaggguggagcuacuacugugggggacugaagaacgugcgggaggugaaaggcuuaaccaagggcggcccgggacaugaggagcccaucccgauguccacauacggcuggaaccucgugcggcuccagagcggcguugacgucuucuucacgccgccugagaaaugcgacacccugcugugcgacaucggggaaagcucccccaacccgacaauagaggccggucggacccuccgcgugcugaaccugguagagaacuggcucaauaauaacacgcaguucugcauaaagguccugaaucccuacaugcccucagugaucgagaaaauggagacccugcagcggaaguacggaggcgcacucguccgcaauccgcugucccggaacagcacccacgaaauguauugggucaguaacgcaacggggaauaucgucucaucggugaacaugaucagccgcauguuaaucaacagguuuaccaugaagcacaaaaaggccaccuacgaacccgacguagaccugggcagcgggacccgcaacauuggcaucgagagcgaaauccccaaccucgacaucauuggcaagcggaucgagaagaucaagcaggagcacgagacgucauggcauuacgaccaggaccaccccuacaagaccugggccuaccacggcagcuaugagaccaagcagaccggaucggcuagcuccauggugaauggggugguccgccugcugacgaagccgugggacgugguacccauggucacccaaauggccaugaccgacacuacgcccuucggccagcagcgcguguucaaggaaaagguggauacccggacccaggagcccaaagagggcaccaagaaauuaaugaagaucacggcagaguggcuguggaaggagcugggaaagaagaagaccccacgcaugugcacccgggaagaguuuacccguaagguccguucaaacgccgcccucggagccaucuucacggacgaaaacaaguggaaguccgcucgggaggcgguggaggaugggcgguucugggaacuggucgaccgcgaacggaaucugcauuuggagggcaagugcgagaccugcguguacaacaugaugggaaagcgcgagaagaagcugggcgaauuuggcaaagcgaaggggagccgggccaucugguauauguggcugggcgcacgcuucuuggaguucgaagcguuaggguuccugaaugaagaccacugguuuucccggggcaacucccucagcgggguggaaggggagggccugcaucgucuggguuacauacuccgcgacgucucuaagaaggagggcggggccauguacgccgacgacaccgccggaugggacacccgcauuacgcuggaagacuugaaaaacgaggagauggucaccaaccacaugaagggggagcacaagaagcucgccgaggcgaucuuuaagcugaccuaccagaauaagguuguacggguacagcgccccacgccgagagguacggugauggacaucauuagccgccgcgaccagcgcggauccgggcaggucggcaccuacgggcugaacaccuucaccaauauggaggcucagcucauccgccaaauggagggcgagggcauauucaaaagcauucagcaccugacgguuaccgaggagaucgccgugcagaacuggcuggcccggguuggucgcgagcgccuaaccagaauggccaucucuggcgaugacuguguggugaagcccauugacgacagauucgcgaacgcccugaccgcccugaacgauaugggcaaaguccguaaggacauccaacagugggagcccucucggggcuggaacgacuggacccagguacccuucugcucccaccacuuccacgagcucgugaugaaagacggucgaguccucguuguaccuugccguaaccaggacgagcugaucggccgcgcccggaucagccagggagcuggguggucccucaaagagacagccugccugggaaagucguaugcccagauguggacccugauguacuuccaccgccgagaccucagacuggcagcuaaugcgaucugcagcgcggugccaagccacuggguaccgaccagccguaccacguggagcauacaugccaagcacgaguggaugaccaccgaggacaugcuggccguuuggaacagagucuggauccaggaaaaccccuggauggaggacaagacccccguggaguccugggaggagguucccuaucucggaaagcgagaggaucaguggugcggcucacugauuggccugacuucccgcgcaacaugggcgaagaacauccaaaccgccauuaaccaggugcggagccucauagguaacgaggaauacaccgacuacaugccgagcaugaagcgguucaggcgggaagaagaagaagccggcguccugugguga

SEQ ID NO: 24903 - RNA, 9876 nt, Artificial Sequence
  derived and/or modified CDS sequence (opt11) from DENV-2__FJ850076__SS-prME
accgccggcgccaucgugaugcugauaccgaccgucauggcguuccaccuaaccaccaggaacggggagccccacaugauaguggggcggcaggagaaggguaagucccuauuauucaagacugaggacggcgugaacaugugcaccuuaauggccaucgacuugggagagcugugcgaggacaccaucaccuacaagugcccguugcuccggcagaacgagccugaggauaucgacugcugguguaacuccacguccaccugggucaccuaugggaccugcaccaccacuggcgagcaucggcgcgaaaagcgaagcguggcccucgugccccacgucgggaugggccucgagacgcgcaccgagacuuggaugagcuccgaaggggccuggaagcacguucaaagaaucgagacguggauccugcgccacccgggcuuuaccaugauggccgcgauacuggcauacacuauugggaccacacacuuccagcgggcccucaucuucauacugcugaccgccgucgcgcccagcaugaccaugcgcugcaucggcauaucgaaccgggacuucgucgagggcgugagugggggcuccuggguagauauuguccuagagcaugggagcugcguaaccacgauggccaagaacaagccaacccuggacuucgagcugaucaaaacugaggccaaacaacccgcuacacuccgcaaguacugcgucgaagcgaaacugacgaacacuaccacggagucacggugcccgacgcaaggcgagcccagccugaacgaggagcaggacaagcgcuucaucuguaagcacuccauggucgaccguggcuggggaaacggcugcgggcuauucggcaagggagggauagugaccugcgcgauguucacgugcaagaaaaauauggaaggaaaggugguccagcccgagaaucuggaguauaccauagugauuacgccccacucuggagaggagcacgccguggggaaugauacagggaagcaugguaaggagauaaagaucacuccgcaguccagcaucacggaggccgagcugaccggguacggcacagucaccauggagugcagcccccgcaccggccucgauuucaacgagauggugcugcuucagauggaggacaaggcguggcucgugcaccgccagugguuccuggaccugccccuacccuggcuuccgggggccgacacgcagggcagcaacuggauccagaaggagacucuggucacuuucaaaaauccccaugcuaaaaaacaggacguugucguccuuggcucccaggaaggggccaugcacaccgcucugacuggggccacggaaauucagaugagcagcggcaaccuccuauucacgggccaccugaagugucgccugagaauggacaaguugcagcugaaggggauguccuacaguauguguaccggcaaauucaaaaucgugaaggagaucgccgaaacccaacacgguacgaucgucauccgcgugcaguacgagggggauggcucccccugcaagauacccuucgagaucauggaccuggagaagcggcacguguuagggcgguuaauaacugucaauccgaucgugaccgagaaggacucaccgguaaacauagaggcggagccacccuucggcgacuccuacauaauaaucgggguugagccgggccagcugaagcucaacugguucaagaaggggucauccaucggccaaauguucgagaccaccaugcgcggcgccaaacggauggccauccugggugacaccgccugggacuucggcagccucggugggguguucaccuccaucgggaaggcucugcaccaaguguucggggcaaucuacggcgcggcauucagcggggucuccuggacgaugaagauacucaucggcguuaucaucacuuggauagggaugaacagccgcagcaccucacuguccgugagccugguccucgugggcgucgucacacuguaucuaggugccauggugcaagcggacuccggcugcguugucagcuggaagaacaaggaguugaaauguggcagugggaucuucaucaccgacaacguacacacguggaccgagcaauacaaguuccagcccgaaagcccgucaaagcuggcuuccgccauacagaaggcgcaugaggaaggcaucugcgggauucggucugugaccagauuggagaaucucauguggaagcagaucacccccgagcugaaccacauccuuucagagaaugaggucaagcuuacgauuaugaccggcgacauuaagggaauuaugcaggccgggaagcggagccugagaccucagcccaccgaguuaaaauacuccuggaagacguggggcaaggcgaagaugcuccccaccgagagccacaaccagacguuccugaucgacgggcccgaaaccgccgagugccccaauaccaaccgagccuggaacucacuggagguggaagacuaugguuucgggguguucacgacgaauauuuggcucaaacugcgcgaaaagcaggacgucuucugugacagcaagcuuaugucggccgccaucaaggacaaccgcgcggugcacgccgacaugggcuacuggaucgaauccgcccucaacgauaccuggaaaauggagaaagccuccuucauugaggucaagagcugccauuggcccaagucccacacucuuugguccaacggcguucuggaguccgaaaugaucauucccaaaaacuucgccgggccggucucgcagcauaacuaccgcccgggauaccacacccagacggcggggccguggcaccucgggaaauuggaaauggauuucgacuucugcgaggggacaaccgugguggugaccgaggacugcggcaaccggggccccucccugaggacgaccacggccaguggaaagcucaucaccgaguggugcugccgcucuugcacgcugccuccccugcgcuaucgaggggaggaugggugcugguacgggauggagauccgcccccucaaggagaaggaggagaaccuagucaacagucuggugaccgcagggcauggucagauagacaacuucagucucggcgugcuggggauggcuuuguuccucgaggagaugcugagaacccgcgugggcacaaagcacgcgauacugcucgucgccguguccuucgugacgcuuauuaccgguaacaugagcuuucgggaccugggccgcgucauggugauggugggggcgaccaugaccgacgacauaggcaugggcgucacguaccuggccuuguuggccgcguucaaagugcgccccaccuucgccgccgggcuacugcuucggaaacucaccuccaaagaacugaugauggccaccauaggcguggcucugcucucucaguccacgaucccggagaccauccuagagcugaccgacgcgcucgcucuggggaugauggcacugaagaucgucaagaacauggagaaguaucagcucgccgucaccaucauggccaucagcugcgugccaaacgcgguaauccugcaaaacgccuggaaggucuccugcacgauacuggccgccgucagcgugagcccccuacugcugacaagcucacagcaaaaggcggacuggaucccccuugcgcugaccaucaagggccugaacccgaccgccaucuuccucacgacccugagccgcaccuccaagaagagaagcuggccccugaaugaggcuauaauggccgucggcauggucuccauacucgcgagcagucugcugaagaaugauguucccaugacugggccccugguggcggguggccugcugacggucugcuacgugcugaccgggcgcagugccgacuuagagcuggaaagagccgccgaugugaaaugggaggaccaggccgagauaaguggguccagcccgauccucucuauuaccauaagcgaggacggcuccaugagcaucaaaaacgaggaggaagagcagacgcugacgauccugauccgcaccggccuccuggucauaagcggaguguuucccguuagcauucccaucacggccgccgcaugguaucugugggaaguuaagaagcagcgggccggcguuuuaugggacguacccuccccgccgcccgucgggaaggcugagcucgaggacggcgccuaccgcaucaagcagcgggggauucucggcuauagccagaucggagccggggucuacaaggagggcaccuuccacaccauguggcacgugacgagaggugccguccuuaugcacagggguaagcgcaucgagccguccugggcagacgugaagaaggaccugguuaguuacgggggcggcuggaagcuagagggggaguggaaggagggggaggagguccagguccucgcguuagagcccgggaagaacccccgggccgugcaaacgaaaccaggcauauucaagaccaacacgggcacgaucggcgcggucucacuggacuucucaccgggcacauccggguccccaauaguggaccguaagggaaagguggucgggcucuacggcaacggugugguaacgcgguccggggcuuacgucagcgcgaucgcucagaccgagaaguccaucgaggacaaccccgagaucgaggacgacauuuuccguaagaagcggcugacgaucauggaccuucaccccggcgccgggaaaaccaaacgauaucuccccgccaucgugagggaggccaucaagcgcggccuucggacccugauccuggcgccuacccgcguggucgccgccgagauggaggaggcccuucgcgggcugcccauccgcuaccagacgccugcaaucagggcggagcauacuggccgcgagaucguggaccugaugugccacgcuacguuuaccaugagacuccugagcccggugcgggucccaaacuacaaccugaucaucauggacgaggcccacuucacggaccccgccagcauugccgcgcgaggcuacaucuccacccggguggagaugggggaggcagccggcaucuucaugaccgccacgccucccgggucccgcgaccccuucccccaguccaacgcccccaucauggacgaggagcgggagaucccggaacgcucguggaacucuggccacgagugggugaccgacuucaaggggaagacugucugguucgugcccagcaucaaggcuggaaacgacauagccgcgugccuccguaagaacggcaaaaaggugauccagcugucccgcaagaccuucgacagugaguaugugaaaaccagaucaaacgacugggauuucguugugacuaccgacauaagcgagaugggugcuaauuucaaagcggagcgcgugauagauccccggcgcuguaugaagccagugauccugaccgacggcgaagaacgggugaucuuagccgggccgaugcccgucacgcacuccagcgccgcgcagcgccgaggacgaaucgggcgcaaccccaagaacgagaaugaccaguauaucuacaugggcgagccacuggagaacgacgaagacugcgcccacuggaaagaggcgaagaugcugcucgauaacaucaacacgccggaggguaucauccccuccauguucgagccggaacgugaaaagguggaugccauugacggggaguaccgcuuacggggcgaggcucguaagaccuucguggaccuaaugcggcgcggggaucuaccugugugguuagccuacaagguagcagcggagggcauaaacuaugccgaucggcgcuggugcuucgacggcaucaagaacaaccagauccuggaggagaaugucgagguugagaucuggaccaaggagggcgagcgaaagaagcuuaagccacgcuggcuggacgccaggauuuacagcgacccccuggcccucaaggaguucaaggaauucgcggccggccgcaaaucccuuacccugaaccuaauaacagagauggggcgccugcccacauucaugacucagaaggcgcgcaaugcccuggacaaccuagccgugcuacacaccgcagaggccggcggcaaggcauacaaccacgccuugagcgagcucccugagacgcuggagacccugcugcuguugacccuacuggccaccgucacgggcggaaucuuucuguuccucauguccggaaagggcaucgggaaaaugacccuggggauguguugcaucaucaccgcgagcaucuugcucugguacgcgcaaauucagccccacuggaucgccgccuccaucauauuagaguucuucuugaucguucucuuaauccccgagcccgagaagcagaggaccccgcaagacaaccagcucaccuacgugguuaucgccauccuuacugugguggcggccaccauggccaacgagaugggguuccuggagaaaacuaagaaggaccuugggcucggcagcaucaccacgcaggaaagcgaauccaacauccuagauaucgaccugcgccccgcgagugccuggacucucuacgcuguagccaccacguuuguuacgcccaugcugcggcacuccaucgagaauagcucagugaacgucagccugaccgccauagccaaucaggcgacagugcucauggggcugggcaagggauggccccuguccaagauggacauaggcguuccucuacuggccaucgguuguuacucgcaggucaacccgaucacccugacggccgcacuuuuauuacucgucgcccacuacgcgaucaucggcccgggccugcaagccaaggccacucgcgaggcgcagaagcgugccgcggcgggcauaaugaaaaaccccacuguggacgguaucaccgucauugaccuggagccgauacccuacgaccccaaguuugagaagcagcucggccaggugaugcugcugauucucugcgugacgcagguccugaugaugcgcaccaccugggcccugugcgaagcccucacccuggccacuggucccaucuccacgcucugggaggggaacccgggccgguuuuggaacaccaccaucgcggugagcauggccaacaucuuucggggcucauaccucgccggggcgggauuacuguucagcaucaugaaaaacacgaccaacacccggcggggaacugguaacauaggcgaaacgcucggggagaaguggaagucccgccugaacgcgcugggcaagagcgaguuccagauuuacaagaaguccgggauucaggagguggaccggaccuuagccaaggaagguauaaaacgcggggagaccgaccaccacgccgucagccgggguucagcaaagcugcgcugguucguggagcggaacaugguuacccccgagggcaaggucguggaccugggaugcggacgcgggggcuggagcuacuacugcgggggccucaagaacgugcgggaggugaagggccugacgaagggcgggcccggccacgaagagcccaucccaauguccaccuaugguuggaaucuggugcgucuucagucggggguggacgucuucuucacgccccccgaaaagugcgacacccugcugugcgacaucggggagucuucccccaacccgacgaucgaggcgggccggacccuccgggugcucaaccugguugagaacuggcucaacaacaacacccaguucugcaucaaagucuugaaccccuacaugccuagugugaucgaaaaaauggaaacacugcagcggaaguacgggggcgcacucgugcgaaacccgcuguccagaaacagcacgcacgagauguacugggugagcaacgccacggguaacaucgucagcuccgugaacaugaucagccgcaugcugauuaaccgcuucacuaugaagcacaaaaaggccacauacgaacccgacgucgaccucggcuccgggacucgcaacauaggcaucgagagcgaaauacccaauuuagauaucaucggcaagcggaucgagaagaucaaacaggaacacgagacgagcuggcacuacgaucaggaccacccguacaaaaccugggcuuaccacggaagcuacgaaaccaagcaaaccggauccgccagcuccauggugaacgggguaguccgauuauugacgaaaccgugggauguggugcccauggucacccagauggcaaugaccgacaccacgcccuucggccagcaacgcguguucaaggaaaagguggacacccggacccaggagcccaaggagggcaccaagaaacucaugaaaaucaccgccgagugguuguggaaggaguugggcaagaagaagacuccgcgcaugugcacccgggaagaguucacccgcaagguccggagcaaugccgcucucggcgccaucuucacggacgagaacaaguggaaguccgcgagagaggccgucgaggaugggcgguucugggaauuggucgaccgcgagcgcaaccugcaccucgagggcaagugcgagaccugcguguacaacaugauggggaagcgugagaagaaacugggcgaguuuggcaaggcgaaggggagccgggcuaucugguacauguggcugggugcacgcuuccucgaguuugaagcucugggguuucugaacgaagaccacugguucucgcgaggcaacagccugucugggguggaaggcgagggccugcaccgccuuggguauauacuccgugacgucuccaagaaggaagguggggccauguacgccgacgacaccgccggcugggacacccgcaucacccuggaggaccugaagaacgaggagauggugacuaaccacaugaagggggagcacaagaagcuugcggaggccaucuucaagcuaaccuaccagaacaaggugguccgggugcagcgcccaacgcccagaggcaccgugauggacauuaucucacgccgggaccagcgcggcuccgggcaggucggcaccuacgggcugaacacauucaccaacauggaggcgcagcucauccgccagauggagggcgagggcauuuucaagagcauccagcaccugaccgugacagaagagaucgccguccagaacugguuagcccggguagggcgcgagcggcucacccgcauggcgaucuccggcgacgacugcguggugaagcccaucgaugaccgcuucgccaacgcccucaccgcccugaacgacauggggaaagugagaaaagacauccagcagugggaaccgagccgcggcuggaacgacuggacccaggugcccuucugcucccaccacuuucacgagcucgugaugaaggacggccgcguacugguugugcccugccggaaccaggaugagcugaucggccgugcccggaucagucagggggcgggguggucacucaaggagaccgccugccugggcaaaucauacgcccagauguggacccuuauguauuuccaccgccgggaccuccgccucgccgcaaacgcgaucugcucagccguccccucacacugggugccgaccucgcguaccacguggagcauccacgccaaacacgaguggaugaccaccgaggauauguuggcuguguggaaccgcgucuggauccaggagaaccccuggauggaggauaagacgcccguggaauccugggaagaggugcccuaucuggggaagagagaggaucaguggugcggcagccugaucggccugacaucgcgcgcgaccugggccaagaacauacagaccgccaucaaccagguccggagccuuauugguaacgaggaguacaccgacuacaugcccagcaugaaacgcuuccgcagagaagaggaggaggcuggcguucugugguaa

SEQ ID NO: 24904 - RNA, 9876 nt, Artificial Sequence
  derived and/or modified CDS sequence (opt11) from DENV-2__GQ868640__SS-prME
accgcaggcgccauagucaugcugauucccacuguaauggcguuccaccucacgacccgcaacggggaaccucacaugauugugggacggcaagagaaggggaagucccugcuguucaaaaccgaggacggggugaacaugugcacccucauggccaucgaucugggugagcugugcgaggacaccauuaccuacaagugcccccugcugcgacagaacgagcccgaagacauugacugcuggugcaacagcaccuccaccuggguuacuuacgggaccugcaccacuacuggugagcaccggcgcgagaagcgauccguggcccuggugccccaugucggaaugggauuggagacgcgcaccgaaaccuggaugagcuccgaaggggcuuggaagcacguccagcggaucgagacuuggauacugaggcacccugguuucaccaugauggccgcuauacuggcauacacaauugggaccacccauuuccagcgggcucugaucuucauccuccuaaccgccguagcaccgagcaugaccaugcgcugcaucggcauaucuaaucgugacuuugucgagggcgucucugguggcuccugggucgacaucguccuugagcauggguccugcgugaccaccauggccaagaacaagcccacacuggauuucgagcugaucaaaacggaggccaaacaacccgccacccugcgcaaguacugcguggaggcuaagcugacgaauaccaccaccgagagucggugcccgacgcagggggagccaucgcugaacgaggagcaggacaaacgcuucauaugcaaacacucuauggucgauagagguugggggaacgggugcggucucuucgguaagggugggaucgugaccugcgcuauguucaccugcaaaaagaacauggagggcaaggugguacagcccgaaaaccuggaguacaccauagugauuacuccccauucaggggaagagcacgcaguaggcaacgacaccgggaagcacggcaaggagaucaagauuaccccccaauccagcauaacagaggccgagcucacuggguaugggacggucaccauggagugcagcccccgcaccggguuggacuucaacgagaugguguuguuacagauggaggauaaggccuggcucguacaccggcagugguuccucgaccuuccccuaccuugguuaccgggggccgauacucagggcuccaacuggauccagaaggagacgcuagugaccuucaagaacccccacgcgaagaagcaggacguggucguacuagggucccaggagggugcuaugcacaccgcucugacgggggccacggagauccagauguccagcggcaaucuccucuucaccggucaucugaagugucgccugcggauggacaaguuacagcugaaggggauguccuauaguaugugcacaggcaaguucaagaucguaaaggagaucgcggagacccagcacggcacgaucgucauccggguacaguacgaaggcgacgggagccccugcaagauucccuucgaaaucauggaucuagagaagaggcacguguugggacgccuaaucaccgucaacccgauugugacugagaaggacagccccgugaacaucgaggcggagccgcccuucggugacucuuacaucaucaucggugucgaaccaggccagcugaagcucaacugguucaagaagggcucuaguauuggccagauguucgaaaccacgaugcgcggcgcgaagcggauggccauccuuggggauacggccugggacuucgguagccucggagguguauucacuuccaucggaaaggcccuucaccagguguucggggcuauauacggagcggccuucaguggggucuccuggaccaugaaaauccugaucggcguaaucauuacguggauuggaaugaacagccgcuccaccagccuguccguaucgcuggugcucguggguguuguaacccucuaccuuggggcgauggugcaggcagacucagguugcguggucagcuggaagaacaaggagcuuaagugcggcuccgggauauucauuacggacaacguucauacguggacggagcaguacaaguuucagccggaaagcccuucgaagcuggccagugccauccagaaggcccacgaggagggcaucugcgggauacggagcgugacccgccuggagaaccucauguggaagcagaucacccccgagcugaaucacaucuugucggagaacgaggucaagcucacgaucaugacgggcgacaucaaagggauuaugcaggccgggaagcgcagccugcgaccccagccuaccgagcuaaaauauucuuggaaaaccugggguaaagcgaagaugcucccuacugaaagccauaaccagaccuuucuaauagaugggccggagacggccgagugccccaacaccaaccgagcguggaacucucuggagguggaggacuacggguuugggguauucacgacaaacaucuggcucaagcugcgcgagaagcaggaugucuucugcgacagcaagcugauguccgcugcgaucaaggacaacagggcggugcacgcugacaugggcuacuggauugagagcgcccucaacgauacguggaagauggagaaagccuccuucaucgagguuaagagcugucacuggcccaagucccacacccuauggaguaacggcgugcuggaguccgaaaugaucauccccaagaauuucgccgggccgguuagccagcauaacuaccgccccggcuaucacacccagacggcggggccguggcaccucggcaaacucgagauggauuucgacuucugcgaagggacuacagucguugucaccgaggauugcggcaaccggggcccaagccugaggacgaccacggccucuggcaagcucaucacggaguggugcugucggagcuguacguuaccuccucugcgcuaccggggcgaggacggguguugguacgguauggagaucagaccucucaaagagaaggaggagaaccuggucaauucgcuaguaacugccgggcauggucagaucgacaacuucucucucggcgugcuggggauggcgcuguuccuagaggagaugcugcguacacgcgugggcaccaagcacgcaauccuacucgucgcuguuuccuucguuacacugaucacggggaacaugucguuccgagaccuaggacgcgucauggucauggugggggccacuaucacagacgacauaggcaugggcguaacguaccucgcgcucuuggcggcguucaaaguucgaccaaccuucgccgccgggcuacugcugcgcaagcucacguccaaggaacucaugauggcuaccauagguguggccuuguuaagccaaucaacuaucccagagaccauccuggagcuaacugaugcccucgcguuggguaugauggcacugaaaauaguuaagaacauggagaaguaccaauuggcgguuaccaucauggccaucagcugcguuccgaacgcgguaauucugcagaacgcuuggaaggugucgugcacgauacuggcagccguauccgugagcccacuccugcugacgagcucccagcagaaggccgauuggaucccacucgcauugacaauaaaaggucugaacccgacagccauuuuccucacgacucucucgcgcacgaguaagaaacgaagcuggccauugaaugaggccaucauggcugugggcaugguguccauacuugccucuucccuuuugaaaaacgacguacccaugaccgggccccucguggcuggcgggcuguuaacaguuugcuacgugcucaccggccgcagcgccgauuuagagcuggagcgggccgccgaugugaagugggaggaccaagcggagaucagcggguccuccccaauucucuccauaaccaucucagaggacgguuccaugagcauaaagaacgaagaggaggagcagacacugaccauccugauccgaaccggccugcuggucauuagugggguuuucccuguaagcauacccaucaccgccgccgccugguauuuaugggaggucaagaagcagcgggccggggugcucugggauguucccuccccaccucccguuggcaaggcggagcuggaagauggcgccuacaggaucaagcaaagaggaauccugggcuacagccagauaggugcagggguuuauaaggagggcacauuccacacuauguggcacguaacgcgcggggcugucuuaaugcacagaggcaagcgcauugagccguccugggccgacgugaaaaaggacuuaguguccuacgggggcggcuggaagcuagagggggaguggaaggagggcgaagagguacagguguuagcccuggagcccgggaaaaacccacgggccgugcagacgaaacccggcaucuuuaagaccaacaccgggacuaucggcgccgucucccuagacuucucacccggcaccuccgggagccccauuguggaccgaaagggcaaaguagucggauuguacgguaacgguguagugacgcggaguggcgcguacguuagcgcuaucgcccaaacugagaaguccauugaggauaaucccgagaucgaggacgacaucuuccgcaagaagcggcugacaaucauggaccugcacccuggagccgggaagaccaaacguuaccucccagccauugugcgggaggccaucaaaaggggacuucgaacccugauccuagcgcccacccgcguugucgccgcggagauggaggaggccuuacgcgggcugcccauucgguaccagacacccgccauccgcgccgagcauaccggcagagagaucguggaccugaugugccaugcaacauucacuaugcgcuugcugagcccugugcgggugcccaacuacaaucugauuaucauggacgaggcccauuucacggaccccgcaagcauagccgcucggggcuacauauccacccggguggagaugggggaagccgccggcaucuuuaugaccgccacgccgcccgggucgcgcgacccuuuuccccaaagcaacgccccgauuauggacgaggagcgggagauacccgaaaggagcuggaauuccggccaugaguggguuacggacuucaagggcaagaccgucugguucguaccgucaauuaaggccggcaacgacaucgccgccugccugcggaagaacggcaagaaagugauccagcugucccggaagaccuuugacagugaguacgucaagacgcgguccaacgacugggacuucguggugacgaccgacaucagugagaugggcgcgaauuucaaagcggagagggucauugauccccggcgcugcaugaaacccgugauccugacugacggcgaggaacgagucauccucgccggccccaugcccguaacgcacuccucugccgcccagcgccggggcagaaucgggcgcaaccccaaaaacgagaacgaucaguacauuuauaugggugagccccuggagaaugacgaggacugcgcgcauuggaaggaagcgaaaaugcugcucgacaacaucaauacgccugaaggaaucauccccagcauguucgagcccgagcgggaaaaaguggacgcuaucgacggggaauacagacugcguggugaggcccgcaaaacauuuguggaccuuaugcgccgcggggaccucccugucuggcuggcuuauaaggucgcugcggagggcauuaauuacgccgaucggcgauggugcuucgaugggauuaagaacaaccaaauuuuggaggagaauguagagguggagaucuggaccaaggaaggggaacgcaagaagcucaagccacgcuggcuggaugcccggauuuacagcgauccccuugcccucaaagaguucaaggaauucgccgccggccgcaaaucccugacccugaaccucaucacggaaauggggcggcugcccaccuucaugacccagaaagcacguaacgcucuggacaaccuugcaguguuacacaccgcugaggccggcgggaaggcauacaaccacgcucuaagugaguuaccagaaacccuggagacccugcuccugcuuacucuccuggcaacggucaccggcggcauuuuuuuauuccucaugucaggcaagggaaucgggaagaugacccuggguaugugcugcauuauaaccgccagcauccugcucugguacgcccagauccagccccacuggaucgcggccuccaucaucuuagaguucuuccugauaguccuuuuaauucccgagcccgagaaacagagaacaccgcaagacaaccagcugaccuacguggucauugccaucuugacgguuguggcggccaccauggcaaacgagaugggcuuccuggaaaagacuaaaaaagaccugggacucgguagcaucacgacccaagagucugaguccaauauccuggauauagaucugcguccggccuccgccuggacccucuaugcuguugcgaccaccuucguaacgccuaugcuucggcacuccauagagaacucgucggugaacgucagucugacggcuauugccaaccaggcuaccgugcucauggggcugggcaaaggcuggccccucuccaagauggacaucggcgugccgcuccuggccauugggugcuacucgcaggucaacccaauuacccugacggccgcgcuccugcugcucgucgcacacuacgcgaucauugguccuggcuuacaggccaaagcuacccgggaggcacaaaagcgagcugccgccgggaucaugaagaaccccaccguggacggaaucaccgucaucgaccuggaaccaauccccuaugaccccaaguucgagaaacaguuaggccaggugaugcugcugauccuuugcgugacgcaggucuuaaugaugaggaccacaugggcccugugcgaggcucucacccuggccacagguccgaucuccacccugugggagggcaacccuggccgguucuggaacacuaccaucgcggugaguauggccaacauauuccgcggcuccuaccucgccggugccggccuguuauuuuccaucaugaagaauacgaccaauacccgccgcgggacggguaacaucggcgagacgcucggagagaaguggaagucccgccugaacgcgcuggguaagagcgaguuccagaucuacaagaaauccggcauucaggaaguagacaggacccucgccaaggagggaaucaaaagaggggagacagaucaccacgccguuagucggggcuccgcuaaauugcgaugguucguagagagaaacauggucaccccugagggcaaggucguggaucuggguugcggccgagggggcuggagcuacuauugcgguggccucaagaacgugcgggaagucaaaggccugacgaagggcggccccggucacgaagagccuauuccaauguccacuuacggguggaacuugguccgccugcagagugggguggacgucuucuucacgccccccgaaaaaugcgacacccugcucugcgacauuggcgaaaguucucccaacccaacaaucgaagcaggacggacgcuccgcgugcuaaaccuuguggagaacuggcucaacaauaauacgcaguuuugcaucaaaguucugaaccccuacaugcccagcgugauugagaagauggagacccuacaacguaaauaugggggcgcucuuguacggaauccgcuaucgcgaaauaguacccacgagauguacugggucagcaacgccacaggcaauauaguguccuccgugaacaugaucagcagaaugcugaucaaccgguucaccaugaagcauaaaaaggccaccuacgagccggauguagaccugggcucuggcacccgcaacauugguaucgagagcgagaucccaaaccucgacauaauaggcaagagaaucgaaaagaucaaacaagagcacgagacuuccuggcauuacgaccaggaccacccuuacaaaaccugggccuaccaugggagcuacgaaaccaagcagaccggauccgccagcucaauggugaaugguguggucaggcuccucaccaagccgugggacguagugcccauggucacacagauggcgaugacagacaccacgcccuucggccaacagcgcguauucaaggaaaaggucgacaccaggacccaggaacccaaggagggcaccaagaaacucaugaagaucacggccgaguggcuguggaaagaacuugggaagaagaagaccccgcggaugugcacgagagaggaauucacucggaagguccggucuaacgcggcgcucggcgcaauuuucacggacgaaaauaaguggaaguccgcgagagaggcuguggaggacgggcgguuuugggaacucgucgacagggagcguaaccugcaccucgaagguaagugcgagaccugcguguacaacaugauggggaagagggagaagaagcugggcgaguucggcaaagccaagggcagccgggccaucugguacaugugguuaggcgcgcgcuuucucgaauuugaggccuuaggguuccugaacgaagaccacugguucucaaggggcaacagccucuccggaguugagggcgagggccuacaucgccugggguacauuuuacgggaugucucuaagaaagaagggggggccauguacgcggaugacaccgcaggcugggacacgagaauuacgcuggaagacuugaagaacgaagagaugguuaccaaccacaugaagggggagcauaagaagcuugcugaggcaaucuucaagcugaccuaccaaaacaaggugguccgggugcagcgcccuacccccagaggaacugugauggacauaaucucgagacgggaccaacgaggcaguggacaagucgggaccuaugggcuuaauaccuuuaccaauauggaggcucagcucauacgccagauggagggggaggggaucuucaagagcauccagcaucugacggugacggaagagaucgccgugcaaaacuggcuggcccgggucggccgagagcggcucaccaggauggcgaucuccggcgacgacugcgucgugaagcccaucgacgaccgguuugccaacgcccucaccgcccuaaacgacauggguaagguccgcaaggacauucaacaaugggaaccgagccgcggcuggaacgacuggacgcaggugcccuucuguucccaccacuuccacgaacucgugaugaaggacgggcgugucuugguggugccgugccggaaccaggacgagcuuaucggccgcgcgagaaucagucaaggcgccggguggucccucaaggagaccgccugucuggguaagagcuacgcgcagauguggacgcuuauguacuuccaccgccgcgaccucagacuugccgccaacgcgauuugcucugccguccccucucacugggugccuaccucccggaccacguggagcauacacgccaaacacgaguggaugaccaccgaggauaugcuugccguauggaaccgcgucuggauccaggaaaauccguggauggaggauaagacccccguggagagcugggaggagguccccuaccuagggaagcgggaagaccaguggugcggcagcuuaaucgggcugacgucccgcgccaccugggccaagaacauccagaccgcaaucaaucagguacggagccucauaggcaacgaagaguacacagauuacaugccaagcaugaaacgcuuccgucgugaggaggaggaggccgguguguuaugguag

SEQ ID NO: 24905 - RNA, 9876 nt, Artificial Sequence
  derived and/or modified CDS sequence (opt11) from DENV-2__FJ850078__SS-prME
acugccggcgugaucgucaugcugauaccuaccgugauggcuuuccaccucaccacccgaaacggggagccccauaugauaguaggccggcaggagaaggguaaaucccugcuauucaagacggaggacggcguaaacaugugcacccucauggcgauagaccugggagaacugugcgaggauaccaucacauacaagugcccgcuccugagacaaaacgagcccgaggacauugacugcugguguaacagcaccaguaccuggguuaccuacgggaccugcaccaccacgggggaacaccggcgcgagaagcgguccguggcccuugucccccauguggggaugggccuggagacacgcaccgagacuuggaugagcucggagggggccuggaagcacguucaacggaucgagaccuggauccuccgccacccuggcuucaccaugauggcugccaucuuggcguacaccaucgggaccacgcacuuccagagggcacucauauucauccugcugaccgccgucgcucccagcaugaccaugcgcugcaucgggaucucuaaccgggacuuuguugagggcgugagcgggggguccugggucgacauagugcucgagcacgggagcugugugaccacgauggcaaaaaacaagcccacccuggauuucgagcugaucaaaaccgaggccaaacagcccgcaacacucaggaaguacugcgucgaggccaagcucacgaacaccaccaccgagucccguugcccgacacagggugagcccagccuaaacgaagagcaagacaagcgcuucauuugcaagcacuccaugguggaccggggcugggguaacggcugcgggcuuuucggaaagggcggaaucguaaccugcgccauguucacuugcaaaaagaauauggaagggaaaguggugcagccugagaaccucgaauacacuaucgugaucacaccccacagcggagaggagcaugcggucggcaaugacacuggaaagcacgguaaggagaucaagaucacuccgcagaguuccauaaccgaagcugagcuuaccgguuacggcacggugaccauggagugcucuccccguaccggccuggacuucaaugagauggugcuguuacagauggaggacaaggccuggcucgugcaccggcaaugguuccuggacuugccgcuucccuggcuuccgggggccgacacgcagggcaguaacuggauacagaaggagacgcuggugaccuucaagaacccacacgcuaagaagcaggacgugguugugcucggaucccaggagggcgcgaugcacaccgcccugacaggggcaacggagauccagaugagcagcggcaacuugcuguucaccggccaucugaagugucgccugagaauggacaagcugcagcucaaagggauguccuacagcaugugcacuggaaaauucaagaucgucaaggaaauugccgagacccagcacgguacgaucgucauccgagugcaguacgagggcgacggauccccaugcaagaucccauuugagaucauggaucuggagaagcggcacguccuggggcgccugauaacaguaaacccgaucguaaccgagaaggauucacccgucaacaucgaggccgagccgcccuucggugacuccuacaucaucguggggguggaaccgggccagcugaaacucaauugguucaagaaaggaucuucuaucggccagauguucgagaccacgaugcgcggggcuaagcggauggccauccugggugacacagccugggauuucgggagccucggaggugucuucaccuccauuggcaaggcccuccaccagguauucggugcaauuuacggugcagccuucaauggagugagcuggaccaugaagauccuuauaggugucaucaucacuuggaucgggaugaacuccaggagcaccucccugucagugagccugguacucgucggagucgugacccuguaccugggggccaugguacaagcagauaguggcugugugguguccuggaagaacaaggagcucaagugcggaagcgguaucuucauaaccgacaacguucauacguggaccgagcaguacaaguuccagcccgagucccccagcaaacuggcaagcgcuauucagaaggcccaugaggagggcauaugugguauccgguccgucacgcgccuugaaaacuugauguggaaacagaucaccccagagcuaaaucacauccugucugagaaugagguaaaguuaacgaucaugacuggcgacaucaaggggaucaugcaagccgggaaacggucccugcgcccgcagccuacggagcucaaguacucuuggaaaaccugggguaaggccaagaugcuccccacggagucccacaaucagaccuuucucaucgauggcccggaaaccgcggaaugccccaacgccaaccgggccuggaacagccuggaggucgaggacuacggcuucgggguguucaccacgaauaucuggcucaagcugagggagaagcaggacguauucugcgacaguaaauugaugagcgcagcuauuaaggacaaccgugcgguccaugccgacaugggguacuggaucgaguccgcccucaacgacaccuggaagauggagaaggccucuuucaucgaggucaagucaugccauuggcccaagucacauacccugugguccaacggcgugcuggagagcgagaugaucauccccaagaacuucgccgggcccgucucccagcacaacuacaggcccggcuaccacacccagacagcggggcccuggcaccucggcaaacuggagauggauuucgauuuuugugaggggacuacugugguggucacagaggacugcggcaaccggggccccucucucaggacaacaaccgccucagggaaguuaauaacagaguggugcugccggagcugcacccugccgccccugcgcuaccggggcgaggauggguguugguacgggauggagauccgcccccucaaggagaaggaggagaaccuggucaacagucuggugacugccgggcacggccagauugauaacuucagucuaggcgugcuggggauggcccucuucuuagaagagaugcugcggaccagggugggcacgaagcacgcgauccugcucguggccgugagcuucgugacccucauaacggguaacauguccuuccgggaucugggcaggguaauggucauggugggggccaccaugaccgaugacaucgggaugggcgugaccuacuuggcccugcuagcugcguucaagguacggcccacguucgccgcagggcuccugcugcgaaaacucacaagcaaggagcugaugauggccacuaucggcguggcccuucucucccagucaacaauaccggagaccauccuggagcugaccgacgcgcucgcccucgggaugauggcguuaaagaucguaaagaacauggaaaaguaccaauuggccgucaccaucauggccaucuccugcgugccaaaugcuguaauccugcagaacgccuggaaggugucgugcaccauccuggccgccguguccgucagcccccucuuguuaacgucaucacagcagaaggccgacuggaucccccucgcccugacgaucaagggucugaaucccaccgcgaucuuccucaccacgcugucccgcacaaguaagaaaaggagcuggccccugaaugaggccgugauggccgucggcauggucagcauccuggcaaguagccugcugaagaacgauauccccaugacggggccccucguggcuggcggacugcugaccgugugcuacguccucacgggccgcucggcagaccuggagcucgagagagccgcugacgugaagugggaggaccaggcugaaauaagcggguccuccccgauucucuccaucacuaucucugaggacggcucgaugucaaucaagaacgaggaggaggagcagacgcugaccauucucaucaggacggguuuguuggugauaaguggaguguuccccguuuccauccccauuaccgccgccgccugguaccuuugggaggugaaaaagcagcgggcuggcguccucugggacgugccuagcccgccgcccguggagaaggcggagcuggaggacggggccuaucgcauuaagcagcggggcaucuuaggguacagccagaucggagcuggcgucuacaaggaagggaccuuccacaccauguggcacgugacccgcggcgcgguguuaaugcaccgggguaagcgaaucgagccguccugggccgacgucaagaaggacuuggugucguacggcgggggcuggaagcuggagggagaguggaaggagggggaggaagugcagguccucgcgcuggaacccgguaaaaaccccagagccguccaaacgaaacccgggaucuucaagaccaacacuggcaccaucggagcagucucacuggacuuuuccccggguacgagcggcagucccaucgucgaccgcaagggaaaggucgugggccuauacggcaacggcgucgugacuagaagcggagccuacguguccgcuaucgcgcagaccgaaaaguccaucgaggacaaccccgagaucgaggacgacaucuucagaaagaagcgccugaccaucauggaccugcacccaggggcgggaaagacgaagcguuacuuaccggcuaucguccgggaggccauuaagcgcggauuaagaaccuugauccuggcgccgacacgcguggucgccgccgagauggaggaggccuugaggggccuucccauucgguaccagacccccgccauacgcgcggagcacacggggagggagaucguugacuugaugugccacgcaacguucaccaugcgcuuacugucacccgugagggugcccaacuacaaccugaucauaauggacgaggcccacuuuacggaccccgccagcaucgccgcgcgcggguacaucucuacucgggucgagaugggggaagccgcugggaucuuuaugacagccacgccgcccgggucccgcgaccccuuuccccagucuaaugcgccgaucauggacgaagagcgggagauacccgagcgcuccuggaacagcgggcaugagugggucaccgacuucaagggcaagacggugugguucguccccucuauaaaagccgggaacgacauagcggcuugccuccguaagaacggcaagaaggugauccaguuaucgcgcaagacuuucgauuccgaguacgugaagacucggagcaacgacugggauuucgucgugaccaccgacaucagugagaugggugcaaacuucaaggccgagagggugaucgaccccaggcgcugcaugaagcccgucauacuaaccgauggggaggagagagugauccucgccggaccgaugccggugacccacagcuccgccgcucagcgccggggucgcauuggccggaauccuaaaaaugaaaacgaccaguacaucuacaugggcgagccccuggaaaaugaugaagacugcgcccacuggaaggaagcuaagaugcuacucgacaacaucaacacaccggaaggcaucaucccuagcauguucgagcccgagcgggaaaaggucgacgccaucgacggcgaguaccgacugcgcggggaggcccggaagacguuuguugaccugaugcggagaggcgaccucccgguuuggcuggccuacaagguugccgcggaggggaucaauuacgccgaucgacgauggugcuuugacggcaucaagaacaaucagauccuggaagagaacguggaggucgagauauggaccaaggagggagagcggaaaaagcugaagccccgcuggcuggacgcgagaauauacucagacccucuggcccucaaggaguuuaaggaauucgcggccggccgcaaaagcuugaccuugaaccucaucaccgagaugggucggcugcccacguucaugacccagaaggccagaaaugcauuagacaaccucgccgugcuccacacugcggaggcugggggcaaggcuuacaaucaugcucuuuccgagcuuccugagacccuggagacgcugcucuugcugacgcuucuggccacagugaccgguggcauauuccucuuuuuaaugucuggcaaggggaucggcaaaaugacgcuggggaugugcuguaucaucacagcguccaucuuacugugguaugcccaaauccagccccacuggaucgccgccucgauuauccuugaauuuuuccugaucgucuuacugaucccugagcccgaaaagcagcgcacaccgcaagacaaccagcugaccuacguugucauagccauccucaccguaguggcggccacgauggcuaacgaaauggguuuccuggagaagaccaagaaggaccuggguuuaggcaguaucaccacccaagagucggagagcaacauccuggacauugaccugcgccccgcauccgccuggacccuguacgcgguagccaccaccuucgucacacccaugcuacggcacucaaucgagaauuccagcgucaacguaucguuaacggcaaucgccaaccaagcgaccguccuuaugggccuggggaaggguuggccacugagcaagauggacaucggcgugccgcuccuggcuauuggcugcuacucccaggugaacccgauuacccugacggcggcgcuccugcugcucgucgcccacuacgcgauuauuggccccggcuugcaggccaaggccacgcgcgaggcgcaaaagcgggccgcggcagggauuaugaaaaaccccaccguagacgggaucaccgugaucgaccuggagccgauucccuacgacccgaaguucgagaagcagcucgggcaggucaugcuccuaauucuuugcgugacccagguacucaugaugcgcacgaccugggcccugugcgaggcccucacucuggccacagggcccaucucgacgcucugggagggcaauccggggagauucuggaauaccaccauagcugucuccauggcgaacauauuuagagggucuuaccucgcuggggcaggguugcuguucucuauaaugaagaacaccaccaacacccgccggggcaccgggaacaucggugaaacccucggcgagaaguggaagagccgccugaaugcucuggguaaguccgaguuccagaucuauaaaaaguccggcauccaggagguagaccgaacgcucgccaaggagggaauuaagcgcggcgagacugaccaccaugccguuucacgggguucagccaaguuacggugguuugucgagcggaauauggugacacccgagggcaagguugucgaccugggaugcgggcguggcgguugguccuacuacugcggcgggcuuaagaacgugagggaggugaagggccucacccgcgggggccccggccaugaggagccgaucccuauguccacguauggguggaaccuggucagacuccaguccggcgucgacgucuuuuucacgccccccgagaaaugcgacacccugcugugcgacaucggggaguccucccccaacccuacgaucgaggccggccgaacccuccgagucuuaaaccuaguggagaacuggcucaacaacaacacgcaguucugcauaaaggugcugaacccguauaugcccuccgucaucgagaaaauggagacccugcagcgcaaguacggcggggcgcugguucggaacccgcugagccgcaacuccacgcacgaaauguauugggugagcaacgccaccggcaacaucguaucgagcgugaacaugaucucacggaugcugaucaaucgcuucacuaugaagcacaagaaggccaccuacgagcccgacguggaccuggggagcggcacccgaaauauugggaucgaguccgagaucccaaacuuggauaucauaggcaagcgcaucgagaagaucaagcaagagcaugagacgucuuggcacuaugaucaggaccacccauacaaaacaugggcuuaucacggaucguacgagaccaagcaaaccgggagcgcguccagcauggucaacggcguggugcgccugcugaccaaaccuugggaugucguacccauggugacgcagauggcaaugaccgacacaacccccuucggccaacagcgcgucuuuaaagaaaaggucgacacccgcacccaggagcccaaggaggguaccaaaaagcucaugaagaucaccgcagaguggcuguggaaggaacugggcaagaagaagacgccgcggaugugcacccgcgaggaguucacccggaagguccgcuccaacgccgcauugggggccauauucaccgaugagaacaaauggaaguccgcgcgugaggccguugaggacggacgcuucugggagcucguggaccgggagcgcaacuuacaccucgaggggaagugugagacgugcguuuauaauaugauggguaagcgggagaagaagcugggggaauuugguaaggccaagggcucccgcgccauaugguacauguggcugggagcgcgguuccucgaguucgaggcgcugggcuucuugaaugaggaccacugguucagccgcgggaacucccuaagcggcguggagggggagggccugcaccggcugggcuacauccuccgcgauguaagcaagaaagagggcggcgcgauguacgccgaugacaccgccgggugggacacgagaaucacccuggaggaccugaagaacgaggagaugguuacuaaccacaugaagggagagcacaagaagcuggcggaggcgauuuucaagcugaccuaccagaauaaaguggucagggugcagcggccuacgccccgugggaccgugauggacauaauuucccggcgcgaucaaagaggaagcggccaggugggcacuuauggccugaacacguucacuaauauggaggcucagcucauccgacagauggagggcgaaggaauauucaaguccauucagcaccugaccguaaccgaggagauagcagugcaaaacuggcuugcccgcgucgggcgggagcgccugacuaggauggcaaucaguggggacgacugcgucgugaagcccaucgaugaccgcuucgcaaacgcccugacggcccugaaugacaugggcaaagugcggaaggacauccagcagugggagccgucccguggguggaaugacuggacccaaguccccuuuugcagucaccacuuccacgagcucgugaugaaggacggccgggugcuagucgugcccugccggaaucaggaugagcugauugggagagcccgcaucucccagggcgccggauggagccucaaagagaccgccugccuagggaagucuuaugcacaaauguggacccugauguacuuccaccggagagaccuucggcuggcagccaaugcaaucugcagcgccgugcccucccacugggucccgacuagcagaaccaccuggucuauucacgccaaacacgaauggaugacgaccgaggacaugcucgcaguauggaaccggguguggauccaggaaaaccccuggauggaggauaaaacccccguugagagcugggaggaggugcccuaccucgggaaacgcgaggaccaauggugcgggucccugaucgguuuaacgagccgggcgaccugggccaagaacauacagaccgccaucaaccaggugcgaucccuuaucgggaacgaggaguacaccgacuacaugccaucuaugaagcgcuuccggcgagaggaggaggaggccggcguccugugguaa

SEQ ID NO: 24906 - RNA, 9876 nt, Artificial Sequence
  derived and/or modified CDS sequence (opt11) from DENV-2__FJ850082__SS-prME
accgugggcguaauugugaugcucauucccacggccauggcuuuccaccucaccacccgcaacggugagccccacaugaucgugggccggcaagagaaggggaagucccugcuguucaagaccgagaacggcgugaacauguguacccucauggcgauagaccugggggaacugugugaggacacgaucacguacaagugcccgcuccugagacagaacgaacccgaggacaucgauugcuggugcaacuccaccagcaccugggugaccuacgggaccugcaccaccacgggcgagcaccggagggagaagcggucaguggcccuggucccccacguggggaugggccucgagacccgcaccgagaccuggaugagcuccgagggggccuggaagcacgugcagcggaucgagacauggauccugcgccacccaggguuuaccaucauggcugccaucuuagcguacaccaucgggaccacgcauuuccagcgggcccucaucuucauccugcugaccgccgucgcccccagcaugaccaugcgcugcaucggcaucuccaaucgggacuucguggagggcguuagcgggggcucuuggguggauaucguccucgagcacgggucuugcgugaccacgauggcaaagaacaagccaacccuggacuucgagcugaucaagaccgaggcuaagcagccagccacacuccggaaguacugcgucgaggccaagcugacaaacaccaccaccgagucccggugccccacgcagggugagcccagccugaacgaggagcaggacaagcgcuucaucugcaagcacuccaugguggaccggggcugggggaacggcugcgggcuguucggcaagggcgggaucgugacgugcgccauguucacgugcaagaagaacauggagggcaagguugugcagcccgaaaaucuggaguacaccaucgugaucacgccccacagcggggaagaacacgcggucggcaacgacacgggaaagcacggcaaggaaaucaagaucacaccccaguccagcaucacggaggcagagcugacaggguacgguacggucaccauggagugcucgccccgcaccggccucgacuucaacgagaugguguuacugcagauggaagacaaggccuggcugguccaccggcagugguuccuggaccugccccuccccugguugccgggugccgauacccagggcagcaacuggauccagaaagagacgcuggugaccuucaagaacccccaugccaagaagcaggacgucgugguccuagggagccaggagggggcgaugcacaccgcccugaccggggccacggaaauccaaaugaguucuggcaaccuccuguucaccggccaccucaagugccgccugcggauggacaagcuccagcugaaggggauguccuacucuaugugcaccgggaaguucaagaucgucaaggagaucgccgagacccagcacggaacgaucgugauccgcgugcaguacgaaggcgacggcucccccugcaagauccccuucgagaucauggaccuggagaaacggcacguccuagggcguuugaucaccgugaacccgaucgugaccgagaaggauagccccgucaacaucgaggccgagccgccguucggcgacuccuacauaaucaucggaguggagccgggccagcugaaacucaacugguucaagaaagggucauccaucggccagauguucgagacuacgaugcgcggcgcgaaacggauggcgauccugggggacaccgccugggacuuuggaagccucggcgggguguucacuuccaucggcaaggcccuucaccagguuuucggggccaucuacggcgcggccuucagcggcguguccuggacuaugaagauccugaucggcgugaucauaacuuggaucgggaugaauagccgcuccaccagccugucugucagccugguauuagugggcgucgugacccuguaccugggggccauggugcaggccgacuccggcugcgucgugagcuggaagaacaaggagcucaagugcggcaguggaaucuucaucaccgacaauguccauacguggaccgaacaguacaaguuccaacccgagagccccagcaagcuggcguccgcaauccagaaggcccacgaggagggcauuugcgggauccggagcgugacccgccuggagaaucuuauguggaagcagauuacgccugagcugaaccacauccuguccgagaacgaggugaagcucacgaucaugaccggagacaucaagggaaucaugcaggcugggaagcggagccugcgcccgcagcccaccgaacugaaguauagcuggaagacguggggcaaggccaaaaugcucucuacggaaucccacaaccagaccuucuugaucgaugggccggagaccgcggaaugcccuaauaccaaccgugcauggaauagccuggagguggaggacuacggcuucggggucuucacgaccaacauauggcucaaacugcgcgaaaaacaggacguguucugcgacuccaaacugaugagcgccgccgucaaggacaaccgggccguccacgcggacaugggcuacuggaucgaguccgcccucaacgauacauggaaaauggaaaaggccagcuucaucgaggugaaguccugccauuggccuaagagccacacccugugguccaacggggugcuggagagcgagaugaucauccccaagaacuucgccgggccggucucccagcauaacuaccgcccuggcuaccacacucagacugccggucccuggcaccuuggcaaacuggagauggacuucgacuucugcgagggaacuaccgucguggucaccgaggacugcggcaaccggggcccaucccugcgcacgaccaccgcgagcgggaaguuaaucacugaguggugcugccgcucgugcacgcugcccccgcuaagguaccggggcgaagacggguguugguacggcauggaaauccgaccccucaaggagaaggaagaaaaccuggugaacagccuggugaccgccgggcacggccagaucgauaacuucucccugggcguccuugggauggcccuguuccucgaggaaaugcugcggacccgcguggggaccaagcacgccauucugcucguggcggucagcuucguaacucugaucaccgggaacauguccuuccgggaccuagggcgcgugauggugauggugggggccaccaugaccgacgacauuggcaugggcgucacguaccucgccuugcuggccgccuucaagguacgccccaccuucgcugccgggcuccugcugcggaagcucaccagcaaggagcuuaugauggcuaccaucggcguggcccugcucucccagucgacgauccccgagaccaucuuggaacugaccgacgcucucgcgcuggggaugauggccuugaaaaucgugaagaacauggagaaguaccagcucgcggugaccaucauggccaucucaugcgugcccaaugccgucauccuucagaacgcguggaaggucagcugcaccauccuggccgccguguccgucagcccccugcugcugaccuccucccagcagaaggccgacuggaucccccucgcgcugaccaucaagggccugaaccccacagccaucuuccucacuacucuguccaggacuagcaagaagcgguccuggccucugaacgaggccaucauggccgucgguauggugagcauccucgccuccagccuucugaagaacgacaucccgaugaccgggccccuagucgcgggcgggcugcugacgguaugcuacgugcucaccggccgcuccgccgaccuggagcuggagcgugccgccgacgucaagugggaggaccaagccgagaucuccgggagcucacccauccuaucgaucaccaucuccgaggacggcagcauguccaucaaaaacgaggaagaggaacagacccuaacgauccuuauccgcaccggccuccuggugaucagcggaguguuccccgucuccauccccaucacugcggccgccugguaccugugggaggugaaaaagcagcgggccggcguguuaugggauguccccagcccgccgcccgugggcaaggccgagcuggaggagggcgcguacagaaucaagcagcgggguaucuuaggcuauucccaaaucggcgccggggucuacaaagagggcacuuuccacaccauguggcacguuacgcgcggcgccguguuaaugcaccggggcaagaggaucgagcccagcugggccgacgugaagaaagacuuggucuccuacgggggcggauggaagcuggagggggaguggaaggagggcgaggagguccaggugcucgcacuggagcccgggaagaacccccgggcgguccagaccaagcccggcaucuucaagaccaacaccggcacgaucggggccgucagccucgacuucucccccggcacuagcggguccccuaucguggaccgcaagggcaaggucguggggcucuacggcaacggaguggucacccggagcggcgcuuacgugagcgcgaucgcgcaaaccgacaagagcaucgaggacaaccccgaaaucgaggacgacaucuuccgcaagaagcggcugacgaucauggaucugcaccccggcgccgggaagaccaagcgcuaccuccccgccaucgugcgggaggccaucaagcgcggccugcggacccugauacuggccccgacccgugucguggcggccgagauggaggaggccuugcgcgggcuucccauccgauaucagacgccggccauccgggccgaacacaccggccgggaaaucgucgaccugaugugccacgcgaccuucaccaugaggcuucugagccccgugcggguaccgaacuacaaccugauaaucauggacgaggcucacuucacugaccccgccuccaucgccgcccgcgguuacaucagcacccggguggagaugggggaggcggccgguaucuucaugaccgccacgccacccggcucgagagauccguucccccagagcaacgcgcccaucauggacgaggagcgggagauccccgagcgcuccuggaacucuggccacgaguggguaacggauuuuaaggggaaaacggugugguuuguaccguccaucaaagcgggcaacgacaucgccgccugccuccgaaagaacgggaagaaggucauccagcuuagccgcaagaccuucgacuccgaguacgugaaaacccgggccaacgauugggacuucguggucaccaccgacaucagcgagaugggggccaacuucaaggcggagcgcgugaucgauccccggcgcugcaugaagcccgugauccugaccgacggcgaggaacgggucauccucgcggggcccaugccggucacccacuccagcgcggcccaacgccggggccgcaucgggcgcaaccccaagaacgagaacgaucaauacaucuacaugggcgagccccuggagaacgacgaggacugcgcccacuggaaagaggcaaagaugcugcucgacaauaucaacacacccgagggcaucaucccguccauguucgaacccgagcgggagaaaguggacgccauugacggcgaguaccgccugcggggcgaggcccguaagaccuucgucgacuuaaugcggcgcggagaccuccccguguggcuggcuuauaaggucgccgcggagggcaucaacuacgccgaccggcgauggugcuucgacggcaucaagaacaaccaaauccuggaggagaacguggagguggagaucuggaccaaagagggcgagcggaagaaacuaaagccgcgcuggcuggacgccagaaucuacagcgacccccucgcccucaaggaguucaaagaguucgcggcgggccgcaaaucacugacccugaaccucaucacggaaaugggccggcugcccaccuucaugacccagaaagcccgcaacgcccucgacaaccucgccguacugcacaccgcggaggccggcgggaaggccuacaaccacgccuuaagcgagcuacccgagacgcuggagacccugcuccugcugaccuuacuggcaacugugacaggcggcaucuuccuguuccucauguccgggaaggguaucgggaagaugacccugggcaugugcugcaucaucaccgcuagcauccuguugugguacgcgcagauccagccgcauuggaucgccgccuccaucauccuagaguucuuucugaucgugcuccuaaucccagaacccgagaaacagcgaacgccacaagacaaccagcugaccuacgucgugaucgcaauccucaccguggucgcggccaccauggccaacgagaugggguuccuggagaagaccaagaaggaccuggggcucggcagcaucacaacucaggagagcgaauccaacauccuggauaucgaccugcgcccggccagcgccuggacccucuacgcgguggccaccaccuucgucacgcccaugcugcggcacuccauagagaacagcagugucaacgugagccugaccgcgaucgccaaccaagcgaccguucucauggggcugggcaagggguggccccuguccaagauggacaucggugucccccuccuggccaucgggugcuacagccaggugaauccgaucacccugacggccgcccucuuacuucucgucgcccacuacgcgaucaucggcccgggccuacaggcuaaagccacccgcgaggcccagaagcgggccgcggccgggaucaugaagaauccaaccgucgacggcaucaccgugaucgaccucgagcccaucccguacgaccccaaauucgagaagcagcucggccaagugaugcugcugauccucugcgucacccaggugcugaugaugcgcacgaccugggcgcucugugaagcccucaccuuggcaaccggacccaucuccacccugugggaagggaaccccggcagauucuggaacaccacgaucgcgguaucgauggccaauaucuuucgcggcuccuaccucgccggggcaggccugcuguucagcaucaugaagaacacgaccaacacccgccgggggacaggcaauauaggagagacgcucggggagaaguggaagucccgccugaacgcguugggcaagagcgaguuccagaucuacaagaaguccgggauccaagaggucgaccggacccucgccaaggagggcaucaagcgcggcgagaccgaucaccacgccgugagccgaggcuccgccaagcugcgcugguucguggagcggaacauggucaccccagagggcaaggugguagaccuggggugcggccgcgggggcuggagcuacuacugcgggggccucaagaacguccgggaggugaagggccugacgaagggcgggcccgggcacgaagaacccauccccaugaguacguacggcuggaaccuugugcgacuccagagcgggguggauguguucuuuaccccgcccgagaaaugcgauacccuccugugcgauauuggcgagagcucacccaaccccacgaucgaggccggccggacccuccgcguacugaacuugguagagaacuggcucaacaacaacacccaguucugcaucaaggugcugaacccauacaugcccagcgugaucgagaagauggagaccuugcagcggaaguacgggggcgcgcucguccgcaacccacugucccggaacagcacccacgagauguacuggguguccaacgcaacggggaacauagugagcagugucaauaugaucagccgcaugcugauaaaucgguucaccaugaagcauaagaaagccaccuacgagccggacguggaccuggguuccgggacgcgcaacaucggcaucgagagcgaggugcccaaccucgacaucaucggcaagcggaucgagaagaucaagcaggagcacgagacauccuggcacuaugaccaggaccaccccuacaagaccugggccuaccacgggagcuaugagaccaagcagaccggcuccgccagcagcauggucaacggagucgugcgccugcugacgaagcccugggacgucgugccgauggugacccagauggcgaugacggacacgacgccguucggccagcagcgcgucuucaaagagaagguggacacccggacccaggagcccaaggagggcaccaagaaacuuaugaaaaucacggccgaguggcuguggaaggagcucgggaagaagaaaaucccccgcaugugcaccagggaggaguucaccaggaagguacggagcaacgccgcccucggugccaucuucaccgaugagaacaaguggaaguccgcgcgagaagccguggaggacgggagguucugggagcugguggacagggagcggaaccugcaucucgaggggaagugcgagacgugcgucuacaacaugauggggaagcgcgagaagaagcugggugaguucggcaaggccaaggggagccgggccaucugguacauguggcugggcgcgcguuuccucgaguucgaagcccugggguuccugaacgaggaccacugguucucccggggcaacagccucagcggcguagagggcgagggccugcaccggcugggguacauacuccgggacguguccaagaaggagggcggcgccauguacgccgaugacaccgccggaugggacacccgcaucacccuggaggaucugaagaacgaggagaugaucacgaaccauaugaagggggagcacaagaagcucgcggaagccaucuucaaacugaccuaccagaauaaggucgugcgggugcagcgcccaacgccccguggcaccgucauggacaucaucagccgccgggaccaacgcggcuccggccaggugggcacguacgggcugaacaccuucaccaacauggaggcccagcucaucagacagauggagggcgagggcaucuucaagagcauucagcaccugaccgugacggaggagaucgccguccagaacuggcuggcccggguggggcgcgagcgguuaacucgcauggcgauuuccggcgaugacugcguggucaagcccaucgaugaucgguucgccaacgcauugaccgcccugaacgacauggggaaggugcgcaaggacauccagcagugggagccaagccggggcuggaacgacuggacacaggugccguucugcucccaccacuuccacgaacucgucaugaaggacgggcgcguacugguggucccaugcaggaaccaagacgaacugaucggccgcgcccggaucagccagggcgcgggguggucccucaaggagacggccugucuaggaaagagcuacgcucagauguggacccugauguacuuccaccgccgggaccuccgccuggcggcgaacgcgaucugcuccgcagugcccagccacugggugcccaccucccgaacgaccuggagcauccacgccaagcacgaguggaugacgaccgaggacaugcuggccguguggaaucgcguguggauccaggaaaacccauggauggaggauaagaccccgguggaguccugggaggagguccccuaucucgggaagcgggaggaucaauggugcggcagccucauugggcuaaccucccgagcuacgugggccaagaacauccagacagccaucaaccaggugaggucccucaucggcaacgagggguacaccgauuacaugcccagcaugaaacgauuccgccgggaggaagaggaggccggggugcuaugguga

SEQ ID NO: 24907 - RNA, 9876 nt, Artificial Sequence
  derived and/or modified CDS sequence (opt11) from DENV-2__FJ850085__SS-prME
accgucggagugaucgugaugcuuauacccaccgcaauggccuuccaccucaccacccgcaauggggagccccacaugaucgugggcaggcaggagaaggggaagucccuccuguucaagaccgagaacggcgucaacaugugcacccucauggcgaucgaccugggggagcugugcgaggacaccaucaccuacaagugcccccuucugcgccagaacgagcccgaggacaucgacugcugguguaacuccaccagcaccugggugaccuacgggaccugcaccaccacgggcgagcaccggcgcgagaagcgguccguggcccuggucccccacguggggaugggccucgagacccgcaccgagaccuggaugucuuccgagggggcguggaagcacgugcagcggaucgagaccuggauccugcgccacccaggguucaccaucauggccgccauccucgcauacacgaucgggaccacccacuuucagcgggcccucaucuucauccugcugaccgcugucgcccccagcaugacuaugcgcugcaucgggaucuccaaucgggauuucguugagggcgugagcgggggcuccugggucgacaucguacucgagcacggcagcugcgugaccacgauggcgaagaacaaacccacguuggacuuugaacuuaucaagaccgaagcaaagcagccagccaccuuacgcaaguacugcgucgaggccaagcugacgaauaccaccaccgagucgcgaugcccgacccagggcgagcccagccugaacgaggagcaggacaagcgcuucauuugcaagcauucgaugguagaccggggcugggggaacggcugcggucuguuuggcaagggcgggaucgugacgugcgccauguucacgugcaagaagaacauggaaggcaaggucgugcaacccgaaaaccuggaguacaccaucgugaucacgccucacagcggggaagaacacgcggucggcaacgacacugguaagcacggcaaggagaucaagaucaccccgcaguccagcaucaccgaggcagagcugaccggguacggcacggugaccauggagugcagcccccgaaccggccucgacuucaacgagaugguucugcugcagauggaggacaaggccuggcuuguccaccggcagugguuccuggaccugccccuccccuggcugccgggggccgacacccagggcagcaacuggauccagaaggagacgcuggugaccuucaagaacccccacgccaagaagcaggaugucgugguguuggggucccaggagggcgcgaugcacaccgcccugacaggggccacggaaauacagaugagcagcggcaaccucuuguucaccggccaucugaagugcagacugcggauggacaagcuccagcugaaggggauguccuacagcaugugcacgggaaaguucaagaucgugaaggaaaucgccgagacccagcacgggacgaucguuauccgcgugcaauacgagggcgacggcucccccugcaagauccccuucgagaucauggaccuugagaagcggcacgugcucgggcgccugaucaccgucaacccgaucguugccgagaaggacagccccgucaacaucgaggcggaaccacccuucggcgacuccuacaucauaaucgggguggaaccgggccagcugaagcucaacugguuuaagaaagggagcuccauuggucagauguuugagaccaccaugcgcggcgccaagcggauggcgauccugggcgauacggccugggacuucggcagccucggcgggguauucacguccaucgggaaggcccuccaccaggucuucggggcaaucuacggcgccgccuucaguggggucuccuggaccaugaaaauccugaucggggugaucaucaccuggaucggaaugaacagccgcucuacgagccuuuccgucucucugguacucguuggggucgugaccuuauaccugggggccauggugcaggcggacuccggcugcgucgugagcuggaagaacaaagaguuaaagugcggguccgggaucuucaucaccgacaacgugcacacauggacugagcaauacaaguuccagcccgaaagccccagcaagcuggccuccgccauacagaaggcgcacgaggagggcaucugcgggauccggagugucacccgccuggagaaccucauguggaagcagauaaccccggagcugaaucacauccuguccgagaaugaggugaagcucaccaucaugacgggcgacaucaaggggaucaugcaagccggcaagcggagccuccgcccacagccaacugaacugaaguauucguggaagaccuggggcaaggcaaaaaugcucagcaccgaaucccacaaccagacguuccugauagacggccccgagacugccgagugcccgaauacaaaccgggccuggaacagccuggagguggaggacuacggcuucggggucuucaccacgaacaucuggcucaagcugcgcgagaagcaggacguauucugugacuccaagcugaugagcgccgcugugaaggauaaucgggcgguccacgcugacaugggauacuggaucgaauccgcccuuaacgacaccuggaagauggagaaggccagcuucaucgaggugaaguccugccacuggcccaaaagccacacccugugguccaauggcgugcuggagagcgagaugauuauccccaagaacuucgccgggccggucucccagcacaacuaccgcccggguuaccacacccagaccgcugggcccuggcaccucggcaagcuggagauggacuuugacuucugcgaagggaccacagugguggucaccgaggacugcggcaaccggggccccagccugcgaaccacgaccgccagcggcaagcucaucaccgaguggugcugccgguccugcacccugcccccgcuacgcuacaggggcgaggacgggugcugguacggcauggagauccgcccgcucaaggagaaggaggagaaccuggucaauucucuggugacugccgggcacggccagauagacaacuucucccucggcguacuggggauggcccucuuccucgaggagaugcuucggacccgcguggggaccaagcacgcgauacugcucguggccgucagcuucguuacccuuauaacugggaacauguccuuccgggaucugggccgcguuauggucauggugggggcgaccaugaccgacgauauaggcaugggcgugaccuaccucgcgcugcuggccgcguucaagguccgccccacauuugccgccgggcuccugcugcggaaguugaccaguaaagagcugaugauggccaccaucggcguagcccugcuaucccagagcaccauccccgagacgaucuuagagcugacugacgcgcucgcccuggggaugauggcccugaagaucgugaaaaacauggagaaguaccaguuggccgucaccauaauggcuaucucaugcgugccgaacgcggugauccugcagaacgccuggaaggugagcugcaccauccuggcagccguguccgucagcccccuccugcuuacaaguagccagcagaaggcggacuggaucccacucgcccucaccaucaagggcuuaaaccccaccgccaucuuccugaccacucugucccgcaccagcaagaagcggagcuggccgcuuaacgaggcaauaauggccguugggauggugagcauccucgcguccagucugcugaagaacgacauccccaugaccgggccccucguggccggcggguugcugaccgugugcuacgugcugacgggccgcagcgccgaccuggagcuggagcgggccgccgacgucaagugggaggaucaagcggaaaucucugggagcuccccaauccucucgaucaccauuuccgaggacggcagcaugagcaucaagaacgaggaggaggagcagacccugaccauccugaucaggacgggccuccugguuaucagcgggguguucccuguguccauccccaucacagccgccgccugguaccugugggaggugaagaagcagcgggccggcgugcucugggacgucccuagcccgccucccguggggaaagcggagcuagaggagggcgccuacaggaucaagcaacggggcauccuuggcuacucccagauuggcgccgguguguacaaggagggcaccuuccacaccauguggcacgucacccgcggcgccgugcucaugcaccggggcaagagaaucgagcccucaugggccgacgugaagaaggaccuggucuccuacgggggcggcuggaagcuggagggcgaguggaaggagggcgaggagguacaggugcucgcgcuggagcccgggaagaacccccgcgcuguccagacgaagcccggcaucuucaaaaccaacaccgggaccauaggagcugugagccuggacuuuucuccuggcacgagcgggucccccaucgucgaccgcaaggggaaggucguggggcucuacggcaacggcguggucacccggagcggggccuauguguccgcgaucgcacagacagauaagagcaucgaggacaaccccgagaucgaggacgauaucuuccgcaaaaagcggcugaccaucauggacuuacaccccggggccgggaagacgaagcgcuaucuccccgcaaucgugcgagaggcgaucaagcggggccugagaaccuuaauucuggcgccgacucgcgucguggccgccgagauggaggaggcacuccgugggcugcccauccgguaccagacccccgccauccgggcggagcacacgggccgggagauuguugaccugaugugccacgccaccuucaccaugcgucuccuuagccccguccgggugccuaacuauaaccugauuaucauggacgaagcccacuucaccgaccccgccuccaucgccgcgcgcggguacaucucuacgaggguggagaugggagaagccgcugguaucuucaugaccgccacgccuccugggucccgcgacccguucccgcaaagcaacgcgcccauaauggacgaggaacgggaaauccccgagcgcuccuggaacagcggccacgaguggguuaccgacuucaaggggaagacggugugguucgugccguccaucaaggccggcaacgacaucgccgcaugccuccguaagaacggcaagaagguuauccagcugagccgcaagaccuucgauuccgaguaugugaagaccagggccaacgacugggacuucguggucaccacagacaucagcgagaugggggcgaacuucaaagccgaacgcgugaucgacccucggcgcugcaugaagcccgugauccugaccgacggcgaggagcgagucauccucgccggccccaugccggugacacacucgagcgccgcccagcgccggggccgcaucgggcgcaacccgaagaacgagaacgaccaguacaucuauaugggcgagccccuggagaacgacgaggacugcgcgcacuggaaggaggccaagaugcugcucgacaacauuaacaccccagagggcaucaucccguccauguucgagcccgagcgagagaagguggacgcaaucgauggcgaguaccgccuacggggcgaggcccgcaagacguucgucgaccugaugcggcgcggggaccuccccguguggcuggccuacaaagucgcggccgagggcauuaauuacgccgacaggcgcuggugcuucgacgggaucaagaacaaucagauccucgaggagaacguggagguggagaucuggaccaaggagggcgaaagaaagaagcugaagccgcgcuggcuggacgcccggaucuacagcgauccccuggcgcucaaggaguucaaggaguucgccgccggccgcaagucccugacccugaaccucaucaccgagaugggaaggcugcccacguuuaugacccagaaggccagaaacgcacuggacaaccucgcgguuuugcacaccgcggaggccggagggaaggccuacaaccacgcccuaagcgagcuccccgagacccuggagacguuacuccugcugacccuccuagcgacagugaccggcggcauauuccuguuccucauguccggcaagggcaucggcaagaugacgcugggcauguguugcaucaucaccgccagcauccugcucugguacgcccagauccagccacacuggaucgccgccuccaucauccuggaguucuuccugauugugcuccugauacccgagcccgagaagcaacggacgccacaggacaaccagcugaccuacguugugaucgcgauccucacuguggucgccgccacgauggccaacgagaugggguuccuggagaagacaaagaaggaccugggccucggcuccaucacuacccaggaguccgagucuaacauccuggauauagaccugcgcccggccagcgcguggacucucuacgccguggccaccacguucguaacccccaugcugcggcacuccaucgagaacagcuccgucaacgugagccugacagcuauugcuaaucaggcgaccgugcucaugggccugggcaagggguggccacuguccaaaauggacaucggcgucccccuccuggcgaucgggugcuacagccaagugaacccgaucacccugaccgccgcccucuuacuuuugguggcgcacuacgcuaucaucggccccgggcuucaggccaaggccacgcgcgaggcccagaagcgggcggccgcggggauuaugaaaaacccaaccgucgacggcaucaccguuaucgacuuggagcccaucccguacgaccccaaguucgagaagcagcucggccaggugaugcugcuuauccucugcgucacccaggugcugaugaugcgcacgacgugggcccugugcgaggcucucacccuagcgaccggccccaucuccacgcugugggaggggaaccccggucgguucuggaacacaaccaucgccguuagcauggccaauaucuuccgaggguccuaccuugccggggcaggcuuacuguucagcauaaugaagaacaccacgaauacccgccgggggaccgguaacauuggugagacacucggggagaaauggaagagucgccugaacgcccuggggaagucggaguuccagaucuacaagaaauccgggauccaggaggucgaccggacgcucgccaaggagggcauuaagaggggagaaaccgaccaccacgcggugagcagagguagugccaagcuccgaugguucguggagcggaacauggucaccccggagggcaaggugguggaccuggggugcggccgcgggggcuggaguuacuacugcgggggccucaagaauguccgggaggugaagggguuaacaaagggcgggcccgggcacgaggagcccauucccaugagcaccuauggcuggaaccuggugcgccuucagagcggggucgauguguucuucaccccgcccgagaagugcgacacccugcugugugacaucggggaaagcagccccaaccccaccaucgaggcgggccggacguugcgcgugcugaaccuggucgagaacuggcucaauaacaacacccaguucugcaucaaggugcuaaacccguacaugccaagcgucaucgagaagauggagacccugcagcggaaguacgggggcgcccucguccgcaaccccuuguccagaaacagcacucacgagauguauuggguguccaacgccaccgggaacaucgugagcucagucaacaugaucagccgcaugcugaucaaccgguucacaaugaagcauaagaaggcaaccuacgagccggacguggacuugggcucugggacccgcaacaucggcaucgagagcgaggugcccaaccucgacaucaucggcaagcggaucgagaagaucaaacaggagcacgagaccuccuggcacuaugaccaggaccaccccuacaagacgugggcauaccacgggucauacgagaccaaacaaaccgguuccgcgucauccauggucaaugggguggugcgccugcuaaccaagcccugggacgucgugccgaugguuacgcagauggccaugaccgacaccacccccuucggccagcagcgagucuucaaggagaagguggacacgcggacccaggagcccaaggagggcaccaagaaacuuaugaaaaucaccgccgaguggcuguggaaggagcuggggaaaaagaagaucccccgcaugugcacgcgggaggaguucacccgaaagguccggagcaacgccgcccucggcgcaaucuucaccgacgagaacaaguggaaguccgcgcgcgaggccgucgaggacgggcgguuuugggagcugguggaucgagagcggaaccuucaccucgagggcaagugcgagaccugcguuuacaacaugaugggaaagagggagaagaaacugggcgaguucggcaaggccaaggggagccgggcgaucugguacauguggcugggcgcccgauucuuagaguucgaggcccuaggguuccuaaacgaggaucacugguucucccggggcaacagccucagcgggguggagggcgaaggccugcacagacugggguacauccuccgggacguguccaagaaggagggcggugccauguacgccgacgacacggcgggcugggacacccgcaucacccuggaggaccugaagaacgaggagaugaucaccaaucacaugaagggggagcacaagaagcucgccgaagcaaucuucaaacuuacguaccagaauaaggucgugcgggugcagcgaccgacuccccgggggacagucauggacaucaucagccgccgugaccaacggggcucaggccaggugggcacuuaugggcugaacacguucaccaacauggaggcccagcuuauacgacagauggagggcgagggcaucuucaaaagcauccagcaccugaccgugaccgaggagaucgccgugcagaacuggcuggcgcggguggggcgcgagcgguuaacgcgcauggccauauccggcgaugacugcguggucaagcccaucgacgaccgguucgcaaacgcccugacggcacugaacgacauggggaaggugcgcaaagacauccagcagugggagcccagcaggggcuggaacgacuggacccaagugccauuuugcucccaucacuuucacgaacucgucaugaaggacgggagagugcuggugguccccugccggaaccaggacgaguuaaucggucgcgcgcggaucagccagggcgccggguggagucucaaggagaccgccugucuuggcaagagcuacgcccaaauguggacgcugauguacuuccaccgccgggaucuccgccuggccgcaaacgccaucugcuccgccgugcccagccacugggugcccaccucccggaccaccuggagcauccaugccaagcacgaguggaugaccacggaggacaugcuggcggucuggaaucgcguuuggauccaggagaacccguggauggaagacaagacgccgguggaauccugggaggagguccccuaccuagggaagcgggaggaccaaugguguggcagccugaucgggcugacgucccgcgccacaugggcuaaaaacauccaaacggccaucaaccaggugcgcagccucaucggcaacgagggcuacaccgacuacaugcccagcaugaagcgcuuccgccgcgaggaggaggaggccggggugcuaugguga

SEQ ID NO: 24908 - RNA, 9876 nt, Artificial Sequence
  derived and/or modified CDS sequence (opt11) from DENV-2__FJ850088__SS-prME
accgccggcgugauagugaugcuuauacccacggugauggccuuccaccucaccacccgcaacggugaaccccacaugauagugggccggcaagagaaagggaagucccucuuguucaagacugaggacggugucaacaugugcacgcucauggcgauagaccucggcgagcugugcgaagacaccaucaccuauaagugcccgcugcugcgccagaacgagcccgaggauaucgacugcugguguaacagcaccagcaccugggugaccuacgguacuuguaccaccacgggggagcauaggcgcgagaaacgguccguggcacuggugccccauguggggaugggccuagagacucgcaccgagaccuggaugucuagcgagggggcauggaaacaugugcagcggauagagacuuggaucuuacgccaccccggcuucaccaugauggccgcuaucuuggcguacaccauugggacuacgcacuuccagagggcccucaucuucauccuccuuaccgcggucgcccccucuaugaccaugcgcugcaucggaauaagcaacagagacuucguugagggcguguccgggggcagcugggucgacauagugcucgagcauggaagcugcguuaccacgauggcgaagaacaaacccacccuggacuucgaacugaucaagacggaggccaagcagccagcuacccucaggaaauacugcgucgaggcaaagcugacgaacaccacaaccgagagccggugcccaacgcaaggcgaacccagccuuaacgaggagcaggacaagcgcuucaucugcaagcauuccaugguugacaggggguggggaaacggcugcggucuguucggcaaaggagggaucgugacuugcgcaauguuuaccugcaagaagaacauggagggcaaggugguccaaccugagaaccuagaguauacgaucguaaucacgccucacagcggagaagaacacgcgguuggcaacgacacugggaagcacggcaaagaggucaaaauuacgccgcaguccagcauuaccgaggccgaguugaccggguauggaacggugacaauggaguguagcccccggacaggccucgacuucaacgagaugguacugcuccagauggaggacaaggcaugguuagugcaucggcaaugguuucuggacuugccguugcccuggcuuccaggugcagacacgcagggcagcaacuggauccagaaggaaacgcugguaaccuucaagaacccacacgccaagaagcaggaugugguuguccuagguucccaggagggcgcuaugcauaccgccuugacaggcgcaacagagauacagaugagcucgggcaaucucuuguucacaggccaccugaaaugccgccugcggauggacaagcuccaacuaaaggggauguccuacagcauguguaccgggaaguucaagaucgugaaggagaucgccgagacccagcacgguacgaucguuauucgcgugcaguacgaaggagauggcagucccugcaagauuccuuucgagaucauggaccuugagaagcggcacgugcuggggcgucuaauuacagucaacccgauaguaacugagaaagauagccccguaaacaucgaggccgaaccgccuuuuggcgacuccuauaucauugucggcgucgagccgggccagcugaaacucaauugguucaaaaagggcagcagcauuggccaaauguuugaaaccacgaugcguggcgcaaagcggauggccaucuugggcgauaccgcaugggacuucgggagcuuaggaggcguguucacauccaucgggaaggcgcuccaccaggucuuuggcgccaucuauggugcggccuucaacggggucagcuggacaaugaagauccugaucggcgugaucaucacguggauagguaugaacucccggagcaccucacuuagcguuucccugguccucgugggcgucguaacccuguaccucggugcuaugguccaggccgauuccggcugcguaguauccuggaagaacaaggaacucaagugcgguagcgggaucuucaucacagauaacguucacacguggaccgaacaauauaaguuccagcccgagagccccagcaaacuggcuagcgcgauccaaaaggcgcaugaagagggcaucugcgggauccgguccgugacucgccuggagaaucugauguggaagcagaucacgccggaguuaaaccauauuuugagcgagaaugaaguuaaauuaacaaucaugacaggcgacaucaaggggauaaugcaggccggcaagcggucacugcgcccacagccgacggaguuaaaguacucguggaaaaccuggggcaaagcuaaaaugcuucccacggagucacacaaucaaaccuuccugauagacggaccggaaaccgcggaaugccccaaugccaaucgagccuggaacucauuagaaguggaggauuauggguucgguguguucacgacgaacauauggcucaagcugagggagaagcaggacguauuuugcgacuccaagcucauguccgccgccaucaaggacaaccgggccgugcaugcagacaugggguauuggaucgagucagcccuaaacgacacuuggaagauggaaaaggccagcuucaucgaggugaagaguugucacuggcccaagucacacacccuguggucgaacggugugcucgagagcgagaugaucauuccuaagaacuucgccgggccuguuucccagcacaacuaccgccccggguaccacacccagaccgcggggcccuggcacuugggcaagcuggaaauggauuucgacuucugcgaggggacgaccgucguugugaccgaggacugcgguaaccggggcccgucgcuacgaacgacgaccgcgucugggaaacucaucaccgaauggugcugccguagcugcacucugccgccgcuacgcuauagaggggaggacgggugcugguauggcauggagauccgcccccucaaggagaaggaggagaacuuaguaaauucauuagucaccgcagggcacggccagaucgacaacuuuucacucggcguauugggaauggcccuguuccucgaggaaaugcugaggacgcgcgugggcaccaagcacgcgauccugcucgucgcagugucucuagugaccuuaaucacggggaacaugucuuuccgagauuuggggcgcgucaugguuauggugggggcaaccaugaccgaugauaucgggaugggcguuacguaucuggcccuauuagccgcguuuaaggugcgccccaccuucgccgcggggcuacugcugcggaagcugaccucaaaagaacugaugauggccacaaucggaguggcccuccugucccagagcaccauccccgagacgauucuggagcucaccgacgcacuagcauuggggaugauggccuuaaaagucgugaagaacauggaaaaguaucagcuggccguuacaaucauggccaucuccugcgucccaaaugcggucauucugcagaacgcauggaagguaagcugcaccauccuagcugccgugaguguuagcccccuauugcuaacgucaagccagcagaaggcggauuggaucccccuggcauugacgaucaagggccugaacccgaccgccaucuuccugaccacgcuaucccgcaccagcaagaagcgguccuggccccuaaacgaggccguuauggcagugggaaugguaucgauucuggcuuccucccugcucaagaacgacauccccaugacugggccccuggucgcgggugggcugcucaccgugugcuacguuuuaacgggccguuccgcugaccuagagcucgagagagccgccgacgucaagugggaggaccaggcugaaaucagcggaucuaguccgauccuuagcauaaccaucucggaggacgggagcauguccaucaaaaaugaggaggaggaacagacucugaccauccuaauccguaccggccuucuggugaucucggggguauuucccgucucgaucccuauuaccgcggccgcaugguacuuaugggaagugaagaagcagagggccggcgugcugugggacgugcccagcccgccgcccguggagaaggcggaacuugaggacggagcguacaggauaaaacaacgugggauccucggguacucccagaucggcgcuggcguguacaaggaagggaccuuucacacuauguggcacgucacgcgcggcgccguguugaugcaucgggggaagcgcauagagccgagcugggccgacgugaagaaagaccugguuaguuacggcgguggcuggaaacucgaaggugaguggaaggaaggagaggagguccagguccuggcacuggagcccggcaagaacccccgagccguccagacgaagcccgggaucuuuaagacuaacaccggaaccauaggggcggugucucuggacuucuccccuggaacgaguggcuccccaaucguugaccgcaagggaaagguggugggucuguacggaaacggcguugucacccggagcggcgccuacguguccgcgaucgcacagaccgagaaauccaucgaggacaauccugagaucgaggaugacaucuucaggaagaaacggcuaaccauaauggaccuccaccccggggccggcaaaacuaaacgcuacuugccggcgaucgugcgggaggccauuaagcgcggacugaggacccuaauccuugcgccuacacgcgucguagcugccgaaauggaagaggcccugcgcggccugccgauucguuaccagaccccugccaucagggcagaacacacggggcgagaaaucguggacuugaugugucacgccaccuucaccaugcgccugcugagcccgguucgcgugcccaauuacaaucucauuauaauggacgaggcgcacuucaccgaccccgcuucuaucgccgcgcgcggcuauaucagcacccgcguagagaugggcgaagcggcaggcaucuucaugaccgccacgccgcccggaucaagggaccccuucccccagagcaaugcgcccaucauggaugaagaacgggaaauaccagagcgcuccuggaacagcggccacgagugggucacggacuucaaaggcaagacugugugguuuguuccuuccaucaaggccgguaacgacaucgccgcaugccugcgaaagaauggcaagaagguaauccaacugucuagaaagaccuuugacucugaauacgugaagacccggagcaacgauugggacuucguggucacgacggacaucuccgagaugggcgccaacuucaaggcggaacgcguuaucgauccacggcgcuguaugaaaccggugauccucaccgacggggaggaacgggucauccuagccggaccgaugcccgucacccacagcagugccgcucagcggcgggggagaaucggacguaaccccaagaaugagaaugaucaguacauauacaugggggagcccuuggaaaaugacgaagacugcgcccacuggaaggaggcgaagaugcuacuagacaacaucaacaccccggagggcaucauccccucuauguucgaacccgaacgggagaaagucgaugccaucgacggggaauaccgccugagaggcgaggcccggaagacguucguggaccucaugcgccgcggcgaccuaccaguauggcuggccuacaaagucgccgccgagggaaucaacuacgccgaccggagauggugcuuugacggcaucaaaaacaaccagaucuuagaggaaaacguggagguggaaauuuggacuaaggagggggagcguaagaaacugaagccccgcuggcuggacgcccggaucuacuccgacccccucgccuuaaaggaguucaaggaguucgcggccggucggaaaagccugaccuuaaaccugaucaccgagaugggccgucugccgacuuucaugacgcaaaaagcccgaaacgccuuagacaaccuagcaguccugcacaccgcggaggcagggggcaaggcauacaaucaugcccugagugagcugccggaaacccuggaaacucuacugcugcuggcacugcuggcaaccgucaccggcggcaucuuccucuuccuaaugucuggcaaggggaucggcaagaugacccuggggaugugcuguaucauuacggcuuccauccuccugugguacgcccagauccaaccucauuggaucgcagccaguaucauccuggaguucuuccuuaucguccugcugauacccgagccggagaagcaacggacuccgcaggacaaccaacucaccuacguggugauagccauccugaccgucgucgccgccaccauggccaacgaaaugggcuuccuugagaagacgaagaaggaucucgggcuggguucuaucaccacccaggagucggagucuaacauccuggacauagaccucaggccagccucugcguggacucuguacgccguggccacgaccuuugucacgcccaugcugcggcacucuaucgaaaauuccucggucaacgugagccuaacagcuaucgccaaccaagccacaguacuaaugggccuggguaaggguuggccguuaagcaagauggacaucggcgucccgcugcuggccauagguugcuacucccaggugaauccuaucacgcucacagccgcgcugcugcuccugguggcgcacuacgcaaucaucgggcccggcuugcaggccaaggcgacccgugaggcgcagaagcgagcggccgcugguaucaugaagaaccccacagucgacgggauuacggugaucgaccucgaaccgauacccuaugacccuaaguucgagaagcagcugggccaggugaugcugcuuauucuguguguaacccagguccugaugaugcgcaccacuugggcgcucugcgaggcauugacccuggcgacugggcccaucagcacccucugggagggcaacccggggcgguucuggaacacgaccauugccguguccauggccaacauauuccgcggaagcuacuuggccggagcugggcucuuauucuccguaaugaagaauaccacuaacacgcgccggggcaccgggaacaucggcgaaacauugggugagaaguggaagucccgccugaacgcccuggguaaauccgaguuccagaucuauaaaaaguccggcauccaggagguagaccggacccuggcgaaggaggggaucaaaagaggcgagacagaccaccaugccguaucucgagggucggcaaaacugcgcugguucgucgagagaaauaugguaacccccgaggggaagguaguugaccucgguugugggcggggcgggugguccuacuacuguggagggcugaaaaaugugagagaagucaaaggucuuacgcgcggcgggcccggucaugaggaaccuaucccaaugagcacuuacggguggaaccucgucaggcugcaaucgggaguagauguguuuuucacgccgcccgagaagugcgacacucuucuaugcgacauaggggaguccagccccaacccuaccaucgaggcaggucgcacuuugcggguucuaaacuugguggagaacugguugaacaacaacacgcaguucugcaucaagguucuuaacccguacaugcccuccgucauagagaagauggagacccuccagcguacguauggcggagcccuggugaggaacccgcugagccgaaauagcacccacgaaauguacuggguaagcaaugccacugggaacauaguauccagcguaaauaugaucagcaggaugcugaucaaccguuucacgaugaagcacaagaaggccacuuacgagcccgauguggaccucggaagcggcacgcgcaacauuggcaucgagagugaaauuccuaaccuggauauuauaggcaagcgcauugagaaaauuaagcaagagcacgaaaccagcuggcacuacgaucaggaccacccauacaagacgugggccuaccacggcaguuacgagaccaaacagaccggcagcgcgagcagcauggucaacggcgugguccgccuacugaccaagccuugggacgucgucccgaugguuacgcagauggcuaugacagacaccacccccuucgggcagcaacguguauuuaaggagaaagucgauacgcgcacccaggagccaaaggaaggcaccaaaaagcugaugaaaauaacggcagaguggcuguggaaggaacucggcaagaagaagacgccgagaaugugcacccgagaggaguuuaccaggaagguccggaguaacgccgcacugggagcaaucuuuaccgacgagaacaaauggaagucugcucgggaagcaguggaggacggccgcuucugggagcugguggaccgggagcgcaaccuccaccuugaggggaagugugaaacuugugucuacaacaugaugggcaagcgcgagaagaagcuaggugaguucgggaaggccaaggggucgcgcgcgauaugguauauguggcucggcgcacgguuccucgaguucgaggcucugggcuuccucaacgaagaucauugguucagccgcgggaauaguuugagcggcguagagggagagggguugcaccgguuaggcuacauccugcgagacguaagcagaaaggagggcggcgccauguaugccgacgauaccgcugguugggacacucgcaucaccuuagaagaccugaagaacgaggagauggugacgaaccacaugaagggggagcauaagaaacucgccgaggcuauuuucaaguugaccuaccagaacaagguagugcgggugcagcgccccacgccccgggggaccguaauggauauaaucucccgccgcgaccagcggggcagcggccaggugggaacguacggccucaacaccuucacgaacauggaggcccaacugauccgccaaauggagggcgagggcauuuuuaaguccauccaacaccugaccguuaccgaggagauugccguacagaacuggcucgcucgcgugggcagagagcggcugacccgcauggccauaagcggcgacgacugcgucgugaaacccaucgacgauagguucgccaacgcccugacagcucucaacgauaugggaaaaguucgcaaggauauacagcagugggagccgagccggggcuggaacgacuggacgcaggucccuuucuguucgcaccacuuccacgaacuugugaugaaagacggccgcguguuagucguccccugccggaaccaagacgaguugaucgggcgggcccgcaucucccaaggagccgguuggagccugaaggagacggcaugccuggggaaauccuacgcccaaauguggacccucauguacuuccaccgccgggaccugcgccucgccgcgaacgcgauaugcucagccgugccaucccacugggucccaaccagccggaccacgugguccauccaugcuaagcacgaauggaugacgacugaagauauguuggcgguuuggaaccgcgucuggauccaggagaacccauggauggaggacaaaacccccgucgagagcugggaagagguuccguaccugggcaagcgggaggaccagugguguggauccuugaucggccucaccagccgcgcuacgugggccaagaacauccagaccgcgaucaaccaaguucgcucccuaaucgguaacgaagaguacacggauuacaugccuagcaugaagcguuuccggcgggaggaggaggaggccggaguccuuugguga

SEQ ID NO: 24909 - RNA, 9876 nt, Artificial Sequence
  derived and/or modified CDS sequence (opt11) from DENV-2__FJ850091__SS-prME
acugcgggagugaucgucaugcugauucccaccgccauggccuuccaucucaccacccgcaauggggaaccccacaugaucgugggacggcaggagaaagggaagucccugcuguucaaaaccgaggacggcguaaacaugugcacacucauggccauggaccugggugagcugugcgaggacaccauaaccuacaaaugcccacuccugcgccaaaacgagccggaggacauagacugcuggugcaacucgaccucuaccugggucaccuacgggacgugcaccacuacgggugagcaucggcgcgagaagcguagcguggcccuggugccccacgucgggauggggcucgagacccgcaccgagaccuggaugagcucggagggggccuggaagcacgugcaacggaucgagaccuggauccuccgccauccuggcuucacuaucauggccgcgauccucgcuuacacuauagggacaacgcacuuucagcgugcccucaucuucauccuucugacagcgguggcgccaagcaugaccaugcguugcauaggcaucuccaaccgggacuucguagaaggcguaucugggggcuccuggguggacaucgugcucgagcacgggagcugugugaccacgauggccaagaacaagcccacccuggacuucgagcugaucaagacagaggccaagcagcccgcuacacuccgcaaguauugcaucgaggcgaaguuaacgaacacaaccaccgaaucccguugcccgacucagggcgagccuucacugaacgaagagcaggauaagcgcuucaucugcaagcacuccaugguggaccgggguugggggaauggcugcgggcuguucggcaagggcgggaucgugacaugcgcgauguucacgugcaagaagaacauggaggggaagaucgugcagcccgaaaacuuggaguacaccaucguuaucacgccccacagcggcgaggagcaugccgucggcaacgacaccgggaagcacggaaaggagaucaagaucacaccgcaguccucaacgaccgaagccgagcugacgggguacggcaccgugacaauggagugcagcccucguacuggccuagacuucaacgagaugguguuauugcagauggaggacaaggccugguuaguccacaggcagugguuuuuggaccugccccuaccuugguuaccuggugcggacacgcagggcucaaacuggauccagaaggagacgcuggugaccuucaagaacccccacgcaaagaagcaagacgugguugugcuugggucccaggagggugccaugcauacagcccugacgggggccaccgagauccagaugagcagcggcaaucuccuguucaccggccaccugaagugccgcuuacggauggacaaacuccagcugaaggggaugaguuacucaaugugcaccgggaaguucaagaucgucaaggaaaucgcugagacgcaacauggcaccaucgugauacgugugcaauacgagggcgacggaucccccugcaagauccccuucgagaucacggaccuggagaagcggcacguacucgggcgccugaucacagugaauccgaucgucacggagaaggauagccccgucaacauugaggcggaaccgccuuucggcgacuccuacaucaucguggggguggaaccgggccagcugaaacucaauugguucaaaaaggggaguuccaucggccagauguucgagacaacuaugcgcggugccaagcggauggcuauccugggcgauaccgccugggacuucggcucguugggcggugucuucacguccaucgggaaagcacuccaccaggucuucggugcgaucuacggagccgccuucagcgggguguccuggaccaugaagauacugaucggcgucauaauuaccuggauagggaugaacagccgcuccacaucgcuguccgugagccuggugcucgucggcguggugacuuuguaccuaggugccauggugcaggcggacuccggcuguaucguaaguuggaagaacaaggaguuaaagugcggcucagggauauucaucaccgacaacguccacaccuggaccgagcaguacaaguuucagcccgaaagccccagcaagcuggccuccgccauacagaaggcucacgaggaggggaucugugggauucgcagcgucacgcgccuggaaaaccucauguggaagcaaaucaccccagagcugaaccacaucuuauccgagaacgagguuaaguuaaccauuaugaccggagauaucaaggggaucaugcaggcugggaagcgcagccugaggccucagcccacggagcugaaauacuccuggaagacuugggguaaggcgaagauguugagcaccgagagccacaaucagaccuuucuuauugauggaccugagacggccgagugcccgaacaccaaucgggccuggaauagcuuagagguggaggacuacggcuucggggucuucaccacaaacaucuggcucaagcugcgcgagaaacaggacguguucugugauucaaagcugaugagcgcggccaucaaggacaaccgcgcgguucacgcggacaugggcuacuggaucgaguccgcccucaacgacaccuggaagauggagaaggccagcuucauugaggucaaguccugucacuggcccaagagucacacccuguggucaaacgguguucuggagagcgagaugaucauccccaagaacuucgccgggcccgugucccagcauaacuauaggccuggcuaccauacucagaccgcggggcccuggcaccuaggcaagcuggagauggacuucgacuuuugcgagggaaccacggucguggugaccgaagacugcggcaaccgaggccccagcuuacgcacgaccacggccagugggaagcucauaaccgagugguguuguagaaguugcacccugcccccguugcgcuaccggggagaagacggauguugguacgggauggagauccgcccccucaaagagaaggaggaaaaucuggucaacagccucgugaccgcuggccauggccagaucgacaacuuuucccuaggcgugcugggaauggcgcuguuccuagaggagaugcugcggacgcgcgugggaaccaagcaugcgauccugcucguggcccuaagcuuugugacccugaucaccgggaacaugucuuuccgggaccucggccgagucauggugauggugggggcgacgaugaccgacgacaucggcaugggagucaccuaucuagcgcuccucgccgcguucaaggugcgucccaccuucgccgccgggcugcugcugcgaaaacuuacgagcaaggagcuaaugauggccaccauaggcaucgcccuccugagucaaagcacguugcccgagaccauccucgaguugacggacgcacuggcccuggggaugauggcccucaagaucguacgaaauauggagaaguaucaacuggccgucaccauuauggccauaucaugcgugcccaacgcggugauccuccagaacgcguggaagguuagcuguaccauccuggccgccguauccguaagcccccuacucuuaacuuccagucagcagaaggcggacuggaucccccuggcccucacgauuaagggccugaaccccacggccaucuuccugacgacccucagccggaccucgaagaagcgcuccuggccccugaacgaggccauaauggccgucggcauggucucgauacuggcguccagccucuuaaagaacgacauccccaugaccgggccucugguugccgguggguuacugacugugugcuacguucugaccggccgggccgccgaccuagagcuggaacgcgccgcggaugugaagugggaggaccaggccgagaucagcgggucaagccccauccuguccauuacgaucuccgaggacggcuccaugagcaucaagaaugaggaggaagagcagacccucaccauccugauccggaccggccuacucgugaucuccgggguguucccgguaagcauacccauaaccgcagccgcaugguaccugugggaggugaaaaagcagcgcgccggcgugcugugggacgucccaagccccccgcccgucgggaaggcggagcucgaggacggagccuaccgaaucaagcagcgcgggauccuugguuacagccagauaggcgccgggguauacaaggaagguacguuccacacuauguggcacguuacccgcggcgccgugcugaugcaccggggcaagcggauagaacccuccugggcggacgugaagaaagaucucaucagcuacggcggcggauggaaacuggagggugaguggaaagagggcgaggagguccaggugcucgcccucgagcccgggaagaacccccgcgccgugcagacgaagcccggcaucuuuaagacgaauaccggaaccaucggcgccgugucccucgacuucagcccgggcacgucggggagccccaucguggaccggaaaggcaagguggugggccuguauggcaacggcguggugacgcguucgggggcuuaugucucggccaucgcccagaccgagaaguccaucgaggacaaccccgagauagaagacgauaucuucagaaagaagcgccucaccaucauggaccugcaccccggcgccgggaagacgaagcgguaccugcccgccaucgugcgugaggcaaucaagcgcggccugcgcacgcuaauccuggcuccaacccgcgugguugccgcugagauggaggaggcccugcgcggucuccccauccgcuaccagacccccgcgauucgggcugagcacacagggcgcgaaaucguggaucugaugugccacgccacauuuaccaugcggcuacucagccccgugcgcgucccgaacuacaaccuaaucauaauggaugaggcacacuucaccgaccccgcuagcaucgcggcccgggguuacaucuccacccgcguggagaugggggaggccgccggcaucuucaugacggcaacgccgccugggagccgcgacccguucccccagaguaacgcuccgaucauggacgaggagagagagauucccgagcggagcuggaacuccggccacgaaugggucaccgacuuuaaggggaagaccgugugguucgucccgagcaucaaagcuggcaaugauaucgcagcaugcuuacgcaagaauggcaagaaggugauacagcucuccaggaagacguuugacagcgaguacgcgaaaacacgcgcuaaugacugggacuucgucgugaccaccgacaucuccgagaugggagccaacuucaaggccgaacgggugaucgacccgagaagauguaugaagccagucaucuuaacggacggcgaggagcgcgugauccuggcggggcccaugccgguaacccacagcuccgcggcgcagcggcgcgguaggaucgggcggaaccccaagaacgaaaacgaccaguacaucuacaugggcgagccccucgagaacgacgaggacugugcccauuggaaggaggccaagauguugcuggacaacauaaacaccccggaggguaucauccccagcauguucgagcccgagcgcgaaaaggucgacgcaaucgacggggaguaccggcucagaggcgaggcacggaagaccuucguggaccugaugcgccgcggcgaccugcccguguggcucgccuauaagguagcagccgagggcaucaacuacgcggaccgcaaguggugcuucgacggaauaaaaaauaaucagauucuggaggagaacguugagguggagauauggacgaaggagggcgaacgaaagaagcuaaagccccgcuggcuugacgccaggaucuacuccgacccguuagcacuaaaggaguucaaagaguucgcugccggacgcaaguccuugacccugaaccugaucacggaaauggggcggcuccccaccuucaugacacagaaagcgcgcaacgcccuggacaaccuggcgguccuccacaccgccgaggugggcggaaaagccuacacccacgcccuauccgagcugcccgaaacccucgagacacuccuccuccugacacuguuggccgccgugacaggagguauauuccuguuccugaugagcggaaagggcauugguaagaugacuuugggcaugugcuguaucauaaccgccuccauccugcugugguaugcccaaauccagccgcacuggauugcggccagcaucauccuggaguuuuuccucaucgucuugcucauccccgagccugagaagcagcgcacgccucaagacaaccagcuaaccuauguggucauagccauacucaccgugguggcggccaccauggcaaaugagauggguuuucucgagaagacgaagaaggaccuuggcuuuggcuccauaaccacucaggagagcgagagcaacauucucgacaucgaccuccgcccggccuccgccuggacacuguacgccguggcgacgacguuugugacucccaugcugagacacagcauugagaacuccucagugaacgucucgcucaccgccaucgcaaaccaggccacaguucugauggggcucggaaagggguggcccuugagcaagauggacaucggggugccccugcuggccauagggugcuacagucaggucaacccgauaacccugaccgcggcucugcugcuccuaguagcccauuacgccaucaucgguccuggcuuacaggccaaagcaacccgcgaggcccagaagagggcggcugccggcaucaugaagaaucccacgguggacggcauaaccgucaucgaccuagagcccaucccguacgaccccaaguucgagaagcagcuggggcaaguaaugcugcucauccugugcgugacucaaguccugaugaugcggaccacgugggcccucugcgaggccuugacccuggccaccggacccaucagcaccuuaugggaggggaacccgggccgguucuggaacacuaccaucgccguaucgauggcgaacaucuuccgcggcagcuaccuggccggggccggccuacuguucagcaucaugaagaacacaaccaacacgcggcgggggaccggaaacguaggagagacccugggcgaaaaauggaagucacggcuaaacgcucucggcaagucagaguuccaaaucuacaaaaaguccggcauccaggaggucgaccggacccuggccaaagaaggcauuaagcggggagaaacggaccaccacgcuguguccagaggcucagccaagcugcgcugguucguggagcggaacauggucaccccggagggcaaggugguugaccucgggugcggacgugguggauggagcuacuacugugggggccugaagaauguacgggagguaaagggccugaccaagggcgguccgggccaugaggagccaauccccaugagcaccuacgguuggaaccucgucaggcugcaguccgggguugacguguucuucacuccgcccgaaaagugcgacacucugcucugcgauaucggugagagcagccccaaucccaccaucgaggccggccggacuuuacgcguucuuaaucuagucgagaacuggcuaaacaauaacacacaguuuugcauuaaggugcugaacccguacaugcccucggugaucgagaagauggagacgcuccagcggaaauacggcggcgcacuaguccgcaacccccugucacggaacuccacccaugagauguacugggugucaaacgcuaccgggaacauugugucaagcgucaacaugaucagccgcaugcugaucaaccgguucaccaugaagcacaagaaggcgacguacgaaccggacguggaucucggcuccggaaccaggaauaucggcaucgaauccgagauccccaaccuagacaucaucggcaagcgaaucgagaagaucaagcaggagcacgagacgucguggcacuacgaccaggaucaccccuacaaaaccugggccuaccacgggucauacgaaacgaagcagacuggaagcgccuccagcauggugaacggcgucgugcgccugcucaccaaaccgugggacgugguuccgauggugacccagauggccaugacggacaccacuccguucggccagcagcgcguguuuaaggagaaggucgauacccggacgcaggagcccaaggaggguaccaagaaacugaugaagaucaccgcggaauggcuguggaaggaacucgggaaggagaagaccccccggaugugcacacgcgaggaguucacccgcaaggugcgguccaaugcggcccugggagccguguucaccgacgagaacaaguggaaguccgcccgcgaggcugucgaggaugggcgauucugggagcuuguggacagggagcggaaucuccaucuggaaggcaagugcgagaccugcguuuacaacaugauggggaagcgcgaaaagaagcugggagaguucggcaaggccaaagggucccgugccauaugguacaugugguuaggcgcucgcuuucuggaauucgaggcgcugggguuccugaacgaggaccauugguucagccggggcaacucccugagcggggucgagggcgaggggcugcaucgacuugguuacaucuugcgggaggucggcaagaaagaagggggugcgauguacgccgacgacacugccgguugggauacccgcaucacccuggaggaccucaagaaugaggagaugguuaccaaccauaugaagggugaacacaagaagcuggccgaggcgaucuucaagcuuacguaccagaacaaggucgugcgggugcagcgcccgacgccccggggcaccgugauggacaucaucagccgcaaggaccagcgggggaguggccagguggguaccuacggccucaacacguucacgaacauggaggcgcagcugauccgccagauggagggcgaggggaucuucaagagcauccaacauuugaccgccaccgaggagaucgccgugcagaacuggcucgcgcgcgugggucgggagcgacugagucggauggccaucagcggggacgauugcguggucaagcccauugacgaccgcuucgcguccgcucugacggcccuuaaugauaugggcaaggugcggaaggacauccagcaaugggagccuagccgcggguggaacgacuggacccaggugccguuuugcucccaccacuuccacgaguuaguaaugaaggacggccguguccuggucguucccugccgaaaucaggacgagcucaucgggcgggcccgcaucagccagggggccggcuggucacucaaggagaccgcgugccugggcaagagcuacgcccagauguggacccucauguacuuccaccggcgcgaccugcggcuugccgccaacgcaaucuguucagcugugccaagccacugggugccuacaucccggaccacuugguccauccaugcuaagcacgaguggaugaccacggaggacaugcucgcgguauggaaccggguguggauccaggagaacccguggauggaagacaagacaccgguggaguccugggaggagguccccuaccugggaaaacgcgaggaccaguggugcgggagcuuaaucggccuaacgucccgagccaccugggccaaaaacauccagacagccaucaaccagguccgcucccugaucggcaacgaggguuacacggauuauaugcccagcaugaagcgguuucgccgcgaggaggaggaggcuggggugcuaugguga

SEQ ID NO: 24910 - RNA, 9876 nt, Artificial Sequence
  derived and/or modified CDS sequence (opt11) from DENV-2__GQ199890__SS-prME
accgccggcgugaucgugaugcucauacccaccgccauggcguuccaccucaccacccggaacggggagccccacaugaucgugggccggcaggagaaggggaagucccugcuguucaaaaccgaggacggcgugaacaugugcacccucauggccauugaccugggggagcugugugaggacaccaucaccuacaagugcccccuccugcggcagaacgaacccgaagacaucgauugcugguguaacuccaccucgaccugggucaccuacgggaccugcaccaccaucggcgagcaccggagagagaagcgguccguggcccuggugccacacguuggaaugggccuggaaacgcgcacugagaccuggaugagcagcgagggggccuggaagcacgugcagcggauugaaaccuggauccugagacacccgggcuucacgaucauggcagcgauccuagccuacaccaucgggaccacccacuuccagagagcccucauuuucauccugcugacggcuguggcgcccagcaugaccaugcgcugcauuggcaucagcaaccgggacuucguggaaggugugagcgggggcuccuggguggacaucguccuagagcacggcuccugugugaccaccauggccaaaaacaagcccacccucgauuucgaacuaaucaagaccgaggccaagcagccagccacgcuccgcaaguacugcaucgaggccaagcugacuaacacgaccacugaaucccgguguccgacccaaggcgaaccaucguuaaacgaggagcaggacaagcgcuucaucugcaagcacucuaugguugaccggggcuggggaaacggcugcggccuguucggcaagggcggcauugugacgugcgcgauguucacgugcaagaagaauauggagggcaagauaguucagcccgagaaccuggaguacaccaucgugaucacgccccacucgggugaagagcgagccgugggcaacgacacggggaaacacggcaaggagaucaagaucaccccgcaauccucgaccaccgaggccgaauuaacaggguacggcacggugaccauggaaugcucgccccggaccggucucgacuucaacgagauggugcugcugcaaauggaagauaaggccuggcuuguacaccgccaaugguuccuggaccuuccccuccccuggcugccgggggccgacacccaggggagcaacuggauccagaaggaaacacuugugaccuucaaaaacccccacgcgaagaagcaggacguugucguacucgggucccaggagggcgccaugcacacagccuuaacgggggccacggagauucagaugagcagcggcaaccuccuguucacuggccaccugaagugcaggcugcgcauggacaagcuccagcugaaggggauguccuacagcaugugcaccggcaaguucaagaucgucaaagagaucgccgagacccagcaugggacgaucguuauucgggugcaguacgagggcgacgggucacccugcaagaucccauucgagauuaccgaccuggagaagcgccacguucuagggcgacugauuaccgugaacccgaucgugaccgagaaggacagcccuguaaacaucgaggcggagccgccauucggugacuccuauaucauuguggggguugagccgggccagcugaaauuaaauugguucaagaaggggagcucaaucggucagauguucgagacgacgaugcggggcgcaaagcgcauggccauacugggcgauaccgccugggacuucggcagccucggcggggucuucaccagcauugggaaggcacuccaccagguguucggggcaaucuauggcgccgccuucagcgggguguccuggacgaugaagauccugauaggcguuaucaucaccuggaucggcaugaacagccgguccacaagcuuauccgugagccuggugcucguuggcguagugacccuguaccugggugcaaugguccaggcagacuccgguugcaucguaagcuggaagaacaaggagcucaagugcggcucuggaaucuuuaucacggacaaugugcacaccuggaccgagcaguacaaguuccagcccgagagccccagcaagcuggccucugcaauccagaaggcucacgaagagggaaucugcgggauccguagcgucacucggcuggagaaccucauguggaagcagaucacgccagaguuaaaucacauccugagcgagaaugaggugaagcucaccaucaugaccggcgacauuaaggggaucaugcaggcaggcaagcgcagcuugcggccgcaaccaaccgaacugaaguacagcuggaagacguggggcaaggcgaagaugcuaaguaccgagucccacaaccaaaccuuccugaucgacgggcccgagaccgccgagugcccgaauacuaaccgggccuggaauagccuggagguggaggacuacggauucggagucuucaccaccaacauuuggcucaagcugcgggagaagcaggacguuuucugcgacucgaaacugaugagcgccgccaucaaggauaaccgcgcggugcacgccgacaugggcuacuggauugaguccgcauugaacgacacauggaagauggaaaaggcgagcuuuauugaagucaagucaugccacuggccuaagucccacacccuguggucaaacgguguacuggagagcgagaugaucauccccaagaacuucgccgggcccgugucccagcacaacuaccggccgggguaccauacgcagaccgcaggccccuggcaccuaggcaagcuggagauggacuucgacuucugcgaggggaccacagucguggugaccgaggacugcggcaacagaggccccagccugcggaccaccaccgccagcgggaagcucaucacugaguggugcugucgcuccugcacccugcccccguugcgguaccgcggcgaggacgggugcugguauggaauggagauccggccccucaaagaaaaagaggagaaccuggucaauagccuggugacagccgggcacgggcagaucgacaauuucagucucggcguguuggggauggccuuauucuuagaggaaaugcugcgcacccggguuggaacaaagcacgcgauccugcucguggcccugucuuuugugacccugaucaccgggaacaugaguuuccgcgaccucgggcgcgucauggugauggugggggccaccaugacggacgacauugggaugggcgucacuuaccuggcccugcucgccgcguucaaagugcggcccacguucgcggcggggcuguuacugcgaaagcugaccagcaaggagcugaugauggccacaaucggcaucgcacuacugagccagagcacccugccugaaacgauccucgagcuaacagacgcgcuggcccuagguaugauggcccugaagauaguccgaaacauggagaaauaccagcuggccguaacgaucauggcaaucuccugcgugccgaacgcagugaucuugcagaacgccuggaaggucagcugcacuauccuggccgcugucuccgugucuccccucuuacucaccagcagccagcagaaggcugacuggaucccucucgcacucaccaucaagggccugaacccaacggcgaucuuccugaccacucucucccgcaccaguaagaagcgguccuggccgcugaacgaggccaucauggccguaggcauggugagcauccuggcguccagccuucugaaaaacgacauccccaugacggguccgcuggucgccggcgggcuccugacugugugcuacgugcugacuggccgcagcgccgaccucgagcuagagcgggccgccgacgucaagugggaggaucaggccgagaucuccgggagcucccccaucuuaagcaucaccaucuccgaggacgguagcaugucuauuaagaacgaggaggaggagcaaacgcuuaccaucuugauccgcacuggcuuacucgugaucagcggaguguucccggucagcaucccuaucacggcugccgccugguaccugugggaggugaaaaaacagcgggcagggguccuaugggacguccccaguccgccgcccguggggaaagcugagcucgaagacggcgccuaucgcaucaaacagcgggggauccucgguuacagucagaucggcgccggggucuacaaggagggcaccuuccacacgauguggcacgucacccgcggggcugugcugaugcaccgugguaagcgcaucgagccuagcugggccgacgugaagaaagaccucaucuccuacggaggcggcuggaagcuugagggggaauggaaggagggcgaggagguccaagugcuggcgcucgaacccgggaagaacccgcgggcagugcagacuaagcccggcaucuucaagaccaacacggggaccauaggcgccgucagccuugacuucucccccgggaccagcgggucucccauuguggaccgcaagggcaagguugucggucuguacggcaacggcguagucaccagaagcggggccuacgucuccgcaaucgcucagacggagaaguccaucgaggauaacccugaaaucgaggacgauaucuuccgcaagaagcgguugacuaucauggaccugcaccccggcgccgggaagaccaagcgcuaccugcccgccaucguccgggaggcuaucaaacgcggccugcgcacucucauccuggcuccgacgcggguggucgcagccgagauggaggaggcccugcgcgggcuucccauccgguaccagaccccggccauccgcgcggagcacacuggucgggagaucguagaccugaugugccacgcaacguucacgaugcgccugcucagccccgugcgggucccgaacuauaaccugaucaucauggaugaggcccacuucacagacccggccuccaucgccgcccgcgguuacaucagcacucgggucgagaugggggaggccgccggcaucuucaugacagccacgccgcccggaucccgugacccguucccacagucgaacgcgccgauaauggacgaggagcgggagauccccgagcgauccuggaauagcggacaugaaugggugaccgacuucaaggggaagaccgucugguucgugcccuccaucaaggcgggcaacgacaucgcagcaugccugcggaaaaaugggaagaaaguaauccaacucagccgcaaaaccuucgacuccgaguauguuaagacgcgggcaaacgacugggacuucguugugaccacagacaucagcgaaaugggggcgaacuucaaggcagagcgcgucauugacccucggagaugcaugaaaccugugauccugaccgacggagaggagcgggugaucuuagccgggccaaugccgguaacgcauucaucugccgcccagcgccgcggccggauugggcgcaacccgaagaacgagaacgaccaguacaucuacaugggcgagccccucgagaacgacgaggacugugcgcauuggaaggaggccaagauguuacuggauaacaucaauacccccgagggcaucaucccguccauguucgagcccgagcgggagaagguggacgccauugacggggaguaccgccuccggggcgaagcccgcaagacauucguggaccugaugcgacgcggggaccugcccguauggcucgcuuacaagguugcggccgagggcaucaacuacgcagaccggaaguggugcuucgacgggauuaaaaauaaccaaauacuggaggagaacguggaggucgagaucuggaccaaggagggcgagcgcaagaagcugaagccgcggugguuagacgcucggaucuacucggauccccuggcccugaaggaguucaaggaguuugccgccggccggaagucccucacgcugaaccugaucaccgagauggggagacucccuaccuuuaugacccagaaagccaggaacgcccuggacaaccuggcgguacuccauacggcagaagugggcgggaaggccuacacccacgcccugagcgaacugccugagacccucgaaacccugcuguugcugacucugcuugcgaccaucaccggcggcaucuuuuuauuccugauguccgggaagggcaucgggaagaugacccucggcaugugcugcaucaucaccgcgagcauccugcugugguacgcccagauccaaccgcacuggauagccgccuccaucauccucgaguucuuccucaucguccuccucauccccgagcccgagaaacagcgcacaccccaggacaaccaacugaccuacguggucaucgccauccugaccgugguugcggccacuauggccaacgagaugggauuccucgagaaaacgaagaaagaccugggguucggcacgaucaccacucaggagagcgaaagcaacauacuggacaucgaccuucggcccgccuccgccuggacgcuuuacgcgguggccaccaccuucgugacccccaugcugcgccacagcaucgagaacuccucagucaacgucucccucacggccaucgccaaccaagccaccgugcuaauggguuuaggcaagggguggccacuaagcaagauggacauuggcgugccccuacuggccaucgggugcuacucccagguaaacccgauaacccucaccgccgcccugcugcucuuaguggcucacuacgcgauaauaggcccagggcugcaagccaaggccacgcgugaggcccagaaacgagcggcugcugggaucaugaagaacccgaccguggacggcaucaccguaaucgaccucgagccgaucccguacgaucccaaguucgaaaagcagcugggccaggugaugcuguugauccugugugugacccagguccugaugaugcggacgaccugggcucugugcgaggcccugacccuggccaccggcccgaucagcacgcucugggaggggaaccccggccgguucuggaacaccacaaucgccguguccauggccaacaucuuccgcggcagcuaucucgccggcgcuggucuucuguucuccaucaugaaaaacacuacuaacacacggcgcgggacaggcaacgugggcgagacccuuggggagaaguggaagucacggcugaacgcgcucggcaaguccgaguuccagaucuacaagaaauccgggauccaggaggucgaccguacgcuggcgaaagagggcaucaagcgcggggagacagaccaccacgccgugucccgcggcuccgcaaagcugcggugguucguggaacgcaacauggucacaccggaaggcaaggugguggaccucggcugcggccggggcgggugguccuacuacugcgguggucugaagaacgucagggaggucaaggggcugaccaagggcgggcccgggcacgaggagcccauccccaugagcacguacgguuggaaccucgugagacugcaguccggggucgacguguucuucacgccgcccgagaagugcgacacccugcucugcgauaucggcgagagcagccccaaccccacaaucgaggccggccgcacccugcggguguuaaaccuaguagagaauuggcugaauaacaacacgcaguucugcaucaaggugcucaacccguauaugcccuccgugaucgaaaagauggagaccuuacagcgcaaauaugggggcgcgcugguccggaacccucugagccgcaacuccacccacgagauguacugggugagcaaugccaccgggaacaucgugucaagcguuaacaugaucucccggaugcugauuaaucgcuucacgaugaagcauaagaaggccaccuacgaaccggacguggaucucggcagugggacccggaauaucggcauugaauccgagaucccuaaccuggacauaaucgguaagcgcaucgagaagaucaagcaggagcacgagaccucauggcacuacgaccaggaccacccguacaagacgugggccuaccacggcuccuaugagaccaagcagacgggcagcgccuccagcaugguaaauggggucgugaggcuucucaccaagcccugggaugugguaccgauggugacgcaaauggcgaugaccgacaccaccccauucggccagcagcggguuuucaaggagaaggucgacacccgcacccaggagccgaaggaggguaccaagaagcugaugaagaucaccgcagaguggcuguggaaggagcucgggaaggagaaaacgcccaggauguguacgagggaggaauucacccggaaggugcgcuccaacgcggcccugggcgccaucuucaccgacgagaacaaauggaaguccgcgcgcgaggcuguggaggacgggcguuucugggagcuggucgaccgggagcgcaaccuccaucuggagggcaaaugcgagacgugcguguauaacaugauggggaagagagagaagaagcugggcgaguucgggaaggcgaaggguucccgcgccaucugguacauguggcucggcgcucgguuucuggaguucgaggcccugggguuccucaacgaggaccacugguucagccgcggcaauucccugagcgggguggagggcgagggccuucacagacucggguacauucuucgcgaggucgggaagaaggagggcggugccauguacgccgacgacaccgccggcugggacacucggaucacacuggaggacuugaagaacgaggagauggugaccaaccacaugaagggggagcacaaaaagcuggcggaggcaaucuucaagcugaccuaccagaauaagguagugcgcgugcagcggccgacgcccaggggcaccgucauggacauaauaucucggaaagaccagcgcggguccggccaggugggcaccuacggccucaacaccuucaccaacauggaggcacagcugauacgccagauggagggagaggggaucuuuaaaagcauccagcaccugaccgccacggaggagaucgccgugcagaacuggcucgcgcgagucggcagggagcgauuaucccgcauggcgauaagcggggacgacugcguggugaagccuaucgacgaccgguucgccagugcgcugacugccuuaaacgacauggggaagguccguaaggacauucagcagugggagcccagccggggcuggaacgacuggacccagguaccguucugcagucaccauuuccacgaguuagugaugaaggacggccgcguccugguagugccuugcagaaaccaggacgaacucaucggccgcgcacggaucagccagggggccggcuggucucugaaggagaccgccugccugggcaagagcuacgcgcagauguggacccuaauguauuuccaccgccgggaucuucgccuggccgcgaacgccaucugcagugcgguucccagccacugggugcccacgucccgaacgaccuggagcauccacgcaaagcaugaguggaugacgacagaggauaugcucgcgguauggaaccgaguuuggauccaggagaacccguggauggaggacaagacccccguggagagcugggaggaggugcccuaccuggggaagcgggaggaccaguggugcgggagccugaucggcuugaccucccgagccaccugggccaagaacauccaaacugccaucaaccagguucggagccugaucggcaacgagggguacaccgacuacaugccuaguaugaagcgcuuucgcaaggaagaagaggaggccggcgugcugugguga

SEQ ID NO: 24911 - RNA, 9876 nt, Artificial Sequence
  derived and/or modified CDS sequence (opt11) from DENV-2__GQ868549__SS-prME
accgccggagugaucgugaugcugauccccaccgccauggcguuccaccucaccacccgcaacggggagccccacaugaucgugggccggcaggagaaggggaagucccugcuguucaagaccgaggacggcgugaacaugugcacgcuuauggcaaucgaccugggggagcugugcgaggacaccaucaccuacaaaugucccuugcuccgccagaacgagcccgaggauaucgacugcuggugcaacucgaccucaaccugggucacauacggaaccuguacgaccaccggcgagcaccggcgcgagaaacggucgguggcucuggugccccacgucggcaugggucucgagacccgcaccgagaccuggaugagcuccgagggugccuggaagcaugugcagcggaucgagaccuggauccuccgccacccgggcuucacaaucauggccgcgaucuuggcuuauaccaucgggaccacgcauuuccagcgcgcgcucaucuucauccugcugaccgccguggcgcccagcaugaccaugcgcugcaucggcaucuccaaccgggacuucgucgagggagugagcgggggcuccuggguggacaucguccucgagcacgggagcugcgucacuacuauggccaagaacaagcccacccuggacuucgaguugaucaagaccgaggccaagcagcccgcaacccuccgcaaguacugcauugaggccaagcugacaaacaccacuaccgagagccguugcccgacgcagggugagcccagccugaaugaggagcaggacaagcgcuucaucugcaagcacaguaugguggaccgcggcugggggaauggcugcgggcuguucggcaagggcggaaucgugaccugcgcgauguucaccugcaagaagaauauggagggcaagaucguccagcccgagaauuuagaguacaccaucgugauaacgccccacagcggggaagagcacgccgucggcaacgacaccgguaagcacggcaaggagauaaagauaaccccgcaguccagcaccaccgaggccgagcugacgggguacggcaccgugaccauggagugcagcccccggacuggccucgacuucaacgagauggugcugcugcagauggaggacaaggccuggcucgugcaccggcagugguuccuggaccugccgcuuccaugguuaccgggggccgacacgcaaggcagcaacuggauccagaaggagacccuggugacguucaaaaacccccaugcgaagaagcaagacguggucguguuggggucccaggagggcgccaugcacaccgcucuaacgggggccaccgagauccagaugagcagcggcaacuuacuguucacaggccaccugaagugccgucugcggauggacaaacuccagcugaaggggauguccuacagcaugugcaccggcaaguucaagaucgucaaggagaucgccgagacucagcacggaaccaucgugauccgcgugcaguacgagggcgacggcagucccugcaagauccccuucgagaucaccgaccuggaaaagcggcacguccucgggcgccugaucaccgugaacccgaucgugacggagaaggacagccccgucaacaucgaggcggagccucccuucggcgacuccuacaucaucguggggguggagccgggccagcugaagcucaacugguuuaaaaaggggagcagcaucggccagauguucgagaccaccaugcgcggagccaagcggauggccauccugggggacacagccugggacuucggcucacucggcggggucuucacguccaucgggaaggcccuccaccagguauucggggcgaucuacggcgcugccuucagcggggugucuuggaccaugaagauccugauuggcguaaucaucaccuggauagggaugaacagccgcucgaccagccuguccgugagccuggugcuugucggcguugugacgcuguacuugggggccauggugcaagcggauucaggcugcaucguuagcuggaaaaacaaggagcucaagugcggcuccgggaucuucaucaccgacaacgugcacacguggaccgagcaguacaaguuccagcccgagagccccagcaagcuggccuccgccauccagaaggcccacgaggagggcaucugcggaauacggagcgucacacgccuggagaaccucauguggaaacagaucacccccgagcugaaccacauccuguccgagaaugaggugaagcucacgauaaugaccggcgacaucaaggggaucaugcaagccggcaagagaagccugcgcccgcagcccacggagcugaaauauuccuggaagaccuggggcaaggcuaaaaugcucagcaccgagucccacaaccagaccuucuuaaucgacggucccgagacggcugagugcccgaacaccaaccgggccuggaacagccuggaaguggaggauuacgguuucggggucuucaccacuaacaucuggcucaagcugcgggagaagcaggacguguucugcgacuccaagcuuaugagcgccgccaucaaagacaaccgggcagugcacgccgacauggguuacuggaucgaguccgcccucaaugacacguggaagauggagaaggccagcuucaucgaggucaaguccugccacuggcccaagucacacacgcuguggucuaacgguguguuagagagcgagaugauuaucccuaagaacuucgccggacccgucucacagcacaauuaccgcccuggcuaccacacccagaccgcgggaccguggcaccucggcaaacuggagauggauuuugacuucugugaggggaccacugucgugguaaccgaggacugcggcaaccguggcccuagccuucgcaccaccacugccagcgggaagcucaucaccgaguggugcugccgguccugcacgcugcccccucugcgcuaccguggcgaggacgggugcugguauggcauggagauacgcccgcucaaggagaaagaggaaaaccuggucaacagccuggugaccgccgggcacggccagaucgauaacuucucccucggcgugcugggcauggcccuguucuuagaggagaugcuacggacgcgcguugggacuaagcaugcgauccugcucgucgcccugucuuucgugacucuuaucaccgggaauauguccuuccgggaccucggccgcgucauggugauggugggagccacgaugacagacgacauaggcaugggcgucaccuaccuggcccugcucgccgcguucaaagugcgccccaccuucgccgcgggccuguugcuccguaagcugacgagcaaagagcugaugauggccaccaucggcaucgcccuucugucccagagcacccugcccgaaaccauccucgagcugacggacgcucuggcacucggaaugauggcccugaagauugugcgcaauauggagaaguaccagcuggccgucaccaucauggcaaucucaugcgugccgaacgccgugauccuccagaacgcguggaaggucagcugcaccauacuggccgccguguccgugagcccccugcuccucaccucgagccaacagaaggcugacuggauaccccuggcccucacgauuaagggccugaaccccacugccaucuuccugaccacccucucccggacgucuaagaagcgcuccuggccgcugaacgaggccaucauggccguaggcauggugagcauccuggcguccagcuuacugaaaaacgacauccccaugaccggaccccugguggccggcgggcuccugaccgugugcuacgugcucacgggccggucagccgaccucgagcuggagcgcgccgcggacguaaagugggaggaccaggcggagauauccgggagcucgcccauccuguccaucacgaucuccgaagacggcagcauguccaucaaaaaugaggaggaggagcagacuuuaaccauccugauccggaccggccuguuagugaucagcgggguguuccccgucagcauccccaucaccgccgcggccugguaucugugggagguuaagaagcaaagagccggcgugcugugggacguccccucgccgccgccagugggaaaggcggaauuggaggacggcgccuacaggaucaagcagcgggguauccugggcuacucccagaucggcgccgggguguauaaagagggcacguuccacaccauguggcacgucacccgcggggccgugcuuaugcaccgaggcaaacggaucgagcccagcugggccgacgugaaaaaagaccucauuuccuacggggggggcuggaagcuagagggggaguggaaggagggagaggaaguccaggugcuugcguuggagcccggaaagaacccccgcgccgugcagaccaagcccggcaucuucaagacaaauaccgggaccaucggcgccgucucacuggacuucuccccuggcaccagcggaucccccaucguggaccggaaaggcaagguggucgggcuguacggcaauggcguggugacgcgcagcggagccuacgucuccgcgaucgcccagaccgagaagucuaucgaggacaaccccgagaucgaggacgacauauuccggaagaagcgccucaccaucauggaucugcacccgggcgccggcaagacgaagcgguaccugcccgcgaucgugcgcgaggccaucaagcggggccugcgcacgcucauccuggcgcccacccgcguggucgccgccgagauggaggaggcucugcggggccucccgauccgguaccagacccccgccauccgggcggaacacaccggccgcgagaucguggaucugaugugccacgccacguucaccaugcggcugcugagccccgugcgcgucccgaacuauaaccugauuaucauggacgaggcucacuucaccgaccccgccuccaucgccgcgcggggcuacaucagcacccgaguggagaugggggaggccgccggcauauucaugacggccacuccgcccgggucccgggauccguucccacagagcaacgcgcccauaauggacgaggagcgcgagauccccgagcgcucguggaacagcggccacgagugggugaccgacuucaaggggaagaccgucugguuugugccaagcauaaaagccggcaacgauauugccgccugccugcgcaagaacggcaaaaaggugauccagcucagccggaagacguucgacuccgaauacgugaagacccgcgccaacgacugggacuucguggugaccaccgacauaagcgagaugggcgcgaacuucaaagccgagcgggucaucgaccccagacggugcaugaagcccgugauccugacggacggcgaggagcgcgugauccuggccgggcccaugccggucacacacuccagcgcagcccagcgucgcggucgcaucgggcggaauccgaagaacgaaaacgaccaguacaucuacaugggggagccccuggagaacgacgaggacugcgcgcacuggaaggaggcuaagaugcugcuggacaacaucaacaccccagagggcaucaucccuuccauguucgagcccgagcgugagaagguggacgccaucgacggggaguaccggcuccgcggcgaagcucggaagaccuucguggaccugaugcgucgcggggaccuccccgucuggcucgccuauaagguggcggccgagggcaucaauuacgccgaccgcaaguggugcuucgaugggaucaagaauaaccagauccuggaggagaacguggaggucgagaucuggacgaaggagggcgagcggaagaaacugaagccccgcuggcucgacgcccggaucuacucggacccccuggcguugaaggaguucaaggaguucgccgccggccgcaagucccucacacugaaccugaucaccgagauggguaggcucccaaccuucaugacgcagaaggccaggaacgcccuggauaaccuggcggugcuccauaccgccgagguuggcgggaaggccuauacccacgcccugagcgaacugcccgagacgcucgagacgcugcugcuccugacccugcucgcggcggucaccggcgggauuuuccuguucuugauguccgggaagggcaucgggaagaugacccucggcaugugcugcaucaucaccgccagcauccugcugugguacgcacaaauccagccacacuggaucgccgccuccaucauccuggaguuuuuccugauuguccugcucauccccgagcccgagaaacagcggacaccccaggacaaccagcugaccuacgucguuaucgcgauccugaccguagucgccgccaccauggccaacgagaugggauuccucgaaaagacgaagaaggaccugggcuucggcagcaucacaacccaggagucggaguccaacauccuggacaucgacuugcgccccgcaagcgcguggacacucuacgccguugccacgacguuuguuacccccaugcuucggcacuccaucgagaacagcuccguaaacgugagucucaccgccaucgcgaaccaagccacggugcugaugggacugggcaagggguggccccucuccaagauggacaucggcgucccgcugcuggccaucgggugcuacagccagguaaacccaaucacccucacagccgcccugcugcuccugguugcgcacuacgcgauaaucggccccggccugcaggccaaagccacucgcgaggcccagaagcgggcggcggccgggaucaugaagaaccccacggucgacgggaucaccgugaucgaccucgagcccaucccauacgaccccaaguuugagaagcagcuggggcaggucaugcugcucauccugugcguaacccaggugcugaugaugcgcaccacgugggcccucugcgaggcccugacccuggcgaccggccccaucuccaccuugugggagggcaaccccggccgguucuggaacacgaccauagcgguguccauggccaacaucuuccgcggcuccuaccuggccggggccggcuuacuguucagcaucaugaaaaacacaaccaacacgcggagagggaccggcaaugucggcgaaacuuuaggggagaaguggaagucccgccugaacgcccucggcaagucggaguuccagaucuacaagaaguccgguauccaggagguggaccggacgcuggccaaagagggcaucaagaggggggagacggaccaccaugcugugagucgcggcucugccaagcugcgcugguucgucgaacggaacauggugaccccggagggcaagguggucgaccucggguguggccgcgggggcuggagcuacuacugcgggggccuuaagaacgugcgggaggugaagggccugacgaagggcgguccgggccacgaggagcccauccccauguccaccuauggcuggaaucucguccgccugcagagcggcguggacguguucuucacaccgcccgagaagugcgacacccugcucugcgacaucggcgagagcucccccaaccccaccaucgaggcgggucggaccuuacgcguccugaaccucguggagaacuggcuaaacaacaacacccaguucugcaucaaaguguugaauccguacaugcccagcgucauugagaagauggagacacuccagcggaaguauggcggcgcccuggugcgcaacccccugucccggaacagcacacacgagauguacuggguguccaacgccaccgggaacaucgucagcuccguaaacaugaucagccgcaugcugaucaaccgguucacuaugaaacacaagaaagccacguacgagccggauguggaucucggcuccggaacccgcaacaucggaaucgagagcgagauccccaacuuagacaucaucggcaagcggaucgagaagaucaagcaggagcacgagaccuccuggcacuacgaccaggaccacccauacaagaccugggccuaccaugggagcuaugagacgaagcagaccggauccgcuagcuccauggucaaugggguggugcgccuguuaaccaagcccugggacgucgucccgauggugacccagauggccaugacggacacaacccccuucggccagcagcgcguuuuuaaggagaagguggacacccggacgcaggaacccaaggagggcacuaagaaguuaaugaagaucaccgccgaguggcuguggaaagagcucgggaaggagaagacgccccgcaugugcacuagggaggaguuuacaagaaaaguucggagcaacgccgcccugggagcggucuucaccgacgagaacaaguggaagagugcacgcgaggccguggaggacgggcgguucugggagcuugucgaccgcgagcggaaccuccaccuggaaggcaagugcgagaccugcgucuacaacaugaugggaaagcgcgagaagaagcugggcgaauucggcaaggccaaggggagccgagcgaucugguacauguggcucggcgcccgcuuccuggaguuugaagcucugggguucuugaacgaggaucacugguuuuccagaggcaacagccugucagggguggagggcgaaggauuacaccgccugggguacauccugcgggaggucggcaagaaggagggaggcgccauguacgccgacgacacggccgggugggacacccgcaucacccuggaggaccucaaaaacgaggagaugguaaccaaccauaugaaaggcgagcacaagaaguuagccgaggccaucuuuaagcugacguaucagaauaaggugguccggguccagcgcccaacuccccggggcacugugauggacauuauaucccgcaaggaccagcgggggagcggccaggucgggaccuacggccucaacacguucacgaacauggaggcccagcugauccgccagauggagggcgaggggaucuucaaauccauccagcacuugacagccaccgaggaaauugccguacagaacuggcucgcacgcgugggccgggagcgccugagccggauggccaucucgggggacgacugcgucguaaagcccauugacgaccgcuucgcuagcgcccugacggcgcucaacgauaugggaaagguccggaaggacauccagcaaugggaaccgucgcgcggguggaacgacuggacccaggucccguucugcagccaccauuuucacgagcuggugaugaaggacggccgggugcuggucgugcccugccgaaaucaggacgaacucaucggcagggcccgcaucucccaaggggccggcuggagccugaaggagaccgccugcuuagggaagucauacgcccagauguggacacucauguacuuccaccggcgcgaccuccggcuggcggccaacgccauaugcagcgccgugccaucccacuggguccccacgagucguacuaccugguccauccacgccaagcacgaguggaugaccaccgaagauaugcuggcgguuuggaaccggguguggauccaggagaauccuuggauggaggacaagacgcccgucgaaagcugggaggaggugcccuaccugggcaagcgcgaggaccaguggugcgggucccugaucggccucaccucccgggccaccugggccaagaacauccagacagccaucaaucagguacgcagcuugaugggcaacgagggauacacagacuacaugcccuccaugaagcgguucagacgcgaggaggaggaggcgggcguccugugguga

SEQ ID NO: 24912 - RNA, 9876 nt, Artificial Sequence
  derived and/or modified CDS sequence (opt11) from DENV-2__GQ868551__SS-prME
accgcgggcguaaucgucaugcugauccccacagcuauggcauuccaccucaccacucgcaacggggagccccacaugaucgucggucggcaggagaaggggaagucucuucuguuuaagaccgaggauggcgugaacauguguaccuuaauggcuauagaccugggggagcucugcgaggacaccaucacguauaagugccccuuacugcgccaaaaugagcccgaggauaucgacugcugguguaauagcacgagcaccuggguaacguacggaaccugcaccaccacgggagagcaucggcgcgaaaagaggucgguugcccuagugccccacgucgggaugggccucgaaaccagaacagagaccuggaugaguuccgagggggccuggaaacacgugcagcggaucgagacauggauauugcgccacccggguuucaccaucauggccgcgauccuggccuacaccauagguacaacgcauuuccagcgcgcccucauauucauccugcuuaccgcaguggcgcccagcaugaccaugaggugcaucggcaucuccaaccgugacuuugucgagggcguaagcggcggcuccuggguugacaucguacucgagcacggaucuugcgugacgacgauggccaagaacaagccaaccuuggacuuugaguuaaucaagaccgaggccaagcagcccgccacgcuccgcaaguacugcaucgaggcaaagcugacgaacaccacaacugagagucgguguccgacgcagggagaacccagccugaacgaggaacaagacaagcgcuucauauguaagcacuccaugguggaccggggcugggggaacggguguggguuguucggcaagggcgguauagugaccugcgccauguucacgugcaagaagaacauggaaggcaagaucgugcaacccgagaaccuugaauacaccauugugaucacgccccauaguggggaggaacacgccgucggcaacgacaccgggaagcacgggaaggaaauuaaaaucacuccgcagucgagcaccaccgaggccgagcugacggguuacggcacaguaacgauggagugcagcccacgcaccggauuagacuuuaaugagaugguacuucugcagauggaggacaaggccuggcucguccaucggcagugguuccuggaccucccccucccguggcugccaggggcagacacgcagggcuccaacuggauccaaaaggagacccuuguuaccuucaagaauccccacgcgaagaagcaggacgugguagugcucgggucccaggagggugccaugcacaccgccuugacaggagccacugagauccagaugucuuccggcaaccuccucuucaccggacaucugaagugccgccugcggauggacaagcuccagcugaaggggaugucguauagcaugugcacgggcaaguucaagaucgucaaggagaucgcagagacgcagcacgggacgaucgugauuagggugcaguacgagggagacggguccccgugcaagauccccuucgagaucaccgaccuggaaaagcgacacguacucgggcggcugauuaccgugaaucccaucgugacagaaaaggacucucccgucaauauagaggcggagccgcccuuuggugacuccuacaucaucguggggguggagccuggccagcugaagcucaacugguucaagaaggggagcuccaucggccagauguucgagaccacaaugcgaggcgcaaagcggauggcgauccucggggacaccgccugggacuucgggagucucggcggugucuucaccuccaucgggaaggcuuugcaucagguguuuggggcgauauacggagccgccuucagcggcgugagcuggacgaugaagauccugauaggggucauaauaaccuggaucgguaugaacagccguuccacgucccugaguguuagucuggugcuaguuggaguggucacgcuguaccugggggccaugguccaggcggacuccggaugcaucgucagcuggaagaacaaggagcucaagugcggcuccggcaucuucauuacggacaauguucacaccuggaccgagcaguacaaguuccagccugagagccccagcaagcuggccuccgccauccagaaggcccacgaggagggcaucugcgggauccgcagcgucacgcgccuggagaaccucauguggaagcagaucacccccgagcugaaccacauccugucggagaaugaggugaagcucacaaucaugacgggcgacauuaaagguaucaugcaggccggaaaaaggucacugcgcccacagccuacggagcucaaguacuccuggaagaccuggggcaagguaaagaugcucucgaccgagucgcacaaccagaccuuucucauagacgggccugaaacggcugagugcccaaacaccaaucgggcguggaacucauuagaaguggaggacuauggcuucgguguuuucaccaccaauaucuggcucaagcuccgcgagaaacaggacguguucugcgacuccaagcuuauguccgccgccaucaaggacaaucgugccguacacgccgacaugggcuacuggaucgagagcgcucugaacgacacguggaagauggaaaaggccagcuucaucgaggugaaguccugccauuggcccaagagccacacacuguggucuaauggcguucuggaaagcgaaaugauuauccccaagaauuucgccggccccgugucccaacacaacuacaggccgggcuaccacacccagaccgcaggucccuggcaucucggcaagcuggagauggacuuugacuucugugaggggacuacgguaguggucaccgaagacugcggcaaccggggccccucguugaggaccacuacggcguccgggaaguugaucacagaguggugcugccggagcugcacucugcccccauuacgauaccggggcgaggacgggugcugguacggcauggagauacgcccccugaaggagaaagaggagaaccuggugaacagcuuagugacggccggccacggccagaucgacaacuucucucucggcguucuggggauggcacucuuccucgaggaaaugcuccgcacacgggugggcaccaagcaugccauauugcucguggcacugagcuucguaacccugauuaccggaaacauguccuuccgggaccuuggucgcguuaugguuauggucggggccacuaugaccgacgacaucggcaugggcgugaccuaucuggcgcugcucgccgccuucaaagugcgaccuaccuucgcggcaggucugcugcuucgcaaacuuacgagcaaagagcuuaugauggcuaccauaggcaucgcccugcugucccaaagcacccuuccggagaccauucuggagcugacggaugcccuagcacucggcaugauggcccugaaaauaguucguaauauggagaaauaccagcuggcagugaccaucauggcuaucucuugcgugccgaaugcagugaucuugcagaaugcguggaagguauccugcaccauccuggccgccgugucugucaguccccugcugcugaccaguagccagcagaaggccgacuggaucccccuggcgcucacgaucaagggcuugaaucccaccgcaaucuuccugacuaccuuaagccggaccuccaagaaacgauccuggccucugaacgaggccauuauggccgucggcauggugagcauccuggcuuccagccuuuuaaagaacgacauuccgaugaccggcccccugguggccggcggccuccugacggugugcuauguccugaccggccggagcgccgaccuagagcuugagcgggcugccgacguaaaaugggaggaucaggccgaaaucuccgggucaucccccauccuuagcaucacuaucuccgaggauggcucgauguccaucaagaacgaggaggaggagcagacccucaccauucugauccggacuggccucuuagugaucucuggggucuucccuguguccauccccauaaccgccgccgccugguacuugugggaggugaaaaaacagcgagccgggguccugugggacgugcccagcccgcccccgguagggaaagcggagcuugaagacggcgcguaccguauuaagcagcgaggaauccugggcuacucccagaucggcgccggggucuacaaggagggaacguuccacaccauguggcaugugacccgaggugccgugcuuaugcaccgcggcaagcguaucgagcccagcugggcagacgucaaaaaggaccucauuaguuacgggggcggauggaagcucgagggcgaguggaaggaaggcgaggagguccagguccuggcccucgaacccggcaagaacccacgcgcgguccagacgaagcccggcaucuucaagacgaacaccggaacuauaggagcagugucucuggacuucucucccggcaccucgggcucccccaucguagaucggaaggguaaggucgucgggcuguacggcaacggcguggucacucgcagcggggccuacguguccgcuaucgcgcaaaccgaaaagucaaucgaggacaaccccgagauagaagacgauaucuuccggaaaaagcgccucaccaucauggacuugcaccccggagccgggaagaccaagcgguaccugcccgccaucguucgcgaagccaucaagcgggguuuacgcacgcugauacuggccccgacccgggucguugcggccgagauggaagaggcccugaggggucuccccauucgcuaccagacccccgcuauccgggccgagcauaccggccgagaaaucguggaccugaugugccacgcaacguucaccaugcggcugcucagccccguccgagucccaaacuacaaccugaucaucauggacgaggcccacuuuaccgaccccgccuccaucgcagcgcgcggcuacaucagcacccgcguggagaugggggaagccgccgguaucuucaugacggccacgccgcccggaucccgggacccuuucccccagagcaaugccccaauuauggacgaggaacgugagauccccgagcggucguggaacagcggccacgagugggucaccgacuucaaggguaagacggucugguucgugccguccaucaaggcuggaaacgacauagcugcaugccugcgcaagaacggcaagaaggucauccagcucagcagaaagaccuucgacucggaguacguaaagaccagagccaacgacugggacuuuguugugaccaccgacaucuccgagaugggggcaaacuucaaagcggagcgcgugaucgaccccagacggugcaugaaaccugugauccugacggauggggaagagcggguuauacucgccgggccaaugccaguuacccacuccagugccgcccagcggcgcggacgcaucgguaggaaccccaagaacgagaacgaccaguacauuuacaugggcgagccacucgagaacgaugaggauugcgcccacuggaaagaagcgaagaugcugcuggacaacauaaacacucccgagggcaucaucccguccauguucgagccugagcgcgagaagguugacgccaucgacggggaguaccgauuacgcggcgaggcccggaagaccuuuguggacuugaugcgccgcggggaccuacccguauggcucgccuacaagguggccgcugaggguaucaacuaugcggaccgcaaguggugcuucgaugggaucaagaacaaccaaauucuagaggagaacgucgaggucgagaucuggacuaaggagggcgaacggaagaaguuaaaaccgcgcuggcuugacgcccgaauauacucugacccacuggcccugaaagaauucaaggaguucgcggcaggccgcaagucccuaacgcucaacuugauaaccgagaugggucgccucccgaccuucaugacgcaaaaggcccggaaugcccuggacaacuuagcaguucuucacacagccgaggucggcgggaaggcguacacccacgcccucucugaacugccagaaaccuuagaaacgcugcugcuccugacccugcuugccgccgucaccggcggcaucuuucuguuucuuaugagcgggaagggaaucgggaaaaugaccuugggaauguguugcauuauaacggcgagcauccugcugugguacgcacagauccaaccucacuggaucgccgccaguauuauccucgaguucuuuuugaucguucugcucauccccgaacccgagaagcaacggacuccacaggacaaccagcugaccuacguugugaucgcgaucuuaaccguggucgcugccacgauggcaaaugagauggguuuccuugagaagacgaagaaggaucugggcuuuggcagcaucacgacacaggaaagugaguccaacauccuagacaucgaccuccgcccggcaagcgcauggacuuuguaugcuguggcuacgaccuucgucaccccuaugcugcggcacucuauugaaaacagcucggugaauguuagucucaccgccaucgccaaccaggcaacgguccugauggggcugggcaaaggguggcccuuauccaagauggacaucggcgugccccuuuuggcuauagggugcuacagccaggugaaccccaucacccucaccgccgcccugcuguuacuaguagcccacuacgccaucaucggccccggccugcaggcuaaggccacccgcgaggcacagaagcgggccgcagccgggaucaugaagaaucccaccguggacggcaucacagugauugaccucgagcccaucccguacgaccccaaauuugagaaacagcuagggcaggucaugcuguugauccucugcgucacccagguucuuaugaugcgcaccacgugggcucucugcgaggcccugacccuagccacaggccccaucuccacccucugggaggggaaccccggccgguucuggaacacgaccaucgcagucagcauggccaauaucuuccgcggcuccuaccuggccggcgccggucuucuguucagcaucaugaagaauacuaccaacacgcgcagggggaccggcaacguaggcgagacgcuaggggagaaguggaaaucccgucugaacgcgcucggcaagucagaguuucagauauacaagaaguccgguauacaggagguagaccggacgcuggccaaggagggcaucaagcgcggggagacugaccaccacgcggucucucgggguagugccaagcugcggugguucguggagaggaacauggugaccccggagggcaaggucguggaccucgggugcggccgcggcgguuggagcuacuacugcggaggccugaaaaacguacgggaggugaagggcuugaccaagggcggaccaggucacgaggagcccauacccauguccaccuacggauggaaccucguacgccugcagagcggcguggaugucuucuucacgccgcccgagaagugcgauaccuuguuaugcgauaucggcgagagcucccccaacccgaccaucgaggccggccggacccugcgcgugcugaaccucguggagaacuggcuaaacaauaauacccaguucuguaucaagguccugaacccguauaugcccagcguaaucgagaaaauggagacgcuccaacggaaguaugggggcgcguugguccgcaauccacugucccggaauagcacccacgagauguacuggguguccaaugcuaccgggaacauaguuucaagcguaaacaugauuucccgcaugcuaauuaaccgguuuaccaugaaacacaaaaaggccacguacgagccagacgucgaccuuggcagcgggacccgcaauaucggcauugaaagcgagauacccaaccuggacauaaucggaaagcggauugagaagaucaagcaggagcaugagaccagcuggcacuacgaccaggaccaccccuacaagaccugggccuaccacgggucauacgagacgaagcagaccgguagcgccucguccauggugaauggggugguacgccuguuaaccaagccaugggacguggugccaauggugacacagauggccaugacggacaccaccccguucgggcagcagcgcguguucaaagagaagguugacacccggacucaggagcccaaggaggguaccaagaagcugaugaagaucaccgccgaauggcuguggaaggagcucgggaaggagaagacgccccggaugugcacgagagaggaguucacccgcaagguccgguccaacgccgcccugggcgcgguguucaccgacgagaacaaguggaagagugcgcgugaggccguggaagacgggagauucugggagcugguugaccgcgagcgcaaccuccaccuggagggcaagugcgaaacuugcguguacaacaugaugggcaaacgagagaaaaagcugggugaguucggcaaggccaaagggucccgggcgaucugguacauguggcucggcgcgcgcuucuuggaguucgaagcccuggguuuccucaacgaggaucacugguucagccgagggaauagccugagcggggucgagggcgaaggccugcaccgucucggguacauucugcgggaggugggcaagaaggaagggggcgccauguacgccgacgacacggccgguugggauacccguaucacauuagaggaucucaagaaugaggagaugguuaccaaccauaugaagggcgagcacaagaagcuagcggaggccaucuucaagcugacguaccagaacaaagucgugcgagugcagcgcccaacccccagggggaccguaauggacauaaucucccgcaaggaccaacgagggucaggacaaguggggaccuacggccucaauacguucacgaacauggaggcccagcugauccgccaaauggagggcgagggaaucuucaaguccauacagcaccucacggccacagaggagaucgccgugcagaacuggcucgcccgcgucggacgggaacgguugagccgaauggccaucuccggggacgacugcguggucaaaccgaucgacgaucgcuucgcaagcgcgcuaacggcccucaacgacaugggcaaggucagaaaggauauccagcagugggagccuuccagaggguggaacgacuggacccaagugccguucugcagccaccacuuucacgagcugguuaugaaggacggccggguacugguggugcccugccgcaaucaggaugaacucaucggccgggcgcgcaucucccagggggccggcuggagccugaaagagaccgcuugccugggaaaauccuacgcccagauguggacccucauguacuuucacaggcgcgaccugcgacuggccgcgaacgccaucugcucagcaguuccgucccacugggugcccacaagccgcacuaccugguccauccacgccaagcaugaguggaugacgacggaggauaugcucgcgguuuggaaccggguauggauccaggagaacccguggauggaggacaagacacccguugagagcugggaggagguuccguaccugggcaaacgagaggaccaguggugcgggucccucaucggccucaccagucgggcaacuugggccaagaacauccaaaccgcuauuaaccagguucgcagccugaugggaaacgagggguacacggacuacaugcccaguaugaaacgguuccgccgagaggaagaggaggccggaguacugugguag

SEQ ID NO: 24913 - RNA, 9876 nt, Artificial Sequence
  derived and/or modified CDS sequence (opt11) from DENV-2__HM181971__SS-prME
acggcuggaguuaucguaaugcuaaucccgacugcaauggcauuccaccuaacgacgcggaacggagaaccacacaugaucgugggacggcaagaaaaaggcaaaagccuccuauuuaaaacagaagacggaguaaacaugugcacgcucauggcaaucgaccugggcgaacucugcgaagacaccauuacauacaagugcccacuuuuacggcaaaacgaacccgaagacauugauugcuggugcaauagcacgaguaccuggguaacauacgggacauguacgacaaccggagaacacagaagagagaaaagaagcgucgcacuggucccccacguaggcaugggccucgaaacacgcacagaaacauggaugagcucggaaggugcauggaagcauguucagaggaucgagacguggauacugagacaccccggcuuuaccauaauggcagcuauacucgcuuacacgaucggaacaacgcauuuccaacgggcacucaucuucauccuacuaaccgcaguugcaccaucaaugaccaugcgcuguauuggcauaagcaaccgagacuucguagaggguguaagcgggggcuccuggguagacaucguccuagagcacggcucuugcguaacaaccauggccaaaaauaaaccgacgcuagauuucgagcugaucaaaaccgaagcaaaacaacccgcgacacuuagaaaauacugcauugaggccaaauuaaccaacaccacaaccgagagcagaugccccacccagggggaacccagccucaacgaagaacaggauaaacgcuucauaugcaaacacaguaugguggaccgcggcuggggaaacggauguggacuauucgguaaaggcgggauagucacgugcgcgauguucacaugcaagaagaacauggaagggaaaauaguacaacccgaaaaccucgaauacacuauagucauuacaccccacagcggagaagaacacgccgucggaaacgacaccggcaagcacggcaaagaaaucaaaaucacgccgcagagcagcaccacggaagcggaauuaacgggguacggcacggucaccauggaaugcucuccacggacaggguuggacuucaacgagaugguacuccuacagauggaagauaaagcauggcugguccaucggcaaugguuccucgacuugccuuuaccauggcugccaggggccgacacgcagggcagcaacuggauccaaaaagagacacucguuaccuucaaaaacccacacgccaagaaacaagacguagugguccugggaucacaggagggagcaaugcacaccgcccuuaccggagccacugaaauccaaaugucaagugggaaccuccucuuuaccggacaccucaaaugccgacuacgaauggacaagcuacagcucaaaggaaugucguacuccauguguacgggcaaauucaaaaucgucaaagagauugcggagacccaacauggcacgaucguaauacgcguccaauacgaaggcgacgggaguccgugcaaaauaccauucgaaaucacggaucuugagaaacgccacguacugggacgucucaucacuguuaaccccauugucaccgaaaaagacucaccaguaaauaucgaagcggagcccccauucggggacaguuauauaauaguagguguggaaccaggacagcugaaacugaacugguucaagaaaggaaguucaauuggccagauguucgaaacaacaaugaggggagcaaagagaauggccauauuaggcgauaccgcgugggacuucggcucgcuagggggaguuuucaccucgauagggaaagcgcugcaccaagucuucggagcgaucuacggggccgcguucucgggcguaaguuggacaaugaagauauugauaggggugaucaucaccuggaucgggaugaacucaaggucgacaagccuaagcgucagccuagucuuagucggcguggucacgcuauaccugggagccaugguacaggcagacucggguugcauaguauccuggaaaaauaaagagcucaagugcggaagcggaaucuucaucacggacaacguccacacauggacagagcaauauaaguuccagccggaaucuccaucuaaacucgccucagcaauccaaaaggcacaugaggagggcauaugcggaauccgcagugucacgaggcuagagaaccucauguggaagcagauaacacccgaauuaaaccacauucuauccgagaacgaaguaaaguuaacaauuaugacaggggauauaaaaggcauuaugcaggcaggaaaacgcucccuacgcccgcagccuaccgagcucaaauacagcuggaagacguggggcaaggccaaaaugcuauccaccgaaucgcacaaccagacguuccugauagacggaccggaaacagcugaaugcccgaacacuaacagggcuuggaauagccuagagguggaggauuacggcuucggagucuuuacgaccaacauuugguuaaaauugagagagaaacaagacguuuucugcgauagcaagcugaugagcgccgccaucaaggauaaucgcgcggugcacgcagacaugggcuacuggauagagagcgcacugaacgacacauggaagauggaaaaggccagcuucauagaggucaaaagcugccauuggccgaaaagccauacacuauggagcaauggcguacucgaaagugaaaugaucaucccaaagaacuucgcaggcccaguaagccagcacaacuacagaccuggguaucacacccaaaccgcgggccccuggcaucuggggaaacucgagaucgauuucgacuucugcgaaggaacgaccguugucguuaccgaggacugcggaaaccgaggacccucacuccgcacaaccacagcaaguggaaaacuaaucacugaguggugcugcagaucaugcacguuacccccacuacgauacaggggcgaagacggaugcugguacggcauggagauacgacccuugaaggaaaaggaggagaaucuagugaacucccuaguaacagccggccacggccagauugauaacuucucgcuaggcgucuuggggauggcccuauuccuagaggagaugcuuaggacccgcguuggcacaaaacacgcgauacuucucgucgcacuuucguucgugacucuaauaacaggaaauaugaguuuucgagacuuaggccgggugauggugauggugggcgcaacaaugacagacgacaucgguauggguguaacauaucuagcgcuuuuagccgccuucaaagucagaccgacauucgcagccggccugcuacuacgaaaacugacuuccaaagaauugaugauggcaaccauuggaauugcucugcucagccaaucaacucuaccggagacaaucuuagagcugaccgacgcacuagcccugggaaugauggcacugaagauagucagaaacauggaaaaauaccaauuggcagugacgauaauggcgaucucgugcgugccgaaugcggugauacuacaaaaugcauggaaagugagcugcacgauccuggcugcaguaucugugucgcccuuacuccuuacaagcucucaacagaaagcagacuggauacccuuggcauugacaaucaaaggccuaaauccaaccgcaaucuuccuaaccacuuugucgcgaacguccaaaaagagaagcuggccguuaaacgaagcaaucauggccguggggauggucuccauacuagcuucaagccuucugaaaaacgacauaccuaugacagggccucuaguggcaggagggcuccuaacagucugcuauguucucacaggccggagcgcggaccuggagcucgagcgggccgccgauguaaagugggaggaucaagcagaaauaucggggucaucaccuauccugagcauaaccaucagcgaggacggcagcauguccaucaaaaacgaagaagaggaacagacacugacgauacuaauccgaacaggacuccuaguaauauccggcguguucccugucagcaucccaauaacggccgcugcgugguaccugugggagguuaagaaacagcgcgcaggcguauuaugggacgucccuagcccgccucccgucggcaaagcagagcuagaggacggggcauacaggauaaaacagcguggcauacuuggcuauagccagauuggcgcaggaguguauaaggagggaaccuuccacacaauguggcacgucaccagaggcgccgucuuaaugcacaggggcaagcggaucgaacccuccugggcggacguuaagaaagaccucaucagcuacggcggaggguggaaguuagagggggaauggaaggaaggugaagaaguccaaguccucgcacuagaacccgguaagaacccacgugcagugcaaacaaagcccggcauauuuaagacuaacacuggaaccaucggggccguaucgcuugacuucuccccagguaccuccggcucgcccaucguagacagaaaaggaaaagucgucggacucuacgggaacggaguuguaaccaggucgggggccuauguaucagccauagcgcaaacggagaaaucaaucgaagacaacccagagaucgaagacgacaucuucaggaagaaacgauuaacuaucauggaccuacacccaggggcgggcaaaaccaaacgcuaucugccggcuaucguacgagaagccauuaaacguggacugcggacccuuauacucgccccgacgcgaguaguugccgccgagauggaggaagcucucagaggacucccaauaagauaccaaacaccggcuauccgagcagaacacaccggccgagaaauaguagaccuaaugugccaugcgacauucaccaugcgacuccugucaccggugcgggucccuaauuacaaccucauaauuauggacgaggcgcacuucaccgacccagcgagcauugcagcacgcggauacaucaguacacgcgucgagaugggggaggcugcugggauauucaugacugcaacgcccccaggaucacgagacccauuuccgcaauccaacgccccgauuauggacgaagaacgagaaaucccagaacgaagcuggaacucuggacaugaaugggucacagacuucaaaggaaaaaccgucugguucguacccagcauuaaggcagggaacgacaucgccgccugccuaaggaaaaauggcaagaaaguaauccaacucucucgcaagacguucgacuccgaauacgucaaaacacgagccaaugacugggacuucguggucacgacggacauuagugagaugggggccaacuucaaggccgaacgagucaucgacccgagaagguguaugaaaccaguaauccugacugacggggaagagagggugauacuagccggcccuaugccaguaacucauagcuccgccgcacaaagacgaggucgcauuggacgcaaucccaagaacgaaaacgaccaauauaucuacaugggcgaaccacuugagaaugaugaggauugcgcacauuggaaggaggcgaaaaugcuacuugacaacauaaauaccccugaagggaucauuccaagcauguuugaaccggagcgagagaagguagaugcgaucgacggugaauaucgauuaaggggagaagcgcguaaaacguucguugacuugaugcguagaggcgaccugccaguauggcuagcuuacaaaguagcugcagagggcauaaacuacgccgaccgcaaguggugcuucgacggaaucaaaaacaaccaaauauuagaagagaacguggagguagaaauauggaccaaagaaggggaacgcaagaagcucaaaccgcgaugguuggacgcgcguauauauagcgacccucucgcucuaaaagaguucaaagaguucgcugcagggagaaagagccugacgcugaacuugauaacggaaauggggcgauugcccaccuucaugacucaaaaagccagaaacgcccuggacaaccuugccguacuacacacagcggaaguugggggaaaggcguacacccacgcacuuagcgaacugcccgaaacccuggaaacuuugcugcuacuaacgcuccuagcagcugucaccgggggcauauuccuguuccucaugagcgggaaaggaauuggaaaaaugacacucgggaugugcugcaucauaaccgccagcauucucuuaugguacgcacaaauacagccccauuggaucgcagcgaguaucauccucgaguucuuucugaucgugcuccucauacccgagccggaaaagcagcggacuccacaggacaaccaacuaacauacgucguuauugcaauucugacgguggucgcggcgaccauggcaaaugagaugggguuccucgagaaaacgaagaaagaccugggauucggcagcauaaccacgcaggaguccgaaagcaacauccucgacaucgaccucaggccugccuccgcuuggacacuuuaugcgguugcuacgacguuuguaacaccgaugcuacgacacaguaucgaaaacucguccgucaauguuucacucacagcaauagcgaaccaagcgaccguacugaugggcuuagguaaaggcuggccgcuauccaaaauggacauagggguuccucuccucgcuauaggcugcuacagccaaguaaacccuaucacacuaacggccgcauugcuccuacucguagcacacuaugcgauaauaggaccaggucuucaggcaaaagcaacgagagaggcacagaagcgagcagcagccggcauaaugaaaaauccuacugucgacggaauuacggucauugaccucgaacccauacccuacgaccccaaguuugagaaacaacuuggccaagucauguuacugauacuaugcguaacgcaagugcugaugaugcgcacaaccugggcgcuuugugaagcgcucacgcuggcaacgggcccuaucucaacccuaugggagggaaauccgggacgcuucuggaacacaacaaucgcggugucgauggcgaacauauucagggggagcuaucuagcaggggcggggcuauuguuuagcauuaugaaaaauacuacaaacaccagacgcgggaccgggaacgucggugagacccuaggagaaaaauggaaaagucgucugaacgcacucgguaaaagcgaguuccaaauuuacaagaaaucgggcauucaagaaguagaccgcacucucgcgaaagaagggauaaagcgaggcgagacagaccaccaugcggucagccgaggaucugccaaacucagaugguucgucgagcgaaauaugguaacccccgagggaaaggucguagaccuuggguguggacgaggcggcugguccuauuauugcggcggacuaaagaacgugcgcgaagugaaagggcugaccaaaggaggaccgggacacgaggaaccgauccccaugagcacauauggauggaaccuuguucgacuccagucagggguggacguguucuucacaccgcccgagaagugcgacacauuacuuugugauauaggggaaagcagcccgaacccuaccauagaagcaggcagaacacuaagaguacuuaaucugguagaaaacuggcugaauaacaauacgcaauuuugcauaaaagugcucaacccuuacaugccuuccguuaucgagaaaauggaaacgcuacagagaaaguacggaggugcccuagugcggaacccacuaucacggaacucaacgcacgagauguacuggguaagcaacgcaacggggaacaucguaagcuccguaaacaugaucucccggaugcucaucaaccgauuuacaaugaaacacaaaaaggcuacguacgagcccgacguggaccuggggucuggaacaagaaauauagggaucgaaagcgagauccccaaccuagacauuauaggaaaacgcaucgagaagauuaagcaagaacacgagaccagcuggcacuacgaccaagaccacccuuacaaaaccugggcauaccacggcucauacgagacaaaacagacagguagugccucgucaauggucaacgguguggugcgccuccucaccaaacccugggacgucgugcccauggucacucaaauggcaaugacagacacaacaccauucggccaacagagaguuuuuaaagaaaaaguugacacgaggacacaggaacccaaagaaggcaccaagaaauuaaugaaaauaacagcugaguggcucuggaaggaauuagggaaggagaaaacaccgcgcaugugcacacgggaggaguucacucgcaaagugcgaucaaacgcugcguugggagcagucuucaccgacgaaaacaaguggaaaagugcccgagaggcagucgaagacggacguuuuugggaauuaguagacagagagcggaacuugcacuuggaggggaagugcgaaacuugcgucuacaacaugaugggaaagagggagaagaaacugggcgaguucggcaaagcuaaagggucgagagcuaucugguacauguggcugggcgcacgauuccuagaguucgaggcccuuggguuucucaacgaagaccauugguucagccgaggaaauagccuaagcggggucgagggagagggacuccacaggcuaggcuacauacuucgcgagguugggaaaaaggaagggggcgccauguacgccgaugauacagcagggugggacacccggauaacucuagaggacuugaaaaacgaggaaauggucaccaaccauaugaagggcgaacacaagaaauuagcggaagcuauauuuaaacucacguaccaaaacaaggugguccggguacagcgaccuacaccacgaggaacaguaauggacauuauaagucggaaggaccaacgagggagcggacagguagggaccuacggauuaaacacauucacgaauauggaagcccagcucauacgccaaauggagggggaaggcaucuuuaagagcauccaacaccuaacagcgacagaagaaauagcagugcagaacugguuggcgcguguagggagggaacgguugagccgaauggccauaucaggagaugacugcguuguaaaaccuaucgaugaccguuuugcuucggcucugacagcacuaaacgacauggggaagguacgaaaggacauccaacaaugggaacccagcaggggguggaaugacuggacacaagugcccuucugcagccaccacuuucaugaauuggucaugaaagacgggcgcguccucgugguaccaugcagaaaccaagacgaacucaucggccgcgccagaaucucccagggcgcuggauggucgcucaaagaaacggccugcuuaggaaaaucauacgcacagauguggacgcucauguacuuccauaggagagaccucagacuagcagcaaacgcaaucuguagcgcagucccuagccacuggguuccaacuucacgcacgaccuggagcauccacgcaaagcacgaguggaugaccaccgaggacaugcuagcugucuggaaccgcgucuggauccaggaaaacccuuggauggaagauaaaacacccguugaaucgugggaggaagugccguaucuugggaaacgcgaagaccaauggugcggcucccucaucggccucacgucgagagcaacaugggcgaagaacauccaaaccgccauaaaccaaguacgcagucugauggguaacgaaggauacacggacuacaugccuagcaugaaaagauuccgcagagaagaggaagaggccggaguacugugguaa

SEQ ID NO: 24914 - RNA, 9876 nt, Artificial Sequence
  derived and/or modified CDS sequence (opt11) from DENV-2__GU131881__SS-prME
acagccggggugaucgucauguuaauccccaccgcgauggccuuccaccucaccacccgcaacggggagccccacaugaucgugggccggcaggagaaggggaaaucccugcuguucaagaccgaggacggcgugaacauguguacccucauggccaucgaccugggggaauuaugcgaggacaccaucaccuacaaguguccccuccuacgccagaacgagcccgaggacaucgacugcugguguaacagcaccagcaccugggucaccuacgggacuugcacgaccacgggcgagcaccggagggagaagcggaguguggcccuagugccccacgucgggaugggccucgagacccgcacagagacauggaugaguuccgagggggccuggaagcacgugcagcggaucgagacauggauccugcgccacccgggauucaccaucauggccgcgauccuggccuauacuaucggaaccacccacuuccagcgggcccucaucuucauccugcugacagcaguggcgcccaguaugacgaugcguugcaucggcauuuccaaccgggauuucguagagggugugagcgggggcuccuggguggauaucgucuuagaacacgggagcugcgugaccacgauggccaaaaacaagcccacucuggacuucgagcugaucaagaccgaggccaagcaacccgccacccuccgcaaguacugcaucgaggccaagcuuacaaacaccacaacggagucacgguguccgacgcagggcgagcccagccuuaacgaggaacaggacaagcgcuucaucugcaagcacucaaugguagaccgcggcugggggaacggcugcggacuguucggcaagggcgggaucgugaccugcgcgauguucacguguaagaagaauauggagggcaaaaucgugcagcccgagaaccuggaguauaccauugugaucacgccccacucgggggaggaacacgcggucggcaacgacaccgggaagcauggaaaggagaucaagauaaccccgcaguccagcaccaccgaggccgagcugacggguuacggcaccgugaccauggagugcagcccccggaccggccucgauuucaacgagaugguccugcugcagauggaggauaaagccuggcucguccaccggcaaugguuuuuggacuugccccuccccuggcuaccaggggccgacacgcagggcagcaacuggauucagaaagagacgcuggugaccuucaagaacccccacgcgaagaagcaggacguagucgugcucggcucccaagagggcgcaaugcacaccgcgcugacgggggcaaccgagauccagaugagcagcggcaacuuacuguucaccggccaucugaagugccgccuucggauggacaaacuccagcugaaggggauguccuacucuaugugcaccggcaaauuuaagaucgucaaagagauugccgagacgcagcacgggacgauugugauccgcgugcaguacgagggcgacggcucacccuguaaaaucccuuucgagaucaccgaccuggagaaacggcacguccucgggcgcuugaucacggugaacccgaucgugacggaaaaggauucacccgucaacaucgaggcagagccgcccuucggggacuccuacaucauagucgggguggagccgggccagcugaaacucaacugguucaagaaggggucguccauuggacagauguucgagaccacuaugcgcggagccaagcggauggccauccuuggagacaccgccugggacuuuggcagucucggcggcguauucacuuccaucgggaaagcccuccaccagguguucggggcgauuuacggagccgccuucagcggggugucauggaccaugaagauccugaucggcgucauaaucaccuggaucgggaugaauagccgcuccaccagccuguccgugagccuggugcucgugggcguggugacccuguaccugggggccaugguucaggcggacaguggcugcaucgucagcuggaagaacaaagagcucaagugcggcuccgggaucuucaucacugacaacguucauaccuggaccgagcaguacaaguuccagcccgagagcccaagcaagcucgccuccgccauccaaaaggcccacgaggagggcaucugcggcauacggagcgugacgagacuggagaaccugauguggaagcagauaacccccgagcugaaccacauccuguccgagaacgaggugaagcucaccauaaugacaggagauauaaaagggaucaugcaggccggaaaacggagccuaagaccgcagcccacggagcugaaguauagcuggaagaccuggggcaaagcgaagaugcucucaaccgagucccauaaccagacuuuucugauagacgggccugagacggccgaaugcccgaacaccaaccgagccuggaacagccuggaaguggaggacuacggcuucggcgucuucaccaccaacaucuggcugaagcuccgcgagaaacaggacguguuuugcgacuccaagcugaugagcgccgcuauaaagaacaacagggcggugcacgccgacaugggcuacuggaucgaauccgcccucaacgacacguggaagauggaaaaggcaagcuucaucgaggucaaguccugccacuggcccaaaagucacacgcugugguccaacggcgugcuugagucagagaugaucaucccuaagaacuuugccgggcccgugucccagcacaacuaccgcccgggcuaccacacccaaaccgcggggcccuggcaucucggcaagcuggagauggauuucgacuucugcgaagggaccaccgucgucgugacggaagacugcgggaaccggggccccucacugcgcacgaccacggccagugggaagcucaucacugagugguguugccgguccuguacccugcccccgcuacgcuaccgcggcgaggaugggugcugguacgggauggagauacgcccccucaaggagaaagaggagaaccuggucaacucacugguaaccgcugggcacggacagaucgacaacuucagucucggcgugcuggggauggcccuguuucucgaggagaugcuccggacgagagucggcaccaagcacgcgaucuuguugguggcccugaguuucgugacccuaaucaccgggaacaugucuuuccgggaccucggacgcguuauggugauggugggggccacgaugacugacgacauuggcaugggagucacguaccuggcccugcucgccgcauucaaggugcgccccaccuuugcugcagggcugcuucuccggaagcugacgagcaaggagcugaugauggccaccaucggcaucgcccuccuuucccaaagcacccuccccgagaccauacucgagcugacggacgcgcuggccuuagggaugauggcccugaagaucgugcgcaauauggaaaaguaucagcuugccgucacgauaauggccaucucuugcgugccgaacgcgguuauucuccagaacgccuggaaggucagcugcaccauccuggccgcgguguccguaagcccccugcuucugaccuccagccaacagaaggcggauuggaucccccuggcccucacuaucaagggccugaaccccaccgccauuuuccugaccacacucucccggacgagcaaaaagcgcuccuggccccugaaugaggccauaauggcagucggcauggucagcauccuggcguccagccuccugaagaacgauauacccaugaccggcccccuagucgccggcgggcugcugaccguguguuacgugcugacuggacggucggccgaucucgagcucgagcgcgcagcggaugucaagugggaggaccaggcggagaucuccgggagcucacccauccugagcauuacgaucuccgaggacggcagcauguccaucaagaacgaggaagaggaacagacccucacuauccugauacggacgggucugcucgugaucagcggaguguucccggucucgaucccuaucaccgccgccgccugguaccugugggaagugaagaagcaacgcgccggggugcucugggaugugcccagcccgccgcccgucggaaaggcggagcucgaggacggagccuaccggaucaagcagaggggaauccugggcuacucccagauuggagccgggguauacaaggagggcacguuccacaccauguggcacgucacccgcggagccgugcugaugcaccgcggcaagcggaucgaacccagcugggccgacgucaaaaaggaccucaucuccuacgggggaggcuggaagcuggagggggaguggaaagagggcgaagagguccaggugcuggcgcucgagcccggcaagaauccccgcgcagugcagaccaaacccgguaucuucaaaacgaacaccgggaccaucggagccguuagccuggacuucuccccuggcaccagcgggucccccaucguggaccggaagggaaagguggucgggcuguauggcaacggugugguuacacgcagcggugccuacgucuccgcgaucgcccagaccgagaagaguaucgaggauaaccccgagaucgaggaugacaucuuccggaagaagcgccucaccauuauggaccugcaucccggcgccgggaagaccaagcgcuaccugccugccauugugcgcgaggccaucaagcggggccugaggacucucauccuggcgccgaccagagugguagccgcagagauggaggaggcccugcguggucuccccauacguuaccagacucccgccauccgcgcggagcauaccggucgggaaaucguggaccugaugugccacgccacguucaccaugcggcugcucucucccgugcgcgucccgaacuacaaccugaucaucauggacgaggcccacuucaccgacccggccuccaucgccgcgcggggauauaucagcacccgcguggagaugggggaagccgcuggcaucuucaugacggcgacuccacccgggucccgggacccguucccccagagcaacgcgccaaucauggacgaagagagggagauccccgagcgguccuggaacagcggccacgaauggguaaccgacuucaaggggaagaccgucugguucgucccaucaaucaaggccggcaacgacaucgcugcgugucugcgcaagaaugggaagaaggugauacagcucagccggaaaacguucgauucagaguacgucaagacccgcgccaaugauugggauuucguggugaccaccgacaucagcgaaaugggggcuaacuucaaggccgagcgggucauugacccccgcagaugcaugaaacccgugauccuuacggacggcgaggagcgugugauacuggccgggcccaugccggucacccacuccagcgccgcacagcggcgcggcagaauugggcggaaccccaagaacgagaacgaccaguacaucuacaugggcgagccucuugagaacgaugaggacugugcucacuggaaggaggccaagaugcuacuggacaauaucaacacacccgagggcaucaucccguccauguucgagccggagcgcgagaaaguggacgccaucgacggcgaguaucggcuucggggagaggcccggaagacuuucguggaccugaugcgccgcggggaccuacccgucuggcucgccuacaagguggcggccgaagguaucaauuacgccgaccgcaaguggugcuuugacgggaucaagaacaaucaaauccuggaggagaacguggaggucgagaucuggacgaaggagggcgagcggaagaagcugaagccgagguggcucgacgcccggaucuacagcgacccccuggcgcucaaggaauuuaaagaguucgcagcaggacgcaagucccugacccugaaccugaucaccgaaauggggcggcucccgacauucaugacgcagaaagcccgcaacgcccuggacaaccuggcggugcuccacaccgccgaggugggcgggaaggccuacacacaugcccugucggagcugccagagacccuagagacgcugcuccuccugacccugcucgccgcggucaccggcggcaucuuccuuuuccugauguccgggaaggguauugggaaaaugacccuaggcaugugcugcaucaucaccgccagcauucuccugugguacgcccaaauccaaccccacuggaucgcugccuccaucauucucgaguucuuccugauugugcugcucauccccgagcccgagaagcagcggacgccccaggacaaccaacugaccuacguugugaucgcaauccuuaccguggucgccgccacgauggccaacgagaugggguuccucgagaagacgaaaaaggaccugggcuucggcagcaucaccacccaggagucagaguccaauauccuggacaucgaccuccgcccggccagcgcguggacccuguacgccguggccacgaccuuugugaccccaaugcugcggcacuccauugagaacagcuccgucaacguuagccugaccgccauugcgaaucaagcgacggugcugaugggucugggcaagggguggccccuauccaagauggacaucggcgucccccugcuggccaucgggugcuacagccaaguaaacccgaucacccucacugcugcacugcugcuccugguggcgcacuacgccaucaucggccccggccugcaggccaaggcaacccgcgaggcccagaagagggcggccgccgggaucaugaaaaaucccacggucgacgggaucaccguaaucgaccuagagcccaucccguaugaccccaaguucgaaaagcagcugggccaggucauguuacucauccugugcgucacccaggugcugaugaugcguacgacgugggcacucugcgaggcccugacccuggcgaccggccccaucucuacacucugggaggguaacccuggacgguucuggaacacgaccaucgcggucagcauggcgaacaucuuucgcggcuccuacuuagccggggccgggcuccuguucagcauaaugaagaacaccacaaauacgcgucgggggaccgguaacgucggcgagaccuugggggaaaaguggaaaucccgacugaacgccuugggcaagagcgaguuccagaucuacaagaagagcgggauccaggagguggaccggacccuggccaaggagggcauaaaacgcggugagacggaccaccacgcugucucgagaggauccgccaaacugcgcugguuuguugaacggaauauggugacaccggagggcaagguggucgaucucgggugcggccgcgggggcuggagcuacuauugcggggggcugaagaacguacgcgaggugaagggucucaccaagggcggccccgggcacgaggagcccauccccauguccaccuauggcuggaaccugguccgccuacaaagcgguguggacguguucuucacgccacccgagaagugugacacccugcucugugacaucggcgagagcucccccaaccccaccaucgaggcggggcggacccuacgcguccugaaccucguggagaacugguuaaacaacaacacucaauucugcaucaaagugcugaauccuuacaugccgagcgucaucgagaaaauggagacccuccagcggaaguacggcggggccuuggugcgcaacccccugucccggaacucaacccacgagauguacuggguuuccaacgccaccgggaacaucgucagcucggugaauaugauaagccgcaugcugaucaaccgguucaccaugaaacacaagaaggccacauacgagccggacguggaccucggcuccgggacccgcaacaucgggaucgagagcgagauaccgaaccuugacaucaucggcaagcggauugagaagaucaaacaggaacacgagaccuccuggcacuacgaccaagaccaccccuacaagaccugggccuaccacggaagcuacgagacgaagcagacaggcuccgcgagcuccauggucaacggugugguacggcugcugaccaagcccugggacgucgugccgauggucacacaaauggccaugacggacaccacccccuucggccaacagcgcgucuucaaggagaagguggacacucggacgcaagagcccaaggagggcaccaagaagcugaugaagaucaccgccgaguggcuguggaaggagcucgggaaggaaaagacgccuagaaugugcacgagggaggaauucacccgcaagguccggagcaacgccgcccugggcgcggucuucacagacgagaacaaguggaagagugcuagggaggccguggaggacgggcgguucugggagcugguggaccgcgagcggaaccuccaccuggaagguaagugcgaaaccugcguuuacaacaugaugggaaagcgggagaagaagcugggcgaguucggcaaggccaaagggagccgggcgauaugguacauguggcucggcgcccgcuuccuggaguuugaagcccugggguuccucaacgaggaucacugguuuucccgggggaacucccuguccgggguggagggcgaggggcuucaccgccucggguacauccuccgggagguuggcaagaaggagggaggcgccauguacgcagacgacacggcggggugggacacccgcauaacgcuggaagaccucaagaaugaagagauggugaccaaccacaugaagggcgaacauaagaagcuugccgaggccaucuucaaguuaacguaccagaacaaggugguccgggugcagcgcccgacuccccggggcacggugauggacaucaucucccgcaaggaccagagaggaucgggccaggucggcaccuacggccuaaauacuuucaccaacauggaggcucaguugauccgccagauggagggagaggggaucuucaaguccauccaacaccugaccgcuacugaggagaucgcggugcagaacuggcucgcccgcgugggccgggagcgccugagcagaauggccaucuccggggacgacugcgucgugaaacccaucgaugaccgguucgcgagcgcccugacggcgcucaacgacaugggcaaggugcggaaggauauucaacagugggaaccauccaggggguggaacgacuggacccaggucccguucugcagccaccacuuccacgagcuggucaugaaagacggccggguauuagucgugcccugccguaaccaggacgagcucaucggccgugccaggaucucccaaggggccggcuggagccugaaagagacagcgugccuggggaaguccuacgcccaaauguggacccucauguacuuccaccgccgcgaucugcggcuggcggccaaugcgauuugcagcgccguccccucacacuggguccccaccagccgcacgaccugguccauucacgcgaaacaugaguggaugacuacagaggauaugcucgccguauggaaccgcguauggauccaggagaacccguggauggaggacaagacgccuguugagagcugggaggaggugcccuaccuggguaagcgcgaggaccaguggugcgggucccugaucggccucacuucucgggccacaugggccaagaacauccagaccgccauuaaccagguacgcagccugaucgguaaugagggguacacagacuacaugccuucgaugaagcgguuccgccgcgaggaggaggaggcggguguccugugguga

SEQ ID NO: 24915 - RNA, 9876 nt, Artificial Sequence
  derived and/or modified CDS sequence (opt11) from DENV-2__FJ898461__SS-prME
acggccggcgugaucgucaugcucauucccaccgccauggcguuccaucucaccacucgcaauggggagccccacaugaucgucggacggcaggagaaggguaagucccugcuguucaagacagaggacggcgugaacaugugcacccucauggccaucgaccucggggagcugugcgaggacaccaucacguacaaauguccccuccugagacaaaaugagcccgaggacaucgacuguuggugcaacucgacgucgaccugggucaccuaugggacgugcacaaccacgggcgagcaccgucgcgaaaagagguccgucgcccuuguuccccacgucgggaugggccucgagacccgcaccgagaccuggaugucuagugagggggccuggaagcacguucagcgcaucgagacguggauccugcgccaccccgguuucacgaucauggccgcgauucuggccuacacgaucgggaccacgcauuuccagcgcgcccucaucuuuauucugcugacagccguggcgcccucgaugaccaugcgcuguaucggcauuagcaaucgggacuucgucgagggcgugagcggugggagcuggguggacauaguccucgagcacgggucuugcguaaccacgauggccaaaaacaaacccacccuggacuucgaacugaucaagacggaagccaagcagccugccacgcucaggaaauacugcauugaagccaagcuaacgaauaccaccaccgagucccggugcccgacacagggagagcccucacugaaugaggagcaggacaagcgguucaucugcaagcacuccaugguggaccgaggcugggggaacggcugcggccuguuuggcaaggguggcauuguuaccugcgccauguucacgugcaagaagaacauggaggggaagguggugcagcccgagaaccuggaguauaccaucgucauaacgccacacagcggugaggagcacgccguuggcaaugacaccgggaagcauggcaaagagaucaagaucacgccgcagagcaguauaacggaggccgaacugacgggguacggaacagucacuauggagugcagcccccggaccggacucgacuucaacgagaugguccugcugcagauggaggacaaagccuggcugguccaccgccagugguuccuggaccugcccuugccauggcugccgggggccgacacccaaggaagcaacuggauccagaaggaaacgcuagugaccuucaaaaacccccacgcgaagaagcaggacgucgugguccucgggucccaggagggcgccaugcacaccgcccugacaggcgcuacggagauccaaaugaguagcggcaauuugcuguucaccggccaccugaagugcagacugcggauggauaagcuccagcugaaggggaugucauacagcaugugcacgggcaaguucaagaucgugaaggagaucgccgagacccagcacgguacaaucgucauccgcguccaguacgagggcgacggcucccccugcaaaauacccuucgagaucaccgaccuggagaagaggcacgugcucgggagauugaucaccgugaacccgaucgucaccgagaaggacagccccgugaacaucgaggcugagccgccauucggcgauuccuauaucaucaucgggguggaaccgggccagcucaaguuaaacugguucaagaaggguucguccaucgggcagauguuccagacuaccgucagaggugcgaagaggauggccauccugggggacaccgcuugggacuucgggagccucgggggcguguucacuaguaucgggaaggcgcuccaccagguguucggggcgauuuacggagccgccuucagcgguguguccuggacgaugaaaauccugaucggugugauaaucaccuggauaggcaugaacucacgcucgaccagccucuccgugagccuggugcucguuggcguggucaccuuauaccugggggccauggugcaagcggacuccggcugcgugguaagcuggaagaauaaggaacucaagugcggcagcgggaucuuuaucacggauaauguacacaccuggaccgagcaguauaaauuccagcccgaaagccccagcaagcuggccuccgccauccagaaggcccaugaggagggcauuugcggcauccggagcguuacccgccuggagaaucucauguggaagcagaucacgcccgaacuaaaccacauccucuccgagaaugaggucaagcucaccaucaugaccggcgacaucaaggggaucaugcaggcaggcaaacggucccugcgcccgcagcccaccgagcuuaaguacaguuggaaaacguggggaaaggcgaagaugcugagcacggaaucgcacaaucagacuuuccugauugacgggcccgagaccgcugagugcccgaauacaaaucgggccuggaacagccuggagguggaggacuacggcuucgggguguucaccaccaacaucuggcucaagcugcgcgagaagcaggaugucuucugcgacuccaagcucaugucugccgcgaucaaggacaaccgggcggugcacgccgacaugggguacuggauugagucagcccucaacgacaccuggaagauggagaaagccucuuucauagaggugaaauccugccacuggccgaagagucauacccugugguccaacggcguccuggaguccgagaugaucauccccaagaauuuugcugggcccgugucucagcacaacuaucgcccgggguaccacacccagaccgcggggcccuggcaccucggcaagcuggagauggauuuugaccugugcgaagggacaacaguggucgugacggaggacugcggaaaccggggccccagccuucgcaccaccaccgccagcgggaagcugaucacggaguggugcugucgguccugcacgcuucccccgcuccgcuaccgcggggaggacgggugcugguacggcauggagaucaggccccugaaggagaaagaggagaaucuggugaacagccucgugaccgccgggcacggccagaucgacaacuuuucccugggcguacugggaauggcccuguuccuugaggagaugcugcggacgagaaucgguacgaagcacgcgauacucuugguaguugugagcuuuguuacccugaucacaggcaauauguccuuucgggaccucggcagggucauggugauggugggggcuaccaugacggacgacaucggcaugggcgucaccuaccuggcccuguuagccgccuucaaggugcgcccgaccuucgcggcggggcugcuucuccggaagcugacaagcaaagagcugaugauggccaccaucggcaucgcacuccuuucccagagcacuauacccgagacuauccuggagcugaccgacgcccuagcgcuggggaugauggugcuaaagauaguucgaaacauggagaaguaccagcuggccguaacgauaauggcgaucucaugcgugccgaacgccgucauccugcagaacgccuggaaggucagcuguaccauacucgcggccguguccguaagcccccugcuucucaccuccagccagcagaaagccgacuggaucccucuugcacucacuaucaagggccucaaccccacggcgaucuucuugacuacucugucccggacaaguaagaagcgcuccuggccgcugaacgaggccauuauggccgucggcauggucagcauucuggccuccucuuuacucaagaaugacauacccaugacggggccuuuaguggcaggagggcugcucaccgucugcuacguccugaccggucggagcgcugaucuggagcucgagagagcggccgacgugaagugggaggaccaggccgagaucuccgggucgucucccauccucucgaucaccaucuccgaggacgguagcaugucuaucaaaaacgaggaggaggagcagacgcugaccauccucauccggacugggcuucugguaaucucuggggucuucccgguuuccauccccaucaccgccgcggccugguaucuaugggaggugaagaagcagcgcgccgguguccuaugggacgucccgagcccgccgcccguggaaaaagccgagcuggaagauggugccuaccggaucaagcagaggggcauacucggcuacucccagaucggcgccggcgucuacaaggaagggaccuuccacaccauguggcaugugacgcggggcgccgugcugaugcaucgcggcaaacggaucgagccaagcugggccgacgucaagaaggaccugauuucauacggagggggauggaaguuagagggcgaauggaaagaaggcgaagagguccaggugcucgcccuugagccgggcaagaacccccgcgccguccaaacgaagcccgggauauucaagaccaacacaggcaccauuggggcggugagccuggacuuuucucccggcaccagcgggucccccauuguagaucgcaagggcaagguggugggccuguacgggaauggcguagucacucgcagcggcgccuacgugucugccaucgcccagacggagaaauccaucgaggacaaccccgagaucgaggacgacauauuccggaagaagcgccugacaaucauggaccuccaccccggcgcgggcaagacgaaacgguaccugccagccaucguucgcgaggccaucaagcggggauuaagaacacugauccucgccccaacgagggucguggcugcugaaauggaggaggcgcugcguggccuccccauacgcuaccagacacccgccauuaagaccgagcacacagggcgagaaaucguggaccucaugugccaugcgacguucaccaugcgccuccugagccccguccgggugccgaacuauaaccucaucaucauggacgaggcucacuucaccgacccggcguccaucgccgcccgcgguuacaucagcacccggguggagaugggcgaggccgcagggaucuucaugacugcgaccccgccggggagccgcgacccguucccccagucuaaugcucccauuauggacgaggaacgggagauccccgaacgcuccuggaacucggggcacgagugggucaccgacuucaaaggcaagaccgugugguucguuccaaguauuaaggcggggaaugacauagcugcuugccuucgcaagaacggcaagaaggugauucaacugagcaggaagacauucgacuccgaguaugugaagacucgggcuaacgacugggauuucgugguuaccaccgacauuagcgagaugggagccaacuucaaggcggagcgugugauagacccccggcgcugcaugaaacccgugaucuuaacggauggggaggaacggguuauuuuagccggccccaugcccgugacacauuccagcgccgcccagagacgggggcgcaucggcaggaaccccaaaaacgaaaacgaccaguacaucuacaugggggagccccuggagaaugacgaggacugcgcccacuggaaagaggccaagaugcuccuggacaacaucaacacacccgagggcaucaucccguccauguuugaacccgaacgggagaagguggaugccaucgacggugaguacaggcuccgcggggaggcgcgcaaaacauucgucgacuuaaugcgccgcggcgaccugccaguguggcucgccuacaaagucgccgcggaggggaucaacuacgccgaccguaaaugguguuucgacggcaucaagaacaaccaaauccuugaggagaacauggaggucgagauuuggacgaaggagggggagcgcaagaagcugaagccgcgguggcuggaugcgcguaucuacagcgacccacucgcguuaaaagaguucaaggaauucgcagccggccggaagucccugacgcucaaccuaauaaccgagaugggccgcuugccgaccuuuaugacgcaaaaggcucggaaugcccucgacaaccuggccguucuccacacugccgaggccgggggcagagcguauaaccacgcucugagcgagcugcccgagacccuggaaacccuccugcugcugacccuucuggccacgguaaccgggggcaucuuccuguuccugauguccggcaaggguaucggcaagaugacccuggggauguguuguaucaucaccgccagcauauugcugugguacgcccagauccagccacauuggaucgcggccuccaucauacuggaguucuuccuuaucgugcuccuaauccccgagcccgaaaagcagcggacaccacaggacaaucaguugacauacgucgucaucgccauccugacugugguugccgccaccauggcgaacgagaugggcuuucuggagaagacgaagaaggaccucgggcugggcucuaucaccacccaagagcccgaaagcaacauccuggacauugaccugcgccccgccagugcguggacccuguacgccguugccacgaccuucgugacccccaugcugcgccacaguaucgagaauucuagcgugaacgucucccucaccgcuaucgccaaccaggccacuguccucaugggccuggggaagggcuggccccuaagcaagauggacaucggcgugccacugcuggccaucgguugcuacagccaaguuaaccccaucacccugaccgcggcccugcuacucuuaguagcccauuacgccauuaucgggcccggccugcaggcaaaggcaacccgagaggcccagaagcgggcugcagccggcaucaugaagaaccccacgguggacgggaucaccgucaucgaucucgagccuauccccuaugaccccaaauucgagaagcagcugggccaggugaugcuguugauccugugcgugacucagguccugaugaugcgcaccacgugggcacucugugaggccuuaacccuggccaccggucccaucaguacccucugggagggcaacccugggcgguucuggaacacgaccauagccgugagcauggcuaauaucuuccgcggcagcuaccuugcgggcgccgggcuccuguucuccaucaugaagaauaccaccaacacccgccgagggaccgggaauaucggggagacgcugggcgagaaguggaagucccgcuuaaacgcccuagggaaguccgaauuccagaucuacaagaaguccggcauucaggagguggauagaacccuggcuaaagaggguaucaagcgcggcgaaacggaccaccacgcggucagucgcgggagcgccaagcuccgcugguucgucgagagaaacaugguaaccccagagggcaagguaguagaccugggcugcgggcgcgggggguggucguacuacugcggcggguugaagaacguucgggagguuaagggucugacgaagggugggcccggucaugaggaacccaucccgaugagcaccuacggguggaaccucgugagacugcaauccggcguggacguauucuucacccccccagagaaaugcgacacacugcucugcgacaucggggagagcagccccaacccgaccaucgaagcaggccgaacuuugcgcgugcugaaccucguggagaacugguugaacaacaacacucaguucugcaucaagguccugaacccguacaugcccagcgugauagagaagauggagacccuccagcggaaguacggcggggcccuggugcgcaacccgcugagcagaaacuccacccacgagauguacuggguuucgaaugccaccggcaauaucguguccagcguaaacaugaucucuaggauguugaucaaccgguucaccaugaagcacaagaaggcgacuuacgagcccgaugucgaccucgggaguggcacccgcaauaucgggaucgaguccgagauccccaaccuggacauaaucgggaagcggaucgagaagauuaagcaggagcacgagacgaguuggcacuaugaccaggaucacccuuacaagaccugggccuaccacgguuccuaugaaacgaagcagaccgggagcgccagcaguauggugaacggcgugguccgccugcucaccaagccuugggacgugguccccauggucacccaaauggccaugacggacaccacccccuuuggccaacaacgcguguucaaggagaagguggacacccggacucaggagccuaaggagggaaccaagaagcuuaugaagauaaccgccgaaugguuguggaaggagcucgggaagaagaagacccccaggaugugcacgcgggaggaguucacccgcaagguccgguccaacgcggcccugggggcuaucuucaccgaugaaaacaaguggaaauccgcccgcgaggccgucgaggacggacgguucugggagcuagucgaccgcgagagaaaccuccaccuggaggggaaaugugaaacaugugucuacaacaugauggguaagcgcgagaagaaacugggggaguucgguaaggcgaaaggcucucgggcaaucugguacauguggcucggggcgcgauuccuggaguucgaggcgcugggcuuccucaaugaggaccacugguucagcaggggaaacucacugagcgguguggagggggagggcuuacaccgcuugggcuacauccugcgggacguagggaaaaaggagggcggcgcgauguacgcugacgacacagcgggcugggacacccgcaucacgcuggaggaccuuaagaacgaggaaauggugaccaaccacaugaaaggcgaacacaagaagcuggccgaggccaucuucaagcugacguaccagaacaaggucguccgaguucagcgucccacaccccgaggcacgguuauggacaucaucagucgccgugaccagaggggcuccgggcaagucgguaccuacggacuaaacacguucaccaacauggaagcgcaguugauccgccagauggagggcgagggcaucuuuaagagcauccaacaucugaccgccaccgaggaaauagcugugcagaacuggcuggcccggcugggccgcgagcgacugucccgcauggccaucagcggcgacgauugcgugguaaagcccaucgacgaccgauucgcgagcgcccucacggccuuaaaugacauggggaagguucggaaggacauacagcagugggagcccagccggggguggaacgacuggacccaggugccguucugcucgcaccacuuucaugaacugguaaugaaggacgggcgcgugcucgugguccccugucggaaccaagacgagcugaucggacgcgcccggaucucccagggcgcagguuggucccugaaggagaccgcgugucucggcaagagcuacgcccaaauguggacgcuaauguacuuucaccgccgggacuuacgccucgccgccaaugccaucugcuccgcgguaccuagccacugggucccgaccucgcggacgaccuggagcauccaugccaagcaugaguggaugaccacggaagauauguuagccgucuggaaccgcguuuggauacaggagaaucccuggauggaggacaagacaccuguggaauccugggaggaagucccuuaccuggggaagcgggaggaccagugguguggcagccucauaggucugaccucccgcgccaccugggcgaagaauauccagacugccauaaaccagguacggucccucaucggcaaugaggaguacacggacuacaugccguccaugaagcgguuucgacgugaggaagaagaggccggugugcucugguga

SEQ ID NO: 24916 - RNA, 9876 nt, Artificial Sequence
  derived and/or modified CDS sequence (opt11) from DENV-2__FJ024473__SS-prME
accgcgggcguaaucgucaugcugaucccuaccgcuauggcauuucaccucacgacccgcaauggggagccgcauaugaucguuggccggcaggagaagggaaaaagucugcuauucaaaacugaggacggggugaacaugugcacccuuauggccaucgaccugggggagcugugcgaggacacaaucacguauaagugcccccugcugagacagaacgaacccgaagacaucgacuguuggugcaacuccaccagcaccugggucaccuacggaaccuguaccacgacgggcgagcaccggcgcgagaagcggucgguggcucuggugccccacguggggaugggccuggaaaccagaacugagaccuggaugagcuccgagggagccuggaagcacgugcagcggaucgaaacguggauccuacgccaccccgguuucaccaucauggccgcgauccuggccuacaccauagggaccacacacuuccagcgcgcccucaucuucauccuacugacugcgguggcgcccagcaugaccaugcgaugcauagguaccuccaaucgggacuucgucgagggggugagcgggggcucuuggguugacauaguacucgagcacgguagcugcgucaccaccauggccaagaacaagccaaccuuggacuucgagcugaucaagaccgaggcuaagcagcccgcuacccucaggaaguacugcaucgaggccaagcugaccaacaccaccacggagucccggugcccuacccagggcgagccgagccuuaacgaagagcaggacaagcguuucauuugcaaacacuccaugguagaccggggcugggggaacggcugcggucuguuuggcaagggcgggaucgugaccugcgcuauguucacguguaaaaagaacauggaagguaagguggugcaacccgagaaccuggaguacacgaucguuaucacgccucacucgggggaggagcacgccgugggcgacgacacaggcaaacacggcaaggagaucaagaucaccccucagucgagcaucacugaggcagagcuuacaggguacggcacuguuaccauggaguguagccccaggacugggcucgacuucaacgagaugguuuugcugcaaauggaggacaaggccuggcucgugcaucgucaaugguuccuggaccugccccuccccuggcuuccgggggccgacacacagggcucuaacuggauacaaaaggagacccuugugaccuuuaagaacccccacgcgaagaagcaggauguugugguccucgggagucaagagggagccaugcauaccgcgcuaaccggugccacugagauacagaugagcuccggcaaccucuuauucaccggucauuugaaaugccgccugcgcauggacaagcuccagcugaaaggcauguccuacagcauguguaccggcaaguuuaagauagugaaggaaaucgccgagacucagcacggaaccaucgugauacgcguccaguacgagggcgacggcuccccgugcaagauacccuucgagaucacagacuuggagaagcgccacguccucgggcgucugauuacggugaauccaaucgugauugaaaaagacucacccgugaacauagaggccgagccuccguucggcgacucuuauaucaucauugggguggagccgggacagcugaagcugaacugguucaagaaggggaguuccaucggccagauguucgagacgacuaugagaggcgcuaagcgcauggccauccugggggauaccgccugggacuuuggcagccucggcggcguauucaccuccauagggaaggcccuccaccagguguuuggggcgaucuacggugccgccuuuagcggcguaucguggacgaugaagauccugauuggcgucgugaucacauggaucggcaugaacucgcgcagcacaagccuguccgucagccugguccuugugggcgugguuacccuguaccugggggcgaugguucaagcagacagcggcugcguggucagcuggaaaaacaaggagcucaagugcggcuccggaauauucaucacggacaacgugcacaccuggaccgagcaguauaaguuccagcccgagucacccagcaagcuggccuccgccauccagaaggcccacgaggagggcaucugcgggauccggagcgugacgcgacuggagaaucucauguggaagcagaucaccccggagcugaaccacaucuuauccgaaaacgaggucaagcucacuaucaugaccggcgacaccaaggggauaaugcaagccgguaagcgguaccugcguccgcagcccacggagcuaaaguacucguggaagaccuggggcaaagcgaaaauguuauccaccgagucgcacaaccaaacuuuucugaucgaugggccugagacggccgaaugccccaacacaaaccgcgccuggaauucccuggagguggaagauuacggcuucggagucuucacuaccaacaucugguugaaguuaagagagaagcaggacgucuucugcgacagcaagcugauguccgccgccaucaaggacaaccgggcggugcacgccgacaugggcuauuggaucgagagcgcccucaacgacaccuggaagauggagaaagccuccuucauugaggucaagucaugccacuggccaaagucgcacacucucuggagcaaugggguauuagaguccgaaaugauaauccccaaaaauuucgccgggcccgugagccaacacaacuacagacccggcuaccacacccagaccgcagggccuuggcaccucggcaagcuggagauggacuuugacuucugugaggggaccacgguggucgucacggaggacuguggcaaucgggggccgucccugcgaaccaccacggcgagcgggaaacucauuaccgaauggugcugccggagcugcacccugcccccgcugagauaccggggcgaggacgggugcugguacggaauggagauuagaccucucaaggagaaggaagagaaccucgugaauucccuugucaccgccgggcacggccagauugacaacuucucucucggaguauuggggauggcgcuguuccuugaggagaugcuccggacgcgagucggcacgaagcacgcgauucuguuggucgccgugaguuucgugacccugaucaccgggaacaugagcuuucgagaccuuggccgggucauggugauggucggcgcaacgaugaccgacgacaucggaaugggcgucaccuaccucgcccugcuagccgcguucaaagugcgccccaccuucgcggccgggcuccuccugagaaagcucacgucaaaagagcucaugauggcuaccaucggaaucacccugcucagccaguccaccauccccgagacgauccuggaguuaaccgaugcccucgcguuagggaugaugguucugaagauugugcgcaacauggaaaaauaccagcucgcuguuaccaucauggcuaucagcugcgugccgaacgccgucauccugaggaaugccuggaagguguccugcaccaucuuagcggccgucagcguaagcccucugcugcugacgagcucccagcagaaggccgacuggauaccgcucgcgcuaaccaucaagggccuuaaucccaccgcuaucuuccucaccacgcugagccgcaccucuaagaagcgaagcuggccgcugaacgaggcgaucauggcagucgguauggucucuauccuugccuccucucuguugaagaacgacauccccaugacagggccccucguugcaggcggguuguugaccgucugcuauguccucacgggucgcagcgcagaucuggaacuggaaagagcggccgaugugaagugggaggaucaggccgagauuagcggguccagccccauccuguccauaacaauuagcgaggacgguucgaugagcaucaagaaugaggaagaggagaccacucugaccauccugaucagaacuggccuccuggugauauccggcgucuucccugugucuaucccaauaacagcggcggccugguaccuuugggaggugaagaaacagcgcgcgggcgugcucugggaugugccaucgccgccgcuggucgggaaggccgaguuggaggacggcgccuacaggaucaagcaacgugguaucuugggcuacagccagaucggcgcgggggucuauaaggaaggcaccuuccacaccauguggcaugugacacgcggggcgguccugaugcaccggggcaaacgaauugagcccagcugggcagacgugaagaaagaucugaucaguuacgggggcggcuggaagcucgagggggaguggaaggagggcgaggagguacaggugcuggcguuggagcccgggaagaacccccgggccguccagaccaagcccggcauauucaagaccaacaccgggacgaucggugcggugucccucgacuucagccccggcaccucagggagccccauuguggaccguaaaggcaaggucguagggcuguacggcaacggugucgucacccgcuccggggccuacgugagcgccaucgcccaaaccgagaaguccaucgaggacaacccggaaauagaagacgacaucuuccgcaaaaagcgguuaacgaucauggaccuccaccccggcgcugggaagaccaaacgguaccugcccgcuaucgugcgggaggccaucaagcguggccugcgcacccugauccuggccccgacccgaguaguggcggcggagauggaggaagccuuacgcggucuacccauccgguaucagacgcccgccauuaaggcugagcacaccggcagagaaaucguugaccugaugugucacgccacauucaccaugcggcuuuuaucacccgugcgagugcccaauuacaaucucaucaucauggacgaagcgcacuucacggacccggccucgauagcagcacggggauacaucagcaccagaguggagaugggcgaggcagcggggaucuucaugaccgccacgccuccugggagccgagaccccuucccgcaaaguaacgcccccaucauggaugaggagcgcgagauccccgagaggagcuggaacagcgggcacgaaugggugaccgacuucaaggggaagaccguuugguucgugcccucuaucaaggccggcaacgacauagcggccugucuacguaagaacggcaagaaagucauccagcuguccaggaagacguucgacuccgaguacgugaaaacccgcgcaaacgacugggacuuuguggucacgaccgauauauccgagaugggugccaauuuuaaggccgaacgggugaucgauccccgcaggugcaugaagcccgugauccuaacugacggcgaggagcgcgucauccuagcggggcccaugcccgugacccauagcuccgccgcgcaacgacggggccgcaucgggcggaacccgaagaacgagaacgaccaauauauauacaugggugagccucuggagaacgacgaggacugugcccacuggaaggaagcuaaaaugcuccuggacaauaucaacacgcccgaaggaaucauuccaagcauguucgagccggaacgcgaaaagguggaugcggucgacggggaguaccggcuuaggggugaggccaggaaaaccuucguagaccucaugagacguggggaccugcccguuuggcuggccuauaagguugccgccgagggcaucaacuacgcggaccgcaaguggugcuucgacgggauuaaaaacaaucaaauccucgaggagaauguggaggucgagaucuggaccaaggagggggaacgcaagaagcugaagccgcgcuggcuggacgcgaggauuuacuccgacccccucgccuugaaggaguucaaggaauuugcugcgggccggaagucucucacacuuaaccuaaucacggagaugggacgguuacccacauucaugacccaaaaggcccgcaacgcacucgacaaccuggcugugcugcacaccgcugaggcgggcggccgggccuacaaucacgcccucagugaacugcccgagacgcuagagacccugcuccugcucacucuccuggccaccguaacagguggcaucuuccucuuccugaugagcgggaagggcaucgggaagaugacgcugggcaugugcugcauuaucacugccuccguccuccugugguaugcgcagauacagccccauuggaucgcggccucaaucauuuuagaguucuuccucauuguccuguugaucccggagcccgagaagcagcgcacgccccaggacaaucagcuuaccuacguggucaucgccauccugacugucguggcggccaccauggcaaaugagauggguuuuuuagagaagaccaagaaggaccucgggcugggcuccaucaccacgcaggaaagcgagagcaauauccuggacaucgaucuccggcccgcuucugcuuggacccuguacgccguagcgaccacuuuugugacgccgaugcugcgccauagcaucgagaacuccagcgugaaugucagcuugacagcaaucgcgaaccaagcgaccgugcugauggggcuggguaaggguuggccccugagcaagauggacaucggcgugccccugcuggcaaucgguugcuacucccaggucaaccccauuacccucaccgccgcgcugcugcuccucguagcccacuacgccaucaucgggccggggcugcaagcgaaggccaccagggaagcccaaaaacgcgccgcggcggggaucaugaagaaccccaccgucgauggcaucaccgucaucgaucucgaaccuauccccuacgacccgaaauuugaaaagcagcuggggcaggugauguugcucauauuaugcgugacacaaguacugaugaugcgcaccaccugggcccucugcgaggcccugacccuggcaaccggcccuauuagcacccuaugggagggaaaccccggccgcuucuggaacaccaccauugcgguguccauggcaaacaucuuccgcggcuccuaccuggccggagccggccucuuauuuuccauuaugaagaauacuaccaacaccaggcgcggaacagguaacauaggcgagacgcugggggaaaaguggaaauccaggcugaaugcccucgguaaguccgaguuccagaucuauaagaaguccgggauccaagagguagaccggaccuuagccaaggagggcauuaagcgcggggaaacugaccaccaugccgucucucgcggaagcgcgaagcuucggugguucguugagcgaaacauggugacccccgaggguaaggucgucgacuugggaugcggccgaggcggaugguccuacuacugcggcggucugaagaacguucgcgaggucaaggggcugaccaagggcggaccggggcaugaggagcccauucccaugagcacauacggcuggaaucuuguccggcugcagagcgggguggacgucuucuuuacuccacccgagaaaugcgacacccuucucugugacauaggggagucaagccccaacccgaccauugaagccggccgaacgcuacgggugcucaaucucguggagaacuggcugaacaacaacacccaguuuugcaucaagguucugaaccccuauaugcccagcgugaucgagaagauggagacccuccagcgcaaguacgggggcgcucugguccggaaucccuuaagccgcaacuccacccacgagauguauugggucagcaacgcaacggggaacaucguguccucggugaacaugaucucgcggaugcugauuaacagauucaccaugaagcacaagaaagccaccuacgaggccgacguagaccucggcagcggaacccggaacaucgguauagaguccgagauacccaacuuagacaucaucggcaagcggaucgagaagaucaagcaggagcacgagacaagcuggcacuacgaccaagaccacccauauaaaaccugggccuaccacgguuccuaugagaccaagcagaccgguucagccuccucaaugguuaacgggguggucagacugcucacgaaaccgugggauguggugcccauggugacgcaaauggcaaugaccgacacaacgcccuucggccaacagcggguguuuaaggagaagguggacacccgcacccaggagccgaaagagggcaccaaaaaguugaugcggaucacggcagaguggcuguggaaggagcucggaaaaaagaagacgccucgaaugugcacccgggaggaguucaccagaaagguccgauccaaugccgcucugggcgcuauauucacugacgagaacaaguggaaaucggcgcgcgaggccguugaagacggucgcuucugggaguuagucgaccgagagcggaaccuccaccuggaggggaagugcgagaccugcguguacaauaugaugggcaagcgcgagaagaaacugggagaguuuggcaaagccaaggggucccgggcaaucugguacauguggcucggcgcacgauuccuggaguuugaggcccugggguuccucaacgaagaccacugguucagccgaggcaauucccugagcgggguggaaggugagggccugcaccgcuuaggguacauccugcgggacgucgggaagaaggagggcggcgccauguacgcagacgacaccgcugggugggacacccgcaucaccuuagaggaucucaagaacgaggagauggugaccaaucacaugaagggugaacauaaaaaacuggccgaagccaucuuuaaacugaccuaucaaaauaaggugguccgggugcagcgcccuaccccgcgcggcacggugauggacaucaucagccgccgcgaccaacggggguccggccaggucgggaccuauggccucaacacguucacaaacauggaagcccaacugauccgccagauggagggugaagggaucuucaagagcauccagcaucugacggccacagaggaaaucgcggcccagaacuggcucgcccggguuggccgggagaggcuguccaggauggccaucagcggggacgauugcgucgucaaaccaauugacgaccgcuuugccuccgcccugaccgcgcugaacgacaugggcaaggugcgaaaggacauccaacagugggagcccagccggggguggaaugauuggacccaaguacccuucugcagccaccacuuccaugaguuagugaugaaggacggccgcguacuggucguucccugccggaaucaggacgagcucaucggccgcgcccgcaucucacagggcgccggcuggagucugaaggagacugccugccugggcaagagcuacgcgcagauguggacucucauguacuuucacagacgggaccuccgccuggcggccaacgccaucugcuccgccgucccgucucacugggucccgaccucucggacaaccuggucuauccacgcgaagcacgaauggaugacgaccgaggacaugcucgccgucuggaaccgcgucuggauacaggagaaucccuggauggaggacaaaacgcccguggaauccugggaggaaguccccuacuuaggaaagcgagaggaucagugguguggaagccugaucggccucacaucccgugccacgugggccaagaacauccagaccgccauuaaccaggugcgcucccuuauaggcaacgaggaguacacagacuauaugcccagcaugaagcgguuccgacgggaggaggaggaggccgggguccugugguga

SEQ ID NO: 24917 - RNA, 9876 nt, Artificial Sequence
  derived and/or modified CDS sequence (opt11) from DENV-2__FJ024474__SS-prME
acggcgggcgugaucguaaugcugauccccaccgccauggcguuccauuuaacgacgcgcaacggggagccacauaugaucgugggucggcaggagaaggggaaaagccugcuguuuaaaacugaggacggcgugaauaugugcacccugauggccauagaccugggggagcugugcgaagacacgaucaccuacaagugcccccuccuaaagcaaaacgagcccgaagauaucgacugcuggugcaacucaaccagcacaugggucacuuacgggaccugcaccaccacgggcgagcaccgacgcgagaagcgcuccguggccuuggugccccacguuggaaugggccucgagacgcggaccgagacguggaugucuagcgagggggcuuggaaacacgugcagcgcaucgagacauggauucugcggcacccgggcuucaccauaauggcagcaauucuggccuacacaaucggcaccacgcacuuccagcgcgccuugauauucauccugcuaaccgccguagcgcccucaaugacuaugagaugcaucggcaucuccaauagggacuucgucgagggcguuagcgggggauccuggguggauauaguucucgaacacgggagcugugugacuacgauggccaaaaacaaacccacgcuggacuucgagcugauaaagaccgaggccaagcagccagcgacccuccggaaguacugcaucgaggccaagcugaccaacacaacaaccgagucacgaugcccgacgcaaggcgagcccucucugaacgaggagcaggacaagcgauucaucugcaagcacucgauggucgaccgcggaugggggaacggcugcgggcuguucggcaagggcgggaucgugaccugcgcgauguucaccugcaagaagaacauggaagggaagguggugcagcccgagaaccuggaguacaccaucgugaucacuccccauagcggggaggaacacgccgugggcaaugacauagguaaacauggcaaggagauuaagaucaccccgcaauccagcaucaccgaggccgagcugacagguuacgggacugugacgauggagugcagcccccggaccggucucgacuucaacgaaaugguccuccuucagauggaggacaaggccuggcucguacaucgucagugguucuuggaucuacccuuacccugguuaccgggggccgacacccagggcagcaacuggauccagaaggagacccugguaacguucaagaacccccacgcgaagaagcaggacgucgugguccucgggucucaggagggcgcgaugcauaccgccuugaccggggcaaccgaaauccagaugaguuccggcaaccuccuguuuacgggccaccuuaagugccgacugcgaauggacaagcuacaacugaaagggaugagcuacagcauguguaccggcaaauucaagaucgugaaggagauagccgagacccaacacgggaccaucguuauccggguccaauacgagggcgauggcucaccaugcaagauccccuucgagaucacagaccuggagaagcgccacgugcucggccggcugaucaccgugaauccgaucgucaucgaaaaggacagccccgugaacaucgaggccgaaccgcccuucggcgacuccuauaucauuauagggguggagccgggucaauugaagcucaacugguucaagaaggggucauccauaggccagauguucgagaccacaaugaggggagccaaacggauggccauccugggggacacggcgugggacuucggcagucucggcgggguguucaccuccauugggaaggcccuccaucagguguucggggcgaucuacggcgcugcauucagcggaguguccuggaccaugaagauccugauuggcgucgugaucacuuggaucgggaugaacagccgguccacgucuuugucugugagccucgugcucgugggcguggucacccuauaucugggggcuauggugcaggcagacuccggcugcguggucaguuggaagaacaaagaacugaaaugcggcuccgguaucuucaucaccgauaaugugcacaccuggacggagcaguacaaguuccagcccgaguccccgagcaaauuagccucugcaauccaaaaggcccacgaggaaggcaucugcggcauccgcagcgugacccgucuugagaaccucauguggaaacaaauuaccccggaacugaaccacaucuuaucugaaaacgaggugaagcuuaccaucaugaccggcgauaccaaggggaucaugcaggcgggcaaacgcuacuuacggccgcagccaacggagcuuaaguacagcuggaagaccuggggcaaggccaagauguugaguacggagagccacaaccagacguuccugauugacgggcccgagaccgccgagugcccgaauaccaaccgagccuggaacucccuggagguggaggacuacggcuuugggguguucacgaccaacaucuggcucaagcugcgggagaaacaggaugucuucugcgauagcaagcugauguccgccgcuauuaaggacaaccgcgcgguccacgcggauaugggguacuggaucgaaucggcccucaaugacaccuggaaaauggagaaggcuuccuucaucgaggucaagagcugucacuggcccaaaagccacacccuguggagcaauggcguguuagagagcgagaugauuauuccuaagaacuucgccgggccagugagccagcacaauuacaggccgggguaccacacccagacggccggucccuggcacuuaggaaagcuagagauggacuucgacuucugcgaagggaccaccguggucgugaccgaggacuguggcaaccgcggccccucacugcggacaaccaccgccucagggaagcucauaaccgaguggugcugcagaagcugcacgcugcccccccucagguaccgcggcgaggauggguguugguacgguauggagaucagaccccucaaggagaaagaagagaaccuagugaacucgcuggucacagccggucacggccaaaucgacaacuuuucccucggcguacuggggauggccuuauuccucgaagagaugcugcggacccggguggggacuaaacacgcgauccugcuggucgccguguccuucgugacgcugaucaccgggaacaugagcuuucgcgaccugggcagggucaugguaaugguuggugcuacgaugacggacgacaucggcaugggagucacguaccucgcccuauuagccgcguucaagguucgccccaccuucgccgccgggcuacuacugcgcaaguugacaagcaaggaacugaugauggccaccaucggaaucacgcuacucagccaauccacgauucccgagaccauccuggagcuaaccgacgcguuagcgcugggcaugaugguguuaaagaucguccgcaacauggagaaguaccagcuggccguuacgauaauggccaucagcugcgugcccaacgccgucauucugcgcaaugccuggaaaguguccugcaccauacuggcggcagccagcgugagcccccuccugcuuaccucgucccagcagaaggccgacuggaucccccucgcgcugacaauuaagggccugaaucccacggccauauuucucaccacccugagccggaccuccaaaaagcgcagcuggccgcuaaacgaagccaucauggccgucggcauggucuccauccucgcuagcucgcugcugaagaacgauauccccaugacggggccgcucguugcgggcgggcuucugaccgugugcuauguauuaaccggacggagcgcagaccuggaguuagagcgcgccgcagacgucaagugggaggaucaagccgaaaucagcggcuccagccccauacucuccaucaccaucagcgaggauggcaguaugagcaucaagaaugaggaggaggagcagauucugacgauccugauccggaccggccuccugguuauuuccgggguuuucccggucagcaucccuauaaccgcagccgccugguaccugugggaggugaaaaagcagcgggccggcguucucugggacgucccgagcccgccucccguggggaaggccgaguuggaggacggugcuuaccggauaaagcagcgcgguaucuugggcuacagccaaaucggagccgggguguacaaggagggcaccuuccacaccauguggcaugucacgcgcggggcgguucucaugcacagaggcaagcggaucgagccgucgugggccgacgugaagaaggaccugaucuccuacggggggggauggaagcucgaaggggaguggaaggagggcgaggagguccaaguccuagcacuggagcccgguaagaacccucgcgcggugcagaccaaacccggcaucuucaagaccaacacugggacgauuggcgccgucucccuagacuucagcccgggcaccagcgggagucccaucguggaccggaaggguaaaguggucggguuauacggcaacggcguggugacacgcucuggagccuaugucagcgccaucgcgcaaacagaaaagucgaucgaggacaacccggagaucgaggacgacaucuuccggaagaaacgccugacgauaauggaccugcaccccggcgccggaaaaaccaagcgguaccuccccgcuauuguacgcgaggccaucaagagaggcuugcgcacccugauccuugcgccaacuaggguggucgcggccgaaauggaggaagcacuccgggggcugcccauacguuaccaaacucccgccaucaaggccgagcacaccggccgagagauuguggaccugaugugccacgcgaccuucaccaugcgccuccuuucaccggugcggguacccaauuacaacuuaauaaucauggacgaggcgcauuucacagaccccgccagcaucgcugcccgcggcuacaucuccacgcggguggagaugggugaagcggcuggcaucuucaugaccgcaacgccgcccgggagccgggauccguuuccccaguccaaugcccccauuauggacgaggagcgggaaauccccgagcgcagcuggaacuccggccaugaaugggugacugacuucaaaggaaaaacaguuugguucgucccgagcaucaaggcgggaaacgauaucgccgcgugccuccggaagaacggaaagaagguaauccagcuguccaggaagaccuucgacagugaguacgucaagacccgggccaacgacugggauuuugugguaacgaccgacaucuccgagaugggggccaacuuuaaggcggagcgcgucauagauccccgccgcugcaugaagcccgugauccuuacucacggcgaagagcgggugauccucgccgggcccaugccggucacgcacuccuccgccgcccagcgccggggccgcaucgggcgcaaucccaagaacgagaaugaccaguauaucuacaugggcgaaccccuggaaaacgacgaggacugcgcgcacuggaaggaggccaagaugcugcucgacaacauaaauacccccgagggcaucaucccgaguauguuugaacccgagcgggagaagguggacgccguggacggagaguaccgccuuaggggcgaagcccgcaagacauuugucgaccugaugcggcgcggggacuuacccguguggcuggccuacaagguggccgcggagggcaucaauuacgccgaccggaagugguguuucgacgguaucaaaaacaaccagaucuuggaagagaaugucgagguugagauuuggacgaaggagggagagcgcaagaagcucaaaccgcgguggcuggacgcccggaucuacuccgacccccuggcccuuaaagaguuuaaggaguucgcggccgggcggaaauccuugacccugaaccucaucacggagauggggcgcuugcccaccuucaugacccagaaagcccggaacgcccucgacaaccucgccgucuugcauaccgccgaggccggcgggcgcgccuacaaccacgcccuguccgaacugcccgaaacguuagagacgcugcuacuccugacccuacuggccacagugacgggcggaaucuuccuguucuuaaugucugggaaaggcaucgggaagaugacccuggguaugugcugcaucaucacugcguccgugcuucucugguacgcccagauccagccgcauuggaucgccgccagcaucauccuggaguucuuccugaucguccuccugauccccgagcccgagaagcagcggacgccccaagauaaccaacugaccuacgugguuaucgccauccucacggucgucgcggccaccauggccaacgagauggguuuccuggagaagaccaagaaggaccugggcuugggcuccaucaccacgcaggaaagcgagagcaacauccuggacaucgacuugcgcccggccuccgcguggacccucuacgcgguggcuaccaccuucgucacgcccaugcuacggcacagcaucgagaacuccagcgugaacguuucacugaccgccaucgcaaaccaggcgaccgucuuaauggggcucggcaagggguggccccugucaaagauggauaucggcguuccccuccuggccaucggguguuauucccaggugaacccgaucacccugacggccgcccuacugcuacucgucgcccacuacgccaucaucggccccggauuacaggccaaggccacacgggaggcucagaagcgugccgcggccgggaucaugaagaaucccaccguggacggcaucacggugaucgauuuagagccgauuccguaugaccccaaguucgagaagcaauuggggcaggucaugcuucugauccucugcgugacccaaguccuaaugaugcgcaccaccugggcccucugcgaggcccucacccuggccacgggucccaucagcacgcugugggagggcaacccgggccgguucuggaacaccaccaucgcggucucuauggccaacaucuuucgcggcucguaucucgccggcgccggccuccuguuuuccauaaugaagaauacuaccaacacccgcaggggaaccggcaacauuggagagacccucggggagaaguggaaaucccgccugaacgcgcugggcaagagugaguuccagaucuacaagaagucggggauccaggagguggaccggacacucgcaaaggagggcaucaaacgcggggaaaccgaccaccacgccgugucccggggguccgcuaagcuucgcugguucgucgagcggaacauggugaccccggaaggcaaaguggucgaccuggggugcggccgcgggggcugguccuacuacugcgggggccucaaaaacgugcgggaggugaagggccuuacgaagggcggccccggacacgaagaacccaucccgaugagcaccuacgguuggaaccugguccgucugcaguccgggguggacguuuucuucaccccgcccgagaaaugcgacacccugcugugcgauaucggggaauccagcccgaacccgacgauugaggccggucguacgcucagggugcugaaucuaguggagaacuggcucaacaacaacacccaguucugcaucaaaguguuaaacccguacaugcccucggucauugagaaaauggagaccuuacagcggaaguacgggggcgcgcucgugcgcaacccccuuagucggaauucgacccacgaaauguacugggugucgaacgccacggggaacauugucuccuccgugaacaugaucucgcgcaugcugaucaaccgauucaccaugaagcacaaaaaggccaccuacgagccggacguagaccuggguagcgggacacgcaacaucggcaucgaguccgagauccccaaccucgauaucaucggaaagcggaucgagaagaucaagcaggagcacgagaccagcuggcacuacgaccaagaccaccccuacaagaccugggcauaccacggguccuacgagacaaagcagaccggcagcgccuccagcauggucaacggggugguccgucugcuuacgaagcccugggauguugugccuauggugacccagauggcuaugaccgauaccacacccuucggccagcagcgcgucuucaaggagaagguagacacccggacccaggaacccaaggaggggaccaagaagcucaugcgcauaacugcugaguggcuguggaaggaguuggggaagaagaagacgccccggaugugcacccgagaggaguucacccguaagguucgcuccaacgcugccuuaggcgccauuuucacggacgagaauaaguggaaguccgcgcgggaggcggucgaagacgggagguucugggagcugguggaccgggagcgcaacuugcaccucgagggcaagugcgaaaccugcgucuauaacaugauggggaagcgggaaaagaagcugggcgaguuuggcaaagccaagggcucccgcgcgauaugguacauguggcugggcgcgcgguuccucgaauuugaggcucugggcuuccugaaugaggaccacugguucagccggggcaacagucuauccgggguugagggcgagggacugcaccggcugggguacauacuccgcgacgugggaaagaaggagggcggcgccauguacgcggacgauacagccgggugggauacccggaucacacuggaagaccuuaaaaaugaagagauggucaccaaccacaugaagggcgagcacaaaaaacucgcggaggcuaucuucaagcugacauaccagaacaaggugguccgcguccagcggccgacgccccgcggcacggugauggauauuaucagccgucgugaccagcgcgguuccggacagguggggaccuacggccugaacaccuucacuaauauggaggcccagcucauccggcagauggagggcgaggggauuuucaaaagcauccagcacuugacggccaccgaggagaucgccgcgcagaacuggcuggcccgcgucggccgugaacgcuugucccggauggccaucucuggggacgacugugucgugaagcccaucgacgaccgcuucgcuuccgcucugacugcguugaacgacaugggcaagguccggaaggacauccagcagugggagcccagccgcgguuggaacgacuggacgcaagugccguucugcucccaccauuuccacgagcuagugaugaaggauggcagaguccuggugguucccugccgcaaccaagacgagcugauaggccgcgcacgcaucagccagggggccggcuggucccucaaggagacggccugccugggaaagagcuacgcacagauguggacccugauguacuuccaccggcgcgacuugcggcuggcggccaacgccaucugcagugccguccccucccacugggugccgaccagucgcaccacguggagcauccacgcgaagcacgaguggaugacgacagaggacaugcuagccguguggaaccgggucuggauccaggaaaacccguggauggaggauaaaacccccguggaauccugggaagaggugcccuaccucggcaagcgcgaggaccaguggugcgggagccuaaucggacucacgaguagggcgacgugggcaaagaacauccagacugccauuaaucagguccgcagcuuaauuggcaacgaggaguacaccgauuacaugccgaguaugaaacgauuccggcgagaggaagaagaggcagggguacugugguga

SEQ ID NO: 24918 - RNA, 9876 nt, Artificial Sequence
  derived and/or modified CDS sequence (opt11) from DENV-2__FJ024475__SS-prME
accgcgggcgugauugucaugcugauccccacggccauggcuuuccaccucaccacccggaacggggagccccauaugaucgugggccggcaggagaaggggaagucccuuuuauucaagaccgaagacggcgugaacauguguacucuuauggccauugaucuaggggagcugugcgaggauaccaucaccuauaagugcccacuacugcgccagaaugagcccgaggacaucgacugcuggugcaacaguaccucgacgugggucaccuacgggaccugcaccaccacgggcgagcaccggcgcgagaagcgguccguggcccuggugccacacguagggaugggccucgagacccggaccgagaccuggaugagcuccgagggggccuggaagcacgugcagcggaucgagacuuggaucuugcgccacccgggcuucaccauuauggcggcaauccuggcauacaccauuggcaccacgcacuuccagcgggccuuaauuuuuauccugcucacagccgucgcgccuagcaugacuaugcgcuguaucggcaucuccaaccgggacuucgucgagggcgugagcgggggcuccugggucgauaucguccucgaacacggaagcugugugaccacgauggcaaagaacaagcccacccuggacuucgagcugaucaagaccgaggccaagcagcccgcgaccuuacgcaaguacugcaucgaggccaaacugacgaacaccacgacagaguccaggugcccaacccaaggugagcccagcuuaaacgaggagcaggacaagcguuucaucuguaagcacuccaugguggacagaggcugggggaauggcugcgggcuguucggcaaaggagggauugugaccugugcgauguucacgugcaagaagaacauggagggcaagguggugcagcccgaaaaccuggaauacacgauagucaucacgccccacagcggagaggaacacgccgugggcgacgacaccggaaagcacggcaaagagaucaagaucaccccgcaauccagcauuaccgaggccgagcuaaccggauacgggacugugaccauggaaugcucuccccggaccggacuugauuucaacgaaauggugcuguugcagauggaggauaaggccuggcucguucaucgccaaugguuccuggacuuaccccuccccuggcucccgggggcggacacccaaggcuccaacuggauccagaaggagacacuggugacuuucaagaacccccaugcgaagaagcaggacgucgugguccucgggucgcaggagggagccaugcacaccgcccugaccggggccaccgagauccagaugagcagcggaaaccuccuauuuaccgggcaccugaagugccgccugcggauggacaagcuccagcugaaggggauguccuacucuaugugcaccggcaaguuuaagaucgugaaggagaucgccgagacccaacacgggacaaucgucauccgcguccaguaugagggcgacggcagucccugcaagauccccuucgaaaucaccgaccuggagaagcggcacguguugggccgccugaucaccgugaacccgaucgucauugagaaggacagccccgugaacauugaggcggagccgcccuucggcgacuccuacaucaucaucgggguagagccaggccagcuaaagcuuaauugguucaagaaggggagcuccaucggccagauguucgaaaccacgaugagaggcgccaagcggauggcuauucugggggacaccgccugggacuucggcagccuaggcggcgucuucaccuccaucggcaaggcccuccaccagguguuuggggcaaucuacggcgccgccuucucugggguuuccuggaccaugaagauccugauuggcgucgucauuacguggaucggcaugaacucccguuccaccucuuuauccgugagccuggucuuagugggagucgucacccuguaccuaggggcuauggugcaggcggacuccgggugcgucgucagcuggaagaacaaggagcucaaaugcgguucagggaucuucaucaccgacaacguucacacguggacugaacaguauaaauuucagcccgagucgcccagcaagcuggcauccgcuauccagaaagcccaugaggagggcauaugcgggauccggagcgugacccgcuuggagaaccucauguggaaacagaucacgccggaguugaaccacauacuguccgaaaacgaggucaagcucacgaucaugaccggcgacaccaaagggauuaugcaggcgggcaagcgguaccuacgcccgcagcccaccgaguuaaaguacuccuggaagacguggggcaaggcgaagaugcucuccaccgagagccacaaccagaccuuccugaucgacgggccggagaccgcugagugcccuaacacgaaccgggccuggaacucccuggaaguggaggacuauggcuucgggguguucaccaccaacauauggcucaaacugcgcgagaagcaggacgucuuuugcgacagcaagcugauguccgccgcgaucaaggacaaccgggcgguucacgccgacaugggcuacuggaucgagagcgcccucaacgacaccuggaagauggaaaaagcuuccuucaucgaagucaaaagcugccacuggcccaagucccacacucuguggagcaauggggugcuggagagugaaaugauuauccccaaaaacuuugccgggcccgugucucaacacaauuaccgcccgggcuaccacacgcagaccgcagggccauggcaccucgguaaguuggagauggacuuugacuuuugcgaggggacuaccgugguggugacugaggacugcgguaaccgaggcccgucccuccgcacgaccacugccucggguaagcucaucacggaguggugcugccguagcuguacccugcccccgcuucgcuaccggggggaggaugggugcugguacggcauggagauucgcccacucaaggagaaagaggagaaccugguaaacagucugguaaccgccggccacggccagaucgacaacuucagcuugggcguucuggggauggcccucuuccucgaggagaugcugcggacccgcgugggcacgaagcaugcgauacugcuaguugcgguguccuuugugacccugauuacggggaauaugagcuuucgggaccugggcagagucaugguuaugguuggggccacuaugacggacgacaucggcaugggcgucacuuaccuugccuugcuggcugcguuuaaggugcggcccaccuuugccgccgggcuccugcugcggaagcuaacuuccaaggagcugaugauggccacgaucggcaucacccugcucagccaguccaccaucccagagaccauucuggagcugacugacgcccucgcgcuggguaugauggugcuuaagaucgucaggaacauggagaaguaccagcucgccgugaccaucauggccaucagcugcgugcccaacgccguaauacugcgaaacgccuggaagguguccugcaccaucuuggcggccgugagcguuagcccccugcuguugaccagcucccagcagaaggccgacuggaucccccuugcgcuuacgauuaagggccugaaccccaccgcgaucuuccucaccacccugagccgcacguccaagaagcggucauggccgcugaacgaggcaauuauggccgugggcauggucuccauccucgcaagcagucugcugaagaaugacaucccuaugacuggcccccucguggccggcggucugcugaccgugugcuacguccucaccggccgcagcgcggaccuggagcucgagcgggccgccgacgugaagugggaggaucaggcggagaucucagguagcagccccaucuuguccaucacgauuagcgaggacggcucgaugagcaucaagaacgaggaggaggagaccacccugaccauccugauccgcaccggccuccugguaaucucuggggucuucccggugagcauccccaucacggccgcggccugguaccugugggaggugaaaaagcagcgggccgggguccuaugggacgugccgagcccgccucccguggggaaagccgagcuggaggacggcgccuaccgcaucaaacagcgggggauccuuggcuauagccagaucggcgcgggcgucuacaaggagggcaccuuccacacgauguggcacgucacccgcggggccgugcucaugcaccguggcaagcgcaucgagcccuccugggcggacgucaagaaggaccugaucaguuacggggggggcuggaagcucgaaggagaguggaaggagggggaggagguccaggugcucgcgcuggagccggggaagaacccccgggccguccagaccaagcccgggaucuucaagacgaacacagggaccaucggcgcagucagucuugacuucagccccggcacguccgggagcccaauaguugaccgcaagggaaaggucgugggguuguacgggaacgggguggucacccgguccggggccuacgugagcgccaucgcucaaaccgagaaguccaucgaagacaacccagaaaucgaggaugacauauuccgcaagaaacggcugacuaucauggaccugcacccaggagcagggaaaacgaagcgcuaccuccccgccaucgugcgggaggccaucaagcgcggucugcgcacucugauccuggccccgacccgggucguggcggcggagauggaggaggcacucagaggacugccaauucgguaccagacccccgccaucaaggccgaacacacgggccgcgagaucguggaucugaugugucacgcuaccuucacaaugcggcuccugagccccguccgggugccgaacuacaaccuaaucauuauggaugaagcgcacuuuaccgaccccgccagcauagccgcccggggcuacaucuccacucgcguggagaugggggaggccgccggcaucuucaugaccgcaacgccgcccgggagccgggauccauucccacaguccaacgcccccaucauggacgaggagcgcgagauccccgagcggagcuggaacucuggccacgagugggucaccgacuucaaggggaagacggugugguucgugccgagcauaaaggcaggcaaugacauugcggcgugccucagaaaaaacgggaagaaaguuauccagcugucccggaagaccuucgacucagaauacgugaagacccgcgccaacgauugggacuucgugguuaccacggacaucuccgaaaugggggccaacuucaaggccgaacgggugaucgacccgcgccggugcaugaagcccgugauccugaccgacggcgaggagcgugucauccucgcgggacccaugcccgugacccacagcuccgccgcccagcggcgaggacgcaucgggcggaaccccaagaacgagaacgaccaauacaucuacaugggggagccccuggaaaaugaugaggacugugcccacuggaaggaggccaagaugcuguuagacaauaucaacacccccgagggcaucaucccuagcauguucgagccggaacgcgagaagguggacgcugucgacggggaguaccggcugaggggcgaggcucggaaaacguucguugaccugaugcgccgaggggaucucccuguuuggcuggccuacaaggucgccgccgaaggcaucaauuacgcggaccgcaaguggugcuucgacgggauuaagaacaaccagauccuggaggagaacguggaggucgaaauuuggaccaaggagggcgagcggaagaagcucaagccccgcuggcuggaugccagaaucuacucggacccgcuggcccucaaagaguucaaggaauucgccgcggggcgcaagagcuugacccugaaccucaucaccgagauggggcggcugcccacguucaugacccagaaggcccgcaaugcccuggacaaucucgccgugcugcacaccgccgaggcgggcgggcgggcauacaaccacgcccuguccgagcuccccgagacccuggagacgcugcucuuacugaccuuacucgccaccgugaccggcggcaucuuccuguuuuuaaugagcgggaagggaauagguaagaugacccugggaaugugcuguaucaucacggccaguguucuucucugguacgcgcagauccagccacacuggauagccgccagcaucauucuggaguucuuucucaucgugcuccugauccccgagcccgagaaacagagaacgccccaggacaaucagcugaccuacguggucaucgccauccucacugugguagccgcgacgauggccaacgagaugggguuccuggagaagacgaagaaggaucugggccucggcucgaucaccacgcaggagagcgagaguaacaucuuggacaucgacuuacggccggccuccgcuuggacgcucuaugccguugcgaccacuuucgugacccccaugcugcgccacagcaucgagaacuccagcguaaacgucucccugacggccauagccaaccaagccacuguccucauggggcuggguaagggguggccacugucgaagauggacaucggcgugcccuuacuggcuaucgggugcuacagucaggucaacccgaugacccugaccgccgcgcuccuacugcucgucgcgcauuacgccaucaucggccccggccugcaggcgaaggcaacgcgggaagcccagaaacgcgccgccgcggggaucaugaagaaccccaccguggacggcaucaccgucauagacuuggagcccaucccguacgacccaaaguuugagaaacagcucggccaggugaugcugcugauccugugcgugacccagguccugaugaugcggacaacgugggcccugugcgaggcccucacccuggccaccgggcccauuagcacccugugggaagggaaccccgggcgcuucuggaacaccaccauagccguguccauggcgaauaucuuccgaggcagcuaccucgccggggcgggccugcuguucucaauaaugaagaacacaacgaacacccggcgcgggaccggcaacaucggcgagaccuuaggggagaaauggaagucccggcugaaugcccugggcaaguccgaguuccagaucuauaagaaguccgggauacaggagguggaccgcacgcucgcgaaagaaggcaucaagaggggagagaccgaccaccacgccgucucccggggcagcgcuaagcugcggugguucguggagcgaaacauggucaccccggagggcaaggucgucgaccuggggugcggccgcggcggguggucauacuacugcggagggcucaaaaauguacgagaggucaaggggcugaccaagggaggccccgggcacgaggagccuaucccgaugagcacguacggcuggaaccuggugcgguuacaguccgggguggauguauucuucaccccgccugagaaaugcgacaccuuacugugugacauuggcgagagcagccccaacccgaccaucgaggccgggcgcaccuuacggguacugaaccucguggagaacuggcucaacaacaacacgcaguucuguaucaagguccucaacccguacaugcccuccgugaucgagaagauggagacccugcagcgcaaguacgggggagcccuggugcgaaacccccuaagccgcaacuccacucaugagauguacugggucaguaaugccacugggaauaucguguccagcgugaacaugaucucccggaugcugaucaaccgcuucaccaugaagcacaagaaggccaccuacgagccggacgucgacuugggcagcgggacccggaauauaggcauagagucugagaucccuaaccucgacauuaucggcaagcgcaucgagaagaucaagcaggaacacgagacaaguuggcacuacgaccaagaccacccguacaaaaccugggccuaccacggguccuacgagaccaagcagaccggcagcgccuccucaauggucaacggggugguccgccugcugacaaagcccugggacgugguaccgauggucacgcagauggccaugacugacaccaccccguucggccaacagcggguguucaaggagaagguggacacgagaacccaagagccgaaggagggcaccaaaaaacucaugcggaucaccgcggaguggcuguggaaggagcuggggaagaagaagacgccccgcaugugcaccagagaagaguucacccgaaagguccgguccaacgccgcccucggcgccauauucaccgacgagaacaaguggaagagcgcucgggaggcgguggaggacgggcgguucugggagcuggucgaccgcgagcggaaccugcaccucgaaggcaaaugcgaaacgugcguguauaacaugauggguaaacgcgagaagaagcugggcgaguuuggcaaagccaaaggaucccgagccaucugguacauguggcugggcgcccgcuucuuggaguucgaggcgcugggguucuugaacgaggaccacugguucucgcggggcaacuccuuauccgggguggaaggcgagggccuucaucgucugggguacauacuccgggaugucggcaaaaaggagggaggcgccauguacgccgacgacacagccgggugggacacccgcaucacccuggaggaccugaaaaacgaggagauggugacgaaccacaugaaaggcgaacacaagaagcucgccgaggcgaucuucaagcugaccuaccaaaacaagguuguccgcgugcaacgccccacgccccggggcacggugauggacauuaucagccgcagagaccagcguggguccggccaggucggaacguacggccucaacacguucaccaauauggaggcccagcucauccggcagauggaaggcgagggcaucuucaagagcauccagcaccugacugcaacggaggagaucgccgcccagaacuggcuggcgcgggugggcagagaacggcucagucgcauggccaucagcggggacgacugcguggucaagcccauugacgaccgguucgcguccgcccuaaccgcacugaacgacaugggcaaggugcgcaaggauauccagcagugggagcccucucggggguggaacgacuggacccaggugccguucuguucccaccacuuccacgaguuagucaugaaggacggccgcgugcuagucguccccugccggaaccaggacgagcugaucggcagagcucggaucucacagggggccgguuggucccucaaggagaccgccugcuuaggcaagagcuaugcccagauguggacgcugauguacuuucaccgccgggaccuucgccuagcggcgaacgcaaucugcucggccgugcccagccacuggguucccacgucccggaccacguggucgauccacgccaagcacgaguggaugaccacagaggacaugcuggccgucuggaaccguguguggauccaggagaacccguggauggaggacaagacucccgucgagucaugggaagagguccccuacuuagguaaacgggaagaccaguggugcggaagccugauaggccugacgucccgcgccaccugggcuaagaacauccagacggccauaaaucaggugcgcagcuuaaucggcaacgaggaguauaccgauuacaugcccagcaugaagcgguuccgccgggaggaggaggaggccggcgugcugugguga

SEQ ID NO: 24919 - RNA, 9867 nt, Artificial Sequence
  derived and/or modified CDS sequence (opt11) from DENV-2__FJ182012__SS-prME
accgcuggcgugaucgucaugcugaucccaaccgccauggcguuccacuuaaccacgcgcaauggggaaccucauaugaucgugggccggcaggagaaggggaagucccugcuguucaagaccgaggauggcgugaacaugugcacgcucauggccaucgaccucggcgaauuaugcgaggacacgaucaccuacaagugcccacuucuucgccaaaacgagcccgaggacauugacugcuggugcaacagcaccuccacgugggucaccuacgggaccugcaccaccaccggcgagcaucgucgugagaagcgguccguggcuuuggugccccacgucgggauggguuuggagacccgcacugagacguggaugagcagugagggggcguggaagcacguucaacggaucgagacguggaucuuacgccacccaggcuucacuaucauggccgcuaucuuagccuacaccaucgguaccacgcacuuccagcgggcccucauauucauccugcugaccgccgucgcgcccagcaugaccaugcguuguaucggcaucuccaaccgggauuucgucgagggcgugucggggggcuccuggguggauaucguccucgaacacggaagcugcgugaccacuauggccaagaacaagcccacccuggacuucgagcugaucaaaaccgaggccaaacagcccgccacgcuccgcaaguacugcauagaggccaagcuuacgaauaccaccacagaguccagguguccgacgcagggugagcccucccucaacgaggagcaagacaagagauucauaugcaagcacucuaugguugaccggggcugggggaacggcugcgggcuguucggcaagggcgggaucgugaccugcgcgauguucacgugcaaaaagaacauggagggcaaggugguccagcccgagaaccuggaauacaccaucgucauuacaccgcauagcggggaggagcacgccgugggcaacgacaaugggaaagagaucaaaaucacgccucaauccagcaucacggaggccgagcugacgggcuacggcacggugacgauggaaugcagcccccggaccggccuugauuucaaugaaaugguccugcugcagauggaagauaaagccugguugguccacagacagugguuccuggaccugccucuacccuggcugccgggggcugauacccaaggaagcaacuggauccagaaggagacucuggugacguucaagaacccacacgcgaaaaagcaggacgucgugguccucgguucucaggagggggcgaugcacaccgcccugacaggcgccaccgaaauccagaugagcagcgggaaucuacuauuuacgggccaccugaagugcagacugcggauggacaagcuccaacuuaagggcauguccuauagcaugugcaccgguaaauucaagaucguuaaggagaucgccgagacacagcacgguaccauagugauucgaguccaguacgagggggacggcucccccugcaaaaucccauuugagaucacggaccuggagaaaaggcacguguuaggccgccugauuacuguuaacccgaucgucaucgagaaggacagcccugugaacaucgaggcggagccgccauucggugacucuuacauuaucauuggcguggagccugggcagcugaaacuuaacugguucaaaaagggcucuuccaucgggcagauguucgagaccacgaugcgcggcgccaagcggauggccaucuuaggcgacacggcgugggauuucgguucgcugggcggggucuucaccuccaucggaaaagcccuccaccagguguucggggcgaucuacggcgccgccuucagcggcguguccuggacuaugaaaauccugaucggggucgucaucaccuggauuggcaugaacucccgcuccacgagccuuuccgugagccugguccuaguggggguggucacccuguaccugggcgcgaugguacaagcagacuccgggugcguggucaguuggaagaauaaggagcucaagugugggucugguaucuucaucacagacaacgugcauacauggacggagcaguacaaguuccagcccgagucgcccagcaagcuugccucggcaauccagaaggcacacgaggagggcaucugcggcauaagaagcgugacgcgccuggaaaaccucauguggaaacagaucaccccagaacugaaucacauccuguccgagaacgaggugaagcuaaccauuaugaccggagacaccaaggguaucaugcaggccgggaagcgguaccugcgcccacagcccaccgagcuaaaguacagcuggaagaccuggggcaaggcgaagauguuauccacggagucacacaaccagaccuuucuuaucgacgguccggaaaccgcugagugcccaaacacgaaccgggccuggaauucgcuggagguggaggacuacggguucgggguguucacgacuaacauuuggcucaaguugcgcgagaagcaggacgucuucugcgacagcaaacugauguccgcggccaucaaggacaaccgggcggugcacgccgacaugggguacuggaucgaaagcgcccucaacgacaccuggaagauggagaaggcauccuucaucgagguaaagagcugccacuggcccaagucccacacccuguggagcaacgguguccuggaguccgaaaugaucauccccaagaacuucgccggacccgugagccagcauaacuaccggccgggguaccacacccaaacggcgggccccuggcaccucgggaagcuggagauggacuucgacuucugcgaggguaccacggugguagugaccgaggacugcgggaaccggggcccuucuuuacgaaccaccacugcaagcggcaagcucauuaccgaguggugcugccggucgugcacacugcccccgcugcgcuaccgcggggaggacggcugcugguacgggauggagauccgcccccucaaggaaaaggaagagaaccuggugaacucccuagucacggccggccacgggcagaucgacaacuucagccucggagugcuggggauggcacuguuccuagaagagaugcugcggacucgcguggggaccaagcacgcgauccugcucguugccguauccuucgugacccugaucacaggcaacaugagcuuccgggaucuggggcgcgucaugguaaugguuggcgccaccaugacagacgacauugggaugggaguaacguaccucgcacugcuggcggcguucaaagucagacccaccuuugcggccggccuccugcugcggaagcucaccucuaaggagcugaugauggccaccaucgggauaacgcugcucagccaguccaccauccccgagaccauccuggagcugaccgacgcucucgcguugggcaugauggugcugaagaucguacggaacauggagaaguaccagcucgcggugacgaucauggcaaucaguugcguaccuaacgccgucauccugcguaacgccuggaaagugucuugcaccauacuggcggccgucucggugagcccccuccuacugaccagcucgcaacagaaggcggauuggauccccuuagcucugaccaucaagggguugaaccccacggcuaucuuccucaccacccugagcaggacauccaagaagaggagcuggccguuaaacgaggccaucauggccgugggaauggucuccauccuagccagcucgcugcugaagaacgacauccccaugacuggcccccuuguggccgggggacugcuaaccguuugcuacguccucaccgggcggucagcggaccuggagcuugagcgggcggcggacgugaagugggaggaccaggcggagaucuccggauccagccccauucuauccauuaccaucagcgaggauggaagcauguccaucaagaacgaagaggaggagcagauucugacgauccugauccgcacgggccuccuugugauaagcggcgucuucccgguaagcauacccaucaccgccgcggccugguaccuuugggaggugaaaaagcagcgagccgggguauugugggacgugcccaguccgccgcccgugggcaaggccgagcuggaggacggggccuaccgcauaaagcagcggggcauucucggguauagccagaucggcgccggggucuauaaggagggcaccuuccacaccauguggcacgucacucgcggagccguguugaugcaccggggcaagcgaaucgagcccuccugggccgacgucaaaaaggaccugaucagcuaugggggagguuggaaacuggagggcgaguggaaggaaggggaggagguccagguucucgcccuggaaccggguaagaacccgcgggcagugcagaccaagccugggaucuucaagaccaacaccggaaccaucggagcgguaucccuggacuucagccccggcaccagcggcagccccaucguugaccgcaaagggaaggucgugggguuauacgggaacggcguggucacucggucgggagccuaugucagcgcuaucgcccagaccgagaagucaaucgaggacaaccccgagaucgaggacgacauauuccgcaagaagcggcugacuaucauggaucugcaccccggggcuggcaagaccaaacgcuaucuucccgcgaucgugcgggaagccaucaagcgcgggcugcgcacucugauccuugccccgacccggguuguggccgcugagauggaggaggcccuccgcggccugccaauccgguaucaaacgccugcuauuaaggcggagcacaccgggcgcgaaaucguggaccugaugugucacgcgacuuucacuaugcggcuacugucaccuguccgcgugccgaacuacaaccugaucaucauggaugaagcgcacuucacugaccccgcuagcaucgccgccagaggauauaucuccacucgcguggagaugggagaagccgcggggaucuucaugaccgccacgccacccggcucacgggacccguucccucagucgaaugcgccaaucauggacgaggagcgcgagauccccgagcgguccuggaacuccgggcaugaguggguaacggacuucaaaggcaaaaccgucugguucgugcccagcaucaaggccgggaacgacaucgccgcaugccuccguaagaacggcaagaaggucauccaacugucgcggaagaccuucgacucagaguacgugaagacccgcgcuaacgauugggacuuuguggucacgaccgacaucuccgagaugggcgcgaacuucaaagcagagcgggugaucgacccccgccgguguaugaagcccgugauacugacccacggggaagaaagggucauccuagcggggcccaugccggugacccacucguccgcugcccagagacgcggccgcaucggccggaaucccaagaacgagaaugaccaguacaucuacaugggagagccccuggagaacgacgaggacugcgcacacuggaaggaggccaagaugcugcuggacaauaucaacacgcccgagggcaucauuccgagcauguucgagcccgaacgcgagaaaguggacgcgguugacggcgaguaccggcugcgcggggaggcccggaaaaccuucguggaucugaugaggcggggcgaccuccccgucuggcuggccuauaaggucgcugcagaggggaucaacuacgcggaccgcaagugguguuucgacggcaucaaaaacaaccagauccuggaagagaacgucgaggucgagauuuggacaaaggagggugagcggaagaagcucaagccacgcuggcuggacgcaaggauuuauuccgacccccuggcucucaaagaguucaaggaguuugccgcgggcaggaaguccuugacccugaacuugauaacggagaugggccggcugcccaccuucaugacucagaaggcccgcaacgcgcucgacaaccuggcggugcugcacacagccgaagccggugggcgggccuacaaccaugcccuguccgaacucccugagacguuggagacucuucuccugcugacccuucuggccaccgugacugguggcaucuuucucuuccucaugagcggaaaggggaucggcaagaugacuuuagggaugugcugcaucaucaccgccuccguucuccucugguacgcccagauccaaccgcacuggaucgccgcgagcaucauccuggaauuuuucuuaaucguucuccugaucccagagccggagaaacagcgcacgccccaggacaaccagcugaccuauguugucauagccauccucacggucguggccgccaccauggccaacgaaaugggcuuccuugaaaagacaaaaaaggaccuaggacucggcuccauuaccacgcaggagucugagagcaacauacuggacaucgaucugcggccagcguccgcuuggacucucuacgccguugcgacaaccuucgugacgccuaugcugcgacacagcaucgagaauaguagcgugaacgucucucugacugccaucgccaaccaggccacugugcucaugggccuuggaaaaggguggccgcuuuccaaaauggacaucggggugccccuccucgcgaucggaugcuacucccaggugaacccgauaacccucacagcagcgcuccugagccugguggcacacuacgccaucaucggucccggucuccaggcaaaagcaacccgugaggcccagaagcgcgccgccgcgggcaucaugaagaacccgaccguggacggaaucaccgucaucgauuuagaacccauaccguacgacccuaaguucgagaagcagcugggacaagugaugcuauuaauccugugcgugacgcaggugcucaugaugcggaccaccugggcccugugcgaggcauuaacccucgccacugggcccauauccacccuuugggagggcaacccgggccgcuucuggaauaccaccauugcggugaguauggcuaacaucuuccgcggcucuuaccuagccggcgcggggcugcucuucagcaucaugaagaacacgacuaauacccgacgcggcacggggaacauuggcgagacgcuuggcgagaaguggaagucccgccucaacgcccuggggaaguccgaguuucagauauacaagaaguccggcauccaagagguggaccgcacccuggcgaaggaggggaucaagcggggugagaccgaccaccacgcggucagcagggggagugccaagcuccggugguucguggagaggaacauggugacaccagaggggaaggucgucgaccugggauguggccggggaggcugguccuacuacuguggaggccugaagaacgugagggagguaaaggggcucacgaagggagggccgggccacgaggagccgauccccaugucuaccuacggguggaaccuggugagacugcagagcggagucgacgucuucuuuaccccacccgagaagugcgacacccuccuaugcgacauuggugagagcucccccaacccaacgaucgaggcgggccguacccuacgggugcucaaucugguugaaaacuggcuaaauaauaacacucaguuuugcauuaagguucucaauccguacaugcccagcgugauagaaaagauggagacccugcagcgaaaguacggcggggcccuuguacgaaacccccugucccgcaauagcacccaugaaauguacugggucuccaacgcgacgggcaacauuguaagcuccgugaacaugaucagccggaugcugauaaaccgcuucacgaugaagcacaagaaggccaccuaugagccggacgucgaucugggguccggcacucggaacaucgggaucgagagcgagauccccaaccuggacauuauaggcaagcgcaucgagaaaauuaaacaggaacacgagacguccuggcacuaugaccaggaccaccccuacaagaccugggccuaccacggcagcuacgagacaaagcagaccggguccgccucuuccauggugaacggcgugguccgacuccugacgaagcccugggacguuguaccgauggucacacagauggccaugaccgacaccacacccuucgggcagcagcguguguucaaagagaagguggacacccggacccaggagccuaaggagggcacaaagaaacuuaugcggaucacggcggaguggcucuggaaggaacugggcaagaagaagacgcccaggaugugcacccgggaggaguuuacccgcaagguccggucuaacgccgcccugggggccaucuucacggacgagaacaaguggaaguccgcgcgcgaggcgguggaggacggccgguucugggagcucgucgaccgcgagcguaaucugcaccuggagggcaagugcgagaccugcguguacaauaugaugggaaagcgcgagaaaaagcucggcgaauuugguaaggccaagggaagccgggccaucugguacauguggcucggagcccguuucuuagaguucgaggcgcuaggcuuccugaacgaggaccacugguucucgcgggggaauagccugucaggcguggaaggagagggccuccaucgccuggguuacauccugcgggacgucgggaagaaggagggcggugccauguacgccgaugacacggccggcugggacacccgcaucacgcucgaggaccugaagaacgaggagauggugacuaaccauaugaagggggaacacaagaagcuggccgaggccauauuuaaacucacuuaccagaacaagguuguccgggugcagcguccaacgccccggggcacggugauggacaucaucucccgccgcgaccaacguggcagugggcaagucggcaccuacgggcugaacacguucaccaacauggaggcccagcugauccgccagauggagggcgagggcauauuuaaaucuauccagcacuugacggccaccgaggagaucgcugcccagaacuggcuggcgagaguggggcgcgagcggcugagccgcauggccauuucuggcgacgacugugugguaaagcccaucgacgaccgguucgccagcgccuugaccgcccuuaacgacaugggaaaaguccggaaggauauccaacagugggagcccucccggggcuggaacgauuggacccagguaccguucugcucucaccacuuccacgaacuggucaugaaggacggccgcguccuagugguccccugccggaaccaagacgagcugauaggcagggcccggaucucccaaggcgccggguggucgcucaaggagacggccugccucggcaaguccuacgcccaaauguggacccugauguauuuccaccgccgagaccugcgcuuggccgcgaaugcaaucugcagcgcggucccgucgcacugggugcccacgucucggaccaccuggaguauacacgccaaacaugaauggaugacuaccgaggacaugcuggccgucuggaaccgcgucuggauccaggaaaacccguggauggaggauaaaacacccguggagagcugggaggagguccccuaccuagggaagcgggaggaucaaugguguggcagucucaucgggcuaaccagccgcgcuacgugggccaagaacauccagaccgccaucaaccaggugcgcucacugaucgguaacgaggaauacaccgacuacaugcccuccaugaagcgguucagacgagaggaggaagaggccggcgugcucugguaa

SEQ ID NO: 24920 - RNA, 9876 nt, Artificial Sequence
  derived and/or modified CDS sequence (opt11) from DENV-2__EU854293__SS-prME
accgcgggcaugaucaucaugcugauacccaccgugauggcuuuucaccucaccacgcggaacggggaaccucacaugaucguaagccgccaggaaaagggcaagagcuugcuguucaaaaccggugacggcgugaacaugugcacccuaauggcuauggaucugggugaauugugcgaggauacgauaaccuacaagugcccgcuccugaggcaaaacgagcccgaggacaucgauugcuggugcaacucuaccagcaccugggucaccuacggaaccugcaccaccacgggcgagcaccggagagagaagcggagcgucgcacuggugccccaugucgggaugggguuggagacccgcaccgagaccuggaugucuagcgagggggcauggaagcacgcccagcggaucgagacguggauacugcgccaccccggguuuaccaucauggcagcgauccuggccuacaccaucgguaccacucauuuccagcgagcccucaucuuuauccugcugaccgcgguugcgcccuccaugaccaugcgcugcauugguaucagcaacagagacuuuguggaaggcguguccgggggcuccuggguagacauaguccucgagcacggcucuugugugacuacgauggccaagaacaagcccacccuggacuuugagcuuauaaagaccgaggccaagcagagcgcuacucuccgaaaguacugcaucgaggcgaaacuuacgaacaccaccaccgagucucguugccccacgcagggcgagccaagccugaacgaggagcaggauaagcgguucgucuguaaacacuccaugguugaccgggguugggggaauggcugugggcuguuuggcaagggcgguaucgugaccugugcgauguucacgugcaagaagaacaugaagggcaagguugugcagccagagaauuuagaauauaccauaguaauuaccccacacaguggggaggagcacgccgucgguaacgacaccgggaagcacgguaaggagauuaagaucacaccccaguccucuauaaccgaagcagagcugaccggguacggcacgguuaccauggagugcuccccgcgcaccggccucgauuucaacgagauggugcugcuacagauggagaacaaagccuggcucguucacagacagugguuccuggaccuacccuuacccugguuaccaggggcugauacccagggcagcaacuggauccagaaggaaacgcuggugaccuuuaagaacccucacgccaagaagcaggacguggucguucucgggucacaggagggcgccaugcacaccgcccugaccggugcaacggagauucaaauguccagcggcaaccuacuguucaccggccaccugaaaugccgccugcggauggauaagcuccagcuaaaggggauguccuacaguaugugcaccggcaaguucaaagucgugaaggagaucgccgaaacccagcacgggacgaucgugauccgggugcaguacgagggcgacggcucccccugcaagaucccauucgagaucauggaccuagagaagcgacacgugcucgggcgccugauuaccguaaaccccaucgucaccgagaaggacagcccggugaacaucgaggcggagccgcccuucggcgacuccuacaucauuaucgggguggagccuggccaacugaagcucaacugguucaagaaaggaucuuccauaggccagauguuugagaccacgaugcgcggcgccaagcggauggcuauccugggggacaccgccugggauuucggaucccuuggcggggucuucaccuccaucgggaaggcccuccaccagguguucggggcuauuuacggcgcugccuucagcgggguguccuggacgaugaaaauccugauuggcgucaucaucacguggaucggaaugaacagccgcuccaccagccuaagcgugagcuuagugcucgucggugugguuacccuguaucucggagucaugguccaggccgauucuggcugcguggucagcuggaagaacaaggaguuaaaguguggcagcggcaucuucaucaccgacaauguucauacguggacagagcaguacaaguuccagccggagucacccagcaagcucgccuccgccauucagaaggcccacgaagagggcaucugcgggauccggagcgugacccgccuggagaaccucauguggaagcaaaucacucccgagcugaaccacaucuuguccgagaacgaagucaagcucacgauuaugaccggugacaucaagggcaucaugcaggccggcaagcggagucugcgcccccagccgaccgagcugaaguacaguuggaagacuugggguaaggccaagaugcucucgaccgagucccauaaccaaaccuuucuaaucgauggacccgagacagcggagugccccaacaccaaccgggcauggaacagccuggagguggaggacuacgguuucgguguauucacgaccaacaucuggcugaagcugcgcgagaagcaggaugucuucugcgacagcaagcugauguccgccgcuaucaaggacaaccgagccgugcaugcggacauggguuacuggauugaguccgcccuuaacgacaccuggaagaucgagaaagccuccuucauagaggugaaguccugccacuggcccaagagccacacccugugguccaacgagguacuggagagcgaaaugauaauucccaagaacuuugccggccccguuagccaacacaacuaccgccccggguaucacacccaaacggccgguccuuggcacuuagggaaguuggaaauggauuucgauuucugcgagggcaccaccguggucgugaccgaggacugcgggaaccgcggccccucauugcgcacaaccaccgcaagcggcaagcucaucacugaguggugcugucgguccugcacgcucccgccucugcgauaccguggggaggauggcugcugguacgggauggaaauacgaccacucaaggaaaaggaggagaaccugguaaacagccuggugaccgccggacacgggcagaucgacaacuuuucccucggcguucugggcauggcccuguuccucgaggagaugcuccggacuaggguuggaaccaaacacgccauccugcucguggcugugaguuucgucacuuugauaaccgguaauauguccuuucgggaccucggucgcgucauggugaugguaggggccacuaugaccgacgauaucgggaugggaguaacguaccucgcccugcucgccgccuucaaggugagacccaccuucgcugccggccuccuccuaagaaaguugaccagcaaggagcugaugaugaccacgaucgggauagugcugcucagucagucaaccauccccgagacaauccuggagcuuaccgacgccuuagcgcuggggaugaugguccugaaaauggugcggaagauggagaaguaccaguuggcggugacgaucauggcgauccuuuguguccccaacgccguuauccugcagaacgccuggaaggucucuuguaccauucucgccguuguaagcgucuccccgcuguuccucaccagcucccagcagaaggccgacuggaucccccucgcgcuaaccauuaagggacugaacccgacggccauuuuccucacaaccuugagccggaccaauaagaaacgcuccuggccccuuaacgaggccaucauggccguaggcauggugagcauccucgcguccucccugcugaagaacgacaucccgaugacgggaccccucguagccggcgggcuucugaccgugugcuacgugcucaccgggcggagcgccgaucuggaacuggaacgcgccgccgacgucaagugggaggaccaggcggagaucuccgggagcuccccgauccucagcaucacaauuuccgaggauggaucgauguccauaaagaacgaggaggaggagcagauccugacgauccugaucagaaccggccuccuggugaucagcggcuuauuccccguguccaugcccaucacugccgccgccugguaccucugggaggucaaaaagcagcgggccgggguacugugggacgugcccuccccuccacccguagggaaggccgaauuagaggacggugccuaccggaucaaacagaagggcauccugggcuacucccagaucggcgccggcgucuacaaggaggggaccuuccacaccauguggcacgugacgcgaggugcgguacugaugcauaaggggaagcggaucgagcccagcugggcagacgugaagaaagaccugaucuccuacggagggggcuggaagcucgagggggaguggaaggagggggaggaggugcagguccucgcgcuagaacccgguaagaacccacgcgccguucagacgaagcccggccuguucaagaccaacgccggcacgaucggugcggugucccuggacuucucacccggaacgagcggcucacccaucauugacaagaaggggaaggucguaggccucuacgggaacggcguugucacccggagcggggccuacguguccgcgaucgcucagaccgaaaaguccaucgaagauaacccggaaauagaggacgacaucuuccgcaagcggaagcucaccaucauggaucugcaccccggggccggcaagacgaagcgcuaccuccccgccaucgugcgggaggcuaucaagcgcgggcugaggaccuuaauacucgcccccacgcgcgucgucgccgccgaaauggaggaggcccugcgaggccuaccgauccgcuaucagacgccagcgauccgcgccgagcacacggggcgggagauuguggaccugaugugccacgcaacauucaccaugcgccugcucucccccguccgugugccaaacuacaaccugaucauuauggacgaggcucauuuuaccgacccugccuccauagcugcccgcggcuauaucagcacgcggguugagaugggggaggcugccggaaucuuuaugaccgccacgccuccaggcucccgcgacccuuucccgcagagcaacgcgccgaucauggacgaggaacgggagauccccgagcgcuccuggagcagcgggcacgaaugggucaccgacuucaagggcaaaacggugugguucgugcccagcaucaaggcuggcaacgacaucgcggccugucugcggaagaacggaaagaagguuauccagcucucccgcaagacguucgacagcgaauacgugaagacccggacaaaugacugggacuuuguggucacaaccgacaucagcgagaugggcgcgaacuucaaggcugagcgcgugauagacccgagacgcuguaugaagcccgugauccugaccgauggggaggagcgggugauucuggccggccccaugccugugacccacagcagcgcugcgcagcgacggggacgcauuggccggaaccccaagaacgagaacgaccaguacauuuacaugggcgaaccccucgagaacgacgaggacugcgcgcacuggaaggaggcuaagauguugcuggacaacaucaacacgcccgaaggcaucauacccagcauguucgaaccugagcgcgagaagguggacgcaaucgacggcgaguaccgccucagaggggaggcccgcaaaaccuucgucgaucucaugcggcgcggggauuugcccguuuggcucgccuaccggguggcggccgagggcaucaacuacgccgaccgccgguggugcuucgacgggauaaagaacaaccagauacuagaggagaaugucgaagucgagaucuggacaaaggagggggagaggaagaagcugaagccucgguggcucgacgcgagaaucuacuccgacccguuagccuuaaaagaguucaaggaguucgcagcuggccgcaagagccucacccugaacuugaucacggagaugggcaggcuccccaccuucaugacccaaaaggcccgggacgcauuagauaaccuggcgguccuucacacagccgaggcugggggccgcgccuacaaccacgcccuguccgagcugccagaaacgcucgagacccugcugcucuugacccugcucgcgaccgucaccggggguaucuuccuguuccugaugagcggccgggggaucggaaagaugacccucggcaugugcugcaucaucaccgccuccauccugcugugguacgcccagauucagccccacuggaucgcggcaagcaucauucucgaguucuuccugaucgugcugcucaucccggagcccgagaaacagagaacaccucaggacaaucagcugaccuacgucgugaucgcgauacugacgguggucgccgccaccauggcuaacgaaaugggcuuccucgagaagaccaagaaggaucuggggcugggcagcauaaccacgcagcagccagagaguaacauacucgacaucgaccugaggccggccagcgcguggacgcuauacgccguggcgaccaccuuugugacgcccaugcuacgccauagcaucgagaacagcuccgucaacgugucgcuaacagcuaucgccaaucaggccaccgugcugaugggccuggggaagggcuggccccuguccaagauggauaucggggucccuuugcuggccaucggcuguuacagccaggugaacccgaucacccugacggcggcccuguuccuccugguggcgcacuaugccaucaucgggccaggccuucaggcaaaagccacccgagaggcccagaagcgcgcggccgccgggaucaugaagaaccccaccguggacgggauaaccgucaucgaccucgaccccauaccguacgaccccaaguuugaaaaacagcugggccagguuaugcugcucgucuugugcgucacacaggugcucaugaugcgaaccacaugggcccugugcgaggcuuugacccuggcgacggggcccaucagcacccucugggagggcaaccccgggcgcuucuggaacacaacgauagccgucagcauggcuaacaucuucagagguucguaucuggccggggccggguuacuguucucaaucaugaagaacaccaccaacaccaggcgcggcacagggaacaucggcgaaacgcugggcgaaaaauggaagucucguuuaaacgcacucggcaagagcgaguuccagauauauaagaaauccggcauccaggagguggaccgcacccuggccaaggaggggaucaagcgcggcgagaccgaccaccaugccguuagccgcgggagugccaagcuacggugguucgucgagcgcaacauggugacgccggagggcaagguggucgaccucggcugcggccggggcggguggucguacuacuguggugggcuuaaaaacgugcgcgaagugaaaggccuuacgaagggcgggcccggacaugaggagcccauacccauguccaccuacggguggaaucuaguccggcugcagagcggcguagaugucuucuucaccccgcccgagaagugcgacacccugcuaugugacauaggggagagcucccccaaucccacggucgaggcgggccgcacgcugcgggugcugaaccuaguggagaacuggcugaacaacaacacacaguucugcauaaagguccugaacccguacaugcccagcgugauagagaagauggaggcccuccagagaaaauacgggggcgccuuggugcggaacccuuugucccgcaacagcacccacgagauguauugggucucaaacgccagcggaaacaucguguccagcgugaacaugaucucccgaauguuaaucaaccgcuucaccaugcggcacaaaaaggcgacguacgagccggacguugaccuugguagcggcacccggaacaucgggauagagucggagauccccaaccuagacauaauaggcaagcgcaucgagaagaucaaacaggagcaugagaccagcuggcauuacgaccaggaccaucccuacaagaccugggcuuaccauggcuccuacgaaacuaagcagaccggcagcgcguccagcauggugaauggcgugguacggcugcucacaaaacccugggacguagugccgauggucacccagauggcaaugacggauaccacgccauuugggcagcaacgcguguucaaggaaaagguugacaccagaacgcaggaacccaaggagggcaccaagaagcucaugaagaucaccgccgaauggcuguggaaggagcucggcaagaagaagacaccccggaugugcacgcgggaagaguucacccguaaggucagaucuaacgcugcccugggggccaucuucaccgacgagaacaaguggaagagugcccgcgaggccguggaggauucccgguuuugggagcuggucgauaaggagcgcaaccuccaccuggagggcaagugcgaaacaugcguguauaacaugauggggaagcgggagaagaagcugggggaguucgggaaggcuaagggcagccgcgcuaucugguacauguggcucggcgccagauuccuggaguuugaggcccugggguuccucaaugaggaucauugguucagucgugaaaacucgcugucgggcguugaaggcgagggacugcacaagcucggguacauacugcgggacgucuccaagaaggaaggcggcgccauguacgcggacgacacggcgggaugggauacgcguaucacccuggaggaccucaaaaacgaggagauggugacaaaucauauggagggggagcauaagaaacuugccgaagccaucuucaagcugacguaccagaacaaaguaguucggguacagcgaccgacgccgcgggggacggugauggacaucaucagccgccgggaucaacgcggcuccgggcaggucggcaccuauggcuugaauaccuucaccaauauggaggcgcaguuaauccgucagauggagggggagggcguguucaaaucgauacaacaccugaccgugaccgaagagaucgcgguccaaaacuggcuagcccgggugggccgggagaggcuguccagaauggcgaucagcggcgacgacugcguggucaagccacuggacgaccgguucgccuccgcgcucacggcgcuaaacgauaugggcaaggugcgcaaggacauccagcagugggagccgucacggggguggaacgacuggacacaggugccguucugcucccaccacuuccaugagcuuaucaugaaggacggccgcguccuuguggugccuugccggaaucaggacgagcucaucggccgcgcccgcauuagccagggcgcgggauggagucugagagagaccgccugccugggcaagucuuacgcccagauguggucccucauguacuuccaccgccgcgaccugcggcucgcggccaacgccaucugcagcgccgugcccucccauugggugcccaccagcagaacgaccuggagcauucacgccaagcaugaguggaugaccaccgaagacaugcuaaccguauggaaccgggucuggauucaggagaauccguggauggaagacaaaacgccgguagaauccugggaggagauccccuaccuggguaagcgcgaggaccaguggugcgggucucucaucggccucaccucccgggcgaccugggccaagaacauccagaccgccaucaaccaggugcgaucucucaucgggaacgaggaguacacggacuacaugcccucuaugaagcgcuuccggcgcgaggaggaggaggcaggcgucuugugguaa

SEQ ID NO: 24921 - RNA, 9876 nt, Artificial Sequence
  derived and/or modified CDS sequence (opt11) from DENV-2__EU854294__SS-prME
accgccggcgugaucgucaugcuaauaccuaccgccauggcguuccaccuaaccacccgcaacggggagccccauaugaucguaggccggcaggagaaagggaagucccugcuguuuaagacggaggacggcgugaacaugugcacccucauggccaucgaccuuggggagcucugcgaggauaccauuaccuacaagugcccccugcugcgacagaacgagcccgaggacaucgacugcugguguaacagcaccucaaccugggucaccuacgggaccugcacuacgacgggugagcaccgccgugagaagagaagcguagcccuggugccccacguagggaugggccucgagacccgcaccgagaccuggaugagcucugaaggggccuggaagcacgugcagcggaucgagaccuggauccuccgccauccgggcuuuaccaucauggccgcgauccuggccuacaccaucggaaccacgcacuuccagcgcgcccucaucuuuauuuuguugacggcgguggcccccagcaugaccaugcgaugcauaggcaucuccaaucgggacuucgucgagggugugagcgggggcuccuggguggacaucguacuagagcacgggagcugcgugaccacgauggcaaagaauaagcccacucuggacuucgagcugaucaagacugaggccaagcagcccgccacacuccggaaauacugcaucgaggcaaagcugacgaacaccaccaccgaaucccgguguccgacucagggcgagcccucccugaacgaggagcaggacaagcgguucauuugcaaacacuccaugguggaccggggcugggggaacgggugcgggcuguucggcaagggagggaucguaaccugcgcgauguucacgugcaagaagaacauggaaggcaaaguggugcagcccgagaaccuggaauacaccaucgucaucacgccccacagcggagaggagcacgcagucgggaacgauaccgggaagcacggcaaagagauaaagaucacgccgcagucguccaucaccgaggccgagcugaccggguauggcacgguaaccauggagugcagcccccgaaccggccucgacuucaacgagauggucuugcugcagauggaggacaaggcuuggcucgugcaccggcaaugguuccuggaucugccgcuacccuggcugccgggggccgacacccagggcagcaacuggauccagaaggagacgcucgugaccuucaaaaauccucacgcgaagaagcaggacgucgugguccuggggucccaggagggugccaugcauaccgcccugacuggugccacggagauccagaugagcagcggcaaccuccuguucaccggccaccugaaaugccgccugcggauggacaagcuccagcugaaggguauguccuacaguaugugcaccggcaaguucaaaaucgugaaggaaaucgcagagacccagcacgggacgaucguuauccgcguccaguaugagggcgacggcucccccugcaagauccccuucgaaaucacugaccuugagaaacggcacgugcucgggcggcugauuaccgugaacccgaucgucaucgagaaggacagccccgugaacaucgaagcagaaccgcccuucggcgauuccuacaucaucaucggggucgaaccgggccagcugaagcuuaauugguuuaagaaggggagcagcauuggucagauguucgagaccacgaugcggggcgcuaagcggauggccauccugggagacaccgccugggacuuugguucauuggguggggucuucaccucgaucgggaaggcgcuccaccaaguguucggggcgaucuacggugccgccuucagcgggguguccuggaccaugaagauccuuaucggcguugugaucacguggauugguaugaacagccguuccacaagccuguccgugagccugguccuugugggaguagucacccuguaccugggcgccauggugcaggcggacaguggguguguggucaguuggaagaacaaggagcuuaagugcggcucugggaucuucaucacagacaacgugcauacguggaccgagcaguacaaguuucagcccgagagccccagcaagcuggccagcgccauccagaaggcccacgaggagggcaucugcgggauccggagcgugacacgccuggagaaccuuauguggaagcagaucacuccugaguuaaaccacauccuuuccgagaacgaggucaaguuaacaaucaugaccggcgacaccaaagggauuaugcaggcaggcaagcgguaccugcgcccgcaacccaccgagcugaaguacagcuggaagacauggggcaaggcgaagaugcucuccaccgagagccacaaccagacguuccugauugacgggcccgagaccgccgaaugcccgaacacgaaucgggccuggaacagccuggagguggaggacuacggcuucgggguguucacuaccaacaucugguuaaagcugcgcgagaaacaagacgucuucugugacagcaaacugauguccgccgccaucaaggacaacagggcggugcaugccgauaugggcuacuggauagaguccgcccucaacgacacguggaaaauggagaaggccuccuucauagaaguaaagucuugccacuggcccaagucccacacccuguggagcaacggcguucuggaauccgagaugaucauccccaagaauuuugccgggccugugucgcagcauaacuaccggccgggguaucacacacagaccgcgggcccauggcaucucggcaagcuggagauggacuuugacuuuugugaggggacaaccguggucgugacggaggacugcggcaaccggggacccucccugcgcaccaccaccgccagcgggaagcucaucacugaguggugcugucggagcugcacccugcccccgcugcgcuaccggggcgaagacgguuguugguacgggauggagauccgcccacucaaggagaaagaagagaauuuagugaacagucugguuaccgccgggcacggccaaauagauaacuuuaguuuaggaguccuugggauggcacuguuccuggaggagaugcugcgcacgcgcgucggcacgaaacacgcuauccuguuaguagccguguccuucgugacccugauaaccgggaacaugagcuuccgggaccugggccgggucauggucauggugggugccaccaugacggacgauaucggcaugggcguaaccuaucucgccuuacuggccgcguucaaggugcgccccaccuucgccgccggccuccugcugagaaaguuaaccuccaaggagcugaugauggccacuaucggaaucacccugcucagccaguccaccauucccgagacaauccuggaacugacugacgcccucgcgcuggggaugauggugcugaagaucguucgcaauauggagaaguaccagcucgccguuacaauaauggccaucagcugcgugccaaacgcugucauccuuagaaacgccuggaagguguccugcacaauccuggcggcaguaagcgugagcccccuccugcuuaccagcucccagcaaaaggcggacuggauccccuuagcccucacgaucaagggacugaaccccaccgcgaucuuccucaccacccugagccgcacgucaaagaagcggucguggccgcugaacgaggcaaucauggccguaggcauggucuccauccucgccagcagucugcugaagaacgacauccccaugaccggcccccucguggccgguggacugcugaccguguguuacguauugaccggccgauccgcggacuuagagcuggagcgggccgccgacgucaagugggaggaccaggccgagaucagcggguccagcccuauucucuccauaacgaucuccgaggacggcuccaugagcaucaaaaacgaggaggaggagcagacucugacuauccugauucgaacgggccuccuggugaucuccggggucuucccgguuagcauacccaucaccgccgcggccugguaccugugggaggugaagaagcagcgggccggcguccucugggacgugcccagccccccgccgguggggaaagccgagcuggaggacggcgccuaccgcaucaagcagcgggggaucuugggguauagccagaucggcgcaggggucuacaaagagggcacguuccacaccauguggcacgugaccagaggugcaguccucaugcaccggggcaagcgcaucgagcccuccugggccgacgucaagaaggaucugaucaguuacgggggcggcuggaaacuggagggggaguggaaggagggugaggagguccaagugcuugcgcuggagcccggaaagaauccccgagccguccagaccaagcccggcaucuucaagacgaacaccgggacgauuggcgccgucuccuuggauuucagccccgguaccuccgggagccccaucguggaccgcaagggcaaggucgugggacucuacggaaacggaguugucacgcgguccggggcauacgugagcgcgaucgcacagaccgagaaguccaucgaggauaaccccgaaaucgaagacgacauuuuucgcaagaaacggcugaccaucauggaccugcaccccggcgcgggaaagacgaaacgcuaccuccccgcaaucgugcgggaggccaucaagcgcggacugcgaacucugauccuagcuccgacccgggucgucgccgcagagauggaggaagcccuccgcgggcugccuauuagguaccagacccccgccauuaaggccgagcacaccggccgcgagaucguggaccugaugugucacgccacauuuaccaugcggcuccuuagccccguccgcgugccaaacuacaaccugaucaucauggacgaggcgcacuucaccgaccccgcaagcaucgccgcccggggguacaucuccaccaggguggagaugggggaggccgcgggcauauucaugacggccacgccgcccgggagccgggacccguucccccaguccaacgcccccaucauggaugaggagcgcgagauucccgagcggaguuggaacuccggccacgagugggucaccgauuucaaagggaagaccguaugguucguaccgagcaucaaggccgggaacgacaucgcggccugucuccgcaagaauggcaagaaggucauccagcuuucccggaagaccuucgacuccgaauacgucaagacacgagccaacgauugggauuucguggucaccaccgauauuucggagaugggagccaacuuuaaggcggagcgggugaucgacccccgccggugcaugaagcccguuauccugaccgacggcgaggagcgcgucauccucgcggggccgaugccggugacccacagcuccgccgcucaacggcggggccgcaucgggcggaaucccaagaacgagaacgaucaauacaucuacaugggugagccccuagaaaacgacgaggacugcgcccacuggaaggaagccaagaugcugcucgacaacaucaacacccccgagggcauaaucccgagcauguucgagcccgagcgcgagaagguggacgcggucgacggugaguaccggcugaggggcgaggcccggaagaccuucguggaccugaugcgccgcggugaccugcccguguggcuggccuacaaggucgcagccgagggcaucaacuacgcggacaggaaguggugcuucgacgguaucaagaacaaccagauccuggaggagaacguggaggucgagauauggaccaaggaaggcgagaggaagaagcucaagccgagguggcuggacgccagaaucuacuccgacccccuggcccugaaggaguucaaggaguucgccgcggguagaaaaagccugaccuugaaccucaucaccgagauggggcguuuacccaccuuuaugacgcagaaggcccgcaacgcucucgacaaccucgccgugcuccacaccgccgaggcgggcgggcgggccuacaaccacgcccuguccgagcugcccgagacccuggagacccuccuccugcugacgcucuuagccaccgugacgggcggcauauuccuguuucucaugagcgggaaaggcaucgggaagaugacccugggcaugugcugcaucaucacagccucuguacugcucugguacgcgcaaauacagccgcacuggaucgccgccagcaucauccuggaguucuuccugaucguuuugcugauccccgagccugaaaagcagcgcacgccacaggacaaucagcuuaccuacguggucauagccauccucaccgugguggccgcgaccauggccaaugaaaugggcuucuuagaaaagacuaagaaggaccugggccucgguuccaucaccacccaagaaagcgagagcaauauccuggauaucgaccugagaccggccucggccuggacccuguacgccguugcgaccaccuucgugaccccuaugcugcgucauagcauugagaacuccagcgugaacgugucccugaccgcaaucgccaaccaagccacagugcucaugggcuugggcaaaggguggccccugagcaagauggacaucggcgugccccuccuggcgaucggcuguuacucccaggucaaccccaucacucugacagcggcccuccugcugcucguggcgcacuacgcaaucaucggacccggccugcaggcuaaggccaccagggaggcucagaagcgcgccgccgcggggaucaugaaaaaccccacgguggacggcaucaccgucaucgaccuggagcccaucccguaugaccccaaguucgagaagcaguugggccaggugaugcugcugaucuuaugcgugacccagguccugaugaugcggaccacgugggcccugugcgaggcccucacccuggccaccggccccaucagcacccugugggaggggaacccgggccgcuucuggaauaccaccaucgccguuuccauggcuaacaucuuccgcggcucauacuuagccggcgccggccugcuguuuuccauuaugaagaacaccacaaacacgcggcgcgggaccggcaacaucggcgagacccucggugagaaguggaagagccgacugaacgcccuaggcaaauccgaguuucagaucuacaagaagucagggauccaagagguggaccgcacccucgcuaaagaggggaucaagcgcggggagaccgaccaccacgccgucagccgcggcucagccaaacugcguugguucguggagcgcaacauggucaccccggagggcaaggucgucgaccugggcugcggccgcggcgggugguccuacuauugcggcgggcucaagaacgugcgcgaggucaaagggcucacaaagggaggcccugggcacgaggagcccauucccaugagcaccuacggcuggaaccugguccggcuccaguccgggguugacgucuucuuuacgccgcccgagaagugcgacacccugcugugcgacauaggcgaaaguagucccaaucccacgaucgaggccggccgcacccuaagagugcugaaccugguggagaacuggcucaacaacaauacccaguucugcaucaaaguccugaacccguacaugcccuccguuaucgagaagauggaaacgcuacagagaaaguacgggggcgcacucgugcggaacccccugagccgcaacuccacccacgaaauguacugggucaguaacgcgaccggaaacaucgugaguagcgugaacaugaucucccggaugcugaucaaccgguucaccaugaagcauaagaaggcgacguacgaaccggaugucgacuuaggcagcgggacccggaacauuggcaucgaguccgaaauccccaaucucgacaucaucgggaaaagaauagagaagaucaaacaggagcaugagaccucauggcacuacgaucaggaccaucccuacaagaccugggccuaccauggguccuacgaaacuaagcagaccggcagcgccuccagcauggugaacggggugguccgcuugcugaccaagccgugggacguagucccgaugguuacacagauggcuaugaccgacaccacccccuucggccagcagcggguguucaaggagaaaguggacacucgaacgcaggagccgaaggaggggaccaagaagcucaugcggaucacggccgaguggcuguggaaagaacuggggaagaagaaaacgccccggaugugcacccgggaggaguucacccgcaagguccggagcaacgcugcacucggugccaucuucacagacgagaacaaauggaaguccgcgcgcgaagcgguagaggacgggcgguucugggagcuggucgaccgcgagaggaaccugcaccucgagggcaagugcgagaccuguguauacaacaugauggggaagcgggagaaaaaguugggcgaauuuggcaaggcgaaagggucccgggccauuugguacauguggcugggcgcccgguuccucgaguucgaagcccugggguuccugaacgaggaccacugguucagccgaggcaacucacucagcgggguggagggugaaggccugcaccgguuaggguacauuuugcgggacgucggcaagaaggagggcggcgccauguacgccgacgacacggccgggugggacaccaggaucacccuggaggaccugaaaaaugaggagauggugaccaaccacaugaagggagagcacaagaagcuagccgaggccauuuuuaaacugacguaccagaacaaagugguccgagugcagcgccccacgccccggggcaccgugauggacaucaucucccgccgcgaccagcgggguuccggccaaguugggacguacggccugaacacguucacaaacauggaggcgcagcuuaucaggcagauggagggcgagggaaucuucaagagcauccaacaccugaccgccaccgaagagaucgccgcgcagaacuggcucgcacgggugggccgcgagcggcucucccgcauggcaaucuccggggacgauuguguggucaaaccgaucgacgaccgguucgccucggcccugacggcucugaacgacaugggcaagguucgaaaggacauucagcagugggagcccagccggggguggaacgauuggacccaggugcccuucugcucccaccacuuccacgaacucgucaugaaggacggccgcgugcuggugguccccugucguaaccaggacgagcuuaucggccgcgcgaggaucagccagggggccggcugguccuugaaggagaccgccugccugggcaagucauacgcccagauguggacccugauguacuuccaccgccgggacuugcgccuggcagcgaacgcaaucugcuccgcgguacccucccacugggugccuaccucccggacgaccuggagcauccacgcaaagcacgaguggaugaccaccgaggacaugcuggcggucuggaaccgcguauggauccaagagaacccguggauggaggacaagacgcccgucgaguccugggaggagguccccuaccuggggaagcgggaggaccaguggugcgggagccugaucggccugaccucccgcgccaccugggccaagaacauccagaccgccaucaaucagguccgcagccucaucggcaacgaggaguacacggacuacaugccuagcaugaagcgguuccgccgggaggaggaggaggcaggggugcucugguag

SEQ ID NO: 24922 - RNA, 9876 nt, Artificial Sequence
  derived and/or modified CDS sequence (opt11) from DENV-2__FJ024477__SS-prME
accgccggcgugaucgucaugcugauccccaccgccauggcguuccaccucacgacccggaacggggagccccacaugauagugggccggcaggagaaggggaagucccugcucuucaagaccgaagacggcgugaacauguguacacucauggccaucgaccugggggaguuaugcgaggacacuauuaccuacaagugcccccuccugcgccagaaugagcccgaggacaucgacugcugguguaacagcaccuccaccugggucaccuaugggaccugcaccaccacgggcgagcaccgccgggagaagcggucaguggccuuagugccccacgucgggaugggccucgagacccgcaccgagacuuggaugagcucagaaggggccuggaagcacgugcagcggauagaaacguggauacugcgccacccgggcuucaccaucauggccgcgauccuagcauacacuaucggaaccacgcacuuccaaagggcucucaucuucauccuguuaacggccguggcgcccagcaugaccaugcguugcauuggaaucucuaaucgggacuucgucgagggcgugagugggggauccuggguggacaucgucuuagaacacgggagcugugugaccacgauggccaaaaauaagcccacccuggacuucgaacucauaaagaccgaggccaagcagcccgcgacguuacgcaaguacugcauugaagcaaaguugacgaauacuaccaccgaaagucggugcccgacgcagggcgagcccagccugaacgaagagcaggacaagcguuuuaucugcaagcacuccaugguggaccgagguugggggaacggcugugggcuguuuggcaagggcgggaucgugacaugcgcgauguucacguguaagaagaacauggagggcaagguugugcagcccgagaaucuggaauacaccaucgucaucacgccccacagcggggaggagcacgccguaggcaacgacacugggaaacacggcaaggagaucaagaucacgccgcaguccagcauuacagaggccgagcugaccgguuacgguacagugaccauggaaugcucaccccggaccggccuggacuucaaugagaugguacugcuucagauggaggacaaggccuggcucgugcaccggcagugguuccuugaccuaccccucccgugguuaccuggggccgacacccagggcagcaacuggauccagaaggagacgcuggugacuuucaaaaacccccaugcgaagaaacaggacguggugguccuugguucccaggagggcgccaugcacaccgcccugacuggggcgacggagauccagaugagcagcggaaacuugcuguucaccggccaccucaagugcagacugcggauggacaagcuucagcugaaagggauguccuacagcaugugcacaggcaaguucaagaucgugaaggagaucgccgaaacccagcacgggacuauuguuauucgcguacaguacgagggcgauggcagccccugcaaaauccccuucgagauaacugacuuagaaaagcggcaugugcucgggcgccugaucaccguaaacccgaucgucaccgaaaaggauagcccagugaauaucgaagcagaaccgcccuucggcgacuccuauaucaucaucgggguugagccgggccagcugaagcucaacugguucaagaaggggucuuccauuggccagauguuugagacgacuaugcgcggcgccaagcggauggccauccucggagacaccgcaugggacuucggcagccucgggggcgucuucaccucuaucggaaaggcccuccaccagguguucggcgcgaucuacggcgccgccuucagcgguguaagcuggacaaugaaaauccugaucggcgucaucaucacauggaucgguaugaacucgcgcuccaccagccuuucggugagccugguacucgucggcguggugaccuuauauuuaggggccaugguccaggcggauuccggauguguggugagcuggaagaacaaggaguugaagugcgguucgggcaucuuuaucacggacaacguccacacauggaccgagcaguauaaauuccagcccgagucgcccucgaaacuugcuagcgcaauucagaaggcccacgaagagggcaucugcgggauccguucggcaacccgccuggagaaucucauguggaagcagaucacgcccgagcuaaaccacaucuugucggagaacgaggugaagcucaccaucaugaccggcgacaucaaggggaucaugcaggcgggcaagcggagucuacguccgcagcccacagagcugaaguacucguggaagacguggggcaaagcuaagaugcucuccaccgagucgcacaaccagacuuuucugaucgacggucccgagaccgcagagugcccgaacaccaaccgggccuggaacagcuuggaaguggaggacuacggcuucggggucuucacuaccaauaucuggcugaagcugagagagaagcaggacguguucugcgacuccaaacugaugucagcagcgaucaaggacaaccgggccgugcaugccgauaugggcuauuggaucgagucugcccuuaaugacacuuggaagauggagaaggccucauucauagaggucaagucuugccacuggcccaaaucacacacccuguggucuaacgggguccuggagucugagaugaucauccccaagaacuucgcgggaccaguuagucagcacaacuaccgcccggguuaccacacccaaaccgccgggcccuggcaccucggcaagcuggagauggauuucgacuucugcgaggggaccaccguagugguuacggaggacugcggcaacaggggccccagucuucgcacaacuacugcuagcgggaagcuaaucacagagugguguugccgguccugcacccuaccgccgcugcgcuauagaggcgaggacgggugcugguauggcauggagaucagaccccucaaagagaaggaagagaaccuggucaacagccuggugaccgccggccacggccaaaucgacaacuucagccucggcgugcuggguauggcgcuguuucucgaagagaugcugcggacccgcgugggaacgaagcacgccauccuacucgccgccgugagcuucgugacucugaucaccgguaacauguccuuccgggacuugggccgcgucauggugauggugggggccaccaugacggacgacaucggcaugggcguuaccuaccucgcguuauuagcggccuucaagguucgccccaccuuugcugcuggucuccugcugcgcaagcucacuagcaaagagcugaugauggccacgauaggcauagcccugcucucccagagcaccauacccgagaccauucucgaacugaccgaugcccucgcccuaggaaugauggugcugaagaucguccgcaacauggaaaaauaucagcucgccguuacuauaauggcgauauccugcgucccgaacgccgucauccugcagaacgccuggaaaguuagcugcaccauccuggccguagucucuguaagcccccuacuuuuaaccagcagucagcaaaaggcggauuggauccccuuagcucugaccaucaagggccugaaucccacggccauuuuucuaaccacucugucccggaccagcaaaaaacgcagcuggccgcugaacgaggccaucauggccgucggcaugguuagcauccucgccagcagccuuuugaagaacgacauccccaugacgggaccacucguggccggcgggcugcugaccgucugcuacguuuugaccggccggucugccgaccuggaacuggagcgcgccgcugacgugaagugggaggaccaagcggagaucagcggcagcuccccgauucuaucuauuacaaucuccgaagacggcucuauguccaucaagaacgaggaggaggagcagacgcucaccauccugauacggacaggccuauuagugauuagcggaguguucccgguuagcauccccaucacugccgcggccugguaccugugggaggucaagaaacagagggccggcgugcuaugggacguaccgagcccgccccccgucgggaaggcggaguuggaggauggugccuaccggauuaagcagcgggggauucugggcuacagucagaucggcgcaggggucuauaaagaaggcaccuuucacacgauguggcacgugacccgcggggcuguccucaugcaccgcggcaagcggaucgagcccuccugggccgacguaaagaaagaccugaucuccuacgggggcggcuggaagcuggagggggaguggaaggagggcgaagaaguccaggucuuggcgcuggagcccgguaagaauccacgcgccguucagacaaagcccggcaucuucaagaccaacacggggaccaucggcgccgugucacuggauuucucccccggcaccagcgggucccccaucgucgaccggaaaggcaaagugguggggcucuacggcaacggagucgugacccgcagcggggccuacguguccgcgauagcgcagacggagaaguccauagaggauaaccccgagauagaggacgacaucuuccggaagaaacgccucacgaucauggaccugcaucccggagcaggcaaaacuaagcgguaucucccggccauagucagggaggccaucaaacggggacugcgcacccugauacuggcuccgacgcgggugguggcggccgagauggaggaagcccuccggggccugcccaucagguaccaaacccccgccaucaaggcggagcauacgggccgugagaucgucgaccugaugugccacgccaccuucacgaugaggcucuugagccccgugcgggugccuaacuacaaccugaucaucauggacgaagcccauuucaccgaucccgccucgaucgccgcucgcggcuacaucucaacuagagucgagaugggggaggccgcagguaucuucaugacggccacgccgcccggaucccgugacccguucccccagagcaaugcgcccaucauggacgaggagcgggagauccccgaacgcuccuggaauagcggccacgaaugggugaccgauuucaagggaaagacggugugguucguaccgucgauuaaggccggaaaugacaucgccgccugccuacggaagaacggcaagaaaguuauccagcugucacgcaagaccuucgacuccgaauaugugaaaacucgggcuaaugacugggauuucgucgugacgaccgacaucucagagaugggggccaauuucaaggccgagcgcgugaucgacccccgacgaugcaugaagcccgucaucuugaccgauggggaagagcggguuauacucgccggccccaugccugugacgcauuccagcgccgcucagcgacggggccgcauugggcgcaaccccaagaacgagaacgaccaguacaucuacaugggcgagccccuggaaaacgacgaagacugugcgcacuggaaggaagccaagauguuacucgacaauaucaacacccccgaggggaucauuccguccauguucgagcccgagcgggagaaaguggacgcgaucgacggggaguaccgcuugcggggcgaggcacgcaagaccuucguggaccugaugcggcgcggggaccuaccuguguggcuggccuacaaagucgcugccgaagggaucaacuacgcagaucggaaguggugcuucgacggcaucaagaacaaccagauccuggaagaaaacguggaggucgaaaucuggaccaaggagggcgagcguaaaaaacucaagccgcgaugguuggacgcccgcauauacagcgacccccuggcguuaaaggaguucaaggaguucgccgccggccgaaagucacugacacugaaccucauaaccgagauggggcgccugcccaccuuuaugacacaaaaggcccggaaugcccuagauaaccucgccguccugcacacugccgaagccggcggccgcgccuacaaccaugcgcugagcgagcuuccagagacccuggagacucuguugcuauuaacgcuccuggcaacggugacuggcggcauauuccuuuuccucauguccggaaagggcaucgggaagaugacccugggaauguguugcaucaucaccgccucaguccugcucugguaugcccagauacagccucacuggauagcugccucuauuauccuggaguucuuucucaucgugcuccugauacccgagcccgagaaacaacggacgccucaggacaaccagcugacauacguggucauagccauccucaccgugguggccgccaccauggccaacgagaugggguuccuggaaaagacuaagaaggaucugggcuugggcagcauuacgacacaggagagcgaauccaacauccuugacaucgaucugcgcccagcuagcgcguggacccuguaugccguagccacgacguuugugacccccauguuacggcacaguaucgagaacagcuccgugaacgucagccuaaccgccaucgcgaaccaggccacugugcucaugggucuggggaagggguggccauuguccaagauggacauaggcgugccccuccuggcgaucgggugcuacagccaggugaacccaaucacgcugaccgccgcccuccugcugcucguugcgcauuacgccaucaucggcccugggcuccaggccaaggccacgcgcgaagcccaaaagcgugcggccgccgguaucaugaagaacccgaccguggacggaaucacggugaucgaccuggagcccaucccguacgaucccaaguuugagaagcagcucggccaggucaugcugcugauccuuugcgucacccagguccugaugaugcgcaccaccugggcccuuugcgaggcccucacucuggcaacaggcccuaucuccacccugugggaggggaacccaggccgcuucuggaacaccacgauagccgucagcauggccaacaucuuccgcggcaguuaccuggccggggcgggacuucuguucucuauaaugaagaauaccaccaacacuaggcgagguacggguaacaucggagaaacccuaggggagaaguggaagagucgccugaacgccuugggcaagagcgaguuucagaucuacaagaagucggggauucaggagguggacaggacccucgccaaggaggguaucaagcgcggggagaccgaccaccacgccgucagcagaggcuccgccaaacugcgcugguucguagagcggaacauggugacgcccgagggcaaggucguggaccugggguguggccgagggggauggucguacuacugcgggggcuuaaagaacguacgggaggucaagggacugacgaagggaggccccggucacgaggaacccauacccauguccacauacggcuggaacuuagugcgccuccaaagcgggguggacgucuuuuuuaccccgcccgagaagugcgacacgcugcugugcgacauaggcgaauccucccccaaccccaccauugaggcgggccgcaccuuacgcguacucaaccugguggagaacuggcucaacaacaacacccaauucugcaucaagguccugaaccccuacaugcccagcgugauagagaagauggagacgcugcaaagaaaauacgggggagcgcucgugcgaaacccucugucccggaacucaacgcacgagauguacuggguuuccaacgccaccgguaacaucgugagcuccgucaacaugaucagccgcaugcugaucaaccgguucaccaugaagcacaagaaggccaccuacgagccggaugucgaucugggguccgggacgcgcaacaucgguaucgagagcgagauucccaaccucgacaucauaggcaagcggaucgagaagauuaagcaggagcacgagaccucuuggcacuacgaccaagaccaccccuacaagaccugggcguaccacgguagcuacgagaccaagcaaacgggcuccgcuagcaguauggucaacggggugguccgccugcugaccaagccaugggacguagugccgauggucacccaaauggccaugaccgacacuacccccuucggucaacagcgcguuuucaaggagaagguggacacgcguacccaggaacccaaggagggcacgaagaaacucaugaagaucaccgccgaguggcuauggaaagagcuagguaagaagaagaccccccgcauguguacccgggaggaguucacgcguaagguccggagcaaugcagccuugggagcgaucuucaccgacgaaaacaaguggaaguccgcaagagaggccguggaggaugggagauucugggagcuggucgaccgggagcggaaccugcacuuggagggcaagugcgagaccugcgucuacaacaugauggggaagcgagagaagaaauugggugaguucggaaaggcaaaggggagccgggcgaucugguacauguggcuaggagcccguuuccucgaguucgaggcccuggguuuccugaacgaagaccauugguucuccaggggcaacucucucagugggguggagggcgagggccuacaccgccuggguuacauccuccgggacgucaguaagaaggaaggcggggccauguacgcggacgacacagccggcugggacacgcgcauaaccuuggaagaccugaagaacgaggagauggugacaaaccacaugaagggggagcacaagaaacucgccgaagccaucuucaagcugaccuaucaaaacaaggugguucgggugcagcgcccgacgccccggggaaccgucauggacaucaucagccgccgggaccagcgcggcuccgggcaggucggcacuuacggccugaacaccuuuacgaacauggaggcccagcucauccgccaaauggagggcgagggcaucuucaagucgauccagcaccugaccgccaccgaagagauagcggugcagaacuggcuggcccgcguagggagggaacgguugucccgcauggcaauaucgggugacgacugcgucgugaagcccauugacgaccgcuucgccuccgcacugaccgcucugaacgacauggggaaggugcgcaaggacauccagcaaugggagcccagccggggcuggaacgacuggacucagguucccuucugcucccaucauuuccacgaacucgugaugaaggacgggcgcgugcugguugugcccugccgcaaccaagaugagcuaaucggccgugccagaauaucgcaaggcgccggguggucccugaaggagaccgccugccugggcaagagcuacgcacagauguggacgcugauguacuuccaccgccgugaccuccgccuggcagccaacgcaauuuguuccgccgugcccagccacuggguacccaccucgcggacgaccuggucuauccacgcgaagcacgaguggaugacgaccgaggacaugcuugccgucuggaaccgagucuggauccaggagaauccguggauggaggacaaaaccccugucgagucuugggaggaggugcccuaccucgggaagcgggaggaucaauggugcggcucauugauagggcugacgagccgugcaaccugggccaagaacauccagaccgccaucaaccaggugcggucacucaucggcaacgaggaguacaccgacuacaugcccaguaugaagagauuccgccgggaagaggaggaggcgggaguccugugguga

SEQ ID NO: 24923 - RNA, 9876 nt, Artificial Sequence
  derived and/or modified CDS sequence (opt11) from DENV-2__GQ868552__SS-prME
acggccggggugaucauaaugcuaaucccuaccgccauggcguuucaccucacuaccaggaacggcgagccccacaugauuguaggucgccaggagaaggggaagucucuucucuucaagaccgaggacggggugaacaugugcacccucauggccaucgaccugggcgagcugugcgaggauaccaucaccuacaagugcccuuuacugcgacagaacgagccagaagauauagacugcuggugcaauagcacuagcaccugggugaccuacgggaccugcaccaccacgggcgaacaccggcgggagaagcgguccgucgcccucgugccccacguuggcaugggcuuagagacacgcaccgagaccuggaugagcuccgaaggcgcauggaagcacguccagcggaucgagacuuggauccugaggcauccuggcuuugccaucauggcugcuauccuggcauacacgaucgggacgacacacuuccagagagcacucaucuucauauugcuaacagcggucgcgcccagcaugaccaugcgcugcaucggcaucuccaaccgagacuucguggagggagucuccggaggcuccuggguugacaucgugcucgagcacgggagcugugucaccacuauggccaaaaacaagcccacccuggacuucgagcugaucaagaccgaggccaagcagcccgccacgcucagaaaguacuguauagaggcgaaguuaaccaacacgaccacugagucccggugcccuacccagggcgagcccagccugaacgaggaacaggacaagcgauucaucugcaagcacaguaugguggaccgggggugggggaauggcugcgggcucuuuggcaagggcgggaucgugacgugcgccauguucacguguaagaagaacauggaagguaaggucgugcugcccgaaaaucuggaguauaccaucgugaucacgccccacagcggggaggagcacgccgucggaaacgacacugggaagcaugguaaggagaucaaaaucaccccgcagucaagcaucacugaggccgagcuaaccggguacggcaccguuacgauggagugcagcccucgcaccggccuggacuucaacgaaauggugcugcuccagauggaagaaaaagccugguuaguucaccggcagugguuccuagacuugccccugcccuggcugccgggggcggacacccaaggaagcaacuggauccagaaggagacguugguuacguuuaaaaacccacacgccaagaagcaggacguggucguguuagggucccaggaaggcgcaaugcacaccgcgcugaccggugccaccgaaauacaaaugagcagcggcaaccuccuauuuacuggccaccugaagugccgccuccgcauggacaagcuacagcugaaggggaugagcuacagcaugugcaccggaaaguucaagaucgucaaggaaauagcagagacccagcacgggaccaucgucauccgcgugcaguaugagggagaugggucccccugcaaaauccccuuugagauuauggaucucgagaagcggcacgugcuggggcgacugaucacagugaaccccaucguuaccgagaaggacucgcccgugaacauagaagcagagccgcccuucggagauucguacauuaucaucgggguugagccgggccagcucaagcugaacugguucaagaaggggagcuccaucggccaaauguuugaaaccacgaugcgcggcgcgaagcggauggcgauacugggugacacagccugggacuuuggcucauuagggggcguauucaccucuaucgggaaggcgcuucaucaggucuucggcgcgauuuacggugcagccuucagcgggguguccuggaccaugaagaucuugauaggggugauaaucacuuggaucggaaugaacagccgcaguacgagccuguccgucucgcugguucuggugggugugguaaccuuguacuugggggcgaugguccaggcggauuccggcuguguaguauccuggaagaacaaggagcugaaauguggcucagggaucuucaucaccgacaacgugcacaccuggaccgagcaauauaaguuccaacccgagagcccgucgaagcuagcauccgccauccaaaaggcccacgaggagggcaucugcggaauacggagcgucacccgccuugagaaccugauguggaagcaaaucacccccgagcuaaaccacauccucagugaaaacgagguuaagcugaccaucaugacgggggacaucaagggaaucaugcaggcgggcaaacggagccuccgcccccaacccacggagcucaaguacuccuggaaaaccuggggcaaggcuaaaaugcugagcacugaaucccacaaucagacguuccuaaucgaugggccggagacagccgaguguccgaacaccaaucgcgcuuggaacucccucgagguggaggacuauggcuucggcgucuucaccacuaacaucuggcugaaacugcgcgagaagcaggacguauucugcgacuccaagcucaugagcgccgcaaucaaggacaaccgggcagugcacgccgauaugggcuacuggauagaaucggcccucaacgacaccuggaaaauggagaaggccagcuucaucgaggucaaguccugccauuggcccaagagccacacccugugguccaacggcguccucgaaagcgagaugauuaucccuaagaacuuugcggggccggugucgcagcacaacuaccgcccgggcuaucauacucaaaccgccggccccuggcaccugggcaaacuggagauggacuucgacuucugcgagggcacgaccgugguagucaccgaggauugcggcaaccggggcccaagccuccggaccacuacagccagcgggaagcugaucaccgagugguguugccggucuugcaccuuaccgccccuccgcuaucguggggaggaugguugcugguacggaauggagauccggccacugaaggagaaggaagaaaacuuggugaacagccucgugaccgcagggcacggccagaucgacaauuucagucuuggcguucuggggaucgcccucuucuuagaagagaugcugaggacccgaguugggaccaagcaugcaauucuccuuguggccaucucuuucguuacucugaucacggggaacaugucguuucgggaccucggcagggucauggugauggugggggcgaccaugaccgacgacauugggaugggagucacuuacuuggcguugcucgcggccuuuaaagugagacccacguuugccgcuggucugcugcuccggagacuuaccagcaaggagcuaaugauggcuaccaucgggaucgcacuccuuucacagagcaccaucccugagacgauccuggaauuaaccgacgcgcuugcacuggggaugauggugcucaaaauaguccgaaacauggagaaguaccagcuggccgugaccaucauggccaucuccugugugccgaacgcgguaauucuucucaacgccuggaaaguuagcugcacuauacucgcggcaguguccguaucgccacugcucuugacgucgucccaacagaaggcagacuggaucccccuggccuuaaccaucaaaggcuuaaaucccacugccauauuccugacgacguuaucccgcaccucuaagaagcgguccuggccucugaacgaggccgugauggccguaggcauggugagcauccuggcauccucucuccugaagaaugacauacccaugaccgggccccugguggccggagggcugcugacggucugcuacgucuugacgggacgcuccgccgaccucgaguuggagcgggccgccgacguuaaaugggaagaccacgcagagaucucugggagcucucccaucuuaagcaucacuauaucugaggacggcagcauguccauaaagaacgaggaggaggaacagacacucaccauccugauucgcaccggccugcuagucaucagcgggguguucccggugucuaucccaaucaccgcggccgccugguaucugugggaggugaagaagcagcgggccgggguguugugggacgugcccucgccucccccuguugaaaaggcggagcucgaagacggggcguaucgaaucaaacagagggguauacugggguacucccagaucggcgcggguguguauaaagaggggaccuuccacaccauguggcacgugacaagaggcgcuguucugaugcaccgcgguaagaggaucgagcccagcugggcagacgugaagaaggaccucaucucauacggcgguggcuggaaacucgagggcgaauggaaggagggcgaggagguucaagucuuggcgcucgagcccggcaagaaucccagggccgugcagacgaagccggggcuauucaagaccaacaccggcaccaucggggcugugagucuggacuuuuccccaggcacgucggggagccccaucgucgaccgcaaggggaaagugguggggcucuacgggaacggcgucgugacccggagcggcgcuuacguguccgcgauagcucagaccgagaaauccauugagaacaaccccgagauugaggacgacauauuccgcaagaagcgacugacgauuauggaucuacaucccggugccgguaagacgaagcgcuaccugcccgccaucguccgggaggccaucaagcgcggguugcguacccuaauccuggcgccuacacggguggucgccgccgagauggaagaggcccucagaggacucccuauccgguaccagaccccggccauccgcgcggagcacacaggucgagagaucgucgaccuuaugugccacgccaccuucaccaugaggcuccugagccccgugcgggugccgaauuauaauuugaucauaauggacgaggcccauuucaccgaccccgccuccaucgcagcgcgcggcuacaucagcacgcggguggaaaugggcgaggcugccgguaucuucaugacggccacgccucccggcuccagagacccguuuccccagagcaacgcgcccaucauggaugaagaacgggaaaucccagagcguuccuggaacagcggacacgaguggguuaccgacuuuaaagguaagaccguuugguucgucccgucuaucaaggcggggaacgacaucgcugcuugccuccggaagaacgguaagaaagugauccagcugagccgcaagaccuucgacucagaauacguuaagacccgcgccaacgacugggacuuugucgugaccacggacaucagcgagaugggcgccaacuuccgcgccgagcgggugaucgacccccgccggugcaugaagcccgucauucugaccgacggggaggagcgcgugauccucgcuggccccaugccgguaacccacucaagcgccgcccaacgccgagggcgaaucggucggaaccccaagaacgagaacgaccaguacaucuacaugggggagccgcucgaaaacgacgaggacugcgcgcacuggaaggaggcuaagaugcugcucgauaauaucaacacccccgagggcaucaucccuuccauguucgaaccagagcgcgaaaaggucgaugccaucgauggcgaguaccgccugcgcggggaggcccggaagacauucguggacuuaaugcgccgcggcgaccuacccguguggcuggcauaccgcgucgcggccgaggggaucaacuacgccgaucggagauggugcuucgacggcaucaagaauaaccagauucuggaagagaauguagagguugagauuuggaccaaggagggggagcggaagaaauugaagccgcgcuggcuggacgcacgaaucuacagcgauccccuggcucugaaggaguuuaaggaguucgccgccggaagaaagagucugacgcugaaccucaucaccgagaugggccgacugcccacguuuaugacccaaaaggcccgcgacgcccuggauaaccucuccguccugcauacggcggaggcaggaggccgggccuacaaucacgcacugagcgagcucccagagacgcuugaaacgcugcuccugcugaccuuacuggccaccgucaccgggggcaucuuucuguuccucaugagcggcaaggggaucggaaagaugacacucgggauguguugcauuaucacagcauccauccugcucugguaugcccagauacagccacacuggauagcggccagcaucaucuuggaguucuuccugauaguccuccucauuccagagccagaaaagcagcgcacgccccaggacaaccagcugaccuacgucgugauugcgauccucaccgucguugcggccacaauggccaaugaaaugggguuucuggagaaaacaaagaaggaccuagggcugggcagcaucaccacucaggagccugagucuaacauuuuggacaucgaccugcggcccgcguccgcuuggacgcucuacgcgguggccaccaccuucguaacgcccaugcugcgccauuccaucgagaacagcuccgugaacgugagcuuaacggcgauagccaaucaggccaccguccuuauggggcucgggaaaggcuggccacugucaaaaauggacaucggggugccacuccuggccauagguuguuacagccaggugaaucccaucacgcugaccgcggcgcuucuucuuuuaguagcccacuaugcgaucaucggcccuggccugcaggcgaaggccacgcgggaggcccagaagcgggcagcugccggcauaaugaagaaccccaccgucgacgggaucaccgugauugaccuggagccuauucccuaugaucccaaguuugaaaagcagcucgggcagguaaugcuacugauacucugcgugacccaaguucugaugaugaggacgaccugggcccugugugaagccuuaacccuugcaaccgggcccaucuccacacugugggaaggcaacccggggcgauucuggaauaccaccaucgcggucagcauggccaacauauuccgcgguuccuaucuagccggcgcagggcuauuauucucuaucaugaaaaacaccaccaauacccggcgcggcaccggcaacaucggcgagacccucggggagaaguggaaaucccgucugaacgcgcugggcaaaagcgaguuucagaucuacaagaagaguggaauacaagaaguagaccggacccucgcaaaggaggggauaaagaggggcgaaaccgaucaucacgcggucagccgcggguccgccaagcugcggugguucgucgagcgcaacaugguaacacccgaggguaaaguggucgaccugggaugcgggcggggcggguggagcuacuauugcggcggguugaagaacguccgcgaaguuaagggccucaccaagggcgggcccggccacgaggagcccaucccgauguccacguaugguuggaacuuaguacgguuacaaagcggugucgauguuuucuucaccccgcccgagaagugcgacacccuccugugcgacaucggggagagcucccccaacccgaccaucgaggccggacgcacguuaagaguccugaaccugguggagaacugguuaaacaauaauacgcaauucugcaucaaagugcugaacccauauaugcccagcgucauagagaagauggaaacccugcaacgcaaauacggcggggcguuagugagaaaccccuuaucccguaauuccacccacgagauguauuggguguccaacgcaaccgguaacaucgucagcucgguaaauaugaucagccggaugcugaucaaucgguucacgaugaagcauaagaaagcuacuuaugagcccgacguggaccuggggucagggacccgcaacaucgguaucgagagcgaaaucccgaaccucgacaucaucggaaagcggauugaaaagaucaagcaggagcacgagacguccuggcauuaugaccaggaccaccccuacaagacaugggcauaccacggcagcuacgagacaaagcagacgggguccgccagcuccauggucaacggcguugugcgccugcugaccaagccgugggacgucgugccaaugguaacucagauggcgaugacugauacuacgccauucggccagcagcggguuuucaaggagaagguggacacgcgaacccaggagcccaaagaagguaccaagaaguugaugaaaauuacagccgagugguuauggaaggaguuaggaaagaagaagacaccgcggaugugcacccgcgaggaauuuacccggaaaguccgcucgaacgcggcccucggugccauauucacugaugaaaacaaguggaaauccgcucgggaggccgucgaggacagccgcuucugggagcugguggaccgggagcgcaaccugcacuuagaagggaagugcgaaacgugcgucuacaacaugauggguaagcgggagaagaagcugggcgaauuugggaaagcgaagggcucccgcgccauuugguacauguggcugggggcgcgguuuuuagaguucgaggcccuggguuuucugaacgaggaccacugguuuagccgcggcaacagccuuucaggcguagaaggcgaagggcugcacagacuaggcuacauucuacgcgacguuagcaagaaggaggguggugccauguacgcggacgauaccgcaggcugggauacucguaucacguuggaggacuugaagaaugaggagauggugacuaaccacaugaaaggugaacacaagaagcucgcagaagcuaucuucaagcugaccuaccagaauaaagucgugcgcguccagcgccccacgccucgaggcaccgugauggacaucauaucccgaagagaccagagggggagcggccagguggguacguacgggcuaaacaccuuuacaaacauggaggcccagcucauccggcagauggagggcgaagggaucuucaagaguauccagcacuugaccgucacugaagagaucgccguucaaaauuggcuggcccgcguaggacgagagcgccuuagccggauggcgauauccggcgacgacugcguagugaagccccuggacgaccgcuucgcguccgcccugacugccuugaacgacaugggcaaggugcguaaggacauccagcagugggagccgucccgcggcuggaaugacuggacgcaagugcccuucugcagccaucacuuccacgagcuagugaugaaggacggucgcgucuuaguggugccuugccgcaaccaggacgagcucaucggaagggcccgcaucagucagggggcuggauggagccuaaaggagaccgcuugccugggcaaauccuacgcccagauguggacgcucauguacuuccaucggcgcgauuugagacuagcggccaacgcgauuugcuccgccguccccucucacugggucccgaccagcaggaccacgugguccauccacgcgaagcacgaguggaugacaacggaggacaugcucgccgucuggaaccgcguguggauccaggagaaucccuggauggaggacaaaaccccaguagagagcugggaggaagugcccuaucuuggaaagcgggaggaucagugguguggaucucugaucgggcucacaaguagggcgaccugggcgaagaacauucagacggcaaucaaccagguacggagcuuaaucggcaacgaggaguacacggacuacaugccguccaugaagagauuuagacgcgaagaggaagaggccgggguccugugguga

SEQ ID NO: 24924 - RNA, 9876 nt, Artificial Sequence
  derived and/or modified CDS sequence (opt11) from DENV-2__GQ868553__SS-prME
accgcgggcgugaucgucaugcuaauacccaccgcaauggcguuccaccuuaccacgcggaacggggaaccccacaugaucgugggccgacaagaaaaggggaaaucccuccuuuucaagacugaggacggcgucaauaugugcacgcucauggccauagauuugggggagcugugugaggauaccauuacguacaagugcccccuacuacgccaaaacgagcccgaagacaucgacuguuggugcaacucaaccagcacguggguuaccuacgggaccuguacaacaacgggagagcaucgucgcgagaagcggucuguagcccuggugccucacgugggcaugggccucgagacacggaccgaaacauggaugagcuccgaaggugcuuggaagcacguucagcggauagagacauggauacuucgccacccgggcuucacuaucauggcggcgauccuugccuacaccaucgggaccacgcauuuccagagggcguugaucuucauacucuugaccgcaguggcgcccuccaugaccaugcgcuguaucgggauaucaaaccgggauuuugucgagggcguuucugggggcuccuggguggacauaguccucgaacauggaagcugcgugaccacgauggcgaagaacaaaccuacccuggauuuugaguuaaucaagaccgaagcuaagcagccagcaacacuccggaaguacugcauugaagccaagcugacgaacaccacgaccgagaguagaugcccgacgcaaggcgagcccagucugaacgaggagcaagacaagcgcuuuaucuguaagcauuccaugguggaccggggcugggggaauggcugcggcuuguucggcaagggcgguaucguuacuugcgcgauguuuaccugcaagaagaauauggaaggcaagguggugcagcccgagaaccucgaauacacgauagucaucacgccccacagcggggaagaacacgccguggguaaugacaccgggaaacacgggaaggagaucaagauuacuccucaguccagcaucacggaggcugaacugaccggauacggaacagugaccauggaaugcucuccacgaacaggccuggacuucaacgagaugguccugcuucagauggaagacaaagccugguuaguccaccggcagugguuccuagaccuaccacucccguggcugccgggcgccgacacccagggcagcaauuggauccagaaggagacgcuagugacauuuaaaaacccccacgcuaagaaacaggacgucguuguccucgggucccaggaaggagccaugcacaccgcccuuacgggggcaacagagauucaaaugagcaguggaaaccuccuguucaccggacaccugaaaugccgccuucggauggacaagcuccagcucaaagguauguccuacagcauguguaccggaaaguucaaaauagucaaagagaucgcugagacccagcacgguacgauugucauccgaguccaguacgagggugacgguucccccugcaagauucccuucgaaaucacugaccuagagaagcggcauguccucgggcgccugaucaccgugaauccgaucgugacagagaaagacucgcccgucaacauagaggcggagccacccuucggcgacaguuauaucauuaucgggguggagccggggcagcugaaauuaaacugguucaagaaggguuccuccaucgggcagauguuugaaacuaccaugcgcggcgcaaagcggauggccaucuuaggggauaccgcuugggauuucgggucgcucggaggagucuucaccucuaucgggaaagcgcuccaccaaguguucggcgcuauauacggggccgccuucagcgggguaaguuggacgaugaagauucugaucgguguaaucauaaccuggaucgggaugaacucaaggagcacgagccuguccguaagccuggugcucgucggaguggucacacucuaccugggggcaaugguccaggcagauucuggcugcguggucagcuggaagaacaaggaacucaaaugcggcagugggaucuuuauuacugacaaugugcacaccuggacggagcaguauaaguuccagcccgaaucgccuucaaagcuagcauccgcaauacagaaggcccacgaggaaggcaucugugggauccggucagugacccgcuuggagaaucucauguggaagcaaguaacgcccgagcuaaaucacauauuauccgagaacgaggucaaacuaaccaucaugacuggcgacauaaaggguauaaugcaggccgggaaacggagccugcguccacaacccaccgagcugaaguacaguuggaagacguggggcaaggccaaaaugcugagcaccgagucacacaaccagacauuccuuauugacggacccgagaccgccgagugcccgaacacaaaccgggccuggaacucacuugagguggaggacuacgguuuugggguguuuaccaccaacauuugguuaaagcugcgcgaaaaacaggacguauucugugauucuaaauugaugagcgccgccaucaaagauaacagggccguacacgccgacaugggcuacuggauagaguccgcccucaacgauaccuggaagauggaaaaggccagcuuuaucgagguuaagaguugucacuggcccaagagucauacccuauggagcaacggcgugcuggagagcgagaugaucauaccgaaaaacuucgcgggccccgugucccaacauaacuaccgaccgggcuaucacacucagacagucgggcccuggcaccuuggcaaguuagagauggacuucgacuucugcgagggaacgacaguagucgugaccgaagacugcggcaaccggggccccucacugcgcacgaccaccgcgucugggaaacucaucaccgagugguguugccggaguugcacgcugccgccgcugagguaucgaggcgaggaugggugcugguaugguauggaaauccgcccauugaaggagaaggaggaaaaucucguuaacagccugguuacugccgggcacggacagaucgacaacuucuccuuaggggugcuaggaauggcgcuguucuuagaagagaugcuucggacccggguagggacgaagcacgccauccugcucguggccgugagcuuugucacacugaucacugggaacauguccuuucgggaucugggccgcgugauggugauggucggagcuaccaugacggacgauauuggcaugggggugaccuaucucgcccuacuugccgccuuuaagguacgccccacauucgcggccgggcucuuacucaggaagcucacaucuaaggaacugaugauggcgacaaucgggaucgcccugcuuucacaaucuaccauccccgagaccaucuucgaguuaaccgaugcgcuggcccucgguaugaugguccugaaaaucgucaggaacauggaaaaauaucaguuagcugucacgaucauggccaucucaugcguuccuaacgcagugauccuccagaaugcguggaagguuagcugcacuaucuuggcggccguauccguuaguccgcugcuccuuaccaguagccaacagaaagcugauuggauuccccuggcccucacuaucaaaggacuuaaccccacagcgaucuuccugacgacgcucucucguaccucgaagaagagguccuggccguuaaacgaagccauuauggcugucggaauggugucuauccuggcauccagucuccugaagaacgauauccccaugacggggccacucguagccggcggucucuuaaccgucugcuauguguuaaccggcagaagcgcggaucucgaacuggaacgcgcagcugacguuaagugggaggaccaggccgagauaagugggagcuccccaauucuuagcaucacgaucagugaggacggaagcauguccaucaagaaugaagaggaggaacaaauccugaccauacugauccggacgggauuacucgucaucagcggaguguuuccuguauccauaccgauuaccgcagcugccugguaccugugggaggucaaaaagcagcgugccggagugcuuugggauguucccagcccgccacccgucgaaaaagcagaacucgaggauggggccuaccggauuaagcaacgcgguauacugggcuacucccaaauaggugcgggcguguacaaggaaggcaccuuucacacuauguggcacgugacgcgaggcgccguccugaugcaucgggggaagcgaauagagcccagcugggccgacguuaagaaggaccucauuuccuacggcgggggauggaaauuagagggagaguggaaagagggggaagaggugcagguccuggcacucgagcccggcaagaacccccgcgccgugcagacgaaacccgggaucuuccgcacuaacaccggcacgauaggagccgucagccuagacuucucccccggcaccaguggcucuccgauagucgacaggaaagggaagguggugggccuguaugggaacggggucgugacccggagcggcgccuacguguccgcaauugcacaaacggagaaguccaucgaggacaaucccgagaucgaggaugacauauucagaaagaaacgacucacgaucauggaucugcaccccggggccggcaagacuaagcgcuaucugccggcaaucguacgggaggccauaaaacgcgggcuucgcaccuugauacuggcaccgacccgggugguggccgcggagauggaggaggcccuucgcggauugcccauccgguaccagacgcccgccauuaaggcugagcauacggggagagagauugucgaccuuaugugucacgcgacauuuacgaugcggcugcucucaccagugagggucccgaacuauaaccuaaucaucauggacgaagcacauuucacggaccccgccaguaucgcggcccgcggcuauauuucgacacgcgucgagaugggagaggcagcagggauuuucaugaccgcuaccccgcccgguucucgggacccguucccacagagcaaugccccgauuauggacgaagaacgugaaauucccgagcggucguggaacagcggucaugaguggguaacggacuucaaaggaaagaccgugugguucgucccgucuauaaaggcggguaaugacaucgcggcgugucuucgcaaaaacggcaaaaagguaauacagcuaagccgcaagaccuucgacagcgaauacgucaagacacgugcaaaugauugggacuucguagucacgacagacauaagcgagaugggugccaacuuuaaggcugaacgggugaucgacccccgacguugcaugaagcccgucauccugaccgacggggaggagaggguaauucuggcgggccccaugccaguuacccacuccucugccgcccaacgccgaggucguauaggcagaaaccccaagaacgaaaaugaccaguacaucuacaugggggaaccgcuugagaacgaugaggacugcgcccacuggaaggaagccaagaugcuucuggauaacaucaauacgcccgaaggcaucaucccguccauguucgagccagaacgugagaagguagaugcgaucgauggggaguacagacuccgcggggaggcccggaagacguucguugaucugaugcgaagaggggacuuacccguguggcucgccuauaaagucgcggcagaggguauuaacuaugcggaucguaaauggugcuucgacggcaucaagaauaaccagauccuugaagagaacguggaagucgaaaucuggaccaaggagggggagcgaaagaaacugaagccuagauggcucgacgcgcggauuuauagcgacccccuggcccuuaaggaguuuaaagaguucgccgcgggccgcaagucccucacgcuaaaucugaucaccgaaaugggccggcucccaacguucaugacccaaaaggcucgcaacgccuuagacaaccuggcgguauuacacaccgccgaagcugggggaagggccuauaaccacgcucuuucugagcugccagagacgcucgaaacucuacuccuccugacccuguuggcaacgguuacagggggcaucuuucuguuccuaaugucugggaaggggaucggcaagaugacucucgguaugugcuguaucauaacugccucgauucugcugugguacgcgcagauucagccucacuggaucgccgccuccaucauucucgaguucuuucugauugugcuguuaauccccgagccggagaaacaacgaacgccgcaagacaaccagcugaccuacguggugauagccaucuuaacagucguggcugcgaccauggcgaacgaaaugggcuuucuugagaaaacgaagaaggaccuugggcugggaucuaucaccacucaggaaucggaaucuaauauccuagauauagaucugcggcccgccagcgcauggacccuguacgccguggcuaccaccuucgucacacccaugcucaggcauuccauugagaacucuucgguuaaugugagccuuaccgccaucgccaaucaggccacaguccugaugggacucgggaagggauggccccucuccaagauggauaucggggucccgcugcucgccaucggcuguuauagucaggugaacccgauaacccuaacggccgcgcugcuccugcugguugcacacuacgcgauaauuggcccugguuuacaggcaaaggccacccgcgaagcacaaaaacgcgccgcagcgggaaucaugaagaacccuaccguugaugggauuaccguaaucgaccuggagccgauuccguacgaccccaaauuugagaagcaguuagggcagguuauguuguugaucuugugcgucacccagguacucaugaugcgaaccacaugggcccugugcgaagcgcugacccucgccacggggcccauuuccacgcugugggagggaaacccugggcgcuucuggaacacaaccaucgccguguccauggcgaacauauuccggggcaguuaccucgcgggcgcgggguugcuauucaguaucaugaagaacacgacaaacacccggcgcggcacagguaacaucggagaaacgcugggagagaaguggaagagucggcucaacgcauuagguaagagcgaguuccaaauuuacaaaaaguccggcauccaagaaguagaccgaacccuagccaaggaggggauaaagagaggggagacugaucaccacgccguuucacgcggguccgcaaaauuacguugguucgucgagcgcaacauggugaccccggagggaaagguggucgaccugggcugcgggcgcggcggcuggagcuauuacuguggcggguugaagaauguccgggaggugaagggcuuaacaaagggcgggccaggccaugaggagccgauccccauguccaccuacggguggaauuuggugagauuacagagcggaguggacgucuucuucacuccgccagaaaagugugacacacuacucugcgauauuggcgagagcagcccgaauccaacgaucgaggcgggcagaacucuccggguccucaauuuagucgaaaauuggcugaacaacaacacucaguuuugcaucaaaguacuaaacccguacaugccgagcgugaucgaaaagauggagacacugcaacgcaaguacggcggcgcccugguucguaacccccucuccagaaacagcacucacgagauguauuggguguccaacgcgacaggcaacaucgucagcucugugaacaugaucagccgaaugcuaaucaaucguuuuaccaugaagcacaagaaggccaccuacgagccugauguggaccugggcuccggcacccggaacauuggcaucgaaagcgagauccccaacuuagacaucauagguaaaaggaucgaaaagaucaagcaggagcaugagacgucguggcauuacgaccaggaccaccccuacaagaccugggccuaccacgguaguuacgaaaccaagcaaaccggcuccgccagcuccaugguuaaugguguggugagacuccugacgaaacccugggacgucgugccgauggugacccagauggcuaugacugacacgacgccuuucgggcagcagcgaguauucaaagagaagguggacacccgcacacaggagcccaaggaggggacgaagaagcugaugaagauaacggcugaauggcucuggaaggagcuuggaaagaagaaaacgccccguauguguacgcgugaggaguucacgcggaaagugcggagcaacgccgcccugggggccaucuuuacggacgagaacaaguggaaauccgcacgggaggcugucgaagacggcagguucugggagcucguugaccgggagaggaacuuacaccuagaggggaaaugcgaaaccugugucuacaacaugaugggcaagcgggagaagaaacucggcgaguucgguaaggcaaaggggucacgagcaaucugguacauguggcugggcgcccgcuuccuagaguucgaggcgcuggguuuccucaaugaggaccacugguuuagccgugggaacucuuugagcggcgucgagggcgaaggacuccaccgacuggguuacauacugcgcgacguuggcaagaaggagggaggcgcaauguacgcagacgauacagccgggugggacacuagaaucacgcuggaggaucucaaaaaugaggaaauggugacaaaccacaugaagggugagcacaagaagcuggcggaagcgaucuuuaagcucacauaccagaacaaaguggugcgcguccaacggccgacuccccgcggcacggugauggacaucaucucccggcgcgaucaacgcggaagcggccagguugguacauacgggcugaauacauucacgaacauggaagcacagcucauucggcagauggagggugagggcaucuucaaguccauccaacaucucacugcgaccgaggagauagccgcccaaaacugguuggcgagagucgggcgggagcgcuugucuagaauggcuauaucuggugaugacugcguggugaagcccaucgaugaccgcuucgcuucggcccucacagcccugaaugacaugggcaaggugcggaaagacauccagcagugggagcccagcaggggcuggaaugacuggacacaagugccguuuuguucgcaccacuuccaugaguuaguaaugaaggaugggcggguccucguuguccccugccggaaccaggacgaacuaauaggccgcgcgcgcaucucacagggggccggcuggagccugaaggaaacugcaugccuuggcaaguccuacgcccagauguggacccuuauguauuuucaccgacgcgaccugcgucuagcugccaacgcuauauguagugcaguccccucucacugggugccgacgagccgcaccacgugguccauacaugccaaacacgaguggaugacaacggaagacaugcuggcgguguggaaucguguguggauucaggagaacccuuggauggaagauaagacgccuguugagucgugggaagaggugccauaccugggaaaacgcgaagaccaguggugcggcuccuuaaucgggcugaccagccgggcaacgugggccaagaacauacagacggcuaucaaccagguccgcagccugaucggcaacgaggaguacaccgacuacaugcccuccaugaagagauuccgaagggaagaggaggaggcaggcgugcucugguaa

SEQ ID NO: 24925 - RNA, 9876 nt, Artificial Sequence
  derived and/or modified CDS sequence (opt11) from DENV-2__GQ868554__SS-prME
accgccggcgugauugucaugcugauccccaccgccauggcguuucaccucaccacccgcaacggggagccccacaugaucguuggccggcaggagaaggggaaaucccugcuguucaagacugaagacggugugaacaugugcacccucauggccaucgaccugggagagcugugcgaggacaccaucaccuauaaauguccccuccugcggcaaaacgagcccgaagacaucgacugcuggugcaacagcaccagcaccugggucaccuacgggaccuguaccaccacgggagaacacagacgcgagaagcgguccguggcccugguuccccacguagggaugggcuuagagacccggaccgaaaccuggaugagcuccgagggggcauggaagcacgugcaacggauugagacauggauccuucgacacccaggcuucaccaucauggccgcgauccuggccuacaccaucgggaccacgcacuuccagcgggcccucaucuucauccugcugacggcaguggcgcccagcaugacaaugcgcugcaucggcaucaguaaccgagacuuugucgagggcguguccgggggcucuuggguggacauugucuuagagcacgggagcugcgugaccacgauggccaagaacaagcccaccuuagauuucgaguugauaaaaacugaggccaagcagccugccaccuugcgcaaguacugcaucgaggccaaguuaacgaacaccaccacggagucccguugcccgacucagggggagcccagccugaacgaggagcaggacaaacgcuucauuugcaaacacuccaugguggaccggggcugggggaacggcugcgggcuguuugggaagggcgggaucgugacgugcgcgauguucacgugcaagaagaacauggaggguaaggucgugcagcccgagaaccuggaguacaccaucgucaucacgccccacagcggggaagagcaugccgugggaaacgacaccgggaagcacggaaaggagaucaagaucacaccgcaguccagcaucacagaggccgagcugacaggguacggcacggugaccauggagugcucaccccggaccggccucgacuucaacgaaaugguccugcugcagauggaggacaaggccuggcugguccaccggcagugguuccuggaccugccccuacccugguugccuggggccgacacccagggcagcaauuggauccagaaggaaacauuggugacuuucaagaacccccacgcgaagaagcaggauguaguggucuuagggucucaagagggcgccaugcacaccgcccugaccggggccaccgagauccagaugagcagcggcaaccucuuauuuaccggccaccugaagugccgccugcggauggacaaacuccagcugaaggggaugaguuauagcaugugcaccggcaaauucaagaucgugaaggaaauagccgagacccagcacgggacaauugugauccguguccaguacgagggcgauggcucccccugcaagauccccuucgagaucaccgaucuagagaagcgucacgugcucgggcgccucaucaccgugaacccgaucguuaucgagaaggacucacccgugaacaucgaagcggagccacccuucggcgauucguacauuaucaucgguguggagccgggccagcugaagcucaacugguucaagaagggaaguuccauaggccagauguucgagaccaccaugcgcggcgccaagagaauggccauccugggggacaccgccugggacuucggcagucucggcggggucuucaccuccauugggaaggcccuccaccagguauucggggcgaucuacggcgcggccuucagcggggugucauggaccaugaagauccuuaucggggucgugaucaccuggauugggaugaacuccagauccaccagccuguccgugagccugguccuugugggcguggucacccucuaccugggcgccaugguucaggccgacaguggcugcgugguuucauggaagaacaaagagcucaagugcgguaguggaauauuuaucaccgacaacguucacacguggaccgagcaguacaaguuccagcccgagagccccuccaagcuggccuccgccauccagaaggcgcacgaggaaggcauaugcgggaucaggagcguuacccgccuggagaaccugauguggaaacagaucaccccggagcugaaccacauccucucugagaacgaggucaagcucacgaucaugaccggcgauacuaaggggaucaugcaggccgggaagcguagcuugcgcccgcagcccacagaacugaaguacuccuggaagacguggggcaaggcgaagauguugagcaccgagucccacaaccagaccuuccucaucgacgggcccgagacuguggagugcccaaacacgaaccgggccuggaacucccuggagguggaggacuacggcuucggugucuucaccaccaacaucuggcucaaacugcgcgagaagcaggacguguucugcgacuccaaauugaugagcgccgccauuaaggacaaccgggccgugcacgcggacaugggcuacuggaucgaguccgcccucaacgacacauggaaaauggagaaggcuagcuucaucgagguaaaguccugucacuggcccaaaagccauacccugugguccaacggugugcuugagagcgagaugaucauccccaagaacuuugccgggccagugucccagcacaacuaucgcccgggcuaccacacccagaccgccgggcccuggcaccucgggaagcucgagauggauuucgacuucugcgaggggaccaccgucguggugacggaggauugcggcaaccggggccccagccugcgcaccaccaccgcgagcgggaagcucaucacggaguggugcugccguuccuguacccugcccccgcugcgcuaccguggggaagaugggugcugguacggcauggaaauccgcccccucaaagagaaggaggagaaccugguaaacagucuggugacugccgggcacggccagaucgacaacuucucccucggcgugcuggggauggccuuauuccucgaggagaugcuucggacccgcgucggcacgaagcacgccauccugcucgucgcggugagcuucgucacgcugaucaccgggaacauguccuuccgggaccugggccgcgugauggugauggucggggccacgaugacggacgacaucggcaugggcgugaccuaccucgcucuguuggccgccuucaaagugcgcccuacauuugcggccgggcuccuucugcggaagcucaccagcaaggagcugaugauggccacgaucggcaucacgcuguugucccaaagcaccaucccugagaccauccucgagcugacggacgcucucgcccuggggaugaugguccugaagaucgugcgcaacauggagaaguaccaguuagcggugacaauuauggccaucuccugugucccgaacgccgugauucugcggaacgcuuggaaggucagcuguacaauccuggccgcgguuuccgugagcccccuccugcugaccucgagccagcagaaggccgacuggauccccuuggcgcugacgaucaagggccugaaccccaccgccauuuuccucacuacccuaucccgcacgucaaagaagcgauccuggccgcugaacgaggcgaucauggccgucggcaugguaagcauccucgccuccagcuuacugaagaacgacaucccuaugaccgguccccucguggccggggggcugcugaccgucugcuacgugcucaccggccgcagcgcugaccuggagcuggagcgggcggcggacgugaagugggaggaccaggccgagaucagcgggagcucccccauccucagcaucacgaucuccgaagacggaagcauguccaucaagaacgaagaagaggagcagacccugaccauucugauccguaccggccuccuggucaucucagggguguucccgguguccaucccaaucaccgccgccgccugguaccugugggaagucaagaagcagcgggccggcguguugugggacgugcccagcccgccgcccgucgggaaggccgagcuggaggacggcgccuaucgcaucaagcagcgggggauccugggcuacucccagaucggcgcggggguauacaaggagggaacguuucauaccauguggcacgugacgcgcggggcgguccucaugcaccggggcaagcgcaucgagccuagcugggccgacgucaagaaagauuugaucuccuacggaggcggcuggaaacuggaaggagaguggaaggagggcgaggaggugcagguccucgcccuggagccagggaaaaauccccgggccgugcagaccaagcccggaauauucaagacgaacaccgggaccaucggugccgugagccuggacuucucccccggaaccucaggguccccuaucgucgaccgcaagggcaaggugguggggcucuacggcaacggcgucgugacgcgaagcggggccuacguguccgccaucgcccagaccgagaaguccaucgaggacaauccggagaucgaggacgacaucuuccgcaagaagcggcugacuaucauggaccugcaccccggcgccgggaagaccaagcgcuaccuccccgcuaucguccgggaggcaaucaagcggggccugcgcacgcuaauccuggccccgacccgggugguggccgcagagauggaggaggcgcuacgcgggcugcccauccgguaucagacccccgccauuaaggccgagcacaccggccgcgaaaucgucgaccugaugugccacgccacguucaccaugcggcuccugagccccgugcgcgugccgaacuacaaccugaucaucauggacgaagcccacuucaccgaccccgcguccaucgcagcccggggcuacaucagcacccgcgucgagaugggggaggccgccgggauauucaugacggcgacuccaccagggucccgggacccguucccccagagcaacgcccccaucauggacgaggagcgggagauacccgagcggucguggaacagcggccacgagugggugaccgacuucaaggggaagacugugugguucgucccguccaucaaggccggcaacgauaucgccgcgugccuccgcaaaaauggcaagaaggugauccagcucagccggaagacguucgacuccgaguacgugaagacccgcgccaacgacugggacuucguggugaccaccgacaucucggaaaugggcgccaacuucaaggccgagcgugugaucgacccccgccggugcaugaagcccgucauccugacggacggcgaggagcgcgugauccucgccgggccaaugccggugacccacuccucagcggcccagcggcgcggacgcaucgggcggaaccccaagaacgaaaacgaucaguacaucuacaugggcgagccccuugagaacgacgaggacugcgcccacuggaaggaggcuaagaugcuacucgacaacaucaacacccccgagggcaucaucccguccauguucgagcccgaacgagaaaaggucgacgccaucgacggggaauaucgacugcgcggcgaggcgcggaagacuuuuguggaccugaugcggcgcggugaccuccccguuuggcuggcguacaaggucgccgccgaggguaucaacuaugcagaccgcaagugguguuuugaugggaucaagaacaaccagauccuggaggagaacguggaagucgagaucuggacgaaggaaggugagcggaaaaagcucaagccgcgguggcucgacgcgcggaucuacagcgacccccuggcccucaaggaguuuaaggaguucgccgccggcaggaagucccugacccugaaccucaucaccgagauggggcggcuucccaccuucaugacgcagaaggcgcgcaaugcccuggacaaccucgccgugcugcacaccgccgaggccggcgggcgggcguacaaucacgcccugagcgagcucccagagacccuggagacccugcuccugcugacgcuccuggccaccgugaccggcggcaucuuccucuuccucauguccgggaagggcaucgggaagaugacccugggcaugugcugcaucaucaccgcuagcguccugcucugguacgcccaaauccagccgcauuggauagcggccaguaucauccuggaguucuuccucaucgugcucuuaauccccgagcccgagaaacagcgcacgccccaggacaaccagcuaaccuauguggucaucgcuauccuuaccgugguggccgccaccauggcgaacgagaugggguuccuggagaagacgaagaaggaccugggccucggcaguaucaccacucaggagagugaguccaacauccuggacaucgaccugcggccggccucagccuggacccuuuacgccgucgcgacgaccuucgugacccccaugcugagacacuccaucgagaacagcagugugaaugucagcuuaacggcgaucgccaaucaagccacggugcucaugggacugggcaagggcuggccccuguccaagauggauaucggcgugccccuccuggccaucgggugcuacucccaggucaacccgaucacccugaccgccgcccuccugcugcucguggcacacuacgccauaauagggcccggccugcaggccaaggcaacacgggaggcccagaagcgcgccgccgcagggauuaugaagaaccccacuguggacggcauaaccgucaucgaucuggagcccaucccguacgaccccaaguucgagaagcaguuagggcaagucaugcugcugauccucugcgugacccaggugcugaugaugcggacaacgugggcgcugugcgaggcuuuaacccuggccaccgggcccaucuccaccuuaugggagggcaaccccggccgcuucuggaacacgaccaucgccgugagcauggccaacauauuccgcggcaguuaccucgcgggggccggccugcuguucagcauuaugaagaacaccaccaauacgcggcgcgggaccggcaacaucggcgagacccuuggugaaaaguggaagucccgguugaacgcgcugggaaaaagcgaguuccagaucuauaagaaguccgggauccaggagguggaucgcacccucgcgaaggagggcaucaagcgcggggagacggaccaucacgcggucagccgcggcuccgcgaagcugcgaugguucguugagcgcaacauggugaccccagagggcaaggucguggaccuggggugcggccgcgggggcuggagcuacuacugcgggggccucaagaacgugcgcgaggugaagggcuugaccaaaggcggccccgggcacgaggagcccauacccauguccaccuacggcuggaacuuaguacggcuccagagcgggguagacgucuucuucacgccgcccgagaaaugcgacacccugcugugcgacaucggcgagagcucccccaacccgaccaucgaggccggacgcacccuccgaguguugaaccugguggagaauuggcucaacaacaacacccaguucugcaucaagguccugaacccauacaugcccagcgugaucgagaagauggagacgcugcagcgcaaguacgguggcgcucucgugcggaacccccugucccgaaauagcacccacgagauguacugggucuccaaugccaccgggaacaucgugagcuccgugaauaugaucagccguaugcugaucaaccgcuucaccaugaaacacaagaaggcuacguacgagccggacgucgaccugggcuccggaacccggaauaucggcaucgagagcgagauucccaaccucgauaucaucggcaagcguaucgagaagaucaaacaggagcacgagaccaguuggcauuacgaccaggaccaucccuacaagaccugggcguaccacgggagcuacgagacgaaacagaccggcucagcgagcuccauggugaacggggucguccgccugcugaccaaacccugggacgugguuccgauggugacccagauggccaugacugacacaacgcccuucggucagcagcgggucuucaaggagaagguagacacccgcacgcaagagcccaaggagggcaccaagaagcucaugagaaucaccgccgaguggcuguggaaggagcuggggaagaagaagacuccccggaugugcacgagggaggaguucacccgcaagguccggagcaacgcggcgcucggcgcaaucuuuaccgacgagaacaaguggaaguccgcccgcgaggccguggaggaugggcgguucugggaguuggucgaccgcgaacgcaaucugcaccucgagggcaagugcgaaaccugcguguacaacaugauggggaagcgcgagaagaaguuaggcgaauucggcaaggcgaaggggagccgggccaucugguacauguggcugggcgcccgcuuccucgaguucgaggcgcugggcuuccugaacgaggaccacugguuuagccggggcaacagccucagcgggguugagggagagggacugcaccgccugggguacauccuccgagacgucggaaaaaaggagggcggagcgauguacgccgacgacacggccgguugggacacccguaucaccuuggaggaucugaagaacgaggagauggucaccaaccacaugaagggggagcauaagaagcucgccgaagccaucuucaagcugacguaccagaacaaggugguccggguccagcgaccaacgccccggggcaccgugauggacaucaucucccgccgcgaccagcgggggagcggccagguagggacguacggccugaacacauucaccaauauggaggcgcaacucaucaggcagauggagggcgaggguaucuucaaauccauccagcaccugaccgcaaccgaggagaucgccguucagaacuggcuggccagagugggcagagagcggcuaucccgcauggccauuuccggggaugacugcgucgugaagcccaucgacgacagauucgcgagcgcccugacggcccugaacgacaugggaaaggugcgaaaggacauccagcagugggagcccucccggggguggaacgacuggacccaggucccguucuguagccaccacuuccacgagcucgugaugaaggacggccgcguguuagucgugccaugccggaaccaagacgagcucaucggccgcgccagaaucagccagggggccggcuggagccucaaggaaaccgcgugccuggggaaguccuacgcccagauguggacgcugauguacuuccaccgccgggaccuccgccuggccgccaacgccauaugcagcgcgguucccucucacuggguccccaccagccggacgaccugguccauccacgcgaagcacgaguggaugaccaccgaggauauguuggccguguggaaccguguauggauccaggagaacccauggauggaggacaagacgcccgucgaaagcugggaggaggugcccuaccucggcaagcgggaggaccaguggugcgggagucuuauaggccugacaagucgcgccaccugggcgaagaacauccagacggcaaucaaucaggugcgcucccucaucggcaacgaggaguacacggacuacaugcccuccaugaagcgguuccgccgagaggaggaggaggccgggguccugugguga

SEQ ID NO: 24926 - RNA, 9876 nt, Artificial Sequence
  derived and/or modified CDS sequence (opt11) from DENV-2__GQ868555__SS-prME
accgccgguguuaucgucaugcugauccccaccgccaucgcguuccacuugaccacucgcaacggggagccccacaugauuguggggcgccaggagaaggguaagucccugcuguucaagacggaggacggcguuaacauguguacccucauggcgaucgaccugggggagcugugcgaggacaccauuacauauaagugcccccuacugcgccagaacgagccagaagacaucgacugcuggugcaacagcaccaguaccugggucaccuaugggacguguaccaccacaggcgagcaccgucgcgagaagcgguccguggcccuggugccccacguuggaaugggcuuagagacgcgaaccgagaccuggaugagcuccgaaggggccuggaagcacguacagcggaucgagaccuggauccugcgccacccuggauucaccauuauggcagcaauacuggcuuacaccaucgguaccacccacuuccagcgggcgcuuaucuucauucuguuaacagccguggcgcccagcaugaccaugcgcuguaucggaauuucaaacagagacuucguggaaggggugucggggggcucguggguggacauuguccuugagcaugggagcugcgugaccaccauggccaaaaauaagcccacacuggacuucgagcuuauuaaaacggaagccaagcagcccgcaacccucaggaaguacuguaucgaggccaagcugaccaacaccaccaccgagagucggugcccgacccaaggcgagcccagccuuaaugaggagcaggacaagagguucaucugcaaacacuccaugguggacagaggcugggggaauggcugcggccuauucggcaagggcgggaucgugacaugcgcgauguucacgugcaagaagaauauggagggcaaagugguucaaccugaaaaucuggaauacacaaucgucaucacgccccacagcggggaggagcacgccguggggaaugacaccgggaaacauggcaaggagauaaagaucaccccucaguccaguaucaccgaggccgaacucaccggguacggcacgguuaccauggaaugcagccccaggacaggucucgacuucaacgagauggugcuguuacagauggaggacaaggccuggcucgugcaucggcagugguuccuggaccugccccuccccuggcuaccgggugcugacacacaagggagcaauuggauucagaaagaaacguuagugacguucaagaacccccacgccaagaagcaagacgucgugguguuggggucccaggagggagccaugcacaccgcccugaccggggcgacggagauccaaaugagcagcggcaaccuccuguucaccgggcaccugaagugccgccugcggauggacaaacuacaguuaaaaggcauguccuacagcaugugcaccggaaaguucaagaucgugaaggagaucgccgagacacagcacggaacgaucgugauccgggugcaguacgagggcgacggcuccccgugcaagauccccuucgaaaucacugaccuggagaaacggcacguacucggucgccugaucaccgugaacccaaucgucacagagaaggacagcccugugaauaucgaggcagagccgcccuucggcgauuccuauaucaucaucgguguagagccaggccagcugaagcuaaacugguucaagaaggggagcagcaucgggcagauguucgagacaaccaugcgcggugccaagcggauggccauucugggcgacaccgcaugggauuucggcucauugggcgggguauuuaccuccaucggaaaggcgcuccaccaaguguucggggcaaucuauggcgccgccuucagcggugugucauggacgaugaagauccugaucggcgucgugauaaccuggauugggaugaauucgcgcuccaccagccugagugucagccuaguccucgugggcgugguuacccuguaccugggugccaugguucaggcggacagcggcugcguagucagcuggaagaacaaggaacucaaaugcggaucugggauauucaucacagacaacgugcauacuuggaccgaacaauacaaguuucagcccgagagccccagcaagcuggccagugccauccagaaggcccacgaggagggcaucugugggauccguagcgugacccgccuggaaaaucucauguggaagcaaaucacgccggaguuaaaucauauucuguccgagaacgaggucaagcucaccaucaugacaggcgauacuaagggaaucaugcaggcgggaaagcggagcuugcggccgcagcccacggagcugaaguauucuuggaagacguggggcaaagcuaagaugcucuccacagaaagucacaaccagaccuuccucaucgacggacccgaaacggcagaguguccaaacacgaacagggccuggaauagcuuagagguggaggacuauggcuucgggguguucaccaccaauaucuggcuaaagcugcgcgagaagcaggacgucuucugcgauuccaagcugaugagcgccgccaucaaggacaaccgggcagugcacgccgacaugggauacuggaucgaguccgcccugaacgauaccuggaagauggaaaaagccucguuuaucgaggugaagagcugucacuggcccaaaucgcacacgcucuggaguaacggcguccuugagucagagaugaucaucccaaaaaacuucgcggggcccgugucccaacacaacuaucgcccgggcuaccacacccagaccgcgggaccuuggcaccucgggaaacuggagauggauuucgaccugugcgagggaaccacgguggucgugacagaagacugcggaaacagagggcccucgcuccguacuaccacggccagcggcaaacugaucaccgagugguguugccgguccugcacccugcccccgcuucgcuaccggggcgaggacggguguugguauggcauggagauacgcccccugaaggagaaggaggaaaaucuggugaacucgcucgucacagccggacacggccagauagacaacuucucccuggguguacuggggauggcccucuuccuggaggagaugcugcggacacgcguaggcaccaagcaugcgauccucuuagucgcggugagcuucgugacacugaucaccgggaacauguccuuuagagaccucggcagagucaugguaauggugggggcaacgaugaccgacgacaucggcaugggcgucacguaccuggcccuguuggccgcauucaaggugcgcccuaccuucgccgccggucugcugcuccgcaaacugacgaguaaggagcugaugauggcgacaaucggcaucgcccuccucucccagaguaccauccccgagaccauccuggagcugaccgacgcccuggcacugggcaugauggugcucaagaucguccgcaacauggaaaaauaccaguuggccguuaccauuauggcaaucuccugugugccgaacgccgucauccuucggaacgcguggaaggugucgugcaccaucuuggccgcagucuccgugagcccacuauugcugaccucaagccagcagaaggccgauuggauaccacuggcccuuacgaucaaaggucucaaccccaccgccaucuuccugaccacgcuuucccgcacgucaaaaaaacggaguuggccgcucaacgaggccaucauggcugugggcaugguuagcaucuuagcguccagccugcucaagaaugauaucccgaugaccgggccccugguugcgggagggcuucucacaguauguuacguccuaaccggccgcagcgcugaccuggaauuagagcgugcagccgaagugaagugggaggaccaggccgagaucuccggguccucaccgauccugagcauuacgaucuccgaggauggcagcauguccaucaaaaacgaggaggaggagcagacacugacuauccucauccgcaccggccuacucgugaucagcgguguuuuuccgguaaguauacccaucacugcagcugcaugguaucucugggagguaaagaagcagagggccgggguucugugggacguucccagcccuccaccggucgggaaggcggagcuugaggagggcgcguaccgcaucaagcagcggggaauccucggcuauucgcagauuggcgcuggagucuauaaggaagggacguuccacaccauguggcaugucacccguggggccgugcugaugcaucgcgggaagcgcaucgagcccagcugggccgacgucaagaaggaccuuaucaguuacgggggcggcuggaagcuugaaggggaauggaaggagggcgaggagguccaggugcuggcccuugagcccgggaagaacccccgcgcgguccagaccaagcccgggauauucaagacgaacaccgggaccaucggugccguaucccucgacuucucccccggcaccagcgggucccccauuguggacagaaaaggcaaggucgugggucuguacggaaacggaguugucacgcgcagcggggcauauguguccgccaucgcgcagaccgaaaagagcauugaggacaaccccgagauugaggacgacaucuuucgaaagaagcggcugaccauuauggaucuccaccccggggccgguaaaaccaagcgcuaccugccggccauugugcgggaggcuaucaagcggggucugcgaacucugaucuuggccccgacccgggugguagcggccgaaauggaggaggcccugcgcggauuaccgaucagguaccagacccccgccauaaaggccgagcacacugggcgcgagaucguggaccuuaugugccaugcgacuuuuaccaugcggcugcugagccccguccgugugcccaacuacaaccucauaauaauggacgaggcccauuucacugacccagcauccaucgccgcccggggcuacauuagcaccagaguggagaugggggaggcggccggcaucuucaugacggcuacuccgcccgguucucgggacccguucccucagucuaacgcacccauuauggaugaggaaagagagauccccgagcggucauggaacagcggucaugagugggucaccgacuucaagggcaagaccgugugguucgugccgucaauaaaggccgggaaugauaucgccgccugucugcggaagaacggcaagaaggucauccaacugagucggaagacuuuugacucggaguacgugaaaacccgcgccaacgacugggacuuuguggugaccaccgacaucagcgagaugggggccaacuuuaaagcggaacgaguuaucgaccccagacguugcaugaagcccguaauucuaacggacggugaggagcgcgucauacuggccgggcccaugccggugacccacuccagcgcagcccagcggcgcggcaggauaggucggaaccccaaaaacgaaaacgaccaguacauuuacaugggugagccgcuggaaaacgaugaggacugcgcacacuggaaagaggcaaagaugcuauuagauaacaucaacacccccgaagggaucaucccuuccauguuugagccagaacgugagaagguggacgcgaucgacggcgaauacagacugcgcggcgaggcccggaagaccuucgucgaccucaugcgccgaggugaccugcccguguggcuugccuacaagguggccgcggagggcauuaacuacgcagacagaaaauggugcuucgaugguauaaagaacaaccagauccuggaggagaacgucgagguggagaucuggacgaaggagggcgaaagaaagaaguuaaaaccgcgcuggcucgaugcccggaucuacagugacccccucgcccugaaggaguucaaagaauucgcagccggccgcaagucccugacauuaaaccuaauuacugagaugggucgucugcccacuuuuaugacgcaaaaagcccgcaacgcucuggacaaccuggcaguucuacacacggcggaggccggagggcgggccuacaaccacgcacuuagcgagcugcccgagacccuugagacucuccugcugcucacgcuauuggcgaccgucaccggcggcaucuuccucuuccuuauguccgggaagggcauagggaagaugacccugggcaugugcugcaucaucacagcgagcgugcuccugugguacgcccagauccaaccgcacuggaucgccgcgucuaucauacuggaauuuuuccuuaucguuuuacuaauccccgaaccagaaaagcagcgcacgccccaggacaaccagcucaccuacguagugauagccauccuuaccgucguggcggccaccauggcgaaugaaaugggguuucuggagaaaacgaaaaaagaccucggguuggguagcauuaccacccaggagagcgaauccaacauccuagacaucgauuugaggccggccagcgccuggacccuguacgccguggccacuacuuucgugacccccaugcugaggcacuccauagagaacagcucgguaaacgugagucuaaccgccaucgcuaaccaagcgacuguccuuauggggcugggcaagggguggcccuuguccaagauggacauuggcgugccgcugcuggcuaucgggugcuacucgcaggugaaccccaucacgcucaccgccgcacugcugcuccugguagcccacuacgcgauaaucgggcccggccugcaggccaaagccacgcgggaggcccagaaacgcgccgccgccgggaucaugaagaacccaacgguggacggcaucaccgugaucgauuuggagcccaucccguacgaccccaaguucgagaagcagcuugggcaggucaugcugcucauccucugcguuacccagguguugaugaugcggacuaccugggcccucugcgaagcccucacucuagccaccggcccgaucuccacgcuaugggaggggaaccccggccgcuuuuggaacacuaccauugcggucagcauggccaacauauuccgagggaguuaucuugcgggagccggccuacuguucagcaucaugaaaaacaccacgaacacgcggcgcggaaccggcaauaucggggaaacccugggggagaaguggaagucccggcuaaaugccuuaggaaagagcgaguuccagaucuacaagaagagugggauacaggaggucgaccgcacucuggccaaagaaggcaucaagcgcggggagacugaucaccacgccgugucacgcggcucugccaagcugcggugguucgucgagcgcaauaugguuaccccggagggaaagguggucgacuuagguugcggucgcgggggcuggucguauuacugcgguggacugaagaacgugcgcgagguuaagggccugaccaagggcggccccggucacgaggaacccauacccauguccaccuacgguuggaaccucguucgacuccaaagcggggucgacguguucuucacgccgcccgagaagugugauacccugcugugcgacauaggggagagcuccccuaaucccacgaucgaggcaggccgcacacuucggguccugaaccuuguugagaacuggcugaacaauaacacccaguucugcaucaagguguuaaacccguacaugcccagcgucauugagaagauggagacgcuccaaaggaaguacgguggcgccuuggugaggaacccucugagucguaauucgacacacgagauguacuggguguccaacgcgaccgggaacaucgucagcagcgugaacaugaucagccgaauguuaaucaaucgcuucacaaugaaacacaagaaagccacguacgagccggacguugaccuaggcuccgggacccggaacaucggcaucgagucggaaaucccgaauuuggacaucauaggaaagcgcaucgagaaaaucaagcaagagcacgagacauccuggcacuaugaccaggaccaccccuacaagaccugggccuaccacgggagcuacgagacuaagcagaccggcuccgccuccuccauggucaacgggguggugcguuuauugaccaagccuugggacguugugccgauggugacacaaauggcgaugacggacaccaccccguucggucagcagagagucuuuaaggagaagguugauacccguacgcaggagcccaaggaggguaccaagaagcuaaugaagauaaccgccgagugguuguggaaggagcuaggcaagaagaagacaccccggaugugcacgcgggaagaguucacccggaaggucaggagcaacgccgcucuaggggcuauuuucaccgacgagaacaaguggaaaucugcgcgggaagcuguugaagacgggcgcuucugggagcugguugaccgggagcgcaaccuccaucuggagggaaagugcgagacgugcguuuauaacaugauggggaagcgugaaaagaagcugggcgaguucggcaaagccaaagggagccgcgcgaucugguacauguggcuuggagcgcgcuuucuggaguucgaagcccugggguuccuaaacgaggaccauugguuuucccgcggcaauagccugucagggguugagggcgagggccugcaccgguuaggguacauccugcgcgacguguccaagaaagagggcggggccauguacgcugacgacacagccgggugggauaccagaaucacccuggaggaccuuaagaacgaagaaauggucacuaaccacaugaaaggugagcacaaaaagcuggcggaggccaucuucaaguugacauaccagaauaaaguggucagaguucagcgaccuacgccccgggggaccgugauggacaucaucagccggcgcgaccaacggggcuccggccaagugggcaccuauggccuaaacacuuucaccaacaucgaggcccagcugauccggcagauggaaggcgagggcaucuucaaaagcauucagcaccugaccgccaccgaagagaucgcgguucagaacuggcucgcccgcgugggucgggagcgccuuucccggauggccaucagcggcgaugacugugucgucaagcccaucgacgaccgcuucgccuccgcccugacugcucucaacgacauggggaagguucggaaggacauccagcaaugggagcccucccggggguggaacgacuggacacagguucccuucuguucucaccacuuucacgaacuugucaugaaagacgggcgcgugcuggugguccccugccguaaucaggaugaauugaucgggcgggcccgaauaagccagggagcgggauggucccugaaggaaaccgcuugccuggguaagagcuaugcccagauguggacucucauguacuuccaccggcgcgaccuucgguuggccgcgaacgcuauauguuccgcaguucccagccauuggguacccacauccagaacuaccuggagcauucacgccaagcacgaguggaugaccaccgaggacaugcucgcgguuuggaaccggguguggauccaagagaauccauggauggaggauaaaacacccguggaauccugggaagagguacccuaccuggggaagcgcgaggaucaguggugcggcucccugaucggguugaccagccgggcuaccugggccaagaacauacagaccgccauaaaccaggugcguuccuuaaucgguaacgaggaguacacggauuacaugcccagcaugaagcgcuucaggcgcgaggaggaggaggccggcgugcuuugguga

SEQ ID NO: 24927 - RNA, 9876 nt, Artificial Sequence
  derived and/or modified CDS sequence (opt11) from DENV-2__GQ868556__SS-prME
accgccggagugaucgucaugcugauccccaccgcuauggcuuuccaccucacaacccgcaacggggaaccccacaugaucgugggccggcaggaaaaggggaagucacugcuguuuaagaccgaggacggcgugaacaugugcacccucauggcuaucgaucugggggagcugugcgaggacaccaucaccuauaaguguccccuccuucggcagaacgagcccgaggacaucgacugcuggugcaacagcaccucgacgugggucacauacgggaccuguaccaccacuggcgagcaccgacgggagaagcgguccguggcccuggugccccauguggggaugggccucgaaacccgcaccgagaccuggaugagcuccgagggggccuggaagcacguccagcggaucgagaccuggauccuucgccacccgggcuucaccauuauggccgcgaucuuggccuacaccaucgggaccacccacuuccaacgugcccucauuuucauccugcugacggccguggcucccagcaugaccaugaggugcaucggcaucuccaaccgggacuucgucgagggaguuagcgguggguccuggguggacauaguccuugagcacgggagcugcgucaccacaauggccaagaacaagcccacacuggauuucgagcugauuaagaccgaggccaagcaacccgccacccuccgcaaguauugcauugaggccaagcugacuaacacaaccaccgagagucggugcccgacgcagggcgagcccucccugaacgaggaacaagacaagcgcuucaucugcaagcacucgaugguggaccgagguuggggcaacggcugcgggcuguucggcaagggcgggauaguaaccugcgcgauguucacgugcaagaagaacauggagggcaagguggugcagccugagaaccuggaguacaccauagucauaacgccccacagcggagaggagcacgcgguuggcaacgauacggggaaacacggcaaggagaucaagaucacuccucaguccagcaucaccgaagccgagcugaccggguacggcacggugaccauggaguguagcccgcggacuggccucgacuucaacgagaugguucuucugcagauggaagacaaggcguggcuugugcaccggcagugguuccuggaucugcccuugcccugguuacccggggccgacacccagggcucaaacuggauccaaaaggagacccuggugaccuucaagaacccccaugcgaagaaacaggacgucgugguccucgggucccaagagggcgccaugcauacggcacucaccggggccacggagauccagaugagcagcggcaaccuccuguucacaggccaccugaagugccgccuccggauggacaagcuccagcuaaaggggauguccuacucaaugugcaccggcaaguucaagaucgugaaggagaucgccgagacacaacacgggacgaucgugauccgcguccaguacgagggcgacggcucccccugcaaaauccccuucgagaucaccgaccuggagaagcggcacgugcucgggcgccuaaucaccguuaacccgaucgucaucgagaaggacagccccgugaacaucgaggcugagccucccuucggagacuccuacauaaucauagggguggagccgggacagcugaagcucaauugguucaagaaagggagcuccaucggccagauguucgagaccacgaugcgcggcgccaaaagaauggcgauccugggcgacacugccugggauuuuggcucguugggcggggucuucaccucaaucgggaaggcccuccaccaaguguucggagcaaucuacggcgccgcuuucucgggcguuuccuggacuaugaagauucucauuggcgucgugaucacuuggaucggaaugaacucccgcuccaccagccuuuccgugagccuuguccuugugggcguggucacccuguaccugggugccauggugcaagcagacucuggcuguguggucagcuggaagaacaaggagcucaaaugcggcuccgggaucuucaucaccgacaacguucacacguggaccgagcaguacaaguuccagccagagagccccuccaagcuggccuccgccauccagaaggcccacgaggagggcaucugcgguauccguagcgucacccgccucgagaaucucauguggaagcagaucacccccgagcugaaccacauacuguccgagaacgaggucaagcucacgaucaugacgggcgacaccaaggggauuaugcaggcgggcaagcggagccugcgaccucaacccaccgagcugaaguacagcuggaagacguggggcaaggcgaagaugcucagcacugagagucacaaccagaccuuccucauagaugggcccgagaccgccgagugccccaacacgaaucgggcguggaacagucuggaaguggaggacuacggcuucgggguguucacuacuaacaucugguuaaagcugagagaaaagcaggacguuuucugcgacuccaaauugaugagcgcugccaucaaggacaaucgggcggugcaugccgacaugggcuacuggaucgaguccgccuuaaacgauaccuggaagauggagaaagcgagcuucaucgaggugaaguccugccacuggcccaagucccacacccugugguccaacggaguccuugagucagaaaugauaauucccaagaacuucgccgggcccguaucccaacacaacuaccgcccgggcuaccacacgcagacagcggguccauggcaccucggcaaauuggaaauggacuucgacuucugcgaagguaccacgguggucgugacggaggacugugggaaucggggccccucccugaggacgacuaccgccucagggaagcucaucacggaguggugcugccgguccugcacccugcccccgcuucgcuaccggggcgaggacgggugcugguacggcauggagauccgcccccucaaagagaaggaggagaaccugguaaauucacugguaaccgccgggcacggccagaucgacaacuucucccucggcgugcuggggauggcccuguuccucgaagagaugcugcggacccgcgucggcacgaaacacgcgauucugcucguugcggugagcuucgugaccuugaucaccgggaacauguccuuucgggaccugggccgagucauggugauggugggagccaccaugacugaugacaucggcaugggcgucaccuacuuggccuuacuggcagcuuucaaggugcguccgaccuucgccgccgggcuccugcugcggaagcucaccucgaaggagcugaugauggccacgauaggcaucacauuacucucucaaagcacaauccccgagaccauccuggagcugacggacgcccucgcccuggggaugaugguccugaagaucguacguaacauggaaaaguaccagcucgccgugacuaucauggccaucuccugcguccccaacgccgucauccugcggaacgcuuggaaggugaguuguacaauccuggccgccgucucugugagcccccuccugcuaaccucuagccagcagaaagccgacuggauuccccucgcccugacaaucaaggggcugaaucccaccgcgaucuuucucaccacccugaguaggacaagcaagaagcgguccuggccgcugaacgaagcgauaauggccguggguauggucucaaucuuggccuccagcuuauugaagaacgacauccccaugacugggccccucguggcagggggccugcugaccguguguuacguccucaccggccgaagcgcggaccuggagcucgaacgggcggccgacgugaagugggaagaccaggccgagauaagcgggagcuccccuauccucagcaucacaaucuccgaggacgguagcauguccauuaagaacgaggaggaagaacagacccugacuauccugauucgcaccggccucuuagucaucagcggggucuuuccgguguccauucccauaaccgcagcggcaugguaccugugggaggugaagaaacagcgggccggcguucuuugggacguccccucgccgccaccgguuggaaaagccgagcuggaggacggugccuaccgcaucaagcagcggggcauccuggguuacagucagauaggcgcggggguauacaaggaagggacguuucacaccauguggcaugugaccagaggggccgugcucaugcaccgaggcaaacgcaucgagcccagcugggcggacguaaagaaggaccugaucuccuacgggggcggcuggaagcuggagggcgaguggaaggagggcgaggagguccaaguccucgcgcuggagcccgggaagaacccucgggcuguacagacuaagccagguaucuucaagacgaauaccgggacuauaggugcggugagccuggacuucagcccaggcaccagcggguccccuauaguggaccgcaagggcaaggucgugggacucuacggcaacggcgugguaacacggagcggagccuacgugagugcaaucgcccagaccgagaaguccaucgaggacaaccccgagaucgaagacgacauuuuccgcaagaagcggcuaacuauuauggaccugcacccaggcgcggggaagacuaagcgcuaucuccccgccaucguccgggaggccauaaagcgcggccugcgcacgcuaauccuggccccgaccagagucguggccgcggaaauggaggaggcccuccgcgggcugcccauucgguaccagacccccgccaucaaggcugagcacacaggccgcgagauaguggaccugaugugccacgccacguucaccaugcgccuccugagccccgugcgcgugccgaacuacaaccuaaucaucauggacgaggcgcacuucacggaccccgccuccaucgccgcccgaggcuacaucagcacccguguggaaaugggggaagcugcgggcaucuucaugacagccacgccacccggaucccgggauccguuuccccaaagcaacgcccccauaauggacgaggagcgcgagauccccgagcgguccuggaauagcgggcaugagugggucaccgauuucaaggguaagaccgugugguucgugccaucuaucaaggccggcaacgacaucgcggcuugccuccggaagaacgguaagaagguuauccagcugagccggaagacguuugacagugaguacguuaagacccgcgccaacgacugggacuucguagucacuaccgacaucucagagaugggggccaauuucaaagccgagcgggugauugacccccgccgcugcaugaagcccgugauccugacggacggcgaggagcgcguaauccucgcggggcccaugccggugacccacuccucggccgcccaacggcguggccgcaucgggcggaaccccaagaacgagaacgaccaauacaucuacaugggcgagccccuggaaaacgacgaggacugcgcccauuggaaggaggccaagaugcugcucgacaauaucaacaccccugagggcaucauaccauccauguucgagcccgagcgugagaagguggacgcgaucgacggcgaguaccggcuccgcggcgaggcucggaaaaccuucgucgaccugaugcgccgcggggaccuccccguguggcuggccuacaagguggccgcggagggaauuaauuaugcggaccgcaaguggugcuucgauggcaucaagaacaaccagauccuggaagagaacgucgagguggagaucuggacaaaagagggcgagcgaaagaagcucaaaccgcgcuggcuggacgcccggaucuacagcgacccccuugcccucaaggaguucaaggaguucgccgcgggccgcaagucucugacccugaaucucaucaccgagauggggcgucugcccacguucaugacgcaaaaggcccgcaaugcucuggauaaccucgccguccugcacaccgccgaggcgggugggcgugccuacaaucacgcgcuguccgagcuccccgagacccuggagacccuguuauuacugacgcuccuggccaccgugaccgggggcaucuuucuuuuccucauguccgggaaaggcaucgguaagaugacccugggcaugugcugcauuaucaccgccucaguucugcuaugguacgcgcagauccagccgcacuggaucgccgccuccaucauccuggaguucuuccugaucguccuccugauacccgagccugagaagcagcgcacgccacaggacaaccagcugacauauguggugauugccauacucaccgucguggccgcgaccauggccaacgagauggguuuccuggagaagacgaagaaggaccugggccucggcagcaucacuacccaggagagugaguccaauauccuugacaucgaccugcgcccggccagcgccuggacccucuacgccguagcgacgaccuuuguuacucccaugcugcgccacuccaucgaaaacucauccgucaaugucagccugaccgcaaucgccaaccaggccaccgucuuaaugggucugggaaagggguggcccuuguccaagauggauaucggcgugccccucuuagcgaucgggugcuacucacaggucaacccgauaacccucaccgcugcccuccuucugcucguggcccacuacgccaucaucggccccggccugcaggccaaggccacccgggaggcccagaagcgggccgcugcggggaucaugaagaauccuaccguggacggcauuaccguaaucgaccuggaacccaucccguacgaucccaaguucgagaagcaauuagggcaggucaugcugcugauucucugcguuacccagguguuaaugaugcggaccacgugggcucugugcgaggcgcucacccuggcgaccgggcccaucucgacgcugugggaggggaaucccgggcgcuucuggaauacuacaauugcagucagcauggcgaauaucuuucgcggcuccuaccucgccggcgccggccugcuguucagcaucaugaagaacaccaccaacacgcggcgcgggacuggaaacaucggcgaaacacuuggggagaaguggaagucccgacugaacgcccuuggaaagagcgaguuccagaucuauaagaaguccgggauccaagagguggaccgcacccucgcgaaggaaggcaucaaacgaggggagacggaccaccacgccgugagccgcggcuccgccaagcugcggugguucgucgagcgcaacauggugaccccggagggcaagguuguagaccuggggugcggucguggaggcuggagcuacuacugugggggccucaaaaauguacgcgaggugaaggggcugaccaaggguggcccagggcaugaggagccgauccccauguccaccuacggcuggaaccugguucggcuucagagcggaguggacguguucuucacgccgcccgagaagugugacacccugcugugugacaucggcgaaagcuccccaaacccgaccaucgaggcaggccgcacccugcggguccugaaccugguggaaaauuggcucaacaacaauacacaguucugcaucaaggugcugaauccguacaugcccuccgucaucgagaaaauggagacacugcagcgcaaguacgggggcgcccucguucgcaacccccugucccgcaacagcacccacgagauguacuggguguccaacgcgaccgggaacaucgucagcuccgugaacaugaucagccggaugcucaucaaccgcuucaccaugaagcacaaaaaggccacguacgagccggacguggacuuaggcuccgggacgagaaacaucggaaucgagagcgagaucccaaaucucgacaucauuggcaaacgcaucgagaagaucaagcaggagcacgagaccuccuggcacuacgaccaggaccaccccuacaagaccugggccuaccacgggagcuacgagacuaagcaaaccggcuccgccagcuccauggugaacgggguggugcgccuacugaccaaacccugggacgucgugccuauggugacccagauggcuaugacggacacaacccccuucgggcaacagcggguguucaaggaaaaaguggacaccaggacgcaggagcccaaagagggcaccaagaagcucaugcggaucaccgcggaauggcuauggaaggagcuggggaagaagaaaacgccccggaugugcacgagggaggaguucacucgaaaggugagaagcaaugccgcccugggcgccauuuucaccgacgaaaauaaguggaaguccgcccgcgaagcggucgaggacggacgguucugggagcuggucgaccgcgagcggaaucugcaccucgagggcaagugcgagaccugcgucuacaauaugauggggaagagagagaaaaagcugggcgaguucggcaaagccaaggggagccgugcgauaugguacauguggcugggcgcccgcuuccucgaguucgaggcgcugggguuccugaacgaggaccacugguucucccggggcaacucauuaagcggaguggaaggcgagggccugcaccgccugggguacauccuccgggacgugggcaaaaaggagggcggcgcuauguacgccgacgacacugccgggugggacacccgaaucacccuggaagaccucaaaaacgaagagauggugaccaaccacaugaagggcgaacacaagaagcucgccgaggcgaucuuuaagcugacguaccagaacaaggugguacggguccaaaggcccacgccccguggcaccgugauggacaucauaucccggcgcgaccaacgcgggagcggccaggugggaaccuacggccugaacacguucaccaacauggaggcccagcucauaaggcagauggagggugaggggaucuucaaguccauccagcacuuaaccgcaaccgaggagaucgccguccagaacuggcuggcccgggugggccgugagcggcuuagccgcauggcgaucuccggagacgauugcgucgucaaacccaucgacgaccgguuugccuccgccuuaacggcccuuaacgacaugggaaaggugcgcaaggacauccagcaaugggaacccuccaggggguggaacgacuggacccaggugccguuuugcagccaccauuuccacgagcucguuaugaaggauggccgcguguuagugguccccugccguaaccaggaugagcugaucggccgcgcccggauaucccagggggcuggcuggagccucaaggagacugccugccuaggcaaguccuacgcacagauguggacccugauguacuuccacagaagagaccuccgauuagccgccaaugcgaucugcagcgccgugcccucccacugggugcccaccagccgcacgaccugguccauccacgccaagcacgaguggaugaccaccgaggacaugcuggccgucuggaaccgcguguggauccaagagaacccguggauggaggacaagacgccuguggagagcugggaagaggucccuuaccugggcaagagggaggaccaguggugcggguccuugaucggccucacaucacgcgcgaccugggccaagaauauucagaccgcgaucaaccaggugcggagccucaucggcaacgaggaguacacggacuacaugccgucgaugaagcgguuccgcagagaggaagaagaggccggggugcugugguga

SEQ ID NO: 24928 - RNA, 9876 nt, Artificial Sequence
  derived and/or modified CDS sequence (opt11) from DENV-2__GQ868557__SS-prME
accgccggugugaucguaaugcucaucccuaccgccaucgcguuucaccucaccacccgcaacggggagccccacaugaucgucggccggcaggaaaaggggaagagucuacuguucaagaccgaggacggggugaacauguguacacucauggccaucgaccugggggagcugugcgaggacaccauuaccuacaagugccccuuacugcggcagaacgaaccugaagacauagacuguuggugcaacagcaccagcacuugggucaccuacgggacuugcacaaccacgggcgagcaccgccgcgagaagcgguccgucgcccugguaccccacgucggcaugggccucgagaccagaaccgagacguggaugagcuccgagggugccuggaaacacgugcagcggaucgagaccuggauccugcgccacccgggcuucaccauuauggccgcgauccuggccuacaccaucgguaccacgcauuuucagcgggcccucauuuucauacugcugaccgccguggcccccaguaugaccaugcgcugcaucgggauauccaaccgcgacuucguggagggcgugagcggcggcucguggguggacauaguucucgaacacggaucuugcgugacgacuauggccaaaaacaagccuacccuggacuucgagcugaucaagaccgaggccaaacagcccgccacccuccgcaaguacugcaucgaagccaagcugacgaacaccaccaccgagucccggugcccgacgcagggcgagcccagccuuaaugaggagcaagacaagagauucauuugcaaacauaguaugguggaccggggcugggggaacgggugugggcuguuuggcaagggagggaucgugaccugcgcuauguucacgugcaagaagaauauggaaggcaagguggugcagcccgaaaaccuggaguacaccauugucauuaccccccacuccggcgaagaacacgccguggguaacgacacagggaagcacggcaaggagaucaagaucaccccgcaauccagcauaaccgaggcagaauuaaccggguacggcacggugaccauggaaugcucgccgcggaccggccucgacuuuaacgaaaugguacugcuccagauggaggauaaggcauggcucgugcaccgccagugguuucuugacuuaccacucccguggcugcccggggccgacacacagggcaguaacuggauccagaaggagacgcuggugaccuucaagaacccccaugcaaagaagcaggacgucgugguccucggaucccaggagggcgccaugcauacagcccuuaccggggccacggaaauucagaugagcuccggcaaccuccuguuuaccgggcaccugaagugcagacugcggauggacaagcuccagcugaaagggauguccuacucgaugugcaccgguaaguuuaaaaucgugaaggaaauagcggagacccagcacgggaccauugugauccgcguacaguaugagggcgacggcucacccuguaagauccccuucgagaucaccgaccuggagaagcgacaugugcucgggcgccugaucacuguuaacccgaucguaaccgagaaggacagcccagugaacauagaggcggagccgcccuucggcgacuccuacaucaucaucggcguugagccgggccaacugaagcugaacugguucaagaaggggagcuccauuggccagauguucgagacaacuaugcgcggcgcaaagagaauggccaucuugggggacaccgccugggacuucggcucccucggaggggucuucaccaguaucgggaaagccuugcaccagguguucggugcgauuuacggcgcagcauucagcggagucuccuggacuaugaagauccugaucggcguugugaucacauggaucggcaugaacagccgcaguaccucacugagcgugagccuggugcucgugggagugguuacgcucuaccugggggcaauggugcaggcugacuccggcuguguugucuccuggaaaaauaaggaguuaaaaugcggcuccgggauuuucaucacggacaacgugcauaccuggacagaacaguauaaauuccagcccgagagccccagcaagcuugccuccgcuauccagaaggcccacgaggagggcaucugcgggauacggagcgugacccgacuggaaaaccucauguggaagcagaucacgcccgaauuaaaccacauucuuagugaaaacgaggucaagcuuaccauaaugaccggcgacaccaagggcaucaugcaggccggcaagcgaagccugcguccgcagcccacggagcugaaauacuccuggaaaaccuggggaaaggcgaagaugcuaagcaccgaaucacauaaccaaaccuucuuaaucgacgggccagagacggccgagugcccgaacaccaaccgggcuuggaauagccuggagguggaggacuacggcuucgggguauuuaccacgaacaucuggcucaagcugcgagaaaagcaagacguguucugcgacucuaagcugaugagcgccgccauuaaggauaaucgggcggugcaugcagacaugggcuauuggauagaauccgcccucaacgacaccuggaaaauggaaaaggccagcuucaucgaggugaagaguugccacuggcccaagagccacacgcuguggucaaacggcgucuuggagucagagaugauaauccccaaaaacuuugcaggccccguuucccagcacaacuaccgcccgggcuaccacacucaaaccgcggggcccuggcacuugggcaaacucgagauggacuucgaccucugcgaggggacgacgguggucgugaccgaggauugcggcaaccggggcccgagccuccgcacgaccacggccagcgguaagcugaucaccgagugguguugccgguccugcacccucccgccgcuccgcuaucggggugaagaugggugcugguacggcauggagauuagaccacugaaggagaaggaggaaaaucuggugaacagccucgucacugcggggcacggucagaucgacaacuuuucccugggcgugcuggggauggccuuauuccuggaagaaaugcugcggacgcgcguggggaccaagcacgcgauccuccugguagccgugagcuucgugacauugauaacgggaaauauguccuuccgggacuuaggccgggucaugguuauggugggagccacgaugaccgaugacaucggcaugggcgucacguaccuggcccugcucgcagcguuuaaggugcggcccaccuucgcagcagggcuucugcuccggaagcugacuucaaaggagcugaugauggcuaccaucggcaucgcccuccugucucagucaaccauccccgagaccauccuggaacucacugacgcgcuggcguuggggaugaugguacucaagaucguacggaauauggagaaguaucaguuagccgugaccauaauggcaaucuccugcgugccgaacgccgugauccugcggaacgccuggaaggucaguugcacuauccucgccgccgucuccgugagcccccugcugcucacaaguagucaacagaaggcugacuggaucccccucgcgcugacaauuaagggccucaaccccaccgcuaucuuccugaccaccuuaucccgcacgagcaagaagcgguccuggccucucaacgaagccaucauggccguaggaauggucagcauccuggccuccucacugcucaagaacgacaucccuaugaccgggccccugguggcgggcgggcugcucaccguguguuacguucugaccggccgcagcgccgaccuggagcucgagcgggcagcagaggugaagugggaagaucaggccgagaucuccgggagcucucccauuuuaagcauaacuauuuccgaggacggaagcauguccaucaagaaugaggaggaggagcagacccugacaauccucauucgcaccgggcugcuggugaucucaggcguuuucccgguguccauccccaucaccgccgccgccugguaucucugggaggugaagaaacaacgggcugguguccugugggaugugcccagcccgccccccguggggaaggccgaacuugaggacggcgcuuaccgaaucaagcagagggggauucucggcuacucccagaucggcgccggggucuacaaggagggcacguuccacaccauguggcacgugacccgcggagcugugcugaugcaccggggaaagcgaaucgagcccucgugggccgacgucaagaaggaccugaucucuuacgggggcggcuggaaguuagaaggagaguggaaagagggcgaggaggugcagguucuagcccuggaacccgggaagaacccaagagcgguccaaaccaagcccggcauuuucaagacgaacaccggcacgaucggggccgugagccucgauuucucccccggcacuagcggguccccaaucguagaucgcaaaggcaaggucguggggcuguacggcaacggaguggucacgcggagcggggcguacgugagcgccauagcgcagaccgagaaguccaucgaggacaacccugagaucgaggacgauaucuuccggaagaagcgucucaccaucauggaucugcaccccggugcggggaagaccaagcgcuaccugccagcuaucgugcgggaggccaucaaacgcggccugcgcacgcugauccucgccccgacccgggucguggcggcagaaauggaggaggcccugagagggcugcccauccgguaccagacccccgcgaucaaggccgagcacacaggccgagaaaucguagaccucaugugucaugcgacguucaccaugcgccugcuuagcccggugcgggucccgaacuacaaucucaucaucauggacgaggcccacuucaccgaccccgccucuauugccgcccggggguacaucucaacucgcguagagaugggugaggcggccgguaucuucaugacggccacgccgccaggaucccgggacccguuuccccaguccaacgcccccaucauggacgaggagcgggagauccccgagcgguccuggaacagcggacacgagugggucaccgacuucaaggguaagaccgugugguuugugccaucaauuaaggccggcaacgacauagcggccugccugcgaaagaacggcaagaaggucauccagcugagccggaagacguucgacuccgaguacgugaaaaccagagccaaugacugggacuucgucgugaccacggacauaagcgagaugggggccaacuucaaggcggaacgcgugaucgauccccgccggugcaugaagcccgugauccucacagacggcgaggagcguguaaucuuagccggacccaugccggugacacacagcagcgcagcccagcggcgcggccgcaucgggcggaaccccaagaaugagaaugaccaauacaucuacaugggcgaaccgcuggaaaaugacgaagauugcgcccacuggaaggaggccaagaugcuccuggacaacaucaauacuccggagggcauuaucccguccauguucgagcccgagcgcgaaaaagucgacgcaaucgacggugaguaccggcugcgcggcgaggcccggaagaccuucgucgaccuuaugcgccgaggggaccugcccguuuggcuugcuuacaagguggccgcagagggcaucaacuacgccgaccgcaaguggugcuucgacgggaucaagaacaaccagauucuggaggagaacgucgagguggagaucuggacgaaggagggcgaacggaagaagcugaagccgcguuggcuggaugcucggauauacagcgacccccucgcccugaaggaguucaaggaauuugccgccggccgcaaauccuugaccuuaaaccugaucaccgagauggggcgccugccaacauucaugacgcagaaggcccgcaaugcccucgauaaccuggcuguccugcacaccgcggaggccggcggaagggcauacaaccacgcccucagcgagcuccccgagacucuggagacccuccugcugcucacgcugcuggccaccguaacuggcggcauuuuccuauuccugauguccggcaaggggaucgggaaaaugacccuggguaugugcugcauuauaacugcgucagugcuccugugguacgcccaaauccaaccacacuggauugccgccuccaucauccuggaguucuuccucauaguucugcugauccccgagcccgagaagcaacgcacgccccaggacaaccagcucacauacguugugaucgcuauccugaccgucguugcggccacuauggccaacgagaugggguuccuagagaagacgaagaaggacuuaggacuggggagcaucacaacccaggagagcgagagcaacauuuuggauaucgaccuccgcccggccuccgccuggacgcucuacgccguggccacgacguucgucacccccaugcugcgccacuccaucgagaacucuucugugaacgugagccucaccgccaucgccaaccaggcgacgguacugaugggacugggcaagggcuggcccuugucaaaaauggacaucggggugccacugcuggccaucggcugcuacagucaggugaacccgaucacccucaccgccgcccuguuacuucucguugcccacuaugccauuaucggccccggacugcaggccaaggccaccagggaggcacaaaagcgagccgcggccgguaucaugaagaaccccacaguagacggaaucacugucaucgaccucgagccuauaccguacgaccccaaguucgagaaacagcuggggcaagugaugcugcucauccugugcgugacacagguccugaugaugagaaccaccugggcccugugcgaggcccugacgcuggccaccggcccgaucucgacccucugggagggaaaccccggccgcuucuggaacacgacuaucgccguuucaauggccaacaucuucagaggcuccuaccuggccggagccggacuucuguucagcaucaugaaaaauacuaccaacacgcggcgcgggacuggcaacaucggcgagacucugggggagaaguggaagucccgccugaacgcuuugggcaagagugaguuccagaucuacaaaaaguccgguauccaggagguggaccgcacccuggccaaggagggcauuaagcgcggggagacagaccaccacgccgugagccgaggaucggccaaauugcggugguuugucgagcgcaacauggugacucccgagggcaagguggucgaccucggcugcgggcgagggggguggagcuacuauugcgggggccugaaaaacgugcgagaggugaagggacugaccaagggcggccccgggcacgaagagccgaucccgauguccaccuacggcuggaaccucgugcgccugcagagcggcguggacguguucuucacgccgccggagaaaugcgacacccuguuaugcgacauaggcgagucuagccccaaucccaccauugaggccgggcguacccugcgggugcucaaccugguggagaauuggcugaacaacaauacucaauuuuguaucaagguccugaauccguacaugcccagcgugaucgagaagauggagacacuccagcgcaaguacgggggugcccugguucggaacccccugucgcgcaacagcacccacgaaauguacugggugucaaaugccacggggaacauuguuagcuccguaaacaugaucagccgaaugcuaauuaaccgcuucaccaugaaacacaagaaggccacguacgagccggacguugaccucggcuccgggacccggaacauaggcauugaguccgagauccccaaccuggacaucaucgguaaacgcauugagaaaaucaagcaggagcacgagaccucauggcacuacgaccaggaccaccccuauaagacaugggccuaucacgggucuuacgagacgaagcagaccggcagcgcaagcagcaugguuaacggggugguccgccugcucacaaagcccugggacgucgugccgauggucacccagauggcgaugaccgacacaaccccguucgggcagcagcgagucuucaaagagaaaguggacaccaggacgcaggagccuaaggagggaaccaaaaaacugaugaagaucacugcggaguggcuguggaaggaguuggguaagaagaagacgccccgcaugugcacgcgcgaagaguucacacggaagguaagaagcaacgccgcccucggcgccauuuucaccgacgagaacaaguggaaguccgcgcgggaggccgucgaagacgggagguuuugggaguuaguggaucgggaacgcaaccuccaccuggagggcaagugcgagacuugcgucuacaauaugaugggaaagcgugagaaaaagcugggcgaguucggcaaggcgaaggggagccgcgccaucugguacauguggcuuggcgcccgguuucuugaguucgaggcccugggguuccucaacgaggaccacugguuuucccgcgggaacucccugagugggguggagggagagggcuuacacagauuaggguauauucugcgugacgucuccaagaaggagggcggggccauguaugccgacgacacggccggcugggacacccggaucacccucgaggaccucaagaacgaggagaugguaacuaaccacaugaaaggagaacacaaaaagcucgcggaggcgaucuucaagcugacuuaccagaacaaagugguacggguccagcggccuacgccccgggguaccgugauggacaucauaagccggcgcgaucagcgcgggagcggacaggugggcacuuacgggcucaauacguucacgaauauggaggcccaguuaauacggcagauggagggcgagggcauauucaagagcauccagcaucugaccgccaccgaggagaacgccguccagaacuggcucgcgcgcgugggacgggagcgccugucccggauggccaucuccggugacgacugcguggucaagcccauagacgaccgguuugccuccgcccugacggcccucaaugauauggggaaaguacggaaggacauccagcagugggaaccgagccgcggcuggaacgacuggacgcagguuccguucugcucccaccacuuccaugaguuagucaugaaggaugggcggguguugguggugcccugccgcaaccaagacgagcucauaggccgggcccgaaucagccaaggcgccggguggucacugaaggagaccgcuugccugggcaagagcuacgcucagauguggacgcucauguauuuccaucggcgugacuuacggcuugccgcgaacgcaauaugcagugccgugcccagccacugggugcccaccucccgcacgaccuggagcauucacgccaagcacgaguggaugacuaccgaggacauguuagcgguguggaaccggguguggauccaggagaacccguggauggaggacaagacgcccguggaguccugggaggagguccccuaccucgggaaacgagaggaccaguggugcgguagccugauagggcucacaagccgggccaccugggccaagaacauacagacggccaucaaccaggugcgcucucuuaucgguaacgaggaguacacggacuacaugcccucaaugaagcgcuuccggcgcgaggaggaggaggccggcgugcugugguga

SEQ ID NO: 24929 - RNA, 9876 nt, Artificial Sequence
  derived and/or modified CDS sequence (opt11) from DENV-2__GU131947__SS-prME
acggccggugugaucguuaugcugauucccaccgccaucgcauuucaccucaccacccgcaacggggagccacacaugaucgugggccggcaggagaaggggaagucccugcucuucaagaccgaggacggugugaacaugugcacucucauggccaucgacuugggggagcugugcgaggacacaaucaccuacaagugcccucuccuccgccagaacgagcccgaggacaucgacugcuggugcaacagcaccagcacuuggguuacauacgggaccugcaccaccacgggcgaacaucgacgugagaaaagaaguguggcucuagugccucacguagggaugggccucgagacccgcaccgagaccuggaugagcuccgagggggccuggaagcacguccaacggauugagacguggauucuacgccacccgggcuucacaaucauggccgcaauccuggccuauaccaucgggacaacgcauuuccaacgugcccucaucuuuauccugcugacugccguggcccccagcaugaccaugcgcugcaucggcaucuccaaccgggacuucgucgagggcguuagcgggggcaguuggguggacaucguucucgagcacgggagcugcguuacuacgauggcgaagaacaagcccacccuggacuucgagcugaucaagacugaggccaagcagcccgccacgcuccgcaaguacugcaucgaagccaaguugacgaacaccaccacagaaucccggugcccuacgcagggcgagcccucucugaacgaagagcaggacaagcguuucaucugcaagcacuccauggucgaccggggcugggggaacggcugcgggcuguucgggaaaggcgggaucgugacaugcgcuauguucacaugcaagaagaacauggagggcaagguaguucagcccgaaaaucuggaauacaccaucgugauuacgccccacagcggggaggagcacgccgugggcaacgauaccggaaaacauggcaaggaaaucaagaucacuccgcagucgagcaucaccgaggccgagcugaccggauacggcacggugaccauggagugcagcccccggacgggccucgacuucaacgagaugguccugcugcaaauggaggacaaagcuuggcucgugcaucggcagugguuccuggacuugccucuuccuuggcugccgggggcggacacccagggaagcaacuggauccagaaagagacguuagugaccuucaagaacccccacgcgaagaagcaggacgucgugguccuuggaucccaggaaggcgccaugcacaccgcccugacaggggcaacggagauccagaugagcagcggcaaccuccuguucaccggacaccugaagugccgccugaggauggacaaacuucagcugaagggcaugucguauucaaugugcaccggcaaauucaagauagugaaagagaucgccgagacacagcacgguacgaucgugauccgcguccaguacgagggcgacggcucccccugcaagaucccguucgagaucacggaucuggagaagcgccacgugcucgggcgccuaaucaccguuaacccgaucgugacugagaaggauagccccgugaacauagaggcugagccgcccuucggagacuccuacaucaucaucgggguggaaccgggccagcugaagcucaauugguucaagaaggggagcuccaucggccagauguucgagacgaccaugcgcggcgccaaacggauggccaucuuaggggauaccgccugggacuucggcagccucgggggggucuucacgucgauagggaaggcccuccaccagguguucggggcgaucuacggcgccgccuucagcgggguguccuggacuaugaagauccugaucggcgucgugauaacguggaucgguaugaacagccgcuccacgagccuguccgugagccugguccucgugggcguggucacccuguaccugggggcuauggugcaggcagacuccggcuguguggucagcuggaagaacaaggagcucaagugcggcuccgggaucuucauaacggauaacgugcacaccuggaccgagcaauacaaauuucagcccgagagccccagcaagcuggccuccgccauucaaaaggcccacgaggagggcauuugcgggauccggagcgugacccgccuggagaaccuuauguggaaacagaucacgcccgagcugaaucacauccuauccgaaaaugaggucaagcucaccaucaugacuggcgacacgaaggggaucaugcaggccggcaagcggagcuugagaccgcaacccacagagcugaaguauuccuggaagaccuggggcaaggcgaagaugcucagcaccgagucccacaaccagaccuuccugauagacggacccgagacggccgagugcccgaacaccaaccgggccuggaacagccuggagguggaggacuacggcuuugguguguucacaacuaacaucuggcucaaacugcgcgaaaagcaggacgucuucugcgauuccaaacugaugagcgccgccaucaaggauaaccgggcggugcacgccgacauggguuacuggauagaaucagcccucaacgacaccuggaaaauggagaaagccucauucaucgaggugaaguccugucauuggcccaagagccacacccugugguccaacggcguccuggagagugagaugaucaucccgaagaauuuugccggccccguaucccagcacaacuaccggccuggcuaccacacccaaacugcggggcccuggcaccucggcaagcuggagauggauuucgaccugugcgagggcacuacggugguaguuaccgaggacugcggcaaccgggggcccagccuccgcaccaccacggccucggguaagcugaucaccgaguggugcugccgguccugcaccuuacccccgcuccgcuaccgcggcgaggacgggugcugguacggcauggaaauccgcccccugaaagagaaggaggagaacuuggucaacagccucgugacugccggacacggccagaucgacaacuucucuuuaggcgugcuggggauggcccucuuccuggaggagaugcugcggaccagggugggaaccaagcacgcgauccuucuggucgccguaagcuucgugacccucaucaccgggaacaugucuuuucgggaccucggacgaguaaugguaauggucggggccacaaugaccgacgauaucgggaugggcgucaccuaccuggcccugcucgcugcauuuaaggugcgccccaccuucgccgcagggcugcuccuccggaagcugacgagcaaggagcugaugauggcaacaaucggcaucgcccuccuuucccagagcaccauucccgagaccauccuagaguugacggacgcgcuggcccuggggaugaugguacuaaaaaucguccgcaacauggagaaguaccagcuggccgugaccauuauggccaucagcugcgugccgaaugcaaugauccugcggaacgcguggaaggucucgugcaccauucucgcagccguguccgucagcccccugcugcuaaccucaucucagcagaaggccgauuggaucccccuggcacugacgaucaaaggccucaaccccaccgccaucuuccugaccacccugucccgcacguccaagaagcggagcuggccucucaacgaggcuaucauggccgucggcauggucagcauccuggcuuccagccuccucaagaacgacauucccaugaccgggccccugguugccggggggcugcucaccgucugcuacguauugaccggccgcagcgccgaucuagaguuagagcgggccgcagaggucaagugggaggaccaggccgagaucuccgggagcagucccauacuuagcaucacgaucuccgaggacggcagcaugucuaucaagaaugaggaggaagagcagacgcugaccauccucauccgcaccgggcugcuggugaucuccgggguauucccggucaguauacccaucaccgcggccgcuugguaucucugggagguaaagaagcagcgggccgguguucucugggacguccccuccccgccgcccgugggccgugccgagcuggaagacggcgccuaccggaucaagcagcgcgggauucugggcuacucacagauaggcgcugggguguacaaggagggcacguuccacaccauguggcaugucacccgcggggccgugcugaugcaccgaggcaagcggaucgagcccagcugggccgacgugaagaaagaccugauuuccuaugggggcggcuggaaguuagagggggaguggaaggagggcgaagagguccaggugcuggcccuggagcccgggaagaacccccgcgcgguccagacaaaacccggcauuuucaagacuaacacggggaccaucggcgccgucagucucgacuucagccccggcaccagcgggucccccaucguggaccgcaagggaaagguggucggucuguacggcaacggcguggucacgcgcagcggggccuacgucuccgccaucgcgcagaccgagaaguccauugaggacaaccccgagauagaggacgauaucuuccggaagaaacgccugaccauaauggaccuacacccuggcgcugggaagaccaagcguuaccugcccgccaucgugcgugaggccaucaagaggggacugcggacguuaauacucgcuccgacccgcgucgucgcggccgaaauggaggaggcccugcgggggcuuccgauccgcuaccagaccccggccaucaaagccgaacacaccggccgggaaaucguggaccucaugugucacgcgacguucacgaugcgacuuuuaagcccggugagagucccuaacuacaaccucaucaucauggacgaggcccacuucaccgaccccgccuccaucgcggcccgcggcuacauuucuacccggguggagaugggggaagcggcuggcaucuuuaugacggccaccccucccgggucgcgcgauccguucccccagagcaacgccccuaucauggacgaggagcgggagaucccugagcguaguuggaacuccggccacgaauggguaaccgauuucaaggggaagaccgucugguucgugccguccaucaaggcgggcaacgacaucgccgccugccugcggaagaacggcaagaaggugauccaacuuagccgcaaaacguucgacuccgaguacgucaagacccgggcaaacgacugggauuuuguggugaccacggacaucagcgaaaugggggccaacuucaaggcagagcgcguuauugacccccggcgcugcaugaagcccgugaucuugacggacggcgaggagcggguaauccuggccgggcccaugccuguuacacacuccagcgccgcucagcgccgaggccggaucgggcgcaaccccaagaacgagaacgaccaguacaucuacaugggcgagccccuggagaacgacgaggacugcgcccauuggaaagaggcgaagaugcuccuagacaacauuaacacgcccgagggcaucauuccguccauguucgaacccgagcgggagaaaguggacgcuaucgacggggaguauagguuacggggugaggcccgcaagaccuucguagaccucaugcggcgcggggacuuacccgucuggcuggcuuauaagguggccgcugagggcauuaacuacgcagaccggaagugguguuucgacgggaucaagaacaaccaaaucuuagaggagaacguggaggucgagaucuggacaaaggagggcgagcgcaagaagcugaagccacgguggcuggaugcccgaaucuacucagaccccuuagcccugaaagaguuuaaagaguucgcggccggccguaagucccugacccucaauuugaucaccgaaauggggcgccugcccacauucaugacgcagaaagcucggaacgcccuggacaacuuagcugugcuacacaccgcggaggccggcgggcgcgcuuacaaccacgcgcucagcgagcuucccgagacccuugaaacccuccuucugcucacgcugcuggccaccgucaccggaggcaucuuccucuuccugauguccgggaagggcaucgggaagaugacccugggcaugugcuguauaaucacugcgagcgugcuccugugguacgcccagauucagccgcacuggauugccgccuccaucauccuggaguuuuuccucaucguguuguugauacccgagcccgagaaacagcggacgccccaggacaaccaguuaaccuacgucgugaucgccauccugaccgugguagcggccacgauggccaacgagaugggguuccuggaaaagacgaagaaggacuuaggccugggcagcaucaccacgcaggagagcgaguccaacauccuggacaucgaccuccgcccggcuagcgcguggacccuguacgcgguggccacgacauucgugacacccaugcugcgucacuccauugagaacagcuccgucaacguuagcuuaaccgcaaucgccaaccaggcgacggugcugaugggguuggggaagggguggccccucucuaaaauggacauuggggucccacuccuggcaaucgggugcuauagccaggucaacccgauaacccucaccgcugcccuccugcuccugguggcccacuacgcgaucauaggccccggccugcaagcgaaggccacccgagaggcccagaagcgggccgcggccgggaucaugaagaacccuacgguugauggcauuaccguaaucgaccucgagcccaucccguacgaucccaaguucgagaaacagcugggucaggugaugcugcuuauccugugcgucacccagguuuugaugaugcgaacuaccugggcccuuugcgaggcucugacccuggccacuggacccauuucgacgcucugggaggguaaccccggccgcuuuuggaacacgaccaucgcggugucuauggcaaacaucuuccggggcagcuaccuggccggggccggccuccuguucagcaucaugaagaacaccaccaacacgcgccgggguaccggcaacaucggggagacccugggggagaaguggaagucccgacugaacgcacucggcaaaucggaguuccaaaucuacaagaagaguggaauccaggaggucgaccgcacccuagcuaaggagggcaucaagaggggggagacggaccaccacgccguaucgcgagguuccgccaaacugcgcugguucguggagcggaacaugguaaccccagagggcaaggugguagaccucgggugcggccgcgggggcuggagcuacuacugcgggggccugaagaacgucagagaggugaagggccugaccaagggcggccccgggcacgaggagccaaucccgaugagcaccuacggcuggaaccuaguacgcuuacagagcggcguggacguguucuucacgccucccgagaagugcgacacccugcucugcgacaucggugaguccucccccaaccccaccaucgaggcggggcgaacccugcgcgugcuaaaccucgucgaaaacuggcugaacaauaauacccaguucuguaucaaggugcugaacccauacaugcccagcgugaucgagaagauggaaacgcuccagcggaaguacggaggagcccugguccguaacccuuugagucggaacagcacccacgagauguacugggucuccaacgccaccgggaacaucguaaguuccgucaauaugaucagccgcaugcugaucaaucgguucaccaugaagcacaagaaggcuacguacgagccggaugucgaccucggcucggggacccgcaacaucggcauugaaagugagaucccgaaccuggacaucaucgggaaacgcauugagaagaucaagcaggagcacgagaccuccuggcacuacgaccaggaccaucccuacaagaccugggccuaucacgggagcuacgagacgaagcagaccggcuccgccagcucgauggugaacggagucgugcggcugcucaccaaacccugggacguggucccgauggucacccagauggcgaugacggacaccacccccuucggccagcagcgcguguucaaggaaaaggucgacacccggacucaggagcccaaagagggcaccaagaagcugaugaagaucaccgccgaguggcuguggaaggagcucgggaagaagaagacgccucgcaugugcacucgggaagaauucacaaggaaggugcggagcaacgccgcacucggcgcaaucuuuacggacgagaacaaguggaaguccgcgcgagaggccgucgaggaugggcgguucugggagcuggucgauagagaacggaaccuccaucuggagggcaagugcgagaccugcguguauaacaugaugggaaagcgcgagaagaagcugggcgaguucggcaaggcaaagggaucacgggccaucugguacauguggcucggcgcgcgcuuccuugaguucgaggcccugggguucuuaaacgaggaccacugguucucccgggguaacagccuaaguggaguagagggggagggccugcaccgccucggguacauacugcgggacguguccaagaaagagggcggggccauguacgccgacgacacggccggaugggauacacgcaucacccuggaggaccucaaaaacgaggagauggucaccaaccacaugaagggggagcacaagaaacuggcggaggcaaucuucaagcugacguaccagaacaaggucgugcgggugcaacgcccgacgccccggggcaccgucauggacaucaucucgcgacgcgaucagcggggcucaggccaggucgggaccuacgggcucaacacguucaccaacauggaggcccaguuaaucagacaaauggagggcgagggcaucuucaagagcauccagcaucugaccgccaucgaggagauugccgugcagaacuggcucgcgagggucgggcgugagcgacugucgcgcauggcuaucaguggcgacgacugcguggugaagcccauugacgaccgauucgccuccgcccucaccgcccucaacgacauggggaagguccgcaaggacauacagcagugggagcccagccggggcuggaacgacuggacccaggugccguucugcucccaucacuuccacgagcuggugaugaaggacgggcgaguccugguggugcccugccguaaccaggacgaacucaucggccgcgcgcggaucagccagggugccgguuggucgcugaaggaaaccgccugccugggcaagagcuaugcccagauguggacccucauguacuuccaucgccgugaucugcgcuuggccgcuaacgccaucugcuccgccgucccgucgcacugggugcccaccucucggaccacguggagcauccacgcaaagcacgaauggaugaccaccgaggacaugcucgcgguguggaacagggucuggauccaggagaacccauggauggaggacaagacacccguagaguccugggaggaagucccguaccuggggaagcgggaagaucaauggugcggcagccugauagggcuuacuagccgcgcaaccugggccaaaaauauccagaccgccaucaaccaaguccgcucccugaucggcaacgaggaauacaccgacuacaugcccagcaugaagcgguuccgccgggaggaggaggaggccggcgugcugugguga

SEQ ID NO: 24930 - RNA, 9876 nt, Artificial Sequence
  derived and/or modified CDS sequence (opt11) from DENV-2__GQ868558__SS-prME
accgccggcgugaucgucauguuaauccccacugccaucgcguuccaccucaccacccgcaacggggaaccgcacaugaucgugggccggcaggagaaggggaaaucccugcuguucaagaccgaggacggcguuaacaugugcacgcucauggccaucgaccugggggagcugugcgaagacacuaucacguacaagugcccccuccugaaacagaacgagcccgaggacaucgacuguugguguaacagcaccagcaccugggucaccuacgguacuugcaccaccacgggcgagcaccgccgcgagaagcgcucaguugcccuugugccccacgucgggaugggccucgagacccggaccgagaccuggaugagcuccgagggugcauggaaacacgugcagaggaucgagacguggauccugcggcacccgggcuucaccaucauggccgcgauccuggccuacaccaucggaaccacgcacuuccagcgcgcgcucauauucauccugcugacagcaguagcgccguccaugaccaugcggugcauuggcaucuccaaccgcgacuucgucgagggcgucagcggcggcuccuggguggacaucguccucgagcacgggagcugcgugaccacgauggccaagaacaaacccacccuggacuucgagcugaucaagaccgaggccaagcagcccgccacgcuccggaaguacugcaucgaggccaagcugacaaauaccaccaccgagucccgcugcccgacacaaggagagcccagccugaacgaagagcaagauaagcgguucaucugcaagcacuccaugguggaccgcggcugggggaacggcugugggcuguucggcaagggggggaucgugaccugcgcgauguucacguguaagaagaacauggagggcaagguggugcagcccgagaaccuggaguacaccaucguuaucacgccccacagcggggaggagcacgccgugggcaaugacaccggaaagcacggcaaggagaucaagaucaccccgcaguccagcauuaccgaggccgagcugaccggauacggcacggugaccauggagugcagcccccgaacaggccucgauuucaacgagaugguccugcugcagauggaggacaaggccuggcucgugcaccgccagugguuccuggaccucccccucccuuggcugccgggggccgacacccagggcagcaacuggauccagaaggagacgcucgugacauucaagaacccccacgcgaagaagcaggacgucguggucuuggggagccaggagggcgccaugcacaccgcccucaccggggcuacggagauccagaugagcuccggcaaccucuuguucacaggccaccugaagugccggcugcgcauggauaaacuccaacugaaggggauguccuauagcaugugcaccggcaaguucaagaucgugaaagagaucgccgagacccagcacggcacgaucgugauccggguccaguacgagggcgacggcucccccugcaagauccccuucgagaucacggauuuagagaagcgccacgugcucgggcggcucaucaccgucaacccgauugucaccgagaaggacagccccguuaacauugaggcggaaccgcccuucggggacuccuacauaaucaucgguguggagccaggccaacugaagcugaacugguucaagaaggggucuuccaucggccagauguucgagacgaccaugcgcggcgccaagcgcauggcgauccugggugacaccgccugggacuucggcagccucgggggcgucuucaccaguauuggaaaggcccuccaccagguguuuggcgcgaucuauggggcggccuucagcgggguguccuggacgaugaaaauccugaucggugucgucaucacauggauagggaugaacagccgguccaccagccucuccgugagccugguccucgugggcguggucacccuguauuuaggggccauggugcaggcggauuccggcugcgugguaagcuggaagaacaaggagcucaaguguggcuccggaaucuucaucacggacaauguccacaccuggaccgagcaguacaaguuccagcccgagagccccucgaagcuggccuccgccauucagaaggcccaugaggaaggcaucugcgggauccgaagcgugacucggcuggagaaccucauguggaagcaaaucacgcccgagcugaaccacauccuguccgagaacgaggucaagcucacaaucaugaccggugacaccaagggcaucaugcaggccggcaagcgcagccugcggccgcagcccacggagcugaaguacuccuggaagacuuggggcaaggcgaagaugcauuccaccgagucccacaaccagaccuuccucaucgacgggcccgagacggccgagugcccaaacacgaaccgcgccuggaacagccuugagguggaggacuacggcuucgggguuuucaccaccaacaucuggcugaagcuccgagagaagcaggacgucuucugcgacucuaagcuuaugagcgccgccaucaaggacaaccgcgcggugcacgccgacaugggcuacuggaucgaguccgccuugaacgacaccuggaagauggagaaagccagcuucaucgaggugaagucuugccacuggcccaagagucacacgcucugguccaacggcguccuggagagcgagaugaucauccccaagaacuucgccgggcccgugucccagcauaacuaccggccgggcuaccacacccagaccgcggggcccuggcaucugggaaagcucgaaauggauuucgaucugugcgagggaaccacggugguagugaccgaggacugcggcaaccguggcccuucgcugcggaccaccacggccagcgguaagcucaucacugagugguguugccgcuccugcacccugcccccgcugcgguaccggggcgaggacggaugcugguacggcauggagauccggccccucaaggaaaaggaggagaaccuggugaacagccuggucaccgcuggacauggccagaucgacaacuucucccucggaguguuggggauggcccuguuccuggaggagaugcugcgcacccgggugggcaccaagcacgcgaucuugcucgucgcggucagcuucguuacccugaucaccgggaacauguccuuccgcgaccugggccgggucaugguuauggugggcgccacgaugaccgacgauaucggcaugggcgucacauaccuugcguugcuggccgcguucaagguacggccaaccuucgccgccgggcucuuacugcggaagcucacuagcaaggagcugaugauggccacgauuggcaucgcccugcucucccagagcacgauacccgagacaauccuggaacugacggacgcacuggcccuggggaugauggugcugaagaucguccgcaacauggaaaaauaccagcuagccgugacuauuauggccauuuccugcgucccaaacgccgucauccugcgcaacgcauggaaggugagcugcacuauucuggccgccgucuccgucucuccccuccugcugaccuccagccagcagaaagcugacuggauaccccucgugcugacgaucaagggccugaaccccaccgcgaucuucuuaaccacccuaucacggacgaguaagaagcgcucguggccgcugaacgaggccaucauggccgucggcauggugagcauccucgccucguccuugcugaaaaacgacauccccaugaccgggccccuaguugccggcgggcugcugaccgucugcuacgugcucaccggucggagcgcggaccuggagcuggagcgcgccgccgaggugaagugggaggaccaggccgagaucucggguagcucccccauccucucaaucacgaucucugaggacggcucaauguccaucaagaacgaggaggaggagcagacccugaccauccugauccgcaccggauuacuggucaucucaggggucuucccgguguccauccccaucaccgccgcggccugguaccugugggaggucaagaagcagcgcgccggcguccucugggacgugcccagcccgccgcccguagggaaggccgagcuggaggacggcgccuaccggauaaagcagcgcgggauucugggcuacucccagaucggugcgggggucuacaaggaaggcacguuccacaccauguggcauguaacccgcggggccguccucaugcaccgcggcaaacgcaucgagcccagcugggccgacgucaagaaggaccuuaucuccuacgguggcggcuggaagcuggagggugaguggaaggagggcgaagaagugcagguauuggcccuugagccggggaagaacccccgcgccgugcagaccaagcccggcaucuucaagacaaacgccggcacuauuggcgcugugagucuggacuucucccccgggaccagcgggucccccaucgucgaucgcaagggcaaggugguggggcucuacgggaacggcgucgugaccaggagcggggcauacguguccgcuaucgcccagacggagaaguccaucgaggacaaccccgagaucgaggacgacaucuuucggaagaagcgccugaccaucauggaccugcaccccggcgccgggaagaccaagcgguaccuccccgccaucguccgugaggccaucaagcggggccugcgcaccuuaauccuggccccuacgcgcguaguggcggccgagauggaggaggcccuccggggguugcccaucagauaccagacccccgccaucaaggccgagcacaccggccgggagaucgucgaccugaugugccaugcgaccuucacgaugcgccuacugagccccgugcgggugccgaauuacaaccugaucaucauggacgaggcccacuucaccgaccccgccaguaucgccgcccgcggcuacaucagcacccgagucgagaugggggaggcggccggaaucuucaugaccgccacgccucccggcucccgcgauccguucccccagucgaacgccccgauuauggaugaggagcgggagauucccgagcgcuccuggaacagcggacaugagugggugacugacuuuaaagggaagaccgugugguucgucccgucgaucaaggcgggcaacgacaucgcagccugccuccggaagaacggcaagaaagugauccagcugagccgcaagaccuucgacuccgaguacguuaagacgcgggccaacgacugggacuuugucgugaccaccgacaucagcgagaugggggccaacuucaaggcggagcgcguuaucgacccccggcgcugcaugaagcccgucauccugaccgacggcgaggagcgagugauccucgcggggcccaugccggugacgcacuccagcgccgcccagcgcagaggccgcaucggacgcaaccccaagaaugagaacgaccaguacaucuacaugggcgagccccuggagaacgacgaggauugcgcccacuggaaggaggcaaagaugcuucuugacaacaucaauacccccgaaggcaucaucccguccauguucgagcccgagcgggagaaggucgacgccaucgacggggaguaccgcuuacggggcgaggcccgcaagaccuuuguggaccugaugcggcgcggggaccucccuguauggcuggccuacaaggucgcagcggaaggcaucaacuacgccgaccggaaauggugcuucgacgggaucaagaauaaccagauccuggaagagaacguggaggucgagaucuggacuaaggaaggugagcggaagaagcucaagccgcggugguuagacgcccgcaucuauagcgacccccuggcccucaaggaguucaaggaguuugcugcgggucggaaaucccugacgcugaaccucaucaccgaaauggggcgccugcccaccuucaugacccagaaggcccgaaaugcccuggacaaucucgccguccugcacacggcggaggccggcgggcgugccuacaaccacgcccugagcgagcugcccgagacucuggagacccugcuccuccugacccuccuggccacggugacaggcggcaucuuccuguuccucauguccgggaaggggaucgggaagaugacacuaggcaugugcugcaucaucacggcgagcgucuuacucugguacgcgcaaauucagccgcacuggaucgcugccucuaucauccuggaguuuuucuugauagugcuccugauucccgagccagagaagcagcggacgccccaggacaaccagcugacguacguggucaucgccauccucacggugguggcggccaccauggccaacgagaugggcuuccuggagaaaaccaagaaggaccugggcuuaggcagcauaaccacccaggagagcgaguccaacauacuggacauugaucuucgcccagccagcgccuggaccuuguacgcggucgcuaccacguucgugacccccaugcuacggcacuccaucgagaacagcuccgugaacgucagccugaccgcgaucgccaaccaggcgaccguacucauggggcugggcaagggguggccguuauccaagauggacaucggugugcccuuacuggccaucgggugcuacagccaggucaacccgaucacgcugacggccgcccuccugcuguugguggcccacuacgcgaucaucggccccggccugcaggccaaggccacccgcgaggcccaaaagcgggccgcggccgggaucaugaaaaaccccacgguggacggcauuacggucaucgaccuggagcccauccccuacgaucccaaguucgagaagcagcucgggcaggugaugcugcugauccuaugcgugacgcagguccugaugaugcgcaccaccugggcccugugcgaagcccucacucuggccaccggcccgaucuccacccugugggaggggaaucccggccgcuucuggaauacgaccaucgcggugagcauggccaacaucuuccgcgggucguaccucgccggggccggccugcuguucuccaucaugaaaaacaccaccaacacccgccgagggacgggcaacaucggcgagacucucggcgaaaaguggaagucccgccugaacgcgcugggcaagagcgaguuucagaucuacaagaaguccgggauacaggagguggaccggacccucgccaaagagggcaucaagcgcggggagaccgaccaccacgccgucagccggggcuccgcuaagcugcggugguucguggagcggaacauggugacgccggaaggcaaggucguggaccuggggugcggccgcggggguuggagcuauuacugcgggggccucaagaaugugagagaggucaagggccugaccaagggugguccggggcacgaggagccaauccccauguccaccuacgguuggaaccuagugcgucuccaaagcgggguggacgucuucuucaccccgcccgagaagugcgacacacugcugugcgacaucggcgagagcucccccaauccgaccauugaggccggccggacccucagagugcugaaccugguggagaacuggcucaacaacaauacucaguucugcaucaagguccucaacccauauaugccgagcgugauagaaaagauggagacccugcagcggaaguacgggggcgcgcucgugcgcaacccccugucccggaacagcacgcacgagauguacugggucuccaacgccaccggaaacaucgugucguccgugaacaugauaagccgcaugcugaucaaucgguucaccaugaagcauaagaaggccaccuacgagccggacguugaccugggcuccgggacucgcaacaucggcaucgagagugagauccccaaccucgacaucaucggcaagcggaucgagaagaucaagcaggagcacgagaccuccuggcauuacgaccaggaccaccccuacaagaccugggccuaucacgggagcuacgagaccaaacagacgggcuccgccagcucuauggugaacggggugguccgccugcugaccaagcccugggacguggugccaaugguuacccagauggcgaugaccgacacuacccccuucggccagcaacgcgucuucaaggagaagguggacacccggacucaggagcccaaggaaggcacgaagaagcuuaugaagaucaccgccgaguggcuguggaaggaacuggggaagaagaagacgccccgcaugugcacccgggaggaguucacgcgcaagguucgcagcaaugccgcccucggcgccaucuucaccgaugagaacaaauggaaauccgcgcgcgaggccguggaggacgggcgguucugggagcuggucgaccgcgagcggaaccugcacuuggagggcaaaugugagaccugcguguacaacaugauggggaagagggagaagaagcugggcgaguucggcaaggccaagggcagcagggccaucugguacauguggcuuggcgcgcgcuuccucgaguucgaggccuugggguuccugaacgaggaccacugguucucccgcgguaacagccucagcgguguggagggcgagggccugcaccgccucggauacauucuccgggacgucucaaagaaggagggcggcgccauguaugccgacgacaccgccgguugggacacgcguaucaccuuggaggaccugaagaacgaggaaauggugaccaaccacaugaagggggagcacaagaagcucgcggaggccaucuucaagcugaccuaccagaacaaggugguccgugugcaacgccccaccccacggggcaccgugauggacaucaucucgcgccgggaccagcgaggcuccgggcaggucggcaccuacgggcuaaacaccuucacuaacauggaggcucaguuaauccgccagauggaaggcgagggcaucuuuaaaagcauacagcaccugaccgcuaucgaggagaucgcggugcagaacuggcuggcgaaggugggucgggagcgccucucccggauggccaucagcggcgacgacugugucgugaagcccaucgaugaccgcuucgccuccgcccugaccgcccugaacgacauggggaaggugcgcaaggacauccagcagugggaaccgagccgcggcuggaacgacuggacccagguaccguuuugcucccaccacuuccacgagcuggugaugaaggacgggagggugcuggucgugccuugccgcaaccaggacgaguugaucggccgggcgcgcaucagccagggggccggguggucccugaaggaaacagccugccugggcaagagcuaugcccaaauguggacccugauguacuuccaccggcgcgaccuccggcuggccgcgaacgccaucugcuccgccgugcccagccauuggguccccaccucccgcaccaccuggagcauccacgccaagcacgaauggaugacuaccgaggacaugcuggcgguauggaaccggguguggauucaggagaacccuuggauggaggacaagaccccagucgaguccugggaggaggugcccuaccucgggaagcgcgaggaccaguggugcggcagccucaucgggcugaccagcagagcgacgugggccaagaacauccagaccgccaucaaccagguccgcucccucaucggcaacgaggaguacaccgacuacaugcccucaaugaagcgguuccgccgcgaagaagaggaggccggcguccugugguga

SEQ ID NO: 24931 - RNA, 9876 nt, Artificial Sequence
  derived and/or modified CDS sequence (opt11) from DENV-2__KJ189305__SS-prME
accgccgguguaaucgucaugcugauccccacugccauggcuuuccaccucaccacccgcaauggggagccccacaugaucgucggccggcaggagaaggggaagucccugcuguucaagaccgaggacggugugaacaugugcacacuuauggcaauagaucugggagaacugugcgaggacaccauuaccuacaaaugcccgcugcugcgucaaaacgaacccgaggauaucgacuguuggugcaacucuacgucaacgugggucaccuacgggaccugcacuaccacaggagagcaccgcagggagaagcggucgguggcccuggugccacacguagggaugggucucgagacccgcaccgaaaccuggaugagcuccgagggggccuggaagcacgugcagcggauagagacguggauuuugcgccacccgggcuuuaccaucauggccgcgauccuggccuacaccaucgguacgacgcacuuccagcgggcccucaucuucauccugcucaccgccgucgcgcccaguaugaccaugcgcugcaucggcaucuccaaucgcgacuuuguggaaggagugagcgggggcucguggguggacaucguacucgagcaugggagcugugugaccacuauggcaaagaacaagcccacccuggacuuugagcugauaaaaacagaggccaaacaacccgcaacccuccgcaaguacugcaucgaggccaaacugacgaauaccaccacugagucccgauguccgacccagggagagcccagccugaacgaggagcaggacaagcgauucaucugcaagcacuccaugguagaccggggcuggggaaauggcugcggguuguuugguaaaggagggaucgugacuugcgcgauguucacgugcaagaagaacauggaagggaaagugguccagcccgagaaccuugaguacaccaucguuaucacgccccauagcggggaggaacaugcgguggggaacgacaccggaaagcacggcaaagagauaaaaauuacaccgcaguccagcaucaccgaggccgaacugacuggguacggcacggugaccauggaauguucgccgcgcaccggccucgacuucaaugagauggucuuacugcagauggaagacaaggccuggcucguucaccgucagugguuccuggacuuaccgcugcccuggcuuccgggggccgacacccagggguccaacuggauccagaaggaaacguuagugaccuuuaagaacccgcacgcgaagaagcaagacgucgugguccuggggucccaggagggcgccaugcacacagcgcucaccggggcuacugagauccagaugagcagcggaaaccuccuguucaccggccaccugaagugccgacuacggauggacaaacuucagcucaaagggauguccuacagcaugugcaccggcaaauucaagaucgugaaggagauugccgagacucagcacgggacgauuguaauccgcguucaguacgaaggagauggauccccuugcaaaaucccauucgagauaacagaccuggagaagcgucacgugcuggggcgccugauaacggugaacccuaucgucaccgaaaaagacagcccuguuaacaucgaggcggagccgccuuucggcgauucguauaucauuauuggcgucgagccgggccagcuaaagcucaacugguucaagaaggguagcucgaucggccaaauguucgagacaaccaugcgcggcgcgaagcggauggccauacugggggacaccgccugggacuucggcagccucggcggggucuucaccuccauugggaaggcccuccaucagguguuuggggcgaucuacggcgccgccuucaguggcgucucauggacaaugaaaaucuuaaucggagugaucaucaccuggauagggaugaacagccguucgaccagccucucagucagccuagugcucguaggcguggugacccuuuaucugggggccaugguccaagcggacagugguugugucgugaguuggaaaaacaaggagcucaaaugcggcagcggcaucuucauaacagacaauguucacaccuggaccgaacaguauaaguuucagcccgagagccccagcaaacuggcgucggcgauccagaaggcccacgaggaagggaucugcgggauucguucugugacccgauuagagaaccucauguggaaacagaucacgcccgagcugaaccacauccucuccgagaacgaggugaagcucaccaucaugaccggcgauaucaaggggaucaugcaggccggcaagcggucgcuccgcccacagcccaccgaauuaaaguacucuuggaaaacguggggcaaggcgaagaugcucagcaccgaaucccacaaccagaccuuucugauagauggacccgagaccgccgagugcccgaacacgaaccgggcguggaacucacuugagguggaggacuacggcuucgguguguuuacuaccaacauauggcuaaagcugaaagagaagcaggacguguucugcgacucgaaacuuaugagcgccgccaucaaggacaaccgcgcaguccacgcagauaugggcuacuggauugaguccgcccucaacgacaccuggaagauggaaaaggccagcuucauagaggugaaguccugccacuggccuaaaucucacacccugugguccaacggagugcuggagagcgagaugaucauccccaagaacuucgcaggucccgcgucccagcacaacuaccggccgggcuacuacacgcagaccgcagggccguggcaucucggcaagcuagaaauggacuucgauuucugcgagggcaccacgguuguggugacggaggacugcggcaaccgaggcccgagccugcgcaccaccacugccagcggcaaacucaucacggaguggugcugccgauccuguacgcugccuccacuucgguaccggggcgaggauggguguugguaugguauggaaauucggccccucaaggagaaggaagagaaucuugucaauagccuaguaaccgccggucacggccagaucgacaauuucucacuaggcguacugggaauggcacuguuucuagaggagaugcugcgaacccgggucggcacgaagcacgccauccugcucguagccguuagcuuugucacccugaucacugguaauauguccuuccgcgauuuaggucgggugauggugaugguaggagccaccaugacagacgacaucggcaugggcgugaccuaccucgcccuccuagcggccuuuaaggugcgcccaaccuucgccgccgggcugcugcugcgcaagcucacgagcaaggaacugaugauggccacuauaggcaucgcgcugcucucccagucaaccauccccgagacuauccuggagcuuaccgacgcccucgcccuagggaugauggugcuaaagauugugcggaacauggagaaguaccaacuugccgugacgauaauggccaucucaugcguaccgaacgcggugauacugcagaacgcauggaaggugagcugcaccauccuggccgccgucuccgucagcccccuccugcuuacaagcagccagcagaaggcggacuggauaccccucgccuugacgauuaagggccuaaaucccacugcgauuuucuuaaccacccucucccguacgagcaagaaacgcuccuggccgcugaacgaggcaauaauggcggucgguauggugagcauccucgcgaguagccugcucaagaaugacauacccaugaccgggccccucguagccggaggccugcuuaccgucugcuacgugcucacaggccggagcgccgaccuggagcuggagcgggccgccgacguaaagugggaggaccaggcggagaucuccgggucuaguccgauccucagcaucaccaucucagaagacggcagcauguccaucaaaaaugaagaagaggaacagacgcugaccauccucauacgcacgggccuccuggucaucagcggcguauucccgguauccauacccaucacagcagcugccugguacuuaugggagguuaagaagcagcgugccggcguguugugggacguccccagcccgccgccugucgggaaggcggagcuugaggacggcgcguaccgcaucaagcagcgggggauccuggguuacucccagaucggagccggaguguacaaagaggggacguuccacaccauguggcauguuacacgaggggcaguacucaugcaccggggcaagcgcauagagccgagcugggccgacgugaagaaggaccuaaucuccuacgguggcggcuggaagcuggaaggagaauggaaggagggggaagaagugcaaguccucgcgcuggaacccgggaagaacccccgggcagugcagacuaagccaggcauauucaagaccaacaccgggacaauaggcgccgugagccuggacuucagccccgguacaucggggucccccauaguggacaagaaggggaaggugguggggcucuacggcaacgggguugugacccgcuccggggccuacgucucagcgaucgcccagacggagaaguccaucgaggacaaccccgagaucgaggacgacauuuuccggaagaagcgccugaccaucauggauuugcaccccggcgcuggaaagaccaagcgguaccuccccgccaucgugcgcgaggccaucaaacggggcuuacggacacugauccuagcgccgacgcggguuguggccgccgagauggaggaggcccugcgaggguugccuaucagguaucagaccccugcgaucaaggcggagcacacgggccgggagauagucgaucugaugugccacgcuaccuuuacgaugcgccuccugucccccgugcgaguaccgaacuacaauuugauuaucauggacgaggcccacuucacagacccggccuccauagcugcacgcggcuacauaagcacucgggucgagaugggggaggccgccgguaucuucaugaccgccacgccgcccggaucgcgcgauccguuuccccaauccaacgcucccaucauggaugaggagcgggagauuccagagaggucauggaacagcggccacgagugggucaccgacuucaagggcaagaccgugugguucguaccgaguauaaaagcggguaacgacaucgccgccugccuuaggaagaacggaaagaaggucauacagcugagccguaaaaccuucgacuccgaguacgugaagacgcgggccaacgacugggacuucgucgugacaacagacaucagcgaaaugggggcgaacuucaaggccgagagggugaucgacccgaggagaugcaugaaaccggugauccugacggacggcgaggaacgggugauucucgccgggccaaugccggucacgcacucuuccgcugcgcagcgacgggggcguaucgggcggaacccgaagaacgagaacgaccaguacauuuacaugggugagccccuggagaaugacgaggacugugcccacuggaaggaagcgaaaaugcugcucgacaacaucaacacccccgaggguaucauccccucuauguucgagccggagcgugagaaggucgacgccaucgacggcgaguacagacuuagaggggaagcccgcaagaccuucguagaucucaugcggcguggcgaucuccccguguggcuggccuacaagguugcggccgagggcaucaauuacgccgaccguaagugguguuucgacgggaucaagaauaaccagauuuuagaagagaacguggaaguggagaucuggaccaaggagggcgagagaaagaagcucaagccucguugguuggacgcccgaaucuacuccgacccccucgcucucaaagaguucaaggaguucgccgccggccggaagucccugacacugaaccucaucaccgagaugggccgccucccgaccuucaugacccaaaaggcaaggaacgcccuugauaaccucgcuguacuucacacggcagaggccggcgggcgugccuauaaccacgcccugucagagcuaccggaaacccuggaaacacuacuccugcugacucucuuggcgacagucacgggcgggaucuuccuguuccucauguccggcaaaggaaucgggaaaaugacccugggcaugugcugcauaauuacugccuccauucugcucugguaugcccagauccagccacacuggaucgcagcuuccaucauccuagaguucuuucugaucguccuccugauccccgaacccgaaaagcagcggacgccccaagacaaccaguugacauacguggugauagcgauccucacaguggucgccgccaccauggcgaacgagaugggcuuccuugagaagaccaaaaaggaccugggccucggaagcaucaccacccaggagagcgaauccaacauacuggacaucgaccugcgcccugcuuccgccuggacccucuacgcaguggccaccacguucgugacaccaaugcuccggcauucgauagagaacagcuccgugaacgugaguuugaccgccaucgcgaaccaggccaccgugcucauggggcugggcaagggauggccccuguccaaaauggauaucgguguuccccuccuggccaucggcugcuauucgcaggucaaccccaucacgcugaccgccgcccuccugcuguuagucgcgcacuacgccaucauagguccgggacugcaggccaaggcgacccgcgaggcccagaagcgggcggcagccggcaucaugaaaaauccuacuguggacggcaucacggugaucgacuuggagcccaucccguacgaccccaaguucgagaagcaacucgggcaggucauguugcugauccucugcgugacccaggugcugaugaugcguaccaccugggcccucugcgaagcccucacguuggccaccggccccaucuccacccuuugggagggcaaccccggccguuucuggaacaccaccauugcugucagcauggccaacaucuuccgaggcucuuaccuagccggugcgggccuucuguucagcaucaugaagaacaccaccaacacccggcgcgggacgggcaauaucggcgagacccucggggaaaaguggaagucucgccugaacacacugggcaagagcgaguuucagauauacaagaaguccgggauccaagagguggaccggacccucgcgaaggaggguaucaagagaggggaaacggaccaccacgccgugucucggggcucagccaagcugcguugguucgucgagaggaacaugguaaccccggagggcaaggucguagaccugggauguggccgagggggcuggagcuacuacuguggagggcucaagaacgugcgggaggugaagggccucacgaaagggggaccaggccaugaggaacccauacccauguccacguacggcuggaaucucgucagauugcagagcgggguggacguuuucuucacgccucccgagaagugugacacucugcugugcgacauaggcgagagcucgcccaaucccaccaucgaggccggccgaacccuccggguccugaaccugguagaaaacuggcucaacaacaacacccaauuuugcaucaagguucuuaaccccuacaugcccagcgucauugagaagauggagacgcugcaacggaaauacgggggcgcacucguacgcaacccccugagccggaacuccacccacgaaauguacuggguaagcaacgccacagggaauaucgucagcuccgugaacaugaucagccgcaugcuaaucaaccgguucacuaugaagcacaagaaggcaacguacgagccggauguggaccugggcuccgggacacgcaauauaggcauugagagcgagaucccaaaccuggacaucaucggcaagcggauugaaaagaucaagcaggagcacgagaccucguggcauuacgaccaggaccaccccuacaagaccugggcauaccacggcucuuacgagacgaagcagaccggcuccgcuagcucgauggucaacgggguggugcgccuccugaccaagcccugggacgucgugccaauggugacccaaauggcaaugacagacaccacgcccuucggccaacagcgggucuucaaggagaagguggacacccgcacccaggagcccaaggagggcaccaagaagcucaugaagaucaccgcggagugguuauggaaagagcuggggaagaagaaaacaccccgaaugugcacgcgugaggaguuuacccgcaaggugcggaguaaugcagcccugggggccaucuucaccgacgagaacaaguggaaguccgcgcgggaggccgucgaggacgggcgguucugggagcugguggaccgcgaacggaaccugcaccuggagggcaagugcgagaccugcguguacaacaugauggggaagcgagagaagaaacugggcgaguuuggcaaagcgaaaggcagccgggccauaugguauauguggcugggcgcgcgcuuccuggaguucgaggcgcugggguuccugaacgaggaucacugguuuagccgaggcaacagccugagcggggucgagggcgaaggacugcaccgacugggguacauccuccgggacguggguaagaaggagggcggagccauguacgccgacgacacggccgggugggacacccgcaucacccuagaggacuuaaagaacgaggagauggucaccaaccacaugaagggcgagcacaagaaguuggcggaagccaucuucaaacugaccuaccagaauaaaguagugcgcguccagcggccgacgccccggggcacagugauggauaucauaucccgccgggaccaacgcgggagcggccagguggguacuuaugggcugaauaccuucaccaauauggaggcccaguuaauucggcagauggaaggcgaggggaucuucaagaguauucaacacuugaccgccacugaagagaucgcaguccagaauuggcuggcacgcgugggccgcgagcggcucagccgcauggccaucucaggggacgacuguguggucaagcccaucgaugaccgguucgccagcgcccugacugcccuuaacgauauggguaaagugcguaaggacauccaacaaugggagcccucccggggguggaacgacuggacccagguaccauucugcagccaccacuuccacgagcucgucaugaaggauggccgcgugcugguaguccccugcaggaaccaggaugagcugaucggccgugcacguaucucucagggggcgggcuggagccugaaggagaccgccugccucgggaaauccuacgcacagauguggacgcugauguacuuccauaggcgggaccugcgccuggccgcgaaugccaucuguagcgccgugcccucccacuggguucccacaagccggacgacgugguccauacacgccaagcacgaauggaugaccaccgaggauaugcuggcggucuggaaccgcguguggauccaggagaauccguggauggaggauaaaacgccuguggagagcugggaggaagucccuuaccucggcaagagagaggaccaguggugcgggucccugaucggcuugaccagucgugccacuugggccaagaacauucagaccgccaucaaccaggugcgcagucuaauaggcaacgaggaguacacggacuacaugccguccaugaagcgcuuccgcagagaggaggaagaggcagggguccugugguga

SEQ ID NO: 24932 - RNA, 9876 nt, Artificial Sequence
  derived and/or modified CDS sequence (opt11) from DENV-2__FJ898451__SS-prME
accgccggcguaauagugaugcugauccccaccgccauggcguuccaccuuaccacccggaacggugagccccacaugauugucggccggcaagagaaggggaagucccuccuguucaagacagaggacggcgugaacaugugcaccuugauggccaucgaccuaggggagcugugcgaggacaccaucacuuacaagugcccacuccugcggcaaaacgagcccgaagauaucgacugcuggugcaacaguacgagcaccugggucacguacgggaccugcaccaccacuggcgagcaccggcgcgagaagcgguccguagcccuggugccccacgucgggauggggcucgagacacgcaccgagaccuggaugagcucggagggugccuggaagcacguucaacgcaucgagacuuggauccuucggcacccuggcuucaccaucauggccgcgauccuggccuauaccaucgggaccacgcacuuccaacgggcccucauuuucaucuugcugacggccguggcgcccagcaugacaaugcgcugcaucggcaucuccaaccgggauuuugucgagggcgugagcgggggcagcuggguggacaucguccucgagcacgggucaugcguuacuacaauggccaagaacaagcccacgcuggacuucgagcucauaaagaccgaggcuaagcagcccgcaacccuacgcaaguacugcauagaggccaaacugacgaauaccaccaccgagucccguugccccacgcagggggagcccucacugaacgaggagcaggauaagcgcuucaucugcaaacacuccaugguggaccggggcugggggaacggcugcgggcuguucgguaaggguggcauugugacgugugcgauguuuacgugcaagaaaaacauggagggcaaaaucgugcagcccgaaaaucuggaguacaccauugugaucacuccccacagcggcgaggagcacgccgucggcaaugacaccgggaaacacgguaaggagaucaagaucacgccacagagcaguaccaccgaagccgaguuaacaggguacggcaccgugaccauggaguguucaccccgaaccggccucgacuuuaacgaaauggugcugcuucagauggaggacaaggccuggcucguccaucggcagugguuccuggaucuaccccuuccuugguugcccggggccgauacucagggcaguaacuggauccagaaggagacgcuggucaccuucaagaacccccacgcaaagaagcaagacguggucgugcucgguucccaggagggcgccaugcacacagcgcugacgggggccaccgagauccagaugagcucuggcaaccuucuguucacgggccacuuaaagugccgccuccggauggacaagcuccagcugaaggggauguccuacagcauguguaccggcaaguucaaaauaguaaaggaaaucgccgagacgcagcacgggaccaucgugauuagagugcaguacgagggcgacggcucccccugcaagauaccguuugagaucaccgacuuagagaagcgacacguguuagggcgccugaucaccgugaaccccauugugaccgagaaggacagcccgguuaacaucgaggcggagccgccauucggagacucguacauuaucguagggguggagccgggccagcugaagcugaauugguucaagaaggggagcucuauaggccaaauguucgagaccaccaugcgcggcgcuaagcgcauggccaucuuaggggacaccgccugggacuucggcagccucggagggguguuuacguccaucgggaaggcgcuccaccagguguuuggggcgaucuauggcgccgccuuuagcgggguguccuggacgaugaagauccugaucggugucaucaucaccuggaucgggaugaauagccgcuccacaagccucuccgugagccuggugcucgucggcguggugacguuguaccucggggugauggugcaggccgacuccggcugcaucgugucguggaaaaacaaggaacucaagugcggcuccgggaucuucaucaccgauaauguccacaccuggaccgagcaguacaaguuccagcccgagagcccuagcaagcuggccagcgccauccagaaggcccacgaagagggcaucugugggauccggagcgugacgcgcuuggagaaccucauguggaaacagaucacccccgaguuaaaccacaucuuguccgagaaugagguuaagcucaccaucaugaccggcgacaucaaggggauaaugcaggccggcaagaggagccugaggccgcagcccacggagcugaaguacuccuggaagacguggggaaaggccaagaugcucaguaccgagucccacaaccagaccuucuuaauugacgggccagagacggcggaaugcccgaacaccaaccgggcuuggaacucgcuggagguagaggacuacggcuucgggguuuucuccaccaauaucuggcugaagcugcgcgagaagcaagauguguuuugcgacagcaagcugauguccgcggccauuaaagacaaucgagcgguacacgcagacaugggcuacuggaucgaaagcgugcucaacgacacguggaagauggagaaggcuucguuuauugaagugaaaagcugccacuggcccaagucccauacucuguggagcaacggcgugcuggagucagagaugauuauacccaaaaacuucgccgggcccguuagccagcacaacuaccgaccuggcuaucacacucagacagccggcccuuggcaccucggcaagcuggagauggauuucgacuucugcgaggggaccaccguggucgugacagaggacugcggcaaccggggccccucauugcgcaccaccacagccagcgggaagcucaucacagaguggugcugccggagcugcacccugccaccccuccgcuacagaggggaggacgggugcugguacgguauggagauacgcccccuuaaggagaaagaggagaaccuggugaacucauuggucaccgcggggcacggccagaucgacaauuucagcuugggcgugcuagggauggcccuguuccucgaggaaaugcugcggacccgcgugggcaccaagcacgccauacugcucgucgcccuguccuucguuacccugaucaccgggaauaugagcuucagggaccucggucgagugauggucauggugggggcgaccaugacggacgacaucggcaugggcgucaccuaccuggcccugcucgccgcauucaaggucaggccaaccuucgcugcggggcugcugcuccggaagcucaccuccaaagaacugaugauggccacgaucggcaucgcccuccugagccagagcacccuacccgagacaauccucgaacugaccgacgcccuggcacucgguaugauggugcugaagauugugcgcaacauggaaaaguaccaacuggcgguuacgaucauggcuauauccugcgugccgaacgccgugauccuccagaacgccuggaaaguuuccugcaccauccucgccgcggugagcguuagcccucugcucuugaccagcucccaacagaaggcagacuggaucccacuggcccugaccaucaagggcuugaaccccacggcaaucuuucugaccacccucagccguacuagcaagaagcgaagcuggccgcugaacgaggcaaucauggcuguggggaugguguccauccuggccagcucacuccugaagaacgauauucccaugacggggccccugguagccggcggacuccugaccguuuguuacguguugaccggccggucggcugaccucgagcuagagcgcgcggccgaugucaagugggaagaccaggccgagauaagcggguccucacccaucuuauccaucaccauaagcgaggacggcuccaugagcaucaagaacgaggaggaggagcagacauuaacaauccugaucagaacuggccuucucgugaucuccggaguguucccugucagcaucccuauuaccgccgccgcaugguacuuaugggaggugaagaagcagagggccggcgugcugugggacgucccgagcccgccgccaguugggaaagccgaacucgaagacggugcauacagaaucaagcaacgcgggauauuagguuacucucagaucggcgccgggguguacaaggagggcacguuucacaccauguggcacgucacccgcggcgcgguguugaugcaucgcggcaaacggauugagcccuccugggccgacgugaagaaggaccugauuagcuaugggggcggcuggaagcuagagggggaguggaaggagggggaggaaguccaggugcuugcccucgagcccggcaagaaccccagagccgugcagaccaaaccgggcaucuuuaagacuaacacugggaccaucggcgcggucucccuggauuucucgcccgguaccuccgggagccccaucguggaccggaaaggcaagguggucggacucuacggcaacggcguggugacccgcaguggggcguacgugagcgcaaucgcccagacggagaagucuaucgaagacaaucccgaaaucgaagacgacauauuccggaaaaagcgccucacuaucauggaccugcacccaggugcugggaaaaccaagcgguaccugcccgcgaucguacgcgaagccauuaagcggggccugcgcacccucauuuuggccccgacgcgcguggucgccgccgagauggaggaggcgcugagaggccuccccauccgcuaccaaacccccgccauccgggccgagcacaccggacgcgagaucguggaucugaugugccacgccacuuuuacaaugcgguuacucucgccugugcgcgucccgaauuacaaucugauuaucauggacgaggcccacuucacagacccagcgagcauugccgcccggggcuacaucuccacccgcgucgagaugggagaggccgccggcaucuuuaugaccgcuacgccgcccgguagcagagacccguucccucaauccaacgcccccaucauggacgaggagcgcgagauccccgagcggagcuggaacuccggccacgagugggugacugauuucaaagguaagaccguuugguuuguuccguccaucaaagcuggaaacgacaucgccgcgugcuugcgcaaaaacggcaagaaggugauccagcucucccggaagaccuucgacagugaguaugucaagacgagggcgaacgacugggauuucguggugaccaccgacaucuccgagaugggcgccaacuucaaggccgagcgggucaucgacccccggcgaugcaugaaacccgugauccugaccgacggcgaggaacgcgugauacuugccgggcccaugccggucacgcacagcuccgcggcccagcggcgcggccgcaucgggcgaaauccgaaaaacgagaaugaccaguacauuuacaugggcgagccccucgagaacgacgaggacugugcgcacuggaaggaggccaagaugcuguuggacaacaucaacacgccugaggguaucaucccgucgauguucgagccugagcgcgagaagguggacgcuaucgacggggaguaccggcuccgcggcgaagcgcggaagacguuuguggaccugaugcgacgaggggaccugcccgucuggcucgccuauaaagucgcagcggagggcaucaacuacgcggaccgcaaguggugcuucgacggaaucaagaacaaccaaauucuggaagagaacguggaggucgagaucuggaccaaggaaggcgaacggaagaaacuuaaaccgagguggcuggacgcgcggaucuacucugaccccuuggcgcugaaagaguucaaagaguuugccgcgggccgaaaaagccuuacgcugaacuugauaacggagauggggcgccuacccaccuucaugacgcagaaggcucgcaacgccuuggauaaccuggcgguacuccauacggcggaggugggcgggcgggccuacaaccacgcucuuuccgagcugcccgagacccucgagacccugcugcuccuuaccuuacucgccacggucacuggcgggaucuuucuguuccucaugagcgggaaggggaucgggaagaugacccucggcaugugcugcaucaucaccgccuccauccugcugugguaugcacagauucagccucacuggauugccgcaagcaucauccuagaguucuuucugauaguacugcugaucccagagcccgagaagcagcggacgccccaagacaaccagcugacguacgucgugaucgcuauccugacuguggucgccgcaacgauggccaacgagaugggguuccuggagaagaccaagaaggaccugggcuuuggaagcaucaccacccaggaguccgagagcaacauauuagacaucgaccuccggccugcguccgccuggacccuguacgcuguggcaaccacguucgucacccccaugcugcgccacucgauugagaacuccagcguaaacgugucccucacugccaucgcgaaccaggccaccguccugauggggcugggcaagggcuggccacucagcaagauggacaucggcguuccucugcuggccaucgggugcuacucccaggugaacccgauaacgcucaccgccgcacugcugcuacuggucgcccauuaugccauaaucggccccggccugcaggcgaaggccacccgggaggcccagaagagagccgccgccgggaucaugaagaacccuacaguugacggcaucacggugaucgaucucgaacccauuccguaugaccccaaguucgagaagcagcugggucaggucaugcuacucauccugugugucacccaaguacugaugaugcguacuaccugggcucucugcgaggcgcugacgcucgccaccgggccuaucagcacgcugugggaggggaaccccggccgcuucuggaacacaacgaucgccgugucgauggccaauaucuuccgcggcagcuaccuggcuggggcgggccuccuguuuagcaucaugaagaacaccaccaacacuagacgagggacgggcaacgucggcgagacccugggggagaaguggaagucccgguuaaacgccuuaggcaaguccgaauuucagaucuacaagaagucugggauucaggaggucgaccgcacccuggcuaaagaggguauuaaacggggugagacggaccaccaugcggugucccgcggcucugcgaagcugcggugguucgucgagcgcaacauggugacucccgagggcaagguggucgacuuggguugcggccgcggcgggugguccuacuacugcggcggacugaaaaacgucagggaggugaaagggcugacaaagggcggcccugggcaugaggaacccaucccgaugagcacuuauggcuggaaccucguccggcuccagagcgggguggacguguucuucaccccgcccgagaagugugacacacuacucugugacaucggggaguccagccccaaccccaccauugaggcuggccgcacccugcggguccugaaucucgucgaaaacugguuaaacaacaacacgcaguuuugcaucaaggugcugaacccguacaugcccuccgugaucgagaagauggagacccugcagcgcaaguacgggggcgccuuaguucggaacccccugucccgcaacucgacgcacgaaauguacugggugagcaaugcaaccggcaacaucgucucuagcgugaauaugaucucccggaugcugaucaaccgcuucaccaugaagcacaagaaagcaacuuaugagccggacguggaucucggcagcgggacgcgcaauaucggcauugaauccgagauccccaaucuggacauaaucggcaaacgcaucgagaagauuaagcaagagcacgagaccuccuggcacuaugaccaggaccacccguacaagaccugggcguaccauggguccuacgagacuaagcagacgggcagcgccuccagcauggucaacgggguagugcgccugcucaccaagcccugggacgucgugccgaugguuacccagauggccaugaccgacacgaccccuuucgggcagcagcgggucuucaaagagaaagucgauacccgcacacaggagcccaaggagggaacgaagaaacuuaugaaaauaaccgcagaguggcuguggaaagagcucgggaaaaagaagacgccccgcaugugcaccagggaggaguucacgcggaagguccgcuccaaugccgcguugggcgccaucuucaccgacgagaauaaguggaaguccgcgcgggaggccgucgaggacgggcgcuucugggagcuggucgaccgcgaacgcaaucugcaccuugagggcaagugcgagaccugugucuacaacaugauggggaagcgggagaagaagcugggcgaauuuggcaaggccaaggggucccgcgcgauuugguacauguggcugggagcccgguuucuggaguucgaggcucugggguuucucaacgaggaccacugguucagucgugggaacagccugagcgggguggagggcgagggcuugcaucggcucggguacauccuacgcgaggugggcaagaaggaaggcggcgccauguacgcugacgacaccgccgggugggacacgcggaucacauuggaggaccucaagaacgaggagauggucaccaaccacaugaagggcgaacauaagaagcuggccgaggcgaucuucaagcugacauaccagaacaaggugguucgcguucaacggccuacgccccgcggcacagugauggacauaaucagccggaaggaccaacguggguccggccagguugggacguacggccucaacaccuucacgaacauggaagcccagcugauccgccagauggagggugagggcauauuuaagucaauccagcaccugaccgccaccgaggagaucgccguucaaaacuggcuagcccgggugggccgcgagcgguugucccgcauggccauaagcggggacgauugcguugucaagcccaucgacgaccgguuugccucggcgcugaccgcccucaacgauauggguaaggugcgcaaggacauccaacagugggagcccagccgcggguggaacgacuggacccaggugccguucugcucccaccauuuccacgagcuagucaugaaggacggcaggguguuggugguacccugccgaaaccaggacgagcucauagggcgcgcccggaucagccagggggccggauggucccugaaggagaccgccugccugggcaagaguuacgcucagauguggaccuugauguacuuccaccgccgugaccugagacuggccgccaaugccaucugcucagccgugcccucccacugggugcccaccucacggaccacguggagcauccacgcgaagcacgaguggaugaccaccgaagacaugcuugcggucuggaaccgcguguggauccaggagaacccguggauggaggacaagacccccguugaguccugggaggaggucccauaccugggcaaacgcgaggaccaguggugcgggucccugaucggccucacgucccgcgccaccugggccaagaacauccagaccgcgaucaaccaggugcgaucucugauuggcaacgaagaguacaccgacuacaugccgagcaugaagcgcuuccgccgcgaggaggaggaggccgggguguuaugguga

SEQ ID NO: 24933 - RNA, 9876 nt, Artificial Sequence
  derived and/or modified CDS sequence (opt11) from DENV-2__HM488257__SS-prME
acagccgggaucaucaucaugaugauccccaccgugauggcuuuccaccugaccacacgaaacggggaaccccacaugaucgucucucggcaggagaagggcaagagccugcuguucaagaccgagaacggggugaauaugugcaccuugauggcgauggaucuuggcgagcugugcgaggauaccaucaccuacaacugccccuugcuacgacagaacgagccagaggacaucgacugcugguguaauagcacaagcaccugggugaccuacggaaccuguaccgucacuggagaacacaggagggagaaacggagcguggcgcuugucccccacgucgggauggggcucgagacgcgcacugagaccuggaugaguuccgagggugcauggaagcacgcccagaggaucgagaccuggguccuccggcacccaggcuucacgauuauggcagcgauccuggcguacaccaucggcaccacguacuuucagcgggugcugauauucauccuucuuacggccgucgccccguccaugaccaugcgaugcauagggaucucaaaccgggacuucguggagggcgugucaggagggagcugggucgauaucgugcuggagcacggcagcugcgugaccaccauggcuaagaauaagccuacgcucgauuuugaauugaucaagacugaggccaagcaccccgccacacugcgcaaguauugcaucgaggccaaacuuacuaacacgaccaccgcaagccggugcccgacccagggcgaacccucccucaacgaagagcaggacaagcgcuucgucuguaagcacagcaugguggaccggggcuggggcaacgggugcggccuguuugggaagggagggaucgugacgugugccauguucacaugcaagaagaacauggagggcaagaucguccagccugagaaccucgaguacaccauagucauuacgccccacucaggcgaagagaacgccgugggaaacgacacggggaaacacgggaaggagaucaaaguaacuccgcagagcucuaucaccgaggcagaacugacuggcuauggaacggugacgauggagugcaguccgcgcacaggccuggauuucaaugagauggugcuccugcagauggagaacaaggccuggcugguucaucggcagugguuccucgacuugccccugcccuggcucccgggcgccgacacacagggguccaauuggauccaaaaggagacccuagugacauucaagaacccucaugcgaagaagcaggacgucguggugcuggguagccaggagggggccaugcacaccgcccucaccggcgccacggagauccagaugagcuccgggaaccugcuauucacaggccaccucaagugucgccugcggauggacaaacugcagcucaaggggaugagcuauuccaugugcaccgggaaguucaaggucgugaaagaaauagccgagacccagcacggcaccaucguuauccgcguccaguacgaaggggacggcucucccugcaagaucccguucgaaaucauggacuuggaaaaaaggcauguacuuggccgccucauuacgguaaacccuauuguaacggagaaggacucccccgugaacauagaggcggagcccccauucggggauucuuacaucaucgugggcgucgaaccagggcagcugaagcuguccugguucaagaaaggcucguccaucggucagauguucgagaccaccaugagaggugccaaacggauggcaauccucggcgacacggccugggacuuugggagccuagguggggucuucaccuccaucggcaaagcccuucaccagguguucggagcuauauauggggccgccuucucaggagucuccuggacgaugaagauccucauugguguagugauaaccuggaucggaaugaacagccgcuccacgucgcuguccgucagccugguguuggugggggucgugacccuguaucugggcgucaugguccaggcagacuccgggugcguggugagcuggaagaacaaagagcugaaaugugguaguggcauauuuauuaccgacaauguccacaccuggacggagcaguacaaguuccagcccgaaucaccaucuaaacucgcgucagccauccagaaggcccacgaggaaggcaucugcgguauacggagcgugaccagacuagagaaccugauguggaagcaaauaacacccgaacucaaccauauccuguccgagaaugaggugaaguuaacaaucaugacgggggacaucaaggggaucaugcaggcgggaaaacguucccuacgcccgcagcccaccgagcucaaauacuccuggaaggccuggggcaaggccaagaugcugagcacggaacuccacaaccacaccuuccugaucgacggccccgagacggccgagugcccaaacaccaaccgcgccuggaauagucuagaggucgaggauuacggguucgggguguucaccaccaacaucuggcucaagcugaaggaacgccaggacguguucugcgauagcaagcugauguccgcugccaucaaggacaacagggcgguccacgcggacauggguuauuggauagagagcgcccucaacgauacguggaagauugagaaggccuccuucaucgaggucaaguccugccacuggcccaaaucccacacccuguggagcaacgguguucuggaguccgagaugaucauccccaagaacuucgccggccccgugagccaacacaacuaccgcccgggguaccacacccaaaccgcgggacccuggcaccucgggagacuggagauggacuucgacuucugugagggcacuaccguuguggucaccgaggacugcgggaaccgcggcccaagccucaggaccacgacugcuuccgguaagcuaauuaccgagugguguugucgcaguugcaccuuacccccgcugcguuaccgcggggaagacggcuguugguacgggauggaaauccgaccccugaaggagaaggaggagaaccucgugaauucccugguuaccgccggccacggccagaucgacaacuucucacucggaguccuuggcauggcacuauuucucgaggagaugcugcgcacucguguaggcaccaagcacgcgauccugcucguugccguauccuucgugacccugauuacugggaacaugucauuccgcgaccugggacgcgugauggucaugguuggcgccacgaugacugacgacaucgggaugggcgugacguaccucgcccugcuggccgcguuuaaagugcggcccaccuacgccgccggccuccugcuucguaagcucaccuccaaggagcugaugaugaccaccaucgggaucgugcuacugagccaguccaccaucccggagacgauccuggagcugaccgacgccuuagccuuaggcaugauggugcugaaaaucgugcggaacauggagaaguaccagcucgcgguaaccaucauggccauucugugcgucccuaacgcugugaucuugcagaacgccuggaaggugagcugcaccacgcucgcaauggucuccgugagcccuuugcuguugacaucaagccagcaaaaggcggacuggaucccccuggcguuaaccaucaaggggcucaauccgacugcuaucuuucugacgacccugagccgcacuagcaagaagcgguccuggccgcucaacgaggccaucauggcggugggcaugguuagcauccucgccuccagucugcucaagaacgacauacccaugacuggcccccugguagccgggggccugcucacggugugcuacguccugaccgggcgcagugccgaccuggagcuugagcgagccgcggacgugcggugggaggaacaggccgagaucuccggcagcucgcccauccugucgaucaccauuuccgaggacgggucaaugaguaucaagaacgaagaagaagagcagacacugacaauccucauacggaccggccuccuggucauaucuggccucuucccggucuccauccccaucaccgccgccgccugguaccugugggaggugaagaagcagagagcgggugugcugugggacguacccaguccgccgcccgugggcaaggccgagcucgaggacggggcguaccggaucaagcagaagggcauucugggguauagccagaucggcgccggcguguacaaggaggggaccuuccacacuauguggcacguaacgcgcggggccgugcuaaugcacaaggggaagcgaaucgagcccagcugggccgacguaaagaaagaccucauauccuacggcgggggcuggaagcuggagggugaguggaaggagggugaagagguccagguguuagcccucgagccaggcaagaauccccgcgccguccaaaccaagcccggacucuucaagacgaauaccggcacgaucggugccgucagccuggacuucuccccuggcaccucuggcucgcccauaguagauaagaaggggaaagugguuggucuauacgggaauggaguggugacccggagcggcaccuacgucucagccauagcacaaacggagaaguccaucgaagacaacccugaaaucgaggaugacaucuuccgcaagaagcggcucaccauaauggaccugcaccccggggcugggaagaccaagcgcuaccuacccgccaucgugcgggaggccaucaagcgcgggcuccggacccugaucuuggccccgacucgcguagucgccgcggaaauggaggaggcucuccguggccuaccaauccgcuaccagacccccgcaauucgcgcggagcacacggggagggagaucguggaccuuaugugccacgccaccuucacgaugcgccuauugagccccauccgugugccgaacuacaaccugauuaucauggaugaggcucacuucaccgacccggccuccaucgccgcccgcggcuacaucagcacccggguugaaaugggagaggcagccgggaucuucaugaccgcuacgccgcccggcucccgcgacccguuuccccagucgaacgcccccaucauggacgaggagcgggagauccccgagcgcuccuggaacagcgggcacgagugggugacggacuucaagggcaagacugugugguucgugccaucgaucaaggcggggaacgauaucgcagcgugccuccguaagaacgguaagaaggugauccagcucagccgcaagaccuucgacucggaguacauuaaaacgcggaccaaugacugggacuucguggucacgaccgacauaagcgaaaugggcgccaacuuuaaggccgaacgcgugaucgaccccaggcgcugcaugaagcccgugauccugacggauggcgaagagcgaguuauccuggccggacccaugccggugacgcauuccagcgccgcacaaaggcggggucgcgugggacggaaccccaaaaacgaaaacgaccaguacaucuacaugggggagccccuagagaacgaugaggacugcgcccauuggaaggaggcgaaaauguugcucgacaacaucaacacgcccgagggcaucauuccguccauguucgagcccgagagggagaaggucgacgccaucgacggcgaguaccgccuccgcggggaggcccgcaagaccuucguggaccugaugagacgcggcgaucucccggucuggcuagccuaccggguggccgcugaggggaucaacuacgccgaccgccggugguguuucgacggcgugaagaacaaccaaaucuuagaggagaacguugaaguugagaucuggacgaaggagggggagcggaaaaaacucaaaccgcgguggcuggacgcccgcaucuacucagaucccuuggcccuuaaggaguuuaaggaguucgccgccggacggaagucccugacccugaaccucaucaccgagaugggccgccugcccaccuucaugacacagaaggcccggaaugcacucgacaaccucgccgugcuccacaccgccgaggcagggggccgcgcguacaaccacgcccugagcgagcuccccgagacgcuggagacccuguuacugcugacguuacuggccaccgucaccggggggaucuuccuguuccucauguccggcaaggggaucggcaagaugacccucgggaugugcugcaucaucaccgcgagcauccugcucugguacgcccagauacagccgcacuggaucgccgccuccaucaucuuggaguucuuucugaucguucuccugauccccgaacccgagaagcagcgcacgccccaggauaaccagcugacguaugugguuaucgccauccucaccgugguggcagccaccauggccaaugagaugggcuuccuggagaagacgaagaaggacuucgggcuugguagcaucaccacccagcagccggaaagcaacauccucgacaucgaccuacgcccagccuccgcguggaccuuguacgcggucgccacgaccuuuaucacccccaugcuccggcauagcaucgagaacuccagcgugaauguaucccugacugcaaucgcgaaucaggccacgguucuaaugggccucgggaagggauggccccuuucaaagauggauaucggggugccgcugcucgcuaucggcugcuacucgcaagugaaucccaucacccucaccgccgcccuccuccugcuggucgcucacuacgcgauuauagggccgggccuacaggccaaggccacccgugaggcccagaaacgcgccgccgcugggaucaugaagaaucccacuguggacgggaucacaguuaucgaccuggacccgauacccuacgaccccaaguucgagaagcagcuuggccagguuaugcuccuaguucuaugcgugacccaggugcucaugaugcgcaccaccugggcccugugcgaggcccugacccucgcgacugggccaaucagcacccugugggagggcaacccggggcgcuucuggaacacgaccaucgcgguguccauggccaacauauuucggggcuccuaccuggccggcgcagggcuacuguucagcaucaugaagaacaccgcuaacacccgcaggggcacggggaacaccggagagacccugggagagaaguggaagcaccggcucaaugcgcugggcaagagcgaguuccagaucuacaagaaauccggcauccaggaaguggaccggacgcuggcaaaggaggggaucaagcgcggggaaacggaccaccacgccgucagcaggggauccgcuaagcuccgcugguucguggaacggaaccucgugacacccgagggcaaggucguggaucuaggcugcgggaggggaggguggagcuacuacugcggcgguuugaagaaugugaaggaggucaagggccugacuaagggcgggcccggucaugaggagcccaucccgauguccaccuauggguggaacuuaguacggcuccagagcggcguggacgucuucuuuaccccgcccgagaaaugcgacacccuacugugcgacaucggggagucgagccccaacccgaccguggaggcgggacgcacacuccggguacugaaccugguagagaauuggcuaaacaacaauacccaguucuguaucaaggugcugaaccccuauaugcccagcgugaucgagaaaauggaggcccugcagcgcaaguacggcggggcgcuagucaggaauccgcucucccgcaacagcacgcaugagauguacuggguguccaacgccucgggcaacaucguguccucuguaaacaugauaagcagaauguuaaucaaccguuucaccaugagacauaaaaaggccaccuacgagcccgacguggaccuggggagcggaacccgcaauauuggaaucgaguccgagacucccaaccuugacaucaucggcaagagaauugagaagaucaagcaggagcacgagaccucguggcauuacgaccaagaccaccccuacaagacgugggcguaccauggauccuacgagaccaagcagacaggguccgccuccaguauggucaauggagucguccggcugcugaccaagccgugggacgugauccccauggucacccagauggcgaugacggauaccacccccuucgggcagcagcgcguguucaaggagaaggucgacacccggacccaggagccgaaggaggguacaaagaagcucaugaaaauaaccgccgagugguuauggaaggagcugggcaagaagaaaaccccgcgcaugugcaccagagaggaguucacacgaaaggugcgcuccaacgccgcgcuaggggccaucuuuaccgacgaaaacaaauggaaguccgcccgcgaggccguugaagauucaggguucugggaacuggucgauaaggaaagaaaucugcaccucgaggggaagugcgaaacuugcguauacaacaugaugggcaagcgugaaaagaagcugggggaguucggcaaagccaagggcagcagggcgauuugguacauguggcugggagcacgcuuccuugaauuugaggcccugggcuuucugaacgaagaccacugguuuucccggaaaaacagccucagcgggguagagggcgagggucuucacaaacugggauacauccuccgcgauguguccaagaaggaagguggugccauguacgcggacgacaccgccggcugggacacgcggaucacccuagaggaucugaagaacgaggagauggugaccaaucacauggagggugagcacaagaagcucgccgaggccaucuuccgccugacauaccaaaacaaagugguccgggugcaacgucccacgccccgagguaccgugauggacaucaucagcaggcgggaccagcguggguccggccaggucgugaccuacggccugaacaccuucacgaacauggaggcgcagcucauccgacagauggagggggagggcguguucaagucaauccagcaccuaaccgcuaccgaagagaucgccgucaagaccuggcuggugcguguggggcgggagcgucucucccgcauggccauaagcggcgacgacugcgugguuaagccgcuggacgaccgcuucgccucggcccuaacggcguuaaacgacaugggcaaggugcgcaaggacauccagcagugggaaccaagccggggauggaacgacuggacccagguucccuucugcucccaccacuuucaugagcugauuaugaaggacggccgcgugcuugugguccccugccggaaucaggacgagcucaucgggcgcgcccgaaucucgcagggcgcgggguggagucugagagaaaccgcaugccugggaaagagcuacgcccagauguggagucuuauguacuuccaucggcgugaccugcgccuggcggcgaacgcgaucugcagcgcugugcccucgcauugggugccgaccagccgcacuacguggagcauccacgccacucacgaauggaugaccaccgaggacaugcucacuguauggaaccggguguggauccaggagaaccccuggauggaagacaagacccccguggagagcugggaggaaaucccauaccugggaaagagagaggaucaguggugcggcucacugaucggccucaccuccagagcgaccugggcuaagaacauucagacggccaucaaccagguccgcagccugauugguaacgaggaguacaccgacuauaugccguccaugaagcgcuuucggcgcgaggaagaggaagcaggagugcugugguga

SEQ ID NO: 24934 - RNA, 9876 nt, Artificial Sequence
  derived and/or modified CDS sequence (opt11) from DENV-2__HQ999999__SS-prME
acagcgggcgugaucgugaugcugauccccaccgccauggcguuccaccucaccacccgcaacggagagccucacaugaucgugggccggcaggagaaggggaagucccuguuguucaagaccgaggacggcgugaauaugugcacccucauggccauagacuuaggggagcugugcgaggacaccaucaccuacaagugcccccuccuaaggcagaacgagcccgaagacaucgacuguuggugcaauagcacgagcaccugggucaccuacgggaccugcaccaccacgggcgagcaccggcgcgaaaaacggagcguggcccuggugccucauguagggaugggucucgagacccgaaccgagaccuggaugagcagcgagggggcuuggaagcacauccagcggauugagaccuggauucugcgccacccgggcuucaccauuauggcugcgauacuagccuacaccaucgggaccacccacuuccagcgggcccucaucuucauacugcugaccgcggucgcgcccagcaugaccaugcgcugcauaggcauaagcaaccgggacuucguagagggcgugagcgguggcagcuggguugauaucgugcucgagcacggcagcugcgucaccacgauggccaagaauaaacccacccuggacuucgagcugaucaagacggaggccaagcagcccgccacccuccguaaauauugcaucgaggcaaagcugacgaacaccaccaccgagucccggugcccgacucagggugagcccagccugaaugaggagcaagacaagcguuuuaucugcaagcacuccaugguggacaggggcugggggaacgguugcggacuguucggcaagggcgggaucgugacgugugcuauguucacgugcaagaagaacauggaggggaaagucgugcagcccgagaaccuggaguauaccaucgugaucacgccccacucgggggaggagcacgccgucggcaacgacaccgguaaacacggcaaggagaucaagaucaccccgcaguccagcaucaccgaggccgagcugaccggguacggcacugugacaauggagugcagcccccgcaccggucucgacuuuaacgagauggugcugcugcagauggaggacaaggcuuggcucguccaucggcagugguuccuggaccugccccuccccuggcugccuggggccgacacacagggcagcaacuggauccaaaaagagacccugguaaccuucaagaacccccacgcgaagaagcaggacguggugguacucgggucccaagagggagccaugcacacggcccugaccggggccacggagauccagaugagcaguggcaaccucuuauucaccggccaccugaagugucgccugcggauggacaagcuccaacugaaggggauguccuacagcaugugcaccggcaaguucaagaucgucaaggagaucgccgagacgcagcacggcacgauugugauccgcgugcaguacgagggcgacggcucccccugcaagauccccuucgagaucaccgacuuagagaagcggcauguacucgggcgccugaucaccguuaaccccaucgucaccgagaaggacagccccaucaacaucgaggcggagccucccuucggcgacuccuacaucaucaucggggucgagccuggccaacugaagcucaacugguucaagaaggguagcuccaucggccagauguucgagacgacgaugcgaggcgccaagcggauggcuauccugggggacaccgccugggacuucggcagccucgggggcguguucaccucaaucgggaaggcccuucaccagguguucggcgcgaucuacggagccgccuucagcggcgucucuuggacgaugaagauccugaucggcgugaucaucaccuggaucgggaugaacagccgcaguacgagccuguccgugagccuggucuuaguuggcgucgugacccuguaccugggggccauggugcaggcggacuccggcugcguggucagcuggaagaacaaggagcucaagugcggcucugggaucuucaucacggacaacgugcacacguggaccgaacaguacaaguuucagcccgagagccccagcaagcuggcauccgccauucagaaggcgcacgaggagggcaucugcgggauucggagcgucacccggcuggaaaaccucauguggaagcagauuacgcccgaacugaaucacauccuguccgagaacgaggucaaacucaccaucaugacaggggacaucaaggggaucaugcaggcaggcaagcggagccugcgcccacagcccaccgagcugaaguacucuuggaagacgugggggaaagcgaagaugcucagcacggaaucccacaaucagacuuuccuaaucgacgggcccgagaccgccgagugcccgaacacgaaccgagccuggaacagccucgaggucgaggacuacggcuucgggguguucaccaccaacaucuggcucaagcugaaggagaagcaggacguauuuugcgacuccaaguugaugagcgccgccaucaaggacaaccgcgcgguacacgccgacaugggcuacuggaucgaguccgcccucaacgauaccuggaagauggagaaggccagcuuuaucgaggugaagucaugccauuggccuaagagucacacccugugguccaacggcgugcuggaaagcgagaugaucauccccaagaacuucgccgggccagugucccagcacaacuaccggccgggcuaccacacgcagaccgcagggcccuggcacuuaggaaaguuggagauggacuucgaccugugcgaggggacuaccguugucgugacggaggacugcggcaaccgcggaccuagucuccggaccacuaccgcgucugggaagcugauuacggaguggugcugccgcuccuguaccuuacccccgcuccgguaccgaggcgaggacggcugcugguacggcauggagauccgaccccugaaggagaaggaggagaaucuggugaacagccucguuaccgccgggcacggccagaucgacaacuucucccugggcguguuggggauggcacucuuccuggaggagaugcugcggacccggaucggcacgaagcacgccauccuccugguggccgucagcuucgugacccuuaucaccgggaacauguccuuccgcgaccucgggcgggugauggucauggugggggccacgaugacugacgacaucggcaugggcgugaccuaccuagcccugcuugccgcauucaagguccgccccaccuucgccgccgggcugcugcucagaaagcugaccucuaaggagcugaugauggccaccaucggcauugcccuccugucccagagcaccaucccggagaccauccuugagcucaccgacgcacuggcucuggggaugauggugcucaaggugguccggaauauggaaaaguaccagcuugcugugacgaucauggccaucuccugcgucccgaacgccgucauccugcagaaugcguggaaggugagcugcaccauccucgccgccguguccgucagcccacugcugcucaccuccagucagcagaaagcggacuggaucccccuggcgcugaccaucaagggccucaaccccacggccaucuuuuuaaccacgcugucccgcaccagcacgaagcgguccuggccgcucaacgaggccaucauggccgugggcaugguuagcauccuggccuccagccugcucaagaacgacaucccgaugacugggccccugguugcgggcgggcugcucacggugugcuacguccugaccggccgcagcgcagaccuggagcucgagagggccgcagacgugaagugggaggaccaggccgaaaucuccggguccuccccuauccugucgaucacgaucuccgaggauggcagcauguccaucaagaacgaagaagaggagcagacccugacuauucucauacgcaccggcuugcuggugauuagcggggucuucccgguguccauccccaucaccgcggccgccugguaccucugggagguaaagaagcagcgggccggcguccugugggacgugccaagcccgccgcccguggagaaagccgagcuggaggacggggcguaccgcaucaagcagcgaggcauccucggguacucccagaucggcgccggcgucuacaaggagggcacguuccacaccauguggcacgugacacgcggcgcggugcugaugcaccgggggaagagaaucgagccaagcugggcggacgucaagaaggaccugauauccuacggcgggggcuggaagcucgagggcgaguggaaggagggggaggagguccaagugcuggcccuggagcccggcaagaacccucgugcuguccagaccaagcccgggaucuucaagacgaacaccggcacaauaggggcagugagccucgauuucucacccggcaccagcggcucgccaauuguggaccgcaaggggaaggucgugggccuguacgggaacggcguggucacucggagcggcgccuacguauccgccauugcgcagaccgagaaguccauugaggacaaccccgagaucgaggaugacauauuccgcaagaagcggcugaccaucauggaccuccaccccggggccggcaagaccaagcgcuaccugcccgccaucgugcgggaggccaucaagagagggcugcggacgcugauccucgccccgacaagggugguggcggccgagauggaggaggcccugcgcggccugcccauucgguaccagacccccgccaucaaaaccgagcauacgggucgcgagaucguggacuugaugugccacgccaccuucaccaugcggcugcuuagccccguccgcguuccgaacuacaaccucaucaucauggaugaggcgcacuucaccgaccccgccuccauugccgcgcggggcuacaucagcacgcgcguggagaugggcgaggccgcgggcauauuuaugaccgcuacgccgcccggcucccgggacccguucccccagagcaacgcccccaucauggacgaggagcgcgaaaucccugagcgguccuggaacagcgggcacgaguggguuaccgacuuuaagggcaagacggugugguucguuccguccaucaaggccgggaacgacaucgcugccugccugaggaagaauggcaagaaggucauccagcugagccggaaaacuuucgacuccgaguacgugaagacucgcgcaaacgacugggacuuuguggucaccacggacauaagcgagaugggcgccaacuuuaaggccgagagagugaucgacccgcgccggugcaugaagccugucauccucaccgacggggaggagcgcgucauccuggcgggccccaugccggugacccacuccagcgccgcgcagagacgcgggaggaucggccgcaaccccaagaacgagaacgaccaguacaucuacaugggcgagccccuggagaacgacgaggauugcgcccacuggaaggaggccaaaaugcuccuggacaacauaaacacccccgagggcaucaucccauccauguucgaacccgagcgcgagaagguggacgcgaucgacggagaguaccggcugcgcggggaggcccggaagacguuuguagaccucaugcgccggggcgaccugcccguguggcuggcauacaagguggcagcggaggggaucaacuacgcagaccgaagguggugcuucgacggcaucaagaacaaccaaauccucgaagagaacauggaggucgagaucuggaccaaggagggggagcgcaagaaacugaagccgcguuggcuggacgcccgcaucuacucugacccccucgcccuaaaggaguucaaggaguuugccgcgggccggaagucccugacccucaacuugaucacagagaugggccgccuuccuaccuucaugacgcagaaggcccggaaugcacucgacaaccuggccgugcugcacaccgcggaggcagggggccgcgccuacaaccacgcgcucagcgagcugcccgagacccuggagacacuccugcugcucacucugcuggccaccgugaccgggggcaucuuccucuuccugauguccggcaaggggaucggcaagaugacccuggggaugugcugcauaauuacggccagcauccucuuaugguacgcgcagauucaaccgcacuggauugccgccuccaucauccuggaguucuuccucauaguccugcugauccccgagccugagaagcagcggacgccccaggauaaucagcuuacguauguggucauugccauccuaaccgugguggccgcgacaauggcaaacgagaugggcuuccuggagaaaaccaagaaggacuuagggcugggcagcauaacuacccaggagagcgagucaaacauccuggacaucgaccuuaggcccgccagcgcuuggacgcuuuacgccgucgcaaccaccuuucugacgcccaugcuccggcacuccaucgagaacaguuccgugaacgugucucugacggccaucgccaaucaagccaccguacucauggggcuggggaagggcuggccgcugucaaagauggacaucggugcuccgcugcuggccaucggcugcuacucucaggugaacccuauuacccugaccgccgcccugcuccugcuggucgcccacuacgcgauuauagggcccggucuccaggccaaggccacgcgcgaggcccagaagcgggccgccgccggcaucaugaagaauccaaccgucgacgggaucaccgugaucgaccuggaccccauccccuaugaccccaaguucgagaagcaguugggccaggugaugcuccugauacugugcgucacacaggugcucaugaugcgcacgaccugggcccugugcgaggcccugacccucgccaccggccccaucucaacgcugugggaaggcaaccccgggcgguucuggaauaccacaaucgcggugagcauggccaacaucuuccguggcuccuauuuggccggcgccgggcuccuguucagcaucaugaagaacaccacguccacccgccgggggacagggaacaucggcgagacccugggcgagaaguggaagucccgccucaacgcgcuggggaaguccgaguuccagaucuacaagaagaguggcauccaggaggucgaccggacgcuugccaaggaagggaucaagcgcggcgagaccgaucaccacgcugucucccgggggagcgccaagcuccgcugguucguggagcggaacauggucaccccggagggcaagguggucgaccugggcugcggucgcggcgggugguccuacuacugcggcgggcugaaaaaugugcgagaggugaagggccucaccaagggcgggcccggccaugaggagccuauccccaugagcacguauggguggaaccuggugcgccugcaaagcggcgucgacguguucuucaccccgcccgaaaagugugacacauuacugugcgauaucggggaguccagccccaaccccaccaucgaggcuggccggacccugcgcgugcucaacuuagucgagaacuggcugaauaacaacacgcaguucugcaucaaggugcucaacccguacaugcccuccguuaucgagaagauggaggcgcugcagcggaaguacggcggggcccugguacggaacccccugagccgcaauuccacccacgagauguacugggugagcaacgccacaggcaacauaguguccagcgucaacaugaucucccgcaugcucaucaaucgguucaccaugaagcacaagaaggccacguacgagccggacguagaccuagggagcggcacccgcaacauugggaucgagucagaggugcccaaccuggacauuaucgguaagcggaucgagaagaucaagcaggagcacgagaccagcuggcacuacgaccaggaucaccccuacaagaccugggccuaccacggcuccuacgagacgaaacagaccgggagcgcguccagcauggugaauggcguugugcgccuccugacuaagcccugggacgucgugccgauggugacccaaauggccaugacggacacgacccccuucggacagcagagggucuuuaaggagaagguggacaccaggacgcaggaacccaaggagggcaccaaaaagcugaugaagauuaccgccgaauggcucuggaaggagcugggaaagaaaaagacccccaggaugugcacucgggaagaguucacccgcaagguccgguccaacgccgcccugggggcaaucuucaccgaugagaauaaguggaagagugcccgcgaggccgucgaggacggcagguucugggagcucguggaucgcgagcggaaccugcaucuggaggggaagugcgagaccugcguuuacaacaugaugggcaagcgcgagaagaagcucggcgaguucgggaaggcuaagggcucccgggcgaucugguauauguggcugggggcccgcuuccuagaguucgaggcccugggcuuccugaaugaggaccacugguucagccgggggaacagccuguccggggucgagggggagggccuccaccgccuaggauacauccugcgggagguuagcaaaaaggagggcggagccauguacgccgacgacacggcagggugggacacccgcaucacccuggaagaccugaaaaacgaagagauggugaccaaccacaugaagggcgagcacaagaagcuagccgaggccaucuuuaaacucacuuaccaaaacaaggucgugcggguucagcgaccgacaccccgggggacuguaauggacaucaucucccgucgggaccagcggggcagcggccagguggggaccuacggccugaacacauuuaccaacauggaagcccagcuaauccgccagauggagggggagggcaucuucaaauccauccagcaccucacggccacggaggagaucgcgguccagaacuggcuggcucggguggggagggagaggcugagccgcauggcaauauccggggaugacuguguggucaaaccuaucgacgaccgguucgccagcgcccucacggcacugaacgacaugggcaaagugagaaaggacauccagcaaugggagccauccaggggguggaacgacuggacccaggugccguucuguagucaccacuuccacgagcuggucaugaaggacgggcgcgugcucguuguccccugccggaaccaggacgagcugaucgggcgcgcacggaucucgcagggcgccggcuggagccugaaggagaccgccugcuuggggaaguccuacgcccaaauguggacacugauguacuuucaccgccgggaucugcggcucgcggccaacgccaucugcagcgccgugcccucccacugggugcccaccagccggacgacaugguccauccacgcgaaacaugaguggaugaccaccgaggacaugcuggccgucuggaaccgcguguggauccaggaaaacccguggauggaggacaagacgcccguggagagcugggaggagguccccuaccugggcaagagggaggaccaguggugcggcagucucaucggccuaaccucccgcgccaccugggccaagaacauacagaccgccaucaaccaggugcggagccugaucgggaaugaggaguacaccgacuacaugccauccaugaagcguuuccgcagggaggaggaggaggcgggagugcucugguga

SEQ ID NO: 24935 - RNA, 9876 nt, Artificial Sequence
  derived and/or modified CDS sequence (opt11) from DENV-2__FJ898449__SS-prME
accgcgggaaugauaaucaugcugauucccaccguaauggccuuccaccucaccaccaggaauggggaaccccacaugaucgugagccggcaagagaagggaaagagccuguuauucaagaccaaggacgggacaaacaugugcacgcucauggcgauggaccugggcgagcuuugugaggacaccaucaccuacaagugccccuuccucaagcaaaacgagcccgaagacaucgacugcugguguaauagcaccuccacauggguaaccuacggcaccuguaccacgaccggcgagcaucgacgggagaagcgcagcguagcacuggucccccacguuggcauggggcucgaaacgcgaaccgaaacguggauguccagcgagggagccuggaagcaugcccagcgcaucgagaccuggauccuccggcaccccggguuuaccauaauggccgcgauucuggccuacaccauuggcacaacccacuuucagcgcguucuaaucuucaucuugcuuacugccaucgcucccuccaugaccaugcggugcaucgggaucagcaaccgcgacuucgucgagggcguuuccgguggguccuggguggauaucgugcuagagcacggcaguugugugacgaccauggcgaagaacaagcccaccuuagacuucgagcugauuaagaccgaggccaaacagcccgccacgcugcggaaguacugcaucgaggcaaaacucaccaacaccaccacggacucccgcugcccgacgcagggagagcccacccugaacgaggagcaggacaagcgauucguaugcaaacacuccauggucgacagaggauggggcaacggcuguggccuguucgguaagggcgggaucgugacaugcgcuauguuuacgugcaagaaaaacauggaaggcaaaaucgugcagcccgagaaccucgaguacaccgucgugaucacgccccauagcggcgaggagcacgcgguugggaacgacaccggcaaacacgggaaggaagugaaaauaaccccgcaguccagcauuacggaggccgagcugaccggcuaugggaccguaacuauggagugcagcccccguacgggccuggacuucaacgagauggugcuccugcaaauggaggauaaggccuggcugguccacagacagugguuccucgaccugccgcugcccuggcuccccggggccgauacccagggaagcaacuggauccagaaggagacccugguaaccuucaagaacccccacgccaaaaagcaggauguagugguuuuaggcucccaggagggggcgaugcauacggccuugaccggcgccaccgagauccaaaugagcagcggcaacuugcuguucaccggccauuuaaagugccgucugcgcauggauaagcugcaguuaaagggcauguccuacagcaugugcacggggaaguucaagaucgucaaggagauugccgaaacucagcacgguaccauagugaucagagugcaguacgagggggauggcucccccugcaagauucccuucgagaucauggacuuagagaagcgccacguccugggcagacuaaucaccguuaacccuaucgugacggaaaaggacagccccgucaacauugaggccgagcccccguucggggacagcuacaucaucauuggcguggagccgggccaauugaaacuggauugguucaaaaagggcagcuccauugggcagauguuugagaccaccaugcgcggcgcgaagcgcauggccauucucggcgauaccgccugggauuuugggagucugggcgggguguucacauccaucgguaaggcacugcaccagguuuucggggcgaucuacggugcugccuucucaggcgucuccuggaccaugaagauccucaucggggugauuaucaccuggaucggcaugaacagccggagcacuagccuguccgucucucugguucugguaggaauagucacucuauaccugggcgugaugguucaggcagacucggguugcgucgugagcuggaaaaacaaggagcugaagugcggcuccgguaucuucguaaccgacaacguccauaccuggaccgagcaguacaaguuccaacccgagucacccagcaagcucgccucugcuauccagaaggcccacgaggaggggaucugcggcaucagaagcgugacacggcuggaaaaccugauguggaagcaaauaaccuccgagcucaaccacauccugagcgagaaugaagugaaacugacaaucaugaccggggacaucaaaggcaucaugcaggucgggaaacgcucccuucggccccagccgacggagcuccgauauagcuggaagaccuggggcaaggccaaaaugcugucaaccgaguugcauaaccaaaccuucuugaucgacggccccgaaaccgccgaaugcccuaacaccaaccgggcauggaacucgcuagagguggaggacuauggguucggcgucuucaccaccaauaucuggcuccgccugcgggaaaagcaagacguuuucugcgacuccaagcugaugagcgcagccaucaaggacaaucgcgccgugcacgcugacaugggguacuggaucgaauccgcccucaacgacaccuggaagauagagaaggcgagcuucaucgaggugaaguccugccauuggcccaaaagccacacgcugugguccaacggcguucuagagagugagaugaucaucccgaagaacuucgcgggcccagugucccagcacaacaacagacccggguaccauacccagaccgccggaccauggcacuuagggaagcuggagauggacuuugacuuuugcgaggguaccacaguggucgugacagaggaguguggaaaccgcggcccuagccuucggaccacgacggccucugguaagcucauaaccgaguggugcugucgcuccugcacccugccaccccuucgauaccgcggggaagaugggugcugguaugggauggagauccgaccgcucaaggagaaagaggagaaccugguuagcagccuagugaccgccggccacgggcagaucgacaacuucagucucggcauucugggcauggcgcuguuccucgaggagauguugaggacgcgcguugggaccaagcacgccauccugcucguggcggucuccuucgucacgcugauaaccggcaacaugagcuuccgcgaccucggucgcgugauggucauggugggcgcaacgaugaccgacgacaucggcaugggcguaaccuaccucgcgcugcuggccgccuuuaagguccggccgaccuuugcugcaggacuccugcugcgcaaacuaacguccaaggaauugaugaugaccacuaucgggauagugcucuugagccaguccucgaucccggagacgauauuagagcugacggacgcacucgcccugggcaugaugguucugaagaugguccggaacauggagaaguaccagcucgccgugacuaucauggcaaucuugugugugcccaacgccgucauccugcagaaugcauggaagguauccugcaccauccucgccguugugagcguguccccgcugcuucucaccagcucccagcaaaaggccgacuggauaccacuggcccuuacgaucaaggggcucaaucccaccgccauuuuccugaccacccugagccggacguccaaaaagcggucauggcccuugaaugaggcuaucauggccgucggcaugguauccauccuggccagcucauugcucaagaaugacaucccgaugaccggcccccucguggccgguggccugcucaccgucuguuacgugcugaccgggcguuccgcggaccuggagcucgagcgggccacagacgugaagugggacgaccaggccgagauaagcggauccaguccuauccuguccauaaccaucucagaagacgguuccaugagcauuaagaacgaagaggaggaacagacguugaccauucucauccgcaccggccugcuggucaucuccggccucuuccccgugagcaucccgaucacggccgcagcaugguaccugugggaggugaagaagcagcgggccggggucuugugggacgugcccuccccgccacccgugggcaaggccgaacuugaggacggggccuaccgaaucaagcagaaggggauacugggguacagccagauaggcgccggcgucuacaaggaagggacauuccacaccauguggcacgugaccaggggcgcagucuuaaugcacaaggggaaaaggaucgaacccuccugggccgacguuaagaaagaucucaucagcuacggcgggggcuggaagcuggagggagaguggaaggagggggaggagguccaagugcuggcucuugagcccggcaaaaacccucgggccgugcagaccaagcccggacuauuccgaacuaacaccggcaccauaggggccgugucccuggacuucagcccaggaacguccggcucucccaucgucgacaagaaagggaaagucgugggccuuuacgggaacggcguggucacccgguccggcgcguacguuucagcgaucgcccagaccgagaaguccaucgaggacaauccggagaucgaggaugacauuuuucgcaagcgucgccuaaccaucauggaccuccaccccggcgcgggcaagacgaagaaguaucugccggcgaucgugcgggaggcgauaaagcgcggguuacguacccugaucuuagccccaacccgcgucguggccgcggaaauggaggaggcgcuccgcggccuaccaauacgauaccagacccccgccauucgcgcggagcacacggggcgggaaaucguugaccugaugugucacgccaccuuuaccaugcgccuccugagccccauccgggucccaaacuacaaccuaaucaucauggacgaggcacacuucaccgacccggcgagcaucgccgcucgcggcuacauauccacgcggguugagaugggcgaggcggccgggauauucaugacggcgacuccgcccggcagccgugaucccuucccgcaguccaaugccccuaucauggacgaggagagagagauuccggagcggaguuggaacuccgggcacgagugggugaccgacuucaaaggcaagacaguuugguucgugccaagcaucaagacugggaacgauaucgcggccugccuccggaaaaauggcaaaagggucauccagcugucucggaaaaccuuugauagcgaguaugucaagacgcgcaccaaugacugggacuucgugguaacuaccgacauuagcgagaugggcgccaacuucaaggcggagcgggucaucgacccgaggcgauguaugaagcccgugauccugacugacggggaggagcgcgugauucucgccggucccaugcccgucacgcacagcagugccgcccaacggcgcggacgcaucggacggaacccgcgcaacgaaaaugaucaguacaucuacaugggggagccccuggagaacgacgaggacugcgcucacuggaaggaggccaagaugcuacucgacaacaucaacacccccgagggcaucauuccgagcauguucgaaccggagcgggaaaagguggacgccaucgacggcgaguaccgccuacgcggggaggcucgcaagaccuuuguagaccugaugagacgcggugacuuacccgucuggcuggccuacaaggucgcguccgagggaauaaacuacgcagaccggcguugguguuucgacggcaccaggaacaaccagauccuggaagagaacguggagguagagauauggacgaaggagggcgagcgcaaaaaguuaaagccccguuggcuggacgcgcggauauacagugacccgcucgcccucaaggaguucaaagaguucgccgccggccggaagucccugacccuuaaccugaucacugagaugggacgucugccgaccuucaugacgcagaaggcccgggacgcacuggacaaccuugccgugcugcacacagccgaggcaggcggcaaggccuauaaccacgcccugagcgagcuccccgagacccuggagacccugcugcuucugacccuccuugccacgguuaccggcggaaucuuccuguuccucauguccgggcgcgggaucggcaagaugaccuuggggaugugcuguauuaucaccgcguccauccucuugugguacgcacaaauccagccccacuggaucgccgccagcaucauccuggaguucuucuuaaucguacuccugauccccgagcccgagaagcagaggacaccccaggacaaccagcugaccuacguaaucaucgccauccuaaccgucguggcggccacgauggccaacgagauggguuuccuggaaaagacgaaaaaggaccuggggcuagggcauaucgcgacccagcaaccagaguccaacauccuggacaucgaccugcggccggccagcgcguggacccucuacgccguggccaccacguucauaacccccaugcugcggcacuccaucgagaacagcuccgucaacgugagcuuaaccgccaucgccaaccaggccaccguucucauggggcuggggaagggcuggccccuguccaagauggacaucggggucccccuucucgccaucggcugcuacagccaggugaauccgaucacucugacagccgcccuccugcuccucguagcacacuacgcgaucaucgggcccggucugcaagccaaggccacacgcgaggcccagaagcgcgccgccgccggcaucaugaagaaccccaccguagaugguaucacggugaucgaccuggaucccauccccuacgacccgaaguucgagaaacaacucggccaagugaugcuucugguacucugcgugacccaggugcugaugaugcggaccaccugggcccugugcgaggcccucacacuggcgaccgggcccgucucgacgcugugggagggcaaucccgggcgcuucuggaauaccacgaucgccguaagcauggcgaauauuuuccggggcuccuaccuagccggcgccgggcugcuguucagcaucaugaagaacaccaccucaacccgucggggcaccgggaacaucggggagacucucggggagaaguggaagucccgucugaacgcgcuggggaagagugaguuccagaucuacaaaaagagcgguauccaggagguugaccggacgcucgcuaaggaggggaucaaacgcggcgagaccgaccaccacgccgugagucgugggagcgcgaagcugaggugguucguggaacguaaccuggugacgcccgagggcaagguggucgaccucggcugcgggcguggugggugguccuauuacugcggcgggcucaagaauguacgggaggucaaggggcuuaccaagggcgggcccggccaugaggagcccauucccaugagcaccuauggcuggaaucuugugagauugcagagcggcguggacguauucuucgugccgcccgagcggugcgacacccuguuaugcgacaucggggaguccagccccaaccccacuguggaagccggucgcacgcuacggguccugaacuugguggagaacuggcugaauaacaacacucaguucugcguaaaaguucuaaacccguacaugcccuccgugaucgagcgcauggagacccugcagcggaaguaugggggugcguuagugcgcaacccucugucgcgcaacuccacccaugagauguacugggucagcaacgccuccggcaauaucgugagcucggugaacaugauuagcaggaugcugauaaaucgcuucaccaugcggcacaagaaagccacuuacgagccggacgucgaccucggguccggcacccgcaacaucggaauugagucugagacccccaaccuggacaucauaggcaagcggaucgagaagaucaagcaggaacacgaggccucauggcacuacgaccaggaccaucccuauaaaacgugggcguaccacgggagcuacgagacuaaacaaacgggguccgccucgucaauggugaacggcguuguuagguuacucaccaagcccugggacguggugccuauggucacgcagauggcgaugaccgacaccacaccguucggucagcagcgcguuuuuaaagagaagguggacacgcgcacccaagagcccaaggagggcaccaagaagcugaugaagaucaccgccgaguggcuguggaaggagcucggaaaagaaaagacaccccggaugugcacccgcgaggaguucacuaagaagguccggagcaacgccgcacugggggccauuuucacagacgagaacaaguggaagucagccagggaggccguggaggacaaccgguucugggaguugguagacaaggaacgcaaucuccacuuggagggcaagugcgagacgugcguguacaauaugauggggaagcgugagaagaaacuuggcgaguucgggaaagccaagggcucacgcgcuaucugguacauguggcucggcgcccgguuccuggaguucgaggcacugggguuccucaacgaggaccacugguucucccgcgagaacucucugagcggcguggagggggagggccuucacaagcucggguacauccugagagaggucuccaagaaagagggcggcgccauguacgcugacgacacggccgggugggacacccgcaucaccaucgaggacuugaagaacgaagagaugaucacgaaucauauggcuggcgagcacaagaaacuugccgaggccaucuucaaacugaccuaccagaacaagguggugcggguccagcgcccuacgccccgcgggaccgugauggacaucaucagccggagggaccagcguggguccggccaggugggcaccuacggccucaacaccuucacuaauauggaggcgcaacucauucgccagauggagggagagggcaucuucaagagcauccagcaccugacugccuccgaggagaucgccguccaggacugguuggugcgcguagggcgcgagcgguugagccgcauggcuaucuccggcgaugacugcgucgugaaaccccuggaugacagguucgcccgcgcgcuaacggcucucaacgacaugggaaagguccguaaagacauccagcagugggagcccagccgcggguggaacgacuggacccaaguccccuucugcucccaucacuuucaugagcugaucaugaaggacggccggaccuuaguggugcccugccguaaccaggacgagcucauagguagggcccgcauuagccaaggugccggauggucgcugcgggaaaccgccugucugggcaagagcuacgcgcagauguggucccucauguacuuccaccgccgggaccugcgacuggccgccaaugccaucuguagcgccguccccucccacugggucccaaccucgcgcacuaccuggagcauccacgcaucccacgaguggaugaccacggaagacauguugacgguguggaaccgcgucuggauccuggagaacccauggauggaggacaagacacccguggagagcugggaggagauccccuacuuaggcaaaagagaagaccaauggugcgggucucucauuggcuuaaccagccgggccaccugggccaagaacauccagacggccaucaaccaggugcgcucccugauugggaacgaagaguacaccgauuauaugcccucgaugaagcgguuccgccgagaggaagaggaggcgggaguccucugguag

SEQ ID NO: 24936 - RNA, 9876 nt, Artificial Sequence
  derived and/or modified CDS sequence (opt11) from DENV-2__FJ906966__SS-prME
accgccgguaugaucaucaugcugauacccacugugauggccuuucaucucaccaccagaaacggggagccccacaugaucguuagccggcaagagaaagguaagagccugcuguucaagacagaggacgggguaaacaugugcacccuaauggcgauggaccugggcgagcucugcgaggacaccaucaccuacaagugccccuuccucaagcagaacgagccugaggacauugauugcuggugcaacucaacgagcacgugggugaccuacgggaccugcacuacaacaggagagcaccgccgagaaaagcgcagcgucgcccugguaccccacguuggcauggggcuggagacgcggaccgagacauggauguccagcgagggcgccuggaagcacgcccagagaaucgaaacuuggaucuuacggcaccccggguucacgaucauggccgcaauucuggcguauaccaucggcacaacacauuuccagcgcgcucugaucuucauccuccucaccgcugucgcaccuuccaugacaaugcggugcauagggaucagcaaccgcgauuuugucgagggcguguccggcgguagcugggucgacaucgugcuggagcacggcuccugcgugacuacaauggccaagaauaaaccuacgcucgacuucgagcuuauaaagacagaggccaaacagcccgcuacgcugcgcaaguacugcaucgaagcgaagcucacgaacacaaccaccgauagccgcugcccuacgcaaggggaacccaguuuaaacgaggagcaggacaagcgguucgucugcaagcauucaaugguggaccgcggcuggggcaacgguugcggccuauuuggcaagggugguaucgugaccugugcgauguucacgugcaagaagaauauggaaggcaagguugugcagcccgagaaccuugaguacaccaucgugaucacgccccauagcggcgaagaacaugccgucgggaaugauacgggcaagcacgggaaggagaucaagaucaccccucaaagcuccaucaccgaggccgaguuaacagguuacggcacggugaccauggaguguaguccacggacaggccuagauuucaacgagaugguucuccugcagauggaaaacaaagccuggcugguucaccgccagugguuccucgaccugccccugcccuggcucccuggcgcggacacccaggggcuuaacuggauccagaaggagacacucgugaccuucaagaacccccacgcgaagaagcaggacguggucgugcucgguucccaggagggggccaugcauaccgcccugaccggcgccacugagauccagaugagcagcgggaacuuacuguuuaccggccaccuuaaaugucgguugcgcauggauaaacugcagcugaagggcauguccuacagcauguguaccgggaaguucaaggucgugaaggagauagccgagacucagcacgguacuaucgugauccggguccaguacgagggggacggaucaccaugcaaaauacccuucgagauaauggaccuggagaagaggcacgugcucgggcggcugaucaccgugaacccgauugucaccgagaaagacagccccgugaauauagaggcggagccuccuuuuggggacuccuacauaaucaucggcguggagccggggcagcuaaagcucaauugguuuaagaagggcagcagcaucgggcagaugaucgagaccacgaugagaggcgcuaagcgcauggccaucuugggggacaccgcgugggacuucgggagcuugggcggggucuucaccuccauuggcaaagcccuccaccagguauuuggugcgaucuauggagccgccuucucaggcguguccuggauuaugaagauccugaucggggucaucaucaccuggaucggcaugaacagccgaucgacgagccuguccgucagccuggugcucgucgggguggugacucuguaccuggggguaaugguacaagccgacucagggugcguggucagcuggaagaacaaggaacucaagugcggcagcggcaucuuuaucaccgacaacgugcauaccuggacggagcaguacaaguuucagcccgagagccccagcaagcuggcguccgccauacagaaggcgcacgaggaggguaucugcggcauccguagcgugacacgacuggagaaccucauguggaagcagaucaccccugagcugaaccacauccugagcgaaaaugaggucaagcugaccaucaugacgggagacaucaagggcaucaugcaggccgggaagcgcagccugcagccgcaacccacggaacugaaguacuccuggaagaccuggggcaaggccaagaugcucagcacugagagucacaaccagacguuccugauagacggcccggagaccgcggagugcccgaacaccaaccgggccuggaacagccuggaaguggaagacuacggguucgggguguucacgacgaacaucuggcucaagcuacgcgagaagcaagacgucuuuugcgacaguaagcugaugagcgccgcgaucaaagauaaccgggcaguacacgcggacaugggauacuggaucgagucagcccucaacgacaccuggaagaucgagaaagccagcuucauagagguaaaaucuugccacuggccaaagagccauacgcugugguccaacggcguccuggaaagcgagaugaucauccccaagaacuucgcgggccccgugucccagcacaacuacagaccgggauaccacacccagaccgccggcccauggcaccucgggaagcuggagauggacuucgacuucugcgagggcacaaccguggucgugaccgaggacugugggaaccggggccccucacugcgcaccacaacggcgagcggcaagcucaucaccgaauggugcugcagauccugcaccuugcccccgcugcgcuaccgcggugaggacggcuguugguaugggauggagauccgcccccucaaggaaaaagaagagaaucuggugaauucacuggucacugccggccacgggcagauagacaacuucucccucggagugcuggguauggcccuguuccucgaggagaugcugcgaacuaggguggggaccaagcacgccaucuuauuaguugcugugagcuucguaacccugauaacaggcaacaugagcuucagagaccuggggcgcguuaugguaaugguaggcgcaacaaugaccgacgacaucgggaugggcguuacauaccucgcccuccuggccgccuucaaggugcggcccacguucgcggccggccuccugcugcgcaaacucaccucuaaggaguuaaugaugacgaccaucgggauugugcugcucucccagagcacgauccccgagaccaucuuagagcugaccgacgcccuagcccugggcaugauggugcugaagaugguucgcaagauggagaaguaccagcuugccguaaccaucauggccauccugugcguuccgaacgccgugauucugcagaacgcuuggaaggucuccugcacgauccuggccguggugagcguuagcccccuauuucugaccucgucccagcagaaagccgacuggaucccccuugcgcugaccaucaaggggcugaaccccaccgccaucuuccucacgacccugagucguacuaacaaaaaacgauccuggccgcucaacgaggccaucauggcgguggguaugguuaguaucuuagccuccagucugcugaagaacgacauccccaugaccggcccccucgucgccgggggauugcugacggucugcuacgugcucaccgggcgcagugcggaccuggagcuagagcgugccgccgauguuaagugggaggaccaggcggagaucagugguagcucccccaucuuaagcaucacaaucuccgaagacgggagcauguccaucaaaaaugaggaggaggagcagacccugacgauccugauccggaccggacuacuggugauuagcgggcuguucccggugagcauccccaucaccgcggccgccugguaccuuugggaggucaagaagcagcgcgccgguguccucugggacgugcccuccccgccgcccgucgggaaagcagaacuggaagauggcgccuaccggauaaagcagaagggcauccugggguacagccaaaucggcgccggcgucuacaaggaggguaccuuccauaccauguggcacguaacgcgcggcgcaguccugaugcacaaggggaaacggaucgagcccagcugggcugacgugaagaaggaccugauuuccuacggcgggggcuggaagcuggagggggaguggaaagagggagaggaggugcaggucuuagccuuggagccagguaagaacccacgcgccguucagaccaaaccuggucuguucaagaccaacgccgggacgaucggggcagugagccuggacuucuccccaggcaccagcggcucccccaucauugauaagaaaggaaaggucguuggccuuuacgggaauggcguggucacuagaagcggcgccuacgucuccgcuauugcccagaccgagaaguccaucgaggacaauccggagaucgaagacgauaucuuccgaaagcgcaagcucaccauaauggaccugcaccccggggccggcaagacgaagagguaucuacccgcaauagugcgggaggcgaucaagcgcgggcugcggaccuugauccuggccccgaccagggucguggccgccgagauggaggaggcccugcgcggccugcccauucgcuaccagacccccgcgauacgggccgagcacacuggccgcgagaucguugaucugaugugccacgcaaccuucaccaugcgccugcucucccccgucagggugccgaacuacaaucugauaaucauggaugaggcccacuucacagaccccgcaagcaucgcggcccgcggcuacaucagcacgcggguggagaugggggaggcagcggggaucuucaugacggccacgccgccaggcuccagagauccguucccucagagcaacgcgcccauuauggacgaagagcgcgagauccccgagcgcucuuggagcucagggcaugagugggucaccgacuucaagggaaagacggugugguucgugccgagcaucaaggcagggaacgacauugccgccugcuuacggaagaauggcaagaaagucauacagcucucccguaagacuuucgauagcgaguacguuaagacccgaaccaaugacugggauuucguggucacgaccgacaucuccgagaugggcgcgaacuucaaggcggagcgcgugaucgacccccggcguugcaugaagcccguaauucugacugauggggaggagagagugauucuggccggccccaugccggugacgcauucuuccgcugcccagcggcgggggcgcaucggccggaaccccaagaacgagaaugaccaguacaucuacaugggagagccccucgaaaaugacgaggacugugcgcacuggaaagaagccaagaugcugcuggauaacaucaacacacccgagggcaucauccccagcauguucgagcccgagcgcgaaaaaguggaugcgauagacggcgaguaccggcuccgcggggaggcccgcaaaaccuucguagaccugaugcgucgaggagacuuacccguguggcuggccuaccggguggcugcggaggggaucaauuacgcggaccggagauggugcuucgauggcaucaagaacaaccagauucuugaggagaacguugagguggagauauggaccaaagagggugagcguaaaaagcuaaagccgcgguggcucgaugcccgcauuuacuccgauccccuggcauugaaagaauucaaggaauucgcggccggacgcaaaucccucacacugaaccugauuacggagaugggccgccuccccaccuucaugacccaaaaggcccgggacgcccuggacaaccuggcgguccuccacaccgccgaagcgggaggccgcgccuacaaccaugcguuauccgagcuuccugagacgcucgagacucuucugcuccugacccugcucgcgaccguaacgggcgggaucuuccuguuucugaugagcgggcgggggauuggcaagaugacccucgggaugugcugcaucaucacggccuccauucugcugugguacgcccaaauccaaccgcauuggaucgccgccagcaucauccuggaauuuuuccugaucgugcuucucaucccagagcccgaaaaacaacgcacgccccaggacaaccaguugaccuacgucgugaucgcgauccucacggugguugccgccaccauggccaacgagaugggcuucuuggaaaagacgaaaaaggaccuuggguuaggcuccaucaccacgcagcagccggagagcaacauccucgacaucgaccuacggcccgccagcgcuuggaccuuauaugccguggccaccaccuuugugacgcccaugcuccgucacucuaucgagaacagcuccgucaaugugagcuuaaccgccauugcuaaccaggcaaccgugcugaugggacucgggaagggguggccccugaguaagauggacaucggagucccgcuccucgcgauaggcugcuauagccagguaaaccccaucacccugacugcugcccuguuccuccugguggcgcacuacgccaucauuggaccgggacugcaggcuaaggccacccgggaggcucagaaacgcgcggcggccgggaucaugaagaaccccaccgucgacgguaucacggugaucgaccuagacccgauucccuacgaccccaaauucgagaagcaacugggucaggugauguugcuaguacuuugcgugacccagguucucaugaugcggacaacgugggcccucugcgaggcccugacccuggcgacgggacccaucuccacccucugggagggcaacccaggacguuucuggaacaccaccaucgcuguaucgauggccaacauauuucggggcaguuaucuggccggcgccggccuccucuucagcaucaugaagaauacgacgaacacucgccgcggaacggggaacaucggggagacgcugggcgaaaaguggaagucccggcucaacgcacucggcaagagcgaguuccagaucuacaaaaaguccgguauacaagagguggaccgcacccuggcgaaagaggguaucaagcgcggggagaccgaucaccaugccgugagccgaggcucugcuaagcuccgaugguucgucgagcguaacauggucacgcccgaaggcaagguugucgaccucggcugcgggcguggcggguggagcuacuacuguggggggcuaaagaacgugcgcgaggugaagggccugacgaagggagggcccggccacgaggagccaauaccgaugucuaccuacggguggaaucucguccgguuacagagcggcguggacguguucuucaccccgcccgaaaaaugugacacccugcucugcgauauuggggagucaucccccaacccuacggucgaggcaggccguacccuacgggugcuuaaccucguggagaacuggcugaacaacaacacccaguucuguaucaagguccugaacccguauaugcccuccgugaucgagaagauggaggcccuccagcgcaaguacgggggggcccuggugcgcaauccacugucgcgcaacaguacccacgagauguauugggucucaaacgccagcggcaacaucguguccagcgugaacaugaucucccggaugcuaaucaacagguucacaaugcgucacaagaaggcaacguacgaaccggacgucgaucucggaagcggcacccgcaacauagggauagaguccgagauucccaaucuagacaucaucgguaagcggaucgagaaaauuaaacaagagcacgagacaagcuggcauuaugaucaggaccaccccuacaaaacgugggcguaccacggaagcuacgagacgaagcagaccgggagcgccuccagcauggugaacggcgucguccgccugcucaccaaaccgugggacguggugcccauggucacacagauggcaaugaccgacacuaccccauucgggcagcagcgcguguucaaagagaagguggacacccggacgcaggaacccaaggaaggcaccaaaaagcugaugaagaucaccgcggaauggcuauggaaggagcucggcaagaagaagaccccgcgaaugugcacgcgccaagaguucacccgcaaggucagauccaacgccgcacugggcgccaucuuuaccgacgaaaauaaguggaaguccgcaagggaggccguggaagauucccgguucugggagcuggucgacaaagagcgcaaccuccaccuggagggcaagugcgagaccugcguuuauaacaugauggguaagcgggagaaaaagcugggcgaauucgggaaggccaaggggagccgcgcuaucugguacaugugguugggcgcccgauuucuggaguucgaggcccucggauuccuaaacgaggaccacugguucucccgcgagaauagccugucaggcguggagggggagggccugcacaaguugggcuacauccugcgcgacgucuccaagaaggaggguggagccauguacgcggacgacacggccggcugggacacccgcaucaccuuagaggaccucaagaacgaagagauggugacuaaccacauggagggcgagcacaaaaaacuggccgaggcaaucuucaagcugacguaccagaacaaggugguccgggugcagcgccccacgccccgggggacggucauggauauaaucagccgccgagaccagcgcggcuccgggcaggucggcaccuauggacucaacacguucaccaacauggaggcccagcugauccggcagauggagggggaggguguauucaaaagcauccagcaccugaccgugaccgaggagauugcuguccaaaacuggcucgcccgcgugggacgcgagcggcugucccgcauggccaucagcggugaugacugcguagucaagccccuggacgaccgguucgccuccgcacucaccgcgcugaacgacaugggcaaggugcgcaaggacauucagcagugggaaccuagccggggguggaacgauuggacacaagugcccuucuguucccaccacuuccacgagcugaucaugaaggacggccgcguccucguggugccuugccggaaucaggacgagcugaucgggcgcgcccggauaucacagggcgccggguggucccugcgcgagaccgccugccucggcaagagcuacgcacagauguggucccugauguacuuccaccgucgcgaccugcggcucgcggccaacgcgaucugcagcgccguccccucgcacugggugccgaccucucgcacgaccuggucuauccacgccaagcacgaguggaugacaaccgaggacaugcugaccguauggaaccgugucuggauccaggagaaccccuggauggaggauaagacgccugucgaaucgugggaagagauccccuacuuaggaaaacgcgaggaccaguggugcggaagcuugauaggacugaccucccgcgcgaccugggcaaagaacauucagaccgcgaucaaccaagugcgcuccuuaauugggaacgaggaguauacggacuacaugccguccaugaagcgguuccgcagggaggaagaggaagccggcgucuuaugguag

SEQ ID NO: 24937 - RNA, 9876 nt, Artificial Sequence
  derived and/or modified CDS sequence (opt11) from DENV-2__FJ906968__SS-prME
accgccgguaugaucaucaugcugauacccacggugauggcuuuccaucucaccacgcggaacggcgaaccccauaugaucguaagccggcaggagaaggggaagucccuguuguuuaagaccgaggacggggugaacaugugcacccucauggccauggaccugggcgagcugugcgaggacaccaucacuuacaagugcccuuuccucaagcagaacgagcccgaggauaucgacuguuggugcaacagcaccagcacuugggugacuuacgguaccugcaccaccacgggcgagcaccgccgggagaagcguagcgucgcgcuggugccccacgugggcaugggucuggagacccggaccgagaccuggauguccagcgagggcgcauggaagcacgcccaacgcaucgagacguggauuuugcggcaccccggguucacuaucauggccgcuauccuggccuacaccaucggcaccacgcacuuucaacgcgcccugaucuuuauucuccugaccgcggucgcgccguccaugaccaugcggugcauugggaucagcaacagggacuucguggaaggcguguccggugggagcugggucgauauagugcuggagcacggcuccugcgugaccacgauggccaagaacaagccuacgcucgacuucgagcucaucaagaccgaagcaaagcaacccgccacccuucggaaguacugcaucgaagccaaauuaacgaacaccaccaccgacaguaggugccccacgcaaggcgagcccucccugaacgaagaacaggauaagcguuucguaugcaagcacagcaugguggaccgcggcugggggaaugggugcggccuguucgggaagggcggcauugugaccugcgcgauguucacguguaaaaagaauaugaagggcaagguggugcaacccgagaaucucgaguauaccaucgugaucacgccgcacaguggcgaggagcaugccgucggcaaugauacagguaagcacgggaaggagaucaagaucaccccucaaucuuccaucacugaggccgagcugaccggcuacggaacggugaccauggagugcagcccccggaccggccuggacuuuaaugaaauggugcuccuacagauggagaacaaagccugguugguacaucgccagugguuucucgaccugccccuacccugguuaccgggcgccgacacccagggcuccaacuggauccagaaggaaacgcuugugaccuucaaaaacccgcacgcgaagaagcaggacguggucgugcugggcagccaggagggagccaugcacaccgcccucacgggcgcuacagagauccagaugaguuccgggaaccuacuguucacaggccaccucaaaugucggcugcgcauggacaagcugcagcucaagggcaugaguuacuccaugugcaccgguaaguucaaggucgugaaggagaucgccgagacccagcacggcacgauagugauccggguccaguacgagggggacggcucgccgugcaagauacccuucgagaucauggacuuggaaaaacgccacguguugggccggcucauuaccgugaacccgauagucacugagaaggacucgcccgugaacauugaggcggagccacccuucggggacaguuacaucaucaucggcguggagccgggccaguugaagcugaauugguuuaagaagggcuccagcaucgggcagaugaucgagaccacgaugcgcggcgcuaagcgcauggccauccucggcgacaccgccugggacuucggaucacugggcggugucuucaccagcaucggcaaggcccuucaccagguguuuggggcgaucuacggcgccgccuucucgggcgugucauggauuaugaagauccucaucggggugauaaucaccuggaucggcaugaacucaagaagcacgucccugagcgucucccuggugcuugugggggugguaacccucuaccugggcguaauggugcaggcugacucagguugcgugguaagcuggaagaacaaggagcugaagugcggcagcggcaucuucauaaccgacaacgugcacaccuggacagaacaauacaaguuccaaccugagagccccuccaagcucgcguccgccauucaaaaagcccacgaggaggggaucugcggcauccggagugugacccgccuggaaaaccugauguggaagcagaucacucccgagcucaaccacauccugagugagaacgagguaaagcugacgaucaugacgggggacaucaaggguauaaugcaggccggcaagcgcucccuccagccgcagcccaccgagcugaaguauucguggaagaccugggguaaggccaaaauguuauccaccgagagccacaaccagacguuccuuaucgacgggcccgagaccgcagagugcccgaacacuaaccgggccuggaacucgcuggagguugaggacuacggguucggcguauucaccacgaauauauggcugaagcuccgcgaaaaacaagacguguucugugacucgaagcugaugagugccgcgaucaaggacaaccgagcuguacacgcugauaugggauacuggauugagagcgcccuuaacgacacauggaagauagagaaggcuucauuuauugaggucaagagcugccacuggccgaaaagccacacccucuggagcaacgagguguuagaguccgagaugaucauccccaagaacuucgccggcccggugucacaacauaacuaccgccccggguaccauacccaaaccgcugggcccuggcaccuggggaagcuagaaauggacuucgacuucugcgaggggacgaccguggucguaaccgaggauugcggcaaccgugggcccagucugcgcaccacgacugcguccgggaagcuaauaacugaauggugcuguaggagcugcacccuacccccucugcgcuaccggggcgaggacgggugcugguacggcauggagauacgcccucugaaggaaaaagaggagaaccucgugaacuccuuggucacggcggggcacggccagaucgauaacuucucgcugggggugcucggcauggcuuuguuccuggaggagaugcuccguacccgcgugggcaccaagcacgccauccugcuggucgcggugucguuugugacccugaucacggggaacaugagcuuucgagaccugggcaggguuauggugauggugggggccaccaugaccgacgacauuggcaugggggugacauaccuggcccuccuagccgccuucaaggugcgacccacguucgcugccggccuguugcuccguaagcugaccuccaaggagcucaugaugaccaccaucgguauugugcugcugagccaauccacgauucccgagaccauccucgagcugaccgaugcccuggcacucgggaugaugguccugaagauggugcgcaagauggagaaguaccagcuggccguaaccaucauggcgauucucugcguccccaacgccgucauucuucagaacgccuggaagguuagcugcacgauccuggcggugguguccgucagcccccucuuccugaccuccagccagcagaaggccgacuggaucccccuggcgcucacuaucaaaggcuugaaccccacugcaaucuuccugacgacccucucccgaacaaacaagaaacgcagcuggccgcugaacgaggccaucauggccguagggaugguuuccauccuggcgucuaguuuacugaagaacgacauccccaugaccggcccccuggucgccgguggauugcugacggugugcuacgugcugaccggaagaagcgccgaccucgaacuggagcgcgcagccgacguaaagugggaggaccaagcagagaucagcggguccucccccauccugagcauaaccauuagcgaagacgguuccaugucgaucaagaacgaggaggaggagcagauccucaccauccugaucagaacggggcugcucgucaucucgggccuguuccccgugagcauccccaucacggccgccgccuggugccugugggaagucaagaaacagcgagcuggcgugcucugggacguuccuagcccgccaccugucgggaaagcggagcuggaggacggcgccuacagaaucaaacagaaagggauccugggcuacagccagaucggagcuggcguuuauaaggagggcacuuuucacaccauguggcacguaacccguggagcuguucucaugcacaagggcaagcggaucgagcccuccugggccgacgugaagaaggaccugaucaguuacggcggaggguggaaauuggaaggcgaguggaaggagggcgaggaggugcaaguccuagcgcuggagcccgggaaaaacccccgcgccguacagacuaagcccggcuuguucaagaccaaugccgggacgaucggcgccgugucccucgacuucagccccggaacauccggaagccccauuaucgauaagaagggcaaagucguagggcuguacggcaacgggguagucacgcgguccggcgcguacgugagcgcgauagcccagaccgaaaaguccauagaggacaaucccgaaauugaggacgacauauuucgaaaacggaaguuaacgauuauggaccuccaccccggcgcugguaagacgaagcgcuaccugccugccauagugcgggaggcgaucaagaggggcuuacggacgcugauuuuggccccgacccgcguuguggccgccgagauggaggaggcccugcggggguuaccuauccgcuaucagaccccggcgaucagggccgaacacaccggccgcgagaucgucgaccuuaugugccacgccacguuuaccaugcgucugcugucacccguccgcgugccgaacuauaaccucauuauuauggacgaggcccacuucaccgaccccgccagcauagcugcucgcggguacaucuccacccggguggagaugggcgaggccgccggcaucuuuaugacggcgacgccucccgggucucgugacccauucccccagucaaacgcgcccaucauggacgaagaacgggagaucccugagcgaagcugguccagcggccacgaguggguuaccgacuuuaaggggaaaaccgugugguucgugccguccauuaaggcgggcaacgacaucgccgcgugccugcguaagaacggcaagaaggucauccagcugagccgcaagacguucgacuccgaguacgugaaaacccggaccaacgacugggacuucguugucacgacggauaucagugagaugggcgcgaacuucaaggccgagcgcgugaucgacccccggaggugcaugaagcccgugaucuuaaccgacggagaggagcgggucauccuggccggacccaugccggugacucacuccucagccgcccagcgcaggggccgcauugguaggaaucccaagaacgagaacgaccaguacaucuacaugggcgagccccuugagaacgacgaggacugcgcgcacuggaaggaggccaagaugcuccuggacaacaucaacacuccagaggggaucaucccgucuauguucgagcccgagcgggagaaaguggaugccaucgacggcgaguaccgucugcgcggcgaggcccgcaaaacguucgucgauuugaugcgacguggggaccuacccguguggcuggccuacaggguggcggccgagggaauuaacuacgcagaucgccggugguguuucgaugggaucaagaacaaccagauccucgaggagaacgucgagguagaaauauggaccaaggagggcgaacgcaaaaagcucaagccgagaugguuagacgcccguaucuacagcgacccuuuggccuugaaggaguucaaggaguucgcugccggacggaagucgcugacccuaaaccugaucacugagaugggccgccuccccacguucaugacccagaaggcccgggacgcccucgauaaccuggcgguguugcacaccgcugaggccggcggacgugcuuacaaucacgcccucagcgagcuuccugagacccuggagacgcuccugcugcuuacccugcuggcgaccgugacgggugggaucuuucucuuccugauguccggccggggcaucgggaaaaugacgcuaggcaugugcugcaucauaaccgccagcauccuacugugguacgcucagauccagccgcauuggaucgcggccuccaucauucuggaguucuuccucaucgugcugcugauucccgagccugagaagcagagaacgccccaagacaaccagcucaccuacgucgugaucgcgauucugaccguagucgccgcaacgauggcgaacgagaugggguuucuggaaaagacgaagaaagaccucggccucgguagcauuaccacucagcaaccagagagcaacauacuggacaucgaccuccggccugccuccgccuggacgcuguacgccguagccaccacguucgugacccccaugcugcgccacucaaucgaaaauuccagugucaacgugagccugacggccaucgcaaaucaggcgaccgugcugaugggccuggggaagggguggcccuuaucaaagauggacaucggcgucccucugcucgcaaucggcugcuacucacagguaaacccaaucacccuuaccgccgcacuguuucuguuaguggcucacuacgcaaucauaggccccgggcugcaggccaaagccacgcgggaggcccagaagcgggcggcggcaggcaucaugaagaacccgaccguagacggcaucaccgugaucgaucuagacccgaucccuuaugaccccaaguucgagaagcagcucggccagguuaugcugcugguccucuguguaacacaggugcugaugaugcgaacgaccugggcuuuaugcgaagcccucacccuggcgaccggccccauuagcacguuaugggaggggaauccgggccgcuucuggaacacaaccauagccgucuccauggccaauauauuccggggguccuaccucgccggugccggccuguuguucuccaucaugaagaacaccacgaacacccgccgagguaccggcaacaucggggagacccucggcgagaaguggaaaucccggcugaacgcguugggcaaguccgaguuucaaaucuacaaaaaguccgggauccaggaaguggaccgcacguuagcaaaggaggguaucaagcgaggggagacugaccaucacgccgugucccgcgguagcgccaagcugcggugguucgucgaacgaaacauggugacccccgaggggaaggucgucgaucucggcugcgggcgcggcggcugguccuacuacugcggagggcucaaaaacgugcgcgaggugaaggggcugacgaagggcgggccagggcacgaggaacccaucccgaugagcacguacggguggaaccuaguucggcuccagagugggguggacguguucuuuacgccgcccgagaaaugugacacccuccugugugacaucggggagagcucacccaacccgaccgucgaggcgggccgcacgcuccgggugcucaaucugguggagaacuggcucaacaacaacacccaauuuugcauuaaggugcugaaucccuauaugcccuccgugaucgagaagauggaagcccuucagcgcaaguaugggggcgcccucgugcggaacccccugagccgcaacuccacccacgagauguacugggucucaaacgcauccggaaacaucgugagcuccguaaacaugaucucgcgcaugcugaucaaccgguucacuaugcggcacaagaaggccacauacgaaccagacguugaccugggcuccgggacgcgcaauaucggaaucgagagcgagauuccuaaccucgacaucaucgggaagagaaucgagaagaucaagcaagaacacgagacaagcuggcacuaugaccaagaccaucccuacaaaaccugggcuuaccacggcagcuacgagaccaagcaaacuggcuccgccagcuccaugguuaacggggugguccgccugcugacgaagccgugggacguagugcccaugguuacccagauggccaugaccgacacgaccccguucggccagcagcgcguauucaaggagaagguggacacccggacccaggaacccaaagaggggacgaagaagcucaugaagaucaccgccgaguggcuguggaaggagcuaggcaagaagaagaccccgcguaugugcacacgagaggaguucaccaggaaggucagaagcaaugccgcgcucggcgccaucuucaccgaugagaacaaguggaaguccgcccgcgaggcaguggaagacucuagauucugggagcuggucgauaaagagcgcaaccugcaccuugagggcaagugcgagaccugcguguacaacaugauggguaaacgggagaagaagcugggagaguucggcaaggccaaagggucccgcgcaaucugguauaugugguuaggcgcccgguucuuggaguucgaggcacugggcuuccucaaugaggaccacugguucagccgcgagaacagcuugagugggguggagggcgaagggcuacacaagcugggcuacauccuccgggacgucagcaagaaagaaggcggcgccauguacgcggacgauaccgcgggcugggacacgcgcauaacccuggaggaccucaagaacgaggagauggugaccaaccacauggagggggagcacaagaagcucgccgaagccaucuucaaauugaccuaccaaaacaagguuguccgugugcagcgccccacuccccggggcaccgugauggacaucauuagccgccgggaccaacggggaagcggccagguggggacauacggcuuaaacaccuucaccaacauggaagcccagcucauccggcagauggagggcgaggggguguucaagaguauccaacaccugaccgugacggaggaaaucgccguccagaacuggcuggcccgcgugggacgcgagcggcucagccgaauggcaaucuccggggacgacugcgucgucaagccucuagacgaccgguucgccagcgccuuaaccgcccucaaugacaugggcaaggugcgcaaggacauccagcaaugggagccaucccgcggcuggaacgauuggacucaggugcccuucuguagccaccacuuccacgagcuuauuaugaaggacgggcgcguucuaguagugcccugccggaaccaggacgagcugauuggcagggcccggaucucacagggagccggcuggagccugagggagacagccugccuggggaaguccuacgcccagauguggucucuuauguacuuccaccggcgcgaccugagauuagcggcuaacgccaucuguuccgccgucccgagccacugggugccgaccucccgcaccaccuggucuauccacgccaagcacgaguggaugaccaccgaagacaugcucaccguguggaaccggguauggauccaggagaacccguggauggaggacaagacccccguggagagcugggaggagauccccuaccugggcaagcgcgaggaccaguggugugguucgcuaauugggcucacaagccgugccaccugggccaagaacauacagaccgccauuaaucaggugcgcucccugaucgguaacgaggaguauacugacuacaugccguccaugaagcgguuucgccgcgaggaggaagaggcagggguccuuugguga

SEQ ID NO: 24938 - RNA, 9876 nt, Artificial Sequence
  derived and/or modified CDS sequence (opt11) from DENV-2__FJ906969__SS-prME
accgccggcaugaucaucaugcugauccccaccgugauggcguuccaccucacgacacggaacggcgagccccacaugaucgucucacggcaagagaagggcaagagccugcuguucaagaccgaggacggugugaacaugugcacccugauggcgauggaucugggcgaguuaugugaggacacaaucacauacaagugucccuuccucaagcagaacgagcccgaggacaucgacugcuggugcaacuccaccuccaccugggugacauacgggaccugcaccaccacgggcgagcaccggcgggaaaagcgaagcgucgcccuggugccccacguagggauggggcuggagacccgaaccgagaccuggauguccagcgagggcgccuggaagcacgcccagcgcaucgagacguggauauuacggcacccgggguucaccaucauggccgcgauccuagccuacaccaucggcacuacacacuuccagcgcgcccugaucuucauccuccugaccgccgucgcccccuccaugacaaugcgaugcauuggcaucagcaaucgcgacuucguggagggcguguccggcgggagcuggguagacauuguguuggagcacggguccugcguaaccacgauggccaagaauaagcccacguuagacuucgagcugaucaagaccgaggcuaagcagcccgccacccuccgcaaguauugcaucgaggccaaacucacgaacacgaccaccgauagccggugcccaacucaaggggagcccucccugaacgaggagcaggacaagcgguuugugugcaagcacagcaugguugacaggggcuggggcaacggguguggccuguucgggaagggcgggaucgugaccugcgcuauguucacgugcaagaagaacaugaagggcaagguugugcagcccgagaaccuggaguacacgaucgucaucacgccccacuccggcgaggaacaugccgucgggaacgacaccggcaagcaugggaaggaaaucaagaucaccccgcagagcucgaucaccgaggccgagcugaccggcuacgggacggugaccauggagugcagcccccggacuggccuggacuucaacgagauggugcuccuacagauggagaauaaggcuuggcugguccacaggcagugguuccucgaccuuccccugcccuggcucccgggcgccgacacccagggguccaauuggauccagaaagagacgcuggugaccuuuaagaacccccaugcgaaaaagcaggacguggucguccugggaagccaggagggggcgaugcauaccgcgcucaccggggccacggagauacagaugagcuccgggaaccuguuauucaccggucaccucaagugccgccuacgcauggacaagcugcaguuaaagggaaugagcuauuccauguguacugggaaguucaaggucguuaaggagaucgccgaaacccagcauggcacgaucguaauacggguccaguacgagggggacggcucgcccuguaagaucccguucgagaucauggaccuggaaaagcgacacgugcugggccggcugaucacggugaacccgaucgucacagagaaggauucccccgugaacaucgaggcggagccgcccuucggggacagcuauaucaucaucggcguggagccggggcagcugaaacugaauugguucaagaagggcuccagcaucggccagauguucgaaaccacgaugcgcggcgccaagcgcauggccauccugggcgacaccgcaugggacuuugggucccugggaggggucuucaccagcaucggcaaagcccugcaccaaguguuuggagccaucuacggcgccgcauucuccggggugucguggauaaugaagaucuuaaucggugucaucaucaccuggaucggcaugaacucccggucaacgucccuaagugugucccuggugcuggucgggguggugacccucuaccuaggcgugaugguccaggccgacagcgggugcguggucuccuggaagaauaaggagcugaagugcggcagcggcaucuucauaaccgacaacgugcacaccuggacugagcaauacaaguuccagcccgagagccccuccaagcucgccagcgcaauccagaaggcccacgaggaggggaucugcggcauucgcuccguuaccaggcuugagaaccuaauguggaagcagauuacccccgagcugaaucacauccugagcgagaacgaggucaagcucacgaucaugacgggggacauaaaggguaucaugcaggccgggaagcgcucccuccagccgcagcccaccgagcugaaguacagcuggaagaccugggguaaggccaagaugcuguccaccgagagccacaaucagacguuccucauagacggccccgagacggcggaguguccaaacacgaaccgggccuggaacucucuggaaguggaggacuacggguucggcguauucaccacgaacaucuggcugaagcuccgcgagaaacaggacgucuucugcgacagcaaacuuauguccgccgccaucaaagauaaccgcgccgugcacgcggacaugggguacuggaucgagagcgcccugaacgacaccuggaagaucgaaaaagccuccuucaucgaggucaagagcugccauuggcccaagucucacacccucuggagcaacggcgugcuggaauccgagaugauaaucccuaaaaauuucgcgggacccgugagccagcacaauuacaggccuggguaccacacccagaccgcgggccccuggcacuuagggaagcucgagauggauuucgacuuuugcgagggcacgaccguggucgugaccgaggacugcgggaaccggggccccagucuucgcaccacgaccgcguccggaaagcugaucaccgaguggugcugccggagcugcacccucccuccccuacgcuaccgaggugaggacggcugcugguacgggauggagauccgcccccugaaggaaaaggaggagaaccucgugaacucccuggugacggccggccacgggcagauagacaacuuuagccugggcgugcuaggcauggcccuguuccuggaggagaugcuccguacccgcguggggaccaagcacgccauccugcuggucgcgguuuccuucgugacgcuuauuacggggaacaugucuuuccgggaucuggggcgcgucauggugauggugggcgccaccaugaccgacgacauugggaugggcgucaccuaccuugcucuccuggccgccuucaaggugcggcccacguucgcggcaggcuuauuacugcgcaagcugaccuccaaggaacucaugaugaccaccaucgguauugugcugcugagucaaucaacgauccccgagacuaucuuggagcugaccgaugccuuggcccugggcaugaugguacugaagauggugcgcaagauggagaaguaucagcucgccgugaccauaauggcuauccuuugcguccccaacgccgugauccugcagaacgccuggaaggucuccugcacgaucuuagccgugguguccgugagcccccucuuccugaccuccagccagcagaaggcagacuggaucccccuggcgcucaccaucaaggggcugaacccaaccgccaucuuccugacgacccuuucacguaccaacaagaaacgcagcuggccgcugaacgaggcgaucauggccgugggaaugguguccauccuggcgagcucucuccugaagaacgacauacccaugacgggcccucuggucgcagggggccuccugacggugugcuacguacugaccgggcggagcgccgaccucgaguuagagcgggcugcggaugucaagugggaggaccaggccgagaucagcggcuccucccccauccuguccauuaccaucagcgaggacgguuccaugagcaucaaaaacgaggaagaggagcagauccugacgauccugauccggacgggguuauugguaaucuccggccuguucccggugaguaucccgaucaccgccgccgccuggugccucugggaggucaagaagcagcgcgcugggguccuuugggacgugcccagcccgccucccgucggcaaggcggaacuugaggacggggcauaucggaucaaacagaagggcauccugggguacagccagaucggcgccggcguguacaaggaagggacuuuccacacgauguggcacguaacacgcggcgcgguauugaugcacaaaggaaagcgcaucgagcccucuugggcagacgugaagaaggaccugaucagcuacggcgggggcuggaaacuggagggggaguggaaggaaggggaggaggugcaaguccuagcgcuggagcccggcaagaacccccgcgcuguacagacgaagcccggacuguucaagacgaaugcagguaccauaggagccgugucccucgacuucagccccggcacauccggcagccccaucaucgauaagaaagggaaggucgugggccuguaugggaacggcguggucacgcgguccggcgcuuacgugagcgcgaucgcucagacugagaaguccaucgaggacaaccccgagaucgaggacgacaucuuucgcaagcggaaacucaccaucauggaccuccacccgggagccggcaaaaccaagcgcuaucugcccgcaaucgugagagaggcgaucaaacgcgggcugcgcacacugauccuagcgccgacucgcguaguggccgccgagauggaggaggcccugagaggccugcccauccgcuaccagacccccgccaucagagccgagcacaccgggcgcgagaucguagaccucaugugccaugccacguucaccaugcgccucuuaagccccguccgggugccaaacuacaacuuaaucauaauggacgaagcccauuucacugaccccgcuucuaucgcggcacguggguacaucuccacccgggucgagaugggcgaggccgccgggaucuuuaugacggccacgccacccggcagccgcgacccguucccucagucaaaugcgccuaucauggaugaagaacgggagaucccugagcgcagcugguccagcgggcacgaauggguuaccgacuucaagggcaagaccgugugguuugugcccuccaucaaggccggcaacgauaucgccgccugccugcggaaaaacggcaagaaagugauccagcugagccgcaagaccuucgacagugaguacguuaagacccggaccaacgacugggacuuuguggucaccacggacaucagcgaaaugggagcgaacuucaaggccgagcgugugaucgacccccgccgcuguaugaagcccgugauccucaccgacggagaggagagagucauauuggccggccccaugccggugacccacuccagcgcggcccaacgccgggggcgcaucggucggaaccccaagaacgaaaacgaucaguacaucuacaugggagagccccuggagaaugacgaggacugcgcgcauuggaaggaagccaaaaugcuccucgauaacauuaacacccccgagggcaucauuccguccauguucgagcccgagcgagagaaggucgacgccauagacggcgaguaccgguugcgcggggaggcccgcaagacauucgucgaccuuaugcggcgcggcgaccugcccgugugguuagccuaccggguggcggccgaagggaucaacuaugccgaccgccgguggugcuuugacggcaucaagaacaaccaaauacuagaggagaacguagagguggagaucuggaccaaggaaggggagcgaaagaaauugaaaccgcgcuggcuggacgcacgaaucuauucggacccccucgcccugaaggaguucaaggaguucgcggccggccgaaagucccugacccucaaucugaucacagagaugggccgucugcccacguucaugacccagaaggcccgggacgcccucgacaaccuggcgguccuccacaccgcugaggcugggggccgggccuacaaucacgcccucucagagcuccccgagacccuggagaccuuacugcugcucacauugcuggcgacagugaccggaggcaucuuccucuuccugaugucgggccgggggaucggcaagaugacgcucggcauguguugcaucauaaccgccucuauccuccugugguacgcgcagauccagccgcacuggauugcggcguccaucauacuggaguucuuccucaucgugcugcugauccccgagcccgagaagcagcgaaccccucaggacaaccagcugaccuacgucguaaucgccauccugaccguggucgccgcuacgauggcgaacgagaugggcuuccuggaaaagaccaagaaggacuuagggcugggcagcaucaccacccaacagccugagagcaauauccuggauaucgacuugcggccggcuuccgccuggacgcuguaugccguggccacgaccuucgugacucccaugcugcgccacucuaucgagaacuccagcguaaacgugagucucacugcuaucgccaaucaagcgacggugcugaugggccuggggaaaggcuggccauuaucgaagauggauaucggggucccgcugcuggccaucggcugcuacucccaggucaaucccaucacccucaccgccgcccuguuucugcucguggcgcacuacgccauaaucgggcccggccugcaggccaaggccacucgagaggcccagaagcgcgcggccgccggcauuaugaaaaaucccacggucgauggaauuaccgugauugaccuggacccgauacccuacgacccuaaguucgaaaagcagcucggccaggugaugcugcugguccucugcgugacccaagugcugaugaugagaacgaccugggcccugugcgaggcccucacgcuggccaccgggcccaucagcacacugugggagggcaacccggggcgauucuggaacaccaccaucgcuguuuccauggccaacaucuuccggggcagcuaccucgccggcgcugggcuucuguucuccaucaugaagaauaccacaaacacccgacgcgggacagggaacauuggggaaacccucggcgagaaguggaagucccggcugaacgcacugggaaaaagcgaguuccagaucuacaaaaaguccgggauccaggagguggacaggacgcucgccaaggaggggauaaagagaggggaaaccgaccaccacgccgucucgagggguagcgccaagcugcggugguuugucgagcgcaacauggugaccccggaggguaagguggucgaccugggguguggccggggcggguggaguuacuacugcggcggguugaagaacgugcgggaggucaagggccuuacaaagggugggcccggccacgaagaacccaucccuaugagcacguacggguggaaucugguccggcuccaguccgguguggacguauucuucacgccgcccgaaaagugcgauaccuugcucugcgacauaggggagagcagcccaaauccgaccguagaggcaggccgcacguugcguguguuaaacuuaguggagaacuggcucaacaacaacacccaauuuuguaucaagguccugaaccccuauaugcccuccgugaucgagaagauggaggccuuacagagaaaguacggcggcgcucucguacggaacccucugagccgcaacuccacccacgagauguauugggucagcaaugcguccggcaauaucguaagcucagugaacaugaucucucggaugcugaucaaccguuucaccaugcggcacaagaaggccaccuacgaacccgaugucgaccugggguccggcacgagaaacauagguaucgaaagcgagauccccaaccuggauauaaucggcaaacggauugagaagaucaagcaagagcacgaaaccuccuggcacuacgaccaggaccaccccuacaagaccugggccuaccacggcagcuacgagaccaagcagacggggagcgccucauccaugguuaacggcgugguccgccuuuuaaccaagccgugggacguggugcccauggucacccagauggccaugaccgacacgacccccuucgggcagcagcgcguauuuaaggagaagguggacacccggacccaggaaccgaaggagggcacgaagaaacucaugaagaucaccgccgaauggcuguggaaagagcugggcaagaagaaaaccccgcgcaugugcacccgagaagaguucacccgcaagguccggucuaacgcagcgcucggagccaucuucacugacgagaacaaguggaaauccgcccgggaggccguggaggacagucgguucugggagcuugucgauaaggagcgcaaccugcaccucgagggcaagugcgagaccugcguguacaacaugaugggaaagcgagagaagaagcugggcgaguucgggaaggccaagggcucccgcgcgaucugguacauguggcuuggcgcccgguuccucgaguucgaggcccugggguuccugaacgaggaccacugguuuucgcgcgagaacagccucuccggcguggagggggagggccugcacaagcucggguacauccuccgggaugucagcaagaaagagggcggcgcgauguacgcggaugacaccgccgggugggacacgaggaucacccuggaagaccugaaaaacgaggaaauggugacaaaccacauggagggcgagcacaagaagcucgccgaggccauuuucaagcugaccuaccaaaacaaggugguccgggugcaacggccuacgccccgugggaccgucauggacaucaucucccgccgggaccagcgcgguagcgggcaggucggcacguacgggcugaacacauucacgaacauggaggcccaacucauccggcaaauggagggugaagguguguucaaguccauacagcaccucacagucaccgaggagaucgcgguccagaacuggcuggcccgaguggggcgcgagcggcugagccgcauggccaucucuggcgacgacugcguggucaagccgcuggacgaccgguucgccagcgcccugacagcgcucaacgacaugggcaaggugcgcaaggauauucagcagugggagccgucccggggauggaacgacuggacccaggugccguucugcagccaccacuuucacgagcugaucaugaaggacggccgcguccuggugguucccugccggaaucaggaugagcuuaucggacgcgcacggauaucccaaggcgcagguuggagucugcgcgagaccgccugccugggcaaauccuaugcccagauguggagcuugauguacuuccaccggcgcgaucuccggcuggcggccaaugcgauuugcucggccguccccagccacugggugccgacuucccgcaccacguggagcauccacgcgaagcacgaguggaugaccaccgaggauaugcucaccguguggaaucgcgucuggauccaggagaaucccuggauggaggacaagacccccguggagagcugggaggagauuccuuaccugggcaagcgugaggaucaguggugcggaucccugauuggccuuaccagccgggcgaccugggcuaagaauauccaaaccgccaucaaccaggugcgcucccugauuggaaacgaggaguacaccgauuacaugcccagcaugaagcgguuucgaagggaggaagaggaggccggcguccuaugguga

SEQ ID NO: 24939 - RNA, 9876 nt, Artificial Sequence
  derived and/or modified CDS sequence (opt11) from DENV-2__FJ898454__SS-prME
acagcgggcgugaucauuaugcugauccccaccgcuauggcguuucaccucacaacccggaacggggagccccacaugauugugagccgccaggagaagggcaagagccugcuguucaagaccgaggacggggugaacaugugcacccucauggccauggaucuuggcgagcugugugaggacaccaucacuuauaauugccccuugcugcggcagaaugagccggaggacaucgacugcuggugcaacuccacguccaccugggugaccuacgggaccugcaccgccaccggcgaacauagacgcgagaagcggagcgucgcccucgugccccacgugggcauggggcuggagacccgcacagagaccuggaugucuagcgagggcgccuggaagcacgcucagcggaucgagacguggauacugcgucacccuggguuuaccauuauggccgccauuuuggccuacacuauuggcaccaccuacuuccagcgggucuuaauuuucauccuacugacggcuguggcccccuccaugaccaugcgcugcaucggcaucucgaaccgggacuucguagagggggucuccggcgggagcuggguggacaucgugcucgaacauggcuccugcgucaccaccauggccaagaacaaacccacgcuggauuucgaacugaucaagacggaggccaagcagcccgcgaccuugcggaaguacuguaucgaggcgaagcugaccaacaccaccacugccagccggugccccacccagggagagcccucucugaacgaggagcaggacaagcgcuucguguguaaacacagcaugguggaucggggcuggggcaaugggugcggcuuguucgggaaaggcgggaucgugacgugcgccauguuuacuugcaagaagaacauggaggggaagaucguccaacccgagaaccuggaguacaccaucguggucacgccccacuccggcgaggagaacgccgugggaaacgacacaggcaagcacgggaaggagaucaaggugacgccucagagcuccauuaccgaggccgaacuaaccggcuacgggaccguuacaauggaaugcagcccccgcaccggccucgacuuuaacgagauggugcugcuccagauggagaacaaggcguggcucguacaccggcagugguuccuggaccugccacucccguggcugccgggcgccgacacacaggggaguaacuggauccagaaggagacccuggucacauucaagaacccccacgcaaagaagcaggacguggucgugcucggcucgcaggagggggccaugcauaccgcccugaccggggcgaccgaaauccagaugagcuccgggaaccuccuguucacgggccaccugaagugucgccugagaauggacaagcugcagcugaagggcaugagcuacaguaugugcaccggaaaauucaagguagucaaagagauugccgagacccagcacggcaccauaguggugcgcguccaguacgaaggggacgguagccccugcaagauccccuucgagaucauggaccuggagaaacggcauguccucggccgcuuaauuacggugaacccgaucgucaccgagaaggacucccccguuaacaucgaggccgagccgccguucggggacagcuacauaauaaucgggguggagccggggcagcugaagcucuccugguucaagaagggcagcuccaucggccagauguucgagaccacaaugcggggcgccaagcggauggccauccugggugacacggcgugggacuucggaagccugggcggggucuucacuuccauuggcaaggcacuccaccaaguuuuuggugccaucuacggcgcggcauucagcggcguguccuggaccaugaagauacugaucggggucgugaucaccuggaucggcaugaacagccgcucuacgagccuguccgugagcuuagugcuaguggggguggucacacuguaccuuggcgucauggugcaggccgacaguggguguguagugucguggaagaacaaggagcuuaagugcggaagugguaucuucaucaccgauaacgugcacacauggacggaacaguauaaguuccagcccgagucccccagcaaacuggccuccgcuauccagaaggcauacgaggaggggaucuguggcauacgaucagucacccgccuggagaaccuuauguggaagcagaucacccccgaacuaaaccacauccuguccgagaacgaggcgaagcucaccaucaugaccggggauaucaaggggaucaugcaggccgggaagcggagccuccgcccgcagcccaccgagcugaaguacucauggaagaccuggggcaaagccaaaaugcucucaaccgagccccacaaccagacguucuugaucgacggcccggagaccgcugagugcccuaauaccaaccgggccuggaacucccuggagguggaggacuacggguucggcguguuuaccacgaacaucuggcucaaguuaaaggagcgccaggacgucuucugugacagcaaauuaauguccgcggccaucaagaacaaccgggccgugcacgccgacaugggguacuggauagagagugcccucaacgacaccuggaaaaucgagaaggcgaguuuuaucgaggucaagagcugccacuggcccaagucccauacccuguggagcaauggcgugcuggaguccgaaaugauuauucccaagaacuucgccggcccggugucccagcauaacuaccgucccggguaucacacccagaccgcaggccccuggcaccucgggaaguuagaaauggacuuugacuucugcgagggcacgaccguggucgucaccgaagacugcgggaaccggggccccagccugcgcaccacgacugccuccggcaaacucaucaccgaguggugcugccggagcugcacacugccgccgcugcgcuaucgcggggaggacggcugcugguaugggauggagauccgcccccucaaagagaaggaggagaaccuggugaacucccucguaacggcgggccacgggcagaucgauaacuucagccucggcgugcugggcauggcccuguuucucgaggagaugcugcggacccgcgucgggacuaaacacgcaguccugcuugucgcagugaguuucaugacccugaucacgggcaauaugagcuuccgggaccuggggcgcgucauggugauggugggagccgccaucaccgaugauaucgggaugggcgucaccuaccuugcccugcucgccgccuucaaagugagaccuaccuucgccgcgggccuccugcugcggaagcucacguccaaggaguugaugaugaccaccaucgggaucguguuacucagccaauccaccaucccggagacgauccuggaacucaccgacgcccucgccuuaggcaugaugauacugaaaauuguccgcaacauggaaaaguaccaacucgcugucaccaucauggccacacugugcgucccaaacgcggugaucuugcagaacgcuuggaaggugucaugcacgaucuuagccgucguguccgucagcccccugcuacucaccaguagccagcagaaggccgacuggaucccccuagcgcugaccaucaaggggcucaauccgaccgcuaucuuccugacgacccugucccggaccaauaagaaacgcucauggcccuuaaacgaagccaucauggccguagguaugguguccauccuggccagcuccuugcuaaagaacgacauccccaugaccggccccuuaguggccggcggacugcucacggucugcuauguguugaccgggcggucugccgaccuggaguuggagagggccgcagacgugcggugggaggaccaggccgagaucucgggcuccucuccgauccugucuaucaccauaucggaggacgguuccaugagcaucaagaacgaggaggaggagcagacccugacgauccucauccgcaccggccugcucgucaucuccggccucuuccccgugagcauucccaucacagccgccgcaugguaccugugggaagugaagaagcagcgggcagggguccugugggacguucccuccccgccgcccgugggaaaggcagagcucgaagacggggccuaccgcaucaagcagaagggcauacugggguacucucagaucggcgccggcgucuacaaggaggggaccuuccacaccauguggcacgugacgagaggcgccgugcugaugcacaaagggaagcgcaucgaaccuaguugggccgacguccggaaggaccucaucagcuacggagggggcuggaagcuggagggggaguggaaggaaggggaggagguacagguguuagcccuugagcccggcaagaacccccgcgcgguccagaccaagccugggcuguucaagacaaacacuggcacgaucggggccgugagucuagacuucagcccuggcaccuccggcagccccaucguggacaagaaggguaaggucgugggccucuacgggaauggagucgucacccgguccggaaccuacgugagcgccaucgcccagacugagaaguccauagaggacaaccccgagaucgaggacgauaucuuccgcaagaagcggcugaccauaauggaccugcaccccggggcuggcaagaccaagcgcuaccugccggccaucgugcgggaggcgauuaagcgcgggcuccggaccuuaauccuggcgccgacccgcgucguggccgcggagauggaggaggcccuccgcgggcugcccauucgguaccagacccccgcgaucagagccgagcacacggggcgggagaucguagaccuaaugugucacgcgaccuucacgaugcgccugcugagcccgguccggguacccaauuacaaccugaucaucauggacgaggcgcacuucaccgaccccgccagcaucgccgcgcgcggcuacaucaguacccgggucgagaugggcgaggccgccgggauauucaugacugccacacccccgggcagccgcgacccauucccccaguccaaugccccuaucauggacgaggagcgggagaucccggagcgcagcuggaacuccggacacgaauggguuacggacuucaagggcaagaccgugugguucgugccgagcaucaaggccgggaacgacaucgcggccugccuccggaagaacggcaagaaagucauccagcugucccgcaagacauuugacagcgaguacauuaaaacgcggaccaacgacugggacuucguggugaccaccgacaucuccgagaugggugccaacuuuaaggccgagcgcgucaucgacccccggagaugcaugaagcccgugauccugacggacggggaagagcgcgugauucuagccgguccgaugcccgucacccacucauccgcggcccagagacgcgggcgcaucggccguaaccccaagaacgagaacgaccaauacaucuacaugggggagccacuggagaacgacgaggacugcgcccacuggaaggaggccaagaugcugcucgauaacauuaacaccccagaggguaucaucccaagcauguucgagcccgagcgggagaagguggacgccaucgacggggaguaccgcuuaaggggggaggcgcgcaagaccuucguggaccugaugcggcgcggcgaccucccggucuggcuggccuaccggguggccgccgaggggaucaacuacgccgaccgccgguggugcuuugacggcaucaagaacaaccagauucuggaggagaaugucgaggucgagaucuggacgaaggagggcgagcgcaaaaagcucaagccgcggugguuggacgcgagaaucuacuccgacccccuggcccucaaggaguuuaaggaguucgcggcaggacguaagucucuaacacugaaccucaucaccgagaugggccgccugcccacuuuuaugacgcagaaagcgcguaaugcuuuagacaaccuugccgugcugcacacagccgaggccgggggccgcgcguacaaccaugcccugucggagcuaccugagaccuuagagacauugcuacugcucacgcuccuagcgaccgugaccgggggcauauuccuguuccucaugagcggcaaagggaucggcaaaaugacccugggcauguguugcaucaucaccgccuccauccugcucugguacgcgcaaauccaaccccacuggaucgcagccagcaucauccuugaguucuuccugaucgugcuccucauccccgagccugagaagcagcgaaccccucaggacaaccagcugaccuacguggucaucgccauccucaccgugguggccgccaccauggcgaacgaaaugggcuuccuggagaagacgaaaagagauuuugggcuaggcuccaucgccacccagcagcccgagagcaauauucucgacaucgaccuccgccccgcgucugccuggacccuguacgccguagcuacuacguucaucacccccaugcuccgccacuccaucgagaauaguuccguaaaugugucacugaccgccaucgccaaccaggcaaccguccucaugggccucgggaaaggauggccgcuguccaagauggacaucggggugccgcugcucgccaucgggugcuacucucaggugaaccccaucacgcugaccgccgcccugcuccugcuggucgcccacuacgccaucaucgggcccggucuacaggcgaaagccacacgggaggcccagaagcgcgccgccgcgggcauuaugaagaacccgaccguggacgggaucaccgugaucgaccuggaccccauccccuacgaccccaaguucgaaaagcaguugggucaggucaugcuccuggugcugugcgugacccagguccucaugaugcgcacaaccugggcgcugugcgaagcccugacgcucgcgaccgggccgaucuccacccugugggagggcaacccugggcgguuuuggaacaccacgaucgccguaagcauggcgaacaucuuccgcggcucauacuuggccggagccgggcuucuguucuccauuaugaagaacaccaccaacacgcggcgcggcacggggaacaccggcgagacacugggugagaaguggaagaaccggcucaacucccuaggcaagagcgaguuccagauuuacaagcguagcgggauccaggagguggaccgcacgcuggcgaaagaagggauaaagcgcggcgagacggaucaccacgcggucagucggggguccgcaaaacugcgcugguucguggagcggaaucugguaacacccgagggcaaggucguggaccucggcugcgggcgcggcggguggucauauuacugcggcgggcugaagaacgugagggaggucaagggccugaccaagggcgggcccggucacgaggagccaaucccuauguccaccuauggguggaaccuggugcgccuucagagcggaguggacgucuucuucacgccgccagagaagugcgacacccugcugugcgauaucggggaguccagcccgaaccccaccguggaagccggccggacccuccgcgugcugaaccucguugagaacuggcucaacaacaacacgcaguucugcauuaaagugcugaacccauauaugccaagugucauugagaagauggagacucuacagcggaaguauggcggcgcacugguccguaaccccuuaucccggaacagcacccacgagauguacuggguguccaacgccagcggcaacaucguguccucugucaauaugaucucccggaugcuaauuaaccgcuucacgaugcgccacaagaaggcaaccuacgagccggacguggaccuggggagcggcacgcgcaauaucgggaucgaguccgagacgcccaaccuggacaucauagguaagcguaucgagaagaucaagcaggaacaugagaccucauggcacuacgaccaggaccacccuuacaagacgugggcuuaccacggcuccuacgagacgaagcagaccgggagugccagcagcaugguaaacggcgucguucgccugcuuaccaagcccugggaugugauccccaugguuacccagauggccaugacggacaccacaccguucgggcagcagaggguguucaaggagaagguggacaccagaacgcaggagccgaaggaaggcacgaagaagcucaugaagaucaccgcagaguggcuguggaaagagcugggcaagaagaagacgccccguaugugcacgcgcgaggaguucacccggaaagucagauccaacgcggcccucggggccaucuucaccgaugagaacaaguggaaguccgcuagagaagccguagaggacucccgcuuuugggagcuggucgacaaggagcggaaccuacaccucgagggcaagugcgagaccugcguguacaauaugauggggaagcgggagaagaagaucggcgaauucgggaaagcgaagggcagccgggccaucugguacauguggcuaggcgcccgauuccuggaauucgaggcccucggguuccugaacgaagaccacugguucucacgggagaacagccucagcggcguggagggggagggccuacacaaacugggguacauccugcgcgaagucuccaagaaggaaggcggcgcgauguacgccgacgacaccgccgggugggacacccggaucacccuagaggaucugaagaacgaggagauggugaccaaccacauggaaggcgagcacaagaagcuggccgaggccaucuucaagcucacuuaccagaacaaggucgucagggugcagcggcccacgccccgggggaccguuauggacaucaucucgcgccgggaucaacgcggcuccgggcaggugggcaccuacggccugaauacguucaccaacaugggggcgcaacugauccggcagauggagggcgagggaguguuuaagggaauccagcaucugaccgccaccgaggagguggccguccaggacuggcuugcucgcgugggccgggagcgcuugagccggauggccaucagcggggacgacugcguggucaagccgcucgacgaccgcuucgccucagcccugacggcgcugaacgacaugggcaaaauccggaaagacauccagcagugggagcccucccgcggguggaacgacuggacccaggugcccuucuguagccaccacuuucacgagcucaucaugaaggacgggcgggugcuggucguccccugccgcaaccaggacgagcugauagggcgggcacgcaucucgcagggcgccggcuggagccuccgggagaccgcgugccuggggaaguccuacgcccagauguggagccucauguacuuccaccgcagagaucuccggcuggcugccaacgccaucugcuccgcggugccgagccacuggguucccaccuccaggacuacgugguccauacaugcccgccacgaguggaugaccacugaggacaugcugaccguguggaaccgcguguggauccaggagaaccccuggauggaggauaagacgcccgucgaauccugggaggaaauuccguaccucggcaagcgggaggaccaguggugugguagccuuaucgggcugaccucgcgcgccaccugggccaagaacauucagacggcgaucaaccaggugcggucccucauugggagcgaggaguacacggacuacaugccguccaugaagcgcuuccgccgcgaggaggaagaggccggcguacugugguga

SEQ ID NO: 24940 - RNA, 9876 nt, Artificial Sequence
  derived and/or modified CDS sequence (opt11) from DENV-2__JQ922551__SS-prME
accguggggaugauaaucaugcucauccccaccgcaauggcauuccacuuaaccaccagaaauggcgaaccccacaugauugucagcaggcaggaaaaggguaaguccuuacuauuuaagaccgaggacgggguaaauaugugcacccucauggcgauggacuugggugaguuaugcgaggacaccauaaccuacaacugcccccuccugaagcaaaaugaacccgaggacaucgacugcuggugcaacagcaccucuaccuggguaacguacgggacauguaccgccacgggugagcaccggcgggagaaaaggagcgucgcgcuagugccccacgugggcauggggcucgaaacccggacggagaccuggaugagcucagagggagcaugcaagcacgcacagcggaucgaaaccuggauccugcggcauccgucauuuacgaucauggcggcaauccuggccuauaccaucgggaccacguauuuccagcgcgucguuuuccucauggugcuaaccgcagucgcgcuaagcaugacgaugagaugcaucgggaucuccaaucgagacuucguagagggggugucuggaggguccugggucgacaucguucuugagcacgggucuugcguaaccaccauggccaagaacaagcccacgcucgacuucgagcugaucaaaaccgaggccaagcagcccgccacucuccggaaguacugcauagaggccaagcugaccaacacuacgaccgcuucccguugucccacccagggcgagccgagccugaaugaggagcaagauaagcgguucgugaggaagcacucgaugguggaccgcgguuggggcaacggcugcggcuuauucgggaagggcgggaucguuacgugcgccauguucacguguaagaaaaacauggaggggaaaaucguccaacccgagaaccuggaguauacguuagugauaacgccccauagcggcgaggagaacgccgugggcaaugacacgggcaaucacggcaaggagaucaaggucacgccccaguccucgaucaccgaggccgcccucaccggguacggcaccgugacgauggaaugcaguccgcgcaccgggcuaaacuuccacgagauggugucguuacccauggagaauaaggcguggaugguacacaggcagugguuccucgaccugccccuucccuggcucccuggcgccgacacacaagguagcaacuggauccagaaggagacucucgugaccuucaagaacccgcaugccaagaaacaagacgucguagugcuggggucucaagagggcgccaugcacaccgcucucaccggggcgaccgagauacagaugagcuccgguaaucugcuguucacggggcaccugaaaugucgccuucggauggacaaacuucagcucaaggggaugucuuacagcaugugcaccggcaaguuuaaagucguguggggaauugcucgaacccagcacggcaccaucgugcaccggguccaauacgagggagacgggagccccugcaaaauaccacuaaacauaaugggccuggagaagcgccacguguuaggccgcccgauaacggugaaccccaucguaaccggcaaggacuccccagugaacaucgaggccgagccgccgcugggugacagcuacaucaucaucggcguggagccagggcagguuaaauugacaugcucacagaagggcagcuccaucggccagauguucgaaaccaccaugcgcggcgcgaagcguauggcgaucuuaggcgacaccgccugggacuucggaagccugggcgggguguucaccucgaucggcaaggcccugcaccaaguauuuggugccauauacggggccgcauucagcggcgugagcuggacuaugaagauccucaucgguguugugaucacguggaucggcaugaacagccgcucuaccagccugucggucagucucguguuggucgggguugugacgcucuaccugggcgugaugguacaagcugacucgggcugugugguguccuggaagaacaaggagcugaagugcgggagcggcauauucgucacagacaaugugcacacguggaccgagcaguacaaguuccaaccagaguccccaagcaaacucgccucugccauccaaaaggcccacgaggaagggaucugcggcauacgcagcgugacgcgccuggagaaccucauguggaagcagaucaccccggagcucaaccauauccugucggagaacgaggucaagcugacgauaaugaccggggacauuaagggcauaaugcaggcagguaagcgcagccuacggccacagccgacugagcugaaguacuccuggaaaaccugggggaaggccaaaaugcugucuacggagccgcacaaucaaaccuucuugaucgacgggccagagaccgcggagugucccuccacuaaccgcgccuggaacagccugaagggcggggacuacggcuucgggguguucacgaccaacaucuggcucaaguugaaggaacggcaggacguguccugcgauucuaaacuuauguccgccgcaaucaaggacaaccgugccguccacgcugacaugggcuacuggauagagagcgcccugaacgauaccuggaagaucgagaaagcguccuucaucgaggucaaaucaugccauuggcccaagucacacacgcucugguccaacggggugcucgaguccgaaaugaucauaccuaagaaccuggcgggcccugugucccagcacaacuaccgaccgggguaccacacccaaaccgcgggccccuggcacuuaggcaagcuggaaauggacuucgaccugugugaggggaccaccgucguggucacugaggacugcgguaaccgcgggccuagccucaggacuacgaccgccuccgguaagcugaucaccgaauggugcugucggagcugcacucugccaccccuccgguaccgcggugaggacgggugcugguauggaauggagauccggccauuaaaggaaaaggaggagaacuuagugaacuccuuggugaccgcagagcaugagcagaucgacaauuucucgcuugggguccuggguauggcccucuuucuggaggagaugcugagaacaagagucggcaccaagcacgccgugcuccuggucgcuguguccuuuaugacacugaucaccggcaacaugucauuccgggaccucgggagaguuauggucauggugggugccgcaaugacugacgacaucgguauggggguuaccuacuuggcgcuguuagcggcauucaagguccggccgacguucgccgcuggccugcugcuccgcaagcuaaccuccaaggaacugaugaugaccaccaucgguaucguccuccugagccagucuacgauccccgagaccauccuggagcucaccgaugcgcuugcucuggguaugaugauccucaagaucguccgaaacauggaaaaauaucagcuggccgugaccaucauggcaauccuuugcgugcccaacgccaugauccuccagaacgcuuggaaggucuccugcacgauccuggccgugguauccguuagcccccuacuccucaccuccagccaacagaaggcagauuggauaccgcuugcccucaccaucaagggccugaaccccaccgcgauuuuccugacaacccucagccgcaccaacaagaagcgcagcuggccucucaaugaggcuaucauggcgguggggauggucagcauccuggcguccagccuccugaaaaacgacauaccgaugaccggcccccuggucgccgggggccuuuugacagugugcuaucugcuccccgggcgcuccgccgaccuggaguuagagcgggccgcagaucuccgcugggaggaucaagcagagauuagcggcuccagcccgaucuuauccaucaccaucagcgaggacggguccaugagcauuaagaaccaggaagagaagcagacucugacuaucuugaucaagacggggcugcuggugauuucagagcuauucccaguacagaucccgauuaccgcugccgcaugguaccugugggaagugaagaagcagagggccggggugcugugggacguacccagcccgccgccgguggggaaggcagaacucgaggacggcgccuacgggaucaaacagaagggcauccugggcuacucccagauaggggcgggaguguacaaagaggggaccuuccacacgauguggcaugucacccgcggggccgugcugaugcacaaggguaagcggauugagcccagcugggccgacgugcguaaggaccucauuagcuauggcggcggguggaagcuggagggagaauggaaggagggagaggagguccaggugcuggcccuggagcccggcaagaacccccgggccguacagacuagacccggacuguucaagaccaauaccggcaccauaggggcggucagccuggacuuuucucccggaacgucagggucgccaauuguggauaaaaaggguaaaguggucggccucuacggcaaugggguggugaccagaaguggcaccuaugucucggcaaucgcgcagacggagaaguccaucgaggacaacccagagauugaggacgacaucuuccgcaagaagcggcucacgaucauggaccugcaccccggggcgggcaagaccaaaagauauuuacccgcgaucguucgggaagccaucaagcgcggguuacggacccugauacuggcucccacccgaguggucgccgcugaaauggaggaggcguugcguggucugccuauccgguaccagacacccgccauacgcgcagagcacaccggccgcgagaucguugaccugaugugucaugcuaccuucaccaugcgccuucucucgccugugagagucccaaacuacaaccugaucauuauggacgaggcccacuucacggacccggcgucaaucgcugcccgcggguacaucucuacaagaguggagaugggagaggccgccggcauauucaugaccgcgacgccgcccggcucccgugaccccuucccgcaguccaacgcccccaucauggaugaggaaagagagauccccgagcgcuccuggaacagcgggcacgagugggugacggacuucaaaggcaagaccguaugguuuguucccaguauaaaggcggggaacgacaucgccgcgugccucagaaagaacgguaaaaaggugauccaguuaagucgcaagacguuugacucagaguacaucaagacacggacuaaugacugggacuuugucgugaccacugauaucucggagaugggcgccaauuuuaaggccgagcggguuaucgauccgcgccgcugcaugaagcccguaauccugaccgacggggaggagcggguuauccuagcgggccccaugccggugacccacuccagcgccgcacaacgccgaggccgcaucggccgcaauccgaaaaacgagaacgaccaguauaucuacaugggcgagccgcuugagaacgacgaggacugugcccacuggaaggaggccaagaugcugcucgacaauauuaacacccccgaagggaucauacccuccauguucgagcccgagcgggagaagguagacgccaucgacggagaguaucgccugcgaggcgaagcccgcaaaaccuucguggacuuaaugcgucguggagaccuccccguguggcuggcuuaucggguggccgcagaggggauuaacuacgcugaccgccguuggugcuucgauggcaucaaaaacaaccaaaucuuggaggagaacgucgaggucgagaucuggaccaaggagggcgagaagaaaaaguugaagccccgcuggcuggacgccagaaucuacagcgacccccuggcucucaaggaguucaaggaguucgccgcugggcgcaaaucccugacucuuaaucucaucaccgaaaugggcaggcugccaaccuucaugacccaaaaggcgcgcaacgcgcuggacaaccucgcggugcuacacacugccgaggcugggggccgggccuacaaucaugcgcugagcgagcuccccgaaacacuggagacccuguugcugcugacccucuuggccacugugacgggcgggaucuuccuguuccugauguccggcaaggggaucggcaagaugacucuagggauguguugcaucauuacagccagcauccugcuuugguacgcccagauucagccgcacuggaucgccgcgucaaucauucuggaguucuuccuaauaguucuccugaucccggagcccgaaaagcaacguacgccccaggacaaccagcugacguacgugguaaucgcuauucucaccgcagucgccgccaccauggcuaaugaaaugggcuuccuggagaaaaccaagaaggacuucggacucgguucuaucgccacucaaccacccgagaguaauauccucgauaucgaccugcggccugccuccgccuggacccucuacgcuguggcuaccacguucaucaccuccaugcugcgccauagcaucgagaacagcuccgugaacgucagccugacugcgaucgccaaccaggccacggugcugaugggccucgggaaggguuggccccuguccaagauggauaucggggugccccuccucgcgauuggcugcuacagccaggucaacccgauuacccugacggccgcgcugcuccugcugguggcucauuaugccaucaucggcccagggcuccaagcgaaggcgacccgggaggcccagaagcgugcagcggccggcauaaugaaaaaucccaccguggacgggauaacagucaucgacuuggaucccaucccguacgaccccaaguucgagaagcaacugggccaggugaugcuucuggugcuaugcgugacccagguucucaugaugaggaccaccugggcccuuugugaggcccugacccucgcaacugggcccaucuccacauugugggagggcaaucccggccgguuuuggaacaccaccaucgccgugagcauggcgaacaucuuccggggguccuaccuggcgggggccgggcuguuguuuagcauuaugaagaacacgaccaacacccggaggggcacggggaauacgggggagacccugggcgaaaaauggaaaaacagacuuaacgccuuggggaaguccgaguuccagauauacaagaaauccggcauccaggaagucgacagaacccuggcgaaggaggggauuaaacggggcgaaaccgaccaucaugccgugucccgcggaucagccaagcuccggugguucguggaacgcaaccuggucaccccggaggggaaggucgucgaccugggaugugggcguggcgggugguccuacuauugcgggggccucaagaacguaagagaaguuaaggggcuuacgaaaggagggccuggccacgaggagcccauccccaugagcacuuacggguggaacuuaguccggcuacagagcggcgucgauguguucuucacaccacccgaaaaaugcgauacguugcugugcgacaucggcgaguccucaccaaacccgacaguggaggccggucgcacgcuccggguccuaaacuuaguggagaacuggcugaauaacaauacgcaguucugcgugaagguacucaaccccuacaugcccuccguaaucgagaaaauggaaacacugcagcguaaguacggaggggcguuggugcguaauccccucagccgaaauucgacgcacgagauguacugggucucuaaugcguccggcaacaucgugagcuccgucaacaugaucucgagaaugcugaucaaucguuucaccaugcggcacaaaaaggccaccuacgagccggacgucgaccugggauccggcacgagaaacaucggcauugagagcgagacucccaaccucgacauuaucggaaagaggaucgagaagauuaagcaagagcacgagacuuccuggcacuacgaccaggaccauccuuacaaaacgugggccuaccacggcagcuacgagaccaagcagacggggucggccagcucaauggugaauggcgugguccggcuccugaccaagcccugggacgugaucccuauggucacccagauggccaugaccgacacaacccccuuugggcagcagagagucuuuaaggagaaguccgacacccgcacgcaggagcccaaggagggaacgaagaaauugaugaagaucacccccaaguggcuguggaaggagcuggguaaaaagaagacgccgcgaaugugcacccgggaggaguucacgcguaaaguucguagcaacgcugccuuaggggccauauucaccgaugagaauaaguggaaguccgccagagaggccguggaggauucccgguucugggagcuggucgacaaggaacgaaaccugcacuuagaggguaagugcgagacaugcguguacaacaugaugggcaagcgagagaaaaagcugggugaguucggaaaggcaaaggggucucgcgccauaugguauauguggcuaggagcccgguuucucgaguucgaggcccuggguuucuuaaaugaggaccauugguucagucgggaaaauucccucagcggcgucgagggcgagggacugcacaagcuaggauacauccuccgggacgugucgaaaaaggaaggcggggcgauguacgccgaugacaccgcggggugggacacgcgaauaacccuggaggaccugaagaacgaggagaugggcgccaaccaccuugaaggggagcccaagaaguuauacgaggccaucuucaaguuaacguaccagaacaagggcgugcggguccaacgcccgacgccccggggcccguuaauggacaucauucugcgccgggaucaaggcgggucaggacaagugggcacuuaugguuugaauaccuucaccaauaugggggcucagcugauccgccagauggaaggcgagggagucuuuaagggcauccagcaucugaucgccacugaggaaaucgccguucaggacuggcucgcgcgcguugggcgggagcguuucucccguauggccaucagcggcgacgauugcgucgugaaaccccucgacgacagguuugcgucggcucugacggcccugaacgauaugggcaaggagcggaagguguuacagcagugggagcccagccgugaguggaacgacuggacgcaaguacccuuuugcagccaccacuuccacgaacuaaucaugaaagacgggagaguccuggucguuccgugccgaaaucaggaugagcucaucggcagagcccggaucagccagggggccggcuggucccugcgggagaccgcgugccugggcaagucauacgcccagauguggucccagauguacuuucaucgccgggaccuccgccuagccgccaacgcgaucugcagcgcgguucccucccauuggguacccaccagccggacgacuuggagcauccacgcccgccaugaauggaugaccaccgaagacaugcugaccgucuggaacagggucuggauccaagaaaacccauggauggaggacaagacgccgguggaguccugggaggagauccccuacuugggcaagcgcgaggaccagugguguggaucacugauaggccugacgagucgggcgacuugggccaagaacauucagaccgcgauuaaccagguacgcagccucauuggcaaugaggaguauaccgauuacaugcccaguaugaagcgcuucaggcgcgaggaagaggaggccggcguacugugguga

SEQ ID NO: 24941 - RNA, 9876 nt, Artificial Sequence
  derived and/or modified CDS sequence (opt11) from DENV-2__JQ922550__SS-prME
accguugguaugaucaucauguuaauuccuacggugauggcuagccaccucaccacgcggaacgggggcccccauaugaucgugauagggcagcagaagcgcaagaccuccuucuucaagaccaagaaaggccacgacaugugcacgcuaauggccauggcguucggggaguucugcgagaacaccauaacuuacaagugccccuuucugaagcagaacgagcccgaggacaucgacuguuggugcaacagcaccagcaccugggugaccuacgggaccugcacgacaacgggcgagcaccggagagaaaagcggagcgucgcccucguuccccauguggggaugggcuuggagacccggaccgagacauggaugagcagcgagggcgccuggaagcacgcgcagcgcaucgaaaccuggauccugaggcaccccggguucaccauaauggccgcaauccucgccuacaccauaggaacgacccacuuucagcgcgugcugauuuucauccuguuaaccgccaucgcuccgucaaugaccaugcgaugcaucggcaucagcaaccgcgacuucguggaaggaguguccgggggcagcugggucgacaucguucuggagcacggguccugugugacgaccauggcgaagaauaagccgacacuggacuucgaguugaucaagaccgaagcaaagcagcccgccacguuaaggaaauacuguaucgaggccaagcugaccaacaccacuaccgacagucgcugccccacccagggcgagccaacccuaaacgaggaacaggacaagcgguuugugugcaaacauuccaugguugaccgcggcuggggaaacggcugcggauuguucggcaagggcggaaucgugacgugcgccauguucaccugcaagaagaacaugaagggcaagaucguccagcccgagaaccucgaguauaccguggugauaacaccacacagcggggaagagcacgccgucggaaacgacaccgggaaacacggcaaggaggugaagaucaccccccaaucgagcaucacggaagccgagcuaaccggguacggcaccguaaccauggagugcaguccccggaccgguuuagacuucaacgaaauggugcugcuccagauggaagacaaagccugguuagugcaccgccagugguuccuggaccucccccugcccuggcuuccgggggccgauacccaaggcagcaacuggauccagaaggagacccucguuacauuuaagaacccccacgccaagaagcaggacgucguaguacuggguagucaggaaggggcgaugcauacugcccugaccggggccacugagauccaaaugucgagcggcaaccuccucuucaccggccaccugaagugccggcuccguauggacaagcugcagcugaaggggauguccuacagcaugugcaccggcaaguucaagguggugaaggaaauugccgagacccagcacgggaccaucgucauacgggugcaguacgagggggacggaucccccugcaagauccccuucgaaaucaaggaccucgaaaagcgucacguguuggggcggcuuauuaccgucaacccaaucguaacagagaaggauagucccgucaacauugaagcagaaccgccccuuggcgacuccuacaucaucaucggagucgaaccgggccagcugaagcucgacugguucaagaagggaucauccaucggccagauguucgaaaauaccaugcgcggugcuaaacgcauggccauccucggggacaccgccugggacuucggaagcuuaggcgggguguucaccuccaucgggaaagcucugcaccagguguuuggggccaucuacggcgcugcguucagcggggucuccuggacgaugaaaauccucaucggcgucaucaucacuuggauagggaugaauagccgguccaccagucuguccgugucccugguucuuguuggcaucgugacccuguaccuggggguaauggugcaggccgacuccggcugcggcgggugcgagcgcaagacaaagacaaagugcgggagcgguauuuucgucaccgacaacguacacacguggacugagcaguacaaguuucagccggaguccccgagcaagcuggccagugccauccagaaggcccaugaggaggggaucugcgguauccgcuccgugacucgcuuagagaaccucauguggaaacagauaacacccgagcugaaccacauccucagcgagaacgaagugaagcugaccaucaugaccggcgacaucaaaggcauaaugcaggccgggaagcggagucugcgcccgcagcccaccgagcuccgauacagcuggaaaaccuggggcaaggccaagaugcuuuccaccgaacugcacaaucaaaccuuccugauagaugggcccgaaaccgcagagugcccaaacaccaaccgcgcuuggaauagccuugaaguagaggauuacggguucggcguguucaccaccaacaucuggcuucgccuccgcgagaagcaggacgucuuuugcgauucgaagcugaugagcgcagcuaucaaggacaaccgggcgguccacgccgacaugggguauuggauagaguccgcgcugaacgacacguggaagaucgagaaggccagcuucaucgaagucaagagcugccacuggcccaaaagccacacuuuaugggguaacggggugcuggaguccgaaauggucauccccaagaacuucgccggcccugugagccagcacaacaaccgcccgggguacuacacccagaccgcugggcccuggcaccugggcaagcucgagauggacuucgacuucugcgagggaacgacuguggucgugaccgaggauugcggcaaccgggggccuucccugcgcaccaccaccgccuccggcaagcugaucaccgaguggugcugucggagcugcacacuuccgccucccaaguaccgcggggaggauggcugcugguacgguauggaaauacggccccugaaagagaaggaagagaaucuaguuucgagccucgucaccgcggggcauggccagaucgacaacuucucacuggggauucugggcauggcccucuuccuggaggagaugcugagaacgcggguggggaccaagcaugccauucuccugguggccgucaguuucgugacccugaucacgggcaacauguccuuccgagaccucggccgggugaugguuauggugggggcgaccaugacggacgauaucgguaugggggucaccuaucuagcacugcuggccgccuucaaggucagacccacauucgccgccgggcuccugcuccgcaagcugacaagcaaagaguuaaugaugaccaccauaggcaucgugcucuccucacaguccagcaucccggagacgaucuuggaguugacagaugcccuugcucuagggaugaugguccugaaaaugguccgaaauauggaaaaguaccagcuugccgugaccaucauggcuauucugugcgugcccaacgcggugauccugcagaaugccuggaagguguccuguaccaucuuggccguagugagcgugagcccccugcuguugacaagcucccagcagaaggcagauuggaucccgcuggcucugaccauaaagggccucaacccaaccgcgaucuuccucaccacgcuaagcggaaccagcaagagaagaucguggccccucaacgaggcuaucauggccgucggcaugguguccauccuggccagcaguuugcugaagaacgacauacccaugaccgggccccuaguggcgggcgggcugcucaccgucuguuacguacugacagggcgcagugccgaccuggaacuggagcgagccaccgacgugaagugggaugaccaggccgaaaucagcggcuccuccccgauccugucuaucacgaucagcgaagacggguccaugagcaucaagaacgaggaggaggagcagacccugacuauucucauccguacggggcuguuagucauaagcggacucuuccccgucucaauucccauaaccgcugcggccugguaccucugggaggugaagaagcagcgggccggcguccugugggaugugcccuccccgccccucguuggcaaggccgaacuggaggacggggcauaccgcaucaaacagaagggaauccucgguuacagccagaucggcgcgggggucuacaaggaaggcaccuuucauaccauguggcacgugacgcggggcgcggugcucaugcacaagggcaagcgcaucgagccauccugggccgacgucaaaaaggaccugauaagcuauggcggggguuggaagcuggagggggaguggaaggagggggaggaagugcaggugcucgcccuggagccaggcaagaaccccagagcuguccagaccaaacccgggcuguuccgcaccaauaccgggacgaucggagcggugucccuagacuucagccccggcacaaguggcagccccaucguggacaagaaggggaaggucgugggucuguacgggaaugguguuguuacucggucuggggccuacgugagcgccaucgcccagacagagaaguccaucgaggauaacccagagaucgaggacgacaucuuccgaaagcggcgccuaacgaucauggaccuccaccccggugccggcaagaccaagcgcuaccugccagcgaucgugcgcgaggccaucaagcgggggcuccgcacccucauccuggccccgacccgcgugguggcugcagaaauggaggaggcgcugcggggucugcccauccgcuaccagacgcccgccauccgggccgagcacaccgggcgcgagauuguggaccuaaugugucacgccacauuuaccaugcggcugcugagccccauccgcgugcccaacuacaaccucaucaucauggacgaggcacacuucacggaucccgccagcaucgccgcucggggcuacaucuccaccagaguggagaugggggaagcugccggcaucuucaugacagcaacgccccccggaagccgagacccguucccccagucuaacgcccccauuauggacgaggagcgcgagauccccgaacggagcuggaacagugggcacgaaugggucacggauuucaaagguaagaccgucugguucgucccgucaauaaagaccgggaacgacauugccgcaugccugcgcaaaaacggcaagagagugauacaacugucccgcaagacauucgacagugaguacgucaagacgcggaccaacgacugggacuucgugguuacuaccgacaucuccgagaugggggccaacuucaaggccgagcgcgucaucgacccccgacgcuguaugaagcccguuauacugacggacggcgaggagcgggugauccuggccggccccaugccggucacccacuccuccgccgcgcagcggcgagggcggaucggccgcaacccaaagaacgaaaacgaccaguacauuuacaugggcgaacccuuagaaaacgacgaggacugcgcacauuggaaggaggccaagaugcuguuggacaauaucaacacgcccgagggcaucaucccgaguauguucgaaccugaacgggagaaaguggacgccaucgacggagaguacagacugcggggagaggccaggaagacccugcuggagcugauccgcggcgggcccaucccgguguaccucggcuacaaauggcccggggagggcaucaacuacgcggacucacgccugugcguaggccggacccagaauaaccagauccucgaagagaacguggaggucgagaucuggaccaaggagggaaaagggaagaagcucaagccacgcuggcuggacgccaggauauacucggaccccuuagcccucaaagaguucaaggaguucgccgcugggcgcaagucucugacccugaaccucauuaccgagaugggacgccuaccgacguucaugacacagaaggcccgagaugcccuggacaaccuagccgugcuucacaccgccgaggcugggggcaaggcguacaaccacgcccugagcgagcugcccgagacccuggagacccugcuccugcugacgcuacuggccacagugacgggcggcauuuuccucuuccucauguccgggcgggggaucggcaagaugacccuggguaugugcuguaucaucacggccagcauccuguugugguacgcucagauccagccccacuggaucgccgcuucaaucauacuggaguucuucuugaucguccuccuuauccccgagccggaaaaacagcgcacaccccaggacaaucagcugaccuacguuaucaucgccaucuugacaguggucgccgcgacgauggcaaacgaaaugggcuucuuagagaagaccaagaaggaccucggccucgggaacaucgccacacagcagcccgagagcaacauccuggacaucgaccugcggccugccagcgcuuggacgcucuacgccguggccaccaccuucaucaccccgauguugcggcacuccaucgagaacucauccgugaacgucagucugaccgccaucgcuaaccaggccacggugcucaugggacuggggaaaggcuggccccugucgaaaauggacaucggggugccccugcuggcaaucggcugcuauucucaggucaauccaaucacccugaccgccgcguuauugcugcucgucgcccacuaugccaucauaggcccggggcugcaggcuaaggccacccgggaagcccagaaacgcgccgcggcaggcaucaugaagaaccccacgguggacggcaucaccgucauagaccuggacccaaucccauaugacccuaaguucgagaagcagcucgggcaggugauguugcuuguguugugcgucacccaagugcugaugaugcggaccacuugggcccugugcgaggcccucacccuggccaccggccccguguccacccugugggaagggaaccccggccgcuucuggaacacgaccauacucauccagauggcuaacauccugcgggggucuuaccuggccggggccgggccccucuucaguaucauggagaacacgaccggcccgcggcgccggacggggcagcuggggagagagcugcuccggagguggaaaucgcggcugaacgccuuaggcaaguccgaguuccagaucuauaagaagucggggauccaggaggucgaccgcacccuggccaaggagggcaucaagagaggggagaccgaccaccacgcggugucgcgcgggagcgcgaagcugcggugguucguggagcgcaaccuggucacccccgagggcaagguaguggaccucgggugcggccgcggcgggugguccuacuacugcggcgggcugaagaacguccgggaggugaaggggcugacaaaaggcggacccggccaugaggagcccaucccaaugagcacuuacggcuggaacuuggugcgccugcaguccgguguggauguguucuuuaucccgcccgagcgaugcgacacucugcucugcgacaucggcgagagcuccccgaaucccacgguggaggccggccgaacccugagggugcugaaccucguggagaacuggcugaacaacaacacgcaauucugcaucaaggugcugaaccccuauaugcccagcgucauugagaagauggagacgcugcagcggaaguacgggggcgcccucgugcggaacccgcugucucguaacucaacacaugagauguacugggucagcaacgccuccggaaacaucgugagcuccgugaauaugaucagccggauguugaucaaccgcuucacgaugcgccacaagaaggcgacguaugagccagacguggaccucggauccggaacccgaaacaucgggauugagagcgaaauuccgaaucuggacaucaucgguaagcggaucgagaagaucaagcaggagcacgagacguccuggcacuacgaccaggaucacccauauaagaccugggccuaccacgguagcuacgagacgaaacagaccggcucagccagcuccauggucaacgggguggugcgccugcuaacuaagccgugggacgucgugccaauggugacccagauggccaugacagacaccacccccuucgggcagcagcgggucuucaaggagaagguggacacuagaauccaggaaccgaaggagggaacgaagaagcugaugaagauaauggcggaguggcuguggaaggagcucgggaagaagaagacgccgcggaugugcacaagagaagaauucaccaagaaggugaggagcaacgcagcccugggcgccaucuuuacggacgagaacaaguggaaguccgcgcgagaggccguggaggacgggcgcuucugggaguugguggaccgcgagcggaacuuacacuuggaggggaagugcgagaccugcguguacaacaugauggggaagcgcgagaagaaacugggcgaguucggcaaagcuaaggggucccgggccauaugguacauguggcucggagcccgcuuccuggaguucgaggcccugggguuccuuaacgaggaccacugguucucccgggaaaacagccuguccggcgucgagggugagggccugcacaagcucggcuacauccugcgcgaagugaguaagaaggaagggggcgcgauguacgccgaugacaccgccgggugggacacccggaucacgcucggagccuuaaagaacgaacgcaagugcacggagcauauggaaggagagccucgcaaacccggucguggccacuucaaguggcgcaaccagaaccgggucguagggguacaaggcccgacccccggggguaccguuauggacaucaucagucgcaaaaaccagcggggcuccggccaggugggcacguacgggcugaauacuuucacgaacauggaggcgcagcugauacgccagauggaaggcgagggguuuuucauagagcaucaacacuugacggcgagcgaggaaaacgccgugcaggacuggcuggccagagucggccgagaaaagguguccaggaugcccauaucaggcgacgacugugucgucaagcccuuagacgaccgcuucgcccgggcguuaacggcccugaacgacauggguaaaguacgcaaggacauccagcagugggaaccaucccggggcuggaacgacuggacacaggugccguucugcagccaucacuuccacgagcugauuaugaaggacgggcgaacccucgucgugcccugucggaaccaggaugagcugauaggccgcgcccgaaucucccagggggcagguuggagcuucggcgagaccgccugccuggguaaguccuacgcgcagauguggucacucaucaacuucaggaucccagaccugcgcuuggccgccaauguaaucugcuccgugguacccagccauugggugccgaccucucgcacuaccuggagcauccacgccaaccacgaguggaugaccaccgaggauaugcucacugucuggaaccgcguguggauacuggaaaaccccuggauggaggacaagacccccguugaguccugggaagagaucccguaccuggaaaagcgggaggaccagugguguggcucccucaucgggcugacgccccagccgcccugggccaagaacaucgagaccgcuaucaaccaggugcguucccugaucggcaacgaggaguacauugacuauuugcccagcaugaagcgcuuccgcauagaggaggaggaaagcggguuccuaugguga

SEQ ID NO: 24942 - RNA, 9876 nt, Artificial Sequence
  derived and/or modified CDS sequence (opt11) from DENV-2__JQ922553__SS-prME
acagcagggaugauaauaaugcuaauacccacggugauggcguuucaccuaaccacuagaaacguugaaccgcccaugauauuuucaagacaagaaaaagggaaauccuuucucuucaaaacaaaagauggacacgacaugugcacguucauggcaauggaccuaggcgaacucugcgaagacaccauaaccuacaaaugcccauuucucaaacaaaaugaacccgaagacauagacuguuggugcaacuccaccaguacguggguaacauacggcacuugcacuacaaccggagaacaccgacgugagaaacguucgguugcacucguaccacacguaggaaugggauuagagacacggacggagacuuggaugucaagcgagggugcauggaaacacguccagcgcauagaaacuuggauucucaggcacccggguuucacaauuauggcggcuauccuugcauacacaaucgguacaacacacuuucagcggguccucauauuuauccuacuaaccggaguagcaccaucaaugagaaugcgaugcauugggaucaguaacagggacuucgucgaaggcguguccgggggauccuggguggacauuguacuagagcacgggucgugugucaccacaauggccaaaaacaagccgaccuuagaccuugagcuaauaaagaccgaagcgaagcaaccggccacccugaggaaauacugcauugaggcaaagcuaacaaacaccacaacugacagccgcugccccacacaaggagagccaacacugaacgaagaacaggacaagagguucguauguaagcacucaaugguggaucgcggcuggggcaauggguguggccucuucggaaaaggagcaaucgugaccugcgcgauguucaccuguaaaaagagcaugaaaggcaaaauuguccaacccgaaaaccucgaguacaccgucguaaucaccccacacaguggcgaggaauaugcgguuggcaacgacacgggcaaacacggcaaggaagugaaaauaacgccacaaagcagcauuacugaggcagaacuuacgggauaugguacaguaacuauggaauguucgccgcgaacgggccuagacuucaacgagauggugcuauuacaaauggaggacaaagcauggcuuguccaucggcagugguuccucgaccugccccucccguggcugcccggggcugacacccaaggcuccaacuggauccaaaaggagacgcucguuacauuuaagaacccgcacgcaaagaagcaagacgucguagugcuuggaucacaagaaggcgccaugcauacagcgcugacaggggcgacagagauccaaaugucaagcggcaaccuucuauuuaccggacaccuaaaaugccgucuuaggauggacaaacuccagcuaaagggaaugucauacuccaugugcaccgguaaauucaagguggugaaggagauagcugaaacacaacacgguacaauuguaauacgaguacaguacgagggcgauggcucgccgugcaaaaucccauuugagauaauggaucucgagaagcgacacguccugggacgacucaucacagucaaccccauuguaacggaaaaagacucaccaguaaauauagaggcggaaccuccguucggagacuccuacauaaucauagguguagagccaggacaacuaaagcucgacugguuuaagaagggguccucgaucgggcaaaugcucgaaacaacaaugcguggggcaaaaagaauggcaauacugggggauaccgcaugggacuucggcagccucggcgguguauucacaucaauuggcaaagcacuccaccaagucuuuggggccauauacggggccgcauucucagguguguccuggaccaugaaaauacugauaggcgugaucaucaccuggauuggcaugaacaguaggagcacaagucucuccgucagccuaguucucgucggcaucguaaccuuauaccuaggcguuauggugcaagccgauucaggaugcguggucaguuggaaaaacaaagagcuaaagugcggaucaggaauauucgucacggacaacgugcacacauggaccgaacaguauaaauuccagccagaaucgcccucuaaacuugcaagcgcaauccaaaaagcccacgaagaaggcaucugcggaauaagaagcgucacaagguuagagaaucugauguggaaacaaaucacccuagagcucaaccacauucuaagcgagaacgaaguaaaacuaacuauaaugacgggugacauuaaagggauuaugcaagucggcaaaaggucacugcgcccucaaccaacagaacuacguuacucguggaaaaccuggggcaaggcaaaaaugcuaagcaccgaacugcacaaccaaacuuucuugaucgaugguccugaaaccgcagaaugcccgaacgcaaaccgagcauggaauagccucgaggucgaagacuacggauuccggaaauacaaaacaaagauuuggccgacauugaaggaauggcgaaaggucuucugcgacagcaaacuaaugagcgcggcaauuaaggauaacagagcaguccaugcagacauggguuacuggauagaaagugcgcugaacgacacauggaaaauagaaaaagccucauucauagaggucaaaagcugucacuggccaaaaagccauacccuauggggaaacggcguucaggagagugaaaugguuauccccaaaaacuucgccggcccagucucacagcacaacaaccgaccgggauacuacacgcaaaccgcgggcccauggcaccuaggcaaacuagagauggauuucgacuucugugagggaacgacagucguugugacagaggauugugguaauagaggaccaagccuccgaacaaccacagccagcggaaagcucaucacagaauggugcugcagguccugcacccuaccacccuugcgauacagaggagaagcaggcuguugguacuggauggacauuagaccucugaaagagaaggagaaaaaccuagucuccagccuggugaccgcgggucauggacaaauugacaacuucagccugagaauacucggaauggcccuauuuuuggagaaaaugcuuaugacgcggcucgguacuaagcacgccauccugcuaguggcggugagcuucgugacucuaaucacgcgcaacaugagcuucaaagaccugggccgcguaaugguaaugguuggcgcuacuaugacggacgacaugcgcaugggaguaaccuaccuugcgcugcugccggcuuuuaaaguucggcccacuuucgcaacuggccuacuauugagaaaauuaacaagcaaagaacuuaugaugacaaccaucgguaucgugcuauucagucaaucgucaauaccagaaaccaucuuagaacuuaccgacgcgcuggcccucgguaugaugguccugaagauggugcggaacauggagaaguaucagcuggccgucaccauaauggccauacucugcguacccaacgcaguuauacugcaaaacgcauggaggguuagcugcaccauucuagcuguagucucgguuucgccccucuucuuaaccagcucaaggcaaaaggccgauuggauuccccuagcgcugacuauaaaagggcuaaaucccacggcaauuuuccugacgacucuuucccguaccucgaagaaacgaucuuggccgcucaacgaagccauaauggccguugggauggucuccauauuggcgagcucacuacucaaaaaugauauaccuaugacaggcccauuagucgccgggggucuacuuacagucugcuauguguuaacuggccgauccgcugaccuagaacuagaacgggcugcugacgucaagugggaugaucaagcugaaaucagcggaagcagcccaauacucucgaucacaauuagugaagacggaagcauguccaucaaaaacgaagaggaggaacagacacucacgaucuuaauaagaacgggacucuuaguaaucagcggacucuuccccguuucgauaccaauuacagccgcggccugguaccuuugggaggucaagaaacagagagccgggguacugugggacgucccgucgccaccaccaguagguaaagcagaacuagaagacggcgccuaccggauacaacaaaagggaauauucggguacucacaaauaggagcgggggucuauaaagaaggaaccuucccgacgauguggcacgucacgagaggcgcagugcuaaugcauaaaggcaaaagaaucgaacccaguugggcggacgucaagaaagaccucaucagcuacggagguggauggaaguuggagggagaguggaaagagggggaagagguucaaguucuagcccucgagcccgggaaaaaucccagggccgugcaaacgaagccaggccuguucaaaaccaacaccgggaccauaggugcagucucgcuggacuucagcccaggaacaucaggaaguccaaucgucgacaagaaaggaaaagugguaggucucuacggcaauggcguggugacacguagcggcgcguauguaucagcuaucgcccaaacagaaaaguccaucgaggacuaucccgaaguggaaauggacauauuucggaagaaacggcucaccauaauggacuuccauccgggggccggucgccagaaacgguacuucccagccaucgucagagaggcgauaaagcgaggacuaagaacccugauacucgcacccacgcgcguuguagcggcugagauggaagaagccuugcgcgggcuuccaauucgcuaccagacacccgcgauacgagcagaacacacgggacgcgagaucguagaccuaaugugucacgcaaccuucacaaugagacuauugagcccaaucaggguaccgaauuacaaccuaauaauuauggacgaggcgcauuucacagauccggccucuauagcggcaaggggauacauuagcacgcgcguugaaaugggcgaagcagcggguauauucaugacagcuacaccgcccggcagcagagaccccuuuccgcaaaguaacgccccaaucauggacgaagaacgugaaauuccggagcggagcuggaacagcggacacgagugggucacggacuuuaaagggaaaauugucugguucguuccuagcuugaagacuggaaaguacauagcugcaugccuacguaagaaugguaagcgggucauccagcuaagccguaaaaccuuugacagugaauaugucaagaccaggaccaacgauugggacuucguuguaacaaccgauauuagugaaaugggagccaacuucaaggccgaacggguaauugacccacgccgcuguaugaaaccaguaauccugacagauggagaagaacgaguaauucuugcaggccccaugccggucacacacuccagcgcugcccaacgcagaggccguaucggacgcaaccccaagaacgaaaacgaccaguacaucuacaugggggaaccgcuggaaaaugacgaagauugcgcacacuggaaggaagcgaaaaugcuacuugauaacaucaacacuccagaagggauaaucccaaguauguucgaaccagaacgcgagaaagucgaugcaauagauggcgaauaccgucuucgaggcgaagcacgaaaaacccuacucgaacuuauaaggggcggaccaauccccguguaccucggauacaaauggccaggagagggaauuaacuaugcagacagccggcuauguuucgacggaaucaaaaacaaucagaucuuggaggaaaacgucgaagucgaaauauggacaaaggaaggcgagcggaaagagcuuaaaccccgguggcuugacgcucgaaucuacagcgauccgcucgcauuaaaagaguucaaagaguucgcggcgggacgaaaaucgcugacgcucaaccugaucacggagaugggucgacugcccacauucaugacccagaaggcuagaggagcucuggcgagucucaugguucuccacaccgccgaagccgguggccgagccuacaaucacgcacucuccgaauugccggaaacacucgaaacauuacuacuacucacgcuacuggcaaccgucacaggaggaaucuuccucuuccugaugucaggaagaggaauaggaaagaugacccuagguauguguugcaucaucacggccuccauccuguuaugguacgcgcaaauccagccacacuggauagcagccucaauaauccucgaguucuuccucaccgugcuucuaaucccagaaccagaaaagcaacggacuccccaagauaaucaacuuacguacguuaucauagccauauuaacaguagucgcagcaacgauggcaaaugagauggguuuccuggagaaaacaaagaaagaucucggcuugggcaacaucgcaacacagcaauccugcaaaaagauacucgacaucuaccuuggccccgcacuaccuuggaagcuauacgcgggaggcacaacguucaucaccccaaugcuccgacacucaauagaaaacucgagcgugaacgucagucugaccgccaucgcaaaccaagcaacuguauuaaugggacugggcaagggcuggccccuaaguaaaauggauaucggggucccccuacucgcgaucggcugcuacagccagguuaaccccauaacccugaccgccgcguuauuccuucucguagcccacuaugccauaaucggcccgggacuacaggcgaaacccacacgugaagcccagaagcgagcagcggccggaauaaugaaaaauccgacgguugacgggauuaccguaauagaccucgacccaauaccguacgacccgaaauuugaaaaacaacucggacaggucauguuacugguacuauguguaacccaagugcuaaugaugcgcacgaccugggcucuaugcgaggcccuaacuuuggcgacgggacccguauccacgcugugggaagggaaccccggacgguucuggaacacgacaauugcgguaucaauggcgaacaucuuccggggaucguaccuggcaggagcagggcuccucuuuucgauaaugaaaaacacaaccagcacaagacggggcaccgggaauaucggagagacgcucggggaaaaauggaagagucgacuaaacgcgcucggaaaaagcgaguuucagaucuacaagaaaucagggauccaggaaguagaccggacccucgcaaaagaagguauaaaacgcggcgaaacggaccaccaugcagucuccagaggcagcgcuaaguuacgaugguucgacgagcggaacuuaguaacuccggaagggaagguaguagauuuaggauguggccgggguggguggaguuucuucuguggcggacucaagaacguaagagaaguaaaagcacuaacgauagguggcccgggccacgaggaaccaauacuaaugagcacuuacggcagaaacuugguacgaagccaauccggggugguuguguuucacacacccccugaaaagugcgacacuucacugcgcgauauaggcgaaucauccccgaauccgacaguugaagcgggccguacacuacgaguccugaaccucguagaaaacuggcucaacaacaacacgcaauucuguauaaaagucuugaaccccuacaugccaaguguaaucgagaaaauggaggcccuacaacguaaauacggaggagccuugguaaggaauccgcuuucgaggaacagcacacacgaaauguacugggugagcaaugcauccggaaauauaguuucaucggugaauaugaucucacgcaugcuuauaaaccgguucacaaugcggcacaagaaagcgacauacgagccggacguagaucucggcagcgguacccgaaacaucggcaucgagagcgaaacuccaaaccuagacauuaucgggaagcgaaucgaaaagaucaaacaagaacaugaaaccagcuggcacuacgaccaagaucacccauacaaaacuuggggcucccacggaucuuacgagacuaaacagacgggauccgcuuccagcauggucaacgggguuguacgacuacuaacaaaaccaugggauguuguuccgaugguaacucaaauggcaaugacggauaccaccccguucggucaacagcgcguguuuaaggaaaagguugacacccgaacacaggagccgaaagaagguacaaagaaacucaugaaaaucacugcggaauggcucuggaaagaauuggggaaaaagaagacccccagaaugugcacgagggaggaguucaucaagaaaguaaggucuaaugcugcccuuggggcaauuuucacagacgaaaauaaauggaaguccgcgagagaggccgucgaggaugguagauucugggagcucgucgacaaggaaaggaaccuccaccuagaaggcaagugcgagacgugcgucuauaacaugauggggaaaagagaaaagaagcugggggaguucgggaaagccaagggaucccgagcaauuugguacaugugguuaggugcccgauucuuagaauuugaggcgcuaggguuccugaacgaggaccacugguucaguagagaaaacagccucuccggggucgaaggagaaggacuacacaagcuaggcuacauccuaagggaagugaguaagaaagagggcggagcgauguacgccgacgacacggcagguugggacacucguaucacccuggaagaccugaaaaaugaagaacggaaaacuaaucacaugggaggcgagcaccgcaaacuggcccguggaauauucaagaugaaucucaccaacaaaguagugagggugcagaggcccacgccaggagggacccugauggacauaaucagcaggaagacccagcgcggaucagaacaagucggcacguauggcuuaacgacguuaacaaacuuggaagcaccuccgauucgucaaauggaagggaaaggaguauucaaaggccaccaacaucgcaccgcaagcgaagaaaacgcaguacaggauuggcucgcccgcgucgggggugagaggcugagccggcuagcaauuucgggcgacgacugugugguaaagccccuggacgaucgauuugcgagagccuuaacugccuuaaacgauaugggcaaggugcguaaggacauacagcaaugggaacccagccggggcuggaacgauuggacccaggucccauucugcucccaccacuuucacgaacuaauuaugaaagauggacgcacgcucguaguaccgugcaggaaccaagacgaguuaauaggccgcgcgcgaaucagccagggcgcaggauggucccuccgagagacggcgugucuagguaaguucuaugcccagagauggagccucauguacuuccacagaagggaccuccgcuuagcccccaacgcgaucugcuccgcaguucgaacccacugggucccuacaucacgcaaaacguggccaauacaugcgagccaugacuggaugaccacagaagucaugcuaacggucuggaacaagcucugguuccaagaaaacccauggauggaagacaaaacaccagucggcuucugggaagaaaucccuuuccucgaaaaagguaaggaccaauggggcggcagccucaucggacucacaagccgaccacccugggcaaagaacuuccaaccggccauaaaucaaguucgcucccuccugugcaacgaagagagcgcggacuuuaugccaaguaugaagcgcuucagaagggaagaagaagaagccgggguacucugguga

SEQ ID NO: 24943 - RNA, 9876 nt, Artificial Sequence
  derived and/or modified CDS sequence (opt11) from DENV-2__JQ922549__SS-prME
accgccggcgugaucaucaugcugauccccacggccauggcguuucaccugacuacccgcaacggggagccccauaugaucgucagcagacaggagaaggguaagagccugcuuuucaagacggaagacgggguuaacaugugcacccucauggcaauggaccugggugagcugugcgaagacaccauuaccuacaacugcccccucuugcgccagaaugaacccgaggauaucgacugcugguguaacagcaccagcaccugggugacguacgggaccugcaccgccccuggcgaucaccggcgcgagaagcguagugucgccuuggugccccacguggggauggggcucgagacccgcacggagacguggaugagcucggagggcgccuggaagcacgcgcagcggauugagaccuggauccugcgccaucccggauucacaaucauggccgccauccuggccuacacuauugguaccacauacuuccagcggguccucauccuuauccugcucacagcgguggcccccuccaugacgaugcgcugcaucgggauaagcaaccgagauuuuguggagggcgucuccggcgggucauggguggacaucgugcuggagcacggcuccugcguaacaaccauggccaagaacaaacccacccucgacuucgagcucaucaagaccgaggccaaacagcccgcaacucugaccaaauacugcaucgaggcgaagcugaccaacacgaccaccgcuagccguugccccacccagggagagcccucccucaacgaagagcagcacaaacgauuugugugcaagcauagcaugguggaccgcggcuggggcaacgggugcggacuguucggcaagggcgggaucgucacgugcgcgauguucacgugcaagaagaacaugaagggcaaaaucgugcagccugagaaccuggaguauaccaucguggucaccccgcacuccggagaggagaacgcagucgggaaugacacggggaaacacgggaaggagaucaaggugcgcccccaaagcucuaucacugaagcggaacuuacgggcuacgguaccgucaccauggaaugcagcccacggacgggcuucgccuucaacgagaugguacuucuacagauggagaacaaagccuggcucguucaccggcagugguuccuggaccugccccuccccuggcugccgggcgccgacacucagggguccaacuggauccagaaggagacccuugucacguucaagaacccccacgccaagaagcaggacguggucgugcucgggucacaggagggggccaugcacacggcgcugaccggcgccaccgagauccagauguccuccgggaaccugcuguuuacgggccaccugaagugccgccugcggauggacaagcuccagcuaaaagggaugagcuacuccauguguacggggaaguucaagguggugaaggagaucgccgagacccaacacgggaccaucgugauccgagugcaguacgagggggacggcagccccugcaagaucccauucgagaucauggaccuggagaaacgacucgugcuaggccgccugaucaccgugaaccccaucgugacagagaaagacagccccgucaacaucgaggccgagccuccguucggagacagcuacaucauaauuggcguggagccugggcagcucaagccuuccugguucaagaaaggcagcuccauccgccaaauguucgagaccacaaugcgcggggcgaagcgcauggcgauacugggcgacaccgccugggauuucggaucguuggggggcguguucacgucaauugggaaagcccuccaccaggucuucggcgcuaucuacggugcggccuucagcggcguguccuggaccaugaagauccucaucggcguggucaucaccuggauagggacgaacagcagaaguacuagccuguccgugagccuugugcucgucggaguggugacccuguaccugggugucaugguacaggccgauuccggcugcguggucagcuggaagaacaaagaguugaagugcgggagcggaaucuucaucaccgauaacgugcacaccuggaccgagcaguacaaguuccagcccgaguccccaagcaagcuggcuagcgccauccagaaggcgcacgaggaggguaucugugggaucaggucggugacccggcuggagaaucucauguggaagcagaucacccccgagcuuaaccacauacuguccgagaacgaggugaagcucaccaucaugacgggcgauaucaagggcaucaugcaggccggcaagcguucgcugcgcccccagccgaccgagcugaaguacucuuggaagaccugggggaaggccaagaugcucagcaccgagccccacaaccagacguuccugaucggcggcccagagaccgccgaaugcccaaacaccaaccgagcauggaauucccuagagguggaagacuacggguuuggcguguucacgaccaacaucuggcucaagcuuaaggaacgucaggaugucuucugcgacagcaagcugauguccgcugcaaucaaagacaacagagccgugcacgcagacaugggguacuggaucgagagcgcccucaacgacaccuggaagaucgaaaaggcguccuucaucgaggugaagagcugccacuggccgaagucccacacccuguggagcaacggggugcuggaguccgagaugauaauucccaagaacuucgccggcccuguuagccagcacaacuaucggcccggauaccacacccagaccgccgggcccuggcaccucgggaaacuggagauggacuuccacuucugcgaaggcacgaccguggucgugaccgaggacugcggaaaccgcggccccagccuuaggaccacgacagccucgggaaagcucaucacugaguggugcugccgcagcugcacccugccgccacugcgcuaccguggugaggacggcugcugguacgggauggagauucggccucucgagggggaggagggggaccuggugcacucucuggucacggcuggccauggccaaaucgacaacuucagucucgguguguugggcauggcgcuuuuccucgaagagaugcugcgcacccggguggggaccaagcacgccguccugcugguggccguguccuucaugacccugaucacgggaaacaugagcuuccgcgaccuggggcgcguuauggugaugguuggggccgcgaugaccgaugacauuggcaugggugucaccuaccuugcccuuuuggccgccuucaaggugcggcccaccuucgcagcgggccuauuguuacgcaagcuaacguccaaggagcugaugaugaccaccauugggauaguacugcuuagccaguccaccauccccgagacgauucucgagcugaccgacgcccucgcccuggggagaaugauccugaagaucguccgaaauauggagaaauaccaacucgccgugaccauaauggccauccucugcgugcccaacgcggugauccugcagaacgccuggaagguuucuugcaccaucuuagccgucguguccgugagcccacugcuccucacuuccucucaacagaaggcggauuggaucccccuggcacugacgaucaagggccucaaccccacggccaucuuccugaccacacugucccggaccaacaagaagaggagcuggccccucaacgaggccaucauggccgucgggaugguuuccauccuggccagcucccuacucgaaaacgacaucccgaugaccggaccccugguggccgggggccugcucaccgugugcuacgugcugacggggcggagcgccgaucuggagcuugaacgcgccgccgacgugcggugggaggaccaggccgagaucucaggcuccagccccauccugagcaucaccaucuccgaggauggcucuaugagcaucaaguacgaggaggaggagcccacuuugaccauccuaauccgcacggggcugcuggucaucuccgggcucuucccggugagcauccccaucaccgcggccgccugguaccugugggaggugaagaaacagagagccgggguacugugggacgugccauccccgccgcccgugggcaaggccgagcucgaggacggggcguaccgcauuaagcagaaaggcauccugggcucgagucagaucggggcgcgggucuacaaagagggaaccuuccacacgauguggcacgugacccgcggggccgugcugaugcacaagggcaagcggaucgaaccaucuugggcugaugucagaaaggaucucaucuccuacggcggcggcuggaagcuggagggggaguggaaggagggcgaggaagugcaggugcucgcccucgaaccgggcaagaacccccgggcggugcagacgaaaccgggcuuauuuaagaccaacaccgggaccaucggcacagugagccuggacuucucccccggcaccucugaauccccgauuguggacaaaaaagguaaggucguaggccuguacgggaacggcguggucacccgcuccgggaccuaugugagcgccaucgcccagacggaaaagagcaucgaggacaaccccgagaucgaagacgacaucuuccggaaaaagcgccugaccauaauggaccuucaccccggggccggcaaaacgaagcgguaucugcccgcgaucguuagggaggccaucaagcgcgggcuccgaaccuuaauccucgccccgacucgcgucguggccgccgagauggaggaggcgcuccggggccugccaauccgauaccagacccccgccaucagggcggagcacacagggcgcgagaucguggaccugaugugccacgccaccuucacuaugcggcuucugagccccguccgcgugccgaacuacaaucugaucaucauggacgaggcccacuucaccgacccugcuaguaucgccgcccgcggcuacaucagcacacgcguggagaugggcgaggcggcagggaucuucaugaccgcgacgccgcccggcucccgggacccuuucccccaaagcaacgcccccauuauggacgaggagcgcgagauccccgagcgguccuggaacaguggccacgagugggucaccgauuucaaagggaaaacggugugguucgugccgaguaucaaggcugggaacgacaucgccgcaugccuccgcaagaacggcaagaaggucauccagcugagccggaagaccuucgacucagaguacaucaagacucgcaccaacgauugggacuucguggugaccaccgacaucagcgagaugggcgcaaacuuuaaggccgagcgggucaucgacccccgccgaugcaugaagcccgugauccugacggacggggaggaacgcgugauccuugccggcccuaugccggucacgcacuccagcgccgcgcagcgacgggggcgcaucggccggaacccgaaaaacgagaacgaccaguacaucuauaugggagaaccacuggagaacgacgaggacugcgcccauuggaaggaggccaagaugcuucucgacaacauuaacacgccugagggcauuauccccuccauguucgagcccgaacgcgagaaaguggacgccaucgacggcgaguacaggcugcggggggaggcccggaagaccuucgucgaccugaugagacggggagaccuccccguuuggcuugcuuaccgcgucgccgcugaggggaucaacuaugccgaccgucgcugguguuucgacggcaucaagaauaaccaaauucuugaggagaacgucgagguggagaucuggacgaaggagggcgaacggaagaagcucaagccgcgcuggcuggacgcccggaucuacuccgacccccuggcacucaaggaguucaaagaguucgccgccggccgcaagucacugaccuugaaccucaucacugagaugggccggcugcccaccuuuaugacucagaaggcucguaacgcgcuggauaaccucgccgugcugcacaccgccgaggccgggggccgagcguacaaccaugcacugagcgagcuccccgagacccuggagaccuugcucuugcugacgcuccuugccaccgucacugggggcaucuuccuguuccucauguccggaaaggggaucggaaagaugacccuggggaugugcugcaucauaaccgccucgauccuguugugguacgcccagauccagccgcauuggauagcugcgucgaucauccuggaguucuuccugaucgugcuacugauccccgagcccgagaagcagcgcacgccccaggacaaccagcucaccuacgugguuaucgccauccucaccguuguagccgccaccauggcgaacgagaugggcuuccuggagaagacgaagaaggacuucggguugggcagcaucgcgacccagcagccggagagcaauauccucgacaucgaccugcgacccgcgagcgccuggacccuguacgccgucgccacgacguucauuacacccaugcuccggcauagcauagaaaacucccccgugaacguaagccugaccgcgaucgcuaaccaagcgacgguccuaaugggccucgggaagggcuggccgcuguccaaaauggacaucggggugccccccuuggccaucggcugcuauagccaggugaaccccaucacgcucaccgcggcccugcugcugcugguugcccacuacgccaucaucgggccaggccuccaggugaaggcaacccgcgaggcgcagaagcgggcagccgccggcauuaugaagaaccccacgguggacgggaucacggucauagaccuagaccccauacccuacgacccgaaauucgagaagcagcugggccagaucauguuacgcgugcugugcgugacccagguccugaugaugcggacaaccugggcccugugcgaggcgcugacuuuagccacggggcccaucuccacucugugggagggcaacccgggucgcuuaggcaacaccacgauugccgugagcauggccaacauauuccgcgguuccuaccuggcaggggcgggccuacuguuuagcauuaugaaaaacaccacaaauacccgccgggggacgucuaaccugggcgagacccugggcgagaaguggaagaaccgccuuaacagucuggggaaauccgaauuccagaucuacaagaaguccggaauccaggagguugaccggacccuggccaaagagggcaucaagaagggcgagaccgaucaccacgccgucucccgcgggagcgccaagcugcggugguuuguggagcgcaacuuagugacgcccgagggcaaagucguggaccuaggcugcgggcggggcggaugguccuacuacuguggagggcucaaaaacgugcgcgaggucaagggcuugaccaagggcgggccuggccacgaggagcccauccccaugucuaccuacggcuggaaccuggugcggcuccaauccggugaggacguguucuucacgccgcccgagaagugcgacacgcugcugugcgacaucggcgagagcagccccaaucccaccgucgaggcaggccgcacacuccgggugcugaacaugguggagaacugguuaaacaacaauacccaguuuugcaucaagguccugaauccguacaugcccuccgugaucgagaagauggaggcccugcagcgcaaguacggcggggcccuagugcggaacccucuuagccgcaacuccacccacgagauguacuggguuagcaacgccuccggcaacaucgucagcuccgugaacaugaucagccggaugcugaucaaccgguucacgaugcgccacaaaaaggccacuuacgagcccgacgucgaucugggcaguggcacccggaacaucgggaucgagagugagaccccaaaccuggacaucaucggcaagcgcaucgagaagaucaagcaggagcacgagacguccuggcacuaugaucaggaccauccuuauaagacaugggcauaccauggcagcuacgagacaaagcagaccggguccgccaguucccucgugaacggcgugguuagacuccuaaccaagccgugggacgugauaccuauggugacccagauggcgaugaccgacaccacgccguucgggcaacagcgcgucuucaaggagaagguggacacccggacccaggagcccaaggagggcacgaagaaguugaugaagauaacggccgaguggcuguggaaggagcuggguaagaagaaaacgccccggauguguacccgcgaagaguucagccgcaagguucgauccaaugccgcgcucggggccauauucaccgaugagaacaaguggaaaucggcccgcgaggccguagaggacggacgguucugggagcugguggacaaggaacgcauccugcaucucgaggggaaaugcgaaacgugcguuuauaacaugaugggcaagcgggaaaagaagaucggggaguucggcaaggccaagggcuccagagcgauaugguacauguggcugggggcccguuuccuggaguucgaggccuugggcuuccugaacgaggaccauugguucagccgagaaaacagccucucaggcguggagggcgagggacuucacaagcugggcuacauccuacgggagguuagcaagaaggagggcggagcuauguacgccgacgacacugcggguugggauacacgaaucacccucgaggaucugaagaacgaggagauggucacgaaccacauggagggggagcacaagaagcuggccgaggccaucuucaagcucaccuaucagaacaaaguggucaggguccaacgccccaccccacgcggcaccgugauggacauaaucucccgccgcgaccagcgggggagcggccagguggggaccuacgggcugaacaccuucacuaacaugggcgcccagcugauccgucagauggagggggagggcguguucaaggggauccagcaccucaccgcgacggaggagaucgccgugcaggacuggcuggcucggguggggcgcgagcgccugucccgcauggccaucucgggcgacgacugcguagugaagccccucgacgaccgguucgccuccgcgcugacugcccugaaugacauggggaaggugcgcaaggacauccagcagugggagcccucucgggguuggaaugacuggacccaggucccauucugcucccaccacuuccacgaguugauuaugaaggacggucgcguguuagucgucccgugucggaaccaggacgagcugauaggacgcgcucggaucucucagggcgccggauggagucuacgggagaccgccugccuggguaaaucguacgcacagauguggucccugauguauuuucaccggagagacuugcggcuggcugccaacgccauuugcagugcugugccgucccacuggguucccacaagucgaaccacccgcuccauccaugcgcggcaggaguggaugaccaccgaggucaugcuuacgguguggaaucgcguguggauccaggagaaccccuggauggaggacaagaccccgguggagaguugggaggagaucccuuaccucggcaagcgggaggaccaguggugcggcucucucaucggccugaccuccagagccaccugggccaagaacauccagacggcaaucaaccaagugcggagccucaucggcuccgaggaguauaccgacuacaugcccagcaugaagcgcuuccggcgugaggaggaagaagcgggcgugcugugguga

SEQ ID NO: 24944 - RNA, 9876 nt, Artificial Sequence
  derived and/or modified CDS sequence (opt11) from DENV-2__JQ922552__SS-prME
accgcuggcaugauuaucaugcugauucccaccguaauggccuuccaccucaccacgaggaacggggagccgcccaugaucguuagcaggcaggagaagggcaagucccuacuauucaaaaccgaggacggggugaauaugugcgcacuuauggccauggaccugggcgagcgcugcgaggacaccaucacuuacaacugcccccugcucaaccagaacgagccugaggacauagacuguugguguaacagcaccuccaccugggugaccuauggcaccugcaccaccaccggggaacugcggcgggaaaagaucagcgucgccuugguuccccacgugggaauggggcucgagacccggaccgagaccuggauguccagcgagggcgccuggaagcacgcccagcgcaucgaaauauggauccugcgacaccccgguuucacgaucauggcggcgauacucgccuacacgauuggaacuucacacuuccaacgcguccucaucuucauccugcugacugccauugcccccagcaugaccaugcguugcaucgggaucucgaaccgcgacuucgucgaaggggugagcggcggguccuggguagauauugugcucgagcacggcagcugugugacaaccauggccaagaacaagcccacccuggacuuugagcugaucaagacggaggccaagcaaccggccacgcuacgaaaguauugcaucgaagccaagcuaacgaauacgaccaccgacagucgaugccccacgcaaggggagcccaccuuaaaugaggagcaggauaagagguucgucugcaagcacucuaugguugaccgcggcuggggcaauggguguggccuguucggcaagggggggaucguaacgugcgcgauguucacgugcaagaaaaucaugaaaggaaagaucguacagccagagaaucuggaguacaccguggugaucaccccgcacuccggcgaggaacacgccgucgggaaugacaccggcaagcaugggaaggaggugaagauaacuccucagucauccaucaccgaggccgagcugaccggcuacggaaccgucaccauggagugcaguccccgcacgggucuugacuucaacgagaugguccugcugcagauggaggacaaggccugguugguacaccgccagugguuccuggaccugccccucccguggcugcccggcgcugacacccagggaucgaacuggauccagaaggaaacccuaguaaccuucaagaacccacacgcgaagaagcaggacgucgugguccucggcagccaggagggggcgaugcacacggcccugaccggcgccaccgagauccaaaugaguuccgggaaucuccucuucaccggacacuuaaaaugccggcugcgcauggacaagcuccagcugaagggcaugagcuacucaauguguacggggaaguucaaggucgugaaggagauugccgagacccagcacgguacuaucguuauccgagugcaguacgagggugauggauccccgugcaagauccccuucgagauaauggaccuggagaagcgccacgugcuaggacggcugaucaccgucaacccuaucgugacagagaaagauucccccgugaacaucgaggcugagccgccguucggggacagcuacaucaucaucggcgucgagcccgggcagcugaagcucaacugguucaagaaaggauccagcaucgggcagaugcuggagaccacgaugcgcggcgccaagaggauggccaucuuaggcgacaccgccugggacuucgggucccucggcgggguguucacgucaaucggcaaggcccugcaucagguguucggggcgauuuacggcgccgccuucuccggcgucagcuggacgaugaagaucuuaacaggggugaucaucacauggaucggcaugaauagccggucuacgagccugagcgugucgcucguucugguggggaucgugacccuguauuugggugucauggugcaggccgacagcgguugugucgucucauggaagaacaaggaacucaagugcggaagcggcaucuucgugaccgacaacgugcacaccuggacggagcaguacauguuccagccagagagccccucgaagcuggcaagcgcuauccagaaggcccacgaggaggggauaugcggcauacguagcgucacccgacucgagaaucugauguggaagcaaaucacgccggagcugaaccacauacucagcgagaacgaggucaaauugaccaucaugacgggggacaucaagggcaucaugcaggucgggaagcgcuccuugcggccgcaaccuaccgagcugagguacucauggaagacauggggccagccgaagauguuauccccagagcugcaccaccagaccuuccucaucgacggccccgagaccgccgagugucccaauacgaaccggaccugggacagccuggaggucgaggacuacggguuuggcguguucacuacgaagauuugguugcgccuccgggagaagcaggauguguucugcgauucuaagcugauguccgccgcaaucaaggacaaccgcgcggugcaugccgauaugggguacuggaucgaguccgcacugaacgacacuuggaagaucgaaaaggcuagcuucaucgaggugaaauccugccacuggccuaagagccacacccucugguccaugggcguacuagaaagcgagaugguaaucccaaagaacuucgcgggacccgugucccagcacaaccaccgacccgguaucccuacccagaccgccggccccuggcacuuagggaagcucgagauggauuucgacuucugcgagggcacgacuguggucgugacugaggacugugggaaucgcggcccaagccugcggacgagcacggccuccgguaaacugaucaccgaguggugcugccgcagcuguacucugccgccccuacgauaccguggagaggacgggugcugguacggcauggagauccggccccuaaaagagaaggaggagaaccucguauccagccuggucaccgccggccacgggcaaaucgacaacuucucccugggcauucucggcauggcccuuuuccuggaggagaugcucaggacgcggguggggaccaagcacgccauccugcugguggccguuuccuucgugacccucaucacagggaacauguccgggagggaccugggccgcgugauggucauggugggggccacgaugaccgaugauaucggcaugggcgugaccuaccuagcccuucuggcugcauucaagguccggcccaccuuugccgcuggacuucuccuccgcaagcugacguccaaggagcucaugaugaccacuauuggcaucgugcugcugucccagagcuccauucccgaaaccauccucgagcugacggacgcccuggcgcucggcaugaugguacuuaagaugguccguaacauggaaaaauaccagcuugccgugaccaucauggccauccucugcguccccaacgcugugauccugcaaaacgccuggaaggugucuuguaccauccuggcucucgucuccguuagcccacuguuccugacuuccucacagcagaaggccgacuggauuccccucgcccugacaaucaagggccugaaccccaccgcuaucuuucucaccacccugucccgcacgagcaaaaagcguuccuggccgcugaacgaagccaucauggcgguggggaugguaagcauucucgcuagcucccugcugaagaacgacauacccaugaccgggcccuuaguagccggcggacugcucacuguguguuauguguuaaccggacgcagcgccgaccuggagcuggagcgggcggccgacguuaaaugggaugaucaggccgagaucagcggaagcucccccauccucagcaucacgauuuccgaggacggcagcaugucuaucaagaacgaagaggaggagcagacacuuaccauacucauccgcaccgagcucuugguaaucagcggccuguucccgauauccauccccauuacggccgccgcaugguaucuaugggaggucaagaagcaacgcgccggggugcuuugggacgugccgagcccgccuccugugggaaaagccgagcucgaagacggugccuaccgcaucaagcagaagggcauucucggguacucgcaaaucggcgccggcguguacaaagaaggcaccuuccacaccauguggcacguaacccggggcgcgguccuaaugcauaagggcaagcgcauugaaccuagcugggccgacguaaagaaggaucuuaucuccuacggcggugguuggaagcucgagggggaguggaaggagggggaagaagugcagguccuggcccuggagcccggcaagaaccccagggcugugcagaccaagcccggccucuucaagacgaacacuggcaccaucggagccgugagcuuggacuucucccccggcacgagcggcuccccaaucgucgacaagaagggcaagguggugggccuguaugggaacggcgucgugacgcgcucaggcgcguaugugagcgcaaucgcacagaccgagaagagcaucgaggacaaucccgagaucgaggacgacaucuuucggcgcaagaagcugaccaucauggaccuccacccuggcgccggcaagacgaagcgguaucugcccgccaucguccgagaagcgaucaagagagguuugcgcacacucauccucgccccaacccgagucguggcggcugaaauggaggaggcgcugcgcggacuccccauucgcuaucaaacccccgccauccgggccgagcacaccgggcgcgagauaguggaccugaugugccacgccacguucaccaugcgacugcucucgcccaucagggugccgaauuacaaccugaucaucauggaugaggcccacuucaccgaccccgcguccaucgccgcucggggcuacaucuccacccgaguagagaugggcgaggccgccgggauuuucaugacggcgacgccuccuggcucccgggacccguucccccagagcaacgcccccaucauggacgaggaacgggaaaucccagagcggucauggaacagcggccacgaauggguaacggacuucaagggaaaaaccgugugguuugugccguccaucaagacggggaacgauaucgccgcaugccugaggaagaacggcaaaagggucauccaguugagccgaaagacguucgacuccgaauacgugaagaccagaaccaacgauugggacuucguggucacgacggacauuucagagaugggcgccaacuucaaggcugagcgcguuauagacccccgccgcugcaugaagcccgugauccugacggacggcgaggaaaggguaauucuagccggccccaugccggugacacacuccagcgccgcacagcgccgggggcgcaucggccgcaaucccaagaacgagaacgaccaauacauuuacaugggggagccccucgagaacgacgaggacugugcccacuggaaggaggccaagaugcuccuggacaacaucaauaccccggaaggcaucauccccuccauguucgagcccgagagagaaaaaguagacgcaauugacggcgaauaccgccuccgcggggaggcgcgcaaaaccuucguugaccugaugcggcguggcgaccuaccagucuggcucgccuaccgggggccggccgaaggcauuaacuacgccgaucgccgaugguguuucgacgggaucaagaacagccaguuccuggaggaaaauguggaaguggagaucuggcccuccggcggcgagaggaaggagcugaagccccgguggcuugacgccagaauuuacucagacccccuggcccugaaggaguucaaggaguucgccgcgggucggaagucccucacccuuaaucucaucacagagauggggcgucugccgacguucaugacccagaaggcccggaacgcccuggacaaucuggccgugcuccacaccgcggaggccggcgggcgggccuacaaccaugcccuaagcgaacugcccgagacccucgagacgcugcuacuccugacccuguuagccacugucacgggggggauuuuccuauuucugaugagcgggcgaggaaucggcaagaugacgcucggaaugugcuguaucauaaccgcguccauauugcugugguaugcccaaauccagccccacuggaucgccgccaguauaauccucgaguucuuccugaucgugcuacucaucccagaacccgaaaagcagcgcaccccccaggacaaccagcucaccuacgugaucaucgcaauccuuacggucguggcagccacgauggccaacgaaaugggcuuccuugagaaaaccaaaaaggaccugggacugggaaacauugugacacagcaacccgaaaguaacauccucgacaucgaccugcgucccgccagcgccuggacucuguacgcggccgccaccacuuucauaacuccgauguugcgccacucaaucgaaaacagcagugucaacaugagcuuaaccgccaucgccaaccaggcgacgguacuaauggggcucgggaagggguggccccuguccaagauggauaucggggugcccuugcucgcuaucggcuguuacagccaggucaaccccaucaccuuaacggccgcccuguuccuguugguggcccacuacgcgaucaagggcccgggacuacaggccaaggcuaccagggaggcccagaagagggcugccgccggcaucaugaagaaccccacgguagacgguaucaccgucaucgaccucgaccccaucccguacgacccgaaguucgagaagcagcucggccaagugauguuacucguacuuugcgucacacagguucugaugaugcgcacaacgugggcccugugugaggcacugacccuggcgaccgggccgguuuccacccucugggagggcaaccccggccgcuucuggaacacgacgaucgccgucagcauggccaacauauuccgcgggagcuaccuggccggcagcucgcagguguggcccagcauuaacaaucuuaagggcggacgucgggggacgggggcccagggcgagaccuugggggagaaguggaagcggcaacugaaccagcuguccaagagcgaauucaacacguauaagcgcuccgggaucauggaaguggaccgguccgaggcgaaagaggggcugaaacgcggcgagacgaccaagcacgcggucagccggggcaccgccaagcugcgcugguucguggagcggaaccuggugaaaccggaagggaagguaaucgaccuaggcugcgggcgcggcggguggucguacuauugcgcuggccugaaaaaggugacggaagugaaggguuauaccaagggcggccccggccacgaagaaccgaucccgauggccaccuacggcuggaaucuggucaagcuccacucgggcaaggacguguucuucacgccgcccgaaaagugcgauacgcuguugugugacaucggggaguccagccccaauccgaccguggaagcgggccggacccuacgcguccucaaccugguggagaacuggcucaacaacaacacccaguucugcaucaagguccugaaccccuacaugcccuccgucauagagaagauggagacgcugcaacggaaauacgggggcgcccuggugcgcaauccccucagcaggaacuccacgcacgagauguacugggucaguaacgccucugggaauaucguuagcuccgugaacaugaucagccguauguugauuaacagauucaccaugcggcacaagaaggccacauacgagccagacguggaccuggguucaggaacccgcaacaucggcaucgagagcgaaacgcccaaucucgacaucaucgggaaacgcaucgagaagaucaagcaggagcaugagaccuccuggcacuacgaccaggaccacccguacaaaaccugggcuuaccauggcagcuacgagaccaagcagacgggcuccgccagcucuauggucaacgggguaguucgucuguuaaccaagccaugggacgucgugccgaugguuacccagauggcaaugaccgacacgaccccguucggacagcagcgggucuucaaggagaagguggacacccgcacccaggagcccaaggagggcacgaagaagcucaugaagaucaccgccgaguggcuguggaaggagcuggguaagaagaagacaccucgcaugugcccgcgcgaggaguucaccaagaaaguucggagcaaugccgcgcucggcgccaucuucacggacgccacgaaguggaagucagcccgggaagccgucgaagacgggcgguucugggaacucguggacaaagagcguaacuuacaccucgagggcaaaugcgagaccugcguguacaacaugauggggaaacgggagaaaaagcugggcgaguucggcaaggcgaaagggucccgcgccauaugguacauguggcucggcgcgcgguuccucgaauuugaggcccugggguucuugaacgaagaccauugguucagccgcgaaaauucccucagcggcgucgagggggaaggccugcauaagcugggcuacauucuccgggaggugcgcaagaaggaagguggggccauguacgcggacgacuccgcggggugggacacccggauaacucuagaggaccugaaaaacgaagagcgcaucaccaaccacauggaggucgagcauaagaaguuggccgugggucacuuuauacuaacuuaccccaacaaggugguacguguacagcgacccacccccguggggacggucauggacaucaucagccgaaaaagucagcgcgguaguggccagguugggacguacgggcugaacaccuucacgaaccucgaagggccgcgcaucaggcagauggagggcgaggaguccuucaagagccaccagcugcaaacggcaacugagcguaacgcggugcaggacuggcuggcccggguaggccgcgagcgucuauccagaauggccauaagcggagacgacugcgugguaaagccacuggacgaucguuucgcucgagcccuaaccgcgcuuaaugacaugggcaagguccggaaggacauucagcagugggagccauccagaggguggaacgacuggacccaggugcccuucugcagucaccacuuccacgagcugaucaugaaagacgguagaacgcugguugucccgugccguaaccaggacgagcucaucggccgggcgcgcaucucccagggcgccggcuggucguuacgggagaccgccugccucgggaaguccuacgcccagauguggucacucauguacuuucaccggcgagaccuucgccuggcggcuaacgccauuugcuccgccgugccgucccacuggguacccaccucgcggaccacuugguccauucacgccucccacgaauggguugcgacagaggacaugcucacagucuggaacagaguuuggauccaggagaauccguggauggaggacaagacccccguagaguccugggaagagauaccguaccuggguaagcgugaggaccaauggugcggcucacuuaucggccuuacaucccgggcuacgugggccaagaacauccagaccgccaucaaccaaguccgcucucugaucgggaacgaggaguacaccgauuacaugcccuccaugaagagguuccgcagggaggaggaggaagcaggcgugcugugguga

SEQ ID NO: 24945 - RNA, 9876 nt, Artificial Sequence
  derived and/or modified CDS sequence (opt11) from DENV-2__GU131896__SS-prME
uccgcggggaugaucaucauguuaauacccacggugauggccuuccaccucaccacccggaauggggagccgcacaugaucgucggcauccaagagaaggggaagucccugcuauucaagaccgaggacggcgugaacaugugcacccucauggcgauggaccugggggagcuaugcgaggauacgaucaccuacaagugcccgcuccugcggcagaacgagcccgaggauaucgauugcuggugcaacagcaccuccaccugggugaccuacgguaccugcaccaccaccggcgagcaccguagagagaagcgcagugucgcccuugugccccacgugggcaugggccucgagacacggaccgagacauggauguccagcgagggggcuuggaagcacgcucaacgcaucgagaccuggauccuucggcaccccggcuucacgaucauggccgcaauccuggccuacaccaucgggaccacccacuuucagcgugcccuaaucuucauccugcuaacggccgucgcgcccuccaugaccaugcggugcaucggcauuagcaaucgcgacuuuguagagggcgugaguggggguucauggguagauaucgugcucgaacacgguuccugcgugaccacgauggcgaagaacaagcccacgcuggacuucgagcugaucaagaccgaggccaagcagcccgccacccuccggaaguacugcauugaagcaaagcucaccaacacgaccaccgagucucguugucccacccagggggagcccucccugaaggaggagcaggacaagcgguuugucugcaagcacaguauggucgaccgcggcugggggaacggcugcggccuguuugggaagggcgggaucgugacgugcgcgauguuuacauguaaaaagaauauggagggcaagauuguucagcccgagaaccuugaguacaccauaguugugacgccccacuccggggaggagcacgcugucggcaacgacacggguaaacacggcaaggagaucaagguaaccccgcagagcuccaucacugaggcugagcuuacaggguacggcaccguuacaauggagugcagcccccggaccggccuugauuucaacgagaugguccugcuucagauggagaauaaggccugguuagugcaccgccagugguuccuggaucuuccccuuccguggcugccuggggccgacaagcagggcuccaacuggauccagaaagagacccuggugacauuuaagaacccccacgcgaagaagcaggacguagugguccucgggucgcaagaaggcgcaaugcacacggcauuaaccggggccaccgagauccagaugagcuccgggaaccuccucuucaccggccaccugaagugccgguuacgcauggacaaauugcagcugaaggggaugagcuauuccaugugcacgggcaaguucaagguggugaaagagaucgccgagacucaacacgggaccaucgucauccggcugcaguacgagggugacggcagccccuguaagauccccuucgagaucauggaucucgaaaagcgcuacgugcuggggcgccugaucacugugaacccgauagucacugagaaggacucccccgugaacaucgaggcagagccgcccuuuggcgacagcuacaucaucauagggguggagcccggccaacucaagcugaacugguuuaagaagggcuccaguaucggccagauguucgagaccaccaugcgaggugcuaagcgcauggccauccugggggauaccgccugggacuucggcucucuugggggugucuucacgagcgucggaaaggcucuucaucagauauucggcgcuaucuacggcgcggccuucagcggggugaguuggaccaugaagauccugaucggggucauuauaaccuggaucgggaugaauucccggagcaccucacugagcgugucccucgugcuggucggcaucgugacgcuuuaccucggagugaugguccaggcggacucgggcugcguggucuccuggaagaauaaggaacugaagugcggcagcgggaucuucaucacugacaauguccacacguggaccgagcaguacaaguuccagcccgagagccccuccaaguuggcgagcgcgauccaaaaggcccaggaggagggaaucugcgguauccgcuccgugacgcggcucgagaaucugauguggaagcagaucacccccgagcugaaucacauccuggccgagaacgaggugaagcugaccauuaugaccggcgacaucaaggggaucaugcaggccggcaagcgaagccugaggccgcagcccacggaguuaaaguacuccuggaagaccuggggcaaggcuaaaaugcugagcaccgagucucacaaccagaccuuccugaucgaugggcccgagacagccgaaugcccgaacaccaaccgcgccuggaacucucucgaaguggaggacuacggcuucgggguguucaccaccaacaucuggcugaagcuuaaggagaagcaggaugccuucugcgauucgaagcuuaugagugccgccauuaaggacaaccgggcggugcacgcggacaugggcuauuggauagagagugcacugaacgacacguggaaaauagagaaagccagcuucaucgagguaaagaacugccacuggcccaagucccacacccuguggucuaauggcguguuggaguccgagaugaucauccccaagaaccuggcggggcccgugagucagcauaauuaccgcccgggcuaccauacccagaccgccgggcccuggcaucugggcaaacuugagauggacuucgacuucugcgacgggacuacggucaucgucaccgaggauugcggcaaucggggccccucccuucgcacgaccacggcaagcgggaagcugauuacagaguggugcugcagaagcuguacccucccccccuugcgcuaccggggcgaggacggguguugguacggcauggaaauccguccccugaaggagaaggaggagaaccucgucaacucccuggucaccgccgggcacggccagguggacaacuucagccugggcguauuagggauggcgcucuuccucgaggagaugcucaggacgcgcguuggcaccaagcaugcaauccugcugguggccguguccuucgucacccucaucacagggaacaugagcuucaaagaccugggccggguggucgucauggugggggccacgaugaccgacgauaucggcaugggugugaccuaccuggcgcuccuggcggccuucaagguccgccccaccuuugccgccggacugcuccuccggaaacugacguccaaggagcuuaugaugaccaccaucggcaucgugcugcugagccaguccaccauacccgagacgauccucgagcucaccgacgcccuugcccucgggaugauggugcugaaaaucgucagggacauggagaaguaucagcuggccgugaccaucauggccauccucugcgugcccaacgcggucauccugcagaacgcguggaaagugagcuguaccauccuggcugucguguccguuagcccccuccugcugacgucgagccagcagaagaccgacuggauuccccucgcccugaccaucaagggccugaaucccaccgccauuuuccucacgacuuuaucccgcaccaacaagaagaggucauggccgcuuaacgaggcaaucauggcggucggcaugguguccauccucgcuagcucguugcugaagaacgacauccccaugacaggcccucucgucgccggcggucugcugacggucugcuacguucucaccggccgcagcgccgacuuggaacuggagcgggcuaccgacgugaagugggaggaccaggcggagauuuccgggagcagcccgauccucagcaucacaauuucugaggacggcaguaugagcaucaagaacgaggaggaggagcagacacugaccauccugauccgaacuggacuccuggucauuuccgggcuguucccggugagcauccccaucaccgcagccgccugguacuugugggaggugaagaagcaacgugccggcgucuugugggacgugccgucaccgccgcccauggggaaggccgagcuggaggacggcgccuaucgcaucaagcaaaaggggauccucggcuacucgcagaucggcgccgggguguacaaagagggcacguuccacacgauguggcacgugacccgcggggccguacuuaugcacaagggcaagcgcaucgagcccuccugggcugaugugaagaaggaccuuaucagcuauggcggggguuggaagcucgagggggaguggaaggagggugaagaaguucaaguucuggcgcuggagcccgggaagaacccccgggcgguacagaccaagcccggccucuucaaaaccaacacggggaccaucggcgcugucucccuggacuucagccccgggaccuccgggagccccauuaucgacaagaagggaaagguuguggggcucuacggcaacggcguagucaccaggucaggggccuacgugagcgccauugcucagacggagaaguccaucgaggacaacccugagauagaggacgacaucuuccgcaagcgccggcugaccaucauggaccuccaccccggcgccgggaaaacuaagcgcuacuugcccgccaucguccgggaagccaucaaacgcggccugcgaaccuuaauccuggcgccgacucgcgugguggcggccgaaauggaggaggcauugagagggcuccccauacgcuaccagacucccgccauccgggcggagcacacgggccgcgaaaucgucgaccugaugugccaugccacauucacgaugcgcuuacucagcccugugcggguuccgaacuacaaccuaaucaucauggacgaggcccacuucaccgaucccgcaucaaucgccgcacgcggcuacaucagcacccgggucgagaugggagaggccgccggcaucuucaugaccgccacuccgcccgggagcagggacccguucccccaguccaacgccccaaucaucgacgaggagcgggagaucccggaacgcagcuggaacaguggacacgaaugggugaccgacuuuaaggggaagaccgugugguucguccccagcaucaaggcgggcaaugacaucgccgccugccugagaaagaauggcaagaaggugauccagcucucccgcaagaccuucgacucugaguaugugaagacgcggacuaacgacugggacuucgucgugaccaccgacaucuccgagaugggggcaaacuucaaggcggaccgagugauagacccccggaggugcaugaagcccgucauccugacggacggcgaggagcggguaauccuggcggggcccaugccagugacccacucuuccgccgcccagagacggggccgcaucgggcggaaucccaagaacgagaacgaccaguacaucuacaugggcgagccccucgagaacgacgaggauugcgcccacuggaaggaggcgaagaugcugcuugacaacaucaacaccccggagggcauuauuccgucaauguucgagccagaacgcgagaagguggacgccaucgauggggaguaccggcuccgcggcgaggcccgcaaaaccuuugucgaucugaugcggcgcggagaucugcccguguggcuggccuacaaggucgcagcggagggaaucaacuacgccgaccggcgcuggugcuucgacgggaucaagaauaaccagauccuggaagagaacguggaaguggagaucuggacaaaagagggcgagcggaagaagcugaaaccgcgguggcucgaugcccgcaucuacuccgacccccuggcacugaaggaguucaaggaguucgccgcgggccgcaagagccucacguuaaaccugauuaccgagauggggcggcuccccaccuucaugacucagaagacccgcgacgcgcuggacaaccuggccgugcuccacaccgcagaggcgggagggagagcauacaaccaugcccuguccgagcugccugagacacucgagacgcugcugcuccugacacuacucgccaccgugacuggaggcaucuuccuguuccugaugagcggucgcggcauugggaagaugaccuuaggcauguguugcauaaucacggcgaguauccugcugugguacgcgcagauccagccucacuggaucgccgcuuccaucauccuggaguucuuccugauaguccuacuaauucccgagcccgagaagcagcgcacaccccaggauaaccaacugacauacguggugaucgcaauccuuaccgucguggccgcgacgauggccaacgagaugggauuccucgagaaaacaaagaaggaccugggccugggcuccauugccacccagcaaccggagagcaacauccucgacaucgaccugcgccccgccuccgcuuggacacuguaugcgguggccacgaccuucguuaccccuaugcuccgccauagcaucgagaacagcuccgugaacgugagccugaccgccaucgcuaaccaggccacgguccugauggggcucggcaagggguggccgcuauccaagauggacaucggugugccgcuguuagcgaucgguugcuacagccaggugaaccccauuacccugaccgcagcgcuguuacuguuagucgcccacuacgcgaucauaggucccggucuacaggcgaaggccacccgggaggcacagaagcgggccgcagccggcaucaugaagaaucccacagucgacggcaucaccguaaucgaccuggauccuauccccuacgaccccaaguucgagaagcagcuggggcaggucaugcugcugauucugugcgugacucaagugcucaugaugcgcaccacaugggcccugugcgaggcucuuacccuugccaccggccccaucuccacccucugggaggggaacccgggcagauucuggaauacgaccaucgcggucagcauggccaacauuuucaggggcuccuaccuggccggugcuggccucuuauucuccaucaugaagaauacuaccaauacgcggcggggaaccgggaacaucggggagaccuugggggagaaguggaagagcagacucaacgcucugggcaaguccgaguuccagacguacaagaagucagggauccaggaaguggaucggacguuagcgaaggagggcaucaagcgaggggagaccgaccaccacgccgucucacguggcuccgccaagcucagaugguucguagagcggaacauggucacccccgagggcaagguggucgaccuugggugcggccgagggggcuggagcuauuacugcgggggcuuaaaaaaugugcgggaggugaagggccucacaaagggcgggcccgggcacgaggaaccaaucccgauguccacguacggcuggaaccucguccgccugcagagcggcguggacguguucuucaucccgccugagaagugugacacccuccugugugacauaggcgaguccucacccaacccgaccguugaggccggacgaacccugcgcgugcucaaccuaguggagaacuggcugaacaauaauacgcaguucugcaucaagguccugaaccccuacaugcccuccguaaucgagaagauggaggcacuccagcggaaguacgggggagcccuggugcgcaacccguuaagccggaacagcacucacgagauguacugggucuccaacgccagcgggaacaucguguccucagugaacaugaucagucgcaugcucauuaaccgguucaccaugcgccacaaaaaagccaccuaugagcccgacguugaccugggcucgggaacacggaauaucggcauugagucagagaucccuaaucuggacaucaucggcaagcgcaucgagaaaaucaagcaggagcacgagacaagcuggcauuaugaccaggaccaccccuauaagaccugggccuaccacggguccuacgaaaccaagcagacaggcagcgcguccucgauggugaacggggucguccggcuccugacaaagccgugggacgugcugcccacuguuacccagauggcuaugacggacacaacucccuucggccaacagcgcgucuucaaggagaagguggacacccgcacccaggagcccaaagagggaacgaaaaagcucaugaagaucaccgcggaguggcuguggaaggagcuggggaagaaaaagacuccgcggaugugcacccgcgaagaguucacgcguaaggugcgcuccaacgccgcccugggcgcuaucuuuaccgacgagaacaaguggaaauccgcccgggaggcggucgaagauagccgauuuugggaacugguggacaaggagcggaacuuacaccucgagggaaagugcgagaccugcguguacaacaugaugggcaagcgcgagaagaaauugggggaguuuggcaaggccaagggcagucgagccauaugguauauguggcugggggcucgguuccucgaauucgaggcgcugggcuuucugaacgaggaccacugguucucccgagagaauagcuuaucgggggucgagggggaggggcuacacaagcugggcuacauccuccgagacguaagcaagaaggagggaggggccauguacgccgacgauaccgcggguugggauacgcggaucacucuggaggaucuaaagaaugaggagauggucaccaaccacauggagggggagcacaagaagcucgccgaggccaucuucaagcucacuuaccaaaacaagguugugcgcguccagcggcccacgccccgcggcaccgugauggacaucaucagccggcgagaccagcggggauccggccaggugggcaccuacgggcugaacaccuuuacgaacauggaggcacagcucauccgccagauggagggcgagggagucuucaagaacauccagcaucugaccgccaccgaggaaguagcggugcagaacuggcuggcccgggugggccgagagcgccucagucggauggccauauccggcgacgacugcguggugaaaccccuggacgaccgcuucgccaacgcccuaaccgcgcugaaugauaugggcaagauccggaaggacauccagcagugggaaccgagcaagggcuggaacgacuggacgcaggucccauucuguucgcaucacuuccaugagcugaucaugaaggacgggcguguacuggucgucccaugucgcaaccaggacgagcucaucggccgcgcccggaucagccaaggggccggcuggucccugcgcgagaccgcaugccugggcaaaagcuacgcucagauguggucccucauguacuuccaccggcgcgaccugcggcucgcggccaacgccaucugcagcgccgugcccucccacugggugccgacgagccguaccaccugguccauccacgccaagcacgaguggaugacgaccgaggacaugcucaccgucuggaaccggguguggauccgcgagaacccuuggauggaagacaagacacccgucgagagcugggaggagauucccuaucuggggaagcgggaggaucaauggugcggcucccugaucggucucacgagccgcgcgacuugggccaagaacauccaagccgccaucaaccagguccggucucugaucggcaacgaggaauacaccgacuacaugccgagcaugaagagauuccggcgcgaggaggaggaggcgggggugcugugguga

SEQ ID NO: 24946 - RNA, 9876 nt, Artificial Sequence
  derived and/or modified CDS sequence (opt11) from DENV-2__GU131897__SS-prME
agcgcgggaaugauaaucauguugauccccaccgucauggccuuccaccucaccacgcgaaacggggagccccacaugaucguggguauccaagagaaggguaagucgcugcucuucaagaccgaggauggcguaaauauguguaccuuaauggcgauggaccugggggaguuaugcgaggacaccaucacauacaaguguccccuucuacggcagaacgagccagaagacauagauugcuggugcaauucaacuuccaccugggugaccuacgggaccuguaccacgacuggggaacaucgccgggagaagcguagcguggccuuagugccacauguggggauggggcuggagacgcggaccgagaccuggaugagcagcgagggcgccuggaaacacgcccagcgcauagagacuuggauccugcggcacccuggauucacgaucauggccgcgauauuagccuacaccaucgggaccacccacuuccagcgcguccucauauucauccugcuaacggccguggcucccucaaugaccaugcggugcaucggcaucucuaaucgggacuucguggagggcgucuccgggggcagcuggguggacaucguccuagagcacggaaguugcgugacgaccauggcaaagaacaagccgacgcuggauuucgaacugauaaagaccgaggccaagcaaccagccacgcuccgcaaguacugcaucgaggccaagcugaccaauacgacuaccgaaucucgcugccccacacagggagagcccucucugaaggaggagcaagacaagcgguucguuugcaagcacuccaugguggacagaggcugggggaacggcugcggccuguucgggaagggcggaauagucacgugugccauguuuacgugcaaaaaaaacauggagggcaagauuguacagccugaaaaccuggaguacaccaucguggucacgccccacuccggugaagagcacgcgguuggcaaugacaccgggaagcacggcauggagauuaaggugacuccgcagagcuccaucacagaggcggaguuaaccggguauggcaccgucacgauggagugcagcccgcggacaggccuagacuucaacgaaaugguguuacugcagauggagaacaaagccuggcucgugcaucgccagugguuucuugaccugccccuccccugguugccgggggccgacaagcaggagucaaacuggauucagaaggagacccuagucacuuuuaaaaacccccacgccaagaagcaagauguggucgugcucggaagccaggagggggcgaugcacacggcacuuaccggcgccaccgagauacagaugagcucuggcaacuugcuguuuaccggccaucugaagugccggcugcgcauggacaaguuacaguugaagggcaugucauacuccauguguacagggaaguucaagguggucaaagagauugccgaaacccagcacggcaccauagucauccgcgugcaguacgagggggacggcucgccuugcaagauccccuucgagauaauggaccuggaaaagagguacguccuaggccggcuaauaacuguaaacccaauugugacggagaaggacucccccgucaauauagaggccgaaccgcccuucggggacagcuacaucaucauuggcguggagccgggccagcugaaguugaacugguucaaaaagggcuccagcaucgggcagauguucgaaaccaccaugaggggcgccaagcgcauggccauccugggcgauacagcaugggacuucggcagucuuggcggaguguuuaccagcauaggcaaggcauuacaccaggucuucggggcgauauacggcgcggccuucuccggcgugagcuggaccaugaagauccugaucgggguuaucauaaccuggaucggcaugaacucccggagcaccucccugagcgucagucuggugcuuguagggaucgucacacuuuaucuugggguaauggugcaggcagauagcgggugcguuguguccuggaaaaacaaggaguugaaaugugggagcggaaucuucaucacggacaaugugcacaccuggacugaacaauacaaguuccagcccgagucgccguccaagcuggcaagcgcgauacagaaagcccaggaagaggggaucuguggcauucgcucggucacgcgguuggagaaccucauguggaagcagauuaccccugaauugaaccacauacucgcugagaacgaggugaagcucacgaucaugaccggggacaucaaggguauuaugcaagcagggaagcgcuccuuaagaccgcagccaacugaauuaaaguacucuuggaagaccuggggcaaggccaagaugcucuccaccgaauccuacaaccagaccuuccugaucgauggccccgagacggcggaguguccgaacaccaaccgcgcguggaacucccuggaagucgaggacuacggguucggaguauucaccaccaacaucuggcucaaauugaaggaaaagcaggaugcauucugcgacuccaagcugaugagcgccgccaucaaggacaaccgggccguucacgcugacaugggauacuggaucgaguccgcccuaaacgacacguggaagaucgagaaagcaaguuucaucgaggucaagaacugccacuggcccaagucccacacccucuggaguaaugggguccuggaaagcgagaugaucaucccuaagaaccuagcaggccccguuagccagcacaacuaccgucccggguaccacacgcaaauagcgggacccuggcaccugggcaaacuggagauggacuucgacuucugcgaugguaccaccgugaucgucacggaggauugcgggaaccggggacccucucuccgcacgacuaccgccucaggaaagcugaucacugaguggugcugccggagcugcacauuaccgccguugcgcuaccgcggggaggacgguuguugguauggaauggagauccguccacuuaaggagaaggaggagaaucuaauaaacaguuuggucaccgccggccacggucagguggacaacuucucucugggcguucugggcauggcccucuuccuggaggagaugcugcggacccgcguggggacuaagcacgcgauccuccugguggccgugagcuucgucacccugauuaccggcaacaugagcuucaaagaucucgggcggguggucgugaugguuggcgccaccauggcagacgauaucgggaugggcgucacauaccuggcgcuguuagccgcguucaaggugcgccccaccuucgccgcuggccugcuguugaggaaacugacauccaaggagcugaugaugaccacaaucgggaucgugcucuugagccagucuaccaucccagaaacaguccuagaguugaccgaugcccuagcccugggaaugaugguacucaagaucgugcggaacauggagaaguaccagcuggccgucacgaucauggccauacugugugugccgaacgccguaauccuccagaacgccuggaaggugucuuguaccauucuggcgguggucucggucucaccucugcuccugaccuccagccaacagaagaccgacuggaucccacucgcccucacuaucaaggggcugaauccgacggcuaucuuucugacuacccugucccgaacgaacaagaagcgaagcuggccgcugaacgaagcuauaauggcggugggcauggucuccauccuggcaagcagucuccugaagaacgacauccccaugaccgguccccuuguggccggaggccuccugaccgugugcuacguucucaccgggcgcagcgccgaucuugaacuggagagagccacugacguaaagugggaggaccaggcggagauaucgggcucaucgccuauccugaguaucacgaucuccgaggacgggagcaugaguaucaaaaacgaggaggaagagcagacguuaaccauuuugauucgcacgggccugcucgugaucuccggacucuucccgauaagcauccccaucaccgcugccgccugguacuugugggaggucaagaagcaacgcgcugggguucucugggacgugccuagcccgccccccauggguaaggcggagcuggaggauggggccuaucggauuaagcagaagggcauccugggauacucccaaauuggggccggcguguacaaggagggaaccuuccacacaauguggcacguaacgagaggcgcuguucucaugcacaaggggaagcguaucgaaccuuccugggcagacguaaagaaagaucugaucagcuacggcgguggcuggaaguuagagggcgaguggaaagagggagaggagguccagguacucgcgcuggaacccggcaaaaacccccgggcgguccagacuaagcccgggcuguucaagacgaacaccggcaccauuggugccgugucacucgauuucucaccaggcacaucuggcucucccaucauagacaagaagggaaaggugguaggcuuguacgggaacggaguagucacccgcuccggggccuacgucagcgccauagcgcagacugaaaagucgaucgaggacaaucccgaaaucgaggacgacaucuuccgaaagcgacggcugacaaucauggaucugcauccaggggccggcaagacgaaacgcuaccuccccgcgaucgugcgggaggccaucaaacgcgggcuucggacgcugauacucgccccgacccgaguggucgcagcagaaauggaggaggcgcugcggggccugcccauacgauaucagacucccgccauacgggcugagcacacggguagggagauuguggaccucaugugccaugccaccuucaccaugcgcuugcucucccccgugcggguccccaacuacaaccugaucaucauggacgaggcccacuuuaccgacccagccuccaucgccgcgcgaggcuacaucagcacgcggguggagaugggcgaagcagccgggaucuucaugaccgccacgccgccaggcagccgcgacccuuucccccagucuaacgcccccauaaucgaugaggagcgugagauccccgaacgcagcuggaacuccgggcaugagugggugauggauuucaaggguaaaaccgugugguucguuccgagcaucaaggcgggaaacgacauugcggcgugccugcggaagaauggcaagaaggugauccagcugucccgcaaaacguucgacuccgaguauguaaagacacggaccaacgacugggacuucguuguaaccacugacaucuccgagaugggcgcaaacuuuaaagcugagagaguuauugacccccggcgcugcaugaagccaguaaucuugacugacggggaggagcgagugauccuggccggccccaugccggucacucacucguccgccgcccaaagacgggggcgcauuggccggaacccuaagaacgagaacgaccaguacaucuauaugggggagccccuggagaacgacgaggacugcgcccacuggaaggaggcgaagaugcuccuggacaacaucaacacccccgagggcaucaucccgagcauguuugagcccgagcgcgaaaaaguggacgccauagacggcgaauaccggcugcggggagaggcccgcaaaacguuuguggaccucaugagacgcggugaucugcccgucugguuggcguacaagguggcagcggaggggauuaacuacgcugaccguagauggugcuucgacgguaucaagaacaaucagauacucgaggagaacguggaagucgaaaucuggaccaaggaaggggagcggaaaaaacugaagcccagguggcuggacgcccggaucuacuccgacccucucgcucucaaggaguucaaggaguucgcugccggccgcaagagccugacccucaaccugaucaccgagaugggcaggcuacccacuuucaugacccagaagacccgcgacgcccucgauaaccuggcaguacugcacaccgcagaggcggggggcagagccuacaaucacgcgcuauccgagcugcccgagacacuggagacgcucuugcuacucacucuguuagcaacagucaccggcgguaucuuucucuuccugaugucagggcgagggauugggaagaugacccuagggauguguugcaucaucacggccuccaucuugcugugguacgcgcagauacagccgcacuggaucgcugccucgaucauccuggaguucuucuugauugugcuccugauucccgaacccgagaagcagagaaccccccaagauaaccagcucaccuaugugguaaucgcuauucugaccguagucgccgccaccauggcaaacgagaugggcuucuuggagaagaccaagaaggaccucggucucggcucgaucgccacccagcagccggagaguaacaucuuagacaucgaccuuaggccugccuccgccuggacgcuguacgcggucgcgaccaccuucgucacgcccaugcugagacauagcaucgagaacagcucggugaaugucucucugacugcuaucgccaaccaagccacuguccuuaugggauuaggaaagggcuggccccucuccaagauggauaucggggugccgcugcuggcgauaggcugcuacucccaaguuaaccccaucacccucacugccgcccuccuucugcugguggcccacuacgcgauuaucgggccuggccuucaggccaaagccacgcgcgaggcucaaaagagggccgcggccggcauuaugaagaaccccacaguggacgggauaaccguuaucgaccucgauccgauucccuacgaccccaaguuugaaaagcagcugggccaggucaugcuguugauccugugcgugacccagguccuaaugaugcgcacgaccugggcacucugcgaggcgcugaccuuagcuacaggccccaucucaacguugugggagggcaacccggggcgguucuggaacaccaccaucgcggugucgauggccaauaucuuccguggcucguaccuggcgggugccggccuccuauuuagcaucaugaagaacacgacgaacacccggagagggaccgggaacaucggggaaacucugggcgagaaguggaagucccgccuuaacgcacucgguaaauccgaguuccagauauacaagaaauccgggauccaggaggucgaccggacgcuggcgaaggaggggaucaagcguggcgagaccgaccaccaugccgucagccggggcucugcuaaacugagaugguuuguggaacggaacauggugacccccgagggcaaaguuguggaccucggguguggaagaggcggguggagcuacuacugcgggggucugaagaacgugagggaggucaaggggcuaaccaagggcggcccgggccacgaagagcccauaccgauguccaccuauggguggaaccucgugcgucugcagucuggggucgacgucuucuucaucccaccagagaagugcgacacccugcucugcgauaucggggaaaguucucccaacccgaccguggaagcaggucggacccugagagugcugaacuuagucgagaacuggcugaacaacaacacacaguuuuguaucaagguacugaaccccuacaugccuagugugauagagaaaauggaggcgcugcagcggaaguacggcggggcccucguucgcaacccgcugagccggaacagcacccaugagauguauugggugucgaacgcuagcggcaacaucguuuccagcgucaacaugauaucccgcaugcugaucaaccgguuuaccaugcgucacaaaaaggccaccuacgagcccgacguggaccuugggucuggcacccguaacaucgggaucgaguccgagauccccaaccuagacaucauuggcaagaggaucgagaaaaucaaggaggagcacgagacgucauggcauuacgaccaggaccacccuuacaagaccugggccuaccacggcuccuacgagaccaagcaaaccgggagcgcguccucuauggucaauggcguggugaggcuguugacgaaaccgugggacguguuacccaccgucacgcagauggccaugaccgacacgaccccauucgggcagcagcgaguguucaaggagaagguagacacacgaacccaggaacccaaggaaggcacaaagaagcuaaugaagauaacugcggaguggcucuggaaggagcuuggcaagaagaagacgccgcgcaugugcaccagggaagaguucacgcgcaaggucagaucaaaugccgcccuaggggcaauauuuacggacgagaauaaguggaaguccgcgcgggaagcggucgaggacuccagguuuugggagcugguggauaaggaaagaaaccugcaccuggagggcaagugugagacaugcguguacaauaugauggggaagcgcgagaagaagcucggcgaauucggcaaggccaaggggucucgggccaucugguacauguggcugggugcccgcuuccuagaguucgaggcccucgguuuccuaaacgaggaucacugguucucccgggagaacagccugucaggaguugagggggagggccuccacaaacuuggguacauccugcgcgacgucucgaagaaggagggcggcgccauguacgccgaugacacugcggggugggacacgcggaucacccucgaggaccuuaagaacgaggagauggugacaaaucacauggaaggagagcacaaaaaacuggccgaggccaucuucaaauugaccuaccagaauaaggugguccgcguucagcgcccaacaccacgcgggaccguaauggacaucaucagucggcgcgaccaacgcggcucgggacaagucgggacuuacggccugaacacguucacgaauauggaggcccagcugauacgacagauggagggggagggcguuuuuaagaacauccaacaccucaccgugaccgaggaagccgcgguucagaacugguuagcccggguggggcgcgagcgcuuaagccguauggccaucuccggcgaugacugcguggugaagccccucgacgaccgcuuugccaacgcacugacggcgcugaacgacaugggaaaaaucaggaaggauauccagcaaugggagccgagcaaaggcuggaacgacuggacgcagguccccuuuugcucccaccacuuccaugaguugaucaugaaggacggacgcguguuagucguccccugcaggaaucaggacgaacucaucggccgcgcaagaauaucucagggugccggauggucccucagagagacugccugccugggcaagagcuacgcucagauguggucccugauguauuuccaccgccgggaccuccgccuggcggcgaacgccaucugcagcgcggugcccucccacuggguacccacaagccgcacaacgugguccauccaugcgaaacacgaauggaugaccacugaggacaugcucaccgucuggaaccggguuuggauccgagagaaccccuggauggaggacaagacccccgucgaaagcugggaggagaucccauaucucggcaagcgggaggaccaguggugcgggucccugaucgggcugaccuccagagcgaccugggccaagaacauccaggcugcaaucaaccagguuaggucccuuauuggcaacgaggaauacacagacuacaugcccuccaugaagcgcuuccggagagaggaggaggaggcgggagugcuaugguga

SEQ ID NO: 24947 - RNA, 9876 nt, Artificial Sequence
  derived and/or modified CDS sequence (opt11) from DENV-2__GQ868631__SS-prME
ucggcugggaugaucaucauguuaauccccacgguaauggccuuccaccuaaccacccgaaacggggaaccccacaugaucguaggcauccaggaaaaaggcaaaucucugcucuuuaaaaccgaggauggcguuaacaugugcacccucauggcgauggaccugggggagcugugcgaggacacgaucaccuacaagugcccccuccugcggcagaaugagcccgaggauauugacugcugguguaacuccaccuccaccuggguuaccuacgggacgugcaccaccaagggcgagcaccgccgggagaagcgcaguguagcccucgugccccacgucgggaugggccuagagacccggacggagacauggauguccucagagggggccuggaagcacgcccaacgcaucgaaaccuggauccugcgacaccccggcuucaccaucauggccgcgauccuggcguacacgaucgggaccacccauuuccaacgcguccucaucuucauccugcugaccgccguggcccccucgaugacgaugcggugcaucggcaucagcaaccgcgauuucguggagggcgugucggguggcaguuggguggacauaguucucgagcauggguccugcgugaccacgauggcgaaaaacaagccuacgcuggacuucgagcucaucaagacggaggccaaacaacccgcuacccuccgaaaguauugcaucgaagccaagcugaccaacacaacaaccgagucccgaugccccacccagggcgagcccucccuaaaggaggagcaagacaagcgguucgugugcaagcacagcaugguggaucgcggcugggggaacggcugugggcuguucgguaagggcgggauugugacgugcgccauguucacgugcaagaaaaauauggaggggaagaucguccagccggaaaaccuggaguacaccaucguggugacaccccauuccggggaggagcacgcggugggcaaugacacugggaagcacgggauggagaucaaggugacgccgcagagcuccaucacugaggccgaauugaccggguacggcaccguuaccauggagugcaguccccggacgggccucgacuucaacgagauggugcuguuacagauggagaacaaggcuuggcuggugcacaggcagugguuccuggaucugccgcuccccuggcuuccgggggccgacaagcaggagucuaacuggauccaaaaagagaccuuagucaccuucaagaacccccacgcgaagaagcaagacgugguagugcuggggagccaggaaggggcgaugcauaccgcucugacaggggccaccgagauccagaugaguuccgguaacuugcuguucaccggacaccugaagugccgucugcgcauggacaaacuccagcugaagggcaugagcuacuccauguguacagggaaguucaagguggucaaggagaucgcugagacgcagcauggcacuaucgugauccgggugcaguacgagggggauggcagcccgugcaaaauccccuucgagaucauggaucuggaaaagagauacgucuuaggccggcucaucaccgugaacccgaucgugaccgagaaggacucacccgucaauaucgaggcugagcccccguucggggacucauacauuauaaucggcguugagccagggcaacugaaacugaacugguucaagaaggguucaucaaucgggcagauguucgagacgaccaugcgcggcgccaagcgcauggccauccugggcgacacagcgugggacuuuggguccuuaggcggcguguucaccagcaucgggaaggcacuacaccaggucuucggggccaucuacggcguggcguucuccggagucagcuggacuaugaagauccugaucggggucaucaucaccuggaucggcaugaacuccagaaguaccuccuugagcgucucccuugugcucgucggcaucgugacccuguacuuaggcgugaugguccaggcagacagcgggugcguggugagcuggaagaacaaggagcuuaagugcgguuccgguaucuucaucaccgacaacguucacaccuggaccgagcaauacaaguuccagccagagucccccaguaagcuggccagugccauacagaaggcgcaggaggaggguauauguggcaucagguccgugacccggcuggagaaccucauguggaagcagaucacgcccgagcugaaccacauccuggccgagaaugagguuaagcucacaauaaugacuggggauaucaagggcaucaugcaggcggggaagcggagccugcggccgcagccgaccgagcuuaaauacuccuggaagacguggggcaaggccaaaaugcucuccacggaguccuacaaccagaccuucuuaaucgauggccccgagacggccgagugccccaacacgaaccgcgcauggaacagccuggaaguugaggacuacggguucggcguguuuacuacuaacauauggcucaagcugaaggagaagcaggacgccuucugcgacuccaagcugaugagcgccgcgaucaaggauaaccgagcagugcacgcggacaugggauacuggaucgagagcgcgcucaacgacaccuggaagauugagaaggccuccuucaucgagguuaagaauugccacuggcccaaaucccacacucuguggagcaacggggugcuugaaucugaaaugaucaucccgaagaaccucgcagggcccgucucgcagcacaauuacagaccgggguaccauacccagaucgccggccccuggcaccuggggaagcucgaaauggacuucgacuuuugcgauggcaccacagucauugugacggaggacugcgggaaccggggucccucgcugcgcacgaccaccgcgucgggcaaacuuaucacugaguggugcuguaggagcugcacgcugcccccgcucagauaccguggcgaagacgguugcugguaugggauggagauacgcccccugaaggagaaggaggagaaccuggugaacagccucgugaccgccggucacggacagguggauaacuucagccugggcguucugggcauggcucucuuccuggaggaaaugcuuaggacucgggucgggaccaagcacgcaauucugcuuguggcggucagcuuuguuacgcuaaucacaggcaacaugucauucaaagaccucgggcggguggucgucauggugggcgccaccauggccgacgauaucgggaugggcgugaccuaccuggcccuuuuagcagcguucaagguccgccccacguucgccgccggccugcuccuccggaagcugaccuccaaagaacugaugauggccacuaucgggaucguacuccugagccaguccacuauuccagaaacaguucuggagcucaccgaugcccuggcgcugggcaugauggcccucaaaauaguuagaaacauggagaaauaccagcuggcaguaaccaucauggccauucugugcgucccuaacgccguuauacuccaaaacgcguggaaggugucaugcaccauucucgccgucguguccgugagcccccuguugcugacguccagccagcagaagaccgauuggaucccacuggcacucaccaucaaggggcugaaccccaccgcaaucuuccugaccacccucucccgcacuaacaagaagcggagcuggccccugaacgaggcgaucauggcagucggcauggugucuauacuggccagcucccuccugaaaaacgauauacccaugacaggcccccuaguggccggagggcuccucacggucugcuacgugcugaccgggcgcagcgcagaccucgagcuggagcgggcgacugacgugaaaugggaggaucaagcggaaaucuccggcagcagccccauccuguccaucacaaucucagaggauggguccaugagcauuaagaacgaggaggaggaacaaacgcucaccauccugauccgcaccggacuguuagucaucucgggccucuucccgaucagcauccccaucacggcagccgccugguaccugugggaggucaagaaacagcgggcggggguccuuugggauguccccaguccaccacccaugggcaaagccgagcuggaggacggugccuaccgcaucaagcagaagggcaucuugggguacagccagaucggugccggcguguacaaggaggggacguuccacaccauguggcacgugacccgcggcgccguccucaugcacaaggguaagcgcauugaacccuccugggcagacgugaagaaagaccugaucucuuacggugggggcuggaagcuggagggcgaauggaaggagggggaggaggugcagguccucgcacuggagcccggcaaaaauccccgagcagugcaaaccaagcccgggcuguuuaagacgaacaccgguacuaucggcgccgugagccucgauuucagccccggcaccucuggcucccccaucaucgacaagaaggguaaggucgugggucuauauggcaauggugugguaacccgcuccggggccuauguaagcgcgauagcccaaacggagaaguccaucgaagacaaucccgagauagaggaugacaucuuccggaagcgccggcugaccaucauggacuuacaccccggggccggcaagacuaagcgcuaccuccccgccaucgugcgggaggcgaucaagcgcggacuaaggacccugauccucgccccgacgaggguuguagcugcagagauggaggaggcccuccggggcuugcccauacgcuaccagacccccgcuauccgagccgagcacaccggacgcgagaucguugaccugaugugccacgccaccuucacgaugcgccugcugagccccguucgggugcccaacuacaaucucaucaucauggacgaggcccacuuuacugaucccgccuccauagcggcccgcggcuacauuuccaccagaguagagaugggcgaggcggccgggaucuuuaugacugccacgccaccuggcagccgcgaccccuucccccagucuaacgcgcccaucaucgacgaggagcgggagauucccgagcgcagcuggaacuccgggcacgagugggucacagacuucaagggcaagaccguuugguucgugccgagcauuaaggccgggaacgauauugccgcgugccugcggaagaacggcaagaagguuauccagcuaucccgcaagaccuucgacagcgaguacgugaagacccggaccaacgacugggacuucguggucaccaccgacauuuccgaaaugggcgccaacuucaaagcggagcgagugauugacccccggcggugcaugaagcccgugauccucacggacggugaagaacgagugauccuggcaggcccuaugccggugacccacuccuccgccgcccagcgccgcgggcgcaucggcagaaaccccaaaaacgagaacgaucaguauaucuacaugggugagccccuagagaacgacgaggacugcgcgcacuggaaggaggcuaagaugcucuuagacaauaucaacacuccggaaggaauaaucccuagcauguucgagccagagagagagaaaguggacgcaauagacggcgaguaccggcugcgcggggaggcacgcaagaccuucguagaccucaugagaagaggggaccugcccguguggcuggccuacaaaguggcggcugaggggaucaacuacgccgaccgacgcuggugcuuugacgggaucaaaaacaaccagauccucgaggagaacguggaaguggagaucuggacgaaggagggggagagaaagaaauugaagccacgcuggcuggaugcucguaucuauuccgacccucucgcacugaaagaguucaaagaguucgcggccggucgcaagucuuugacccucaaccugaucaccgagaugggccggcugcccacguucaugacgcagaagacccgggacgcccucgacaaccuggccguccuccacaccgcggaggccggagggcgggccuacaaccacgcccucucagagcugcccgagacccuggagacgcuccugcugcugacccugcuggcgaccguuacugggggcaucuuccucuuccugaugaguggccgggguaucggcaagaugacgcuugguaugugcugcauaaucaccgcguccauucuccugugguaugcccagauccagccccacuggaucgcugccucgaucauccuggaguucuuccucaucgugcugcugauucccgagccugagaagcagcggacgccccaggacaaccaacucaccuacgucguaauugccauccuuaccgucgucgcggccacgauggccaacgagauggguuuccuggagaagaccaaaaaggaucucggccugggcuccaucgcgacccagcagccggagagcaacauccuggacaucgacuuacgacccgccuccgcguggacccuguacgccguggccacgaccuucguaacccccauguuaaggcauagcauagaaaacagcucuguuaacguuagucuaaccgcgaucgccaaccaggcgacgguacugaugggccuggggaagggauggcccuuguccaaaauggacaucgggguaccgcuucuagccauaggcugcuacagccagguaaacccuaucacccuaaccgccgcuuugcugcuccugguggcgcacuacgccaucauugggccaggccugcaggccaaggccaccagagaagcccaaaagcgggcggcugccggcaucaugaagaaccccacggucgacgggauaaccgucaucgauuuggacccgauccccuacgaccccaaguucgagaagcagcuggggcaagugaugcugcucauacuaugcgucacccagguucuuaugaugcgcaccacaugggcccucugugaggcccugacccuggcgacggggcccaucuccaccuuaugggaagggaacccggggcgguuuuggaacacaacgauugcugugagcauggccaacauauuccgcggauccuaccuggccggcgccgggcuccucuucagcauuaugaagaacacgaccaacacgcgucgcggcaccgggaacaucggcgagacgcugggcgagaaguggaagucccgccugaacgcucucgggaaguccgaguuccagaucuacaagaaguccggcauacaggagguagaccgaacccuugccaaggaggggaucaaacgcggcgagacggaccaccacgccgugagccggggguccgccaagcuccgcugguucguugaacguaacauggucacuccugaaggcaaagugguggaucucggauguggucgcggcggcuggagcuacuacugcggcggacucaagaacguccgggaggugaaagggcugacgaagggagggcccggccacgaggagcccaucccgauguccaccuacggguggaaucucgugcgcuugcagaguggcguagacguguucuucaucccgccugagaagugcgauacgcuacucugcgacaucggagagaguucccccaaccccaccguggaggcuggacggacauuacgcguccuaaaccugguggagaacuggcucaauaacaacacccaguuuuguaucaagguacugaaccccuacaugccuucggucaucgagaagauggaggcuaugcagcguaaguacggcggggcccuggugcgcaacccgcucagcaggaauagcacgcacgagauguacugggugucaaacgcgagcgggaauaucgucaguucugugaacaugaucucccgcaugcucaucaaccgguucacgaugagacacaagaaggcgacauacgagcccgacguugaucuggggagcggcacccggaacaucgggaucgaguccgagauccccaaucucgacaucauuggcaaacgcaucgaaaagauaaaagaggagcacgagaccucguggcacuacgaucaggaucaucccuacaagacgugggcguaccacggcaguuacgagaccaagcaaaccggguccgcuuccagcauggugaacggcguggugcggcuucugacaaagccgugggacgucuugcccacggugacccaaauggcuaugaccgacaccaccccuuucgggcagcagcgcgucuuuaaagagaaggucgauacgcgcacccaagagcccaaagagggcaccaagaaguuaaugaagauuacggcugaauggcuguggaaggagcucggcaagaagaagaccccgcggaugugcaccagggaggaguucacccggaaggugcgcucuaaugccgcccuuggcgccaucuuuacggaugagaacaaauggaaguccgcccgggaggccguggaggacagcagguucugggaacucguugacaaggaacggaacuugcaccuggaaggcaagugugagaccugcguguacaacaugauggggaagagagagaagaagcugggugaguucgggaaggccaaggguagccgggccauuugguacauguggcucggggcccgcuucuuagaguucgaggcacuuggguuccugaacgaggaccacugguucucgcgggagaacucgcuguccggcguugagggggagggccuacauaagcucggauacaucuuacgcgacguuagcaaaaaggagggcggcgccauguacgcggacgacaccgccgggugggacacccguaucacgcuggaggaucuaaagaacgaggagauggugaccaaccacauggagggagagcauaagaagcuggcagaggcaaucuuuaagcugaccuaucagaauaagguagugcgcgugcagagaccuacaccucgggggacggucauggacaucaucucucggagagaccagcggggcuccgggcaggucggcaccuacgguuuaaacaccuuuaccaacauggaggcccagcugauccgccagauggagggggagggcguguucaagaacauccagcaccuaacagucaccgaggaagcggccgugcaaaacuggcuagcccgggugggucgagaacggcugucucggauggccauauccggcgaugacugugucgucaagccucuagacgaucgcuucgccaacgcgcucaccgcacuuaacgacaugggcaagauccggaaggacauccaacagugggagccgucgaagggguggaaugacuggacccaggugccuuucugcucccaucacuuccaugagcugauaaugaaggacggccgcgucuuaguggugcccugccggaaccaagacgagcugaucgggcgcgccagaaucagccagggcgcgggguggucccuacgcgagaccgccugccucggcaagaguuacgcgcaaauguggucccucauguacuuccaccguagagaccugcggcuugcugcgaacgccauaugcagcgccguucccucucacuggguaccgaccagccgaaccaccugguccauccacgcgaagcacgaguggaugacgaccgaggacaugcugacgguguggaaccgggucuggauccgcgagaacccguggauggaggacaagacccccgucgagagcugggaggagauccccuaucugggcaaacgggaggaccaguggugcgggucccucaucggccugaccagccgagccacgugggccaaaaauauacaggcugcgaucaaccaggugcggucccucaucgggaacgaggaguacacugacuacaugccgagcaugaagcgcuuccggcgugaggaggaagaggccggcgucuuaugguga

SEQ ID NO: 24948 - RNA, 9876 nt, Artificial Sequence
  derived and/or modified CDS sequence (opt11) from DENV-2__GU131899__SS-prME
agcgcgggcaugaucaucaugcuaauccccaccgugauggccuuccaccucaccacccggaacggggagccccacaugaucgucggcauccaggagaaggggaagucgcugcuguucaagaccgaggacggcgugaacaugugcacccucauggcaauggaccugggggagcugugcgaggacaccauaaccuauaagugcccccuccuacggcagaacgaacccgaggacaucgauugcuggugcaacagcaccagcaccugggugacauacgggaccuguaccaccaccggcgagcaccgccgggagaagcgcucugucgcacugguuccccacguggggaugggccucgagacccggacagagaccuggauguccagcgagggggccuggaagcacgcccagcgcaucgagaccuggauccugcggcacccgggcuuuaccauaauggcugcgauccuggccuacaccaucgggaccacccacuuucagcgcgugcucauuuuuauccugcucacggccgucgcucccuccaugaccaugcggugcauaggcauuagcaaccgcgacuucguggagggagucuccgggggcagcugggucgacaucgugcucgagcauggguccugcguaacgaccauggcgaagaacaaacccacgcuagacuuugagcuuaucaagaccgaggccaagcagcccgcgacccuccggaaguacugcaucgaggccaagcugacgaacacgaccacugagagccggugccccacucagggagaacccagccugaaagaggagcaggauaagcgguucguuugcaagcauagcaugguggaccgcggcugggggaacggcugcggccuguucgggaagggugggaucgugacgugcgccauguucacgugcaagaagaauauggagggcaaaaucgugcagcccgagaaccuggaguacaccaucguggugacaccccacagcggggaggagcacgcgguggguaacgacaccgggaagcacggcaaggagauaaaagugaccccgcagaguuccaucaccgaggcggagcuaaccggguauggcacagucacgauggagugcagcccccggaccggccucgauuucaacgaaauggugcugcugcagauggaaaacaaggccuggcucgugcaccgucagugguuccuggaccugccccuccccuggcugcccggggccgacaagcaggaguccaacuggauccagaaggaaacccuggucacguucaagaacccgcacgccaagaagcaggacguggucgugcucggcagccaggagggggcuaugcacacggcccugaccggcgccaccgagauccagaugagcucagggaacuuauuguuuaccggccaccugaagugccggcugcgcauggacaagcuucaguugaagggcaugucguacuccauguguacggggaaguucaaagugguuaaggagaucgccgaaacccaacacggaacaaucgugauccgggugcaguaugagggggacggcucucccugcaagauuccauucgaaaucauggaccuggagaagcgcuacguccucggccggcugaucaccgugaauccgaucgugacggaaaaagacuccccagucaacaucgaggccgagccgcccuucggggacagcuacaucauuaucggcguugagccggggcagcugaagcucaacugguuuaagaaaggcuccagcaucggacagauguucgaaaccacaaugcgcggagcuaagcgcauggccauccuaggcgacaccgccugggacuucgggucccugggcggaguguucacgagcauaggcaaggcccuccaccagguguucggggccaucuauggcgcggccuucaguggcgugagcuggaccaugaagauccugauaggcgugaucaucaccuggauuggcaugaacucccggagcaccucccugagcgugucacugguacucgugggcaucgucacgcuguaccucggagucauggugcaggccgacagcggcuguguaguguccuggaagaacaaggagcucaagugcgggucagggaucuucaucaccgauaacguucacaccuggacggagcaguacaaguuccaacccgagucccccuccaaauuggcgagcgcgauccagaaggcccaggaagaggggaucugcggcauccgcagcgucacgcggcuggagaaccuaauguggaaacagaucacccccgagcugaaccacauccuggccgagaacgaggugaagcucacaauuaugaccggggacaucaagggcaucaugcaggcggguaagcgcagucugcggccgcagcccacggagcugaaguacuccuggaagaccuggggcaaagcuaagaugcuuagcaccgaauccuacaaccaaaccuuccugaucgaugggccugagacggccgagugcccgaauacuaaccgcgccuggaacucgcuggagguggaggacuacggguucggcgucuucacgaccaacauauggcucaaguugaaggagaagcaagacgccuuuugugacuccaagcugaugagcgccgccauuaaggacaacagagcggugcacgcugacaugggguacuggauagaguccgcccucaaugacaccuggaagauagagaaggccagcuucauagaagugaagaauugccacuggcccaagucccacacccuauggagcaacggcguccuggaguccgaaaugaucauccccaagaacuuggccggaccggugagccagcacaacuaccgaccugguuaccacacccaaaucgcgggccccuggcaucuuggaaagcuggagauggacuucgacuucugcgacggcaccaccgugaucgucacggaggacugcgggaaccggggccccucccuucguaccaccaccgccucaggcaagcugaucacggaguggugcugccggagcugcaccuugcccccacugcgcuaccgcggagaggacggcugcugguacgggauggagauccgcccccugaaagagaaggaggaaaauuuggugaacucccucgugaccgcuggccacggccaggucgacaacuucagccuaggcguacuggggauggcccucuuccuggaagagaugcugcggacccgcguggggaccaagcacgcgauccuccugguggccguuucauucgugacccugaucaccggcaacaugagcuucaaagaccucgggcgggucguggugauggucggcgcaaccauggccgacgauaucgggaugggcguuacuuaccuggcccugcucgcagcuuucaaggugcgccccaccuucgccgcggggcugcuacuccggaaauuaacguccaaggagcugaugaugaccacgaucgggaucguccuccugagccagucgacgauccccgagacaguguuagagcucaccgacgcccuggcguugggcaugaugguccucaagaucguaaggaacauggagaaguaccagcuggccgugacgaucauggccauccugugcgucccgaacgcggucauucuccagaaugccuggaaggugagcuguaccauccuggccgucgugucugugagcccccuguuacugaccuccagccagcagaagaccgacuggaucccacuggcccucacgaucaagggccugaaucccaccgccaucuucuugaccacgcucucccgcacgaacaagaagcggagcuggccauugaacgaggccaucauggccgugggcauggugucgauccuggcgaguucccuccugaagaacgauauccccaugaccggcccccugguggcagggggccuccugacugucugcuacguguugaccgggcggagcgccgaccucgagcuggagcgggccacggaugugaaaugggaggaccaggcugaaauaucgggcagcagccccaucuuaaguaucaccauaagcgaggacggguccaugagcaucaagaacgaggaggaagagcagacccucaccauccugauccgcacgggccugcucgucaucucaggccuguucccgauaagcauccccgugaccgccgccgccugguaccuuugggaggugaagaagcagcgggccgguguccucugggacguucccagcccgccgcccaugggcaaggcggagcuggaggauggggccuaccgcaucaagcagaaggguauccuaggguacagccagauuggcgccggcguguauaaggaggggaccuuccacaccauguggcacgucacgcggggcgccgugcucaugcacaaggggaagcgcaucgagccauccugggccgauguuaagaaagacuuaaucuccuacggcgguggcuggaagcuggaaggcgaguggaaggagggggaggagguccaggugcucgcacucgagcccggcaagaacccucgggccgugcaaacaaagcccgggcuguucaagaccaacacuggcaccaucggggcagucagccucgacuucagcccugguacguccggcucccccaucaucgacaagaaggggaagguaguggggcucuacgggaacggggucgugacccgcucaggcgccuacgugagcgccauagcgcagaccgaaaagucgauagaggauaaccccgagauagaggacgacaucuuccggaagcgccggcugaccaucauggaccugcaccccggggcagguaaaacgaagcgcuacuugcccgccaucguccgggaggccauaaagcgcgggcugcggacccugauucuagccccgacgcgcgugguggcugccgagauggaggaggcccugcggggccugcccauccgcuaucagacccccgcgauccgggccgaacacacagggcgcgagaucguugaccuaaugugccacgccaccuucaccaugcgccugcucagcccggugcgggugccgaacuacaaccugaucaucauggacgaggcucacuucaccgauccagcgaguaucgccgcuagaggcuacauuagcacgcguguggagaugggugaggccgccgggauauucaugaccgcuacgccgcccggcagcagagauccguucccccaguccaacgcccccaucaucgacgaagagcgugagauccccgaacgcuccuggaauuccgggcacgagugggugaccgauuucaagggcaagacggugugguuugucccgagcaucaaggcggggaacgacaucgcggccugccucaggaaaaauggcaagaaagugauccagcugagucgcaagaccuucgacucugaguacgugaagacacggacaaacgacugggacuucguagugacgacggacaucuccgagaugggugcgaacuucaaggcggagcgcgugaucgacccccggagauguaugaagcccgucauccuaacugacggggaggagagagugauucuggcgggacccaugccggugacccacucuucugcagcgcagcgacggggucgcauuggccggaaucccaaaaacgaaaacgaccaguacaucuacaugggagagcccuuagagaacgacgaggacugcgcgcacuggaaggaggcgaagaugcuccuggauaauaucaauacgccggagggcaucaucccgagcauguuugaacccgagcgcgagaaagucgacgccaucgacggugaguaccggcuccgcggagaggcacgcaagaccuucguggaccucaugcggcgcggcgaccugcccguguggcuggccuauaagguggccgcggaaggaauaaacuacgccgaccggcgcuggugcuucgacggcauuaagaacaaccagauccucgaggagaacauggaaguagagaucuggaccaaggaaggggagcggaagaaguugaagccgcgguggcuggacgcccggaucuacucugacccccucgcccugaaggaguucaaagaauucgccgcgggccgcaagucccugacccucaaucugaucacggagaugggccgucuucccaccuucaugacccagaagacccgcgaugcucucgacaaccuggccguacuucacacugccgaagccggugggcgggccuacaaccacgcccucuccgagcugcccgagacccuggaaacgcuccugcuguugacccugcuagccacggugaccggggguaucuuucuauuccugaugagcgggagagggauaggcaagaugacccuaggaaugugcugcaucaucaccgccuccauccuccugugguacgcgcagauccagccucacuggaucgccgccagcaucauccuggaguuuuuucucauugugcugcugauccccgagcccgagaaacagcggaccccccaggauaaccagcucacguacgucgugaucgccauauuaacuguugucgccgcgaccauggccaacgaaaugggcuucuuagagaagaccaagaaggaucuggggcugggcuccaucgccacucagcagcccgagagcaacaucuuggauaucgaucuccgccccgccuccgccuggacccuguacgcgguggccaccaccuucgugacgcccauguugcggcacucuaucgagaacagcucggucaacguauccuugacugccaucgccaaccaggccaccgugcugaugggccuggggaaaggcuggccccucuccaagauggacaucggggucccgcugcuggccaucgguugcuacagccaggugaaccccaucacccuaacggcagcccugcugcuccugguggcccacuacgcaauuaucggccccggccugcaggcgaaggccaccagagaagcccagaagcgggccgcggccggcauaaugaagaaccccaccguugacgguaucacggugaucgaccucgacccgaucccauacgaucccaaguucgagaagcagcugggccagguuaugcuacuaauucugugcgucacccaaguccugaugaugcgcacuaccugggcccucugugaggcccuuacccuggccacgggucccaucucaacccucugggaaggaaacccggggcgguucuggaacacgaccaucgcggugagcauggcuaacaucuuccgcggcuccuaccuggccggcgcugggcuccuguucucgaucaugaaaaacacuaccaacacccggcgcggcacagggaacaugggcgagacgcugggugagaaguggaaguccagacugaacgcccucgggaaauccgaguuucagaucuacaagcggucaggcauacaggaggucgaccgcacccuggcgaaagaggggaucaagcggggcgagaccgaccaccacgcggugucacgagggucggcaaagcugcggugguucguggagcgcaacauggucaccccagaaggcaaggugguggaucucggcugcggccggggcggguggucguacuacugcgggggguuaaagaacgucagggaagugaagggacugacgaagggcgggcccggacacgaggagcccaucccgauguccaccuacggguggaaccucgugcggcugcaaucaggcgucgacguguucuuuaucccucccgagaaaugcgauacuuuacucugugacaucggggaauccagccccaacccgaccguggaggccggcaggacacuuaggguccugaaccucguggagaacuggcugaauaacaauacccaguucugcaucaaggugcugaaccccuacaugcccuccgucaucgagaaaauggaggcgcugcagaggaaguacgguggggccuuggugcggaacccgcugagccgcaacucgacccacgagauguacugggucuccaacgccagcgguaacaucgucuccaguguaaacaugaucuccaggaugcugaucaaucgcuucaccaugcggcacaagaaggccaccuacgagcccgacguggaccucgggagcggcacgcgcaacaucgggauugaguccgagauacccaaccuggacaucauagggaaacggaucgagaagaucaagcaagagcaugaaaccagcuggcacuacgaccaggaucacccguacaagaccugggccuaccauggcuccuaugagaccaagcaaacggggucugcguccucgauggucaacgggguggugcgacugcucaccaaaccgugggacguccugccgaccgugacccaaauggccaugacugacaccacccccuucgggcagcagagaguguucaaagagaagguugacacacggacgcaggagcccaaggaaggcaccaagaagcugaugaagaucacagccgaguggcucuggaaggagcugggaaaaaagaagacgccacgcauguguacaagagaggaguucacccgcaaggugcgguccaacgccgcccugggggcaauuuuuaccgaugagaacaaguggaaguccgcccgcgaggccguggaggacucucguuucugggagcucgucgacaaagagcgcaaccugcaccuggagggcaagugcgaaacgugcguguacaacaugauggggaagagggagaagaagcucggcgaauucgggaaggccaaggguagccgcgccaucugguacauguggcugggcgcacgguuccucgaguuugaggccuuaggguuccugaacgaggaccauugguucucucgcgagaacagcuuaucaggcgucgagggagagggccuccacaagcugggguacauccugcgggacgugucaaagaaggaaggcggcgccauguacgcagacgacacggcgggcugggacacccgaaucacacucgaggaccugaagaaugaggagaugguaaccaaccacaugaagggcgagcacaagaaguuggcugaagccauuuucaagcucacguaucagaacaaggucguucgggugcagcgccccacgccccgggggaccgucauggacaucaucagccgucgugaccagcgcgguuccggacagguagggaccuacggccugaacacuuucaccaacauggaggcccaacugaucagacagauggaaggagagggcguguucaagaacauucagcaccucaccgucaccgaggagguagccgugcaaaacuggcuggcgcgcguugggcgcgagcggcugagccgcauggccaucucuggcgacgacugcguugugaaaccccucgaugaccgguucgccaacgcccugacggcccucaaugacaugggcaagaucaggaaggacauccagcagugggagccgagcaaaggguggaacgacuggacacaggucccguucugcucccaccacuuccaugagcucaucaugaaggacggucgggugcucgugguucccugccgcaaccaggaugaauuaauuggacgugcgcggaucagccagggcgcuggguggucccuacgggagaccgccugccugggcaagagcuaugcccagauguggucccugauguauuuccaccgacgggaccuccgcuuggccgcgaaugccaucugcuccgcagucccaucccacugggugccaaccagccggacaaccuggucaauccacgccaagcaugaguggaugaccaccgaggauaugcuaacggucuggaaccgcguguggauccgggagaaucccuggauggaagacaaaacgcccguggagagcugggaggagauaccguaccucggcaagcgggaggaucaguggugcgguuccuuaaucggccuaaccagccgggccaccugggcuaagaacauccaggccgccaucaaccaggugcgcagccucaucgggaacgaagaguauaccgacuacaugccgagcaugaagagguuccgccgcgaggaggaggaggccggcgugcugugguga

SEQ ID NO: 24949 - RNA, 9876 nt, Artificial Sequence
  derived and/or modified CDS sequence (opt11) from DENV-2__GU131900__SS-prME
agcgcggggaugaucaucauguuaauuccuaccguuauggccuuccaccucacuacccgcaauggggagccucacaugaucgucggcauccaggagaaggggaaguccuuacuguucaaaaccgaggacggcgugaacaugugcacccucauggcgauggaccugggagaacugugcgaagacacuaucaccuacaagugcccccuccuacggcagaacgagcccgaggacaucgacugcuggugcaacagcaccagcaccugggugacuuacgggaccugcaccaccaccggcgagcaccgccgcgaaaagcgcagcgucgcccuggugccccauguggggaugggccucgaaaccagaaccgaaaccuggauguccagcgagggggccuggaaacacgcccaacgcaucgagaccuggauccugagacacccgggcuuuacuaucauggccgcgauccuggcuuacaccaucggcacuacccacuuccagagggugcuuauauucauccugcugacagcuguggcccccagcaugaccaugcggugcaucggcaucagcaacagagacuuuguggagggugucuccgggggcucauggguggacauagugcucgagcacgggucgugcguuaccaccauggcgaagaacaagcccacgcuggacuuugagcugauaaagacugaagcgaagcaacccgccacccuccggaaguacugcaucgaggcaaagcugaccaacaccaccaccgagagccgcugccccacccagggcgagcccucccugaaagaagaacaggacaagcgguucgugugcaagcacagcaugguggacaggggcugggggaacgguugcggccuguucggcaagggggggaucguuacgugcgccauguucacgugcaagaagaacauggaggguaagauugugcagccggagaaucucgaguacaccaucguaguaacgccccacuccggggaggagcacgcagugggcaacgacacggggaagcacggcauggaaaucaaggugaccccgcagagcuccaucaccgaggccgaacugaccggguacggcacugucacgauggagugcagcccccggacgggucucgacuucaaugaaauggugcugcuacagauggagaacaaggcguggcucguacaccgccagugguuccuggaccugccccuccccuggcugccgggugccgacaagcaggaguccaacuggauucagaaggagaccuuaguaaccuucaagaacccccacgcuaagaagcaggacgucgucguguuaggcagccaggaaggggcgaugcacacagcccugaccggcgccaccgagauccaaaugucuuccgggaaccuccuguucaccggccaccugaagugccggcugcgcauggauaagcuccagcugaagggcaugucuuacucuauguguacgggaaaguucaaggugguuaaggagauagccgagacccagcacgggacuaucgugauacggguccaguacgagggggacggcagcccauguaagauccccuucgagaucauggaucucgagaagcgauacguccucggccggcugaucaccgugaaccccaucgucacggagaaggacucccccgucaacaucgaggcggagcccccauucggggacagcuacaucaucaucggaguggagccggggcaacugaagcucaacugguucaagaagggcucuucgauugggcagauguuugagacaacgaugcgcggcgcgaagcgcauggcgauccugggagacaccgccugggacuucgggucccugggcgggguguucacgagcauaggcaaggcccuccaucagguauucggggccaucuacggcgcagccuucuccggcgugagcuggacaaugaagauccugaucggggugauuauuaccuggaucgguaugaacucccguagcaccucccuuucugucucccuggugcucguggggauagucacccuguaccugggcgugaugguacaggccgacagcgggugcgugguguccuggaagaacaaggagcucaaaugcggcaguggcaucuuuaucaccgacaacgugcacacuuggaccgagcaguacaaguuccagcccgagagccccuccaagcuggccagcgcgauccagaaggcccaggaggaggggaucugcggcauccgguccgugacccggcuggagaaccucauguggaagcagaucaccccggagcugaaccacaucuuagccgagaacgagguaaagcucaccaucaugaccggggacauaaagggaauaaugcaggccgggaagcgcagccugcggccgcagcccacggagcugaaguacuccuggaagaccugggguaaagccaagaugcucagcacugaguccuacaaccagaccuuccugaucgaugguccugagacagcggagugcccgaacaccaauagggccuggaacagcuuggagguggaggacuacggcuucggagucuucaccaccaacaucuggcucaagcugaaggagaagcaggacgcuuucugcgacuccaagcugaugagcgcggccaucaaggacaacagagcggugcacgccgacaugggguacuggauugaguccgcccucaacgacacguggaaaaucgagaaagccagcuucaucgaggugaagaacugccauuggcccaagucccacacccucuggagcaacggcguccuggaguccgagaugauaauaccgaagaaccucgcgggccccgugagccagcauaacuaucguccgggguaccacacccagaucgcgggccccuggcaccuugggaagcuggaaauggauuucgacuuuugcgauggcacaacagugaucgucacggaggauugcgggaauagaggccccucucuccguaccaccaccgccagcggcaagcugaucacagaguggugcugccggagcugcacccugcccccucuuagguaccgcggcgaggacggcugcugguacgggauggagauccgaccgcugaaggagaaggaggagaaucuugucaacucccucgugacugcgggccacgggcaggucgacaacuucagccugggugugcugggcauggcccucuuccuagaggagaugcugcgaacccgcgucggaacuaagcacgcuauccuccuggucgccgugucuuucgugacacuuaucacgggaaacauguccuucaaggaccucggacgggucgugguuauggucggcgcgacaauggccgacgauaucgggaugggagugacuuacuuagcccugcuggcggccuucaaggugcgcccaacuuucgccgcuggauuacuucuacggaaauuaaccucaaaagaguugaugaugaccacgaucgggaucguucuccugagccaauccaccauuccagagaccguuuuggagcucaccgacgcccuggcgcuggguaugauggugcucaagaucguucguaacauggagaaguaccagcuggccgugacgaucauggccauccugugcgucccgaaugccgugauccuccagaacgccuggaaggugagcugcacaauccuggcugucguguccgugagcccccugcuucugacguccagccagcagaagacugacuggaucccucuggcacucacgaucaaaggccugaaucccaccgccaucuuucugaccacauugucccgcacgaacaagaagcguagcuggccucugaacgaggccaucauggcggucgggaugguaucaauccuggccucgucccuccugaaggacgacauaccgaugaccggaccccugguagccgggggccucuuaaccgucuguuacgugcugacggggcgcagcgccgacuuggagcuggagagggccacggacgugaaaugggaggaccaggcggagaucuccgguagcucaccgauccucucgaucaccauuucugaggacggguccaugucgaucaagaacgaggaggaagagcagacccucacaaucuugauccgcacaggccugcucgucaucuccggcuuauucccaaucagcaucccaauuaccgcugcagcgugguaccugugggaagugaagaaacagcgggcuggggugcucugggacguccccaguccgccucccaugggaaaggcggaauuagaagacggggcuuaccgcaucaagcagaagggcauucugggguacucgcagaucggcgccggcguguacaaggaagggacuuuucacaccauguggcacguaacccggggcgccgucuuaaugcacaaggggaagcgcaucgagcccuccugggccgacgugaagaaggaccugaucagcuacggcgggggcuggaagcuggagggcgaguggaaagagggggaggaggugcagguccucgcccuggagcccggcaagaaccccagggcgguacaaacgaaacccgggcuguucaagaccaacaccggcacuaucggggccgugagucuugacuuuagccccgggacgagcggcagccccaucaucgacaagaaggggaaggucgugggccuguacgguaacggcguagugacccgcuccggagccuauguauccgcuaucgcgcagaccgagaaguccauugaggacaaccccgaaauugaggacgauauauuccggaagcgccggcugaccauaauggaccugcaccccggggccggcaagacgaagcgcuaccuccccgccaucguccgugaggccaucaagcgcgggcugcggacccugauccucgcgccgacgcguguaguggccgccgagauggaggaggcgcugcggggccugcccauccgcuaccagacccccgccauccgggcagagcacacggggcgcgagaucguagaccucaugugccacgcgaccuucacuaugcgccuacugagccccgucagagugccgaacuacaaccucaucaucauggacgaggcccacuuuaccgauccugccuccaucgccgcgaggggcuacauaagcacgcggguggagaugggggaggcagcugggauuuucaugaccgccacgccgcccggcagccgcgacccguucccccaguccaacgcccccaucaucgacgaggagcgggagauaccggagcgcagcuggaacuccgggcacgagugggugaccgacuuuaaggguaagacggugugguucgugccgaguaucaaggcggggaacgacaucgccgccugccugcggaagaacgguaagaaggucauccagcugucccggaagaccuuugacagcgaguacgugaagacccggaccaacgacugggacuucguagucacgaccgauaucucggagaugggcgcgaacuucaaggcugagcgcguuauagacccccggcggugcaugaagcccgugauccucaccgacggggaggagcgaguuauccuggccggccccaugccggugacccauucguccgccgcccagcgccgggggcgcaucggccggaauccuaaaaaugagaaugaccaguacaucuacaugggcgaaccccuggagaaugacgaagacugcgcccacuggaaggaggcgaagaugcuccuggauaacaucaacacgcccgaggguaucaucccgagcauguuugagcccgagcgcgagaaaguggacgccauagacggcgaguaucggcugcgcggggaggcccgcaagaccuucguugaucugaugcggcgcggcgaccuuccgguguggcuggccuacaagguggccgcggaggggaucaacuaugccgaucggcgcuggugcuucgacgguaucaaaaauaaccagauucucgaggagaacgucgaaguugagaucuggaccaaggagggggagcggaagaaguuaaagccacgcuggcuggacgccaggaucuacuccgacccccucgcccugaaggaguucaaggaguucgccgcgggccgcaagagccugacccucaaccugaucacggaaaugggcagguuaccgaccuucaugacccagaagacccgugacgcccucgacaaccuggccgucuugcacacggccgaggccggcggccgcgccuacaaccacgccuuauccgagcucccugagacccucgagacacucuugcuucuaacacugcuagcaacggugacagggggcaucuuccucuuccugaugagcgggcgcggcauuggcaagaugacccuggggaugugcugcauaaucaccgccucuauccucuuaugguacgcgcagauccagccgcacuggaucgcggccagcaucauccuagaauucuuccucaucgugcugcucauccccgagcccgaaaagcagcggaccccucaggauaaccaguugacguauguugugaucgcuauccuuaccguggucgccgcaaccauggccaacgagaugggguuucuugagaagaccaagaaggaccucggccugggcuccaucgccacgcagcagccggaguccaacauccuggacaucgaucuucgcccggccuccgccuggacccuguacgcgguggccacuaccuucgugacgcccaugcugcggcacagcaucgaaaacagcuccgucaacguuucgcuuaccgcuaucgccaaucaggccaccgugcugaugggccuagggaagggcuggcccuuguccaaaauggacaucggggucccucugcuggcgauuggcugcuacagccaggugaacccgauuacccucacggccgcacugcugcuucugguggcccacuacgcgaucaucgggcccggcuuacaggccaaggccacgcgcgaggcccagaagcgggccgcagccggcaucaugaaaaauccuaccgucgacgggaucaccgugaucgaccuagacccgauccccuacgacccgaaguuugagaagcaguugggucaggugaugcuucuuaucuuaugcgucacccaggugcugaugaugcgaaccaccugggcccucugcgaggcccuuacccuggcaacuggucccaucucuacccucugggagggcaacccggggcgguucuggaacaccacaaucgcugugucgauggcaaacaucuuccgcgggagcuaccuagccggugccggguuacucuuuucgaucaugaaaaacacgaccaacacccggcgcggcaccgggaacauaggcgaaacgcugggagagaaauggaaaucccgccucaacgcccucgggaaguccgaguuccagauuuacaagaaguccgguauccaggaagucgaccggacccuggcgaaggaggggauuaagcgcggcgagaccgaccaccaugccgucucccgcgggagugccaagcugcgcugguucguggaacguaacauggucacccccgaaggcaagguggucgaccugggcuguggccgcggcggguggagcuacuacuguggagggcugaagaacguacgggaggugaagggucuaacgaagggcggcccuggacacgaggagcccaucccgauguccaccuacggcuggaaccucgugcgccugcagucgggcguugacguguucuucaucccccccgagaagugcgacacccuacucugcgacaucggggagucgagccccaacccgaccguggaggcuggccggacguugcgcguccuaaaccucguggagaacuggcuaaacaacaauacccaguucuguaucaaggugcugaauccuuacaugccguccgucaucgagaagauggaggcccugcaacggaaauacggaggggcccuuguacgcaacccgcugucgagaaacagcacgcacgagauguacuggguguccaacgccagcgguaacaucgucuccucagugaacaugauaagccgcaugcugauaaaccgguucacuaugcgccauaagaaggccaccuaugaacccgacguggaccucgguucaggcacacguaacaucggaaucgaauccgagauccccaaccuugacaucaucggcaagcguaucgagaagaucaaggaggagcacgagaccagcuggcacuacgaccaggaccaucccuacaagaccugggccuaccauggcuccuacgagaccaagcagacggggagcgcguccagcauggucaaugggguggugcggcugcucaccaaaccgugggacguccugcccaccguaacccagauggccaugacggacaccaccccauucggucaacagagaguguucaaagagaagguugacacccggacgcaggagcccaaagaggggaccaagaaguugaugaagaucaccgcugaguggcucuggaaggaauuaggcaagaagaagaccccgcggauguguacgcgcgaggaguuuacccguaagguccgcuccaacgccgcucuaggggcaaucuuuaccgacgagaacaaauggaaauccgcccgggaggccguggaagacuccagguucugggagcucgucgacaaggaacggaaccugcaccuggaggggaagugcgagaccuguguguacaacaugauggggaaacgcgagaagaagcucggcgaguuugggaaggccaaggguagccgggccaucugguauaugugguugggcgcccgguucuuagaguucgaggcccuaggguuccugaacgaggaccacugguucucccgggagaacagccucuccggcguugagggcgagggccuccacaagcugggguauauccugcgcgacgucagcaagaaagaaggcggugccauguacgccgacgauacggcggguugggacacacggaucacccucgaggaccugaagaacgaggagauggucaccaaccacauggagggcgagcauaagaagcuggcggaggccaucuucaagcucacuuaccagaacaaggucgugcgaguccaacggcccacuccccggggaaccgucauggauaucaucucgcggcgcgaccagcgggguucuggacagguugggacguacggccuuaauacguuuaccaacauggaggcccagcugauucgccaaauggagggggagggcguguucaaaaauauccagcaccucaccguaaccgaggaggcggcagugcagaacugguuagcccggguggggcgcgagcgccugucacggauggccaucuccggagaugacugcgucgugaagccccucgacgaccgcuucgccaacgcacugacugcgcugaacgacauggguaagauccgaaaggacauccagcaaugggagccgagcaagggguggaacgacuggacccaggugcccuuuuguucccaccacuuucacgaauugaucaugaaagacggccgcguccugguugugcccugccguaaccaggacgagcugaucggccgcgcccggaucucucagggcgcuggguggucccucagagagacggccugccugggcaagagcuacgcccagauguggucccugauguacuuccaccggcgcgacuuacggcuggcugccaacgccaucuguagcgccguccccucccacugggugccgaccagucgaacgaccugguccauccacgccaagcacgaguggaugaccaccgaggacaugcugacgguguggaaccggguguggauccgcgagaaccccuggauggaagauaagacgcccguggagagcugggaggagauccccuaucucggcaagcgggaggaccaguggugcgggucccugaucggucugaccagccgcgcgacaugggccaagaacauccaggcugccauuaaccaggugcggucccucaucgggaacgaagaguacaccgacuacaugccgagcaugaaacgcuuccggcgcgaggaggaggaggcgggcguccuuugguga

SEQ ID NO: 24950 - RNA, 9876 nt, Artificial Sequence
  derived and/or modified CDS sequence (opt11) from DENV-2__GU131901__SS-prME
agcgccggcaugauuauuaugcugauccccacugugauggcauuccaccucaccacccgcaacggggagccacacaugaucgucggcauccaggagaaggggaaaucccugcuguucaagaccgaggacggagugaauaugugcacccucauggcgauggaucugggggagcugugcgaagacaccaucacauacaagugccccuugcugcggcagaacgagcccgaggauauagacugcuggugcaauagcaccagcaccugggugacauacgggaccugcaccaccaccggcgagcaccgccgggaaaagcgcagcgucgcgcuggugccccacguggggaugggccucgagacccggaccgaaaccuggauguccagcgagggagcguggaagcacgcgcagcgcaucgagacguggauccuccggcacccuggcuucacgaucauggcggcaauccuggccuacacuaucggcaccacgcacuuccagcgcguccucauuuucauccugcugacugccguggcaccguccaugacgaugcguugcaucggcaucagcaaccgcgacuucguagagggcgucuccggugguagcuggguggacaucgugcuagagcauggcuccugcgucaccaccauggcaaagaacaagcccacgcuagacuucgagcugaucaagacagaggccaagcaacccgccacacuccggaaguacugcaucgaggccaagcugacaaacacgaccacugagucgcgcugcccgacccagggcgagcccucccugaaggaggagcaagacaagcgguucgugugcaagcacagcaugguggaccgcggcuggggcaacggcugcggccuguucggcaagggcgggaucgucacgugcgccauguuuacgugcaagaaaaacauggagggcaagaucgugcaacccgagaaccuggaguacacgaucguggucacgccccacuccggggaggaacaugcggugggcaacgacacggggaagcacggcauggagaucaaggugacgccucagagcuccaucaccgaggccgaacugaccggguacggcaccgucacgauggagugcagcccacggaccggccucgacuucaacgagauggugcuucugcagauggagaacaaggccuggcucgugcaccgccagugguuccuggaccugccccuccccuggcugccgggggccgacaaacaggaguccaauuggauccagaaggagacccuggucaccuucaaaaauccccaugccaagaagcaggacgucgucguccucggcucacaggagggggcgaugcacacggcccuaacaggcgccaccgagauccagaugaguuccgggaaccuccuguucaccggccaccugaagugccgccuccgcauggacaagcuccaacugaagggcaugucauauuccauguguacggggaaguucaaggucgucaaggaaaucgccgagacccagcacggcaccaucguuaucagggugcaguacgagggggacggcagccccugcaagauccccuucgagauuauggaccuggaaaagcgcuacguccucggccggcugaucaccgugaacccgaucguuacggagaaggauucccccgucaacaucgaagcugagccccccuucggggacagcuacauaaucauaggcguggagccgggccagcugaagcucaacugguucaagaagggcuccagcauagggcagauguucgagacgaccaugcgcggcgcgaagagaauggccauacuaggcgacaccgccugggauuuuggaucccugggggggguguucacgagcaucggcaaggcccuccaccaagucuucggggccauuuacggcgcggcauucuccggcgugucguggaccaugaagauucugaucggggugaucaucaccuggaucggcaugaauuccagaagcaccucccuaagugucucccugguccucguggggaucgucacacuguaccuuggcgugaugguucaggccgacagcgggugcgucguuuccuggaagaacaaggaguugaaaugcgggagcggcaucuucaucaccgacaacgugcacaccuggaccgaacaguacaaguuccagccggaaagccccaguaagcuggcuagcgccauccagaaggcccaggaagaagggauaugcggcauucgcuccgucacacgacucgagaaccucauguggaaacagauuacccccgaacugaaccacauacuggccgagaaugaggugaaauuaaccaucaugaccggggacauuaaaggcaucaugcaggccgguaagcgcucucuacggccgcagcccacggagcugaaguacuccuggaagacguggggaaaggccaagaugcucagcaccgaguccuacaaccagaccuuucugaucgacggcccggagacggcggagugcccaaacacgaaccgcgccuggaacagucuggagguggaagauuacggauucggcgucuucaccaccaacauaugguuaaagcugaaggagaaacaggaugcauucugcgacuccaaguugaugagcgccgccaucaaggacaaccgggcggugcaugccgacaugggguacuggaucgaguccgcccucaacgacacuuggaagauagaaaaggccagcuuuaucgaggugaagaacugccacuggcccaaaucccacacgcuguggagcaacggcgugcuggaauccgagaugaucaucccuaagaaccucgcaggcccagugagccaacauaacuaccgcccgggguaccauacccaaauugcgggucccuggcaccugggaaaacuggaaauggacuucgacuucugcgacggcaccacugugaucguuacggaggacugcggaaaccgggggcccucccucagaacuaccaccgccagcggaaagcugauuacggaguggugcugccguagcugcacucugccaccgcuccguuauagaggcgaggacggcugcugguacggaauggagauccgcccccugaaagagaaggaggagaaccucguuaacuccuuggugaccgccggccacgggcaagucgacaacuucagccugggcguucuggggauggcccucuuccuggaagagaugcugcguacccgcguggggacgaagcacgcuaucuugcuggucgcggucucguucgugacucugaucaccggcaacaugagcuuuaaagaccucgggcgggucguggugauggucggcgccacgauggccgacgacaucgggaugggugugaccuaccuggcccugcuggcggccuucaagguacgccccacuuucgccgcuggccugcugcuccggaagcugacguccaaggaacugaugaugacaacgaucgggaucguccuccuuagccagucuaccauccccgagacuguccuggaguugaccgaugcccuggcacugggcaugauggugcuuaagaucguccgcaacauggagaaguaccaguuggcggugacgaucauggccauccugugcguaccgaacgccguaauccuccaaaacgccuggaaggugagcugcaccauccuggcggucguguccgugagcccccugcuccugaccaguucacagcagaagaccgacuggaucccccuagcccucacgaucaagggucugaaucccacggccaucuucuugaccacccucucccgcacgaacaagaagcggagcuggccucugaacgaggcuaucauggcggucggcauggugucgauccuggccucuucccuccuuaaaaacgacauccccaugaccggcccccugguagcaggggggcucuuaaccgucuguuacgugcugacuggacgcagcgccgacuuggagcuggagcgggccacggacgucaagugggaggaccaggcggagaucuccggcuccucccccauccugaguaucacuauaagcgaagacggguccaugagcaucaagaacgaggaggaggagcagaccuuaacuauccucauaaggacgggcuuguuaguuauauccggucuguuuccgaucucaauucccaucaccgccgcggcaugguaccugugggaggugaaaaagcagcgggccggagugcucugggacgucccgagcccgccgccgaugggcaaggccgaguuggaagacggggccuaccgcaucaagcagaagggcauccugggguacagccaaaucggcgccgggguguacaaggaggggaccuuccacaccauguggcaugugacccggggcgccguccucaugcacaaggggaagcguaucgagcccuccugggcugaugugaagaaggaccugaucagcuauggcgggggguggaagcuggagggcgaguggaaggagggggaggaggugcagguccucgcauuagagccgggcaagaacccccgggccgugcagacuaagcccgggcuguucaaaaccaacacaggcaccaucggagccgugucccucgacuucagccccggcacguccggcagccccauuaucgacaagaaagggaaggucgugggacuguauggcaacggcguggucacccgcuccggcgccuacgugagcgcuaucgcgcagaccgagaagaguauugaagacaaccccgagaucgaggaugauaucuuccggaagcgccggcugacgaucauggaccugcaccccggagccggcaagacgaagcgcuaccuccccgccauaguucgggaggccaucaagaggggucugagaacccugauccucgcucccacccgcgucguggccgccgagauggaggaagccuugcggggcuuaccgauucgcuaucaaacccccgccauccgggcggagcauacggggcgcgagaucguggaccucaugugccacgccacuuuuacgaugcgucugcugagccccguccggguccccaacuacaaccugaucaucauggaugaggcccacuucaccgaccccgccaguaucgccgcgcgcggcuacauuagcacgcgcguggagaugggagaggccgccgggaucuucaugaccgccacgccgcccggcucacgcgacccguucccccaguccaaugcccccauuauugacgaagagcgcgagauucccgagcgcucuuggaacuccgggcacgaaugggucaccgacuucaaggggaaaaccgugugguucgugccgucgaucaaagcggggaacgacaucgcagccugccugcggaagaauggaaagaaagucauccagcuuucccgcaaaaccuucgauagcgaguaugugaagacccggaccaacgacugggacuucguggucacuaccgacaucuccgagaugggugccaacuucaaggcggagcgcgugaucgacccccgccgcugcaugaagcccgugauucucaccgacggcgaggagcgggucauccuggcaggccccaugccggugacccacagcuccgcggcccagaggcgggggcgcaucggccggaaccccaagaacgagaacgaccaguacaucuacaugggugagccccuggagaacgacgaggacugcgcccacuggaaggaggcgaagaugcuucuggacaauauuaauacgcccgaaggcaucaucccgagcauguucgagcccgagcgcgagaagguggacgcgaucgacggcgaguaccggcugcgcggggaggcccgcaagaccuucgucgaccugaugaggaggggagacuuacccguguggcuggccuacaagguggccgccgaggggaucaacuaugcugaccggagguggugcuucgacgggaucaagaacaaucagauacuugaggagaacgucgagguggagauuuggacuaaggagggcgagagaaagaagcugaagccucgcuggcuggacgcgaggaucuacucagacccccuagcucuuaaggaauucaaggaguuugcugcgggccgcaagucacuuacccucaaccugauuacggagaugggccgacugcccaccuucaugacccagaagacccgagacgcacucgacaaccuggccguccugcacacagccgaggccgguggccgggccuauaaccaugcacucuccgagcugcccgagacccuggagacucuccugcuucucacgcugcuggccacggugaccgggggcaucuucuuauuccugaugagcggcagagggaucggcaagaugacacuggggaugugcugcaucaucaccgccuccauccuccugugguacgcgcaaauccagccgcacuggaucgcagccagcaucaucuuggaguucuuccucauugugcugcugauccccgaaccagagaagcagcguacgccgcaagacaaccagcucacauacgucgucaucgccauccuaaccguggucgccgcgaccauggccaacgagaugggcuuccuggagaagaccaagaaggaccucgggcugggcaguaucgcgacacagcagccggagagcaacauccuggacaucgaccuccgccccgccagcgccuggacccuguacgcgguugccaccaccuucgugacgcccaugcugcggcacagcaucgagaacagcuccguuaacguaagccuaaccgcuaucgccaaccaggccaccgugcugaugggccuggggaagggcuggccccucagcaagauggauaucggggucccgcuguuagcgaucggcugcuauagccaagugaaccccaucacgcuuacagcagcccugcugcucuuaguggcccacuacgcaaucaucgggcccggccugcaggccaaggccacccgcgaggcccagaagcgggcugcggccggcaucaugaagaaccccacaguggacgggaucaccgugauagaccucgacccgauucccuaugaccccaaauucgagaagcagcugggccaggugaugcugcugauccugugcgucacccagguguuaaugaugcgcacgaccugggcccucugcgaagcccuuacccuggccaccgggcccauauccacccuuugggaaggcaacccggggcgguucuggaacacaaccaucgcggugagcauggccaauaucuuccgcgguuccuaccuggcaggagccgggcuccuuuucagcaucaugaagaacacgaccaacacccggcgaggcaccgggaaugucggcgagacacucggcgagaaguggaagucccgccugaacgcccuggggaaguccgaguuccagaucuacaagaaguccggcauccaggagguggaccggacccuggcgaaggaggggaucaagcgcggagaaaccgaccaccacgccguaucccggggguccgccaagcugcgcugguucgucgagcggaauaugguuacccccgaggguaagguggucgaccucggcugcgggcgcggcggguggagcuacuacugcggcgggcugaagaacgugcgggaggugaagggccuaacgaagggcgggcccggccacgaggagcccaucccgauguccaccuacggguggaaccucguucgacuucagucuggcguagacguguucuucauaccgccggagaaaugcgauacccuucucugcgacauuggggagucgucgcccaacccgaccgucgaggccggccggacacugagggugcugaaucuggucgagaacuggcugaacaacaacacccaguuuugcaucaaaguucugaaccccuacaugccuuccgugaucgagaagauggaggcgcugcaacggaaguacggcggggcccucgugcgcaauccgcugagccggaacagcacacacgagauguacugggucuccaaugccagcggcaauauaguguccagcgugaauaugauuucccgcauguugaucaaccgauuuaccaugcgucacaagaaggcgaccuacgagcccgacgucgaccucgggucagggacgcggaacaucgggaucgaauccgaaaucccgaaccuggacauaaucggcaagcgcaucgagaagauuaaggaggagcacgagaccagcuggcacuacgaccaggaccaucccuacaagaccugggcguaccacggcuccuaugagaccaaacagacugggagcgcgagcagcauggugaauggcguggucaggcugcucaccaagccgugggacgugcugcccaccgugacccaaauggccaugacggacaccaccccguucggccagcagcgcgucuucaaggagaagguggacacccgcacgcaggagcccaaggaaggcaccaagaaguugaugaagaucaccgccgaguggcucuggaaggagcugggcaaaaagaagaccccgcggaugugcacgcgcgaagaguucacccggaagguccgaucgaacgcagcacugggggcgaucuucaccgacgagaacaaguggaaguccgcccgagaggcugucgaggacagucgcuuuugggaacucguugacaaagagcgaaaccuacaccuggagggcaagugcgagaccugcgucuacaacaugauggggaagcgcgaaaaaaagcucggcgaguuugggaaagccaagggcagccgggccaucugguacauguggcuaggcgcgcguuuccuggaguuugaggcccucggguuccuuaacgaggaccacugguucucccgggagaacucccuuuccggcguagaaggggaaggccuccacaaauugggguacaucuugcgcgacguuagcaagaaagagggcggcgccauguacgcggacgacacggcggggugggauaccaggaucacccucgaagaucugaaaaacgaggagauggucaccaaccacauggaaggagagcacaagaagcuggccgaggccaucuucaagcucacguaccagaacaagguggugaggguccagcggccuacgccccgcgggaccguuauggauaucauuagccggcgcgaccagcgggguuccggccaggugggcaccuacggccugaacacguucaccaacauggaggcacagcugauacgccagauggagggggagggcgucuuuaagaauauccagcaccucacgguaaccgaggaggccgcggugcaaaacuggcuggcccggguagggcgggagcgccugagccggauggccaucuccggcgacgacugcguggugaagccccucgaugaccgauucgccaacgcccugacugcgcugaacgacaugggcaagauacggaaggacauccagcagugggagccaagcaagggguggaacgauuggacucaaguucccuucuguucccaccacuuccacgaacuaaucaugaaggacggaagagugcucgugguccccugccggaaccaggacgagcugaucgggcgcgcccggauuagccagggcgccggauggucccuccgcgagaccgccugucucggaaaaagcuaugcccagauguggucguugauguacuuucaccggcgcgaccuccggcuggcggccaaugccaucugcagugccguccccucccacuggguuccgacgagccgcacgaccugguccauccacgccaagcacgaguggaugacuaccgaggacaugcugaccgucuggaaccggguguggauccgcgagaaucccuggauggaggacaagacgcccgucgagagcugggaggagauucccuaccucgggaagcgggaagaccaguggugugggucccugaucggcuuaacgagucgcgcgaccugggccaagaacauucaggccgcgauuaaccagguccgguccuuaaucgggaacgaggaguauaccgacuacaugccgagcaugaagagauucagacgcgaagaggaggaggcgggcguccugugguga

SEQ ID NO: 24951 - RNA, 9876 nt, Artificial Sequence
  derived and/or modified CDS sequence (opt11) from DENV-2__GU131902__SS-prME
agcgcgggcaugaucaucauguuaauccccaccgugauggcguuccaccucaccacccggaauggggagccccacaugaucguaggcauccaggagaagggcaagagccugcuguucaagaccgaagacgggguuaacauguguacccucauggcgauggaccugggggagcugugugaggacacgauaaccuacaagugcccccugcugcgccagaacgagcccgaagacaucgacuguuggugcaacagcaccaguaccuggguuaccuacggcacgugcaccaccacuggcgaacauagacgggagaagcgaagcgucgcccugguuccccacguggggauggggcucgagacucggaccgaaaccuggauguccagcgagggggcuuggaagcacgcccagcgcaucgagaccuggauccuccggcacccaggcuucacgauaauggcagcaauacuggcuuacaccaucgggaccacccacuuccagaggguccuuaucuuuauccugcugaccgccguggcccccuccaugaccaugcgaugcauuggcaucagcaaccgggacuucguggagggcguguccgggggcucauggguggacauaguacucgagcacgguucuugugucacuaccauggcuaaaaacaagcccacgcuugauuucgagcugaucaagaccgaggcgaagcaaccggccacucuucggaaguacugcauagaggccaaauugaccaacacgaccaccgagagccgcugcccaacccagggcgagccgucccuaaaggaggagcaagacaagcguuucgugugcaagcacagcaugguggaccgcggcugggggaacggcugcggccuguucggcaagggcgggaucguuacgugcgccauguucacaugcaagaagaacauggaaggcaagauagugcagcccgaaaaccuggaguacacgaucguggucacgccccauuccggagaggagcacgcggugggcaacgacacugggaagcacggaauggaaaucaaggugaccccgcagucuuccaucaccgaggccgaguuaacggguuacggcaccgucacuauggagugcagcccgcggacgggccucgauuucaacgaaaugguguugcugcaaauggaaaacaaggccugguuagugcaccggcagugguuccuggaccugccccuccccuggcugccgggggcagacaagcaggaguccaauuggauacaaaaggagacccugguaaccuucaagaacccccacgccaagaagcaggacgucgucgugcucggaagccaggagggggcgaugcacacggcacugaccggcgccaccgagauccagaugagcagcgggaaccuccuguucaccggccaccugaaguguaggcuccgcauggacaaguugcagcugaagggcaugagcuacuccaugugcacagggaaguucaaggucgucaaggagaucgccgagacccagcacgggacgaucgugauccgggugcaguacgagggggauggaagccccugcaagauccccuucgagaucauggaccuagagaagcgcuacguccucggacggcugauuaccgugaauccgaucgugacggagaaggacucccccgucaacaucgaggcggagccgcccuucggggauaguuauaucaucaucggcguugagccgggccagcugaaacucaacugguucaaaaaaggcuccagcaucgggcagauguucgagaccaccaugcgcggcgcaaaacgcauggcaauacugggcgacaccgccugggacuucggaagucugggcgggguguucacgucgaucggcaaggcccuccaccaagucuuuggggccauuuauggcgcagcauucuccggggugagcuggaccaugaagauccuuaucggagugaucaucaccuggaucgggaugaacucccggagcacuucccugagcgucucccuggugcuuguggguaucguuacgcuguacuuaggcguuaugguucaagccgacagcgggugcgugguaucguggaaaaacaaggagcucaaaugcggcagcggcaucuuuaucacagacaacguacauaccuggaccgagcaguacaaauuccagccagagagcccguccaagcuggccagcgccauccagaaggcccaagaggaggggauuugcggcauccgcuccgucacgcggcuggagaaccucauguggaagcagaucacccccgaacugaaccacauccuggccgaaaacgaggugaagcucaccaucaugaccggggacaucaaggguaucaugcaggccgggaagcgcagccugaggccgcagcccacggagcugaaguacucuuggaagaccuggggcaaggccaagaugcucagcaccgaauccuacaaccagaccuuccucaucgacggcccagagacggcggagugccccaacaccaaccgggccuggaacagccuggagguugaggacuacggguuugguguauucaccaccaacaucuggcugaagcugaaggagaagcaagaugcauucugcgacuccaagcugaugucagccgccaucaaggacaaucgggcggugcacgccgacauggguuacuggauagaguccgcccucaacgacacguggaagaucgagaaggccaguuucaucgaggugaagaacugucacuggccgaaaucccacacccuguggagcaauggcguccucgaauccgaaaugaucauccccaaaaacuuagccggcccaguaagccagcacaacuaccgcccgggguaccacacccagaucgcgggccccuggcaccuggggaagcuggaaauggacuucgacuucugcgacggcacgacggugauagucacugaagacugugggaaccggggucccucccuccgcaccaccaccgcuagcggcaaacugaucgccgaguggugcugccggucgugcacgcuccccccccuccgcuaccgcggggaggacgggugcugguacgggauggaaauccggccacugaaggagaaggaggaaaaccuggucaacucccucguuaccgccggccacggccaggucgacaacuucagccugggggugcuggguauggcccucuuccucgaggagaugcugcguacccgcguggggaccaaacacgccauccuccuggucgccgucuccuucgugacgcugaucacaggcaacaugagcuucaaggaccucgggcgggugguggugaugguaggcgccaccauggccgacgacaucgggaugggcgugaccuaccucgcgcuccucgccgcguucaaggugcgccccaccuucgcggccggucugcugcucagaaagcugaccuccaaggagcugaugaugacaaccauugggaucguguuacuaagccaauccacgauccccgagaccguuuuagagcucaccgaugcauuggcccuggguaugauggugcucaagaucguccgcaacauggagaaguaccagcuggccgugacgaucauggccauccugugcgucccgaacgcggugauccuucagaacgcguggaaggugagcuguacgauucuggcugucguauccguaagccccuugcuccugaccuccagccagcaaaaaaccgacuggauccccuuggcccucaccauuaaggggcucaacccuacggccaucuuccugacgacccucagccggacuaacaaaaagcggagcuggccgcugaacgaggcgauuauggccguaggcaugguguccauacuggccagcucccuccugaagaacgacauccccaugacgggcccacugguggccgguggccuccugacagucugcuacguucugaccgggcgcucugcugaccucgagcuggaaagagcaaccgacgugaagugggaggaccaggccgagaucagcggcaguagccccauacuguccauaacgaucagcgaagacgggaguaugagcaucaagaacgaggaggaggagcagacccugacgaucuugauccgcaccggccuacucgugaucuccggccuguuccccaucagcauccccaucaccgccgccgcgugguaccugugggaggugaagaagcagcgggcggggguucucugggacguccccagcccgccgcccaugggcaaggccgagcuggaggacggggcauaccgcaucaagcagaaaggcauccugggguacagucaaaucggcgccgguguguacaaggaggggacuuuccauacaauguggcacgugacccggggcgcgguccucaugcacaagggcaagcgaaucgagcccuccugggcggaugucaagaaggacuuaaucagcuacggcggcggcuggaaacuggaaggcgaauggaaagagggggaagaggugcagguccuggcccuggagccaggcaagaacccccgggccgugcagaccaagcccgggcuguucaagacgaacaccgggaccaucggggcagugucccucgacuucucgcccggcaccagcgguagccccaucaucgacaagaaggggaaagucgucggucuguacggcaacggcguggugacgagauccggcgccuacguaucagcgaucgcccagaccgagaagaguaucgaggauaaccccgagauagaggacgacaucuuuagaaaacgucggcugaccaucauggaccuccaccccggggccggcaagaccaaacguuaucuccccgccaucgugcgggaagcgaucaagcgcggacugcgaacgcugauccucgccccgacccgcgucguggccgcugagauggaagaggcccugcggggccugccaauccgcuaucagaccccugcgauucgggcggagcauaccggacgugaaaucguggaccucaugugccacgccacauucaccaugcgccugcucucacccguccgggugccgaacuacaacuuaaucauuauggacgaagcccacuucacugaccccgccuccauagcggcacgcgguuacaucagcacccggguagagaugggcgaggcugccgggaucuucaugacggccacgccuccgggcagucgcgacccguucccccaguccaacgcgccgaucauagacgaggagcgggagaucccagagcgaagcuggaacuccggccacgagugggucaccgacuucaagggcaagaccguuugguuugugccgagcaucaaagccgggaacgacauagccgccugccugcgcaagaacgggaagaaggucauccaguugucccgcaagacguucgauagcgaguacgucaagaccagaaccaacgacugggacuucguggucacuaccgacaucuccgaaaugggggcgaacuucaaggcggagcgcguuaucgacccccgccgcugcaugaaacccgugauccucacugauggcgaggagcgggucauucuggccggcccaaugccagugacccacuccagugccgcacaacggcgggggcgcaucggccggaacccgaagaacgagaacgaccaauauaucuacaugggagagccacuggagaacgacgaagacugcgcgcacuggaaggaggccaaaaugcuacuggacaacauuaacacgcccgaaggcauaaucccgagcauguucgagccggagcgagaaaagguugacgccauagacggcgaauaccguuuacgcggggaagcgcgaaagaccuucgucgaccucaugcgccgcggcgaucugcccgugugguuggccuacaagguugcggccgaagggaucaauuacgccgaccggcgcuggugcuucgacggaaucaaaaacaaccagauccucgaggagaacguggagguggagaucuggaccaaggaaggggagcggaagaagcugaagccgcgcuggcuggacgccagaaucuacuccgaccccuuggcccugaaagaguucaaggaguucgcggcuggacgcaagucucugacccucaaccugauuaccgagaugggccggcugcccacguuuaugacccagaaaacccgcgacgcccucgacaaucuggccguccugcacacugcggaggccgggggccgggccuacaaccacgcccucuccgagcuucccgagacacuggagacacugcugcuucucacucugcuggccacagugaccggcgggaucuuccucuuccugaugagcgggcgcggaaucggcaagaugacccuggggaugugcugcaucauaacugcgucuauccuccugugguacgcgcagauccagccgcacuggaucgccgccagcaucauccuggaguucuuccucaucgugcugcugauccccgagcccgagaaacagcggacgccacaggacaaccagcucaccuaugucgugaucgccauacuaacgguggucgcggccaccauggcuaaugagaugggcuuccuggaaaagaccaaaaaggaccuuggccugggcuccaucgcaacccaacagccggagagcaacaucuuagacauagaccuaagacccgccuccgcguggacgcuguacgccguggccacgaccuuugugacccccaugcugcggcacagcaucgagaacagcucagugaacgugagccucacggccaucgccaaucaggccaccguguugaugggacuggggaagggcuggccucuguccaagauggacaucggggugccgcugcuggccaucggcugcuacagccaggugaaccccaucacccucaccgccgcccugcugcuccugguggcgcacuacgccauaauugggcccgggcugcaggccaaggccacgcgcgaggcccagaaacgggcggccgccgggaucaugaagaaccccacgguagacgggauaaccgugaucgaccuagaccccauccccuacgaccccaaauucgagaagcagcugggucaggugaugcucuugauccugugugucacacaggugcucaugaugcgcacaaccugggcccucugcgaagcccugacccuggcgaccgggccuaucuccacauuaugggagggcaaccccgggcgguucuggaacaccacuauagccguuucgauggccaacauuuuucgagguuccuaccuggccggcgcagggcuccucuucagcaucaugaagaacaccacgaacacacgucgcggcaccggcaacaucggcgaaacccugggcgagaaguggaaaucccgcuuaaacgcgcucgggaaguccgaguuccagauuuacaagaaguccggcauccaggagguggaccguacgcuggccaaagaaggaauaaagcgcggggagacggaccaccacgccgugagcagaggguccgccaagcugcgcugguucguagagcgaaacauggucacccccgagggcaaggugguggacuugggcugcgggcgcggcggguggagcuacuacugcggcgggcugaagaacgugcgggaggugaagggccugaccaaggguggacccggccacgaggagcccaucccaauguccacguacggguggaacuuaguccgccugcagagcggggucgacguauucuuuauuccgccagagaagugugacacccuucucugcgacaucggggagucuucaccaaacccgaccguggaagcgggcagaacccugcgcguccugaaccucguggagaacuggcugaacaacaacacgcaguucugcaucaaggugcugaaccccuacaugccguccguaaucgagaagauggaggcacugcagcggaaguacggcggggcccucgugcguaacccgcugagcagaaacagcacccacgagauguacugggugucuaacgccagcgguaacaucgucaguagcgugaacaugauaucccgcaugcugaucaaccgguuuaccaugagacacaagaaggcgaccuacgaacccgacguggaccucgggucaggcacccggaacaucgggaucgaguccgaaauccccaacuuagacaucaucggcaagcgcaucgagaagaucaaggaggagcacgagacgucauggcacuacgaccaagaccaccccuauaagacgugggccuaccauggaucuuacgagaccaagcagacagggagcgccaguagcauggucaacggagugguccggcugcucacgaagcccugggacguucugccuaccgugacgcagauggccaugaccgacacaacccccuucggccagcaacguguguucaaggagaagguugacacccgcacccaggagcccaaggaggggacgaagaagcugaugaagauaacagccgaguggcucuggaaggaguugggcaagaagaagaccccgcggaugugcacccgcgaggaguuuacgcggaaggugcgcuccaacgcagcgcuaggggcaaucuuuaccgacgagaauaaauggaaguccgcccgggaagccguggaagacucccguuucugggaguuggucgauaaggagcggaaccuucaccuggagggcaagugcgagaccugcguguacaacaugaugggcaagagggagaagaaguugggcgaauucgggaaggcaaagggcagccgggcgaucugguacauguggcuuggcgcccgcuuccuggaguuugaggcucuaggguuccugaacgaggaccauugguucagucgggagaacucccuuucaggggucgagggggagggccuccauaagcugggguacauacugcgcgacgugagcaagaaggagggcggcgccauguacgcggacgacacagccggaugggacacgcggaucacccucgaggaccugaagaaugaggagauggucaccaaucacauggaaggcgaacacaaaaaacuggccgaggccauuuucaaacucacguaccagaauaagguagugcgcgugcagcggcccacgccgcgagggaccgucauggacaucaucagccgucgcgaucagcgggggucuggccaaguggggaccuacggccugaacacguucacgaacauggaggcccagcuuauccgccagauggagggcgagggcguguuuaagaacauccagcaccugacugugaccgaggaggcggcggugcagaacuggcuugcaagaguggggcgugagcgccugagcagaauggccaucuccggugacgauugcguggugaaaccccuggacgaccgcuucgccaacgcgcugaccgccuugaaugacaugggcaagauccggaaggacauccagcagugggagccgagcaaggguuggaaugacuggacacaggugcccuuuugcucccaccacuuucacgagcugaucaugaaggacggccgcgucuuaguagugcccugcagaaaccaggacgagcugaucgggcgcgcacgaauuagccagggcgccggguggucccugcgggagacggccugccugggcaagagcuacgcgcaaauguggucccuuauguacuuccaccggagagaucuccggcucgcggccaacgccaucugcagcgccgugcccucccacugggugccgaccagccgcaccacgugguccauccacgccaaacacgaguggaugaccaccgaagacaugcuuacuguguggaacagggucuggauucgcgagaacccuuggauggaggacaagacccccguagagaguugggaggaaaucccauaccucggcaagagggaggaccaguggugcggcucccugaucggccugacgucccgcgccaccugggcgaagaauauccaggcggcaaucaaccaaguacgcagucucaucgggaaugaggaguacacggacuacaugccaucaaugaagcgcuuccggcgcgaggaagaggaagccggcguccugugguaa

SEQ ID NO: 24952 - RNA, 9876 nt, Artificial Sequence
  derived and/or modified CDS sequence (opt11) from DENV-2__GU131924__SS-prME
agugcaggaaugaucaucaugcugauccccacugucauggccuuccacuugaccacccggaacggagaaccccacaugauugucggcauacaggagaaagggaagucccuuuuguucaagaccgaagauggcgugaacaugugcacuuugauggcgauggaccuaggggaacugugcgaggauaccaucaccuacaagugcccccuauuacgacagaacgagcccgaggacauugacugcuggugcaacucuaccaguaccugggugacauacggaacgugcaccacuaccggcgaacauagaagggagaagcgcagcguggcccucgugccccacgugggaaugggccucgagacccggaccgagacguggauguccagcgagggggccuggaagcaugcucagcgcaucgagacuuggauucugcggcacccgggcuucaccaucauggccgcgaucuuagccuacaccaucgggacaacccacuuccagcgcguccugaucuucauccuguugacggcugucgccccuuccaugaccaugcggugcaucggaaucuccaaucgcgacuucgucgagggcgucuccgggggcagcuggguggacaucgugcucgagcacgggaguugcgucaccaccauggcgaagaacaagcccacucuggauuucgaacuuaucaagaccgaggcgaagcaacccgccacccuaagaaaauauugcaucgaggcaaagcugaccaauacgacuaccgagagucggugcccaacucagggcgagcccucgcucaaggaggagcaggauaagcgguucgucugcaagcacagcaugguggaccgcggcugggggaauggcugcggccuguucggcaagggagggauugucacgugugccauguucacuuguaagaagaacauggagggcaagaucgugcagccugaaaaccuggaguacacaaucguggugacgccccacucaggggaggagcacgcggucgggaaugacacggggaagcauggcauggaaaucaaggugaccccgcagagcagcaucaccgaggccgagcugaccggguacggcacagucacgauggaguguagcccacggaccggucucgacuuuaacgagaugguacuacuccagauggagaacaaggccuggcucgugcaucgccaaugguuccuggaccuuccccucccguggcugccgggagccgacaaacaggaauccaacuggauccaaaaggagacgcuggucacguuuaagaacccccacgcaaagaagcaggacguugucgugcucggcagccaagagggggccaugcacacggcccucaccggcgcaacugaaauccagaugagcuccggcaaccuccuguucaccggccaccugaagugcagacuccgcauggauaaacuacaacugaagggcaugagcuauuccaugugcacggggaaauucaaggugguaaaggagauugccgagacccagcauggcaccaucgugauccgggugcaguacgaaggcgauggcagucccuguaaaauuccguucgagaucauggacuuggaaaagagguacguccuuggccgccugauaaccgugaauccgauagugacggagaaggacucuccgguaaacaucgaggccgagccccccuucggggacaguuacaucaucauagggguggaaccugggcagcugaagcucaacugguucaagaagggcuccucaauugggcagauguucgagaccacgaugaggggcgcgaaacggauggccauccugggcgacaccgccugggacuuuggcucccugggcgggguuuuuaccagcaucggcaaggcccuccaccaggucuuuggggcaaucuacggggcggcuuucaguggcgugagcuggacgaugaagauccucaucggggugauaaucacguggaucggcaugaacucccggagcaccucacugagcgucucgcugguacucguuggcauagucacgcuguaccugggcgugauggugcaggccgacuccgggugugucguguccuggaagaauaaggagcucaagugcggcagcggcauuuucaucaccgauaacgugcacacguggaccgagcaguacaaauuccagccugaaagccccuccaagcuggccagcgccauccagaaggcucaggaggaggggauuugcggaauucgcuccgucacgcggcuggagaacuuaauguggaagcagaucacccccgagcuuaaccacaucuuagcggaaaacgagguaaaguugaccaucaugacaggagacaucaagggaaucaugcaggccggaaagaggagccugcguccacagcccacggagcugaaguacucauggaaaaccugggggaaggccaagaugcugagcaccgaguccuacaaccagaccuuuuuaaucgacggccccgagacggcggagugcccgaauacgaaccgcgcguggaacagccuggaaguggaggacuauggguucggggucuucacuaccaacaucuggcucaagcugaaagagaaacaggacgcguuuugcgacuccaagcugaugagcgccgcuaucaaggacaaucgagcagugcaugccgacauggguuacuggauagaguccgcguugaacgacacguggaagaucgagaaggccaguuuuaucgaagugaagaacugccacuggcccaaaucucacacccucuggucgaacggcguccuugaguccgagaugauaauucccaagaaccucgccggccccgugucacagcacaacuaccgcccgggguaccacacucagaucgcgggcccauggcaccuggggaaacuggagauggauuucgacuucugcgauggcaccaccgugaucguuacagaagacugcgggaaccggggccccagcuuacgcacuaccaccgccagcggcaagcugauuacugaauggugcugccgaagcugcacacugcccccgcuccgcuaccgcggggaggacgguugcugguaugggauggagauacgcccccugaaggaaaaggaggaaaaccuggugaacucccucguuaccgccggccacgggcagguugacaacuucagccugggggugcugggcauggcccucuuccuggaggaaaugcugcggacccgcguggggacaaagcacgccauucuccucgucgccguguccuuugugacccugaucacuggcaacaugucguucaaagaccucgggcgagucgugguuaugguaggagccaccauggcagacgacaucgggaugggcgugaccuaccuggccuuacucgcggccuucaaagugcgucccaccuucgccgcgggccuacugcugcggaaguugacauccaaagaacugaugaugaccacgaucggcauugugcuccucagccaguccacaauccccgagaccgugcuggagcucacagacgcacuggcucugggcaugaugguucucaaaaucguccgcaauauggagaaguaccagcuggccgugacgaucauggccauucugugugucccgaacgcagugauucuccagaacgcguggaaggugucaugcaccauccucgcggugguguccgugagcccguugcuucugacaucgagccagcagaaaacggacuggaucccccuggcccuaacgaucaaggggcugaacccuaccgccaucuuccugaccacccucucccgcacgaacaagaagcggaguuggccucucaacgaagcgaucauggcggucggcaugguuaguauccuggccucuucccucuugaagaacgacaucccgaugaccggcccccugguggccgguggccuccugacggucugcuacgugcugaccgggcgcagcgccgacuuagaacuugagcgggcuacggacgugaaaugggaggaccaggcggagaucucgggcagcagccccauccuauccaucaccauuagcgaggacgggucaaugagcaucaaaaacgaagaggaggagcagaccuugacuauucuuauccgcacuggccuguuaguuaucuccggccuauuucccauuagcauccccaucaccgccgccgcgugguaccugugggaggugaagaaacagcgugccgggguccuuugggacguccccucaccgccgcccauggggaaggcggaguuggaggacggcgcguaucgcaucaagcagaagggcauccugggcuacucacagaucggcgccggcguguauaaggaagggaccuuccacaccauguggcacgugacccggggcgcuguguuaaugcacaaagggaagcggaucgagcccuccugggccgacguaaagaaggaccucauaucguacggcgguggcuggaagcuggagggugaauggaaggagggggaggaggugcagguccuugcgcuagagcccgguaagaacccccgcgccgugcaaacgaaacccgggcuuuucaagacgaauaccgggacuaucggggccgugucccucgauuuuucacccggaacgucaggcagcccuaucaucgacaagaaggggaaggucguggguuuguacgggaauggcguggugacccgcuccggcgccuacgugagcgccaucgcgcagacugagaaguccaucgaggacaaccccgaaaucgaggacgacaucuucagaaaaagacggcugaccauaauggaccugcaucccggggccggcaagacgaagcgcuaccucccagcaauugugcgggaggccauuaagagagggcugcggacccugaucuuagccccuacccgcgugguggccgccgaaauggaggaggcucugcgggggcugcccauucgauaccagacucccgccauccgagcggagcacacgggucgcgagaucguggaccuuaugugccacgccaccuucaccaugcgccugcugucgccugugcgagugccgaacuacaaccucaucaucauggacgaggcccacuucaccgaccccgccuccauagccgcgcgcgguuauaucucgacgcggguggagaugggcgaagccgccgggaucuucaugaccgccacgccgccuggaagccgcgauccguucccccaguccaaugcccccaucaucgacgaggagcgggagaucccagaacgcagcuggaacuccgggcacgaguggguuacggacuucaagggcaagacggugugguucgugccgagcauuaaggcgggaaacgacaucgccgcuugccugcggaagaacggcaagaaggugauccagcuauccaggaagaccuucgacagcgaguacgugaagacccggaccaacgacugggacuucguggucacgaccgacauaagcgaaaugggcgcaaacuuuaaggcggagcgcguuauugacccccggcgcugcaugaagcccguaauauugacggauggggaggaacgggucauccuggccggccccaugccgguaacccauaguagugccgcccagaggcgggggcgcaucggccgcaaccccaagaacgagaaugaccaauacaucuacaugggggagccccuugaaaacgacgaggacugcgcccacuggaaggaggccaagaugcuccucgacaacaucaauacgcccgagggcaucaucccgagcauguucgagcccgagagagagaagguagacgcuaucgacggcgaguaccggcugcggggggaggcacgcaagaccuucgucgaccugaugcggagaggggaccuaccuguuuggcuggcguacaagguggcugcggaggggaucaacuaugccgaccggcgcuggugcuuugaugggaucaagaacaaccagauccucgaggagaacgucgagguggagaucuggaccaaggagggggaacggaagaagcugaagccucgcuggcuggacgcaaggaucuacuccgauccccucgcccugaaggaguucaaggaauuugccgcgggccgcaagagccugacccucaaccugaucacggagaugggccggcugcccaccuucaugacgcagaagacccgcgacgcacucgauaaccuggccguccugcacacagccgaggccggcggucgggcuuacaaccacgcacucuccgaacugcccgagacgcuggagacccuccuccuguugacccugcuggccacggugacuggggggaucuuccucuuccuuaugagcggccgcgggaucggcaagaugacccugggaaugugcugcauaauaaccgcauccauccuccugugguacgcgcagauccagccgcacuggaucgcggccagcauaauccuggaguucuuccucauagugcugcugaucccggagccggagaagcaacguacgccccaagacaaucagcucacauacguagugaucgccauccuaaccgucgucgccgcgaccauggcaaaugagaugggcuuccuggagaaaaccaagaaggaccucggucuaggcuccaucgcaacgcagcagccggagagcaauauacuggacaucgaccuccgcccugccagugccuggacccuguacgcgguggccacuaccuucgugacacccaugcugaggcacuccaucgagaacagcagugucaaugugagccucaccgcgaucgccaaccaggccaccgugcugaugggccugggaaagggcuggccacucuccaagauggacaucggggucccguuguuagcgaucggaugcuacagccaggugaaccccaucacguuaaccgccgcccugcugcuccuaguggcacacuacgcaauuaucgggcccggccuccaagcaaaagccacccgugaggcccagaaaagggcagcggccggcaucaugaagaaccccaccgucgacgggauuacggugaucgauuuagacccgauccccuacgaccccaaguucgagaagcagcugggccaggugaugcuacuuauccuaugcgucacccagguuuugaugaugcgcacaacgugggcccucugugaggcccugacuuuggccacggggccuaucuccacucucugggaaggcaacccgggaagguucuggaacacgaccauugcggugagcauggccaauaucuuccgcggcuccuaccuggcaggcgcagggcuccucuucagcauuaagaagaacacgaccaacacccguaggggcacggggaauaucggcgagacgcugggcgagaaguggaagucccgccugaacgcgcucggaaaauccgaguuccagaucuauaagaaguccggaauccaggaggucgaccggacccuggcgaaggagggaaucaagcgcggcgagacggaccaccacgccgugagccgggggucggccaagcuccgcugguucguggagcggaacauggucacacccgaggguaaagugguggaccucggcugcggacgcggcgguuggagcuauuacugcggcgggcugaagaacguccgggagguuaagggccugacgaagggagggccuggccacgaggagcccauaccuauguccacuuauggguggaaccucgugcgccuucagaguggugucgacguauuuuucaucccgcccgagaagugcgacaccuugcuaugcgacaucggggagucuagcccaaacccaaccguggaagccgggcguacgcugagaguacugaaccucguugagaacuggcugaacaacaacacgcaguucugcauaaagguccugaaccccuauaugcccucggucauugagaagauggaggcgcugcagcggaaauacggcggagcucuagugcgcaacccccugagccggaauucuacccaugagauguacuggguguccaacgccagcggcaauaucgucuccagcgugaacaugaucucccggaugcugaucaaccgguucaccaugcgccauaagaaggccacguacgagcccgacguggaucucggcagcggcacucguaauauugguauugagagcgagauccccaaccuagacauaauuggcaagcguaucgagaagaucaaggaagaacaugaaaccagcuggcacuacgaccaggaccacccguacaaaaccugggcuuaccauggguccuacgagaccaagcagaccgggagugcguccagcauggucaacggaguggugcgguuacucacgaagccgugggacguccugcccaccgugacccagauggccaugaccgauacgacccccuucgggcagcagcgcguguuuaaggaaaaggucgauacccgcacccaggagcccaaggagggcacaaagaagcugaugaagaucaccgccgaguggcucuggaaggagcugggcaaaaaaaaaaccccucgaaugugcacgcgcgaggaguucacccggaaggugcgauccaacgccgcccugggggcgauauucacugacgagaauaaguggaaguccgcacgggaggccguggaggacucccgcuucugggaacucgucgacaaggagcggaaucugcaccuggagggcaagugcgagaccuguguguacaacaugauggggaagcgcgagaagaagcugggcgaguucggcaaggcaaagggcagccgggcgaucugguauauguggcucggcgcccgguuccuggaauucgaggcccucggguucuugaacgaggaucacugguucucccgggagaacagccuguccggcgucgagggggagggacuccacaaacugggguacauccugcgcgacgugagcaagaaggaaggcggcgccauguacgccgacgacacggcggggugggauacacggaucacccucgaagacuuaaagaacgaggaaaucgugacuaaccacauggaaggcgagcacaagaagcuggccgaagccaucuucaagcucaccuaccaaaacaaagucgugcggguacaacgccccacgccacgcgggacggucauggacaucaucagccgccgcgaucagcggggauccgggcaaguugggacuuauggccugaacacguucaccaacauggaggcucaacugauccgccagauggaaggggagggaguguucaagaauauccagcacuugaccgugaccgaggaggccgcggugcagaacuggcuggcccggguggggcgggagcgccugagccgaauggccauuuccggcgacgacugcgucgugaagccccucgacgacagguucgcaaacgcacuaacggccuuaaacgacauggggaagauccggaaggacauucagcagugggagccgagcaagggguggaacgacuggacucaagugcccuucugcagccaccacuuucacgagcucaucaugaaggacggacgcguucuugugguccccugcagaaaucaggacgagcugaucgggcgcgcgcguaucucccagggcgccggguggucccugcgcgagaccgcgugccuggggaagagcuacgcccagauguggucacugauguacuuccaccgacgcgaucuccggcuugcggccaacgccaucuguucagcuguucccucccacuggguucccacgagccguacuaccugguccauccaugccaagcaugaauggaugaccacagaggauaugcuuaccguguggaaccgggucuggauacgcgagaacccauggauggaggacaaaacgcccguggaaucgugggaagagauaccauaucucgggaagcgggaagaccaguggugcgggucccugaucggacugaccagccgagcgaccugggcaaagaacauccaggcugccauaaaccaggugcggucccucauugguaacgaggaguacaccgacuacaugccaaguaugaagcgcuuccggcgggaggaggaggaggcuggcgugcuaugguga

SEQ ID NO: 24953 - RNA, 9876 nt, Artificial Sequence
  derived and/or modified CDS sequence (opt11) from DENV-2__GQ868638__SS-prME
uccgccgggaugauuauaaugcugauccccaccguuauggccuuccaucucaccacccggaacggggagccgcacaugaucgucggcauccaggagaaggggaagucccugcuguuuaagaccgaagacggcgugaauaugugcacccucauggcgauggaccugggggagcugugcgaggacaccaucaccuacaaguguccccuucugcggcagaacgagcccgaggacaucgacugcuggugcaacagcaccuccaccugggugacauacgggacauguacaaccacaggcgagcaccgcagggagaagcgcucagucgcccuggugccccacgugggcaugggccucgaaacgcgaaccgagacuuggauguccucagagggggcguggaagcacgcccagcgcaucgagaccuggauccugcggcaccccggcuucacaaucauggccgcgauccuggccuacaccaucgguaccacccacuuccagcgagcccucauuuucauucugcugaccgcagucgcaccauccaugaccaugcggugcaucggcaucagcaaccgcgacuuuguggagggcguguccgguggcagcuggguugacaucguccucgagcacgguucuugcgugaccaccauggccaagaauaagccuacgcucgacuucgagcucaucaagaccgaggccaagcagcccgccacccuccggaaguacugcaucgaggccaagcuaacuaacacgaccacagagucucgguguccgacccagggcgagcccucccugaaggaggagcaggauaagcguuuugucuguaagcacucaaugguggaccgcggcugggguaacggcugcggccuguuuggcaagggcgggaucgugacgugcgcgauguucacaugcaagaagaauauggaaggcaagaucguccagcccgagaaccuggaguacaccauuguggugacaccccauuccggggaggagcacgccgucggcaacgacacggggaagcauggcaaggagaucaaggugacuccucagagcuccaucaccgaggccgagcuaaccggguacggcaccgugacgauggagugcagcccgcgaacgggccucgacuucaacgagauggugcugcugcagauggagaacaaggccuggcuagugcaccgccagugguuccuagaucuaccucucccuuggcugccuggggccgauaaacagggcuccaacuggauucaaaaggagacucuggugaccuucaagaacccccacgcgaagaaacaggacguugugguacucgggagccaggagggcgcgaugcacacagcgcugaccggggccaccgagauccagaugucauccggcaaccuccucuucaccggccaucugaaaugccggcugcgcauggacaagcuccagcugaaggggaugagcuacuccaugugcacgggcaaauucaagguagugaaggagaucgcggagacccagcaugggacuaucgucauucggcugcaguaugaaggcgacggcucccccugcaagauccccuuugagauaauggaccuggagaagcgcuacgugcuggggcggcugaucaccgugaacccgaucgucacggaaaaggauucccccgugaacauagaggcggaaccgcccuucggcgacaguuacauaauaaucgggguggaaccgggccagcucaagcugaacugguuuaagaagggguccagcaucggccagauguucgagaccaccaugcgcggugccaagcgcauggccauccugggggacaccgccugggacuucggcagccuaggcggcgucuucacgucgguggggaaggcgcugcaccagaucuuuggcgcgaucuauggcgccgccuucuccggagucucauggaccaugaagaucuugaucggaguaaucaucacauggaucgggaugaauucucggagcaccagccugagcgugucccucguucuuguugguaucgugacgcuguaccucgggguuaugguccaggccgacucagguugcguggugucuuggaaaaacaaggagcugaagugcggcagcgggauauucaucacagacaacgugcacaccuggaccgaacaauacaaguuccaaccagagaguccuucaaagcuagcgucggccauccagaaggcccaggaggaggguaucugcgggauuaggucugugacucggcucgagaaccuuauguggaaacagaucaccccagagcugaaucacauccucgccgaaaacgaggugaagcugaccauuaugaccggcgacaucaaggggaucaugcaggccggcaaacgcagucugcggccgcaacccacggaacuaaaguacucuuggaagacuuggggcaaagcgaagauguuaagcaccgaaucccacaaucagaccuuccugaucgacggucccgagacggccgagugcccgaacaccaaccgcgccuggaauagccuugaaguugaggacuacggcuuugggguguuuacgaccaacaucuggcugaagcugaaggagaagcaggacgccuucugugacucaaagcucaugagcgccgcgaucaaggacaaccgugcggugcacgccgacaugggguacuggaucgaguccgcacugaaugacacguggaagaucgagaaggccagcuucauagaggucaagaacugccacuggccuaagucccacacccuguggagcaacggagugcuagaguccgagaugaucauccccaagaaccuggcggggcccgugagccaacacaauuaccgaccgggcuaccacacucaaaccgcagggcccuggcaccugggcaaacucgagauggacuuugauuucugcgacgggaccacggucauugugacggaagacugcggcaaucggggccccucccugcgcacaaccacggccagcggcaaacucaucaccgaguggugcugccgcagcugcacgcucccgccccugcgcuaucggggagaggaugggugcugguacgggauggagauccgcccccugaaggagaaggaagagaaccucgugaacucccuggucaccgccgggcacggccagguggacaacuucagccugggcguguuagggauggcgcucuuccuggaagagaugcuacggacgcgcgucggcaccaagcacgccauccugcugguggccgucuccuucgucacccucauuaccgguaauaugagcuucaaggaccugggccgagugguggucauggucggggccacuaugaccgacgacaucggcaugggcgugaccuaccuggcccuccuggcggccuucaagguccgccccaccuucgcagccgggcugcuccucaggaagcugacgucaaaggagcucaugaugaccaccauuggaaucguucuuuuaagccaguccaccauucccgagacgauucucgagcugaccgacgcccuggcgcucgggaugauggugcugaagaucguccgcgacauggagaaguaccaacuggccgugaccaucauggccauccucugcguacccaaugccgucaucuuacagaacgccuggaaggugaguugcaccauacuggccgucguguccgucagccccuugcugcuaacuuccagccagcagaagaccgacuggauaccccucgccuugaccaucaagggccugaaccccaccgccaucuuccucacgacccugucccgcacgaacaagaagaggucguggccgcugaacgaggccaucauggcgguuggcaugguaaguauccucgccagcucccugcugaagaacgacauucccaugacaggacccuugguggcaggcgggcugcugaccgucugcuacguguuaacgggccgaagcgccgaccucgaguuagagcgagcgaccgacgugaagugggaggaccaggcggagaucucggggucuaguccaauucucuccaucaccaucagcgaggacggaagcaugucuaucaagaacgaggaggaagaacaaacacugacgauuuuaauucgcaccggccuuuuggucaucuccggucuguucccggucagcauccccaucaccgccgccgccugguacuuaugggaggugaagaagcaacgggccggcguacugugggacguaccaagcccgccgcccauggggaaagcggagcuggaagacggggccuaccgcaucaagcagaaggggauccucggcuacagccagaucggcgccgggguguacaaggaggguacauuccacaccauguggcaugucacgcgcggggcugugcugaugcacaagggcaagcgcaucgagccguccugggccgacgugaagaaggaccugaucaguuacgguggcgguuggaagcuggagggggaguggaaggaaggagaggaaguccagguguuagcgcucgaaccuggaaagaacccccgugccgugcagacgaaacccggcuuguucaaaaccaacacggguaccaucggcgccguaucccuggacuuuagcccgggcaccuccggaucuccgaucaucgacaagaagggcaaggugguggggcuguacggcaacggcgucgugacccgguccggcgccuacguuagcgccauagcgcagacggagaaguccaucgaggauaaucccgagaucgaggacgacaucuuccggaagcgcagacugaccaucauggaccuacacccaggcgcggggaagaccaagcgcuaccugcccgccaucguccgggaggccaucaagagaggccugcgcacccucauucuggcgccgacgcgcgugguugcagccgaaauggaggaggcccuccgugggcuacccauccgcuaccagacccccgccauccgggcggagcacaccggccgcgagaucgucgaucugaugugccacgccaccuucacgaugcgccugcucagccccgugcgggugccaaacuacaaccugaucaucauggaugaggcacacuucaccgaccccgccagcaucgccgcgcgaggcuacaucagcacccgggucgagaugggggaggccgccggcaucuuuaugaccgccacgccccccgggagccgcgauccauucccccagucaaacgcccccaucauagacgaagagcgggaaauccccgagcguucguggaacagcggccaugagugggugaccgacuuuaaagguaaaaccgugugguucgucccgagcauaaaggcgggaaacgacauugcggccugccuccggaagaacggcaagaagguuauccaacucucucgcaaaaccuucgacagcgaguacguuaagacgcggaccaacgacugggacuuuguugugaccaccgauaucuccgaaaugggggccaauuucaaggcggaucggguaaucgacccccggcgcugcaugaagccagucauccugacggacggggaggagcgaguaauccuggccgggcccaugccggugacgcauucauccgccgcccaacgccguggccgcaucggcagaaaccccaagaacgaaaacgaccaguacaucuacaugggcgaaccacuggagaacgacgaggacugcgcccauuggaaggaggcgaaaaugcugcuggacaacaucaacacccccgagggcaucaucccgagcauguucgagcccgaaagagagaaggucgacgccauagacggggaguaccggcuccguggcgaagccagaaagaccuucguggaccugaugcggcgcggggaccuucccguguggcucgcguacaaggucgcugcugagggcauuaacuaugccgaccggcgcugguguuucgacgggaucaagaacaaccaaauccuggaagagaacguggagguggagaucuggacgaaagagggcgagcggaagaaguugaagccuagauggcucgacgcccggaucuacuccgacccguuagcgcuuaaggaguucaaggaguucgccgcuggacggaagagccucacccugaaccugaucaccgagaugggcagauugcccaccuucaugacgcagaagacccgcgacgcccuggauaaccuggccguacuacacaccgccgaggcgggugggcgggccuauaaccacgcucuguccgagcugcccgaaaccuuagagacgcugcugcuccugacacugcucgcaacggucaccggcgggauauuccuguuccugaugagcgggcgcggcaucggcaaaaugacccucggcaugugcugcauaauaacggccuccauccugcugugguacgcgcagauccagccgcacuggaucgccgcgagcaucauacucgaauuuuuccugauaguucugcugauucccgaacccgagaaacagcggacaccgcaggacaaccagcugaccuacguggugaucgccauccugaccgucguagccgcgacaauggccaacgagaugggguuccuagagaagaccaagaaggacuugggccugggcuccaucgccacccagcagcccgagucgaacauccucgacaucgacuugcgccccgcaagugccuggacccuguacgcgguggccacgacauucgucacccccaugcuccgccacagcaucgagaacucguccgucaacguuagccugaccgcgaucgccaaccaagcgacggucuugaugggacucggcaagggguggccccuguccaagauggacauaggcguaccucugcucgcgauagggugcuacucacaggugaauccuaucacccugaccgccgcccugcugcugcucgucgcccauuacgcgaucaucggcccuggccuccaggcaaaggcaacccgcgaggcccagaaacgggcugcggccgggaucaugaagaaccccacaguugacgguaucaccgugaucgaccuggacccgaucccguacgacccuaaguucgagaaacagcuggggcagguuauguugcugauacugugcgugacccagguguuaaugaugcgcaccacgugggcacugugcgaggcccugacccucgccaccggccccaucuccacccugugggaggggaacccgggccgguucuggaacacgacuaucgcggucagcauggccaacaucuuccgcggcucauaucuggccggggccggccuccuguuuagcaucaugaagaacaccaccaacacacgacgaggaaccggcaacaucggcgagacgcugggugagaaguggaagagccgccucaacgcccuggguaagucagaguuccagaccuauaagaaauccggaauccaggagguggaccguacguuagcgaaggagggcauuaaacgcggggagacggaccaucacgcugugagccggggcuccgccaagcuacgcugguucguugagcggaacauggugacccccgagggcaaggugguugaccugggcugcggacgagggggcuggagcuacuacugcgggggccugaaaaacgugcgggaggugaagggccucaccaagggcgggcccgggcacgaggagcccaucccgauguccacguacgguuggaaucuagugcgccugcagagcggggucgacguguucuucaucccgccugaaaagugcgacacccuccugugcgacaucggugaguccagccccaacccgaccgucgaagccggccggacccugcgcgugcucaaccugguagagaauuggcugaacaacaacacucaguucugcaucaaggugcuuaaccccuacaugcccuccgugaucgagaagauggaggcucuccagcggaaguacggaggcgcccuggugcgcaacccguuaagcagaaacagcacucaugagauguacugggucuccaacgccagcgggaacaucguguccuccgugaacaugauaucccgcaugcuuaucaaucgguucacuaugcgccauaagaaggccaccuaugagccagacguagacuuaggcagcggcacccggaacaucgguaucgaguccgaaauuccuaaccuggacaucaucggaaagaggaucgagaaaaucaagcaagaacacgagaccucuuggcacuacgaccaggaucaucccuacaagaccugggccuaccaugguuccuacgagaccaagcaaacaggcagcgcauccagcauggugaacggggugguccggcuccuaacaaagccgugggacgugcugcccaccgugacccagauggccaugaccgacacuacucccuucgggcagcagagggucuucaaagagaagguggauacacgagcccaggagcccaaggagggcacgaaaaagcucaugaagaucacagccgaguggcuguggaaagagcugggaaaaaagaagaccccgcggaugugcacccgcgaggaguucacaagaaaggugcgauccaacgccgcgcucggagccaucuucacggacgagaacaaguggaaguccgcacgggaggccgucgaagacucucgcuuuugggaauuaguggacaaggaacggaaccugcaccucgaggggaagugcgagaccuguguguacaacaugaugggcaagcgggagaaaaaguuaggggaauucggcaaggcaaaagguagcagggcgauaugguacauguggcugggcgcuagguuccucgaauucgaggcccugggcuuucugaacgaggaccacugguucucgcgggagaacagccucuccggggucgagggcgaggggcugcacaagcugggcuacauccuccgcgacguaucuaaaaaggagggcggggcgauguacgcagaugacaccgccgggugggauacccggaucacgcuggaggacuugaagaacgaggagauggucaccaaccacauggagggggaacauaaaaaacucgccgaagccauauucaagcugaccuaucagaacaaagugguacgcguccagcgccccacgccccgcggcaccguuauggacaucaucagcagacgcgaccagcggggguccgggcaggugggcaccuauggucuuaacaccuucacgaacauggaggcgcaacucauucgccagauggagggugaggggguuuucaggaacauccagcaccugacugcgacggaggagguggccgugcagaacuggcuggcccgagucgggcgcgagcggcucagccgcauggccauuuccggugacgacugcguggugaagccccucgacgaccgguucgccaacgcccugacggcccucaacgacauggguaagauucgcaaggacauccagcagugggagcccagcaaaggcuggaacgacuggacacaggucccuuucuguagucaccauuuucacgaguugaucaugaaggacgggagagugcuggugguccccugccgcaaccaagacgagcucauaggccgggcacgcaucagccagggggccgguuggucccugcgggagaccgccugccugggcaaaagcuacgcgcagauguggucccucauguacuuucacaggagggaccugcgccuggccgcgaacgccauaugcagcgccguccccucacacugggugccgaccagccggaccaccugguccauccaugcgaagcacgaguggaugaccaccgaggacaugcucaccgucuggaaccgcguguggauccgggagaacccuuggauggaggacaagacccccguggagucuugggaagagauccccuaccuggggaagcgcgaggaccaguggugcggcucccugaucgggcucaccagccgggccaccugggccaagaauauccaggccgcgaucaaccagguucgcagccugaucggcaacgaggaguacaccgacuacaugccgagcaugaagcgguuccgccgcgaggaagaggaggccggggugcugugguag

SEQ ID NO: 24954 - RNA, 9876 nt, Artificial Sequence
  derived and/or modified CDS sequence (opt11) from DENV-2__GU131927__SS-prME
uccgcuggcaugauaauaaugcugaucccgaccguuauggcauuccaccucacuacccgaaacggggagccccacaugaucguaggcauccaggagaagggcaagagccugcuauucaagaccgaggacggggugaauaugugcacccugauggcgauggaccugggggagcugugcgaggauaccaucaccuacaagugcccccuccugcggcaaaacgagcccgaggauaucgacuguuggugcaacagcacaagcaccugggugaccuaugggacgugcaccaccaccggcgagcaccggcgggagaagcgcagcgucgcccucgugccccacguggguaugggccucgagacgcggaccgagaccuggaugagcagcgaaggggccuggaagcaugcccagcgcauugagaccuggauucugcggcacccaggauucacgaucauggcagcgauccuggccuacaccaucgguaccacccauuuccagagggcccucaucuucauccugcugacggccgucgcgcccuccaugaccaugcgguguaucggcaucagcaaccgcgacuucguagaggguguguccgggggcagcugggucgacaucgugcucgagcacggguccugugugaccaccauggcucggaacaaaccaacgcuggauuucgagcugaucaagaccgaggccaagcagccggccacacuccgaaaguacugcaucgaggccaagcugaccaacacuaccaccgaaagccggugccccacucagggcgaacccucccuaaaggaggagcaagacaagcgcuucgugugcaagcacagcaugguugacaggggcugggggaacggcugcggacuguucggcaagggcggaaucgucacgugcgcuauguucacgugcaaaaagaauauggagggaaaaauuguccagcccgagaaccuugaguauaccaucguggugacgccccacucaggggaggaacaugccguaggcaaugacacggggaagcacggcaaagagaucaaggugaccccgcaaagcuccaucaccgaggccgagcugacuggguacggcacggucacgauggaaugcagcccccgcaccggccucgacuucaacgagaugguccugcugcagauggagaauaaggccuggcuagugcacagacagugguuccuggaucugccccuccccuggcucccaggggcagacaaacaggaguccaacuggauccagaaggaaacccuggugacguucaagaauccucaugcgaagaagcaggacgucgucguccucggcagccaggagggggccaugcacacggcgcugaccggcgccacagagauucaaaugagcuccgggaaccugcuguucaccgggcaucugaagugccggcugcggauggacaaacuccaguuaaagggcauguccuacaguaugugcacggggaaguucaaaguagugaaggagaucgccgagacacagcacggcaccaucgucauccgcgugcaauaugagggggacggcucucccugcaaaauccccuucgagaucauggacuuggagaagcgauacgugcucggccgccugaucaccgucaacccaaucgugacggaaaaggacuccccggugaacaucgaggcggagccgcccuucggggacucuuacauaauuauaggcguggaaccggggcagcugaagcucaacugguucaagaagggcuccagcaucgggcagauguucgagacuaccaugcggggcgccaagcgcauggcgauccugggcgacacggccugggacuuuggcucccugggcggcguuuuuacgagugugggcaaggcccuccaccaggucuucggggcaaucuacggcgccgccuucuccggggugagcuggaccaugaagauccugaucggcgugaucaucaccuggaucggcaugaacucccgcucgaccucccuguccgugucccuggugcuggugggcaucguuacacuguaccugggcgugauggugcaggccgacagcggcugcguggugucuuggaagaacaaggagcuuaaguguggcagcgggauuuucaucaccgacaaugugcacaccuggaccgagcaguacaaguuccagcccgagagucccucaaaacuggcgagcgccauccaaaaggcccaggaggaggggaucuguggaauccgguccgucacgcgcuuggagaaccucauguggaagcagauaacccccgagcucaaccacauccuggccgagaacgaggugaaacucaccauaaugacuggggacaucaagggcaucaugcaggccgggcggcgcagccugcggccgcagcccacggagcugaaguacuccuggaagaccuggggcaaggcgaagaugcucagcacugagucuuacaaccagaccuuccuaaucgacggacccgagacgaccgaaugcccgaacgccaaccgcgcguggaacagccuggaaguggaggacuacggguuuggcgucuucacgaccaacaucugguuaaagcuaaaggagaagcaggacgccuucugcgacuccaaacugaugagcgccgcgaucaaggacaacagagccgugcacgccgacaugggguacuggaucgaguccgcccucaacgacacguggaagaucgagaaggcgagcuuuaucgaggugaagaacugccauuggcccaagucccacacgcuuuggagcaacggcgugcuggaauccgagaugaucauccccaagagccucgcaggacccgucucccaacacaacuaccgcccgggguaucacacccagaucgcuggccccuggcaccuggguaaguuagagauggacuuugacuuuugcgauggcacaaccguuaucgucacggaggacugcgggaaccggggccccucucucaggaccaccaccgccagcggcaagcugaucacggaguggugcugccgguccugcacucugcccccgcuccgcuaccgcggggaggacggguguugguacgggauggagaucaggccccugaaggagaaggaggagaaccuggugaacagccucguuaccgccgggcacgggcagguagauaacuucucccugggcguguugggcauggcccuauuccuagaggagauguugcggacccguguggguacgaagcacgccauccuccucgucgccgugagcuucgucacccugaucacuggcaacauguccuucaaggacuuagggagggucgucgugaugguuggggccaccauggccgacgacauagggaugggcgugacuuaccuggcgcugcuugccgccuucaaggugcgcccuaccuucgccgccggccuacucuugcgcaagcugaccagcaaggaguugaugaugaccacgaucgggaucguccuccugucccagagcaccauucccgagaccauacuagagcucaccgacgcucuggcccuggggaugauggugcugaagaucgugcggaacauggagaaguaucagcuagccgucacgaucauggcaauucugugcgugcccaaugccgucauccuccagaaugcuuggaaggugaguuguacaauacuggccguggucagcguguccccgcuacuccugaccuccucccagcagaagacagauuggaucccccuggcccucacgauuaagggacugaaccccaccgcgaucuuccuaacuacccucucacgcacgaauaagaagagaucguggccgcugaacgaggcgaucauggccguggguauggucucaauccuggccuccagccuccugaagaacgacauucccaugaccggcccgcugguggccgggggucuccugaccgugugcuacguacugaccgggcgcuccgccgaccucgaacuggagcgagcgacggacgugaagugggaggaacaggccgagauaagcggcagcucacccauccuuucgaucaccaucagugaggacgggagcauguccauuaaaaacgaggaggaggagcagaccuuaaccauccugauccgcacgggccuacucguuaucagcggccuguucccaaucuccauccccaucacugccgccgcaugguaccuaugggaggucaagaagcagcgggcggggguucucugggacgugcccagcccgccucccaugggcaaggccgagcuggaggacggagccuaccgcauuaagcaaaagggcauccucggguacucccagaucggcgccggugucuacaaggaggggaccuuucacacuauguggcacgugacccggggcgccgugcucaugcacaaggggaagcgcaucgagcccucaugggccgaugucaagaaagaucugaucuccuacggcgggggauggaaacuggagggagaguggaaggagggugaggagguccaggugcucgcuuuagagcccggcaagaacccccgggcaguccaaacgaagccugggcuguucaagaccaacaccggaaccauuggagccgugagccucgacuuuucccccggcacgucgggaucgcccauuauugacaaaaaggggaagguggucggucuguacgggaacggcguggugacccgcaguggcgccuacgucuccgcgaucgcccagaccgagaagucuaccgaagacaaccccgagaucgaggacgauauauuucgaaagcgccggcuuacuaucauggacuugcacccuggggccgguaagaccaaacgcuaucuccccgccauaguucgggaggcgaucaagcgcgggcugcggacccugauacucgccccgacccgcgugguugccgccgagauggaggaggcgcugcggggccuucccauccgcuaccagacgcccgccauccgugccgagcacaccggccgggagaucguagaccucaugugucacgccacuuucacuaugaggcugcugucccccgugcgggucccgaauuacaaccucaucauuauggaugaagcccacuucacggaccccgcgagcaucgcggcccgcgguuacaucagcacccggguggagaugggggaggccgccgguaucuucaugaccgcgacgccaccaggcucccgcgacccguucccccagaguaaugcgcccaucauagacgaggagcgggagauccccgagcgcucguggaauagcgggcacgaauggguuacagacuucaagggaaagaccgucugguucgugccgagcaucaaggcggggaacgacaucgccgccugucugcguaagaacggcaagaaggugauccagcuaagcagaaagaccuucgauucagaauacgugaagacccggacgaacgacugggacuucguggucacgaccgauaucagcgagaugggcgcgaacuucaaggccgagcgcgucaucgacccgcggcgcugcaugaagcccgugauccucaccgacggggaggagcgggugauccuugcagggccaaugccagugacgcacuccucugcagcacagcgccgcgggcgcauuggccggaaccccaagaacgagaacgaccaguacaucuacaugggggagccccuagagaacgacgaggacugcgcacacuggaaggaggccaaaaugcuucuggauaacaucaacaccccugagggcaucauuccauccauguuugagcccgagcgcgagaagguugaugcaaucgacggggaguacaggcugagaggggaggcccgcaagaccuucguggaccucaugcggcgcggcgaucugcccgucuggcuggcauacaaggucgcggccgaggggaucaacuacgccgaucggcgcugguguuucgacggcaucaagaacaaccaaauacucgaggaaaacguggaggucgagauuuggaccaaggagggggagcguaagaagcugaagccacgcuggcuggacgccagaaucuacagcgacccccucgcccugaaagaguucaaggaguucgcggcaggcaggaagucccugacauugaaccugauaaccgagaugggccggcugcccaccuucaugacccagaagacgcgugacgcccuagacaaccuggccgugcugcacaccgcggaggccgguggucgugccuauaaccacgcgcucagcgagcugcccgagaccuuggagacccuccuguuauugacgcugcuggccacggucaccggaggcaucuuccucuuccugaugucaggccgcgggauaggcaagaugacccugggaaugugcugcaucaucaccgcgagcaucuuacugugguacgcccagauccagccgcacuggauugccgccuccauuauccuggaguucuucuugaucgugcugcugauccccgagcccgagaagcagcgaacgccccaggacaaccagcucaccuacguggucaucgccauccugacagugguagcggccaccauggccaacgagauggguuuccuagagaagacgaaaaaggaccucgggcucggcucgauagccacucaacaaccggagaguaacauccuggacauagaccucaggcccgcuucggcguggacucuguacgccgucgcgaccacguucaucacccccaugcugcggcacagcaucgagaacuccuccgugaacaccucccucaccgccaucgccaaucaggcgacggugcugaugggccugggaaagggcuggccguuaagcaagauggacaucggggucccgcugcuggccaucggcuguuacucccaggugaaucccaucacacucacagccgcccuuuugcuacugguggcgcacuacgcaaucauagggcccggccuccaggccaaagccaccagagaggcccagaagcgggcggccgccggcaucaugaagaaucccacggucgacgggaucaccgugauugaccucgacccgauccccuacgaccccaaguucgagaagcagcugggccaagugaugcugcucauccugugcgucacccagguacugaugaugagaaccacgugggcucucugcgaggcacugacccuggcgaccgggcccaucagcacccucugggagggcaauccggggcgguucuggaacacuaccauagcggugucaauggccaacaucuuccgcggcagcuaccuggccggcgccggacucuuguuuuccaucaugaaaaacaccacgaacacgcggagaggcaccgggaacaucggcgagacacugggcgagaaguggaaaucccgucugaacgcgcuugguaagucugaguuccagauuuacaagaagucaggcauccaggaagucgaccggacccuggccaaggaagggaucaagcgcggcgagacggaccaccacgcgguaucccgggggagcgccaagcugcgcugguucguggagcggaacauggucacaccggagggcaaagugguggaccucggaugcgggcgcggcgggugguccuacuacugcggagggcugaagaacgucaaggaaguaaaaggccugaccaagggugggcccggccacgaggaacccaucccgaugaguaccuacggguggaaccucgugaggcugcagucgggcguggacguguucuucaucccgcccgagaagugugacacacugcucugcgacaucggggagagcucccccaaccccacgguugaggcugggcgcaccuugcgaguccugaaccucguggagaauuggcugaacaacaauacucaguucuguaucaaggugcuuaaccccuacaugcccagcgucauagagaaaauggaggcccuacagcgcaaguacggcggggcccucgugcggaacccgcugucucgcaacuccacccacgagauguauugggugagcaacgccucgggcaacaucgucuccuccgugaacaugaucagccggaugcuuaucaaccgcuucacgaugcggcacaagaaagccaccuacgagcccgacgucgaccucggguccggcacccgcaacauugggaucgaaagcgagguccccaaccuggacaucaucgguaagcggaucgagaaaaucaagcaggagcacgagaccuccuggcacuacgaccaggaccaccccuacaagacaugggcguaccacggcagcuacgagaccacccaaaccggguccgccagcaguauggugaacggcguaguccgcuugcucacgaagccgugggaugugcugcccaccgugacccagauggccaugaccgacaccacucccuucgggcagcagcgcgucuucaaggagaaaguggacacgcggacccaggagcccaaggaaggcacgaagaagcugaugaagaucacggccgaguggcucuggaaggagcugggcaagaagaagacuccgcgcaugugcacucgggaggaguucacucgcaaggugcguagcaacgccgcgcugggggccaucuucaccgacgagaacaaguggaagucggcccgugaggccgucgaggacagccgguuuugggagcucguagacaaagagcgcaaccugcaccuggagggcaaaugcgaaaccuguguguacaacaugauggggaagcgggagaagaaguugggcgaguucggaaaggccaagggcucccgcgcgauuugguacauguggcugggcgcccgauuccuggaguucgaagcccuaggguuucugaacgaggaccacugguucagccgcgagaacucccucucugguguagagggggaaggcuuacacaagcucgguuacauccugcgggacgugagcaagaaggaagggggugccauguacgccgacgacaccgccgggugggauacucgcauuacccucgaggaucugaagaacgaggaaauggucaccaaccauaugaaaggcgagcauaagaaguuagcugaggccaucuucaaacuuaccuaccagaacaagguggugaggguccagcgccccacgccccgagggaccgugauggacaucauaucccgucgggaccagcgcggcagcggccagguggggaccuauggccugaacaccuuuacuaacauggaggcccagcugauccggcagauggagggggagggcguguucaagaauauccagcaccucaccgugacagaggagguagcgguucagaacugguuagcccgcguggggcgcgagcgguugucccgcauggcuaucucuggcgacgacugcguggucaaaccguuagaugaccgguucgcaaacgcccugaccgcgcugaaugacaugggaaagauccgcaaggacauccagcagugggagccgucaaaggguuggaaugauuggacccaagugccauucugcagccaccacuuccacgagcucaucaugaaggacggccggguccuggucgugcccugucgcaaccaggaugagcucaucgggcgggcccgcauuucccagggcgccggguggagccuccgggagaccgcaugccuuggaaaguccuacgcccaaauguggagccuuauguauuuccaccgccgggacuuacgccuggccgcgaacgccaucugcuccgccgugcccagccacugggucccaaccucccgcaccaccuggagcauccacgccaagcacgaguggaugacuaccgaggacaugcuuaccguguggaaccgcguguggauccgggagaaccccuggauggaggacaagacccccgucgaguccugggaggagauccccuaucuaggcaagcgggaggaccaguggugcggcagccuuauaggccugacgucccgugccaccugggcuaagaacauccaggccgccauaaaccaggugcgcagucucaucgggaacgaagaauacaccgacuacaugccgagcaugaagcgguuccgucgcgaggaggaggaggcgggcguucugugguga

SEQ ID NO: 24955 - RNA, 9876 nt, Artificial Sequence
  derived and/or modified CDS sequence (opt11) from DENV-2__GU131928__SS-prME
uccgccggaaugauuauaauguuaauccccacagugauggccuuccaccucaccacgcgcaacggggagccgcacaugaucgucgggauccaggagaagggcaagagccugcuguucaagacugaagacggcgugaacaugugcacccuaauggcgauggaccugggggaguuaugcgaggacaccaucaccuacaagugcccccuccugcggcagaacgaacccgaggacaucgacugcugguguaacucuacaaguaccuggguuaccuacgggaccugcaccaccaccggugagcaccgccgggagaagcgcagcgucgcucuggugccccacguggggaugggccucgagacccguaccgaaacguggaugucaagcgagggggcguggaagcacgcccaacgcauugagaccuggauucugaggcauccgggcuucacgaucauggcugccauccuggccuacaccauugggaccacccacuuccagcgcguacugaucuucauccugcugacggccguggcgcccuccaugacaaugcggugcaucggcaucuccaaccgcgacuuuguggagggcgucuccgggggcucuuggguggauauagugcucgagcacgggagcugcgucaccacgauggcgaagaauaagccaacgcuggacuucgagcugaucaagacagaggccaagcagccggccaccuuacggaaauacugcaucgaggccaaacucaccaacacgaccacagagagccgcugcccaacccagggcgagcccucccugaaagaggaacaggauaagagauuuguuuguaagcauagcaugguggaccgcggcugggggaacggcugcggcuuauuugguaagggcgggaucgucacgugugccauguucacgugcaagaagaacauggagggcaagaucgugcagcccgagaaccucgaguauacaaucguggugacgccccauuccggggaggagcacgcgguggguaacgacacggggaagcacggcauggagaucaaggugacgccgcagagcuccauuacagaggccgagcugacgggguacggcacggucacgauggagugcagcccccggaccggccucgacuucaacgagauggugcugcuccagauggagaacaaggcguggcucguccaccgccagugguuccuggaccugccucuacccugguugccgggggccgacaagcaggaguccaauuggauccagaaggagacccuggucacauucaagaacccccacgccaagaagcaggacgucgucgugcucggcagccaggagggggcaaugcacacggcccuaaccggcgccaccgagauccagaugagcucagggaaccuccuuuucaccggccaucugaagugccgguuacgcauggauaaacuccagcugaaaggcaugagcuauuccaugugcacaggcaaguucaagguggucaaggagaucgccgagacccagcacgggaccaucgugauacgggugcaauacgagggggacggcagccccugcaaaauacccuucgagaucauggaccuggagaagcguuacguccucggccggcugaucacugugaacccgaucgugacggagaaggacucccccguuaacauagaggccgagccacccuucggggacuccuacaucaucauagguguggagccggggcagcugaaacucaacugguuuaagaaggguucaagcaucgggcaaauguucgagacgaccaugcgcggcgcgaaacgcauggccauauugggugacaccgccugggacuucggcucccugggcgggguauucacgagcaucggcaaggcccuccaccaggucuucggggcaauauacgggguggcguuuucaggcgucagcuggaccaugaagauacugaucgggguuaucaucaccuggaucggcaugaacucacggagcacuuccuuaagcguaucccugguguuaguugggaucgugacguuguaccugggcguuaugguccaggccgacagcgggugcgugguguccuggaagaacaaggaguuaaagugcggcagcggcaucuucaucacugacaacguccacaccuggaccgaacaguacaaguuucagcccgagagccccuccaagcuggccagcgccauccagaaggcgcaggaggaggggaucugcggcauccguucgguuacgagacuugagaaccuaauguggaagcagaucacccccgagcugaaccacauacuggccgagaacgaggugaagcucaccauuaugaccggggacauuaaaggcaucaugcaagccgggaagcgcagccugcggccgcaacccacggagcugaaguacuccuggaaaaccuggggcaaggccaagaugcucagcaccgagucauacaaccagacuuucuugaucgacgggcccgaaacggccgagugcccgaacaccaaccgcgcguggaacagccucgaagucgaggacuacggguucggcguguucaccaccaacaucuggcucaaguuaaaggagaagcaggacgccuucugugacucgaagcugaugucggccgccaucaaagauaacagagccgugcacgcggacauggguuacuggaucgaauccgcccucaacgauacguggaagaucgagaaggccuccuuuaucgaagucaaaaacugccacuggcccaagucccacacgcucuggagcaacggcguucuggaguccgagaugaucaucccgaagaaccucgccggccccgugagccagcacaacuaccgccccggguaccacacccagaucgccggccccuggcaccuggggaagcuggagauggacuucgacuucugcgacgggaccacagucaucgugaccgaggacugcgggaaccgcggccccagcuuacgcaccaccaccgcgagcggcaaacugaucacggaguggugcugccggagcuguacucuucccccgcuccgcuacaggggggaagacggcugcugguacgggauggaaauccgcccccugaaggagaaggaggagaaccuggugaacucccucgucaccgccggccacggccagguagacaacuucagccugggcgugcuggggauggcccucuuccucgaggagaugcugaggacucgaguugggacgaagcacgccauacuccugguggcgguguccuuugucacacugaucacugguaacaugucguucaaggaccuuggacgggugguugucaugguaggcgccaccauggccgacgauaucgggaugggcgugacguaccuggcccugcucgccgcguucaagguucgccccacguucgccgccggucuucuguuacggaaacugaccucgaaggaacuaaugaugaccacgaucgggaucguucuucugagccaauccacgauacccgagaccguacuggagcucaccgacgcccuggcccugggcaugaugguccucaaaauugugcgcaauauggagaaguaccagcuagcagucacgaucauggccauccucugcgugcccaacgcagugauacuccagaaugccuggaaggucagcugcaccauacuagcgguuguguccgucagcccccugcuccugaccuccagccagcagaaaaccgacuggauaccccuggcgcucacgaucaagggguugaaccccacggcgaucuuccugaccaccuuaagccgcacgaacaagaagcggagcuggccgcugaacgaggccaucauggcgguuggcaugguguccauccuggcgagcagucuccucaagaacgacauccccaugaccggcccccuggucgccgggggccugcugacuguauguuacgugcugacggggcgcagcgccgaccucgagcuggagcgggccacagacguuaagugggaggaccaggcagagaucuccggcagcagccccauccuguccaucaccaucucugaggauggguccaugagcaucaagaacgaggaggaggagcagaccuugaccauacugauccgcacgggucugcuugugaucuccggccuguucccgauuagcauuccuaucaccgcagccgcaugguaccuaugggaggucaagaagcaaagagccgggguccucugggacgugcccucuccgccgcccauggguaaggcugagcuggaggacggggcguauagaauuaagcagaagggcauccugggguacucucagauuggcgccggcguguacaaggagggaaccuuccacacaauguggcacgucaccagaggcgccguucucaugcacaaggguaagaggaucgagcccuccugggcggacguaaagaaagaccuaauuagcuacggugggggcuggaagcuggagggcgaguggaaagagggagaggagguccaggugcucgcccuggaaccgggcaagaaccccagggcggugcagacgaagcccggguuauucaagaccaacaccggcaccauuggagcaguaucacucgacuucucacccggcacguccgggagccccaucaucgacaaaaaggggaagguggugggccuguaugguaacggcgucgugacccgguccggcgccuaugugagcgccaucgcccagaccgagaaauccaucgaggauaacccagagaucgaagacgauauuuuccggaaaaggcggcugaccaucauggaccugcaccccggggcaggcaagacgaagcgcuaccuccccgcuaucguccgagaggccaucaaacgcgggcugcggacccugauccucgccccaacgcgcgucguagcugccgagauggaggaggcccugcggggccuacccauucgcuaccaaaccccggccauccgggccgagcacacgggucgcgagaucgucgaucucaugugccacgcgaccuucaccaugcgccugcuuagccccgugcgggugccuaacuacaaccuaaucaucauggacgaggcccacuuuaccgaccccgccucaauagccgcccgcggcuacaucaguacacgcgucgagaugggcgaggcagccggaaucuucaugacggcgacuccgccaggcucgcgcgauccguucccccaguccaacgcccccaucaucgacgaggagcgggagauccccgagcgcucguggaauuccggacacgagugggugaccgacuucaaggguaaaacggugugguucgucccgagcauaaaggccgggaacgacaucgcggccugccugcggaagaauggcaagaaagugauccagcugucccgcaagaccuucgacucugaguacgugaagacucggaccaacgacugggacuucgucgugacgaccgacaucagcgagaugggugccaauuuuaaggccgagcgcgugaucgacccccgccgcugcaugaagcccgucauacucaccgacggggaggagcggguuauccuggcgggcccgaugccgguuacccacucauccgccgcccagagacgggggcguauagguagaaacccgaagaaugaaaacgaucaguacaucuacaugggggagccccuggaaaacgacgaggacugcgcccauuggaaggaagccaagaugcuccuggacaauauaaacacgcccgagggcaucaucccuuccauguucgagcccgagcgcgagaagguggacgcgaucgauggcgaguaccggcugaggggggaggcccggaagaccuucguggaucucaugcggcgcggcgaccugcccguguggcuggccuacaaggucgccgccgaggggaucaacuacgcggaccggagaugguguuucgacggcaucaagaacaaccagaucuuggaggagaacgucgagguagagaucuggaccaaagagggggagaggaagaaacugaagccgcgcuggcuggacgcccguaucuacuccgauccccucgcucugaaggaguucaaggaguucgccgccggccggaagagucugaccuuaaaccugaucacugaaaugggccggcugcccaccuucaugacccaaaagacccgagacgcccucgacaaccuggccgugcugcacacggcugaggccggggggcgggcguauaaccacgcccucuccgagcugcccgagacccuggagacucuccugcugcucacccugcuggccacggugacaggcggcaucuuccucuuccugauguccggccgcggaaucggcaaaaugacccuggggaugugcuguaucaucaccgcguccauccuccugugguacgcacaaauccagccgcacuggaucgccgccuccaucaucuuagaguucuucuuaaucguccugcugauccccgagccggagaagcagcggacgccacaggacaaccagcucacguacguggugaucgcaauccugaccgucguggccgccaccauggcgaacgaaaugggcuuccuggagaaaaccaagaaggaccucggguuaggcuccaucgcgacgcagcagccggagagcaacauccucgauaucgaccuccgccccgccuccgcuuggacccuguacgcuguggcgaccacuuucgucacgcccaugcugcgccacagcaucgagaacagcuccgugaacgugagcuuaaccgccaucgccaaccaggccaccguccugaugggcuuagggaagggcuggccccuuucgaagauggacauagggguaccgcuucuggccaucgguugcuacucacaagugaaccccauaacauugacggcagccuuacugcuccuggucgcccacuacgccaucaucggccccggguuacaggcgaaggccacccgcgaggcccagaagcgagcggcugcaggcaucaugaagaacccgaccgucgacgggaucaccgugaucgaucuugacccaauccccuacgacccaaaguuugagaagcagcugggccaggucaugcuguugauccucugugugacucagguccugaugaugcgcaccaccugggcccuaugugaggcuuugacccuggcgacggggcccaucagcacccucugggagggcaacccgggacgguucuggaacaccaccaucgccgucagcauggcgaacaucuuccgcggcucguaucuggccggcgccggguuacucuuuagcauaaugaagaacacgaccaacacucggcgcgguaccgggaacaucggcgagacgcugggcgagaaguggaagucccgccugaacgccuuagggaaguccgaguuccagaucuacaagaagagcggcauccaggagguggaccggacccuggccaaggaggggaucaagcgcggagagaccgaccaccacgcggugagccggggguccgccaagcugcgcugguucgucgagcgcaacauggugacccccgagggcaaggugguggacuuaggcugcgggcgcggaggguggagcuacuacugcggcgggcugaagaacguccgagaggugaagggccugacuaagggcgggcccggccacgaggaaccaaucccgaugucgaccuacggguggaaccucgugcgccugcagagcgggguggacguguucuucauuccgccggagaagugcgacacguuguuaugcgauaucggcgagaguagccccaacccgaccgucgaggccggccggacgcugcgcgugcugaauuugguggagaacuggcugaauaacaacacccaguucugcaucaagguccugaaccccuacaugccguccgugaucgagaagauggaggcccugcagcggaaauacgguggggcacuggugaggaacccucugagccggaacagcacgcacgaaauguacugggucuccaaugccagcggaaacaucgucuccagcgugaacaugauaucccggaugcucaucaacagguucaccaugaggcacaagaaggcuaccuacgagccggacgucgaccucggaucgggcacucgcaauaucggcauagagagugagaccccaaaccuggacaucaucggcaagcgcaucgagaagaucaaggaggaacacgagaccagcuggcacuacgaucaagaccaccccuacaagaccugggccuaccaugguaguuacgagacgaagcagaccgggagcgccuccuccauggucaacggcgugguuagauugcucaccaagccgugggacguguugcccacagugacgcagauggcgaugacagacaccacccccuucggccaacagcgcgucuucaaggagaaggucgauacgcgaacccaggagcccaaggagggaaccaagaaauugaugaagaucaccgccgaguggcucuggaaggaguugggcaagaagaagacgccgaggaugugcacccgcgaggaauucacccguaaggugcgcuccaacgccgcccugggggccaucuucaccgacgagaauaaguggaaguccgcgcgggaggccguagaggacuccagguucugggagcucguggacaaggaacggaaccugcaccuagagggcaagugcgagacgugcgucuacaauaugauggggaagcgcgagaagaaacugggcgaguucgguaaggccaaggguucucgagcaaucugguauauguggcugggcgcccgcuuccuugaguucgaggcgcucggguuucugaacgaggaccauugguucucccgggagaacagccuguccggcguggagggggagggacuccacaagcuuggguacauccugcgcgacgugagcaagaaggaaggcggcgcaauguacgcggacgacaccgccgguugggacacccggaucacccuggaagacuuaaagaacgaggagauggucacgaaucacauggaaggcgagcacaagaagcuggcggaggcuaucuucaagcugaccuaccaaaacaagguagugcgcguccagcggcccacgccccgugggaccgugauggacaucaucagccgccgcgaccaaaggggcuccggccagguggggacguacggucugaacaccuucaccaacauggaagcccaacugaucaggcagauggagggggagggcgucuucaagaacauccagcaccucaccgugacggaggaggccgccguccagaacuggcuggcgcgcgucgggagagagcgccugucacggauggccaucuccggugacgacugcguggucaagccccucgacgaucgcuucgccaacgcacugaccgcacugaacgacaugggcaagauccgaaaggacauccagcagugggagccgagcaagggauggaacgauuggacccagguccccuucugcucccaccacuuccacgagcuuaucaugaaggacggccgcguucuugugguacccugccggaaucaagacgagcugaucggccgcgcgcggaucagccagggcgcaggcuggagucuacgcgaaaccgccugccugggcaaguccuacgcccaaauguggucccucauguacuuccaccggcgggaccuccggcuggccgcgaacgccaucugcucggccgugcccucccacugggugcccacgagccgcaccaccugguccauccaugccaagcacgaguggaugaccaccgaggacaugcugacggucuggaaucggguguggauccgcgaaaaccccuggauggaggauaagacccccguggagagcugggaggagauccccuaccucggcaagcgggaggaccaguggugcggcucccugauuggccucacgagccgcgccaccugggcgaaaaauauccaggccgccaucaaccagguccggucccucauaggcaaugaggaguacaccgacuacaugccaucgaugaagcgcuuccggcgcgaggaggaggaagccggugugcugugguga

SEQ ID NO: 24956 - RNA, 9876 nt, Artificial Sequence
  derived and/or modified CDS sequence (opt11) from DENV-2__GU131929__SS-prME
ucagccggcaugaucaucaugcugaucccaaccgugauggccuuccaccucacgacccgcaacggggaaccccacaugaucgucggaauccaggagaagggcaagagccugcuguucaaaaccgaggacggcgugaacauguguacgcucauggcgauggauuugggggaacugugcgaggauacgaucaccuacaagugcccccuccugcggcagaacgagcccgaggacaucgacugcuggugcaauucaaccagcaccugggugaccuacgggaccugcaccaccacgggcgagcacagacgggagaagcgcagcguagcccuugugccucacgugggcaugggccucgagaccaggacagagaccuggaugagcagcgagggggcguggaagcaugcccagcggauagaaaccuggauccugcgucacccgggguucacgaucauggccgcgauccuggccuacaccauugggaccacccacuuccagcgcguccucaucuuuauccuguuaacggccguggcccccuccaugaccaucagaugcaucgguaucagcaaccgcgacuucguggagggcguauccggcggcaguuggguggacaucgugcuagagcacgggagcugcgucacaaccauggcgaagaacaagcccacgcuggacuucgagcugaucaagaccgaggcaaagcagcccgcaacccuccggaaauacugcauagaggccaaacugaccaacacgacgaccgagagccggugccccacgcagggcgagcccagucucaaggaggaacaggacaaacgauucgugugcaagcacucaaugguggaccgcggcugggggaacggcugcggcuuguucggcaagggcgggauagucacgugcgccauguucacgugcaaaaagaacauggaagggaaaaucguacagcccgaaaaucuggaguacaccauagucgucacuccccacuccggggaagagcacgcggugggaaacgauacggggaagcacgggauggagaucaagguaaccccgcagagcucgaucaccgaggccgagcugaccggauacgguaccgucacgauggagugcagcccacgaacgggcuuagacuucaacgagauggugcugcugcaaauggagaacaaggcauggcucgugcaccgccagugguuccuggaccugccccuucccuggcugccaggggccgacaaacaggaauccaacuggauccagaaggagacccuggucaccuucaagaauccgcacgcuaagaagcaagauguugucgugcucggcagccaggagggggcgaugcacacggcccugaccggcgcgaccgaaauacagaugagcuccgggaaucuucuguucacaggccaccugaaaugccggcugcgcauggacaaauugcagcugaaggguaugagcuacuccaugugcacggggaaguuuaaggugguaaaggagaucgccgagacccagcacggcaccaucgugaucagggugcaguacgagggggacggcagccccugcaagauacccuucgagauuauggaccucgaaaagcgcuacgugcucggccggcucaucaccgugaacccaaucgucacggagaaggacagccccgucaauaucgaggcggagccgcccuucggggauucguacaucaucaucggaguggagccggggcagcugaaacucaacugguucaagaagggguccagcaucgggcagauguucgagaccaccaugcgcggcgcgaagcgcauggccauccugggcgacaccgccugggacuucgggucauuaggcgggguguucaccucaaucggcaaggcccuccaccaagucuucggagcgaucuacgggguggcguucuccggcgugagcuggaccaugaagaucuuaaucggggucaucauaaccuggaucggcaugaacucccggagcaccagucugucagugucccucgugcucgucgggaucgugacacuguaccugggggugaugguccaggcagauucggggugugugguguccuggaagaacaaagagcucaagugcggcagcgguaucuuuaucacggacaacguccacaccuggaccgaacaauacaaguuucaacccgagucccccuccaagcuggcuagcgccauccagaaggcucaggaggaggggaucugcggaauccgcuccgugacgcggcuggagaaucuaauguggaagcagaucacgcccgagcugaaccauauccuggccgagaacgaggugaaacuuaccaucaugacaggggacauuaaagguauuaugcaggccgggaaacgcagccugcggccgcagcccacggagcugaaauacagcuggaagaccuggggcaaggccaagaugcucuucacggagagcuacaaccagacuuuccugaucgacggccccgagacggccgagugcccgaauaccaaucgcgccuggaacuccuuggaaguagaggacuacggguucggcguguuuaccaccaacaucuggcucaagcugaaggaaaagcaggacgcuuucugcgacagcaaacugauguccgccgcaauuaaggacaauagggccgugcacgcggacaugggauacuggaucgagucggcccucaaugacacguggaagaucgaaaaggccuccuuuaucgaggucaagaacugccacuggcccaagagccacacgcucuggucaaacggugugcuggaaagcgagaugaucaucccuaagaacuuagcgggccccgugucgcagcacaauuauaggcccggguaccacacccagauugccggccccuggcaccugggcaaacuggagauggacuucgacuucugcgauggcacaaccgucaucgugacggaggauugcgggaacaggggccccagccuucgcaccaccaccgcguccggcaagcugaucacggaguggugcugucggagcugcacccuacccccccuccguuacaggggggaggacggcugcugguacggcauggagauccgcccccugaaggagaaagaggagaaccuggugaacucucucgucaccgccggccacgggcagguggacaacuucucacucggcgugcugggcauggcccucuuccuggaggagaugcugcggacacgcgucgggacgaagcacgccauacuccugguggcggugagcuucgucacuuugauuacgggcaacauguccuucaaggaccucggucggguggugguuaugguaggcgccaccauggccgacgacauugggaugggcgugacguaccuggcccugcucgccgcguucaagguccgcccuacauucgccgccggccugcuccuccggaagcugaccagcaaggagcugaugaugacgacaaucgggaucgugcuccugucgcagagcacgauccccgagaccguuuuggagcucaccgacgcgcuggcacugggcaugauggucuugaagaucgugaggaacauggaaaaguaccagcuugcggucacgaucauggccauccugugcgugcccaacgcggugaucuuacagaacgccuggaaggucuccugcaccauacuggcugucgucuccgucagcccucuccuccucaccagcucucagcagaaaaccgacuggaucccacuggcgcucacgaucaaagggcugaaccccacggccaucuuccuaaccaccuugagccgcacgaacaagaagcgguccuggccacugaacgaggccauuauggccgugggcauggucucaauccuggcguccagccuccugaagaacgacauccccaugacuggcccccuggucgccgggggccuccugaccgugugcuacgugcucaccgggcgcagcgccgacuuagaguuagaacgggccacggacgucaagugggaggaccaggccgagauaucgggcuccagccccaucuuaaguaucacgaucuccgaggacgggagcauguccaucaaaaaugaggaggaagagcagacccucacaauccugauccgcacgggccuguuggugaucagcggccuguucccgaucuccauccccaucaccgcggcugccugguaccugugggaagugaagaagcagcgggccgggguacucugggacgugccaucaccaccgccuauggggaaggccgagcuggaggacggggcguaccgcauuaagcagaagggcauacugggguacucccagaucggcgccggcguguauaaggaagguaccuuccacacuauguggcaugucacccgcggcgccgugcucaugcacaaggggaagaggaucgagcccagcugggccgaugugaagaaggaccugaucuccuacggcgggggcuggaagcuggagggcgaguggaaagagggggaagagguacaggugcuggcgcuggagcccggcaagaacccccgggcggugcaaacgaagcccggacuguucaagaccaacaccggaaccaucggggcagucagccucgauuucucccccggcacgagcggcucccccaucaucgauaagaaggggaaggucgugggccuguacgggaacggcgucgugacccgcagcggggccuacguguccgcgaucgcccagaccgagaagucgaucgaggauaaccccgaaaucgaagacgacauauuucggaaaaggcgguuaaccauaauggaucugcaccccggggcuggcaagacgaagcgcuaucuacccgccaucguccgggaggccaucaagcggggccugcggacucugauucucgccccuacccgcguuguugccgccgagauggaggaggcgcugcggggccugcccauccgcuaccagacccccgcaauccgggccgagcacacagggcgcgagauugucgaccucaugugccacgcgaccuucaccaugcgccugcugucccccguacgggugccgaauuacaaccucaucaucauggacgaggcucauuucaccgaccccgccagcaucgccgcccgcggcuacaucuccacgcggguagagaugggcgaggcggccgggaucuucaugacagccacgccgcccggcagccgcgacccguucccccagagcaacgcucccauaaucgacgaggagcgcgaaauccccgagcgcuccuggaacagcgggcacgagugggugacugacuucaaggggaagacggugugguucgucccguccaucaaggccgggaacgacaucgcugccugccugcguaagaacggcaagaaagugauccagcugucucgcaagacauucgacuccgaguacgucaagacccggaccaacgacugggacuucgucgugacgaccgacaucagcgagaugggcgccaacuuuaaggccgagcgcgugaucgauccgcggcgcugcaugaagcccguuaucuugaccgacggggaggagcgggucaucuuagcgggccccaugccagugacucacuccagcgcagcccagcgccgggggcgcauaggacgaaaccccaagaacgagaacgaccaguacaucuacaugggggagcccuuagagaacgacgaggacugcgcccacuggaaggaagcaaagauguuauuggacaacaucaacacgccugagggcaucaucccaucaauguucgagcccgagcgagagaaggucgacgcgauugacggcgaauaccgguuacgcggggaggcccgcaagaccuucguggaccucaugcggcgcggagacuuacccguguggcuggccuacaagguagcagccgagggcaucaacuacgcggaccggcgcuggugcuucgacgguaucaagaacaaucagauccucgaagagaacguggaggucgagaucuggaccaaggagggugagcggaagaaacugaagccgcgcuggcuggacgcccggauuuacagcgaccccuuagccuuaaaggaauuuaaggaguucgccgccggccguaaaucccuaacccucaaccugaucacggagaugggccgacugcccaccuucaugacacagaagacucgcgacgcgcuggacaaccuggccguucugcauacugccgaggccgggggccgugcguacaaccacgcccucagcgagcuacccgagacauuggagacccucuugcuucuaacccugcuagcaacagucaccggaggcaucuuccucuuccugauguccggcagagguaucggcaagaugacccuggggaugugcugcaucaucacagccucaauccuccugugguacgcccagauccagccgcauuggaucgcggccuccaucauacucgaguucuuccucaucguccugcugauccccgagcccgagaagcagcggacgccccaagacaaccagcuaacguacguggugauagccauccugaccgucguggcagccaccauggcgaacgagaugggguuccuggagaagaccaagaaggaccucgggcuaggcagcaucgccacgcagcaaccggagucuaacauccuggacaucgaucuccgccccgccagcgccuggacccuguacgccguggcgaccacauucgucacgcccaugcuuaggcacuccaucgagaacagcagugugaacgugucccucaccgcgaucgccaaccaggcuaccguccugaugggcuuaggaaaaggcuggccccucagcaagauggacaucggagugccgcugcucgccaucggcugcuacucccaggugaaccccaucacccuuacggcagcccuuuuacuucuggucgcucacuacgcuaucauuggcccaggccuucaggcgaaggccacccgcgaggcgcagaagcgggcugccgcggggaucaugaagaaccccaccguggacggaauuaccguuaucgaccucgacccgauccccuacgauccuaaguuugaaaagcagcugggccaggucauguuauuaauccucugcgucacccagguacugaugaugagaaccaccugggcccucugcgaggcccugacccuggcgacagggcccaucagcacccucugggagggcaauccggggagauucuggaacaccacuaucgccgucuccauggccaacaucuuccgcggcuccuacuuagcuggcgccgggcuccuuuucuccaucaugaaaaacacgacuaacacccggcgcgguacggggaacauaggcgagacgcugggcgaaaaguggaagucccgccugaaugccuuagggaaguccgaauuccagaucuacaagaaguccggcauccaagaggucgaucgcacacuugccaaggaggggaucaagcgcggcgagaccgaccaccaugcggugucccgggggagcgccaagcugcgcugguucguagagcguaacauggugacacccgagggcaagguggucgaucugggaugcggacgcggcgggugguccuacuacugcggcgggcugaagaauguucgggagguuaagggccugacgaagggggggcccggccacgaggagcccauacccaugagcacauacggguggaaucucgucagacugcaguccggcguggacguguucuucaucccgcccgagaagugugacacacugcucugcgacaucggcgagucgucucccaacccuaccgucgaggccggcagaacgcuccgcguccugaaccucgucgagaacuggcugaacaauaacacccaguucugcaucaagguccugaacccguacaugccuagcgugaucgagaagauggaagcccugcaacggaaauacggcggggcacucgugcgaaacccgcucucccggaauagcacccacgagauguacugggucagcaacgcauccggcaacaucgucagcuccgugaacaugaucagccgcaugcugaucaaccgguucaccaugcgccacaagaaggccaccuacgagcccgacgucgaccucgggagugggacgcggaacaucgggaucgagagcgaaaccccaaaccuggacaucauagggaagcgcauugagaagaucaaggaggagcacgaaaccucuuggcauuacgaccaggaccacccguacaaaacgugggcuuaccacggcagcuacgagacgaagcagaccggguccgccagcucgauggugaauggcguuguccggcugcucaccaagccgugggacguguugcccaccgugacgcagauggcgaugaccgacaccacgccguucgggcaacagcgggucuucaaagagaaggucgacacgcgcacccaggaacccaaggagggcaccaaaaaguuaaugaagaucaccgccgaguggcuauggaaggagcugggcaagaagaagacuccccggaugugcacccgcgaggaguucacgcggaagguucgcucaaacgccgcccugggggccaucuucaccgaugaaaacaaguggaagagcgcgcgagaggcagucgaggauucccgcuucugggagcuuguugacaaggagcgaaaucugcaccuggagggcaagugcgagacgugcgucuauaacaugauggggaagcgcgaaaagaagcucggcgaguucgggaaggccaaaggcucccgggcaaucugguacauguggcugggcgcccgcuuucuggaguucgaggcgcucggguuccugaacgaggaccacugguucagccgugagaacucccugagcggaguagagggcgagggccuccacaagcugggguacauccugcgcgacgugucaaagaaggaggggggcgcgauguacgccgacgacaccgcgggaugggacacccggaucacccuagaggaccucaaaaacgaggagauggucacuaaccauauggagggcgagcacaagaagcuggcggaggccaucuuuaagcucacuuaccagaacaagguggugcgcguccaacgucccacgccgcgggggaccgugauggacauaaucagccgucgcgaccagcggggaagcggccagguggggacguacggccugaacaccuucaccaacauggaagcgcagcugauccgccagauggagggggagggcgucuuuaagaacauccaacaccucaccgugacggaggaggccgcuguacagaauuggcuggcgcgggucgggcgcgagcgcuuaucccggauggccaucagcggcgacgacugcguagugaagccccucgacgaccgcuucgcgaacgcccugacagcccugaaugacauggguaagauccggaaggacauccagcagugggagccaucuaagggguggaacgacuggacccagguccccuucugcagccaccauuuccaugaguuaaucaugaaggacggccgcgugcuggucguccccugucggaaccaggacgaguuaaucgggcgcgcgcggaucucccagggcgcgggguggagccuacgcgagaccgccugccugggcaaguccuacgcccaaauguggagccugauguacuuccaccggcgcgaccuacggcuggccgcgaacgcgauaugcucagcugugcccagccauugggugcccacgucacgcacaaccuggucuauacaugcaaagcacgaguggaugaccaccgaagacaugcugacugucuggaacaggguauggauucgcgaaaaccccuggauggaggacaagacgcccguggaguccugggaggagauccccuaccucggcaagcgggaggaccaguggugcgguagcuugauuggccugaccucccgcgccaccugggcgaaaaacauccaggccgccaucaaccaggucagaagccuuaucgggaacgaggaguacacggauuauaugccguccaugaagcgcuuccggcgcgaggaggaggaggccggcgugcugugguga

SEQ ID NO: 24957 - RNA, 9876 nt, Artificial Sequence
  derived and/or modified CDS sequence (opt11) from DENV-2__GU131930__SS-prME
ucggcaggcaugaucaucaugcugaucccgacaguuauggccuuccaccucaccacccgcaacggggaaccccacaugaucgugggcauccaggagaaagguaagagccuacucuucaagaccgaggacggcgugaauaugugcacccucauggcgauggaccugggggagcugugcgaagacaccaucacauacaaaugcccgcugcugcgacagaacgagcccgaggacauagacugcuggugcaacuccacuagcacgugggugaccuacgggacgugcaccaccaccggcgagcaccgccgggagaagcggagcgucgcucuggugccccauguggggauggggcucgagacccggacugagaccuggaugagcuccgagggugccuggaagcacgcccagcggauagagacuuggauccuacggcacccggguuuuacuaucauggccgcgauucuggccuacaccaucgggaccacccauuuccagcgcgcccucaucuucauccugcugacggccguggcgcccuccaugaccaugcggugcaucggcauuagcaaccgcgacuucguggagggcguaagcgggggcucaugggucgauauugugcuggagcacggguccugcgugacuaccauggcaaagaacaaacccacgcuggauuucgagcugaucaagaccgaagcgaagcagcccgccacccucaggaaguacugcaucgaggcgaagcugacuaacacgaccaccgagagccgcugccccacccagggcgagcccucccugaaggaggaacaggauaagcgguucgucuguaagcacuccaugguggaccgaggcugggggaacggauguggguuguucggcaagggcgggaucgugacgugugcgauguucacgugcaagaagaacauggaggguaaaaucguccagcccgagaauuuggaguacaccaucguggucacgccccauuccggggaagaacacgccgucggcaaugacacagggaaacacggcaaggaaaucaaggugaccccacagagcucuaucaccgaggccgaacugacuggguaugggaccgugacuauggaguguagcccccggaccggccucgacuucaacgagaugguucuguugcagauggagucuaaggcauggcuagugcaucgccagugguuccuggaccugccauugcccuggcugcccggggccgacaagcagggcagcaacuggauccagaaggagacgcuggugacuuucaagaacccucacgcgaagaaacaggacgucgucguccucgggucccaggagggcgcuaugcacacggcccugaccggggccacagagauccagauguccagcgggaaccuccuguuuaccggucaccugaagugccggcuucggauggacaaacuccaacugaaggguaugagcuacuccaugugcacaggcaaguucaaaguggugaaggagaucgccgagacccagcacgguacaauagucauccgggugcaguacgaaggcgacggcucccccugcaagaucccguucgagaucauggaucuggagaagcguuacgugcuugggcggcugaucacugucaacccgaucgugacagaaaaggacagccccgucaacauagaggccgagcccccuuucggcgacuccuacaucaucauuggggucgagccgggacaguuaaagcucaacugguucaagaagggcagcuccaucggccagauguucgagaccaccaugcgcggcgccaagcguauggccauccuuggcgacaccgccugggacuucggcagccuuggcgggguuuucacguccaucgggaaggcgcuccaccaaguauucggugcuauuuauggcgccgccuuuucaggagucuccuggaccaugaagauccuaauaggcgugauaaucaccuggaucgggaugaacagccgcucuaccagccuguccgugucucugguccuggugggcauagugacgcuguaccugggagucauggugcaggccgacaguggcugcguugucucauggaagaacaaggagcuaaagugcggcuccgggauauucaucaccgacaacguucacaccuggaccgagcaguacaaguuccagccggagucccccagcaagcuggccucagcuauccaaaaggcccaggaggagggcaucugugguauccgcagcgugacgagacuggagaaccucauguggaagcaaaucacccccgagcugaaccacauccuggccgagaacgaagucaagcucacgauaaugaccggcgacaucaaggggaucaugcaggccgguaagcgcucccugcggccucaaccgacugagcugaaguacaguuggaagaccuggggcaaggcgaagauguugucuacugagagccacaaccagaccuuccugauagacgggcccgagacggccgaaugccccaacaccaaucgcgccuggaacucgcuggagguggaggacuacggcuucgggguguuuacuaccaacaucuggcucaaguuaaaggagaagcaggacgccuucugugacaguaagcugauguccgcugcgauaaaggacaaccgggccguccaugccgacaugggauacuggaucgagucagcucucaaugacacguggaaaauagagaaggccagcuucaucgagguuaagaacugccauuggcccaagucucacacccugugguccaacggcgugcuggagagcgagaugaucauccccaagaaccucgcgggacccgucucccagcacaacuaccgcccgggcuaccacacccagaccgccgggcccuggcaccuggguaagcuggagauggacuucgacuucugugacgggacaacggugaucgugacugaggacugcggcaaccgaggccccagccugcgcaccaccacggccucggggaagcugaucaccgaaugguguugccgguccugcaccuuacccccgcuccgcuaccggggcgaggauggaugcugguacgggauggagauccggccacugaaggagaaggaggagaaccugguuaacagccucgugaccgcuggacacggucagguggacaacuucucccugggcguccuaggcauggcccuguuccuggaggagaugcugcggacacgcgugggaaccaagcacgccauucuauuaguggcugucagcuucguaacccugauuaccgggaacauguccuuuaaggaccucggccgggugguggugaugguggggacgaccaugaccgaugacaucggcaugggggucacuuaccuggcccugcucgccgcguuuaagguccgccccacguuugccgcagggcuacuguuacggaagcugacgagcaaggagcugaugaugaccacaaucggcaucguacucuugucccagagcacgauccccgagaccauccuggagcucaccgacgcccuggcccugggaaugauggucuugaagaucguucgcgacauggagaaguaucaacuggcggugaccaucauggccauccugugcgucccgaacgccgugauccuccaaaacgccuggaagguaucaugcacgauacuggccgugguaucaguaucuccccuguuauuaaccagcucccaacagaagaccgacuggauuccguuagcuuugaccaucaaggggcugaacccuacggccaucuuccugaccaccuugucacgcacuaauaagaagcggagcuggccgcugaacgaagcaaucauggcugugggcauggugagcauccuggcguccagccuccugaagaacgacauccccaugacagggccccugguugccggcgggcuccugacaguguguuauguuuuaacuggcagauccgccgaucucgaguuagagcgggccaccgacguaaagugggaagaucaggccgagaucagcgggagcucccccauccuaagcauuacgaucuccgaggacggcagcaugagcaucaagaaugaagaggaagaacaaacgcucacgauucugauccgcaccgguuuacucgugaucagcgggcuguuuccgguauccauccccaucaccgcggccgcaugguaccucugggaggucaagaagcagcgggccggcgucuuaugggacguaccgagcccaccgcccauggggaaggccgagcuggaggacggcgcguaccgcaucaagcagaagggaauccugggguacucccaaaucggagcggggguauacaaggaggggacuuuccauacaauguggcacgugacgcgcggggcggugcugaugcauaagggcaagaggaucgagcccagcugggcugaugucaagaaagaccugaucuccuacgggggcggcuggaagcuggagggggaauggaaggagggcgaggagguccagguguuagcgcucgagcccgggaagaacccccgggcgguccagaccaagcccggccuguucaagacgaacaccggaaccaucggcgccgugagccucgacuucucccccggcacaagcgggucccccauuaucgauaagaagggcaagguugucggacuguaugggaacgguguggugacgcgcagcggggccuaugucucugcaaucgcccagaccgagaagucuaucgaagacaaccccgaaaucgaggaugacaucuuucggaagcgacggcugaccaucauggaccuucaccccggcgcggggaagaccaaacgcuaccuucccgccaucguacgggaggccaucaagcgcggccugagaacgcugauccucgcucccacccggguggucgcggcggagauggaagaggcgcugcgggggcugcccauccgguaccagacccccgccaucagggccgagcacaccggccgcgagaucguggaccucaugugccaugcgacuuucaccaugcgccugcugagcccugugcgagugccgaacuacaaccucaucaucauggacgaggcccacuucaccgauccagcaagcaucgccgcacggggcuacauaagcacgcggguggagaugggggaggcagccggcaucuucaugacggcgacgccgcccgggucucgcgacccguucccccagagcaacgcucccauaauugacgaggagagagagauccccgaacgcuccuggaacaccggucacgagugggugaccgacuucaaagggaaaaccgucugguucgugccgagcaucaaggccggcaacgacauagcggccugccugcggaagaacggcaagaaagugauccagcugucccgcaaaacuuucgacagcgaguacgucaaaacccggaccaacgacugggacuucguggucacgaccgacaucuccgagaugggggccaauuuuaaggccgaacgcgucaucgacccccggcgcugcaugaagcccgugauccucaccgacggagaggagcgggugauccuggcgggacccaugccgguaacccacagcuccgccgcccagcgccgggggcgcauuggacggaaccccaagaacgagaacgaucaguauaucuacaugggcgagccccuggagaacgaugaggacugcgcucacuggaaggaagcaaaaaugcucuuggacaauaucaacacgccggagggcaucaucccgagcauguucgagcccgagcgcgaaaagguagacgcgaucgacggggaguaccgucugcggggcgaggcccgcaagaccuucguggaccucaugcggcggggugaccugcccgucuggcuggcuuacaagguggcugcugagggaauaaacuacgcugacagacgcuggugcuucgacgggaucaagaacaaccaaauccucgaggagaauguggaagucgagaucuggacaaaagagggcgagagaaagaagcugaagccgagguggcuggacgcccggaucuacagugaccccuuggccuuaaaggaguucaaggaguucgccgccggccgcaagagccugacccucaaccugaucacggaaauggggcgacugcccaccuucaugacccagaagacgcgcgacgcgcucgacaaucuggccgugcugcacacggccgaggccggcgggagggcguacaaccaugcccucuccgaacugcccgagacccuugagacccucuugcugcucacucuguuagcgacugucacgggcggcaucuuccucuuccugaugagcgggcgcggcaucgggaagaugacccuaggcaugugcugcaucaucaccgccucaauccuccugugguacgcccagauccagccccacuggaucgcggccagcaucauccuggaguucuuccuuauugugcugcugauacccgagcccgaaaaacagcggacgccucaggacaaccagcucacguacguggucaucgcuauauuaaccguaguugccgccaccauggcgaacgagaugggguuccuugagaagaccaagaaggaccucggccucggcucuauugccacccagcagccggaguccaacauccuggacaucgaccucaggcccgcauccgccuggacgcuguacgccgucgcgaccacuuucgugacgccgaugcugcggcacagcaucgagaacagcuccgugaacgucucucucacggccaucgccaaccaagccacggugcugauggggcugggcaagggcuggccacucuccaagauggacaucggcguuccgcugcuggccaucgggugcuacagccagguuaaccccaucacccucacggcggcgcuguuacuccugguugcucacuacgccaucaucggccccggcuuacaagcgaaagccacccgagaggcccagaagcgggccgcggcggggaucaugaagaaccccaccguggacggcaucaccgucauugaccuagaccccauucccuacgacccaaaguucgagaagcagcugggacagguuaugcuguugauccugugcgugacacagguucugaugaugcgcaccaccugggcucucugcgaggcccugacccuggccacgggccccauuuccacccucugggaggggaacccggggcgguucuggaacacgacuaucgcugugucgauggcgaacauauuccggggcuccuaccuggccggggccggccuccucuucucgauuaugaaaaacacgaccaacacccgccgugggacaggaaauaucggcgagacgcugggggaaaaguggaagucccgccugaacgcccucggaaagagcgaguuccagacauacaagaaaucggggauccaggagguagaccgaacacuggccaaggagggcaucaagcgcggagagaccgaccaccacgcggugagccggggauccgcaaaguugcgcugguucguggagcgcaacauggugacgcccgaaggcaaggucguggaccucggcugcggcagagggggcugguccuacuauugcgggggccuuaagaacgugcgggaggucaaaggacugaccaagggcgggcccgggcaugaggagccaauaccgauguccaccuacggguggaacuuaguccgccugcagagcgggguggacguuuucuuuaucccgcccgaaaagugcgacacacuucucugcgacaucggcgaguccagcccaaacccgaccguggaggccggccggacauugcgcguucugaacuuagucgagaacuggcugaacaauaacacccaguucugcaucaagguacugaaccccuacaugcccagugugaucgagaagauggaggcccuucagcggaaauacgguggcgcgcuaguccgcaacccguuaagcagaaauucgacccacgagauguacuggguguccaacgccagcgguaacaucguguccucagucaacaugauuucccgcauguugaucaaccgguucaccaugaggcacaagaaggccacguacgaacccgacguagaccuggguagcgggacccggaacaucgggaucgaguccgagaucccgaaccuggacauuauuggcaagcgcaucgagaagauuaagcaggagcacgaaaccagcuggcacuaugaccaggaccacccguacaagacaugggcauaccacggcuccuaugagacgaagcagacuggcagcgcuucaagcauggugaacggggucguucggcugcucaccaagccgugggacgugcugcccacagucacgcagauggcgaugaccgacaccacacccuuuggccagcaacgcguguucaaggaaaagguggacacgcgcacccaggagccgaaggagggcaccaagaagcugaugaaaaucacugccgaauggcucuggaaggagcuggggaagaagaagacgccacggaugugcacccgcgaggaguucacccggaagguccgcuccaacgcggcacugggcgccaucuucaccgacgaaaacaaguggaaguccgcccgggaggccguggaggacucgcgauucugggaguugguggacaaggagcggaaccugcaccuggaggguaagugcgagaccugugucuacaacaugaugggcaagcgcgaaaagaagcucggggaguucggcaaagccaagggcucacgggccauuugguacauguggcugggggcccgcuuccuggaguucgaggcgcucggcuuccugaacgaagaucacugguucucgcgggagaauagccuguccgggguggagggcgagggacugcacaagcugggcuacauccugcgcgacgucaguaagaaggaggguggggccauguaugccgacgacaccgccggcugggacaccaggaucacccucgaggaccugaagaaugaagaaauggugacgaaccacauggagggugagcauaagaaguuggcggaggccaucuucaagcucacauaccagaacaaaguaguccgugugcagcggcccacgccccggggcaccgugauggacaucaucagccggagggaccagaggggguccggccaggucggcaccuacgggcugaacaccuucaccaacauggaggcucagcugauccgccagauggagggcgaggggguuuucaagaacauccagcaucucaccgcgacggaggagguggccgucaagaauuggcuggcgcggguaggcagggaaagguugagccggauggccaucuccggcgacgacugcguggucaagccgcuggacgaucgcuucgccaacgcucugaccgcccugaacgacauggggaagauccgaaaggacauccagcagugggagccgaguaaagguuggaaugacuggacccaggugcccuucuguucccaccauuuucacgagcugaucaugaaggaugggcgcguccuggucguuccuugccggaaccaggacgagcugaucggccgcgcgcggaucagccagggggccggauggucacuccgcgagaccgccugccugggcaagucguacgcccagauguggucccugauguacuuccaccggcgggaccuucggcuggccgcgaacgccaucugcagcgcugugcccucccacugggucccgaccagccgcacgacauggaguauacacgcuaagcacgaguggaugaccaccgaagauaugcugaccguauggaacaggguguggauccgcgagaaccccuggauggaggacaaaaccccggucgaaagcugggaggagauccccuaccucggcaagcgggaagaccaguggugcgggucccugaucgggcugacuagccgugcaaccugggccaagaacauccaggccgccaucaaccaggugcggagucucaucggcaaugaggaguauacggacuacaugccgagcaugaagcgcuuccggcgcgaggaggaagaggccggggugcugugguga

SEQ ID NO: 24958 - RNA, 9876 nt, Artificial Sequence
  derived and/or modified CDS sequence (opt11) from DENV-2__GU131931__SS-prME
agugcggggaugaucaucaugcugauccccaccgugauggccuuucaccucaccaccagaaauggggaaccgcacaugaucguagggauucaggagaagggaaagucccugcuguuuaagaccgaggacggcgucaauauguguacccugauggcgauggaccugggugaguuaugcgaggauacuaucaccuauaagugcccccuccugcggcagaaugagcccgaggacaucgacugcuggugcaauagcacaucuaccugggugaccuacgggaccugcacgaccaccggcgagcaccgccgcgagaagcgcagcgucgcccuggugccccacguggggaugggccucgagacccggaccgagaccuggaugucgucagaaggggcuuggaagcaugcccagcgcaucgagacguggauccugcggcacccgggcuucaccaucauggcggccauccuugcacauaccauagggaccacccacuuucagcgcguccuuauauuuaucuuacuuacggcuguggcacccuccaugaccaugcggugcaucggcaucaguaaccgcgacuucguggagggcguuagugggggcagcuggguggacauagugcuugagcacggcuccugcgucaccaccauggcgaagaacaaacccacgcuggauuucgagcucaucaagaccgaagccaaacagcccgccacccugcggaaguacugcaucgaggcaaagcugacaaacacgaccaccgaaagccgcugucccacccagggcgagcccuccuuaaaggaggagcaggacaaacgguucgugugcaagcacuccaugguggaccgcggcugggggaaugggugcggccuguucggcaagggcgggaucgucacgugcgccauguucacgugcaagaagaacauggagggcaagaucguccagccugagaacuuggaguacaccauugugguaacgccccacuccggagaggaacacgcggugggcaacgacacggggaagcacggcauggagaucaagguuacuccgcaguccuccaucaccgaggccgagcuuaccggguacggcaccgucacgauggagugcagcccccggaccggccucgacuucaacgaaauggugcugcugcagauggagaacaaggcauggcucgugcaucgucagugguuucuggaccugccccucccauggcugccgggggccgacaagcaggaauccaacuggauccagaaggagacccuugucacuuucaagaacccccacgccaagaaacaggacgugguaguccuaggcagccaggagggggcuaugcacacagcgcuuaccggcgcaaccgagauccagaugagcuccgggaaucuccuguucaccggacaccugaagugccggcugcgcauggacaagcuccagcugaagggcaugagcuacucuaugugcacgggcaaguucaagguggucaaagaaaucgccgagacccagcacgguaccaucgugaucagggugcaauacgagggggacggcucccccugcaagauccccuucgagaucauggaccuggagaagcguuacgucuuaggccggcugaucaccguaaacccgaucgugacggagaaggacucccccgucaauaucgaggccgagccgcccuucggggacagcuacaucaucauaggcguggagccgggucagcugaagcucaacugguucaagaagggcuccuccauaggccagauguucgagaccaccaugcgcggcgcgaaacgcauggccauccugggcgacacugccugggacuucgggagucuaggaggggucuuuacgaguaucggcaaggcccuccaccaaaucuucggggccaucuacggcgcggccuucuccggcgucagcuggaccaugaagauacuaaucggagugauaaucaccuggaucggcaugaacagucgguccacgucucuuagcgugaguuuaguccucguggggaucgugacccuguaucugggcgucaugguccaggcagacagugggugcguggucuccuggaagaacaaggagcucaagugcggcagcggcaucuucaucaccgacaauguacauacauggaccgagcaguacaaguuccagccugagagcccauccaagcuggccagcgcgauccagaaagcucaagaggaggguaucugcggcauccgcuccgucacgcggcuggagaaccugauguggaaacagaucacaccugagcugaaccacauccuggcugagaacgaggucaagcucaccaucaugaccggggacaucaagggcaucaugcaggccgggaaacgaagucugcggccgcagcccacggagcugaaguacuccuggaagaccuggggcaaagccaaaaugcuaagcacugagucccacaaccagaccuuuuuaauugacggacccgagacggcggaaugucccaacacuaaccgcgccuggaacagucuggagguugaggacuacggguucggcguguucaccacgaacaucuggcucaagcuaaaggagaaacaggacgccuucugcgacuccaaguuaaugagugccgcgaucaaagacaaucgggcggugcacgcggacaugggguacuggaucgaguccgcucugaacgacacguggaagaucgagaaggccucuuucauugaggugaagaacugccacuggcccaagucgcacacccucuggaguaacggcgugcuggaguccgagaugaucauccccaagaaccucgccggccccgucagccagcacaacuaccgcccgggguaccauacacaaaucgcgggacccuggcaucugggaaagcuagagauggacuucgacuucugcgacggaaccaccgugaucgugacggaggacugugggaacagaggccccuccuuacgaaccaccaccgccagcggcaaguuaaucacagaguggugcugccggagcugcacccugcccccgcuccgcuaccgcggggaggauggaugcugguacgggauggagauccgcccccucaaggagaaggaggagaaccuaguuaacucccucguaaccgccggccacggucagguggacaauuucagccuaggcguccucggcauggcccucuuccuugaagagauguuacggacccgcguggggacgaaacacgcgauccuuuuaguggccgucuccuucgugacacuaaucaccggcaacaugagcuucaaggaccucgggcggguggucgugaugguuggagcuaccauggccgacgacaucgggaugggcgucacguaccuggcccuucucgcggcauucaagguucgaccuaccuucgccgccggccugcugcuccgcaagcugaccagcaaggaguuaaugaugaccacgaucgggaucgugcuccugagccagucaaccauccccgagaccguccuggagcucaccgacgcacuggcgcugggcaugauggugcucaagaucgugcgaaacauggagaaguaccagcuggccgucacgaucauggccauccugugugucccgaaugccgucauccuccagaacgccuggaaagucagcugcaccauccuggcgguggucuccguaagcccucuguuguuaaccuccagccagcagaagaccgacuggaucccccuggccuuaacaaucaaggggcugaaccccaccgccaucuuucugacgacccucucccgcacgaacaaaaagcggagcuggccgcugaacgaagccaucauggcggugggcaugguguccaucuuggcuagcucacugcuuaaaaacgacaucccuaugaccgguccccugguggcagggggucuccuaacugucugcuacguccuuacggggcgcagcgccgaccucgaguuagagagggccacggacgugaagugggaagaccaggcggagaucuccggcagcagccccauccugucuaucacaaucagcgaggacgguuccaugagcauaaagaaugaggaagaggaacagacccucaccauccugauucgcacgggccugcuggugauuucuggccuguucccgaucagcauccccaucaccgccgccgcgugguaucugugggaggucaagaagcagcgggccggggugcucugggacgugcccucuccaccacccaugggcaaggcggagcuggaggacggggccuaccgcaucaagcagaagggcauccuaggguauagccagaucggcgcgggugucuacaaagaaggcaccuuccacaccauguggcacguuacccggggcgccgugcuuaugcacaaggggaaacgcaucgagcccuccugggcugacgucaagaaagaccugaucuccuauggcgguggcuggaagcuggagggcgaguggaaggagggggaggagguccagguucucgcgcuggagcccggcaaaaacccccgggcaguacagacgaaaccaggucuguucaaaacaaacaccggcaccaucggggcagugagccuggacuucagccccggcacguccggcagcccaaucaucgacaaaaaggggaaagucgucgggcuuuacgggaaugggguggugacccgcaguggcgccuacgucagcgcaaucgcacaaacagaaaagagcaucgaagacaacccugagauugaggaugacaucuuccggaagcgccgguuaaccaucauggaccugcaccccggggccggcaagacgaagcgcuaucucccugcgauagugcgggaggccaucaagcgcgggcugcggacccuuauccuagcgccgacccgcguggucgccgccgagauggaggaggcacugagaggucugcccauccgcuaccagaccccggcuauccgggcggagcacacggggcgagagaucguggacuugaugugccacgccaccuucaccaugcgccugcugagcccggugcgggucccgaacuauaaccucauaaucauggacgaggcccacuucaccgacccagccucgauagccgcgcgcggcuacaucagcacgagaguagagaugggcgaagccgccgggaucuuuaugacggccacgccgcccggaucucgagaccccuucccgcaguccaacgcucccaucaucgacgaagaacgggagauccccgagagaucauggaacuccggccacgagugggugaccgacuucaaggguaaaacugucugguucgugccgagcaucaaggcggggaaugacauagccgcgugucugagaaagaacgguaagaaagugauucagcuaucgcgcaagaccuucgacagcgaguacgucaagacccggaccaacgacugggacuucguugugacuacggauaucuccgagaugggggccaacuuuaaggcggagcgagucaucgauccccggcgcuguaugaaacccgucauccucaccgacggggaggagcgggugauccuggccggcccaaugccggucacccacagcuccgccgcccagcgccgcggucgcauaggccggaaccccaagaacgagaacgaucaguacauuuacaugggggagccccuggagaacgacgaggacugcgcccacuggaaggaggcaaagaugcuacuggacaacaucaacaccccugagggcaucaucccuucgauguucgagcccgagcgcgagaaaguggacgccauagacggcgaguaccggcugcgcggggaggcucguaaaaccuucguggaccucaugcgacguggcgaccugcccgucuggcuggcauacaagguugccgcagaggggaucaacuacgccgaccggcguuggugcuucgacggcaucaagaacaaccagauccucgaggagaacguugagguugagaucuggacaaaggagggagagcggaagaagcugaagccgcgcuggcuugacgcccggauauacuccgacccccucgccuuaaaggaguucaaggaguucgccgccggccgcaagucacugaccuuaaaccugaucacggagaugggacggcugcccacguucaugacacagaagacacgggacgcccucgacaaccuggccguacugcacacggccgaggcuggcgggcgggccuacaaucacgcccuuuccgaacuaccagagacccuggagacccugcugcugcucacccugcuggcuacggucaccgggggcaucuuccuauuccugaugagcggccgcgggaucgguaagaugacacuggguaugugcuguaucauaaccgccaguauccuccugugguaugcgcagauucagccgcacuggaucgccgccagcaucauccuggaguucuuccucaucgugcuguuaauccccgagcccgagaagcagcggacgccgcaggauaaccagcucacauacgucgucaucgccauucugacaguaguagccgcgaccauggccaacgaaaugggcuuuuuggaaaagacuaagaaggaccucgggcugggcuccaucgccacgcagcagccggagagcaacauccuggacauugaucuccgccccgccuccgccuggacccuguacgcggucgccacaaccuucgugacgcccauguugagacacagcaucgaaaacucuuccgugaacgucagccugaccgcaauagccaaccaggcgaccgugcugaugggccugggcaaaggcuggcccuuaaguaagauggacaucggagugccgcugcuggcaaucggaugcuacagccaggucaacccgauuacccucaccgccgcgcugcugcuccugguggcccauuaugcgaucaucgggcccggccuccaggccaaggccacccgcgaggcgcaaaagcgggcagcggccggcaucaugaaaaaccccaccguggacggaaucaccgugaucgaccucgaucccauccccuacgaccccaaguucgagaagcaauuaggacaggucaugcuguugauccugugcguaacgcaaguccuaaugaugcgcaccaccugggcccucugcgaggcucugacccuggcgacggggcccaucaguaccuugugggagggaaaccccgggcgguucuggaacaccaccaucgcagugagcauggccaacaucuuccgcggcaguuaucuugccggcgccgggcuacucuucagcauuaugaaaaauacgaccaauacccggcgaggcacugggaacaucggcgagacguuaggcgagaaguggaagucucgccugaacgcccucggaaaguccgaguuccagaucuacaagaaguccggcauucaggagguggaucggacccuggcaaaggaggggaucaagcgcggcgagaccgaccaucacgccgugucgaggggguccgccaagcugcgcugguucgucgagcgcaacauggugacccccgagggcaaggucguggaccucggcugugggcgcggaggguggaguuacuacugcggcgggcuuaagaacgucagagaggucaagggccugacgaagggugggcccggccacgaggagccaaucccgaugagcaccuacggguggaaucucgugcggcugcagagcggcguggacgucuucuucauaccgcccgagaagugcgauacccuucucugcgacaucggggagagcagccccaacccgacuguggaggcuggccggacucugcgcgugcugaaccucguagagaacuggcugaacaacaacacucaguucugcaucaaggugcugaaccccuauaugcccuccgucaucgaaaagauggaggcgcugcagcggaaguacggaggugcccucguccggaauccguugagccggaacagcacgcacgagauguauuggguguccaacgccagcggcaauaucguauccagugucaacaugaucucccgcaugcugauaaaccgguuuaccaugcgacauaaaaaggccaccuacgaaccggacgucgaccuugggagcgggacucggaacaucgggaucgaaucugaaauccccaaucuggacauuaucggcaagcgcaucgagaagaucaaggaggaacaugagacgagcuggcacuaugaccaggaccaccccuacaaaacuugggccuaccacggcuccuaugagaccaagcaaacugggagcgccucaagcaugguuaauggcgucgugcggcugcucaccaagccgugggacgugcugcccacugucacccagauggccaugacggacacuacccccuucgggcagcagcgcgucuucaaggagaagguggauacccgcacgcaggagcccaaggaggguaccaagaagcugaugaagaucacagccgaguggcuuuggaaggaacugggcaagaaaaagacuccccggauguguacgcgcgaggaguucaccaggaagguccgaucaaacgccgcccugggggcuaucuucaccgacgagaacaaguggaagucggcccgggaggccguggaggacucccgauucugggagcucguugacaaggaacgcaaccugcaccuggaggggaagugcgagaccugcgucuacaacaugauggggaagagagaaaagaagcucggcgaguucgggaaggccaagggcucucgagccaucugguacauguggcugggcgcgcgguuccuggaguucgaggcccucggguuucugaacgaggaccacugguuuucccgggagaacagccucuccggcguggaaggggagggccuccauaagcugggguacauccuccgagaugucucaaagaaagaagggggcgccauguacgccgacgacacggcgggaugggacacccggaucacacucgaggaccugaagaacgaggagauggugaccaaccacauggagggcgagcauaagaagcuggcagaggccaucuucaaacucacuuaccagaacaaggugguccgcgugcagcgccccacgcccagagggaccgugauggacaucaucagccggagagaccagcgggguuccgggcaggucggcacuuacgggcugaacacguucacaaacauggaagcccagcugaucagacagauggagggggagggcguguucaagaauauccagcaccucaccgugaccgaggaggccgcgguacagaacuggcuggcaaggguggggcgagagcgccugagccggauggcgaucuccggcgacgacugcguggucaagccccucgacgaccgcuucgcaaacgcccugacggcgcugaacgacaugggcaagauccggaaggacauccagcagugggagccgaguaagggguggaaugacuggacccaggugcccuucugcucccaccacuuccacgaguugaucaugaaggauggccgcgugcuggucgugcccugccggaaucaggacgaacugaucgggagggcacggaucagccaaggcgcgggguggucccugcgcgagacugccugucugggcaagucauacgcccagauguggucacuaauguacuuccaccggcgcgaccuccggcuugcggccaacgccaucugcagcgccguacccucccacuggguaccaaccucgcgcacgaccugguccauccacgccaagcaugaguggaugacaaccgaggacaugcugaccguguggaaccgggucuggauucgcgagaaucccuggauggaggacaagacccccgucgagagcugggaggagaucccguaccucggcaagcgagaggaucaguggugcggguccuuaauuggccugaccagccgcgcgaccugggcuaagaacauccaagccgccaucaaccaggugcggucacucauagggaacgaggaguacaccgacuacaugccaagcaugaagcgcuuccggcgcgaggaggaggaggcaggcgugcugugguga

SEQ ID NO: 24959 - RNA, 9876 nt, Artificial Sequence
  derived and/or modified CDS sequence (opt11) from DENV-2__GU131932__SS-prME
agcgcaggcaugaucaucauguugaucccgacugugauggccuuccacuuaaccacccgcaacggugagccccacaugaucgucggcauccaggagaagggcaagucccuauuauucaagaccgaggacggcguaaacaugugcacccucauggcgauggaccugggggagcucugcgaggacacaaucacguacaagugcccccuccugcgacagaacgagcccgaagacaucgacugcugguguaacagcaccagcacgugggugaccuacggaaccuguacuacaacgggcgagcaccgccgcgaaaaacgcagcguagcacuggugccgcacguggggaugggucuagagacucguacagagaccuggauguccagcgagggggccuggaagcacgcccaacgaauagagaccuggauucugcgucacccgggcuucacgaucauggccgcgauccuggccuacacgauugggacaacccauuuccagcgcguccuuaucuuuauacugcugacggcuguggcccccuccaugaccaugaggugcaucggcaucagcaaccgagacuucgucgagggagucuccgggggcucguggguggacaucgugcucgagcacggguccugugucaccaccauggcuaaaaacaagcccacguuggacuucgagcugauuaagacugaggcgaagcagccugccacacuccggaaguacugcauugaggccaaacugacaaauacgaccaccgagagcagaugccccacccagggcgagcccucccugaaggaggagcaggacaagagauucgugugcaagcacucaaugguggaccgcggcugggggaacggcugcggccuguuuggcaagggcgggaucgucacgugcgccauguucacgugcaagaagaacauggagggcaaaaucgugcagccggagaacuuagaguauaccauugucgucacgccccauuccggugaggagcacgcggugggcaacgacacggggaagcacggcauggaaaucaagguaaccccccaauccaguaucaccgaggccgagcugaccggguacggcaccgucacgauggaguguagcccucgaaccggccucgacuucaaugagauggugcuacugcagauggagaauaaggccuggcucgugcaccgccaaugguuccuggaccugccccuccccugguugccgggggccgacaagcaggaguccaacuggauccaaaaagagacccuggucaccuucaagaauccacacgccaagaagcaggacguggucgugcucgggagccaggagggggcgaugcacacggccuuaacuggcgccaccgagauucaaaugagcuccgggaacuuacuguucaccggccaccugaagugucggcuacgcauggacaagcuccagcuaaagggcaugagcuacuccauguguacggggaaauucaaaguagugaaagaaaucgcugagacccagcacggcaccaucguaauccgggugcaguacgagggggacggaagccccugcaagauucccuuugagaucauggaccuggagaaacgcuacguccucggccggcugauuacugugaaccccaucgugaccgagaaggacuccccggucaacauugaggccgagccucccuuuggggacagcuacaucauaaucggcguggagcccgggcagcuaaaacucaacugguucaagaaaggcuccagcaucgggcagauguucgagaccaccaugcguggcgcuaagcgcauggccauccuaggggauaccgccugggacuucgguucccuggggggcguguuuacgucgaucggcaaggcacuccaccaggucuucggcgcgaucuacggcgcugccuuuuccggcgugucguggaccaugaagauauugaucggggugaucauaaccuggauuggcaugaacuccagguccaccucccugagcgucagucugguacucguggggaucgucacguuguaccugggcgugauggugcaggccgauagcgggugcgucgugucguggaagaacaaagaacugaagugcggcagcgguaucuucaucaccgacaacguacacaccuggaccgagcaguacaaguuccagccggagucacccucgaagcuggccagcgcaauucagaaggcccaggaggaggggaucugcggcauccgcuccgucacgaggcuggaaaaccucauguggaagcagaucacccccgagcugaaccacauacuggccgagaacgaggugaagcugaccaucaugaccggagacaucaagggcaucaugcaggccggcaaaagaucacugagaccgcagcccacggagcugaaguacuccuggaaaaccuggggcaaagccaagaugcucagcaccgaauccuacaaccagaccuuccugauugacggccccgagacugcggagugccccaauacgaaccgcgcauggaacucacuugagguggaggacuacggguuuggcgucuucaccacaaacaucuggcucaaguuaaaggagaaacaagacgcauucugcgacuccaagcugaugagcgccgccauaaaggacaaccgggcgguccaugccgacaugggguacuggaucgaguccgcgcucaacgacacguggaaaauagagaaggccagcuuuaucgaagugaagaacugccacuggcccaaaucccacacccuguggagcaacgguguccuggaguccgagaugauuauccccaagaaccucgccgggcccgugagccagcacaacuaccgcccuggguaccauacccagaucgcgggccccuggcaccuggggaagcuggagauggacuucgacuucugcgacggcaccacaguaaucgucacagaggauugcgggaaccggggccccagccuucgcaccaccaccgcgagcggcaagcugauuacagaauggugcugccguagcugcacccugccccccuugcgcuaccgaggggaggacggcuguugguacgggauggagauccgcccucucaaggagaaggaggagaaccuggugaacucccucgugaccgccggccacgggcaggucgauaauuucagccugggugugcuaggcauggcccuauuccuggaggagaugcugcgcacccgcguggggacgaagcacgcgauccuccuuguugccguguccuucgugacccugaucaccgguaacaugagcuucaaggaccucggucgggucguggugauggucggcgccaccauggccgacgacauagggaugggcgugacguaccuugcccugcucgcggccuucaaagugcgccccaccuucgcggccggccuucugcuccggaagcugaccucaaaggaacugaugaugaccacuaucggcauugugcucuuaagccaguccaccauucccgagaccguucuggagcucaccgacgccuuggcgcugggcaugauggugcucaagaucguccgcaacauggagaaguaccagcuagccgugacgauaauggcgauccuaugcguuccgaacgcggugauccuccagaacgcauggaagguguccugcacuauccuggcuguuguauccgugagcccccugcuucugaccuccagccagcagaagaccgacuggaucccccuggcccucacgauuaaggggcugaaccccacagccaucuuccugaccacccucucgcgcacgaauaagaagcgaagcuggccgcugaacgaggccaucauggcggucgguaugguguccauccuggccagcucccuccugaagaaugacauccccaugacgggaccucugguggccgggggucuccugaccgucugcuacgugcugaccgggcgcagcgcggaccucgagcuggagcgggccacugaugugaagugggaggaccaggcggagaucuccggcagcucaccuauccuguccaucaccaucagcgaggacggguccaugucgaucaagaacgaggaggaggagcagacccucaccauucugauccgcaccgggcugcucgucaucagcggccuguucccgauaagcauccccaucacggccgcugccugguaccugugggaggugaagaagcagcgggcaggggugcucugggacguccccagcccgccccccaugggcaaggcggaguuagaggacggggccuaccgcaucaaacagaagggcauccugggguauagccaaaucggcgccggcguuuacaaagaagggaccuuccacaccauguggcacgugacccggggugccguccucaugcacaaggggaagaggaucgagccguccugggccgacguuaagaaggaccugauaucauauggcgggggcuggaagcuggagggcgaauggaaggagggggaagagguucagguccucgcgcuggagcccgggaagaacccccgggcggugcagacgaagcccggccuguuuaagaccaacaccgguaccaucggagcaguuucccucgacuucagccccggcacguccgggagccccaucaucgauaagaaggguaaggucgugggccuguacgggaauggcgugguuacccgcuccggcgcuuacguuagcgcgaucgcgcagacggagaaguccauugaggacaaccccgagaucgaggacgacaucuuccggaagcgccggcugaccaucauggacuuacaccccggcgccggcaagacuaagcgcuaccuucccgccaucgugcgggaagccaucaaacgcggguuacggacccucauccuugcgccgacccgcgucguggccgccgagauggaggaggcccuucggggacugcccauccgcuaucagacgccugccauccgagccgaacauacggggcgugagaucguugaccucaugugccacgcuacuuuuaccaugcgccuucugagccccguacgggugcccaacuacaaccucauaaucauggacgaagcccacuucacggaccccgcaucgaucgccgcccgcggcuacaucagcacccgggucgagaugggcgaggccgccgggaucuuuaugaccgcuacgccaccuggaucacgcgacccguucccccaguccaacgcacccaucauugacgaggagcgggagauacccgaacgcagcuggaacuccgggcacgaaugggucaccgauuuuaagggcaagaccgugugguucguaccaagcaucaaggcgggcaacgauaucgcugcgugccuccgaaagaacggcaagaaggucauccagcugucccgcaagacguucgauagcgaauacgucaagacccggaccaaugacugggauuucguggucacgaccgacaucagcgaaaugggcgccaacuuuaaagcagagcgcgugaucgauccccggcguugcaugaaacccgugauccucaccgacggggaagaaaggguaauccuugccggacccaugccggugacccacagcucagcggcccaacgccgggggcgcaucggcagaaaccccaagaacgagaacgaccaguacaucuacaugggggagccccuggagaacgacgaggacugugcccacuggaaagaagccaagaugcuucuggacaacaucaacacgcccgaaggcaucauaccgagcauguucgagcccgagcgcgagaagguggacgccaucgacggcgaguaccggcugcgcggggaggcccggaagaccuuugucgaccucaugcggcgcggcgaccugcccguguggcuggcuuacaagguggccgcggaggguaucaacuacgccgaccggcgcuggugcuucgauggcauaaagaacaaccagauccucgaggagaacgucgaaguggagauuuggaccaaggaaggggagaggaagaagcugaagccacgcuggcuagacgcccggaucuauuccgacccacucgcccugaaggaguucaaggaguuugcagcgggccgaaagucguuaacccucaaccugaucacggagaugggccgguuacccaccuucaugacccagaagacccgcgacgcccucgacaacuuagccguccugcacacugccgaagccggcgggcgggcuuacaaccacgcccucuccgagcugcccgagaccuuagagacccucuuguuacucacacuacuggcgacagugaccggggguaucuuccucuuccuaaugucaggucgcgggaucggcaagaugacacuggggaugugcugcaucaucaccgcuuccauucuccugugguacgcccagauccagccgcacuggaucgccgccagcaucauccuugaguucuuccucaucgugcugcugauccccgagcccgagaaacagcguaccccccaggacaaccaacucacguacgucgugaucgcgauccuuaccguggucgccgcgaccauggccaacgagaugggcuuucuggagaagaccaagaaggacuuaggacugggcucaaucgccacgcagcaaccggagucaaacauacuggacaucgaucuaaggcccgcguccgccuggacccuguacgcgguggccaccaccuucgugacuccuaugcugcggcacaguauagagaacagcuccgucaaugucagccucaccgccaucgcgaaccaggccaccguccugaugggccuagggaaagguuggccccucucaaaaauggacaucggggucccgcugcuggcgaucggaugcuacagccaggugaauccgaucacacucacggccgcccugcuacuccugguggcccauuaugcgauuaucgggcccggcuuacaggcuaaggcaacccgcgaggcccagaagagagccgccgccggcaucaugaagaaccccacaguagacgggauuacuguaaucgaccucgacccgauccccuacgaccccaaguucgagaaacagcuuggccaggugaugcuucucauccugugcgugacccagguguuaaugaugcgcaccaccugggcccucugcgaggcgcuaaccuuggcuacggggcccauauccaccuugugggagggcaauccuggccgguucuggaauaccacaaucgcggugaguauggccaauauauuccgcggcuccuacuuagcaggcgccggguuacucuucagcaucaugaagaacacgacgaacacacggcggggcaccgguaacauaggggaaacgcugggcgagaaguggaagaaccgccucaacgcccucgggaaguccgaguuccagauuuacaagaaguccggcauccaggaagucgacagaacgcucgcgaaggaggggaucaagcgcggcgagaccgaccaccacgccgucucacgugggagugccaagcuacguugguucguggagcggaacauggucacccccgagggcaaggugguggaccucggcugcgggcgcggcgggugguccuauuacugcggaggacugaagaacguacgggaagugaagggccugacgaagggcggucccggccacgaggagcccaucccgaugagcaccuacggcuggaaccucgugcgccugcagucgggcgucgacguguuuuucaucccgcccgagaagugcgacacccugcugugcgacaucggagagagcucccccaacccgaccguugaggcaggccggacgcugcgcguccugaaccucguggagaacugguuaaacaacaacacccaguucugcaucaaggugcuuaacccuuauaugcccagcguuauagagaagauggaggcgcugcaacggaaguauggcggagcccucgugcgcaacccgcugucccggaauagcacccacgagauguauugggugucaaacgcguccggcaacauugucagcagugugaacaugaucagccguaugcugaucaaccgguucaccaugaggcacaagaaggccacuuacgaacccgacguggaucucggaucgggcacgcggaacaucggaaucgagucugagaucccaaaccuggacaucaucggcaagcgcaucgagaagaucaaggaggaacaugagacuagcuggcacuacgaccaggaccaucccuacaagaccugggcuuaucacggaagcuaugaaaccaaacagacggggagugcaucguccauggucaaugggguaguacggcugcucaccaagccgugggacguccugccuaccgugacccagauggccaugacggauaccacgcccuucgggcagcagagaguguucaaggagaaagucgacacccgcacgcaggagccuaaggaggggacuaagaagcugaugaagaucaccgccgaguggcucuggaaggagcugggcaagaaaaagacgccgcggaugugcacgcgcgaggaauucacccgaaaggugcgaagcaacgcugcccugggugcgaucuuuaccgacgagaacaaguggaaguccgcccgggaggccguggaggacagccgcuucugggagcucguagacaaggaacggaaucuacacuuggagggcaagugcgagaccuguguguacaacaugauggggaagcgcgagaagaagcucggcgaguucgggaaggccaagggcaguagggccaucugguacauguggcugggcgcgcgcuuucuggaguucgaggcccucggguuccuaaacgaggaccacugguucagccgcgagaacucccugagcggcguggagggcgagggccuccacaagcugggauacauccugcgcgauguuuccaagaaagagggcggcgccauguacgccgacgauacggcugggugggacacccggaucacgcucgaggaccugaagaaugaggagauggugaccaaccacauggagggcgagcacaagaagcuggccgaggccaucuucaagcucacguaccagaacaagguggugcgcgugcagagaccaacacccagggggacagugauggacaucaucagccggcgcgaccagcgaggcagcggucaggugggaaccuacgggcugaacaccuucaccaacauggaggcucagcugauucgccagauggaaggagagggcguguucaagaacauccagcaucucaccgugacugaggaggccgcggugcagaacuggcuggcccggguggggcgcgagcgccugagucggauggcaaucagcggcgacgacugcgucguaaagccccucgacgaucgcuucgccaacgcucugacggcgcugaacgauaugggcaagauccggaaggacauccagcagugggagccguccaagggauggaacgacuggacccagguacccuucugcucucaccacuuccacgaguuaauaaugaaggacggcagaguucucguggugcccugccggaaccaggaugagcugaucgggagagccaggauuucccagggcgccggauggagucuccgcgaaaccgccugccugggcaagagcuacgcccagauguggagcuugauguacuuccaccggcgcgaccuccggcuagcggccaacgccaucugcuccgccguccccagccacuggguuccgaccucccgcacgaccuggagcauccacgccaagcacgaguggaugaccaccgaagacaugcugacaguguggaaccgggucuggauccgggaaaaccccuggauggaagacaagacccccguggaguccugggaggagauccccuaccucggaaagcgggaggaucaguggugcgggagccuuaucggcuugaccucccgcgcgaccugggcaaagaacauccaggcagccauuaaccagguacguagccucaucgggaacgaggaauacaccgacuacaugccguccaugaagcgcuuucggagggaggaggaggaggcgggcguccugugguga

SEQ ID NO: 24960 - RNA, 9876 nt, Artificial Sequence
  derived and/or modified CDS sequence (opt11) from DENV-2__GQ199892__SS-prME
accgccggggugaucgugauguugauccccacggcgauggcguuucaccugaccacgaggaauggggagccccacaugauagugggccgacaggagaaggggaagucccugcuguucaagaccgaggacggcgugaauaugugcacccucauggccaucgacuuaggggagcucugcgaggacaccauuacguacaagugcccccuccuacgccagaacgaacccgaggacaucgacugcuggugcaacagcaccuccaccugggucaccuacggaaccugcaccaccacgggugagcaccggcgcgagaaacggaguguggcucugguuccccacgucgggaugggucucgagacccggaccgagaccuggaugucuucggagggggccuggaaacauguccagcgaauagagacauggauccuucgccacccgggguucacaaucauggccgcgaucuuggccuacaccaucgggaccacgcauuuucagcgggcccucaucuuuauccugcugacagccguugcgcccucgaugaccaugagaugcaucggcaucaguaaucgcgauuuuguggaagggguaucugggggauccuggguggauaucgugcuagagcacgggucuugcguaaccacgauggccaagaacaaacccacccuagauuuugagcugaucaagaccgaggccaagcagcccgcaacccuccgcaaguacugcaucgaggccaagcugacgaacacaaccaccgagucccggugcccgacgcagggcgagcccucccugaacgaggagcaggacaagcgcuuuaucugcaagcacucgaugguggaccggggcugggggaacggcugcgggcuguuugggaagggagggaucguuacuugcgcgauguuuacgugcaaaaagaauauggaggguaagaucgugcagcccgagaaccuggaguacaccaucgugauaacgccucacagcggggaggaacaugccguggguaacgauaccgguaagcaugggaaggagauaaagaucacaccccaguccagcaccaccgaggcugaacugacgggguacggcaccguuaccauggagugcagcccccggacaggguuagauuuuaacgagauggugcugcugcagauggaagauaaagcguggcucguccaccgucagugguuccuggaccugccgcuccccuggcugcccggggccgacacgcaggggagcaacuggauccaaaaggagacccuggugaccuuuaaaaauccccacgcgaaaaagcaggacgucgucguucucgggucacaggagggcgcgaugcacacugcccugacgggugccacagagauucagaugucgucgggcaaccuccuguuuacugggcacuuaaagugccgccuccggauggacaaacuccaguugaaaggcaugucguacagcaugugcaccggcaaauucaaaaucguuaaggaaauugccgagacccagcacgguaccaucgugauucgcgugcaguacgagggagacggcgcgcccugcaagauccccuucgagaucacugaccuugaaaagcggcacguucucgggcgacugaucacggucaacccgaucgugacggagaaggacuccccggucaauauagaggccgagccgccguucggcgauaguuacaucaucgugggaguggaaccuggccagcugaagcucaacugguuuaagaaggguuccucaaucggccagauguucgaaacgaccaugcgcggcgccaaaaggauggccauccugggggacaccgcuugggacuucggcagccucggcggcgucuucacgaguaucgggaaggcucuccaucaggucuucggggccauuuacggcgccgccuucuccggggugagcuggaccaugaaaauccugauaggcgucauuauuaccuggaucgggaugaacucacgaagcacgucgcugagcgugucucuggugcucgucggcguagugacccuguaccugggggccaugguccaagcggauagcggcugcauagugucauggaagaauaaggagcucaaauguggcagcgggauauucauaaccgacaacgugcauacauggaccgagcaauacaaguuccagccggaaucacccucaaagcuggccagcgcgauccagaaggcccaugaagaggguauaugcggaauccgguccgucacccgccuggagaaccucauguggaaacagaucacuccggaguugaaccauauacugucggagaacgaggugaagcucacaaucaugaccggagacaucaaggguaucaugcaggcgggcaagcgaucccugcgcccccagcccacggaacugaaauacuccuggaagacauggggcaaggcaaagaugcucuccaccgaaagucacaaccagacuuuucugaucgacgggcccgagacggcugaguguccgaacacaaaccgggccuggaacucccuggagguggaagauuacggauucgggguuuucagcacuaacauuuggcucaagcugcgcgagaaacaggacguuuucugcgacuccaagcugauguccgccgcgaucaaggacaaccgggccguucacgcagacaugggcuacuggaucgaguccgcccucaaugauaccuggaagauggagaaggccuccuucaucgaggucaaguccugccauuggcccaagucucauacccuuugguccaacggcguacucgagagcgagaugauuauuccuaagaacuucgcgggccccgugagccagcacaauuaccgacccggcuaccacacgcagacggcgggucccuggcaccucggcaaacuggagauggacuucgacuucugcgaggggaccaccgucgugguuacagaggacugcggcaaccgggggcccagccugaggacgaccaccgccagcgguaaacucauaacggaaugguguugccgcucaugcacccugcccccgcugagauaccggggcgaagacgguugcugguauggcauggagauucgcccacucaaggagaaggaggaaaauuuggucaacucguuaguuacggcagggcacggucagauugacaacuucucccucggcauccucgggauggcgcuguuuuuagaagagaugcugagaacucgcgugggcacgaagcaugccauccuccucgucgcccugagcuucguuaccuuaaucaccggaaacauguccuuccgggaccucggccgcgucaugguaauggucggggccaccaugaccgacgacaucggcaugggcgugaccuaccuggcccugcucgcggcauucaaagugcgccccaccuuugccgcggggcugcuguuacggaaguugaccagcaaggaacuaaugauggccacgaucggaaucgcccuccugucccagagcacauugcccgagaccauccucgagcugacugacgcucuggcccuuggaaugauggcccugaagaucgugcgcaacauggagaaguaucagcuggccguaacgaucauggccauauccugcguccccaacgccgugauccugcagaacgccuggaaaguuagcugcacaauauuagcggcggucuccguaagcccccugcuccugaccaguucgcaacagaaggccgauuggaucccccuggcacucacaauaaagggguugaacccaacggcgaucuuucugaccacccucucccguacuagcaagaagcgaaguuggccgcugaacgaggcgauuauggcagucggcauggugagcauccuggccuccagccucuugaagaacgacauccccaugacugggcccuuaguggccggcgggcuccuaaccgugugcuacgugcugaccggccggucggccgaccucgagcuggaacgcgccgcggaugugaaaugggaggaccaggccgaaaucuccgggucuucccccauacugagcaucacaaucuccgaggacggcagcauguccaucaagaaugaggaggaagaacaaacgcugaccauccuaauccgcaccgggcugcuaguuaucagcgggguuuucccgguguccauccccaucaccgccgccgccugguaucugugggaggucaaaaagcagcgcgcgggaguccugugggacgugcccaguccaccgcccgucgguaaggccgagcucgaagacggagcauaccggaucaagcagcgcgggauccugggcuacucccaaauuggagccggaguguauaaggagggcaccuuccauacgauguggcacgugacccgcggggcuguccucaugcacagggguaagcggauagagccuagcugggcggacgucaagaaagaucucaucuccuaugggggcggcuggaagcuggaaggagaguggaaggaaggggaggaggugcaaguccuggcgcuggagccuggcaagaauccacgcgccguucagacgaagccaggaauauucaaaacaaacacggggaccaucggcgcggugagucuggacuuuuccccugguacuagcggguccccgaucgucgaccgaaaaggaaaaguggucgggcucuacggcaacggcgucgugacccgcucaggggcguacguguccgccaucgcccagaccgaaaagagcaucgaagacaaccccgagaucgaggaugauaucuuccggaaaaagcgccucaccaucauggaccugcacccuggcgccgguaagaccaagcgguaccuccccgcuaucguccgcgaggccaucaagcggggccugaggacccucauauuagcgccgacgcgcgugguggccgcagagauggaggaggcccugcgggggcucccgauccgcuaccaaacccccgcuauccgcgcggagcacaccggccgcgagauugucgaccugaugugccacgcuaccuucacuaugcggcugcugucacccguacgcgugccgaacuacaaucugaucaucauggacgaagcccacuucaccgaccccgcuuccaucgcggccaggggcuacaucucgacacguguggagaugggcgaggccgcuggcaucuucaugacagcgacgccuccugggucccgugacccguucccacagucgaaugccccuauuauggacgaggagagagagauccccgagcgguccuggaacagcggccaugagugggugaccgacuuuaaggggaaaacggugugguucgucccgucuaucaaggccggcaaugacaucgccgcgugccugcgcaagaacggcaagaaagugauccaguugagccggaaaaccuucgacagcgaguacgugaagacgcgcgcgaacgacugggacuucgucgugaccaccgacauuagugaaaugggagccaacuucaaggccgagcggguaaucgaucccagacggugcaugaagcccguuauccugaccgacggcgaggagcgcgugauccuggccgggcccaugccagugacgcauuccuccgccgcgcagcggcgcggccgaauagggcggaauccuaaaaaugagaacgaucaauacauuuacaugggcgaaccccucgaaaacgacgaggacugcgcacacuggaaggaagccaagaugcugcucgacaacaucaacacccccgagggaaucaucccguccauguucgagcccgagcgcgaaaagguagacgccauugacggagaguaccgucuccgcggcgaagcccggaagaccuucguggaccugaugcgccgcggugaccugcccguguggcuugcguacaagguagccgcggagggcaucaauuaugccgaucggaaguggugcuucgacgggaucaagaacaaccagauccuggaggagaauguugaggucgagaucuggaccaaggagggagagcggaagaaacuaaagccgcggugguuagacgcgcggaucuacucugacccguuggcccucaaagaguucaaggaguucgccgccggucgaaagucccucacguugaauuugaucaccgagaugggccggcuccccaccuuuaugacccaaaaggcgcgcaacgcccuggacaaccuugcugucuugcacacggccgaggugggcggaagggccuauacccacgcccugagcgagcugcccgagacccucgagaccuugcugcuccugacucugcucgcgaccguaaccggcgggauuuucuuauuucuaaugagugguaagggcaucggcaaaaugacccucggcaugugcugcaucaucaccgccagcauuuugcugugguacgcccagauacagccgcauuggauagccgccuccaucauccucgaguucuuucugauaguguugcucauccccgagccagagaagcagcgcacgccccaggacaaccaguugaccuacgugguaaucgcgauuuugacugugguggccgcuaccauggccaacgagaugggguuucucgagaaaacgaagaaggaccugggcuuuggaagcauaacgacgcaggagagcgagucgaacauccuggacaucgaccuccggccggccagcgcguggacgcucuacgccguggccacgacuuucgucaccccuaugcugcgucacuccauugaaaauucuagugugaauguuucacuuaccgcaaucgcgaaccaagcuaccguguugauggggcugggaaagggguggcccuuaucuaaaauggacaucgggguaccgcugcuggcgaucgggugcuauagccaggucaauccaaucacacuaaccgcggcccucuuacuccuuguggcgcacuacgcgaucaucggucccggccugcaagccaaggccacaagggaagcgcagaaaagagcugcggccgggaucaugaaaaaccccacgguggacggcaucaccgucaucgacuuagagcccaucccguacgaccccaaguucgaaaaacaacugggucaggucauguugcucauccuaugcguaacccaagucuuaaugaugcgcaccaccugggcccuaugcgaggcuuuaacgcuggcgaccggccccaucuccacuuugugggaggguaacccuggccgcuucuggaacacuaccaucgccgugucuauggccaauaucuuccguggguccuaccuggccggugcgggccuccuuuucagcaucaugaaaaacaccaccaauacccggcgcgggacaggcaacgugggcgagacacugggggagaaguggaaguccaggcugaacgcccuuggcaagagcgaguuccaaaucuacaagaaauccggcauccaggaggucgaucgcacccuggccaaagagggaaucaagcgcggggagaccgaccaccacgccguuagccgcggguccgccaagcugcgaugguuuguugagcgcaacauggucaccccagagggcaaggugguggaccucggaugcggccgcgggggcuggagcuacuacugcgggggccugaagaacguccgggaggucaaaggccugaccaaaggugggcccgggcaugaggagcccauccccauguccaccuauggcuggaaccucgugcggcugcagagcgggguagacgucuucuucacgccacccgagaagugcgauacccugcucugcgacauaggggaaagcuccccaaaccccaccaucgaggccggcaggacccugcgcguacugaaucucgucgaaaacuggcugaauaacaacacccaguucuguauaaagguauuaaacccauacaugcccaguguuaucgagaagauggagaccuuacagcgcaaauacgguggcgcccucgugcggaauccgcugucacgcaacuccacacacgagauguacuggguuucaaaugcgacggggaacaucgugagcuccguuaacaugaucagcagaaugcuaauuaacagauuuacuaugaaacauaagaaggccacauacgaaccggacguggaccucggauccgggacccggaacaucggcaucgagagcgagauccccaaccuggacauaaucgggaagcggaucgagaagaucaagcaggagcacgaaaccuccuggcauuacgaccaggaccacccguacaaaacaugggcauaccacgggucuuacgaaacuaagcagaccggcuccgcgagcagcauggugaacgggguggugcgccugcucaccaagcccugggacguagucccgaugguaacgcagauggccaugacggacaccacccccuuuggacagcagcgaguauucaaggagaaggucgacacccgcacgcaggagcccaaagagggaacgaagaaacugaugaagaucaccgcggaauggcuuuggaaggagcucgggaaggagaagacuccccggaugugcacgcgcgaggaguucacccggaaagugcgaagcaacgcagccuuaggcgcaauuuucaccgacgagaacaaauggaaguccgcccgggaggccguggaggauggccgcuucugggagcugguagaucgagaacgcaaccuccaccuggaagguaagugcgaaaccuguguguacaacaugauggggaagcgcgagaagaagcugggcgaguuuggcaaggccaaggggucacgcgcaaucugguacauguggcuaggcgccagauuccuggaguuugaggcccugggcuuccuuaacgaggaccauugguucucccgcggcaauucacucagcgggguggagggcgaagggcuacaccggcucgguuacauccugcgcgaggucgguaagaaggaaggaggcgccauguacgccgacgacacggcugggugggacacucggaucacccuugaggaccucaagaacgaagagauggugacgaaucacaugaagggcgagcacaagaaauuagccgaggcaauauucaagcugacguaccaaaacaaagucgugcgcgugcagcgcccgacgccgcggggcaccgucauggauauaauuuccagaaaggaccagcgaggaagcggacagguagguaccuacggccucaacacguucaccaacauggaggcccaacugauccgucagauggagggcgaggggaucuucaaguccauacagcaccugaccgccaccgaagagauagcggugcagaacuggcucgccaggguugggcgcgagaggcugucucgcauggcaauauccggugaugacugcguggugaagcccauugacgaccgguuugccagcgcacugacugcgcucaacgauaugggcaagguacgcaaggacauccagcagugggagcccuccaggggguggaacgacuggacacaggugccuuuuugcucacaccauuuucacgagcucgugaugaaagacggccgcguccucgucgugcccugccggaaccaggacgagcucaucgggcgcgcccgaaucucccaaggcgccggcuggagccugaaggaaaccgccugcuuagggaaaaguuacgcccagauguggacccucauguacuuccaccgcagagaccugcgucucgcugcuaacgccaucugcucugcagucccaucccacugggugccgacaucccguacgaccuggucuauccacgcgaagcacgaauggaugaccaccgaagacaugcucgccguguggaaucgcgucuggauccaagagaacccguggauggaagacaagacuccuguagagucuugggaagaggucccguaucuggggaagagagaagaucaguggugcggcucucuaaucggucucaccucgcgugcgaccugggccaaaaauauacagaccgcgauuaaucagguccggagccugauaggcaacgaaggguauacggacuauaugcccuccaugaagcgguuucgccgggaggaagaggaggcgggcguguugugguga

SEQ ID NO: 24961 - RNA, 9876 nt, Artificial Sequence
  derived and/or modified CDS sequence (opt11) from DENV-2__JF730044__SS-prME
accgccggggugaucaucaugcucaucccuaccgccauggcguuccaccucaccacccgcaacggugagccucacaugauagucggccggcaggagaagggcaagagucugcuguucaagaccgaggacggugugaacaugugcacauuaauggccaucgaccugggggagcugugcgaggacaccaucacuuacaagugcccacuccugcgccagaacgagcccgaggauauugacugcugguguaacagcacaagcaccugggugaccuacgggaccugcaccaccacgggcgaacaccggcgcgagaagcggagugucgcucuggugccccacguugggaugggccucgagacccguaccgagaccuggaugagcagcgagggggcauggaagcauguccagcggauugagacguggauccugcgccaucccggcuucaccaucauggcagcgauccuagcuuacaccaucgguaccacgcacuuccagcgggcccucaucuucauccuucuaaccgccguugcacccagcaugacuaugcgcugcaucggcaucuccaaccgggacuucguggagggggucagcggcggguccugggucgacauugugcucgagcacgggagcugcgucacuacgauggccaaaaacaagcccacccuggauuucgagcugauuaagaccgaggcaaaggagcccgcuacccuccgcaaguacugcaucgaggccaagcugacgaacaccaccaccgaguccagaugcccgacgcagggcgagcccagccugaacgaggagcaggacaagcgcuucgugugcaagcacuccaugguggaccggggaugggggaacggcugcgggcuguucggcaagggcgggaucgugaccugcgcgauguuuacgugcaagaagaacauggagggcaagaucgugcagcccgagaaccuagaauacaccaucgugaucacgccccacagcggggaagagcacgccgucggcaaugacaccgggaaacacggcaaggagaucaagaucaccccgcaauccucauccaccgaggccgagcugaccggguacggcacggugaccauggaaugcagcccccgcaccggccucgacuucaacgagauggugcugcugcagauggaggauaaagcauggcucguccaccggcagugguuuuuagaccucccucuccccuggcugccgggggccgacacgcagggcuccaauuggauccagaaggagacgcugguaaccuucaaaaacccccacgcgaagaagcaggacguggucguacuggggagccaggagggcgccaugcacaccgcgcugaccggggccacggagauccaaaugagcuccgggaaccuccucuucacuggccaccugaagugccgccugcggauggacaagcuccagcugaaggggaugagcuacuccaugugcaccggaaaguucaagauugucaaggagaucgccgaaacccagcacgggacgaucgugauucgcgugcaguacgagggcgacggcucgcccugcaagaucccauucgagaucauggaccuggagaagcgacacguccuagggcgccugaucaccguuaacccgaucgucaccgaaaaggacaguccuguuaacaucgaggcggagccgcccuucggcgacagcuauaucaucaucgggguggagccgggccagcugaagcucaacugguucaagaagggguccagcaucggccagauguucgagaccacgaugcgcggagccaagcgcauggccauccugggggacacugcaugggacuucggcucccucggcgggguguucaccagcauggggaaggcccuccaccagguuuucggggcgauauacggcgcagccuucuccggggugagcuggaccaugaagauucugaucggcguaaucauuacguggaucgggaugaacucccgcuccaccucccugagcgucucccuggugcuugugggcgucaucacccuguaccugggggccaugguacaggcggacagcggcugcguggucuccuggaagaacaaggagcucaagugcggcagcgggaucuucauaaccgacaacgugcauacguggacggagcaguacaaguuccagcccgagagccccuccaagcuggcgucggccauccagaaagcccaugaagagggcaucugcgggauccgguccguaacccgguuggagaaccuaauguggaagcagaucacccccgagcugaaccacaucuuaagcgagaacgaagucaagcucacgaucaugaccggcgacaucaaggggaucaugcaggccgggaagcggucccugcgcccucagcccaccgagcugaaguauagcuggaagaccuggggcaaggcgaagaugcucuccacggaaucccacaaccagaccuucuugaucgaugggcccgagacugccgagugcccgaacaccaaccgggccuggaacucccuggagguggaggacuacggcuucgggguguucacgaccaacaucuggcucaagcugcgcgaaaaacaggacgucuucugcgacuccaagcugauguccgccgccaucaaggauaaccgggcggugcaugccgacaugggguacuggaucgagagcgcucucaacgacaccuggaagauggagaaggccuccuucaucgaggucaaaagcugccacuggcccaagucacacacucuguggagcaacggcgugcuggaaucggagaugaucauccccaaguccuucgccgggccgguaagccagcacaauuaccgcccgggcuacuacacccagacggcggggcccuggcaccucggaaaguuggagauggacuucgacuucugcgaagggaccaccgugguagugaccgaggacugcggcaaccggggccccuccuugcgcacaaccacugccagcgguaaguugauuacggaguggugcugcagauccugcacgcugcccccgcugagguacagaggcgaggacgggugcugguacggcauggaaauccgcccccucaaagagaaggaggagaaccuggucaacagccuggugaccgccgggcacggccagaucgacaacuucucccucggcguucuggggauggcccuuuuccucgaggagaugcugcggacccgcgugggaaccaaacaugcgauccugcucgucgccgugagcuucgugacgcugauuaccgguaacauguccuuccgggacuuaggccgcguaauggugauggucggagccaccaugaccgacgacauuggcaugggggucacguacuuggcccugcuggccgcguucaaggugcgccccaccuucgccgccgggcuccugcugaggaagcucacuagcaaggaacugaugauggccaccaucgguaucgcccuucucucccagagcacgauucccgagaccauccuugagcugaccgacgcgcucgcccuggggaugauggugcugaagaucgugcgcaacauggagaaguaccagcucgccgugaccaucauggcgaucucuugcguuccgaacgcugucauccugcagaaugcguggaagguguccugcacgauccuggccgccguguccgucagccccuuacugcugacguccagccagcagaaggccgacuggaucccccucgcgcugaccaucaagggccugaacccgaccgccaucuuccucacgacccugucgcggacguccaagaagcgcuccuggccgcugaacgaggccaucauggccgucgggauggucagcauccuagccagcuccuugcugaagaacgacaucccaaugacggggccccucguggcuggcgggcugcugacuguguguuauguccucaccggccguagcgccgacuuagagcuggagcgcgccaccgacgugaaaugggaggaucaggcggagaucuccgggagcucccccauccucagcaucaccaucagcgaagacggcagcauguccauuaagaacgaggaggaggagcagacgcugaccauccugauccggaccggacuccuggugaucuccggacuguucccugucucaauccccaucaccgccgcugccugguaucucugggaggugaagaagcagcgcgccggcguacugugggacguccccagccccccgcccguggggaaggccgagcuggaggacggcgccuaccggaucaaacagaaggggauccucggcuacucccaaaucggcgcggggguguauaaggagggcaccuuccacacgauguggcacgucacucgcggggccgugcugaugcaccggggcaaacgcaucgagcccucgugggccgacgugaagaaggaucugaucagcuacgggggcggcuggaaacucgagggugaguggaaggagggcgaggagguccagguccuggcccuggagcccgggaagaacccccgggccgugcagaccaagcccggccucuucaagaccaacacggggaccauuggcgcggucucccuggacuucucccccggcaccagcgguucccccaucguggacaggaaagguaagguggucgggcuguacgguaacggcguggugacccggagcggagccuacguaucagccauagcccagacggaaaaguccauugaggauaaccccgagauugaggacgacauuuuccgcaagaagcggcucaccaucauggaccugcacccuggcgcggggaaaaccaagcgcuaccugcccgccaucgugcgugaggccaucaagcgaggcuugcggacccucauccuggcgccgacacgcguugucgccgcagagauggaggaagcgcuccgcggacuccccauccgguaccagacccccgccauuagggcugagcacaccggccgggagaucguggaccuuaugugccaugccaccuucacgaugcgccugcucucacccgugcgggucccgaauuacaaucugaucauuauggacgaggcgcacuuuaccgaccccgccuccaucgccgcccgcggcuacaucagcaccaggguagagaugggggaagcagcgggcaucuucaugaccgccacgccucccgggucccgcgacccguucccucagagcaacgcucccaucauggacgaagagagggagauccccgaacgcuccuggaacagcggccacgagugggugaccgacuucaaggggaaaaccgucugguucgugccguccaucaaagcgggcaacgauauugcggccugccugcggaagaacggaaagaaggugauccagcucucgcgcaagacguucgacuccgaauaugucaagacgcggaccaacgauugggacuucguggugacuaccgacauuagcgagaugggcgccaacuucaaggccgagcgcguuaucgacccccggcgcugcaugaagcccgugaucuuaacggauggcgaggaacgagugauccuggccgggccaaugccggucacccacuccagcgcugcucagcgccggggccgcaucgggaggaacccaaaaaacgagaacgaccaguacaucuacaugggcgagccccucgagaacgacgaagacugcgcccacuggaaggaggccaagaugcugcuggacaacaucaacacaccagagggcaucaucccguccauguucgagcccgagcgggaaaagguggaugcuaucgacggggaguaccgccuccggggcgaagcgcgaaagaccuucguugaccuaaugcggcgaggggaccugcccgucuggcucgccuacagaguggccgccgaggguauaaacuacgccgaccgccggugguguuucgacggggugaagaacaaccagauccuggaggagaacgucgagguggagaucuggacgaaggagggcgagcgcaagaagcugaagccgcgguggcuggacgcgcgcaucuacagcgacccccuggcccugaaggaguucaaggaguucgcagccggccggaagucccucacccugaaccugaucacugagauggggcgccuccccaccuucaugacgcaaaaggcucgggacgcccuugauaacuuagccguccuccacacugccgaggccggcggccgcgcguacaaccacgcccugagcgagcugcccgagacccucgagacccugcugcuucugacgcuucucgccacuguuaccggcgguaucuuccuguuccuuaugagugggaagggcgugggaaagaugacucucgggaugugcugcaucaucaccgccagcauccugcugugguacgcccaaauccagccgcacuggauugcggccucuaucauccucgaguucuuccugaucguacugcucauccccgagcccgagaagcagcggacuccccaggacaaccaguuaacauacguggugaucgccauacugaccgucguagccgccaccauggcgaaugaaaugggguuccuggagaagacgaagaaggaccugggacucggcuccaucgcaacccaggagccggagagcaacauccucgacaucgaccugcgccccgccuccgccuggaccuuguacgccguggcgaccacguucgugacccccaugcuccggcacagcaucgagaacucuucugugaacgugucucugaccgccaucgccaaccaagccaccguccugauggggcucggcaaggguuggccccugucaaagauggacauuggcgugccgcugcucgcgaucgguugcuacucccaggugaaccccgucacucugaccgccgcccugcuccuucugguagcccacuacgccaucaucggccccggucuccaggcgaaggccaccagagaggcccagaagcgggcagccgcggggaucaugaagaaccccaccguggacggcaucacgguuaucgaccuggacccgauccccuacgaccccaaauucgagaagcagcuggggcaggucauguuacugauucugugcguuacccagguccucaugaugaggacgaccugggccuugugcgaggccuuaacgcucgccaccggccccauuagcacccugugggaggggaacccgggccgcuucuggaacaccacuaucgccguguccauggcuaacaucuuccgggguucguaccuggccggggccggccuacuguucuccaucaugaagaacacaacgaacaccaggcgggggacgggcaacaucggcgagacccugggggagaaguggaagucccgccucaaugcccugggcaagucagaguuccagaucuacaagaaguccggcauccaggagguggaccggacccuggcgaaggagggcaucaagcgcggggagaccgaccaccacgcggucucccggggaagcgcaaagcuaaggugguucguggaacggaacauggugacccccgagggcaaggucguggaccuggggugcggccgcggaggcugguccuacuacugcgggggccugaagaacgugaaagagguuaagggccucaccaagggcgggcccgggcacgaggagccgaucccgaugucaacuuacggcuggaaccuugugagacugcagagcgggguggacguguuuuuuacuccacccgagaagugcgacacucucuugugcgacaucggcgaguccagccccaauccgaccaucgaggcaggccgcacucugcgggugcucucccugguggagaacuggcugaacaacgacacccaguucugcauaaagguccucaaucccuacaugcccagcgugaucgaaaagauggagacccugcagcgcaaguacgggggugcccuggugcggaacccgcuguccagaaacagcacgcacgagauguacugggucucuaacgccaccgggaacaucgugagcuccgugaacaugaucagccggaugcugaucaaccgcuucaccaugaagcacaagaaggccaccuacgagccugacgucgaucugggauccgggacucgaaacauaggcaucgagagcgagauccccaaccuggauaucaucggcaagcgcaucgagaaaaucaagcaggagcacgagacgucguggcacuacgaccaggaccaccccuauaagaccugggccuaccacgggagcuacgagaccaagcagacgggcuccgccagcuccauggugaauggggugguccgccuccucaccaagccgugggauguggugcccaugguuacccagauggcaaugaccgacacgacccccuucggccagcagcggguauucaaggagaagguggacacucgcacgcaggagcccaaggaagguaccaagaagcugaugaagaucaccgcggaguggcucuggaaggaacuggggaagaagaagacgccuagaaugugcacccgcgaagaguucacgcggaagguccgcagcaacgccgcucugggcgcgaucuucaccgaugagaacaaguggaaauccgcccgggaggcgguggaggacagccgcuucugggagcucguagacaaggagcggaaccugcaccuggaggggaagugcgagaccugugucuacaauaugaugggcaagcgcgagaagaagcucggggaguucggcaaggccaagggcucucgggcgaucugguacauguggcugggagcccgauuccuggaguucgaggccuuaggcuuccugaacgaggaccacugguucucccgggagaacucucuauccgguguggagggcgagggccuccacaaacugggcuacauccugcgcgacgucggcaagaaggagggcggggccauguaugccgacgacaccgccgggugggacacgcggaucacccucgaggaccugaagaacgaggaaaugguuaccaaccacauggagggagagcacaagaagcuggccgaggcaauuuucaagcucaccuaccagaauaaagugguccgcgugcagcggcccacgccccgcgggaccgugauggacaucaucagucgccgcgaccagcggggauccggccaggucgggaccuacggacugaacaccuucacgaauauggaggcccagcugauccgccagauggagggggagggcaucuucaagagcauccagcaccugaccgccaccgaagagaucgccgugcagaacuggcuggcccgcgugggccgcgagcgccugucccggauggcgaucagcggggacgacugcgucgucaagcccuuagacgaccgcuucgcguccgcuuuaaccgcccucaacgacaugggcaaggugcggaaagacauccagcagugggagccgagccgcggguggaaugacuggacgcagguccccuucugcucccaucacuuccacgagcucaucaugaaggauggccgcgugcugguggucccaugccgcaaccaggaugaguugaucgggcgggcccgcaucagucagggugcgggcuggucccucaaggagaccgccugucugggaaagagcuacgcccagaugugguccuuaauguacuuccacaggcgcgaucuccggcuggccgcgaaugcgaucugcuccgccguccccucccacugggugccgaccucucggaccaccuggagcauccaugccaagcacgaguggaugacgaccgaggacaugcuuaccgucuggaaucggguguggauccaggagaaccccuggauggaagacaagacucccguggaaucuugggaagagguccccuaucuaggcaaacgcgaggaccaguggugcgggagccugaucggauugacgucuagagccaccugggcgaagaacauccagacugccauuaaccaggugcgcucacucaucggcaaugaggaguacaccgacuacaugccaucuaugaagcgguuccgccgcgaggaggaggaggccggcgugcugugguga

SEQ ID NO: 24962 - RNA, 9876 nt, Artificial Sequence
  derived and/or modified CDS sequence (opt11) from DENV-2__FJ639697__SS-prME
accgccggcguuauaaucaugcugauaccgaccgccauggcguuccaccucaccacucgcaacggggaaccccacaugauuguuggccggcaagagaaggguaaaucccugcuguucaagaccgaggacggcgugaacaugugcaccuuaauggccaucgaccugggggaacugugugaagacacaauaacuuacaaaugcccucuccugcgccagaacgagccggaggauaucgacuguuggugcaacagcaccagcaccugggugacguacgggacgugcaccaccacgggcgagcaccggcgcgagaagcggagcgucgcccuggugccacacguagggaugggacuggaaacccgcaccgaaaccuggaugucauccgagggggccuggaagcacguccagcgaaucgagacguggauccuucgccaccccggguuuaccaucauggcugcgauccuggccuacacgauagggaccacucauuuccagcgggcccucaucuucauccugcugaccgccguggcgcccaguaugaccaugcgcuguaucggaaucuccaaucgcgauuuuguggagggcguaagcggaggcuccuggguugacaucgugcucgagcacggcagcugcgucaccacgauggccaagaacaagcccacccuggauuucgagcugaucaaaaccgaggccaaagagcccgccacccuccgcaaguacugcaucgaggccaaacugacgaacaccaccacugagucccggugcccuacgcaaggcgagcccagccucaacgaggagcaagacaagcgcuucguaugcaagcacaguaugguugaccgggggugggggaacggcugcgggcuguucggaaagggcgggauagugacaugcgcgauguucacguguaagaagaacauggaggguaagauuguccaaccugagaaccuggaauacacuaucgugaucacuccacacagcggggaggagcaugccgucgggaacgacaccgggaagcacggaaaggagauuaagaucaccccccagucgagcuccacggaggcggaacugaccggguacggcacggugaccauggagugcagccccagaaccggucucgacuucaaugagauggugcuguugcagauggaagacaaggccuggcugguccaccggcagugguuccuggaccugccccuccccuggcugccaggggccgauacccaaggcuccaacuggauacagaaggagacgcuaguuaccuucaagaacccacacgcgaagaagcaagacgucguugugcucgggagucaggagggcgccaugcacaccgcccugaccggggccacggagauccagaugagcuccggcaaucuccuguucaccggccacuuaaaaugccgucugcggauggacaagcuccagcugaaggggaugagcuacuccaugugcaccggcaaauuuaagaucgucaaggagaucgcugagacacagcacgggacaauagugaucaggguucaauacgaaggagacggcagccccugcaagauccccuuugagauaauggaccuggagaagaggcauguuuuggggcgucugaucaccgugaacccgaucgugaccgagaaggacagccccgucaauaucgaagcggagccacccuucggugauaguuauaucauaaucgggguagagccuggucaacugaagcugaacugguuuaaaaaggggucgagcaucgggcagauguucgagacuacgaugcgcggugccaagcggauggcuauccugggggacaccgccugggacuucggcuccuugggcgggguauucaccagcauggggaaggcccuccaccaggucuucggggcuaucuacggggccgcauucuccgggguaagcuggaccaugaagauacugaucggcgugaucaucacguggaucgggaugaauucccgcagcaccagccugucagucucccucgugcucguaggagugauaacccuguaccucggcgccaugguccaagcagacagcggcugcguggucuccuggaagaacaaggagcucaaguguggcagugggaucuucauaaccgacaacguucacacguggaccgagcaguacaaguuccagcccgagagcccauccaagcuggcaagcgccauacagaaagcccacgaggagggcaucugcgggauccgcucagugacccggcuggaaaaccugauguggaagcagauaaccccagagcugaaucacaucuugucggagaacgaggucaagcucacaauaaugaccggcgacauaaaggggaucaugcaggccgguaaacggucccugcguccgcagcccaccgaacugaaguacucuuggaagaccugggggaaggcuaagaugcucagcacggagagucacaaccagaccuuccugauugacggucccgagacagccgagugcccgaacacuaaccgggcguggaacucucucgagguggaggauuacggcuucgggguguucacgaccaacaucuggcucaaacuacgcgagaagcaggacgucuucugcgacucaaagcugauguccgcagcuaucaaggacaaucgggcagugcacgcggacaugggcuacuggaucgagagcgcccucaaugauaccuggaagauggagaaggccuccuucaucgaggucaagagcugccacuggcccaagucccacacccuguggagcaacggcgugcuggagucggagaugauaauccccaaguccuucgcugggcccgugagccagcauaauuaccgcccgggauacuacacccagacugcgggccccuggcaccugggcaagcuggagauggauuucgacuuuugcgaaggcaccacuguggucgugaccgaggacugcggcaacaggggcccaucccuccgaaccaccaccgccagcggaaaguuaaucaccgaguggugcugccgguccugcacgcugcccccgcugcgcuaccggggcgaagacggcugcugguauggcauggagauccgaccccucaaagagaaggaggagaaccuagugaacucccugguuacagcggggcacggacagaucgacaacuucucucucggcgugcucgggauggccuuguuccucgaagagaugcuacggacccgcguaggaacaaagcacgcgaucuugcucguugccguaaguuucgugacgcugauaaccgggaacaugagcuucagggaccuggggcgcgucauggugauggugggggcaaccaugaccgacgacaucggcaugggcgucacuuaucucgccuuacuagccgcguucaagguacgccccacguucgcggccggccucuugcugagaaaacugacaagcaaggagcucaugauggccaccauaggcaucgcccugcucucccagagcacgauccccgagaccauacuggagcugaccgaugcacuggcccuggggaugaugguucugaagaucguacgcaauauggagaaguaccaacucgccgugaccaucauggccaucuccugcgugccaaacgccgucauccugcagaacgcuuggaaggugucuugcacgaucuuggccgccguguccguuagcccccuccugcugacauccucccagcagaaagccgacuggaucccccucgcgcugacaaucaagggucugaacccaaccgcgaucuucuuaacgacgcuguccaggaccagcaagaagcguuccuggccgcugaaugaggccaucauggccgugggcauggucagcauccucgccagcucccugcugaagaacgauauccccaugaccgggccccucguggcgggagggcugcuuacugucugcuauguccucaccggccggagcgcagaccuggagcuggagcgcgccaccgacgugaagugggaggaccaggcggagaucucggggagcucccccauccucagcaucaccaucucugaggacggcagcauguccaucaaaaacgaggaggaggagcagacgcuaaccaucuuaauucggaccggccuacuggugaucagcgggcuguucccggucuccauccccaucacagcagcggccugguacuuaugggaggugaagaagcagcgcgcgggcguguuaugggaugucccgucgccgccgcccguggggaaggccgaacuggaggacggcgccuaccgcaucaagcagaagggcauccucggauacucccagauaggcgcggggguguacaaggagggcaccuuccauacgauguggcacgucacccgcggggcuguucugaugcaucgaggcaagcgcaucgagcccagcugggccgacgugaagaaagaccugaucaguuacgggggcggcuggaagcuugaaggggaguggaaggagggcgaggagguccaggugcuggcccucgaacccgguaagaacccccgggcgguucagacaaaaccgggccuuuuuaagaccaacacggggacaauuggcgcagugagccucgacuucucccccggcaccagcggcucccccaucguagaucgcaagggcaagguggucgggcuguacggcaauggcgugguaacccggagcggggccuacgucagcgccaucgcccagacggagaaaagcauagaggacaaucccgagaucgaggacgacaucuuccgaaagaagcggcucaccaucauggaccugcaucccggggccgggaagaccaagcgcuaccuuccagcgaucgugcgagaggcuaucaagcgcggccuacguacacucauacucgcaccaacccgcguggucgccgcggaaauggaggaggcccugaggggucuccccauccgauaucagacccccgccauccgcgccgagcauaccggccgggagauuguggaccugaugugucacgccacuuucacgaugcgacugcucucucccguucgcgucccgaacuauaaccuaaucauaauggacgaggcacacuucaccgaccccgccagcaucgcugcucgcggcuauaucagcacccggguagagaugggggaagccgcggggaucuucaugacugccacgccgccggguucacgcgacccguuuccucagagcaaugcgcccaucauggacgaggagcgggagaucccugagcgcuccuggaauaguggccacgagugggugacugacuucaagggcaagaccgucugguucgugccuuccaucaaggccgggaacgacauagcagccugcuugcgaaaaaacggcaagaaggugauccagcucagcaggaagaccuucgacuccgaguaugugaagacacggaccaacgacugggacuucguggugaccaccgauaucagcgagaugggggccaacuucaaggcagagcgcgucaucgauccccggaggugcaugaaaccagugauccucacggacggcgaggagcggguaauccuggccgggccaaugccggucacccauuccagcgcagcccaacgccgggggcgcauagggcgcaacccgaagaacgagaacgaccaguacaucuacaugggcgagccgcucgagaacgacgaggacugcgcccacuggaaggaggccaagaugcuucuggauaacauuaacacccccgaagggaucauaccgucgauguucgagcccgagcgagagaaaguggacgccauagacggcgaguaccgacugcggggcgaggcgcgcaagacguucguggaccugaugcggcgcggggacuugcccgucuggcuugccuaccgggucgccgccgagggcaucaacuacgccgaccgccguuggugcuucgacggggugaaaaauaaucagauccuggaagagaacguugagguggagaucuggacuaaggagggcgaacgcaaaaagcugaagccacguuggcuagacgcgcgcaucuauucagacccccuggcccugaaggaguucaaggaguucgcagccggacggaagagucuuacccuaaaccuaaucaccgagauggggaggcuccccaccuucaugacgcaaaaggcgagagaugcccuggacaaccuugccgugcuccacaccgccgaggccgggggucgugcguacaaucacgcccugagcgaacugccugagacccuugagacccugcuucugcugacucuccucgccacugucaccggcgggauauuucuuuuccugauguccggaaagggcguugguaagaugacccuaggcaugugcuguaucaucaccgcgagcauccugcugugguaugcccagauccagccgcacuggauagcggccagcaucauccucgaguucuuccugauuguccugcucauccccgagcccgagaaacagcggacaccucaggauaaccaacucacguacguggugaucgcuauucugaccgucguggccgcgaccauggccaacgagaugggguuucucgagaagacgaagaaggaccugggccuaggcuccaucgccacccaggagccggaaagcaauauccucgauaucgacuuacgccccgccuccgccuggacccuguacgcaguggcuaccacguucgucaccccuaugcuccgacacaguaucgagaacucuagcgucaacgugucacugaccgccaucgccaaccaggccacgguccuuauggggcuugggaaaggguggccacucucaaaaauggauaucggcgugccacugcucgcaaucgggugcuacucccaaguaaaccccgugacucugaccgccgcccugcuccugcugguggcccacuacgcaaucaucgggcccggccuccaagcgaaggcgacucgugaggcacaaaagcgggccgccgccgguaucaugaagaaccccaccguggauggcaucacggucaucgacuuagauccgauucccuacgaccccaaauucgagaagcagcuggggcaggucaugcuccugauccugugcgugacccagguccucaugaugcgcaccaccugggcccuaugcgaggcccugacgcuggcgaccggcccaaucuccacccugugggaggggaacccgggccgcuucuggaacaccacgaucgccguguccauggcgaacaucuucaggggcucuuaccuagccggcgccggcuugcuguuuuccaucaugaagaacaccacgaacacccgccgggggacuggcaacaucggcgagacccugggggaaaaguggaagucccgccucaacgcccucggcaaguccgaguuccaaauuuacaagaaauccgggauccaagagguugaccgaacgcuagcgaaggagggcaucaagcgcggcgaaacggaccaccacgcugucucccggggcagcgccaaguugcgcugguucguggagcggaacauggugacucccgaagguaagguaguggaccugggauguggccgggguggcugguccuacuauugcgguggcuugaagaacguaaaggaaguaaagggacucaccaagggggggcccgggcacgaggaaccuaucccgaugagcaccuacgguuggaaccuagugcguuuacagagcgggguggaugucuucuuuacgccgcccgaaaaaugcgauacgcuccugugcgacauaggcgagaguagccccaacccgaccaucgaggcuggucgcacccugcggguucucucucugguggaaaauugguugaacaacgauacccaauucugcaucaaggucuuaaaccccuacaugcccagcgugaucgagaagauggagacccugcagcgcaaguacggaggagcccuggugcguaacccgcugucccguaacagcacgcacgagauguacugggucuccaacgccacagggaacaucgugucauccgugaacaugauaagccggaugcuaauaaaccgcuucaccaugaagcacaagaaggccaccuacgagcuggacgucgaucugggcucugggacgcggaauaucggaaucgagagcgagauccccaaccucgacauaaucggcaagcgcaucgagaagaucaagcaggagcacgagacguccuggcacuacgaccaggaccaccccuacaagaccugggccuaccacgggucauacgagaccaagcagacgggcuccgccucuuccauggugaauggggucguucgucugcuaaccaagcccugggacguggugcccauggucacucagauggcgaugaccgacacgacccccuucggccagcaacggguauucaaggagaaggucgacacacgcacccaggagcccaaggagggcacgaagaagcucaugaaaaucaccgcggaguggcuguggaaagagcuggggaagaagaagaccccccggaugugcacccgcgaggaguucacgaggaagguccgaagcaacgcugcucucggggcgaucuucaccgacgagaacaaguggaagucugcccgggaggcgguggaggacagccgcuucugggagcugguggacaaggaacggaaccugcaccucgaggguaagugcgagaccugcgucuacaacaugauggggaagcgcgagaagaaguugggggaguuuggcaaagcgaaaggcagccgggccauaugguacauguggcugggggcccgcuuucucgaguuugaggcccugggguucuuaaacgaggaccacugguucucccgggagaacagccucagcgggguggagggcgaggggcugcauaagcugggcuacauccugcgugacguuggcaagaaggaggguggggcgauguaugccgacgacaccgcagggugggauacgcguaucacccucgaggaccugaaaaaugaggagauggugaccaaucacauggaaggcgagcauaaaaagcucgcugaagcgauauucaaacugaccuaccagaacaaggugguacgcgugcagcggccgacgccccgcgggaccgugauggacaucauuucucgucgcgaccagcggggcuccggucaagucgggaccuacggccugaacaccuucaccaacauggaagcccagcucauacgccaaauggaaggggaaggcaucuucaagaguauccagcaccugacugugacugaggaaaucgccgugcagaacuggcuggccagggucgggcgggaacgccucuccagaauggccaucaguggggacgacugcguggugaagccgcuggacgaucgguucgcguccgcccuuacggcccucaacgacaugggcaagguccguaaggacauacaacagugggaacccagccguggguggaacgacuggacccaggugcccuucugcucccaccacuuucacgagcugauuaugaaggacggccggguacucgucgugccuugucgcaaccaggaugagcucaucgggcgggcccgcaucagccagggcgccggcuggucccugaaggagaccgcuugccugggcaagagcuaugcccaaauguggucauuaauguacuuccaccggagggacuuacggcuugccgccaaugcgaucugcuccgcggugcccucgcauuggguacccaccagccggaccaccuggagcauccacgccaagcacgaguggaugacgaccgaggacaugcucaccguguggaaccgcguguggauccaggagaacccuuggauggaggacaagacccccgucgaauccugggaagaggugcccuaccugggcaagcgcgaggaccaguggugcggcucucuuauuggucucacgucgcgaaccaccugggcuaagaacauucagacggccauaaaucaggugcgcagucugaucgggaacgaggaguauacggacuacaugcccuccaugaagcgcuuucgccgcgaggaagaggaggcgggcgugcugugguga

SEQ ID NO: 24963 - RNA, 9876 nt, Artificial Sequence
  derived and/or modified CDS sequence (opt11) from DENV-2__FJ639698__SS-prME
accgcuggcguaaucaucauguuaaucccaaccgcuauggcguuucaccucacuacccgcaacggggagccacacaugauagugggucggcaggagaaagguaaaucccugcuguucaagaccgaggauggcgugaacaugugcacccucauggcaaucgaccugggugagcugugcgaggauaccaucaccuauaagugcccccuccugcgccagaaugaacccgaggacaucgacugcugguguaacucuacuuccacauggguaaccuacgggaccuguaccacgacgggcgagcaucggcgcgagaagaggucggucgcccuggugccccacgucgggaugggccucgagacaaggacugagaccuggaugagcagcgagggggccuggaagcacgcccaacggaucgaaacauggauccugcgucaccccggguucacaaucauggcggccauccuugccuacaccaucgggaccacgcacuuucaaagggccuuaaucuuuauccugcugacggcaguggccccgagcaugaccaugcgcugcaucgggauauccaaccgggacuucguggagggugugagcggaggguccugggucgacaucguccucgagcaugggagcugugugaccacuauggcaaagaauaagcccacccuggacuucgagcugauaaaaaccgaagccaaagagccagccacccuccgcaaguacugcaucgaggcgaaacugacuaacaccaccacugagucccgguguccgacgcagggcgagccgagccugaacgaggagcaagacaagagguucgucugcaagcacuccaugguggaccgggggugggguaacggcugcgggcuguucgguaagggcgggaucgugaccugcgccauguucagcugcaagaagaauauggagggcaagauaguucagcccgagaaccuggaguacaccaucgugaucacgccccacaguggggaggagcacgccgugggcaacgauacgggcaagcacggaaaggagauaaagauaaccccgcagagcuccaucacggaggccgaacugaccggcuacgggaccguuacgauggaguguagcccacgcacugggcucgacuucaacgaaaugguucugcugcagauggaggacaaggccuggcucgugcaccggcaaugguuucuggaucugccccugccguggcugccgggggcggacacccagggaagcaacuggauacagaaggagacccuggucacguucaaaaacccccacgccaagaaacaggaugucgugguccucgggagccaggagggcgccaugcacaccgcacugacgggggccaccgagauccagaugucguccgggaaccuacucuuuacgggccaccugaagugccgcuuacggauggacaagcuccagcugaaggguaugagcuacuccaugugcacugggaaguuuaagauugugaaagaaaucgcggaaacccagcaugguaccaucguuaucagggugcaguacgagggcgacggcucacccugcaagaucccguuugagaucauggaccuggagaagcggcauguguuagggcgccucauuacgguaaacccgaucaucaccgaaaaagacucccccgugaacaucgaggcggagcccccauucggcgacagcuacaucaucaucgggguggagccgggccagcugaagcucaacugguuuaagaagggcuccagcaucgggcaaauguucgagaccaccaugcgcggcgccaagcggauggccauccugggggacacagccugggacuucggcucucucggcggggucuucaccagcaucgggaaggcgcuccaccagguguucggggcuaucuacggcgccgcguucucuggagugagcuggaccaugaaaauccugaucggcgucaucaucaccuggaucgggaugaacucccgcagcacgucacucagcguaucccuggucuuagucggugugauaacccuguacuugggagcgauggugcaagccgacuccggcugcgucguguccuggaaaaacaaagagcucaaguguggaucugggaucuucaucaccgacaacgugcacaccuggacggagcaguacaaguuccagccggagagccccuccaagcuagccucagcuauccagaaggcccacgaggaaggcaucugcgggauucguuccgucacccggcuagagaaccucauguggaagcagauuaccccugaguugaaucacauccugucagaaaaugaggugaaguuaacuaucaugacgggcgacaucaaggggauuaugcaggcgggcaagcggucccugcgcccgcagcccaccgagcugaaguacucguggaagaccuggggcaaggccaaaaugcucucgaccgagagccacaaccagacauuucugaucgacgggcccgagaccgccgagugcccgaacacuaaccgugcuuggaacuccuuggagguggaggacuacggcuuuggggucuucacaacuaacaucuggcucaaguuaaaggagaaacaggacgucuucugcgaccccaaacuaaugagcgcugcuaucaaagacaaucgggcaguacaugccgacaugggauacuggaucgaguccgcccucaacgacaccuggaaaauggagaaggcuucuuucauugaggugaaguccugccacuggcccaagagccacacccucuggaguaacggcgugcuggagagugagaugaucauccccaagggguucgcaggcccggugagucagcacaacuacaggcccgguuacuacacccagaccgccggacccuggcacuugggaaaauuggagauggacuucgauuucugcgagggcacgacagugguggugaccgaggacugcggcaaucgcgguccgagccugcggacgacgaccgccagcgguaagcucaucaccgagugguguugccgcuccugcacgcuaccgccucugcgguaccgcggggaagacggcuguugguacgggauggagauacggcccuugaaggagaaggaagagaaccugguuaacucccuggugacggccggccacggccaaauugacaacuucuccuuaggggugcuuggcauggcgcuuuuccucgaggaaaugcuucgcacgcgggucggaaccaagcacgcaauuuugcuuguggccguaucauuugugacccugaucacgggcaacaugucguucagggaucugggcagaguuauggugauggucggggcgaccaugaccgacgacaucgggauggggguuacauaccucgcacugcucgcggccuucaaggugcgaccgacguucagcgccggccuccugcugcgcaagcucaccuccaaggagcuuaugauggccacaaucggcauugcccugcucucgcaaucaacaaucccggaaacgauccuggagcugaccgaugcacuggcccugggcaugaugguccugaagaucguacggaacauggagaaauaucagcucgccgugaccaucauggcaaucagcugcguccccaacgcugugaucuugcaaaacgcuuggaagguguccuguaccauucuugccgccgucagcgugagcccccucuuacugacgagcucccagcagaaagcggacuggaucccccuugcgcugaccaucaagggccuaaacccgacugccauauuccucacaacgcugucucgaaccucaaagaagcguagcuggcccuuaaacgaggcgaucauggccgugggaauggucuccauccucgcuagcagcuuacuaaagaacgauaucccgaugaccggcccgcugguggccgggggccugcugaccguauguuacgugcuaacggggcgguccgccgaccuggagcuugaacgagcgaccgacguaaaaugggaggaucaggccgagaucagcggcagcagcccgauccucuccaucaccauuagugaggacggauccaugagcaucaagaacgaggaggaagaacagacucuaacgauccugauacgcaccgggcuauuagucaucucaggucuguuccccgugagcauccccauuaccgccgccgccugguaccucugggagguuaaaaagcagcgggccggggugcugugggacguucccagcccaccacccguuggcaaggccgaacuggaggacggggccuaucgcaucaagcagaaggggauccugggguauagccagauuggggcuggcgucuacaaggaagggaccuuccacaccauguggcacgugacccggggcgcaguucugaugcaucgcgggaagcguaucgaaccguccugggccgacgucaagaaagaccugaucucauacggcggcggguggaagcucgaaggcgaauggaaggagggggaggagguacagguccuagcccuggagcccggcaagaacccgcgcgccguccaaaccaagcccggcuuauuuaagacgaacacaggcacgaucggugcggugucccuggacuucagcccggggaccuccggcagccccauuguggaucggaaggggaagguugugggccuguacggcaauggcguggucacccguuccggcgcauacgugagcgccauugcucaaacagagaaguccaucgaggauaaccccgagaucgaagacgacaucuuccggaagaagcgcuugacaaucauggaccugcauccgggggcgggcaagaccaagcgguacuugccggccaucgugcgcgaggccaucaagcgggggcugcgcacguugauccucgccccaacccgggucguggcggcggagauggaagaagccuuacgcggccucccuaucagauaccaaacacccgccauacgggccgagcacacuggaagagagaucguggaccugaugugccacgccaccuucaccaugcggcugcucucccccgugcgugugcccaacuauaacuugaucaucauggacgaggcucacuucacggaccccgccagcaucgccgcccggggguacaucagcacccgaguggagaugggcgaggccgcggggaucuucaugaccgccacgccgcccggcagcagggaccccuucccccaguccaacgccccuaucauggaugaggagcgugagauccccgaacggagcuggaacuccgggcacgaaugggucacggacuucaaagguaagaccgugugguuuguccccucgaucaaggccggcaacgauaucgcggcaugccuacgcaaaaacgggaaaaaggucauccaacucucccggaagaccuucgacagcgaguacguuaagacucguacgaaugacugggacuucguggucaccaccgacauauccgaaaugggcgccaacuucaaggcugagcgggugaucgacccuaggcgaugcaugaaacccgugauccugaccgacggggaggagcgcgucauccuggccgguccgaugcccgugacgcauagcuccgcagcccaacggcgcgggcggaucggccgcaaucccaagaaugagaacgaccaauacaucuacaugggagaaccccuagaaaacgacgaggauugugcccauuggaaggaggccaagaugcugcucgacaacaucaacacuccggagggcaucaucccaagcauguucgagcccgagcgggagaagguggacgcaaucgauggcgaguaucggcuuagaggggaggcgcggaagaccuuugucgacuugaugcgucgaggcgaccugccgguguggcuagcguaccgcguugccgcagaggggaucaacuaugcagaccggcgcugguguuucgacggcgucaagaacaaucagauccuagaggaaaacguugaaguggaaaucuggacgaaagagggcgaacguaagaagcugaagccccgcuggcuugacgcgcggaucuacucugacccgcuggcccugaaagaguuuaaggaguuugccgcugggcgcaagagccucacgcugaaccugaucaccgagauggggcggcuccccaccuuuaugacccagaaagcgcgcgacgcccuggauaaccuggcuguccuacacacagccgaggucgggggcagggccuauaaccacgcacuguccgagcugccggagacccucgagacccugcuguugcucacccugcucgccacugugacaggcgggaucuucuuauuccugaugagugguaaggggguaggcaagaugacacugggaauguguugcaucauaaccgccuccauccugcugugguacgcgcagauccagccccacuggaucgccgcgucuaucauccucgaguuuuucuuaaucgugcugcucauccccgagccagagaagcagcgaacaccccaggauaaucagcugaccuacgucgugaucgccauccugaccguggucgccgccaccauggcgaaugagaugggcuuucucgagaagaccaagaaggaccugggccuugggagcaucgcaacgcaggagcccgaauccaacauccucgacaucgaccuucgccccgccagcgccuggacccuguacgccguagcuaccacguucgugacgcccaugcuccgccauuccaucgaaaacagcuccguuaacgugucucugaccgcgaucgccaaccaggcaacgguacugaugggccuagggaagggcuggccgcugagcaagauggacaucgggguccccuuacucgcuaucggcuguuacagccagguaaacccuaucacccuuacggcggcacuacuccugcuaguggcucacuacgccaucaucggccccgggcuccaagccaaggcgacccgggaagcccagaagcgcgccgcagccggcauuaugaaaaacccaacggucgaugggaucacaguuaucgaucuggacccuaucccuuacgaucccaaguuugagaagcagcugggccaggugaugcuccugauacugugugucacccaagugcuaaugaugcggacgaccugggcacugugcgaggccuuaacauuggcuacggggccgaucucgacccugugggaaggcaaccccggccgcuucuggaauaccaccaucgccguuuccauggccaacaucuuccgcgggucuuaccuggccggcgcagguuugcuuuucagcauuaugaagaauacgacuaacacccggcgcggaaccggcaacaucggggagacguuaggcgaaaaguggaagucccggcuuaaugcccuggggaagaaugaguuccagaucuacaaaaaguccggaauccaggaagucgacaggacccuugcaaaggaagggaucaagcggggcgaaaccgaccaccacgcggugucgcguggcagcgcuaagcucagaugguucguugagcgaaacauggucacacccgaggggaaggugguggaucugggcugcggaaggggcgguugguccuacuacugcggcggccuaaagaacguccgcgaggugaaaggucucacuaagggcggucccgggcacgaggagccgauccccauguccaccuacggguggaacuuagugcggcugcagaguggcgucgauguauucuuuacgccgcccgagaagugcgacacgcuccuaugcgauauuggcgagucuagcccgaaucccacgaucgaggccgggcggacccuacggguucugagcuuagucgagaacugguuaaauaacgacacccaauucuguaucaaggugcuaaacccguauaugccgucugugauugagaagauggagacccugcagcgcaaauaugggggugcccugguacggaacccacugucccgcaacagcacccacgagauguacugggugagcaacgcgacaggcaacaucgugagcuccguaaacaugauuucucggaugcucauuaaccgcuucaccaugaagcauaagaaagcgaccuacgagcccgauguggaccugggguccggcacccggaacauuggcaucgagagcgagaucccaaaccuggacaucaucgggaagcgcaucgagaagaucaagcaggagcaugagacgaguuggcacuacgaccaggaccacccguacaagaccugggccuaccacggaagcuacgagaccaagcagaccggguccgccucguccauggugaacggagucgugcgccuucugacgaagcccugggauguaguccccauggugacccagauggccaugaccgacaccacgccauuuggccagcaacggguguucaaggagaaggucgacacccguacccaggagccgaaagaggguacuaagaaacuaaugaagaucacagccaaguggcucuggaaggaacugggcaaaaagaagacgccccggauauguacccgcgaggaguucacaaagaaggugcggagcaacgcagcccucggggcuaucuucacugacgagaacaaguggaaguccgcccgcgaggccguggaagacagccguuuuugggaauuggucgacaaggagcggaaucuacaccuggagggaaagugcgagaccugcguguacaacaugauggggaagcgggaaaagaagcucggcgaguucggcaaggcgaaggggucccgagcuauuugguacauguggcugggagccagguuccuagaguucgaggcucucggcuuucugaacgaagaccacugguucagccgcgaaaacagccugucgggcgucgagggagagggccuccauaaauugggcuauauccugcgagacgucuccaagaaggaggguggcgcgauguacgcugacgacaccgcggguugggacacacgcaucacgcucgaggaccugaagaacgaggagauggucaccaaccacauggagggcgaacacaagaagcuagcggaggccaucuucaagcucacauaccagaacaaggucgugcgggugcagcgccccacgccccgggggacagucauggacaucaucucccgcagagaccagcgagguagcggccagguggggaccuacggcuuaaacaccuucaccaacauggaggcgcagcugaucaggcagauggagggggagggaaucuucaaguccauacagcaccucacggugaccgaggaggucgcggugcagaacuggcuggcccgcgugggccgcgaacggcugagccgcauggccaucagcggggacgacugcgucgucaagccacuggacgaccgguucgccagcgcucucaccgcccugaacgacaugggcaaggugcgcaaggacauucaacaaugggaaccgucucggggguggaacgacuggacgcagguuccuuuuugcagccaccacuuccacgaacucaucaugaaggaugggagaguacuggugguccccugccguaaccaggacgagcugauugggcgugcccgcaucucacagggcgccggcuggagccucaaggaaaccgccugucugggcaaaucauacgcucagauguggagcuugauguacuuccaccgucgggaccuccggcuggccgcuaacgccauauguuccgccguccccucacacuggguacccacaucacggacuaccuggagcauucacgcgaagcacgaguggaugaccacugaagacaugcugaccgucuggaaucgcguguggauccaggagaacccauggauggaggacaaaacccccgucgaaagcugggaggaggugccguaccucggcaaacgggaggaucaguggugcgggucccugaucggccugaccucccgcgcgacgugggccaagaacauucaaaccgcaaucaaccagguacgauccuuaaucgggaaugaggaauacacugacuacaugcccuccaugaagcgcuuccggcgcgaagaggaggaggcgggcgugcugugguga

SEQ ID NO: 24964 - RNA, 9876 nt, Artificial Sequence
  derived and/or modified CDS sequence (opt11) from DENV-2__FJ639699__SS-prME
accgccggaguaauuaucaugcugauccccacugccauggcguuccaccucaccacccgcaacggggagccccacaugaucgucggccggcaggaaaaggggaagucgcugcuguuuaagacggaggacggcgugaacaugugcacccuuauggccaucgaccuuggcgaguugugcgaggauaccaucaccuacaagugcccacuccugcgccagaacgaacccgaggacaucgacuguuggugcaauagcaccagcaccuggguuacuuacgggacuuguaccaccacgggggagcaccggcgagagaagcggucagucgcccuagucccacacgugggcaugggccucgagacacgcaccgagaccuggaugagcuccgagggggccuggaagcacgcgcagcggaucgagacauggauccugcgucaccccgguuucaccaucauggcagccauccuggcauauacgaucgggacgacucacuuccagcgggcacucaucuucauacugcugaccgcgguggcgcccagcaugacgaugcgcugcaucggcaucuccaaucgggacuucguagaaggcgugucuggagguuccuggguggacaucguccucgagcacgggagcugcguaacaacgauggccaagaacaaacccacccuggacuuugagcugauuaagaccgaggccaaggagcccgccacccuccgcaaguacugcaucgaggcgaaacugacgaacaccaccacggagucccggugcccgacgcagggcgaaccgagccuaaacgaggagcaggacaaacgcuucgucugcaagcacucuaugguggaccguggcugggggaacggcuguggcuuguuuggcaaagggggaaucgugaccugcgccauguucagcugcaagaaaaacauggagggaaaaaucgugcagcccgagaaccuggaguacaccauagugaucacgccccauuccggggaggagcacgccgugggcaacgacacggggaagcacggcaaggagaucaagaucacuccgcaaagcuccauaaccgaggcugaacugacuggguacgguaccgucacaauggagugcagcccacgcaccggccucgacuucaacgagaugguguuacugcagauggaggacaaggccuggcucgugcaccggcagugguuccuggaccugccacuucccuggcugccgggcgcggauacacaaggcuccaacuggauucaaaaggagacccuggucacguucaagaacccacacgccaagaagcaggacguagugguucucggcagccaggagggggccaugcacaccgcacugaccggggcaacagagauccagaugagcucuggcaaccuccuguucacuggccaucugaagugccgccugcggauggacaaguuacaacugaaggggaugucauacuccaugugcaccggcaaguucaaaaucgugaaggagaucgcagagacucagcacgggaccaucgugauccgggugcaguacgaaggcgauggcucucccugcaagauacccuucgagauuauggaccuggaaaagaggcacgugcuagggcgacugauaacggucaacccaaucauuacugagaaggacucgccagugaacaucgaggccgagccucccuucggcgacagcuacauuaucauugggguggagccuggacagcugaaacucaacugguucaagaagggauccagcaucggccagauguucgaaacuaccaugcgaggggccaaacggauggccauccucggggacacagccugggacuucggcucccucggcggggucuucaccagcaucgggaaggcgcuccaucaaguguucggagccaucuacggcgccgccuucucugggguuucuuggacuaugaagauccuuaucgggguuaucaucaccuggauagggaugaacucccgcucaaccucccugagcgugucccugguuuuggucggcgugauuacucucuaccugggugcaauggugcaggccgacagcggcugcgugguguccuggaagaacaaggaacucaagugcggcagcgguauuuuuaucaccgauaacguucacaccuggacggaacaguacaaguuccagcccgagagccccuccaagcuggccucggccauccagaaggcccacgaagaaggcaucugugggauacgguccgucaccagauuggagaaccucauguggaagcagauuaccccagagcugaaccacaucuuaucagagaacgaggugaaacucaccaucaugacgggcgauauaaaagggaucaugcaggcgggcaagcggucccugcgcccgcagcccaccgagcugaaguacuccuggaagacuuggggcaaggccaagaugcuaucaaccgagagccacaaucagacuuuccucaucgacgggcccgagaccgcagagugcccaaacaccaaucgggccuggaauucacuggagguugaagauuacggcuuugguguauucacuacgaacaucuggcucaaacugaaggagaaacaggacguuuuuugugauagcaagcugauguccgcagccauuaaagacaaccgggccgugcacgcggacaugggcuacuggauugaguccgcccucaacgauaccuggaagauggagaaggcuuccuucaucgagguaaagucaugccacuggccuaaaucccacacccuauggagcaacggcgugcuagaguccgagaugauaauucccaagggguuugcuggccccgugagccaacauaacuaccggccgggguauuacacccagaccgccggaccauggcaucucggaaagcuggagauggacuucgacuucugugagggcacgaccgucguggucaccgaggacugcggcaaucgggggcccagccugcggaccacgaccgccuccggcaaacucauaacggaauggugcugccgcagcugcaccuugccuccuuugcgguaccgcggggaagauggguguugguacgggauggagauccggccccucaaggagaaggaagagaaccuggucaacaguuuggugacggccggccacggccagaucgacaacuucagccuaggggugcugggcauggcccuguuccucgaggagauguugcgcacccgggucgggaccaaacaugccauucugcucguggccgugucguuugucacccugaucacgggcaacaugucguuccgcgaucuggggcgcgugauggugauggucggggcgaccaugacugacgacauaggcaugggggugacuuaccuagccuugcuggcggccuucaaggugcgccccacuuuugccgccggccuucugcugcgaaagcucaccaguaaggaacugaugauggccacaauagggaucgcacugcucagccaguccaccauccccgagacgaucuuggagcugaccgacgcccucgcccugggcaugaugauccuuaagaucguccgcaauauggagaaguaccagcucgccgucaccaucauggccaucagcugcgugccaaacgcgguaauacugcagaacgccuggaaggucuccugcaccauccuggcugccguuagcgucagcccccuccuguugacgucaucucagcagaaagcggacuggauaccccucgcccuaacuaucaagggcuugaaccccaccgccaucuucuugaccacgcugagccgaaccagcaagaagcguagcuggccacugaacgaggccauaauggccguaggcauggugaguauccucgcgucgucacugcugaaaaacgacauccccaugaccggcccccucgucgcuggggggcugcugaccgugugcuacguccucacgggccgguccgccgaccuggagcuggaaagagccaccgacgugaagugggaagaucaagccgaaaucaguggguccucacccauccuauccaucacuaucagcgaggacggcuccaugagcauuaagaacgaggaggaggagcaaacacugacgauccugauccgcaccgggcuccuggugaucuccggccuguuccccgugagcauccccaucaccgcggccgcaugguacuuaugggaagugaaaaagcagcgagccggagugcugugggacguccccucaccgccgcccgucggcaaggccgagcuggaggacggggcguaccgcaucaagcagaagggcauccucggcuauagccagaucggggccggcguguacaaagaggggaccuuccacaccauguggcacgucacgcgcggcgcuguucugaugcaucgcggcaagcggauagagccuuccugggcugacgucaagaaggaccuaauuagcuacggcggugguuggaaacuagagggugaguggaaagagggggaggaaguccaggugcuagcacuggagccuggcaagaacccccgcgcggugcagacuaagccuggccucuuuaagaccaacaccgggacgaucggcgccgucucccuggacuucagucccgggaccaguggcagccccaucguggaccggaaagggaagguggucgguuuauacggcaacgggguugucacccgcuccggcgccuacgucuccgcgaucgcucaaaccgagaaauccauugaagacaaccccgagaucgaggacgacauauuucgcaagaagcgccucacgaucauggaccugcaccccggggccggcaagaccaagcguuaccugcccgccaucgugcgcgaagccaucaagcgggggcuucgcacccucauccuggccccaacacggguggucgcggccgagauggaggaggccuugcgcgggcuccccauccgcuaucaaacgcccgccauccgggccgagcauaccggccgcgagaucguggacuugaugugccaugcgacauucacgaugaggcugcucucccccguccgagucccaaauuacaaucugaucaucauggacgaggcccauuucacggaccccgccagcaucgccgcccggggguacauauccacccgaguagagaugggcgaggcggcggggauuuucaugaccgccacgccgcccggcucuagagauccauucccccagagcaacgcgcccaucauggacgaagagagagaaauaccggagcggagcuggaacuccgggcacgaauggguuacggacuucaagggcaagaccgucugguucguuccgagcaucaaagcgggcaacgauaucgccgccugccuccgcaaaaaugggaagaaagugauccagcucucacggaagaccuucgacagcgaguacgucaaaacccgcacaaacgacugggacuucgucgugaccacagacaucucagagaugggcgccaacuucaaggccgagcgggucauugacccccgccggugcaugaaacccgugauccugaccgauggggaagagcgcguaauccuggcugggccuaugccaguaacgcauuccuccgcggcccagcggcgcggccggaucggccgcaacccgaagaacgagaacgaccaguacaucuacaugggcgagccccuggagaacgacgaggauugugcacauuggaaggaagccaagaugcugcuggauaauaucaacaccccagaggggaucaucccgagcauguucgagcccgagcgcgagaaaguugacgcgauugacggcgaguaccgguuacgcggagaggcccggaagacuuucguugaccugaugcgcagaggagaccugcccguguggcucgccuaccgcgucgccgccgaggguaucaauuaugcggaucggagauggugcuuugauggagugaagaacaaccagaucuuggaggagaaugucgagguggagaucuggaccaaagagggcgagcggaaaaaacugaagccgcgcuggcucgacgcacggaucuauagcgacccccuggcccugaaggaguucaaggaauucgccgccgggcgcaagagucuaacgcugaaucugaucacggaaaugggacgcuuaccaacauucaugacccagaaggcccgcgacgcgcuggacaaccuagcuguucuccacacagccgaagucgggggccgagcguacaaucacgccuuguccgagcugccagaaacgcucgagacccugcugcucuugaccuugcucgccacugugaccggcggaauuuuccuguuccuuaugagcggcaagggggugggcaagaugacccucgggaugugcuguaucaucacagccaguauccuucugugguacgcccagauucagccgcacuggaucgcugccaguaucaucuuggaguucuuccugaucguccugcucaucccugagcccgagaaacagagaacgccgcaggauaaucagcugacguacguggucauagccauccugaccgugguggccgcuaccauggcgaacgagaugggcuuccucgagaaaacaaagaaagacuuaggccuagggagcaucgccacccaggaacccgaauccaacauccucgauaucgacuuacggcccgcaagcgccuggacccuguacgccgucgcgaccacguucgugacgccaaugcuccgacacucuaucgagaacagcucggugaacgucagcuugaccgccaucgcaaaccaagccaccguguugaugggccucgguaagggcuggccgcuauccaagauggacauaggggugccccuacucgcgauaggaugcuacagccaagucaaccccauuacccugacagccgcacuguuguugcucguggcccacuacgcuaucaucggccccggucuccaggcgaaggccacccgugaagcccagaagcgcgcggccgcgggcaucaugaagaacccuaccguggaugggaucacagugaucgaccuggacccgauacccuaugacccgaaguucgagaagcagcugggccaggugaugcuccucauucugugcguuacucaggucuugaugaugcggaccaccugggcccugugcgaggcccugacccucgcgacggggccaaucuccacccugugggaaggcaacccgggucgcuuuuggaacacaaccaucgccgugagcauggcgaacauuuuccgcggguccuaucuagccggcgccggucuccucuucucgaucaugaagaacacuaccaacacccgucgcggcaccggcaacaucggugagacucugggcgagaaguggaagucccgguugaacgcgcuggggaagaaugaguuucagaucuauaagaaguccggcauacaagaaguggaccgcacccuggcgaaggagggaaucaagcggggcgagaccgaccaccacgcugucucgcgcggcagcgccaagcuccggugguucguggagcggaacauggugacccccgaggggaaaguaguggaccugggcugcgggcggggcggcuggagcuacuacugugguggccugaagaacgugagggaggucaaagggcucacgaagggcgggcccggccacgaggagcccaucccuaugagcaccuacggguggaaccuggugagacugcaguccgguguggacgucuuuuucacgccacccgaaaagugcgacacacucuuaugcgacaucggcgagagcagccccaacccgaccaucgaggccggacgcacccuacgggugcuaucccuggucgaaaacuggcugaacaaugacacccaguucugcaucaaggucuugaaccccuacaugcccagcgugauugaaaagauggagacucugcagagaaaguacggcggggcccugguuaggaacccuuugucccggaacuccacccacgaaauguacugggucucgaacgccacgggcaacaucguaagcuccgucaacaugauaagucggaugcucaucaaccgcuucacuaugaagcacaagaaggccaccuaugagcccgacguggaccucggguccggaacacggaacaucgguaucgagagcgaaauucccaaccuggacaucaucgguaagcgcaucgaaaaaauaaagcaagagcaugagacauccuggcacuacgaccaggaccaccccuacaagacuugggccuaucacggcagcuacgagaccaagcagaccggguccgcaucauccauggugaaugguguaguccgccuucugacgaagccgugggacguggugcccauggucacucagauggccaugacugacaccacgccauucgggcagcagaggguguucaaggaaaaagucgacacgcgcacccaggagcccaaagagggcacgaagaagcugaugaagaucacggcgaaauggcucuggaaggagcugggcaagaaaaagaccccgcggaucugcacccgggaggaauuuacuaagaagguccguagcaacgccgcccugggcgcgauauucacagacgagaauaaguggaagucggcccgcgaggcgguugaggacagccgguucugggagcucguggacaaggagcguaaccuccacuuggagggcaagugcgaaaccugcguguacaacaugauggggaagcgggagaaaaagcucggggaguucggcaaagccaaggggucccgagccaucugguauauguggcugggcgcccgguuccuggaguucgaagcgcucggguuccugaaugaggaccacugguuuagccgggagaacucgcuguccggcguggagggcgagggccuccacaagcugggcuacauccugagagacgugagcaagaaggaggggggcgccauguacgccgacgacaccgccgggugggacacuaggaucacgcucgaagaucugaagaacgaggagauggucaccaaccacauggaaggcgagcacaagaagcucgcagaggcaaucuucaagcucaccuaccagaauaaggugguccgggugcagcgccccacaccccgggggacgguuauggauaucaucucacgccgggaccaaagagggaguggccaggucgggaccuacggccuuaacaccuucaccaacauggaggcgcagcugauccggcaaauggagggggaggguaucuucaaaucgauccaguaucucacggugacggaggagguggccgugcagaauugguuggcccgcguuggucgcgagcggcugagccgcauggcaaucuccggggacgacugcguagugaagccucucgacgaccguuucgcgagcgcauuaaccgcccugaacgacauggggaaagugcgcaaggacauccagcaaugggaaccgagucggggguggaacgacuggacccaggugccuuuuugcagccaccacuuccacgaguugauaaugaaggacggacgcguccuuguagugcccugccggaaccaagacgagcuuaucggcagggccaggauaucccagggcgcuggguggagccucaaagagacugcaugccuggggaaguccuacgcccagauguggagccugauguacuuccaucgccgggaucugcggcuggcugccaaugccauauguuccgcggugccuagccauugggugccgaccucccggaccacuuggagcauccacgcuaagcacgaauggaugaccacagaggacaugcugaccguguggaaccgcgucuggauccaagaaaaucccuggauggaggacaagaccccgguugaaucuugggaggagguucccuaccucggcaagcgggaggaccaguggugcgggucucucauuggccugaccucucgcgccacaugggcuaagaacauccagaccgccaucaaccagguccggucccucaucgggaacgaggaguacacggacuacaugccgagcaugaagcgcuucaggcgcgaggaagaggaggccggcgugcuaugguag

SEQ ID NO: 24965 - RNA, 9876 nt, Artificial Sequence
  derived and/or modified CDS sequence (opt11) from DENV-2__FJ639700__SS-prME
accgccggcgugauaaucaugcugaucccgaccgcuauggcguuccaccucacuacccgcaacggggagccccauaugaucgugggucggcaggagaaggggaaaucccuguuguuuaagaccgaggacggcgucaacaugugcacccucauggccaucgaccucggcgagcugugcgaggacaccaucacguacaagugccccuuacugcgucagaacgagcccgaggacaucgacugcuggugcaacaguacuagcacgugggugaccuacgggaccugcaccaccacaggcgagcaccggcgcgaaaagcgguccgucgcgcuugugccccauguggggaugggcuuagagacccgcaccgagaccuggaugagcagcgagggggccuggaagcacgcccagaggaucgagaccuggauacuccgccaccccggcuucaccaucauggcggcaauucuggccuacaccauagggaccacgcacuuucaacgggcccucaucuucauucugcugaccgcggucgcgccaagcaugaccaugcgcugcaucggcaucucuaauagagacuucguggagggugugucagguggcuccugggucgacaucguucucgagcaugggagcugcgugaccacgauggccaagaacaaaccaacccuggacuuugagcugaucaagaccgaggccaaggagcccgccacccuccgcaaguauugcaucgaagcgaagcuaacgaacaccaccaccgagucccggugcccgacccagggcgaacccagccugaacgaagagcaggauaagcgcuucgucugcaagcacuccaugguggaccggggguggggcaacggcugcggccuguucggcaagggcgggaucguaacgugcgccauguucagcugcaaaaaaaacauggagggcaagaucguccagcccgagaaccucgaauauaccaucgucauaacaccccauuccggggaggagcaugccgugggcaacgacacggggaaacauggcaaggagauaaagaucacuccgcagagcuccaucacagaggccgagcucaccggguacggcacugucacgauggagugcagcccccgcacgggccuagacuucaacgagauggugcugcugcagauggaggacaaggccugguugguacaccggcagugguuucuggaccugccccucccuuggcugccgggcgcggacacccagggcuccaauuggauucagaaggagacccuggucacguuuaagaauccccaugccaagaagcaggauguggugguccucgguagucaggaaggcgccaugcacacggcccucacaggggcgaccgagauccagaugagcagugggaaccuccuguucacugggcaccugaagugucgccugcggauggacaagcuccagcugaaggguaugagcuacuccaugugcaccggcaaguucaagaucgugaaggagauugcggagacccagcaugguaccaucgucauccgcgugcaguacgagggcgacggcagccccugcaaaauccccuucgagaucauggaccuggagaagcggcacguacucggccgccugaucacgguaaacccgaucaucaccgagaaggacuccccugugaacauagaggcagaaccgcccuucggugacagcuacauaaucaucggcguggagcccgggcagcugaagcucaauugguuuaaaaaaggguccucuaucggccagauguucgagaccacuaugcgcggcgccaagcggauggccauccugggcgacacggccugggacuucggcagucuaggcgggguguucaccagcaucgggaaggcgcuccaccagguguucggagccaucuacggagccgccuucaguggggugucauggacuaugaaaauccucaucggcgucaucaucaccuggaucgggaugaacuccagaucgaccucccuuagcguguccuuggugcucgucggcgugaucacccuguaucugggggcgauggugcaggccgacagcgguugugucguguccuggaagaacaaggaguuaaagugcggcagcgguaucuuuaucaccgacaacguacacaccuggacggagcaguacaaguuccaacccgaaagccccucaaaguuagccagcgccauccagaaagcccaugaggaaggcauuugcgggauccgguccgucacccgccucgagaaccucauguggaagcagaucacccccgagcugaaucacauccugagcgagaaugaggcgaagcucaccaucaugacgggcgauaucaagggcaucaugcaggccggcaagcggucccugcgcccgcagccuacagagcugaaguacagcuggaagaccuggggcaaggcuaaaaugcucuccacugagucacacaaucaaacguuccugauagacgggccggagacugccgagugcccgaacaccaaccgggccuggaacucccuggagguggaggacuacggcuucgggguguucaccacgaacaucuggcucaagcugaaagagaaacaagacgucuucugcgacagcaaguuaaugucggcggccaucaaggacaaccgagccguucacgccgacaugggcuacuggaucgaaagcgcccuuaacgacacauggaaaauggagaaggcguccuucaucgaggugaaaaguugccacuggcccaaaucccacacacuguggagcaacgggguccuggaaucagaaaugauuauccccaagggguucgccggccccgugagccagcacaacuaccggccgggguaccauacccagaccgccggccccuggcaccucgggaaguuagagauggacuucgacuucugcgaaggcacgacaguggucgugaccgaggacugcggcaaccgggggcccagccugcggaccacgacagccuccggcaagcucaucaccgaguggugcugccgcagcugcacgcugcccccacugcgguaccgaggggaggacggaugcugguacgggauggagauccguccccucaaagagaaagaggagaaccuggugaacagcuuagucacggccggccacggccagaucgacaauuucagccucggggugcugggcauggcccuguuccucgaggagaugcugcgcacccgaguggggaccaagcacgccauccuguugguugcaguguccuucgugacccucauaacgggcaacaugagcuuccgagaccugggacgggucaugguaauggugggcgcgaccaugaccgacgauaucggcaugggagucaccuaccucgcgcugcuggccgccuucaaggugcgccccacguucgccgccggccuccugcugcguaagcucaccucaaaggaguuaaugauggcgaccauagggaucgcacugcucagccagaguaccauacccgagacgauacuugagcugaccgacgccuuagcccuuggcaugaugauccugaagaucgugcguaacauggagaaguaccagcucgcggucacaauaauggcgaucagcugcgugccgaacgccgugaucuugcaaaacgccuggaaggucagcuguaccauacuggccgcggugucggugucgccccugcugcugacgagcucccagcagaaagccgacuggaucccacucgcccuuaccaucaagggccugaaccccaccgccaucuuccucaccacgcugucucgcaccuccaagaagagaagcuggccgcuuaacgaggccaucauggcgguggggaugguguccauacuggcuagcagccugcugaagaacgauauccccaugacaggcccucucguggccgggggccuccuuaccgucugcuacgugcucacuggccgcuccgccgacuuggagcuggaacgggccaccgacgugaagugggaggaccaggcggagaucagcggcucgagccccaucuuauccaucacaauaagcgaggauggcuccaugagcaucaagaacgaggaggaagaacagacccugacgauccugauucgcaccgggcuguuagucaucuccggucuguucccggugagcauccccaucaccgccgccgccugguaucucugggaggucaaaaagcagcgggcgggaguccugugggacgugccguccccgccgcccgucgggaaggcggagcuggaggacggggcauacagaaucaagcagaaagggauccucggauacagccagaucggugccggcguguacaaggaggggaccuuccacaccauguggcacgugacgcggggcgcugucuuaaugcaccgcgggaagcggaucgagcccuccugggccgacgugaaaaaggaccugaucagcuacggaggcggcuggaagcucgagggcgaguggaaggagggggaggaggugcaggugcuggcccuggagcccggcaagaacccacgcgccgugcaaaccaaacccggccuauucaagacuaauaccggcacgaucggcgccgugagccuggauuuuagcccaggaacuagcggcagcccaaucgucgaccggaaggggaagguggugggccuguacggcaacggagucgugacucgcuccggcgccuacgugagcgcgaucgcccaaaccgagaaguccauugaggacaaucccgagaucgaggacgacauuuuccggaagaaacgccucacgaucauggaccugcaccccggcgcgggcaagaccaagcgguaccugccugccauuguccgcgaggcuaucaagcgggggcugcgcacccucauccuggcaccgacccgagugguagccgccgagauggaggaagcccuuagaggccugccuauacgcuaccaaacacccgccauccgggcggaacacaccggcagggagaucgucgaccugaugugccacgcgaccuucaccaugcggcugcucagccccgugcgcgugccgaacuauaaccugaucaucauggacgaagcccacuucacggaccccgcgagcaucgcagcucggggcuacauuuccacccggguugagaugggcgaggccgccgggaucuucaugaccgcgacgccgccugguagccgcgacccguucccccaguccaacgcgcccaucauggacgaggagcgcgagauccccgagcggagcuggaacuccgggcacgagugggugaccgauuucaagggcaagaccgugugguuugucccuagcaucaaagccggcaaugacaucgcagccugccugcgcaagaaugggaagaaagugauccagcucucccggaagaccuuugacucagaguacgucaagacccgcacgaacgacugggacuuugucgugaccaccgacaucucagagaugggcgccaacuucaaggcugagcgggugaucgacccacgccggugcaugaagcccgucauucugaccgacggcgaggaacgcgugauccuggccggcccuaugccggugacgcacagcucagccgcccaacggcguggccggaucggccgcaaccccaagaacgagaacgaccaauacaucuacaugggugagccccucgagaacgacgaggacugcgcacacuggaaggaagcgaagaugcugcuggacaacaucaacacccccgaggggaucaucccgagcauguucgaaccugagcgugagaaggucgacgccaucgacggcgaguaucggcuccgcggggaggcccggaagaccuucguggaccugaugcgccggggcgaccugccgguauggcucgcuuaccgcgucgccgcggaggggaucaacuaugccgaucgucguuggugcuucgacggcgugaaaaacaaccagauuuuggaggaaaacguggagguagagaucuggacaaaggagggcgagcggaagaagcugaagccccgcuggcucgacgcccggauauacuccgacccgcuggcccuaaaggaguucaaggaguucgcagccggacgcaagagccugacguuaaaccugauaaccgagaugggucggcuccccacguucaugacccagaaggcccgcgaugcgcuugacaaccuugccgugcuccauacggccgaggucgggggccgggccuauaaucacgcccuguccgagcugcccgagacccucgagacccugcugcuucugacccucuuggcuacggucaccggagggaucuuccuguuccugaugagcggcaaaggugugggcaagaugacccucgggaugugcugcaucaucacugccuccauucugcuuugguacgcacagauccagccacauuggauagcagccucuaucauccucgaguucuuccugaucgugcuccuaauccccgagcccgaaaagcagcgcacgccccaggacaaccagcucacguaugucgugaucgccauccugaccgucguggccgcuaccauggccaacgaaaugggcuuccucgagaagaccaagaaggaccugggccuggggagcaucgccacgcaggagccggaguccaacauccucgacaucgaccuccggcccgccagcgccuggacgcuguacgcaguggcuacuaccuucgucacgcccaugcuccgccauuccaucgagaacuccuccgugaacgucagccugacggccaucgcuaaucaggcgaccguacugaugggccucgggaagggcuggccccuguccaagauggacaucgggguuccguuguuagccauuggguguuacucucaggugaaccccaucacgcugacggcagcccuucuccugcuugucgcccacuaugccaucauuggcccagggcuccaggccaaggccacccgggaggcccaaaagcgcgccgcggcuggcaucaugaagaaccccaccguggacgggaucaccgugaucgaccuggaccccauccccuacgaccccaaguuugagaagcagcugggccagguuaugcugcugauccugugcguuacacagguucucaugaugaggaccaccugggcccugugcgaggcccugacgcucgccacggggcccauauccacacugugggagggcaacccgggccgcuucuggaacaccaccaucgcggucagcauggccaacaucuuccgaggguccuaccuggccggggccgggcuccuguucagcaucaugaagaauacgaccaacacccggcgcggcaccggcaauaucggggagacacugggcgagaaguggaagucccggcuuaaugcgcuggggaagaacgaguuucagauauacaagaaguccggcauccaggagguggaccgcacccuggccaaggagggaaucaaacggggcgagaccgaccaccacgcagucucccgcgggucugccaagcuacggugguuugucgagcgcaacauggugacgcccgaagggaagguggucgaucugggcugcgggaggggcggauggagcuauuacugcggcggccugaagaacgugcgcgaggugaaaggccucacgaagggcgggccgggacacgaagaacccaucccgaugaguacauauggguggaaucuggugcggcugcaaucaggcguggacguauucuucacgccucccgagaagugcgacacccuccucugcgacaucggcgagagcagccccaauccaacgaucgaggccgggcgcacccuucggguccucucccuaguggagaacuggcugaacaacgacacacaguucugcaucaaagugcucaaccccuacaugccuucgguaaucgagaagauggagacccugcagcgcaaauacgguggugcgcucgugcggaacccccucucucgcaacagcacccacgaaauguacuggguguccaacgccacuggcaacaucguuagcuccguaaacaugaucagccggaugcucaucaaccgcuucaccaugaaacauaagaaggccaccuacgagcccgacguggaccugggcuccggcacccggaacaucggaaucgagucagagaucccaaaccuggacaucauugggaagcgcaucgagaagaucaagcaggagcaugagacgaguuggcauuacgaccaggaccacccguacaagaccugggccuaucacggcagcuacgagacuaaacaaaccgguuccgccagcaguauggucaauggaguggugcgccuccuaacgaagccgugggacgucgugccgauggugacccaaauggcuaugaccgacacaacccccuucggccagcaacggguauucaaggagaagguggauacccgcacccaggagcccaaggaaggaacgaagaagcuuaugaagauuacggccaaguggcucuggaaggaacugggcaagaagaagaccccgcggaucugcacccgcgaggaguucacaaagaaggugcgaucuaacgccgcccugggggccaucuucacggacgagaacaaguggaaaucagcgcgcgaggccgucgaggacagccguuucugggagcucguggacaaagagcgcaaccugcaccucgagggcaagugugagaccugcguguacaacaugauggggaagcgggagaagaaacucggagaguucggcaaggccaaagggucgcgcgcuaucugguacauguggcugggggcgcgguuccuggaguucgaggcccucggguuccugaacgaggaccacugguucagccgcgagaacagccugaguggcgucgagggggagggccuacacaaguugggcuacauccugcgggacgugagcaagaaagagggcggcgccauguacgccgacgacaccgccgggugggacacccgcaucacgcucgaggaccuuaaaaacgaagagauggugaccaaccacauggagggcgagcacaaaaagcucgcggaagccauauucaagcucaccuaccagaacaaggucgugcggguccagcgccccaccccccgugggacugugauggacaucauuucccgaaaggaccagagaggcagcggccagguggggaccuacggacucaacaccuucacuaacauggaggcacagcugauacgccagauggagggcgagggcaucuucaagucgauccaguaccugacgguuaccgaggagguggccguacagaacuggcuggcgcgggucgguagagagcggcuuagccgcauggcgaucucgggagaugacugcguagugaagccacuagacgaucgcuucgccagcgcccucaccgcccugaacgacaugggaaagguucggaaggacauccagcagugggaaccgucccgcggguggaaugauuggacccaggucccuuucugcagccaccauuuccacgagcucaucaugaaggacgggcgggugcuggucgugcccugccgcaaccaggaugagcugaucgggcgagcacggaucucccagggcgcuggcuggagccucaaggagacggccugccuggggaaguccuacgcccagauguggagccugauguauuuccaucggcgcgaccuccggcuggccgccaacgcgauaugcagcgccguacccagccacugggucccuacgucccgcaccaccuggagcauccacgccaagcaugaguggaugaccacggaggacauguuaaccguguggaaccggguauggauccaggagaaccccuggauggaggauaagacgccugucgaaagcugggaggagguucccuaccuggggaaacgcgaggaccagugguguggcucacucaucggucuaaccagccgugccacgugggcgaagaacauccagacggccaucaaccaggugcgcucccucaucggcaacgaggaguacaccgacuacaugccaucgaugaagagauuccgccgggaggaggaggaggccggcguacugugguga

SEQ ID NO: 24966 - RNA, 9876 nt, Artificial Sequence
  derived and/or modified CDS sequence (opt11) from DENV-2__GQ868620__SS-prME
agcgccgguaugauaaucaugcuuauuccuacagugauggccuuccacuugacaacccgcaacggggagccccacaugaucgugggcauccaggaaaaagggaaguccuuacuguuuaagaccgaggacggaguuaauaugugcacacugauggccauggaccugggggaacuaugcgaggacaccaucaccuacaaaugcccccuccugcggcagaacgagccugaagauaucgacugcuggugcaauagcaccuccaccugggugaccuacgggacaugcaccacaaccggcgagcaccgacgggagaagcgcagcgucgcccuggugccccacguggguaugggccuagagacucggaccgagaccuggauguccagcgagggugccuggaagcaugcccagcgcauugagacauggauccugcgacacccggguuucacgaucauggccgcgauccuugcauacaccaucgggacuacccauuuccagagggcccuaauauucauucuuuuaacggccgucgcgccgagcaugacgaugcggugcaucggcauuucaaaccgcgauuucguggagggcguauccggcggcucuugggucgacauuguccucgagcacgguuccugugugacaacaauggccaagaacaagccaacguuagacuucgagcugauuaaaaccgaggccaagcagcccgcgacgcuccgaaaauacugcaucgaggccaagcugaccaacacaaccaccgagucgcgcugucccacgcagggcgagcccucccugaaagaagagcaggauaagcgguucgucugcaagcacaguaugguggaccgcgggugggggaacggaugcgggcuguucggcaaaggagggauugugacuugcgcgauguuuaccugcaagaaaaacauggaaggcaagaucguucaaccagagaaccuggaauacacaaucgucgugacaccacacagcggcgaggagcaugccgucggcaaugacacggggaaacauggcaaagaaauuaagguaaccccgcagagcuccauaaccgaggcagaguugacgggguacggcaccgugacgauggagugcagccccagaacaggccucgacuucaacgaaaugguccugcugcagauggagaacaaagccuggcucguccaccggcaaugguuccucgaccuuccacuccccuggcugccgggagccgauaagcagggcuccaacuggauccaaaaggagacccucgugaccuucaagaacccccacgcgaagaagcaggauguuguuguccucgggagucaagagggcgccaugcacacagcgcuuacgggggccacggaaauccagauguccaguggcaaucuccuguucaccgggcaccugaagugccgccugcgcauggauaaauuacagcugaaggggaugagcuacuccaugugcacgggcaaauuuaaaguggucaaggaaauugccgagacgcaacauggcaccaucguaauccgcgugcaguacgagggcgauggcucaccauguaagauacccuucgagaucauggacuuagagaagcgcuacgugcucgggcggcuuaucacugucaauccgaucguaacugagaaagacagucccgugaacaucgaggcggagccgcccuuuggcgacagcuauaucauuaucggggucgagccgggucagcugaagcucaauugguucaaaaaggggagcagcaucggccagauguucgagaccaccaugcgcggcgcaaagcggauggcaauccugggugacaccgccugggacuucgguagccucggcggggucuucacgagcauagggaaagcucuccaccaaguguuuggcgcgaucuacggggcggcauucuccggggucaguuggaccaugaagauccugaucggcgugauaauaaccuggaucggcaugaacucucggucaacaucccuaagcguguccuuaguccucguuggcauagugacacuuuaccugggggucauggugcaggccgauaguggcugcgucgugucguggaaaaacaaggaacucaagugcggcagcgggaucuucauuacagacaacgugcacaccuggaccgagcaguacaaguuucaacccgagagcccauccaagcuggcaucggccauccagaaggcccaggaagaaggcaucugugggauccgaucugugacgcgacuggagaaccucauguggaagcaaaucaccccagagcuaaaccacauauuggccgagaaugaggugaaauuaacaaucaugacgggcgacaucaaggggaucaugcaagcgggcaaaagaucguuacggccccaaccgacagagcugaaguacuccuggaagacauggggcaaggcgaagaugcucagcaccgagucccacaaucagacguuccugauugauggccccgaaacggccgagugcccgaauacuaaccgcgccuggaacagccuggaaguggaggacuauggauucggaguguuuaccaccaacaucuggcucaagcugaaggagaagcaggacgcguucugcgacaguaagcugaugagcgccgcgaucaaggacaaccgagccguccacgccgacaugggcuacuggaucgaguccgcccuaaacgacacguggaaaauugaaaaggcaucuuucaucgaggugaagaauugccacuggcccaagucccacaccuuguggucgaauggcguguuagaguccgagaugaucauccccaagaaucuggcgggcccugucagccagcacaauuaccgucccggcuaccauacucagaucgcggggccguggcaucugggcaagcuggagauggacuucgacuucugcgacgguaccacagugaucgugacggaggacugcggcaaccggggcccaucccuccgcaccaccaccgcgagcgggaaguuaaucacggaguggugcugccggucuugcacccugcccccgcuucgcuaccggggcgaggacgggugcugguauggcauggagauacgcccucugaaggaaaaggaggagaacuuggucaacucccucgugacggccgggcacggacaaguugauaacuucagccuaggcguccuugggauggccuuguuccuggaggaaaugcugcggacgcgcgugggcacgaaacacgcgauccuccuuguggccgucuccuucgugaccuuaaucaccgggaauaugagcuucaaggaccucggccggguaguagugauggugggggccacgaugacggacgacaucggcaugggcgucaccuaccuggcccugcucgcggcuuucaaaguccgccccaccuucgcugccgggcugcuacuccggaagcuaaccuccaaggaguugaugaugacaaccaucggcaucgugcuccugucgcaauccacgauuccagagaccauccuggagcucacagacgcgcuggcacuggggaugaugguucucaagaucgugcgcaauauggaaaaguaccagcuagccgugaccauaauggccauccuuugcgucccgaacgcugugauuuugcagaacgcauggaaggucucuuguaccauccuggcuguggugucugucucgccacugcuccugaccuccagccagcagaaaacggacuggaucccccuggcucucacaaucaaaggucugaauccaaccgccaucuuccuuaccacacucagccgcaccaacaagaagcgcaguuggccccuuaaugaggccauuauggcuguggguaugguuaguauccuugccucauccuuacugaagaacgacauccccaugaccgggccccugguagccggcgggcuacugacgguuugcuacgugcucacgggcaggucagcagaccucgagcuggagagagccacugacguaaaaugggaagaccaagcggagauuuccgggagcagcccuauucugagcaucaccaucagcgaggacggauccaugagcauaaagaacgaggaggaggagcagacccugacgauccugauacgcaccggacugcucgugaucucagggcuguucccgguuucuauccccaucaccgccgcugccugguaccugugggaggucaagaaacagcgggccggcguacucugggacgugccuucgccaccacccauggguaaagccgagcuggaggacggcgccuaucguaucaagcagaagggcauacugggcuacagccaaauuggagccggcgucuauaaggagggaaccuuccacaccauguggcaugugacgcgcggggcagugcugaugcacaagggcaagcgcaucgagcccuccugggccgacgucaagaaagaccucaucagcuaugggggcggcuggaaauuagagggcgaguggaaggaaggcgaggaggugcaaguccucgcgcuggagcccgggaagaaccccagggucgugcagacaaagcccggccuuuucaagaccaacaccgguacgaucggcgccguaucccucgauuucagccccggcaccucuggaagucccaucaucgauaagaaaggcaaggugguggggcuguauggcaacggcguggucacccgcuccggggcguacgugagcgcgaucgcccagacagagaagaguaucgaggacaauccugaaaucgaggaugauaucuuccggaaaaggcggcugacgaucauggaccugcaucccggagcgggcaaaaccaagcguuaccuaccugcaauugugcgggaggccaucaagcgcggccugcggacucuaauccucgccccgacccgagucguggcggcggagauggaggaggcccugagggggcugccuauucgcuaccagacgccggccauccgggcugaacacacuggccgugagauaguugaccucaugugccacgcgaccuucacuaugcgucugcugagccccguccgggugccgaacuacaaucuaaucaucauggaugaggcccacuucacggaccccgcgucgauugccgcccgcgguuauaucagcacccgaguggagaugggggaggcggcggguaucuucaugaccgccacgccgcccggaagccgcgacccguucccgcaguccaacgccccaaucaucgacgaggagcgcgaaauaccugagcgcagcuggaacuccggccaugagugggucacggauuuuaaagggaagacuguaugguucguuccaaguaucaaagccgguaacgacaucgcagcaugccugaggaagaacggcaaaaagguaauucagcugucccgcaagacuuuugacagcgaguacgugaagacgcggacgaacgacugggauuucguggucacaaccgacaucuccgagaugggggcgaauuuuaaggcagagcgcgugaucgacccccgucguugcaugaagcccgugauccuaaccgacggcgaggagcgcgucauccuggcggggccgaugccggugacucacagcuccgccgcgcagcgccgggggcggaucgggcggaacccaaagaacgagaacgaucaguacaucuacaugggugaaccccuggagaacgacgaagacugcgcgcacuggaaagaggccaagaugcugcuggacaacaucaacacccccgaggggaucauccccagcauguucgaaccugagcgcgagaagguggaugcuaucgacggugaguaccgguuacguggcgaggcccguaagaccuucgucgacuuaaugcgaaggggggaucugccggucuggcuggccuacaagguagcggccgagggcauaaauuacgcggauaggcgauggugcuucgacgggauaaaaaacaaucagaucuuggaagagaacgucgagguggaaaucuggacgaaagaaggagagaggaagaaacucaaaccgcgcuggcuugacgcccggaucuacucugauccguuggcgcucaaggaguuuaaggaauucgccgccggccgaaagucccugacgcuuaaucugaucaccgagauggggcggcugcccaccuucaugacccagaaaacucgcgaugcgcucgauaaccuggcagucuuacacacugccgaggcaggcgggcgggcguacaaccaugcccucuccgagcugcccgagacccuggaaacccuccugcugcucacgcugcuggcuaccgugaccggcggcaucuuccucuuuuugaugucuggucgcggcauaggcaaaaugacacugggaaugugcuguauaaucacggcauccauccuccugugguacgcacagauccagccgcauuggauagcggccagcaucauucuggaauucuuucucauagugcugcuuaucccugagccggagaagcagcguacgccucaggauaaccagcucaccuacgucgucaucgccauccucacgguggucgccgccacgauggcgaacgagaugggguuccuagagaagacuaagaaggaucucggucuggguuccaucgccacccaacagccagaaagcaauauucuggacauagacuuacgcccagccuccgcguggacccuguacgccgucgcgaccacguucguaaccccgaugcugcggcauagcaucgagaauucguccgucaaugugagccucaccgccauugcgaaucaggccaccgugcugauggggcugggcaaaggauggccccucaguaagauggauaucggagucccgcugcuggccauugggugcuacagccagguuaaccccauuacccucacggcggcgcuguuacucuugaucgcucacuaugccaucauaggcccuggccugcaggcgaaggccacccgugaggcacagaagcgggccgccgcagggaucaugaaaaaucccaccguggauggcaucacgguaaucgaccucgacccuauacccuacgaccccaaguucgaaaagcagcugggccaggugaugcugcuaauacuguguguuacccaaguccugaugaugcgcacgaccugggcccucugcgaggcccugacucuggccaccggucccaucucuacucucugggaggggaaucccggccgguucuggaacaccacgauugccgugagcauggcgaacaucuuucgcggguccuaccuggccggggcuggcuugcucuuuagcaucaugaagaacgcaaacaacacucgacgcgggacaggcaacaucggcgagacccugggggagaaauggaagucccgccuaaacgcccucggaaagagcgaguuccaaauauacaagaagucggggauccaggaaguggacaggacgcuggcgaaggaggggaucaaacgcggggagaccgaccaccacgcugucucucggggcuccgcaaagcugcgcugguucguggaacggaauauggugaccccggaggguaaagucguggaucuagggugcggccgugggggcuggaguuacuacugcgggggucugaagaacguacgggaggucaagggucugacuaagggcggccccgggcacgaggaacccaucccgauguccacguaugguuggaaccuggugcgacugcagagcgggguagaugucuuuuucaucccgcccgagaagugugacacccugcugugcgacaucggugaguccagcccaaauccgaccguagaggcagggcggacccugcgcguucugaaccucgucgagaacuggcugaacaaugacacgcaauucugcaucaagguccuaaaccccuacaugcccucagugaucgagaaaauggaggcgcuacagagaaaguacgggggagcccucguccggaacccgcugagccgcaacucgacccacgagauguacuggguguccaaugcuagcgguaacaucguguccucagucaacaugaucucccgcauguugaucaaccgguucaccaugcgacacaaaaaggccacguacgaaccugauguggaucugggcagcgguacccggaacaucgggaucgaguccgagauccccaaccuggacaucaucggaaagcgcaucgagaagaucaagcaagagcacgagacaaguugguauuacgaucaggaccaccccuauaagaccugggcuuaucacgggucauaugagaccaagcagaccggcagcgcgagcagcauggugaauggggucguccgguugcuaacgaaaccgugggauguucugccuacugucacccaaauggccaugaccgacacaacacccuuuggccaacagcgugucuucaaggagaaaguugacacccguacccaggagcccaaggaggguacgaaaaaguuaaugaagaucacugcugaguggcucuggaaggagcuggggaagaaaaagacuccccggaugugcaccagagaagaguucauccggaagguccgguccaacgccgccuuaggggcaaucuucacggacgagaacaaguggaagucggcccgggaggccguggaagauagccgcuucugggaguugguggacaaagagcguaaucugcaucuagaagggaagugcgagaccugcgucuacaauaugauggggaagcgcgagaagaagcucggggaguucggaaaggcuaagggaagccgggccauuugguacauguggcugggcgcgagauuccuggaauucgaggccuuaggcuuccugaaugaagaccacugguucucccgcgagaacagccuguccgggguggaaggagaggggcuccauaagcugggguacauacugcgcgacgucagcaagaaggaaggcggggccauguacgccgacgacacagcaggaugggacacccgcaucacgcucgaagaccugaagaacgaggagauggugacgaaccacauggagggggagcacaagaagcuggcugaagccaucuucaagcucaccuaccagaauaagguuguccgcgugcagcggcccacgccucggggcacggugauggacauuaucagccggcgugaccagcguggcuccggccaggugggcaccuauggucugaauaccuuuaccaauauggaggcacagcuaauucgccaaauggaaggcgaagggguguucgagaacauccagcaccugacggugaccgaggagguugccgugcagaacuggcuggcacguguaggcagagagcgcuugucacggauggcgaucuccggggacgacugugucgugaagccacucgacgaccgcuucgcuaacgcccugaccgcucugaacgacauggggaagauucggaaagacauucagcaaugggagcccagcaagggcuggaacgacuggacccaggugcccuucuguagccaccauuuccacgagcucaucaugaaagacgggcgcgugcuggugguucccugcagaaaucaggacgagcugaucgggcgcgcgcggauaagccaaggggccggcuggucccucagggagacugccugccugggcaaaagcuacgcgcagauguggagucuuauguacuuccauaggcgcgaccuucgucuggccgcgaacgccauaugcagcgccguccccucccacuggguccccacaagcagaacaaccugguccauccacgccaagcacgaguggaugacaacagaggacaugcugacuguguggaauaggguguggaucagggagaaccccuggauggaagauaagacacccguugagucaugggaggagaucccuuaccucgguaagcgggaggaccaguggugcggcucccugauaggguuaacgucgcgcgccacaugggcgaagaauauccaggccgccaucaaccaggugcgaucccuaauuggaaacgaggaguacaccgacuacaugccgagcaugaagcgcuuccggcgcgaggaagaggaggccggaguacuuugguga

SEQ ID NO: 24967 - RNA, 9876 nt, Artificial Sequence
  derived and/or modified CDS sequence (opt11) from DENV-2__FJ639702__SS-prME
accgccggggugaucauuaugcugauccccaccgcgauggcauuccaccucaccacccggaacggggagccccacaugaucguaggucggcaggagaaaggaaagagccuccuuuucaagaccgaggacggcgugaacaugugcacccucauggccaucgaccuuggggaacugugcgaggauacaaucaccuacaagugcccccuccugcgucagaacgagccagaggacaucgauugcugguguaauagcaccagcaccuggguuaccuacgggacgugcaccaccacgggagagcaucggcgcgagaagcgcuccguagcccucguuccacacguggggaugggccucgaaacccggaccgagaccuggaugucaagcgaaggcgcguggaaacauguucaacgcaucgagaccuggauucugcggcacccaggcuucacuaucauggccgcgauccuggcuuacaccaucgguaccacgcacuuucaacgggcccucaucuucauccugcuaaccgccguagcuccaagcaugaccaugcgauguauaggaaucuccaaccgggacuucguggagggggucagcgggggcuccuggguugauauugugcucgagcacggaaguugcgugaccacgauggcuaagaacaagcccacccuggacuuugagcucauaaagaccgaggcgaaagagccugccacccuacgcaaguauugcauugaagccaagcugaccaauacuacuaccgagucccguugucccacccagggcgagcccucgcugaaugaggaacaggacaagcgcuucguguguaagcacuccaugguagaucguggcugggggaacggguguggacuguucggcaaaggcgggaucgugacgugcgcaauguuuacaugcaagaagaacauggagggcaaaaucguucagccagagaacuuagaguacacuauagugauuacgccacacaguggagaggagcacgccgugggaaacgauacggguaagcacggcaaggagauaaaaauaacgccacaguccucauccacagaggcagagcuuaccggguacggaacgguaaccauggaaugcucaccucgcaccggcuuagauuucaacgagaugguuuuacugcagauggaagacaaagccuggcucguccaucggcagugguuucuggaccugcccuuacccuggcugccgggggcggacacccagggaaguaacuggauccagaaggaaacauuggugaccuucaagaacccacacgcgaagaagcaggaugugguggugcucgggagccaggagggcgccaugcacaccgcccugaccggcgcgacagagauccagaugucaagcgguaaucuccuguuuacgggccaccugaagugccgccugcggauggacaaacuucagcugaaagggaugagcuauucuaugugcaccggcaaguucaagaucguaaaggaaauagcagaaacacagcauggaacgaucguuaucagaguucaguacgaaggcgacggcagccccugcaagauccccuuugaaaucauggaccuggagaaacggcacguucucgggcgcuugauaacggugaacccgaucgugaccgagaaggacagccccgucaacauagaggcagagccgcccuucggggacagcuacaucaucaucgggguggaaccaggucaacuaaagcuuaacugguucaaaaaaggauccucuaucggccaaauguucgagaccacaaugaggggcgccaagcggauggccauucugggggacaccgcuugggacuucggaucccucggcgguguguucacaucuauggggaaggcacugcaccaaguuuucggggcgaucuacggcgccgccuuuuccggggugagcuggaccaugaagauccugaucggugugauaauaacguggaucgggaugaacagucgcagcaccagucugagcgugucccugguucuuguaggugucaucacgcuguaccuuggggccaugguacaggcugauucgggcugcguugucuccuggaagaacaaagaacucaaguguggcagcgguaucuucauaaccgacaacgugcacacguggaccgagcaguacaaguuccagcccgaaucacccuccaagcuggcuagcgcgauacaaaaggcccacgaggagggaaucugcggcauacgguccgugaccaggcuggagaaucucauguggaagcagaucaccccagagcugaaccacauccuauccgagaacgagguuaagcucacuaucaugaccggcgauaucaagggaaucaugcaagccggcaagcgaucccugcgcccgcaacccaccgaacugaaguacagcuggaagaccuggggcaaagcgaagaugcucaguacggagagccacaaucagaccuuccuuauugaugggccagagaccgccgagugcccgaacaccaaccgggccuggaacucccucgaaguggaggacuauggcuuugggguauuuaccaccaacauauggcucaagcugcgugagaagcaagauguuuucugcgacagcaaacugauguccgcugcuaucaaggacaaccgugcgguucacgcggauauggguuacuggaucgaaagcgcccucaaugacacauggaagauggagaaggccucguucaucgaaguaaaaucgugucacuggcccaaaucccacacccuguggucaaacggcgugcuggagagcgagaugauuaucccuaagagcuucgcaggacccgugagccagcauaauuaucggccaggcuacuacacgcagacggcugggccguggcaccucggcaaguuagagauggacuucgauuuuugcgaagggacaaccguggucgugaccgaggacugcggaaaccgggggccuucccugcgcacgacuacugccagcgggaagcucauuaccgaaugguguugccgguccugcacgcugcccccacugcgguaccgcggcgaggacgggugcugguacggcauggagauccgcccccugaaggaaaaggaggaaaaccugguaaacagcuuaguuacugccggccacggucaaaucgauaacuucucucucggaguguuggggauggccuuauuccuggaggagaugcugcggacccgggugggaacuaaacacgcgauccugcucgucgccguaagccuggugacccuaaucaccgguaacauguccuuccgagaccucggccgaguuauggucaugguuggugccaccaugaccgacgacauaggcaugggcgucacguaccuggcacugcucgccgcuuucaagguacggccaaccuucgccgcagguuugcugcuccggaaguugaccucaaaggaacuaaugauggccaccauugggaucgccuuauuaucucaauccacgauaccggaaacaauccuugaauuaacugacgcacuggcucuggguaugaugguccucaaaauagugaggaacauggagaaguaucaguuagcagugacgaucauggcgaucuccugcguuccgaaugccgugauucugcagaacgcguggaaggugucgugcacgauccucgcugccguauccgucuccccccuguugcuuaccagcucgcagcagaaggccgacuggaucccccucgcacugaccauuaagggccuuaaccccacagcuaucuuucugacgacccuaucccggaccagcaagaagcgcuccuggccgcuaaacgaggccaucauggcaguagggauggucucuaucuuggcgagcucccugcucaagaacgacaucccgaugaccgguccccuaguugcaggcgguuuguuaacggugugcuaugugcugaccggccguagcgccgaucuggaguuggagagggcaacggacgucaaaugggaggaccaggcggaaauauccgggucuucccccauccuaucaaucaccauuuccgaggacgguuccauguccauaaaaaacgaagaggaggagcagacgcuuaccauacuaauccgcacuggccugcugguuaucagcgggcucuuccccguguccauccccauuacggccgcggccugguaccugugggaggucaaaaagcagcgcgcaggcguacuuugggaugucccaagcccuccgcccguagguaaggcggagcucgaggacggcgccuaccguaucaagcagaaagggauccugggguacagucagaucggcgcugggguauacaaggagggaaccuuucauacgauguggcacgugacccgcggggcaguauugaugcaccggggcaaacgcaucgagcccagcugggccgacguuaagaaggaccucaucucauacgggggcgguuggaagcuagaaggggaguggaaggagggggaggaggugcaggugcuggcacucgagcccggcaagaaucccagagcagugcagaccaagccgggacuguucaagaccaacacggguaccaucggcgcggucagucuugacuuuucccccgguacgagcgggucccccaucguggauagaaaaggaaaggucgucgggcuauauggaaacggaguggugacacgaagcggggcuuaugucagcgcaaucgcgcagacggaaaagucgauugaggacaacccagaaaucgaggacgacauauuccgcaagaagcggcuuaccaucauggaccuccacccgggcgcaggaaagacaaagcgcuaccugccagccauagugcgggaggccaucaagcgcggccuuaggacccugauccuggcgcccacgcgcguggucgccgcggagauggaagaagcccuccgcggucugcccaucagguaucagacgcccgccauacgcgccgagcacaccgggcgggagauuguggaccugaugugccacgcaacauuuacuaugcggcuccugagcccggugcgggucccgaauuacaaccugaucaucauggaugaagcgcacuucaccgaucccgcguccauugcugcaaggggcuacauaagcacacggguggaaaugggcgaggccgcgggaaucuucaugaccgccacuccccccgggaguaaggacccguucccacagagcaacgcccccauuauggacgaggaacgcgagauuccugagcgcagcuggaacaguggacacgaguggguuaccgacuuuaaaggaaagacggucugguucguuccguccaucaaagcaggcaacgacauagccgccugccuccgcaagaacggaaagaaagugauccagcuaagccgaaaaacauucgacagugaauacgucaagacgcgcaccaacgacugggacuucguugucacuaccgauauuucggagaugggggccaauuucaaggcggagcgggucaucgacccccggcguugcaugaaaccggugauccugacagacggcgaggagcgcgugauucucgccggacccaugcccgucacgcacuccagcgcggcccagagacgcggccggauaggacgcaaccccaaaaacgaaaacgaccaauacaucuacaugggcgagccccuggagaacgaugaggauugugcacauuggaaagaagcaaagaugcugcuagacaacaucaacacccccgagggcaucauccccaguauguucgagcccgagcgcgagaagguggaugccauugacggcgaguaccgauuacgcggcgaggcucgcaagacguucguggaccugaugcgccggggagaccuucccgucuggcuagcuuaucgaguggccgcggagggcaucaacuacgcagacagacgcugguguuuugacgggguuaagaacaaucagaucuuagaagagaaugucgaaguagaaaucuggacgaaggagggcgagcgcaagaaguuaaagccacguuggcuugaugcgcggaucuacagcgauccacuggcccucaaggaguuuaaggaguucgcagcaggccgcaaaucccucacucugaaccucaucaccgaaaugggccgccugcccacuuucaugacccagaaggcgcgagacgcgcuggacaaccuugcugugcuccacaccgccgaggcgggcggacgggcauacaaccacgcguuaucugaacuucccgaaacccuggagaccuugcuccuguugacgcugcuagcaaccgucacaggcggagucuuccuguuucucauguccggcaagggagucggcaagaugacccucggaaugugcugcaucauuacggccucuauccugcucugguaugcccaaauccagccgcacuggaucgcagcaagcauaauuuuagaguucuucuugaucguacuccugauccccgagccagaaaagcagcgcacgccacaagacaaucaguuaaccuacguggucaucgccauacugaccguggucgccgccaccauggcuaacgagaugggguuccuggagaaaacuaagaaggaccugggcuugggcuccaucgccacccaagaacccgaauccaacauccucgacaucgaccuccggcccgccuccgccuggacgcuauacgcggucgcaaccacauucguaacacccaugcugcgccacagcaucgaaaacuccagugugaaugucucccugaccgcgauagccaaccaggccaccguucucauggggcugggcaagggauggccccugagcaagauggacauaggagugccccuccuggccaucgggugcuacucccaaguuaaucccgugacgcuuaccgccgcucuccugcucuugguugcucacuacgccaucaucggcccaggucugcaggccaaggcuacacgagaagcgcagaaaagagccgccgccgggaucaugaaaaaccccaccgucgacggcaucacggugaucgaccuggacccgauccccuacgaucccaaguuugagaagcagcucgggcaggucaugcuccugauccucugcgucacccaggucuuaaugaugcggaccaccugggcccuaugcgaggcacuaacucuggcaaccgguccuaucaguacccugugggaggggaacccaggccgauucuggaauaccacuauagccgugagcauggcgaauauauuccgaggcagcuaccuggccggggcuggccuucuguuuucgaucaugaaaaauaccaccaacacgcggcgcggaacggguaacaucggggagacccucggagaaaaguggaagucccggcugaacgcucuggguaaguccgaguuccagaucuauaagaaguccgggauccaggaaguagaccgcaccuuggcgaaggaaggcaucaagaggggggagaccgaucaccacgccgugagccgcggguccgccaaacuccggugguucguugagcgcaacauggucacccccgagggaaagguggucgaccuggguugcggccgcggcggcugguccuauuauugcggcgggcucaagaaugugaaagaggugaaagggcugacgaagggcgggcccgggcaugaggagcccaucccaaugagcacuuacggcuggaaccugguacgccugcagagcggggucgauguguucuuuacgccgccugagaagugcgacacguuacugugcgauaucggcgaguccagcccaaacccgacgauagaagcugggcgaacccugcgcgugcuuucccugguggagaacuggcucaacaaugacacacaauucuguauaaaaguccucaauccauauaugccuagcgugauugagaagauggagacucugcaacggaaauacggaggcgcccuggugcggaauccgcuaaguagaaacagcacgcaugagauguacuggguaucuaacgcgacggggaauaucgugagcuccgugaacaugaucagucgcaugcucauaaaccguuucaccaugaagcauaagaaggcuaccuacgagcccgauguggaccugggcucugggacccguaacaucgguauagagagcgaaauccccaaccuugacaucaucggcaaacggaucgagaagauaaagcaggaacacgaaaccucauggcacuaugaccaggaccaccccuacaaaacgugggcguaccacgggaguuaugagaccaagcagacuggcuccgccagcuccaugguuaacgggguaguccgccugcuaaccaagccgugggauguaguuccaaugguaacccagauggcaaugaccgauacgacucccuucggccagcagcgugucuuuaaggaaaaggucgacacccgcacccaggagcccaaggagggcacgaaaaagcugaugaaaaucaccgcugaguggcuguggaaggagcuggguaaaaagaagaccccgcgcauguguacccgagaggaguucacgcgcaaagugaggagcaacgcagcccucggcgccaucuucacggacgagaacaaguggaaguccgcucgcgaggcgguggaagacagccgguucugggagcugguggauaaggagcggaaucugcaucuggaggggaaaugcgagaccuguguguacaacaugauggggaagcgggagaagaagcuuggcgaguuuggcaaggcgaagggcucgcgcgcgauuugguacauguggcuaggggcgagauuucucgaauuugaagcgcuaggcuuccugaacgaggaccauugguucucccgcgagaauucucugucggggguagaaggcgaaggguugcacaagcugggcuacaucuugcgagacguaggcaagaaggagggcggggccauguacgccgacgacaccgcagggugggauacgcggaucacucuggaggaucugaagaaugaggaaauggugaccaaccacauggaaggagagcacaagaagcucgccgaagcgaucuuuaagcugaccuaucaaaacaaaguggugcgggugcagcguccaacgccccgggggaccgucauggacauaauaagccgccgcgaccaaaggggcucuggccaagugggcacuuacggccugaauaccuucacuaacauggaagcccagcucauucggcagauggagggcgagggcauauucaaguccauccagcaccuaaccgccacugaggagaucgcugugcagaacuggcuugcccgcgucggccgcgaacgccucuccagaauggcgaucucgggggacgacugcguggucaagccccucgacgaccgauucgcgucugcucugacggcccucaaugauaugggcaagguccgcaaggauauucagcagugggagccaagccggggcuggaaugacuggacccaaguacccuucuguucccaccacuuccacgaacuaauuaugaaggacggccgcgugcuggucgugccuugccggaaccaagaugagcucaucgggcgcgcacguaucagccagggggcgggauggucauugaaagagacugccugccugggcaaaagcuacgcgcagaugugguccuugauguacuuccaucgccgggacuugagauuggccgcgaaugcaaucugcagcgccgugccaucccacugggucccgaccagccggaccaccuggagcauccacgccaagcacgaauggaugacgaccgaggacaugcuaaccguguggaaccgcguauggauacaagagaacccuuggauggaggacaagacuccaguggagucaugggaggagguucccuaccuuggcaagcgggaggaccaguggugcgggucuuuaaucggccucacuucucgcgcgaccugggcgaagaauauucagaccgccaucaaccaaguccggucucugaucgggaaugaggaguacaccgauuacaugccgucuaugaagcguuuccggcgggaggaggaagaagccggcguccuuugguga

SEQ ID NO: 24968 - RNA, 9876 nt, Artificial Sequence
  derived and/or modified CDS sequence (opt11) from DENV-2__GQ868621__SS-prME
ucugcggggaugauaauaaugcugaucccaacaguaauggccuuccaucucaccacccgcaacggugagccccacaugauagucggcauccaagagaaagggaaguccuuguuauucaagacugaagacggcgucaacaugugcacucucauggcgauggaucugggggagcugugcgaggacacuaucaccuacaaguguccccuccugcggcagaacgaacccgaggacaucgacugcuggugcaacagcaccagcacguggguuacguaugggaccuguaccacaacgggcgagcaccgccgcgagaagcgcucugucgcccuggucccccacguggggaugggacucgagacccguaccgagaccuggauguccagcgaaggggccuggaagcacgcccagcgcaucgagacuuggauccugcgacacccugguuucacgauaauggccgcgauccuggccuacaccauagggaccacccacuuucaacgcguccucaucuucauccuacugacggccgucgcccccagcaugacuaugcgguguauagggaucagcaaccgugacuucguggagggcgucucuggcggaagcuggguggacaucguccucgagcacggguccugcguaaccaccauggcgaagaauaagcccacgcuggacuucgagcugauaaagaccgaggccaagcaaccggcaacucuccguaaguacuguaucgaggccaagcugaccaacacgaccaccgagucccgcuguccuacccaaggcgagcccucccugaaggaggagcaggacaagcgguucgugugcaagcacaguaugguagaccgcggcugggggaaugguugcggccuguucggcaagggcgggaucgucacuugcgccauguucacuugcaaaaagaacauggagggcaagaucgugcagcccgaaaaccuggaguauaccaucgucgucacgccacacucaggggaggagcaugcgguaggaaacgacacggggaagcacgguaaggagauuaaggugaccccgcagaguuccaucaccgaggccgagcugacuggcuacggaaccguaacgauggagugcagcccccggacgggcuuggacuucaacgagaugguacugcuacagauggagaacaaagcguggcucguacacagacagugguuccuggaccugccccuccccuggcuaccgggggcagacaagcaggaaucuaauuggauacaaaaggagacccuuguuacguuuaagaacccucacgccaaaaagcaggacguggucguacucggcucacaggagggggcgaugcacacggcccugacgggagcaacagaaauccagaugagcucuggaaaucuccuguucaccggccaccugaagugccggcugcgcauggacaagcuccagcucaaagggaugagcuacuccaugugcacuggcaaguucaaagucgucaaggagaucgccgagacccagcacggcacaaucgugauaagaguccaauacgagggagacggaagcccgugcaagaucccuuucgaaaucauggacuuggaaaagcgcuacauucucggccggcucauuaccgucaacccgaucgugacggagaaagacuccccgguaaacauugaggccgagccgcccuuuggagacagcuacaucauaaucggcgucgagccgggacagcucaagcucaauugguuuaaaaagggcuccagcaucgggcagauguucgagaccaccaugcgcggcgcaaagcgcauggccauccugggagauaccgccugggacuucgggucucuaggcgggguguucacgagcaucggcaaggcccuccaccaaguguucggggcaaucuauggggccgcguucuccggcgucagcuggaccaugaagauccugaucggggugaucauuaccuggaucggcaugaauagccggagcaccucccugucggugucccugguccucgucgggauugucacgcuuuaccugggcgucauggugcaggccgacagcgggugcguggucuccuggaaaaacaaagagcucaagugcggcagcggaaucuuuaucaccgacaacguacacaccuggacagagcaauauaaguuccagccugagucccccuccaaacuggccagcgcgauccagaaagcgcaggaagagggaaucugugggaucaggucggugacacggcuggagaaccucauguggaagcagaucacacccgagcugaaucacauucuggccgagaacgaggucaaacucaccaucaugaccggcgacaucaagggcaucaugcaggccgggaagagaagccugcggccgcaaccuaccgagcugaaguacuccuggaaaacguggggcaaggcaaagauguuaagcaccgaguccuacaaucagaccuuccuaaucgauggaccugaaacggcggagugccccaacaccaaucgcgccuggaacagccuggagguggaggacuacggcuucggcguguucacuacuaauaucugguuaaagcugaaggagaagcaggaugcauuuugcgacuccaagcugaugagcgccgccauuaaggacaaccgggcgguccacgccgacaugggguacuggaucgaguccgcccuuaacgauaccuggaagaucgagaaggccagcuuuaucgagguuaagaauugucacuggcccaagucccauacgcucuggagcaacggcgugcuggaguccgagaugaucaucccuaaaaaccucgcuggccccgucagccagcacaacuaccgaccggguuaccacacccaaauagcgggccccuggcaccuggggaaguuggagauggacuucgauuucugcgacggcaccaccguaauugugacggaggacugcgggaaccggggccccucccuccgcaccaccaccgccagcggcaaacugauaacagaguggugcugcaggagcuguacccugcccccgcugcgcuaccgcggggaggacggcuguugguacgggauggaaauccgcccucugaaggaaaaggaagagaaccugguuaacagccucgugacagccgggcacggccagguggacaacuucagccugggcguccucggcauggcccuauucuuggaggagauguugcggacccguguugggacgaagcacgcgauccuccuaguggccgucuccuucaugacccugaucaccggcaacaugucuuucaaggaucucggacgggugguggucauggugggggccacaauggccgacgacaucgguaugggcgugacguaccuggcccuccucgcggccuucaaggugcgaccuaccuucgcagccggccugcugcuccggaaguugacuuccaaggagcugaugaugacuaccauugggauagugcuccugagccaauccacaauccccgaaaccguacuggagcucacagacgcauuggcgcuuggcaugaugguccugaagaucgugcgcaacauggagaaguaccagcuggccgucacaaucauggccauucugugugucccgaacgccguuaucuugcagaacgcauggaagguuagcuguaccauccuggcggugguguccgucagccccuuacuacugaccuccagucaacagaagacagacuggaucccccuggcccucacgaucaaagggcugaaccccaccgccaucuuucugacuacccucucccgcacgaacaagaagcggagcuggccgcugaaugaagcaauuauggcagucggcauggugaguauccuugccagcucccuccuaaagaacgacauaccuaugaccggcccuuuagucgcggggggccucuuaacagucugcuacgugcugaccgggcgcagcgccgaccucgagcuagagcgugccacggacgucaagugggaggaccaggccgagaucaguggcucuucgcccauccuguccaucaccaucagcgaagacgggaguaugucuauuaagaacgaggaggaggaacacacccucaccauccugauacgcacuggccugcuugugauuucaggccuguuuccaaucagcauccccaucaccgccgccgccugguaccugugggaagucaagaaacagcgggcagggguccucugggacgugcccaguccgccacccauggguaaggcagagcucgaggacggagccuaucgcauuaagcagaagggcauacugggguacucccagaucggggccggcguuuacaaagaggguaccuuccacaccauguggcacgucacccgaggcgccgugcucaugcacaaggggaaacgaaucgagccuucaugggccgacguaaagaaggaucugaucagcuacggcgggggcuggaaauuggagggcgaauggaaagagggcgaggagguacaggugcucgcgcuggagcccgguaagaacccccgggccgugcaaacgaaaccagggcuguucaagaccaauacuggcaccaucggggccgucucccucgacuuuucgcccgguacgucaggcagcccgaucaucgacaaaaaggggaagguggugggccuguacgggaacggaguugugacacgcuccggggcuuacgugucugcgauugcgcaaaccgagaaguccaucgaagacaaucccgaaaucgaagacgacaucuuccggaagcgcaggcugaccaucauggacuuacacccaggggcuggcaagacgaagcgcuacuuacccgccaucguccgugaagccauaaagcgcgggcugcggacgcugauccucgcgccaacacgcgugguggccgccgagauggaggaggcccugaggggccugcccauccgcuaccagacccccgccaucagagcggagcacacuggacgagagauugucgaccucaugugccacgccacguucaccaugcggcuauugagcccggugcgcgucccgaacuacaaccucauuaucauggaugaggcccacuucaccgaccccgccuccauugccgcgcgcggcuacauuucaacgcggguggagaugggcgaggccgccgggauuuucaugaccgcgacgccgcccgguagcagagacccguucccccagaguaacgcccccaucaucgacgaggagcgggagauccccgagcgcagcuggaauuccggucacgagugggugaccgauuuuaagggcaaaacggugugguucgucccgagcaucaaggcggggaacgacaucgcagcgugccugcggaagaauggcaagaaggugauccagcugucacgcaagaccuucgacagcgaguacgugaagacccggacaaaugacugggacuucgucgugaccaccgacaucuccgaaaugggcgccaacuucaaggcagagcgcguaaucgacccccggcgcugcaugaagcccgugauccucaccgacggggaggagcgggugaucuuagccggacccaugccggugacacacagcucugccgcacagcgucgggggcgcauuggccggaaccccaagaacgagaacgaccaguacauauauaugggggagccccuggagaacgacgaggacugugcgcacuggaaggaggcgaagauguuacuggacaacaucaacacgcccgagggcaucaucccgagcauguucgagcccgagcgcgagaaggucgacgccaucgauggcgaguacagauuacgcggggaggcccggaagaccuucguggaccugaugcggcgcggggaucuacccguuuggcuggccuacaaaguggccgcggaggggaucaacuacgccgaucggcgcuggugcuucgacggcauuaagaacaaccaaauucucgaagagaacguggagguggagaucuggacuaaggagggggagcgcaaaaaguuaaagccgcgcuggcuggaugcacggaucuauuccgauccgcuggcccugaaggaguucaaggaguucgcugcgggucgcaagagcuugacccugaauuuaaucacggagaugggccggcugcccaccuuuaugacccagaaaacucgcgacgcccuagacaaucuggccguccugcacacggccgaagccggcggacgggccuauaaucacgcccucuccgagcugcccgagacccuagagacccuacugcugcucacccuacuggccacggugacagggggcaucuucuuguuccugaugucaggacgcggaaucggcaagaugacacuagggaugugcuguaucauaaccgcguccauucucuugugguacgcucaaauccagccgcacuggaucgccgccucuauuaucuuagaguucuuccuuaucguccuacugauccccgagcccgagaaacaacgcacgccucaggacaaccaacucacguauguggucaucgcaauauugacgguaguggccgccacgauggccaaugagaugggcuuccuagagaagaccaagaaggaccucgggcuggggaguauugccacgcagcagccggagagcaauauccuggauauagaccuccgccccgccuccgcguggacccuauaugcgguagccaccacguucguuacgccgaugcuucggcacagcaucgagaacagcuccguuaaugugagccucaccgcaaucgccaaccaggccaccgucuuaaugggccuggggaagggauggccccuauccaagauggacauuggggugccucugcuggcgauuggcugcuacucucaagugaaccccaucacccucacggcagcguuacuguugcuggucgcgcacuaugcgauaaucggucccgggcugcaggccaaggccacccgcgaggcacagaagcgggccgcggccggcaucaugaaaaacccaaccguggacgguaucacggugaucgaccucgaccccauccccuacgaccccaaguuugagaagcagcugggccaggucaugcuguuaauccugugcgugacccaggugcugaugaugcgcaccaccugggcccucugcgaagcgcugacccuggcaacggggcccauauccacguugugggagggcaacccggguagauucuggaacaccacuauagcagucagcauggccaacaucuuccgcggcuccuaccuggcuggcgccggguugcucuucagcaucaugaagaacacgaccaacaccagacgcggcacggggaacaucggggagacgcugggcgagaaguggaaguccaggcugaacgcccucgggaaguccgaguuccagauauauaagaaguccgggauacaagagguggaccguacccuggcgaaggaggggaucaaaagaggcgagacagaccaccacgccgucagccggggauccgccaagcugcgcugguucgucgagcggaacauggugacacccgagggcaagguuguggacuuaggcugugggcgcggcggguggagcuacuacugcggcgggcugaagaauguacgggagguaaagggccugacgaagggcggccccggacacgaagagcccauuccaauguccaccuacggguggaaccucguccgccugcagagcggaguagacguguucuucauuccgccugagaagugugacacccuuuugugcgacauaggggaauccagccccaacccgaccguggaggccggcagaacgcugcgaguccugaaccucguggaaaauuggcugaauaauaacacucaguuuuguaucaagguccucaaccccuauaugcccucugugaucgagaagauggaggcguuacagcggaaauacggcggggcacucgucaggaacccucuaagccggaacagcacccaugagauguauugggucuccaaugcgagcgguaauauagucuccagcgugaacaugaucucccggaugcucauuaaccgguucaccaugcgacacaagaaggccaccuaugaacccgacgucgaccucgggagcggcacgcggaacaucgggaucgagagcgaaguaccaaaccuggacaucauaggaaaacgcaucgagaagauaaagcaggagcacgagaccagcuggcacuacgaccaggaccaccccuacaagaccugggccuaccaugggagcuacgaaaccaagcagacggggagcgcguccucaauggugaacggcgucgugcggcuguugaccaagccgugggacgugcugcccaccguaacccagauggccaugacggauaccacccccuuugggcaacaacgcguguucaaagaaaagguagauacccgcacgcaggagcccaaagagggcaccaagaagcugaugaagaucaccgccgaguggcucuggaaggaacugggcaagaagaagaccccgcggaugugcacuagagaggaguucacccggaagguccgcucuaacgccgcccugggggcuaucuucaccgacgaaaacaaguggaaauccgcccgugaggccguugaggacucacgcuuuugggaguugguggacaaggagcggaaccugcacuuagaaggcaagugcgagacgugugucuauaacaugauggggaagcgcgagaagaagcucggcgaguucgggaaggccaagggcucgcgggcgaucugguacauguggcugggcgcgagguuccuggaguucgaagcccucggcuuucugaacgaggaucacugguucucccgggagaacagccugucuggcguggagggggagggguugcauaagcugggcuacauucugcgcgacguaagcaagaaggagggcggcgccauguacgccgacgacacggcggggugggacacgcgaaucacucucgaggaccugaagaacgaggagauggucaccaaccacauggagggugagcacaagaagcuggccgaagccaucuucaagcucacguaccagaauaagguggucagagugcagaggcccacgccccgagguaccgugauggacaucaucagcaggcgcgaucagcguggcuccgggcaagucggcaccuacgguuuaaacacguuuacgaacauggaggcccagcugauccgccagauggaaggggagggcguguucaaaaacauucagcaccugaccgugaccgaagaagucgcagugcagaacuggcuggcgcggguggggcgcgagcgccugucgcguauggccauauccggugaugacugcguggugaaaccgcucgacgaccgcuuugccaacgcauugaccgcccugaacgauaugggcaaaauccggaaagacauccagcagugggagccuagcaaggguuggaaugauuggacccaggugcccuucugcucccaccacuuccacgagcucaucaugaaggacggacgcguccuaguggugcccugcagaaaucaggacgaguugaucgggcgcgcgcggaucucccaaggcgcaggauggagucuccgcgagaccgccuguuuggggaagagcuacgcccagauguggucccucauguacuuccaccggcgagaccuccggcucgcagcuaacgcuaucugcagcgccguacccucccauugggugccgaccucucgcaccacauggucaauccacgccaagcacgaauggaugacgaccgaagacaugcuuaccguguggaaccggguuuggauccgcgagaacccguggauggaagacaagacgcccguggagagcugggaagagauucccuaccucggcaagcgggaggaccaguggugcgggucccugaucggccugaccagccgcgcgaccugggcgaagaacauccaggccgccaucaaccaggugcguagucucaucgggaacgaggaguauaccgacuauaugccaagcaugaagcgcuuccggcgcgaggaggaggaggccgggguccugugguag

SEQ ID NO: 24969 - RNA, 9876 nt, Artificial Sequence
  derived and/or modified CDS sequence (opt11) from DENV-2__FJ639704__SS-prME
ucugcgggaaugaucaucaugcuuauccccaccgugguggccuuccaccucaccacccggaauggggagccccauaugaucgugggcauccaggaaaaagggaagucccugcuguucaagaccgaagacggcgugaacaugugcacccucauggcgauggaccugggggaacugugcgaagacaccaucaccuacaagugcccgcuacugcggcagaaugagccggaggacaucgacuguuggugcaacagcaccagcaccugggucaccuacgguaccugcaccaccaccggggagcaccgccgggaaaaacgcucgguagcccuggugccccacgucgggaugggccucgagacacggaccgagacguggaugucuagugagggggccuggaagcacgcccagcggaucgagaccuggauccugcggcacccggguuucacgaucauggccgcuauacuggccuacaccaucgggaccacccacuuccagagagcccuuaucuucauccucuugacggccgucgcgcccagcaugaccaugcggugcauaggcaucucuaaccgcgacuucguggagggcgucuccgggggaagcuggguggacaucguccuggagcacgguaguugcgucaccaccauggccaagaacaagcccacgcuggacuucgaguuaaucaagaccgaggccaagcagccugccacccuccggaaguacugcaucgaggccaagcugaccaacacgaccaccgaaagccgcugcccgacccagggcgagccgucccugaaggaggaacaggacaagcgauucgugugcaagcacucaaugguggaccguggaugggggaacggcugcggccuguucggaaagggcgggauugucacgugcgcgauguucacgugcaagaagaacauggagggcaagauugugcagccagagaaccuggaguacaccaucguggucaccccgcacuccggagaagaacacgccgucggcaacgacacggggaagcacggcaaggagaucaaggugacaccgcagagcagcauaacagaggccgagcugaccggguauggcaccgucacgauggagugcagcccccggacuggacucgacuucaacgaaaugguccugcugcagauggagaacaaggccuggcuggugcaccgacagugguuccuggaccugccccuccccuggcugccaggggccgacaagcaggaguccaacuggauccagaaggagacccuggucaccuucaagaacccccacgcgaagaagcaggaugucgugguccucgguagucaagagggggccaugcacacggcccugacuggcgcuaccgagauccagaugagcuccgguaaucugcuguucacgggacaccugaagugccgucuccgcauggacaagcuccagcugaagggcaugagcuacuccaugugcacgggcaaguucaagguuguuaaggaaaucgcagaaacucagcacggcaccaucgugauccgggugcaguaugaaggagacgggagccccugcaagauuccuuucgagaucauggaccuggagaaacguuacguccucggccgguuaaucaccgugaacccuaucguuaccgagaaggacucccccgucaacaucgaagcggaaccgcccuucggggacagcuacauaauaaucggcguggagccaggucagcugaagcucaacugguuuaagaagggcuccagcaucgggcaaauguucgaaacuaccaugcgcggcgccaagcgcauggccauccugggcgacacagcuugggauuucgggagucugggcggaguguucacgagcaucggcaaggccuuacaccaggucuucggugcgaucuacggcgccgccuuuuccggggugagcuggaccaugaaaauccuaaucggggugaucaucaccuggaucgggaugaacucccggagcacaucccugagcguaucucuggugcuaguggggaucgucacgcuauaccugggggugaugguccaggccgacagcgggugcgucgucuccuggaagaacaaggagcucaaaugcggaagcggcaucuucaucaccgacaacgugcacacguggaccgagcaguacaaguuccagcccgagagccccuccaagcuggcgagcgccauccagaaagcccaggaggaagggauuuguggcauccgauccgucacucggcuggagaaccucauguggaagcagauaacccccgagcugaaccacauccuggccgaaaacgaagugaagcucaccaucaugaccggcgauaucaagggaaucaugcaggcugggaaacgcagccugcguccgcaacccacggagcugaaauauuccuggaagaccuggggcaagaccaagauguuaagcaccgaguccuacaaccagacguuccugauugacgggcccgagaccaccgagugcccgaacaccaaucgggcauggaacagccuggagguugaggacuacggguucggcgucuucaccaccaacaucugguuaaaacuuaaggagaagcaggacgcguucugcgacuccaaacuuaugagcgccgccauaaaggauaaccgggccgugcacgcagacaugggguacuggaucgaguccgcccucaacgacaccuggaagaucgaaaaggccagcuucaucgaagugaagaacugucacuggccaaaaucccacacccuguggagcaacggcguccuagaguccgagaugaucauucccaagaaccucgccggccccgugucucagcacaacuaccgacccggcuaccacacccagaucgccgggcccuggcaccuagggaagcuagagauggacuucgacuuuugcgacggcacgaccgugauagugaccgaggauugcgggaacagagggcccucccuccgcaccacgacugcgucgggcaagcugaucacugaauggugcugccggagcugcacccugccuccgcuccgcuaccgcggggaggacggaugcugguacgggauggagauccgccccuuaaaggagaaagaggagaaccugguuaacucccucgucacggccggccacgggcaggucgacaauuuuucgcugggcguuuugggcauggcccuguuucuagaggagaugcugcguacuaggguggggaccaagcacgcaauccuccugguugcaguguccuucgugacccugaucacgggcaacaugagcuucaaggaccucgggcgggucguggugauggucggugccaccauggcggacgacaucggaaugggcgugaccuaccuggcccuacucgcggcguucaaggugcgccccacguucgccgccggccugcugcuccggaagcugacgucuaaagagcugaugaugacuacuauugggauuguccuccugagccaauccaccauccccgagacgauccuugagcucaccgacgccuuggccuuagggaugauggugcucaagaucgugcguaacauggagaaguaccagcuggcgguuaccaucauggcaauucugugugugccgaacgccgugauccuccaaaacgcguggaaggugagcugcaccauccuagccguggucuccgugagcccccugcuucugacgagcagccaacagaaggcggacuggauccccuuagcccuuacaaucaagggccugaaucccacagccaucuuccugacaaccuugucgcgcaccaacaagaagcguagcuggccgcugaacgaggcgaucauggcggugggcauggucuccauccuggccucuagucuccugaagaacgauauacccaugaccggcccccugguggccgggggccuccucaccgugugcuacguccugacgggucggagcgcugaccuagagcuggagcgggcaacagacgugaaaugggaggagcaggcggaaaucuccggcaguagcccuauccuauccaucacgaucagcgaggacggguccaugagcaucaagaacgaggaggaggagcagacccuaacgauccugauucgaaccggccugcucgugaucucgggccuguucccgaucuccauccccaucaccgcagccgcaugguauuugugggaggucaagaagcagcgggccggcgugcuaugggacgugcccagcccgccgcccaugggcaaggcggagcuggaagacggggccuaccgcaucaaacagaagggaauccugggguacucccagauaggcgccggagucuacaaggagggaaccuuucacaccauguggcaugugacgcggggcgcagugcucaugcacaaagguaagcgcaucgagcccuccugggcggacgucaagaaggaccucaucagcuacggcgggggcuggaaacuggagggagaguggaaggagggagaagagguccaggugcucgcgcuggagccgggcaagaacccacgggccguccagaccaagcccggucuguucaagacuaacacaggcacgaucggggccgugucguuggacuucagcccaggaaccucgggcagcccuaucaucgacaagaaggggaagguggugggccuguacgggaauggugucguaacccgcuccggcgccuacgucagcgccauugcacagacagagaaguccauugaggauaacccugagaucgaggacgacaucuuccggaagcgccggcugaccaucauggaccuccaccccggggccggcaagaccaagagguaucuccccgccaucgugcgcgaggccauaaaacgcgggcugcggacccugauccucgcgcccacccgcguggucgccgcggagauggaggaagcauuacgcggccugcccauucgcuaccagacgcccgcaauccgggcggagcacaccggucgcgagaucguagaccuuaugugccacgccaccuucaccaugcgccugcuaucgcccgugcgggucccgaacuacaaccucaucaucauggacgaggcccacuuuacagaccccgccuccaucgccgcccgcgguuauaucucgacccggguggagaugggcgaggccgccggcaucuucaugaccgcaacgccgccuggcagccgcgacccguucccccaguccaacgccccuauuaucgacgaggagcgggagaucccagaacgcuccuggaacuccggacaugaaugggugacggacuucaagggcaaaaccgucugguucguaccgagcaucaaggcggggaacgacaucgccgccugccugcggaagaacgguaagaaggugauucagcugucccgcaagaccuuugauucagaguacgugaagacucggacgaacgauugggacuucguugugaccacggacaucuccgagaugggcgccaacuucaaagcugagcgcgucaucgacccccgccgcugcaugaagcccgugauccucaccgacggggaggagcgggugauccucgccgggccgaugccagucacgcacagcuccgccgcccagcgccgugggcgcaucggccggaaccccaagaacgagaaugaccaauacaucuacaugggugaaccccucgagaacgacgaggacugcgcccauuggaaggaggcgaaaaugcuccuggacaacaucaacacuccggagggcaucaucccuagcauguucgaacccgagcgcgagaagguggaugccaucgacggcgaguaccggcugcgcggggaggcccgcaagacguucguggaccucaugcggcgcggagaccugccgguauggcuggccuacaaaguggccgcggaggggaucaauuacgccgaccggcgcuggugcuucgacggcaucaagaacaaccagauacucgaggagaacguggagguggagaucuggaccaaagagggggagaggaagaaacugaagccccgcuggcuggacgcgcggauauauuccgacccccuugccuuaaaagaguuuaaggaguucgccgcgggccguaagagcuuaacauugaauuugaucaccgagaugggccggcuccccaccuucaugacccagaaaacccgcgacgcccuagacaaccuggccgugcugcacaccgcggaggccggugggcgcgccuacaaccacgcgcucuccgagcugccugagacccuggaaacccuccugcugcucacgcugcuggccaccgucaccgggggcaucuuccuauuccugaugucaggccgggggaucggcaagaugacccuggggaugugcugcaucaucaccgccuccaucuugcuaugguacgcgcagauccagccgcacuggaucgccgccagcaucauacuggaguucuucuuaaucgugcuuuugauccccgagcccgagaagcagcgaacgccccaggacaaccagcucaccuacguagucaucgcaauacuaaccgucguggccgcgaccauggccaaugagaugggguuccuggagaagaccaagaaggaccucgggcugggguccaucgccacccagcaaccggaaagcaacauucuggacaucgaccucaggcccgccuccgccuggacccuguacgcggucgccaccacguuuaucacccccaugcugcgccacagcaucgaaaacuccuccgugaacaucagccucaccgcaaucgcgaaucaagccacggugcugaugggccucgggaaggguuggccgcucucgaagauggacauugggguaccgcugcuggcgaucggcugcuacagccagguaaaccccaucacgcucacagccgcccugcugcuccuggucgcccacuacgcaaucauugggcccggccugcaggccaaggcgacccgcgaggcgcagaagcgggcggcggcggguaucaugaagaaccccaccguugacggaauuacggugauugaucuggacccuauccccuacgacccgaaguucgaaaagcagcugggccaggugaugcugcucauccugugcgucacucagguacugaugaugaggacgacgugggcccuuugcgaggcucucacgcuggccaccgggcccaucucgaccuugugggagggcaacccggggagguucuggaacaccacgauugcugugucgauggccaacaucuuccgcggcuccuaccuggccggcgccgggcuccuauucagcaucaugaagaacaccaccaacacucggcgcggcacggggaacaucggcgagacccugggcgagaaguggaaaucccgccugaacgcccucgguaaguccgaguuccagaucuacaagaaguccggcauccaagaggucgacaggacccuggcgaaggaggggauaaagcggggcgagacggaccaccacgcuguuagccgaggguccgccaaauugcgcugguucguggagcggaacauggucacgcccgagggcaaggugguggaccuuggcugcgggcgcggcggguggucauacuacugcggcggacugaaaaacgucaaagaggugaagggacuaaccaagggcggucccggccacgaggagccgauuccgauguccaccuacggguggaauuuagugcggcugcagagcggcgucgacguguucuucaucccacccgagaagugcgacacacugcucugcgacaucggggagucuagcccgaacccgacgguugaggccggccgcacccugcggguacugaaccucguggagaacuggcugaacaacaauacccaguucugcaucaagguguugaaucccuacaugccauccgucaucgagaagauggaagcgcugcagcgcaaauacggcggggcccucgugcggaacccucugucucgcaacuccacucacgaaauguacuggguguccaaugccagcggcaacaucguauccagcgugaacaugaucucccggaugcugauaaaccguuuuacaaugcggcacaagaaggcuacguacgaacccgacguggaccucgggucuggcacccgcaacaucggaaucgagucagagguccccaaucuggacaucaucgguaagcggaucgagaagaucaaacaagaacacgaaaccagcuggcacuacgaccaggaucaccccuacaagaccugggccuaccacggcaguuaugagacgaagcagaccgggucggcaucaagcauggucaacggcguugugcgccuccucaccaaacccugggacguacuucccaccguuacccagauggcgaugaccgacaccaccccguucgggcagcagcgggucuuuaaggagaagguggacacgcgcacccaagagccuaaggagggcaccaagaagcugaugaagauaaccgcagaguggcucuggaaggagcugggcaagaagaagaccccgcggaugugcacccgggaggaguucacacgcaaggugcguuccaacgcagcccugggugcgauuuucaccgacgagaacaaguggaaguccgcuagagaggccgucgaggacucccgguuuugggaacucguggacaaggagagaaaccugcaccuggaggggaagugcgaaacgugcguguacaacaugauggggaagcgggaaaagaagcucggggaguucgggaaagcaaagggcagccgcgcgaucugguacauguggcugggcgcgcgguuucuggaguucgaggcgcucggauuccugaacgaggaccacugguucucccgcgagaauagccuguccggcgucgagggggagggccugcacaagcugggguacauccugcgggacgugagcaagaaggaaggaggggccauguacgccgacgacaccgcgggcugggacacccgaauuacccucgaggaccugaagaacgaggagauggucacgaaccauauggagggcgagcacaagaagcucgcugaggccaucuuuaaacucaccuaccagaacaagguggugaggguccagcgccccacgccgcgggggaccgugauggauaucaucagccgacgggaucagagggguuccggccaggucgggacguacggacugaacaccuuuaccaacauggaagcccaguugauccggcagauggagggggagggcgucuuuaagaacauucaacacuugacggugacggaggaggucgcgguccaaaacuggcuggcgcgcguggggcgggagcgacugagccgcauggccaucuccggugacgauugcguggugaagccccucgacgaccgguucgccaacgcgcugaccgcucuuaacgacauggguaagauccggaaagacauccagcagugggagccgagcaagggguggaacgacuggacacagguucccuuuugcucccaccacuuccacgagcucaucaugaaggacggccgggugcucguggugcccugccgcaaucaggacgagcugaucggacgggcgcgcaucagccagggcgccggguggucccuccgggagaccgcaugccugggcaaaagcuaugcccagauguggucccugauguacuuucaccgccgagaucuccgccuggcggcgaacgccaucugcagcgccguaccaucccauugggucccgacgagccggaccacuuggucuauccacgcgaaacacgaauggaugacaacagaggacaugcugacgguuuggaauaggguguggauccgggagaaccccuggauggaggacaagacccccgucgagagcugggaggagaucccguaccucggcaagcgcgaagaccaguggugcggguccuuaauagggcugaccucucgggccaccugggcaaagaacauccaggccgcuauuaaccaagugcgcucccugaucggcaacgaggaguacacugacuacaugccgagcaugaagcgcuuccgccgggaggaggaggaggccggcgugcugugguga

SEQ ID NO: 24970 - RNA, 9876 nt, Artificial Sequence
  derived and/or modified CDS sequence (opt11) from DENV-2__GQ868622__SS-prME
ucugcgggaaugaucaucaugcucauccccaccgugauggccuuccaucucaccacacgaaacggggagccccacaugaucgugggcauccaggaaaagggcaagagucuacuuuucaaaaccgaggacggagucaacaugugcacccucauggcgauggaccugggagaacugugcgaggacacgaucaccuauaagugccccuuguugcggcagaacgagcccgaggauaucgacugcuggugcaauagcaccuccaccugggugaccuacgggacuuguaccaccacgggcgagcaccgccgagagaagcggagcgucgcccuggugccgcacguagggaugggacucgaaacacguaccgagacguggauguccagcgagggggccuggaaacacgcgcaacgcauagagaccuggauccugagacacccgggcuuuacgaucauggccgcgauccuggccuacaccauagggaccacccacuuccagcgcgcauuaauuuucauccugcugacggccgucgcgcccuccaugacaaugcgguguauaggcaucucaaaccgcgacuucguggagggcgucuccgggggcuccugggucgacaucgugcucgagcacggguccugcgugacuaccauggccaagaacaagcccacgcuagacuuugaguugaucaagaccgaggcccggcagccggccacccuccgcaaauacugcaucgaggccaaguugaccaacacgaccaccgagagccggugccccacccagggcgagcccuccuugaaggaggagcaggacaaacgcuucguuugcaagcacagcaugguagaucggggcuggggcaacggcugcggucuguucggcaagggcgggaucgugacuugugcgauguucacgugcaagaaaaacauggaaggaaagaucguccagcccgagaaccuggaauacaccaucguggugacgccccacuccggggaggagcacgccguuggcaacgacacggggaagcacggcaaggagaucaaggucacuccgcagagcuccaucaccgaagccgagcugacgggcuacggaaccguaacgauggagugcaguccaagaaccggccucgacuucaacgaaaugguccugcuucagauggagaacaaagcguggcucgugcaccgccagugguuccuggaucugccccuccccuggcugccgggggccgauaagcagggcucuaauuggauccagaaggagacccuggugaccuucaagaacccccacgccaagaagcaggacgucgugguccucgggucgcaggagggcgccaugcauacggcuuuaaccggggccacggagauccagaugagcuccggcaaucugcuguucacuggccaccugaagugccgccuacguauggauaagcuccagcugaaggggaugagcuacuccaugugcacgggaaaauucaaggucgucaaggagaucgccgagacacagcacgggaccaucgucaucagggugcaguacgagggcgacggcagccccuguaagauccccuucgagaucauggauuuagagaagcgguacguccucgggcggcugaucaccgucaauccgaucgugacggagaaggacucccccgugaacaucgaggcugagccucccuucggcgacucauacaucaucauugggguagagcccggccagcuuaaguugaacugguucaaaaagggcuccagcauaggccagauguucgagaccaccaugcguggugccaagcggauggcgauccugggggacaccgccugggacuucggcucccucggcgggguguucacgagcauagggaaggcacuccaucagguguuuggggcgaucuacggggcagccuuuucuggggucuccuggacuaugaaaauccugaucggcguuauuaucaccuggaucgggaugaacagcaggagcaccucacugucugugucccugguccucguggggaucgugacgcuguaccugggggucauggugcaggcagacagcggcugcguggucaguuggaagaacaaggagcucaaguguggcagcgguaucuucaucacggacaacgugcacaccuggacugagcaguauaaauuucagcccgagagcccguccaagcuggcgagcgccauccaaaaggcccaggaagagggcaucugcgggauccgguccgugacucgccuggagaaccucauguggaagcagauaaccccugagcugaaccacaucuuagccgagaaugaggucaagcugaccaucaugaccggcgacaucaaggggaucaugcaggccggcaagaggagccugcgcccgcagcccacggagcugaaguacuccuggaaaaccugggguaaggcgaagaugcucagcaccgagucccauaaccagacauuucucaucgacgggcccgaaacggccgagugcccgaauaccaaucgggccuggaauagccuggagguggaggacuaugguuucggaguuuucaccacgaacaucugguugaagcugaaggagaaacaggacgccuucugugacuccaagcugaugucagcagcgaucaaagacaaccgcgccguccacgccgacaugggcuacuggaucgagagcgcccucaacgauacauggaaaauagagaaggcuagcuucaucgagguuaagaauugucacuggcccaagagccacacucuguggaguaacggcgugcuggaguccgagaugaucauacccaagaaucucgcggggcccguaagccagcacaacuaccggccgggcuaccacacccagaucgccgggcccuggcaccugggcaagcuggagauggacuucgauuucugcgacggcaccaccgugauuguuacggaggacugcggcaaccgcggcccgagcuugaggacgacgaccgccagcgguaagcugauuacggaauggugcugccgcucauguacccuccccccgcuccgguaucgcggcgaggacgggugcugguacggcauggagauccggcccuuaaaagagaaggaggagaaccuggucaacagucuggugacggcugggcacggccagguggacaacuucagcuugggcguccuggggauggcucuuuuccuggaggagaugcugcgcaccagggugggcacgaaacacgccauccuccugguggccguuuccuucgugacccucauuaccggcaacaugagcuucaaggaucucggccgcgucguugugauggugggggccaccaugacggacgacaucggaaugggcgucaccuaccuugcacugcuugcugccuucaaggugcgucccaccuucgcagcugggcuauuacuccgcaaguugaccagcaaggagcugaugaugaccaccauuggcaucgugcugcugagccaaucgacuauccccgaaaccauucuagaacucacggacgcccuggcgcuggggaugaugguucucaagaucguacgcgacauggagaaauaccagcucgccgugacuaucauggccauccugugcguuccaaacgccgugauacuccagaacgccuggaaggucucuugcaccauccuggcaguaguguccguuagcccccugcuccugaccucaagucagcagaagacggacuggauaccgcuugcccucaccaucaagggucugaaccccacugccaucuuccugaccacgcucucccggaccaacaagaaacgcagcuggccgcugaacgaggccaucauggcugugggcaugguuucaauccuagccuccucccuccugaagaacgauauccccaugaccggucccuuagucgcuggcgggcuccugacugugugcuacgugcugacgggccgguccgcagaccuggagcuggagcgugccacagacgugaagugggaggaccaggcggagaucuccgggagcagccccauccuguccauuacaaucagcgaggauggcuccaugagcaucaaaaacgaggaagaggaacagacccucacgauccugauccggaccggccugcucgugaucuccgggcuauucccggugagcauccccaucaccgccgccgccugguacuuaugggaggucaagaagcagcgcgccggcgugcugugggaugugcccagcccgccgccuauggggaaagcggagcuggaggacggcgcauaccggaucaagcagaaggguauccugggcuacucucagaucggggcgggcgucuacaaggagggcaccuuccacaccauguggcacgugacccgcggggccgugcucaugcauaagggcaagcgcauugaacccuccugggccgacgucaaaaaggaccugaucucauacgggggcggauggaaguuggagggggaguggaaggagggcgaggagguccagguucuagcgcuggagccugggaagaacccccgcgccguccagacgaagccgggccuguucaagaccaacaccgggacgaucggugcagugucccuugacuucagccccggcacguccgggucccccauuauugauaaaaaggggaagguggucgggcuauacggcaauggcguggugacccgauccggcgcuuacgucagcgcgaucgcgcagaccgagaaguccauagaggacaacccagagauagaggacgacaucuuccgcaagcggcgccugacgauaauggaccugcaccccggcgccgggaagacuaagcguuacuugcccgccaucgugcgcgaggcuaucaaacggggauugcgcacacugauccucgcaccaacccggguggucgccgccgagauggaggaagcuuuacgcggucugcccauccgauaccagacgcccgccauccgcgcggagcauaccggccgcgagaucguagaccucaugugccacgccaccuucacaaugcggcugcugucgcccgugcgcguuccgaacuacaaccucaucauuauggacgaggcccacuucaccgaccccgccuccaucgccgcgagaggcuacaucagcacccgcguagagaugggggaagccgccgguaucuucaugaccgcuaccccuccuggcagccgggacccguucccgcaguccaacgcccccauaaucgacgaggagcgcgagaucccggagcggaguuggaacucaggccacgagugggugacugacuucaaagggaagaccgucugguucgugccgucaaucaaggccggcaacgacaucgccgccugccugcgcaagaacggcaaaaaggugauccagcugucccggaagaccuucgacagcgaauacguaaagacccgcacgaacgacugggacuuuguggugaccaccgacaucuccgagaugggggccaauuuuaaagcggagcgcgucaucgacccccgucggugcaugaagccagugaucuuaacagauggcgaggagcgcguuauccuggcgggccccaugccggucacgcacagcuccgccgcucaacggcgcggucggaucgggcgcaacccaaagaacgagaacgaccaguauaucuacaugggcgagccccuggagaacgacgaggacugugcacauuggaaggaggcgaagaugcuccuggacaacaucaacaccccugagggaaucauacccagcauguucgagcccgagcgggagaaaguggacgccaucgacggggaguacagacugcgcggcgaggcacggaaaaccuucguagaccucaugcgacgcggagaucugcccgucuggcuggccuacaagguggcggcggaaggcauuaacuacgccgaccgcagguggugcuucgacgguaucaagaacaaccagauccucgaggagaacguggaggucgagaucuggaccaaggagggcgaacgcaagaagcucaagccgcgguggcuggacgcucgcauuuacuccgacccgcucgcccugaaggaguucaaggaguucgccgcaggccggaagucacugacacucaaccugaucaccgagauggggcgucugcccaccuucaugacccaaaagacgcgggacgcccucgacaaccuggcugugcugcauacggccgaggcgggcgggagagccuacaaccacgcccucuccgaguugcccgagacccuggagacguugcugcugcucacgcugcuggccacggucaccggcggcaucuuccuguuucucaugagcgggcgaggcaucgggaagaugacccugggcaugugcugcaucaucaccgcauccauccuccuaugguacgcgcagauccagccccacuggaucgccgcgagcauuauucucgaguucuuucucauaguucugcugauccccgaacccgagaagcagcgcacuccccaggacaaccagcuuaccuacgugguaaucgccaucuugaccgucguggccgccaccauggccaacgagaugggcuuccuagaaaaaacgaagaaggaccucggccucggaaguaucgccacccagcagccggagagcaacauccuggacaucgaccuacggcccgcguccgccuggacccuguacgcggucgcgaccacguucgugacccccaugcuaagacacucuaucgagaacagcuccgucaacgucagucugacugcaaucgccaaucaggccaccgugcuaaugggucuggguaagggguggccacucuccaagauggacaucggcgugccgcugcuggcgaucgggugcuacagccaggucaaccccaucacgcuuaccgccgcccugcuucuccugguggcacacuacgcuaucaucggcccaggccugcaggccaaggccacacgugaggcgcagaagcgggcugcugccgggaucaugaagaaccccacaguggacggcaucacggucaucgaccucgacccgauccccuacgaccccaaguucgagaagcagcucgggcaggugauguuguuaauccugugcguuacucaaguccugaugaugaggaccaccugggcacucugcgaggcccugacucuggccacgggcccgaucuccacccucugggaggggaacccuggcagauucuggaacaccacgauagccgugagcauggccaacaucuuccggggcuccuaccuugccggggccggccuccucuucaguaucaugaaaaacaccaccaacacccgucgaggcacuggaaacaucggcgagacccugggggagaaguggaagucccggcugaacgcccucggcaagagcgaguuucagacauacaaaaaauccgggauccaggagguggaccgcacacuggcgaaggagggcaucaagcgcggggagacggaccaccaugccguaagccgcggcagugcuaaacugcggugguucguggagcgcaacauggugacccccgaggggaaggucguugaccucgggugcggccguggcggguggagcuacuacugcggcggccugaagaacguucgcgaggucaagggacugaccaagggcggccccgggcacgaggagcccaucccgauguccaccuacggcuggaaccucgugcggcugcagagcgggguggacgucuucuucaucccgccagaaaagugugacacgcugcucugcgacaucggcgagucgucgcccaacccgacgguagaggccggccgcacccugcggguguuaaaccuugucgagaacuggcuuaacaacaauacccaguucugcaucaaggugcugaaccccuacaugcccuccgugaucgagaagauggaggcguuacagcgcaaguaugggggcgcacuggugcggaacccgcugucccgcaacuccacccacgagauguacuggguaagcaacgccagcgggaacaucgucagcagcgucaacaugaucucccggaugcugaucaaccgguucacgaugcggcacaagaaggccaccuacgagcccgacguggaccucggcagcgggacccgcaacauuggaauagaguccgagauccccaaccuggacauaaucgguaagcguaucgaaaagaucaaacaagagcaugagaccagcuggcacuacgaccaggaccacccauacaagacgugggccuaccacggguccuaugaaacuaagcagaccggcuccgcguccagcauggugaauggagucgugcgccugcucaccaagccgugggacgugcugcccacggucacccagauggccaugaccgacacgacgcccuucggccagcagcguguauucaaggagaagguggacacccggacccaagagcccaaggaaggcaccaagaaauugaugaagaucaccgccgaauggcuguggaaggaguuggggaagaagaagaccccgcgcaugugcacccgggaagaguucacccgaaaaguccgguccaacgccgcucucggcgcgauuuucacagaugagaauaaguggaaauccgcccgcgaggccguagaggaccggcgcuucugggagcucguggacaaagagcggaaccugcaccuagaggggaagugcgagaccugcgucuacaauaugaugggcaagcgcgaaaagaagcucggggaguucggcaaagcaaagggcucccgcgccaucugguacauguggcuaggcgccagauuccuggaguucgaggccuuaggcuuccugaacgaggaccacugguucagccgggagaacucccugucagguguggagggcgaggggcuccauaagcugggcuacauccugcgcgaugucuccaagaaggagggcggugccauguacgccgaugacaccgcgggcugggacacucggaucacccucgaggauuugaagaacgaagagauggugaccaaccacauggagggggagcacaagaagcuggccgaggcuaucuucaagcucaccuaucaaaacaaggugguccgcgugcaacggcccacgccccggggcacggugauggauaucaucagccggcgggaccaaagggggagcggccagguggguaccuacgggcugaacaccuucacgaauauggaggcccagcugauucgacagauggaaggcgagggaguguucaagaacauccagcaccucacggccaccgaagaaguggccguccagaauuggcuggcacgggugggucgggaacgccuaucccggauggcuaucagcggcgacgacugcguagucaagccccucgacgaucgguucgccaacgcccugaccgcccugaacgacauggggaaaauccggaaggacauucagcagugggagccguccaagggcuggaacgauuggacucaggugcccuucugcagccaucacuuccacgagcucauuaugaaggacggacgcguacuggucguucccugccggaaccaagaugaacuaaucggccgcgcgcggaucucccagggggcaggcuggagccuccgcgaaacggccugccugggcaaguccuacgcccagauguggucacugauguacuuccaccgcagggaucuccggcuugcggccaacgccaucugcuccgccguucccagccacuggguccccaccuccagaaccacguggagcauucacgccaagcacgaguggaugaccacggaagacaugcugaccguauggaaucggguguggauucgagagaaccccuggauggaggacaaaaccccggucgagucuugggaggagauccccuaccuaggaaagcgggaggaccagugguguggcagccugaucgggcugaccucccgcgcgacgugggccaaaaacauacaggccgccaucaaccaggugcggagccugaucgggaacgaggaguacaccgacuacaugccauccaugaagagauuccgccgggaggaggaggaggcggggguacugugguga

SEQ ID NO: 24971 - RNA, 9876 nt, Artificial Sequence
  derived and/or modified CDS sequence (opt11) from DENV-2__FJ639705__SS-prME
uccgcgggcaugauaaucaugcuuauccccacugugauggccuuccaucucaccacccggaauggugagccccacaugaucguggguauccaggagaagggcaagagccugcuguucaaaaccgaggacggggucaacaugugcacccucauggcgauggaccugggggaacugugcgaggacaccaucacuuacaaaugcccccuccugcggcagaacgagcccgaggauaucgacuguuggugcaacaguacaagcaccugggugaccuacgggacauguacaaccacuggcgagcaucggcgggaaaagcggagcgucgcccuggugccgcacguggggaugggucucgagacccguaccgagaccuggauguccagcgagggggccuggaagcacgcccagcggaucgagaccuggauccugcggcauccaggguucacgaucauggccgcgauccuugccuacacgaucgggaccacccauuuccagcgcgcucucaucuucauccugcugacggcggucgcgccguccaugaccaugcggugcaucgguaucagcaacagggacuucguggagggcgucuccggagggaguuggguugacaucguguuagaacacgggucgugcguuaccaccauggccaagaauaagcccacgcuggauuucgagcugaucaagaccgaagcacggcagccugccacccuccgcaaguacugcaucgaggcaaagcugaccaacacgacuacugagagccggugccccacucagggcgagccaucccugaaggaggaacaagacaagcgcuucgucugcaagcacagcaugguggaucggggcugggggaacgggugcgggcuguuuggcaagggcgggauagugacaugugcgauguucacgugcaagaagaacauggagggaaagaucguccagcccgaaaaccuggaauacaccaucguggugacgccccacuccggggaggagcaugccgucggcaacgacaccgggaagcaugguaaggagaucaaggugaccccgcagagcuccaucacugaggccgagcugaccggguacggcacggucacgauggagugcagcccccgcaccggccuagacuucaacgagaugguccugcugcaaauggagaacaaggcauggcuugugcaucggcagugguuccuggaccucccccuccccuggcugccgggggccgacaagcagggauccaacuggauacaaaaggagacccugguuacuuucaagaacccccacgcgaagaaacaggacgucguggugcucggaagccaagagggcgccaugcacacggcccugaccggggccaccgagauccagauguccuccggcaaccuccuguuuaccggacacuuaaagugucgccugcggauggacaaacuucagcugaaggggaugagcuacuccauguguacugguaaguucaaggugguuaaggagauagccgagacccagcacgggaccaucgucauccgagugcaguacgagggcgacggcagccccugcaagauccccuucgagauuauggaccuggagaaacgguacgugcucgggcgccugaucacgguuaacccgaucgugacagagaaggauucccccgugaacaucgaggcggagccacccuucggcgacagcuacaucaucaucgggguugagccgggacagcugaagcucaacugguucaagaagggguccagcaucggucagauguucgagacuaccaugagaggugccaagcggauggcaauucugggggacaccgccugggacuucggcucccucggagggguguucacgagcaucggcaaggcccuccaccagguauucggggcgaucuacggcgcugccuucuccggggucagcuggaccaugaagauccugauuggcguuaucauaaccuggauagggaugaacucccgaagcacaucccugagcguaucccucguccucgugggcauugugacgcuguaccuuggaguaaugguucaggccgauagcggcugcguagucuccuggaagaacaaggaguugaaaugcggcagcgggaucuucaucaccgauaacgugcauaccuggacugagcaguacaaguuccaacccgagucgccauccaagcuggcgagcgcaauccagaaggcccaggaggagggcaucugcgggauccgguccgugacgcgccuggaaaacuugauguggaagcagaucacccccgagcugaaccacauccuggcggagaacgaggucaagcucacaaucaugaccggugacaucaaggguaucaugcaggccggaaagcggagccugaggccgcagcccacggagcugaaguacuccuggaaaaccuggggcaaagcgaagauguugagcaccgagucccacaaccagacguuccuuaucgacgggcccgagacugccgagugcccaaacaccaaccgggccuggaacagccuggaggucgaagacuacgguuucgggguguucaccaccaacauuuggcuaaagcugaaggagaagcaggacgccuucugcgacuccaaguugaugagcgccgcgaucaaggacaaccgugccguccaugccgacaugggcuacuggaucgaguccgccuuaaacgacacuuggaaaaucgagaaagccagcuucauugaggucaagaauugccacuggcccaaaucccacacacuguggagcaacggcguuuuagaauccgagaugaucaucccuaaaaaccucgcggggcccgucagccagcacaacuaucggccuggcuaucacacccagaucgccgggcccuggcaccugggcaagcuggagauggacuucgacuucugcgaugggaccaccguaaucgugacugaggacugcggcaaccgcggccccucccuucggacgaccaccgccagcgggaagcugaucacggaguggugcugccgcagcugcacccuucccccacuccgguaccgcggcgaggacgggugcugguacggcauggagauccggccccugaaggagaaggaggagaaucuggucaacucccucguaaccgccggccacggucagguggacaacuucagcuugggcguccugggaauggcucucuuccuggaggagaugcugcgcacccgcgugggcaccaagcacgccauucuccugguggccguauccuucgugacacugaucaccggcaacaugagcuucaaggaccucggccgcguggucgugauggugggggccaccaugacugacgauaucgggaugggcgucaccuaccuggcacugcucgcggccuuuaaagugcggcccaccuucgccgcgggccugcugcuccgcaagcuaaccuccaaggagcugaugaugacgaccaucggcaucgugcuccugucucagucaaccauccccgagaccaucuuagagcucacagacgcccuggcgcucgggaugaugguacucaagaucgugcgcgacauggagaaauaccagcuggccguuaccaucauggcaauucugugcgucccgaacgcagugauccuccagaacgccuggaaggugucauguacaauccuggcagugguguccguaagcccccugcuccugaccaguagccagcagaagacggacuggaucccacucgcccucaccauaaaaggccugaaccccacugccaucuuccugaccacgcucucccggaccaacaagaagcgcagcuggccacugaacgaggccauaauggcggucggaaugguguccauccuagccagcucccuccugaagaacgauauccccaugacugggccccuagucgccggcgggcuccugacgguuugcuacguucugacgggcagaagugcagaccuagagcuggagcgcgccaccgacgucaaaugggaggaccaggcggagaucucugggagcagccccauccuguccaucaccaucagcgaggacggcuccaugagcaucaagaacgaggaagaggagcagacccucacgauucugauccggaccgggcugcucgugaucuccggacuauuucccguguccauccccaucaccgcagccgcuugguaccugugggaggucaagaagcagcgcgccggcguccucugggacgugccgagcccgccgcccauggggaaggcggaacuggaggacggcgccuaccguaucaagcagaagggcauccuaggcuacagccagaucggcgccggggucuacaaggagggcaccuuccacaccauguggcaugucacccgcggggccgugcucaugcauaagggcaaacggauagagccuaguugggcagacgucaagaaggaucugaucagcuaugggggcggcuggaagcuggagggggaauggaaggagggcgaagagguccaagugcucgcgcuggagcccgggaaaaacccacgcgccguccaaacaaagcccggucuguucaagaccaacaccgggacgaucggcgcggucucccucgacuucagucccggcaccuccgggucucccaucaucgauaagaaggggaagguggucgggcuguauggcaaugguguggugacccgguccggggccuacgucagcgccaucgcgcagaccgagaaauccaucgaggacaaccccgagaucgaagacgacauuuuccgcaagcggcgccugacuauuauggaccugcaccccggcgcggggaagaccaagcgcuaccuccccgcuaucguacgagaggcaauaaagcggggccugcgcacauugauuuuagcgccgacucgggugguggccgccgagauggaggaggcccugcgcgggcugcccauacgguaccagacgcccgccauaagagcugagcacaccggccgcgagaucguggauuugaugugccacgcuacguucaccaugcggcuccugagccccguccgcgucccgaacuacaaccucauuaucauggacgaggcccacuuuacggaccccgccuccaucgcggcucggggcuacaucucaacccguguggaaaugggggaggccgccggcauuuucaugaccgccacgccucccgggagccgugacccuuuuccucaauccaacgcccccaucauagacgaggagcgggaaaucccugaacggagcuggaauagcggccacgaaugggugacggacuucaaagggaagaccgucugguucgugccgagcaucaaggcgggcaacgacauugcggccugccugcgcaaaaacggcaagaaggugauccaauuaagccgcaagaccuucgacagcgaguacgucaagacccgcacgaacgacugggacuucgugguuaccaccgacaucucggaaaugggcgccaauuucaaggccgagcgggucaucgaccccagaaggugcaugaagcccgugauccucaccgacggggaggaacgcgugauccuggcugggcccaugccggucacucauucuuccgccgcccagcggcggggccgaaucggucgcaaccccaagaacgagaacgaccaguacaucuacaugggcgaaccccuggagaacgacgaggacugcgcccacuggaaggaagcgaaaauguugcucgacaacauaaacacccccgaggggaucaucccgagcauguuugaaccagagcgggagaagguagacgccaucgacggggaguaccgccuccgaggcgaggcccggaagaccuucguggaccucaugcgcagaggggaucuacccgucuggcuagccuacaagguggcugcggagggcaucaacuaugccgaccgccggugguguuucgacgggauaaagaacaaccagauacucgaggaaaacguggaaguagagaucuggaccaaggagggcgagcgcaagaagcugaagccucgcuggcuggacgcccgcaucuauuccgacccccucgcgcugaaggaguucaaagaguucgccgcgggacguaagucccuaacgcucaaccuaaucaccgagauggggcgccugccgaccuucaugacccagaagacgcgggacgcgcuagacaaccuggcugugcugcacaccgcugaggcgggcgggcgcgccuacaaccacgcucucucugagcugcccgagacccucgaaacccuccugcugcuaacguuacuggccacaguaaccggcggaauauuccucuuccugaugagcgggcggggcaucgggaagaugacccuggggaugugcugcauuaucaccgcguccauccuccugugguacgcgcaaauccagccgcacuggaucgccgccucgaucauccuggaguuuuuccugauugugcugcugauccccgagcccgagaagcagcgcacgccccaagacaaccagcucaccuacgugguaaucgccauccugacagugguggccgcgaccauggccaaugagaugggauucuuagaaaagacgaagaaggaccucggucugggauccaucgccacgcagcaaccggagagcaacauacuggauaucgaccuccggccagccagugccuggacccuguacgcggucgccaccacguucgugaccccuaugcuacgccacucaaucgagaacagcuccgucaacgucagccucaccgccaucgccaaccaggccaccgugcugauggggcugggcaagggguggccccucuccaagauggauaucggcgugccucugcuggcgaucggcuguuacagccaggucaaucccauuacgcucaccgccgcccugcugucccucguggcacauuaugcgaucauaggucccggccuacaagccaaggccacccgugaagcccagaaacgggccgcggccggcauaaugaagaaccccaccguggauggcaucacggucauagaccuggauccgauccccuacgaccccaaguucgagaagcaguugggccaggugaugcuguugauucucugcgugacacagguacugaugaugcggaccaccugggcgcugugcgaagcccucacucuugcaaccggccccaucagcacccugugggaggggaacccuggccgcuuuuggaacaccacgauugccguguccauggccaacaucuuccggggcagcuaucucgcgggggcgggccugcuguucucgauuaugaaaaacaccacgaacacccggcgugggacgggaaacauuggcgagacccucggggagaaauggaagucccggcugaacgcccucggcaaguccgaguuucagaccuauaaaaaguccgggauccaggaagucgaucgcacccucgcgaaggagggcaucaagcgcggggagacggaccaccaugccgucuccaggggauccgccaagcuacggugguucguggagcgcaacauggugacccccgagggcaaggugguggaccuggggugcggucgaggagggugguccuacuacugcgguggccucaagaacguccgcgaggucaaagggcuuaccaagggcggacccggucaugaggagccgaucccgaugagcaccuacggcuggaaucuggugcggcuccaguccgggguggacgucuuuuucaucccgcccgagaagugcgauacgcugcuuugugacaucggcgagucgucacccaauccgaccguggaggccggccggacccuccgcguccugaaccuggucgagaacuggcucaacaacaacacacaguuuugcaucaagguacugaaccccuacaugcccagcguaaucgagaagauggaggcgcugcagcgcaaguacgggggcgcccugguccggaauccccucagcagaaauuccacccacgagauguauugggugagcaacgccagugggaacaucguaagcuccgucaacaugaucagccggaugcucaucaaucgcuucacaaugcggcacaagaaggccaccuacgagccagacguggaccuggguuccgggacccgcaacaucggcaucgagagcgagauccccaaccucgacauaaucgguaaacggaucgaaaagaucaagcaggaacaugagaccuccuggcacuacgaccaggaccaucccuacaagacgugggccuaccacgggagcuaugagaccaagcagacaggcuccgcaagcucuauggugaacggggucgugcgccuguuaaccaagccgugggacgugcuccccacggucacccagauggccaugaccgacaccacgcccuucggccagcagcgcguguuuaaggagaaaguggacacccgaacccaagagccaaaggaaggcaccaagaaacugaugaaaaucacggccgaguggcuguggaaggagcucgggaagaagaagaccccgcgcaugugcacccgggaggaguucacccgcaaggucagaagcaacgcugcccugggugcgaucuucacggacgaaaacaaguggaaguccgcccgcgaggccguggaggacagccguuucugggagcugguugauaaggaacgcaaccuccaccuagagggcaagugugaaacuugcgucuauaacaugaugggcaaacgugagaagaaacugggggaguucggcaaggccaaaggaucccgcgccaucugguacauguggcuuggggcgcgcuuccuggaguucgaagcccuaggauuccucaacgaggaccacugguucagccgcgagaacucccuguccggggucgagggggagggacuccacaagcucggauacauccugcgggacgucagcaagaaggagggcggggccauguacgccgacgacacugcgggaugggacaccaggaucacgcuggaggaccucaaaaacgaagagauggugaccaaccacauggagggggagcacaagaagcuggcagaggccauuuucaaguugaccuaccaaaacaaagugguccggguccaacgccccacgccccggggcacggugauggacauaaucucaaggcgggaucagcgcgggagcggccaaguuggcaccuacggacugaauaccuucaccaacauggaggcccagcuaauacggcagauggagggcgaggggguauucaagaacauccagcaccugacggcaaccgaggagguggcaguccagaacuggcucgcucgcgugggccgcgagcggcuaucccgcauggccauaucgggcgacgacugugugguaaagccccuugacgaucgguucgccaacgcccucaccgcgcugaacgacauggggaagauucgcaaggacauucagcaaugggagccgagcaaaggcuggaacgacuggacccaggugcccuucugcagccaccacuuccacgagcuaaucaugaaggaugggcgcguucucgucgugccgugccgcaaccaggacgagcugauaggccgggcucgcaucucucagggggccggcuggagccugagggagacggccugucucggcaaguccuacgcccagauguggagcuugauguacuuccaccgacgggaccuaaggcuggcggccaacgccaucugcuccgccgugccuagccacugggucccgaccucccggacgacguggagcauccacgcgaagcaugaguggaugaccacggaggacaugcugaccguguggaaccgcguguggaucagggagaaucccuggauggaggauaagacccccgucgaguccugggaggagauccccuaccucgguaagcgggaggaccaauggugcgggucccucaucggguuaaccucccgugcgacgugggccaagaacauccaggccgccaucaaccaggugcgcucccugaucggcaacgaggaguauacugacuauaugccgagcaugaagcgguuccgccgcgaggaagaggaagcuggaguccucugguga

SEQ ID NO: 24972 - RNA, 9876 nt, Artificial Sequence
  derived and/or modified CDS sequence (opt11) from DENV-2__FJ639706__SS-prME
agugccgggaugaucauuauguuaauccccaccgugauggccuuccaccucaccacucggaacggggaaccccacaugaucgucggaauacaggagaaagggaagucccuccuguucaagaccgaagacggcgugaauauguguacacucauggcaauggaccugggggagcugugcgaggacaccauuaccuacaaaugcccucuccugcggcagaacgaacccgaggacaucgacugcuggugcaacagcacguccaccuggguaacguacggcaccugcacgacgaccggcgagcaccgaagagagaagcgcagcgucgcccuugugccccaugucgggaugggccucgaaacccgaacagagaccuggauguccagcgagggcgccuggaagcacgcacagcgaaucgagaccuggauccugcggcauccgggcuucacuaucauggccgcgaucuuggccuacaccauugggacaacccacuuccagagggcccugaucuucaucuuacuuacggcugucgcgccauccaugaccaugcguugcaucggcaucaguaacagggacuucgucgagggcguaagugggggcagcugggucgacauagugcucgagcacggguccugcgugacuacgauggccaagaacaagcccacgcuggacuucgaguuaaucaagaccgaggcgaagcagccugccacccuccggaaguauugcauugaggccaagcugaccaauacgaccacggagagccgcugccccacgcagggcgagcccucccuaaaggaggagcaggacaagcgguucgucugcaagcacaguaugguggaccgcggaugggggaaugggugcgggcuguucggcaagggcgggauagugacgugcgccauguucacuugcaagaagaacauggagggaaagauuguccagccggagaauuuagaguacaccaucguaguuacgccccacuccggggaggagcaugccgucggcaaugacacggggaagcacggcaaggaaaucaaggugaccccgcagagcaguaucaccgaggcagaacugaccggguacggcaccgugacgauggagugcuccccacggaccggccucgacuucaacgaaauggugcugcugcagauggagaauaaggccuggcuugugcaccgccagugguuccuggaccugccucuccccuggcucccgggggccgacaaacaggguuccaacuggauccaaaaggagacccuggugacauucaagaacccgcacgcgaagaagcaggacguagugguauuggggagccaagagggagccaugcacacggcgcuuaccggggccaccgaaauacagaugagcagugguaaccuacuguucaccggacaccugaaaugccggcugagaauggauaagcuccaauuaaaggggaugagcuauuccaugugcacuggcaaguuuaaaguggucaaggagaucgccgagacccaacaugggaccaucgucauccgggugcaguacgagggcgauggcagccccugcaagauccccuucgaaaucauggaccuggaaaagcguuacguacucgggagacugaucaccgucaaccccaucgucacggagaaggacuccccggugaacaucgaggcggagccgcccuuuggugacagcuacaucaucaucgggguugagcccggccagcugaagcucaacugguuuaaaaagggguccagcauaggccagauguucgagaccaccaugcgcggcgccaaacgcauggccauccugggggacacagccugggacuucggaucccucggugggguguucacgagcaucgggaaagcccuccaccagguguucggugcuaucuacggugccgcuuucagcggggucagcuggaccaugaagauccugaucggcgugaucaucacauggaucgguaugaacagcaggucuaccucucuaucugugucucuaguccuagugggcaucgugacacuguaccuaggagucauggugcaggccgacagcggcugcguugucagcuggaagaacaaggagcucaaaugcggcagcgggaucuucaucaccgacaacgugcacaccuggaccgagcaauacaaguuccagccagaaagccccuccaagcuggcgagcgccauccagaaggcgcaagaggagggcaucugcgggauacgcagcgucacgcggcuggagaaucucauguggaaacagaucaccccugagcuaaaucacauccuggccgagaaugaaguaaagcugaccaucaugaccggcgacauuaaagggaucaugcaggcaggcaagcgcagccugcggccgcaacccacugagcuuaaguauuccuggaagaccuggggcaaggcgaagaugcucagcaccgaaagccacaaccagacauuccugaucgaugggccugagacugccgagugcccgaacacgaaccgcgccuggaacagccuagagguggaggauuacggcuucgggguuuucaccaccaacaucugguugaagcugaaagaaaagcaggacgccuucugcgauuccaaauuaaugagcgccgcgaucaaggauaaucgcgccguccacgcugacaugggcuacuggaucgagucugcccucaacgacacguggaaaauugagaaggcaagcuucaucgagguuaagaacugccacuggccuaagucccauacccuuuggaguaacggggugcuagagucggagaugaucaucccaaaaaaccucgcggggcccgucagccagcacaacuaccgcccagguuaccacacucagauagccgggcccuggcaccugggcaagcuggagauggauuucgacuucugcgacgguaccaccgugaucguuacggaggacugcgggaaccggggccccucccugcgcacaaccaccgccagcgggaagcuuaucacugagugguguugccgaagcugcacccugccgccgcuccgcuaucggggcgaggacggauguugguacggaauggaaauccgcccacuuaaggaaaaggaggaaaaccuagucaacucccucgugacggccgggcacggucaggucgacaauuuuagccugggcgugcucgggauggcccuguuccuggaggagaugcugcggacacgcguaggcacaaagcacgcgauccuccucgucgccgucucguucgugaccuugauuaccggcaacauguccuucaaggaccugggccgggugguuguaauggugggggcaaccaugaccgacgacaucgggaugggcgucaccuaccuggcccugcuugccgccuucaaagugcgccccaccuucgcggccgggcuccugcugaggaagcugaccuccaaggagcugaugaugacaaccaucggcaucgcccucuuaagccaaaguacaaucccggaaacuauccuggaacucacggacgcgcuugccuuggggaugauggugcucaagaucgugcgcgacauggagaaauaccagcucgccgugacgauuauggccauccugugcgugccgaacgccgucaucuugcagaacgcguggaaggugagcugcaccauccuagccgucgucagcgugagcccgcugcucuugaccaguagccagcagaagacugacuggaucccccuggcccucacaauuaagggguuaaaucccaccgccaucuuccugaccacgcucucccgaaccaauaaaaagagaagcuggccgcugaacgaagcgaucauggccgucgggaugguguccauacuugccagcucccuucugaagaaugacaucccuaugacugguccacugguggcuggcggccuacugaccgucugcuacgugcugacagggcgcagcgcagacuuggagcuggaacgugccaccgacgugaaaugggaggaccaggccgagaucuccgggucgagccccauacuguccaucaccauaagcgaggacggcuccaugagcauuaagaaugaggaggaggaacagacccucacgauacugauucgcacuggccuguuagucauauccgggcuguuuccggugagcauccccaucacagccgccgcaugguaccuaugggagguuaagaaacagcgggcgggugucuuaugggacguucccagcccgccgcccauggggaaggccgagcuugaggauggcgccuaccgcaucaagcagaagggaauccugggcuacagccagaucggcgccggggucuacaaggaggggacguuccacaccauguggcacgucacucgcggggcgguguugaugcauaaggggaaacgcauugaacccuccugggccgaugugaagaaggaccugaucucguacgggggcggcuggaagcuggagggggaguggaaagagggcgaggagguccaggugcucgcccuggaacccgggaaaaacccccgggccgugcagaccaagcccgggcuguucaagaccaauacggggacaauaggcgccgugucccucgacuucagccccggcacguccgggagcccaaucaucgacaagaaggguaaggucguggggcuguauggcaacggcgucgugaccaggucuggggccuacguguccgcgauagcccaaaccgagaaguccaucgaggacaaccccgagaucgaggacgauauuuuucggaagcgccgacugacaauaauggaccuccaccccggcgccggcaagaccaaacgguaucuccccgcuauuguacgggaggcgauaaaacgcggccuccggacccugauccucgccccgacccgcguaguggccgcagagauggaagaggcacugcgagggcuccccauacguuaucagacgcccgcaaucagggccgagcacaccggccgcgagaucguugaccuaaugugccacgccaccuucaccaugcgucugcugagcccggugcgaguuccgaacuacaaccucaucaucauggacgaggcccacuucacggaucccgccuccaucgcggcccgcggcuacaucagcacacgggucgagaugggggaagccgccggcaucuucaugacagccacgccgcccgguucucgcgauccguuuccccaguccaacgcucccaucauagacgaggagcgggagauuccugagcgcagcuggaacuccggccacgaaugggugacugacuucaaggggaagacagugugguuugucccgucaaucaaagccggcaacgacauagccgcuugccugcggaagaauggcaagaaggugauccaguugucccgcaaaacguucgauagcgaguauguaaaaacccggacgaacgacugggacuucgucgugaccaccgauauuucagagaugggagcgaacuucaaggccgagcgcguaaucgacccccggcgcugcaugaagccagucaucuugaccgacggcgaggagcggguuauccuggcaggccccaugccggugacgcacagcuccgccgcacagagaagagggcgcaucgggcgaaaccccaagaacgagaacgaccaauacaucuauaugggagagccgcuugagaacgaugaggacugugcgcacuggaaggaggcgaaaaugcuccuggacaauaucaauaccccagaaggcaucaucccgagcauguucgaacccgagcgcgagaagguugacgccaucgacggggaguaccgguugcgcggcgaggcacgcaaaaccuucguagaccucaugcggcgcggggaccugcccguguggcuggccuauaaggucgcggcugaagguaucaacuacgccgaccggcgcuggugcuucgacgggaucaagaauaaccagauuuuggaggagaacguggagguggagaucuggacgaaagagggcgagcgaaagaagcugaaaccgcgguggcucgacgcacggaucuacuccgacccccucgcccugaaagaguucaaggaauucgcggccggaagaaaaagccugacgcucaaccugaucacugagauggggagacuccccaccuucaugacccagaaaacgcgcgacgcgcucgacaaccuggccgucuuacacacggcugaggcaggcggucgggccuacaaccacgcgcuguccgagcugcccgaaacccuagagacccuccuacuccucacguuguuagccaccgugaccggcggcaucuuccuauucuugaugagcgggcgcggaaucgggaaaaugacacugggcaugugcugcaucaucaccgcguccauucuccugugguacgcccagauccagccgcacuggaucgcggccagcauuauccucgaguucuuccuuaucguccugcugauccccgagcccgagaagcagcggacgccccaggacaaccaguuaaccuacguggugauugccauccugacagucguugcggcuaccauggccaaugagaugggcuuccucgagaagacgaagaaggaccucggauuaggcuccaucgcaacacagcagccggaguccaacauccuggacaucgaccuacgccccgccuccgccuggacccuguacgccguggcgaccacguucgucaccccaaugcuccgacacucgaucgagaacagcuccgugaacgugagccucaccgcuauugccaaccaggcgaccguacugauggguuugggaaagggguggccccucucgaagauggacaucggcgugccauuacuggccauagggugcuacagccaggugaaccccaucacgcucaccgccgcccugcugcuccuaguggcgcauuaugccaucauuggccccggucuucaggccaaggccacucgcgaggcgcagaagcgugcagccgcaggcaucaugaagaaccccaccguugacggcaucaccgugaucgaccucgauccgauucccuacgaucccaaauucgaaaaacaguuaggucaggugaugcuguugauccugugcgugacgcaggugcugaugaugcgcacuaccugggcguuaugcgaagcccugacgcuggcaaccgggcccaucuccacccuuugggaggggaauccggggcgauucuggaacaccaccaucgccgucagcauggcaaacauauuucgcgguuccuaccucgccggcgccggccuccuauuuagcaucaugaagaacacuacaaacacccggcgcgggacuggcaacaucggcgagacccugggggagaaguggaaaucccgacugaaugcccucggcaaguccgaguuucagaccuacaagaagucuggaauccaggaaguagaccguacccuggccaaagagggaaucaagcgcggggagacggaccaccacgcuguuucgcguggauccgccaaguugcgcugguucguugaacguaacaugguuacuccugagggcaaggugguugaccucgggugcggccgcgggggcuggagcuauuacugcgggggccugaagaacgugcgggaggucaagggccugaccaaggggggccccgggcaugaggagcccaucccgaugaguaccuacggcuggaaccucguccgccugcagagcgggguugacguguuuuucaucccucccgagaagugcgacacgcugcuaugcgacaucggcgagucuuccccgaacccgacagucgaggcgggccggaccuugcgcgugcugaaccucguggagaacuggcugaacaacaacacucaguucugcauaaagguccugaaccccuacaugcccuccgugaucgagaagauggaggcucugcagcggaaauaugggggcgcccucgugcgcaacccgcugagccggaacagcacccacgagauguacugggucucgaacgccucugggaacaucguuuccagcgugaacaugaucucucgcaugcugaucaaccgguucacgaugaggcacaagaaagccaccuaugaacccgacgucgaucucggcagugggacccggaacauaggcaucgaguccgaaauccccaaccuagacaucaucggcaagcgcaucgagaaaaucaagcaggagcacgagaccucguggcauuacgaccaagaccaccccuacaagacgugggcauaccauggguccuaugagacuaagcagaccggcagcgccuccagcauggugaauggggucgucagacugcucacuaagccgugggacgugcucccaacggucacacagauggccaugaccgacacuacucccuucggccagcagcgcgucuucaaggagaaaguugacacccggacccaggagccaaaagaaggcaccaagaagcugaugaaaaucacagccgaauggcuauggaaggagcuggggaagaaaaagaccccgcggaugugcaccagagaggaguucacccggaaagugcgcagcaaugccgcgcugggcgcaaucuucacggacgagaacaaguggaaguccgcccgggaggccgucgaggauucccgcuucugggagcucguggacaaggagcgaaaccugcaccuggaggggaagugcgaaaccugcguauacaauaugaugggcaagcgcgagaagaagcucggggaguucggcaaagcaaaggggagcagggcgaucugguacauguggcugggggcucgcuuccucgaguucgaggcccucggcuuccugaacgaggaccacugguucagccgggaaaauagccuuuccggggucgagggcgaggggcuccacaagcugggcuacauccugcgcgacguuaguaagaaggaggggggggccauguaugcggacgauaccgccggcugggacacccguaucacgcuagaggaccugaagaacgaggaaauggucacuaaccauauggagggggagcacaagaaguuggccgaagccaucuucaagcucacauaccagaacaaggucgugcgcgugcagcggcccacgccgcguggcacgguaauggauaucaucucgcggaaggaccagagaggauccggacagguugggacauacggacugaacacauucaccaauauggaggcccagcuuauccggcaaauggagggcgaagggguuuucaaaaacauccagcacuugacggcgaccgaggagguggccgugcagaacuggcuggcucgugucggccgggagcgccugagccgcauggccauauccggcgacgacugcguggugaagcccuuagacgaccgguuugccaaugcgcugacugcucugaacgauauggggaagauacgcaaggacauccagcagugggaaccgagcaaagguuggaacgacuggacucaaguccccuucuguucccaccacuuccacgagcucaucaugaaggacgggcgggugcuggugguacccugccgcaaccaggacgaguuaaucgggcgggcccgcauaagucagggugccggcuggucccuuagggagacggccugccugggcaagagcuacgcgcagauguggucccugauguacuuccaccgccgggaucuucgacuggcugcgaacgccaucugcagcgccguccccucccauuggguaccgaccagccguacgaccuggagcauccaugcgaagcacgaguggaugacgacggaagauaugcugaccguguggaaucgcguauggauccgagagaacccuuggauggaggauaagacccccguggaaagcugggaggagauucccuaucuuggcaaacgcgaggaccagugguguggguccuugaucggucugaccagcagagccacuugggccaagaacauacaggccgccaucaaccaggugcgcuccuuaaucggcaacgaagaguacaccgacuacaugcccaguaugaagcgguuucgacgugaggaagaggaagcuggaguccugugguga

SEQ ID NO: 24973 - RNA, 9876 nt, Artificial Sequence
  derived and/or modified CDS sequence (opt11) from DENV-2__FJ639707__SS-prME
ucggcggggaugaucaucaugcuuauccccaccgugauggccuuccaccucaccacccgcaacggggagccccacaugaucgucgggauccaggagaaggggaagucccugcuuuucaagaccgaggacggcgugaacaugugcacccuaauggcgauggaccuuggggaacugugcgaggacaccaucacguacaagugcccccuccugcggcagaaugagcccgaggacaucgacugcuggugcaacagcaccucaaccugggugaccuacggaaccugcaccacuaccggcgagcaucgccgugagaagcgcagcgucgcccugguaccccacgugggaaugggccucgagacacggaccgagaccuggaugucaagcgagggggccuggaagcacgcccagcgcaucgagacuuggauccuucgccacccgggcuucacgaucauggccgcgauccuggccuacaccaucgggacgacccacuuccaacgcguccugaucuucauccugcugacagccguggcgccuuccaugaccaugcggugcaucgguaucagcaaucgcgauuucguggagggcgucuccgggggcagcuggguggacauugugcucgagcacggguccugcgucaccaccauggcgaagaauaaacccacgcuggauuucgagcugaucaagaccgaggccaagcagcccgcaacccuccggaaguacugcaucgaagccaaacugaccaacacgacuaccgagucccgcugccccacccagggcgaacccucacugaaggaggagcaggacaagcgguuugugugcaagcacagcaugguggaccgcggcuggggcaacggcugcggccuguuuggcaagggcggcaucgucacgugcgccauguucacgugcaagaaaaacauggagggcaagauuguccagcccgagaaccuggaauacaccaucgugguuaccccccacuccggggaagagcacgccgucggcaacgacacggggaagcacggcaaggagaucaaggugaccccgcagagcuccaucacggaagcugaacugaccggguacggcaccgucacgauggaaugcagcccgcggaccggacucgacuucaacgagaugguguuacugcagauggaaaacaaggccuggcucgugcaccgccagugguuccuggaccuuccccuccccuggcugccgggcgccgacaagcaagaguccaacuggauacagaaggagacccuggugaccuucaaaaacccccacgccaagaagcaggacguggucguacucggcagccaggagggagcgaugcacacggcccugaccggggccaccgagauccagaugagcuccgggaaccuccuuuucaccggacaccucaagugccggcugagaauggacaagcuccagcugaagggcaugagcuacuccauguguacuggaaaguucaagguagucaaagagaucgccgagacgcagcacggcaccaucgugauucgggugcaguacgagggggacggcagccccugcaagauccccuuugagaucauggaccuggagaagcgcuacauauugggccgguugaucacugucaacccgaucgugacggaaaaggacucccccgugaacaucgaggccgagccgccuuuuggggacagcuacaucaucaucggcgucgagccggggcagcugaagcucaacugguuuaagaaagguuccagcaucgggcagauguucgagaccaccaugcgcggcgccaagcgcauggccauucugggcgacaccgccugggauuucgggucccugggcgggguguucacgagcaucggcaaggcccuccaccagguauucggggcuaucuacggcgcggccuucuccggcgucagcuggaccaugaagauccugaucggggugaucaucaccuggaucggcaugaacucccguagcaccucccugagcgugucccuaguucucgucgggaucgugacgcuguaccugggcgucaugguucaggccgacagcgggugcguggucucauggaagaacaaagagcucaaaugcggcucaggaaucuucaucaccgacaacguacacaccuggaccgagcaguacaaguuccagcccgaaagccccucgaagcuggccagcgcgauccagaaggcccaggaggagggaaucugcggcaucagauccgugacgcgacuggagaaucucauguggaagcagaucacccccgagcuuaaccauauccuggccgagaacgaggucaaguugaccaucaugaccggggauaucaagggcaucaugcaggccgggaagcggagcuuaagaccgcagcccacugagcugaaguacuccuggaagaccuggggcaaggccaagaugcucaguacggaguccuauaaccagaccuuccugaucgacggccccgaaacgaccgagugccccaacaccaaucgcgcguggaacagccuggagguggaggacuacggguucggcguguucaccacgaacauauggcucaagcugaaagaaaagcaggacgccuucugcgacuccaagcugaugagcgccgccauaaaggacaaccgugccguucaugcggacaugggguacuggauagaguccgcccucaacgacaccuggaagaucgagaaggccagcuucaucgaggugaagaacugccacuggcccaagucucacacccuguggagcaacggcgugcuggaguccgagaugauuauccccaagaaccucgccggcccggucagucagcacaacuaucgccccggguaccacacccagaucgccggccccuggcaccuggggaaguuagagauggacuucgacuucugcgacggcaccaccgugaucgugaccgaggacugcgggaaccgggggcccucccuccgcaccaccacggcgagcggcaagcugaucaccgaaugguguugccggagcugcacacugcccccgcugcgcuaucgcggggaggacggcugcugguaugggauggagauccgcccccucaaggagaaggaggagaaucuggucaacuccuuggugaccgccggccacggccagguugacaauuucagccugggcguccugggcauggcccucuuccuggaggagaugcuccgcacgcgcguggggaccaagcaugccauccuccugguagcggucuccuuuaugacccugaucacaggaaacaugagcuucaaggacuuggggcgggugguggucauggugggcgccacgauggccgacgacaucgggaugggcgugaccuaccuggcccuacucgccgcguuuaagguccgccccaccuucgccgccggccugcugcuccggaagcugacuuccaaggagcugaugaugacgaccaucgguaucguguuguuaucgcaguccaccauccccgaaaccgugcuagagcucacggacgcccuggcacugggcaugaugguucucaagaucgugcggaauauggagaaguaccaacuggcggugacuaucauggcgauacugugcgucccgaacgcagugauccugcaaaacgccuggaaagucagcugcaccauccuggcagugguguccgucagcccuuuacucuugaccuccagccagcagaagacggacuggaucccccuggcgcucaccaucaaggggcugaaccccacugcgaucuuccugaccacgcucucccgcacgaacaagaagcgcagcuggccgcugaacgaggcaaucauggccgugggcaugguauccaucuuagcgagcucccuccucaaaaacgacauccccaugaccggcccccuggccgccgggggccuucugaccgucugcuacguguugacggggcgcagcgccgacuuggagcuggagcgggccaccgacgugaagugggaggaccaggcggagaucuccggcucgagccccaucuuguccaucaccaucagcgaagacggguccaugagcaucaagaacgaagaggaggagcagacccucacgauccugauucgcaccggucugcucguaaucucgggccucuucccgauaaguauccccaucaccgccgcagccugguaccugugggagguaaagaagcaacgcgccgggguucugugggacguccccagcccgccucccaugggcaaggcggagcuggaggacggggccuaccgcaucaagcaaaagggcauacugggguacagccagaucggggccggcguauacaaggagggcaccuuccacaccauguggcacgugacgcggggcgcuguccuuaugcacaaggggaagcgcaucgagcccaguugggccgacguuaagaaagaccugauuagcuacggcgggggcuggaagcuggagggcgaguggaaggagggggaggaggugcagguccucgcguuggagcccggcaagaauccccgagccgugcagaccaagcccggguuguucaagaccaacaccggcaccaucggggccguuucccucgacuucagccccggcaccagcggcagccccauaaucgacaagaagggcaaggucgugggccuguacggcaacggcguggucacccgcuccggcgccuacgugagcgccaucgcacagaccgagaaguccaucgaggacaaccccgagaucgaggacgacaucuuccgaaagcgccgguuaacgaucauggaucugcaccccggggccggcaagaccaagcgguacuugcccgccaucgugcgggaggccaucaagcgcgggcugcguaccuugaucuuggcgccgacccgcguaguagccgccgagauggaggaggcccugcggggacugcccauccgcuaccagacgccggccaucagagcagagcacaccgggcgggagaucguggaccucaugugucacgccaccuucaccaugcgccugcugagccccguccgggugccgaacuauaaccugauuaucauggacgaggcccacuucacggaccccgccuccaucgcugcgcgcgguuacaucucuacccggguggaaaugggcgaggcggccgggaucuucaugaccgcgacgccgcccggcagccgcgacccguucccccaaucgaacgcccccaucaucgacgaggagagggagauccccgagagaagcuggaacuccggucacgagugggucacugacuucaagggcaaaaccgugugguucgugccgagcaucaaggcggggaacgacaucgccgccugucuucggaagaaugguaagaaggucauccaacugucccgcaagaccuucgacuccgaguacgccaagacccggacgaacgacugggacuucguggugaccaccgacaucuccgagaugggcgcgaauuucaaagccgagcgcgucaucgacccccggagaugcaugaagcccgugauccucaccgacggggaggagcgggugauucuggcgggccccaugccggucacccacagcagugccgcccaacgucgggggcgcaucggcagaaaccccaagaacgagaacgaccaguacauauacaugggggagccccuggagaacgacgaggacugcgcgcacuggaaggaggccaagaugcuucuggacaacaucaacacacccgagggcauuaucccgagcauguucgagcccgagcgcgagaaggucgacgccaucgacggcgaguaucggcuccgcggggaggcccgcaagaccuucguggaccucaugcggaggggcgaucugcccguuuggcuggccuacaagguggcggccgaggggaucaauuacgcggaccggcgcugguguuucgacggaaucaaaaacaaucagauacucgaggagaacguggaggucgagaucuggacaaaggagggggagcggaagaaacugaagccgcgcuggcuggacucccggaucuacagcgacccccucgcgcugaaggaguucaaggaauucgccgccggccgcaagagucucacgcucaaccugaucaccgagaugggccggcuccccaccuucaugacccagaagacgcgcgacgcccucgacaaccucgccgugcugcacaccgccgaagccggcgggcgggcguacaaucacgcccucagcgagcuucccgaaacccuggagacccuacugcugcucacgcuguuagccaccgugaccgggggcaucuuccucuuccugaugucuggccgcgggaucggcaagaugacccuggggaugugcugcaucaucacggccuccauccuccugugguacgcgcagauccaaccucacuggaucgccgcuagcaucauccucgaguucuucuuaauuguccugcugauccccgagcccgagaagcaacggacgccccaggacaaccagcucaccuacguagugaucgccauccugaccgugguggcagcgaccauggccaacgagaugggcuuccucgagaagacaaaaaaggaccucgggcugggcagcaucgcuacccagcagccugagucaaacauccuggacaucgaccuccgccccgccagcgccuggacccuauaugcggucgccacaacguucgugacgcccaugcugcggcacagcaucgagaacucgagcgugaacgucucccucacggcgauugccaaccaggccacagugcuggugggccuggggaagggcuggccucucagcaagauggacaucggggucccgcugcuggcgaucggcugcuacucccaggugaaccccaucacgcucaccgccgcccugcugcuccuaguagcccacuacgcgaucaucggacccggcuugcaggccaaggccacccgagaggcccagaaacgggccgcggccggcaucaugaagaaccccacugucgacggcaucacggugaucgaccucgacccgauccccuacgaccccaaauuugagaagcagcugggccaggugaugcugcuaauacugugcgucacccagguccugaugaugcgcaccacuugggcccuaugcgaggcccugacucuggccacuggacccaucagcacccucugggagggcaacccggggcgguucuggaacacuacgaucgcggugucuauggccaacaucuuucgcggcagcuaccuggccggcgccgggcuacucuucuccaucaugaagaauaccacaaacacccggaggggcacggguaacauuggcgaaaccuugggagaaaaguggaagucccgccugaacgcccucgggaaguccgaauuccagaucuacaagaaguccggcauccaggaggucgaccggacccuggcgaaagaggggaucaagcguggcgagaccgaucaccacgccgugucccgggggagcgccaagcugaggugguucguggagcggaacauggucacgcccgagggcaaggucguggaccucggcugcgggcgcggcgggugguccuacuacugcgggggacugaagaauguucgggaggugaagggccugaccaagggcggacccggccacgaggagcccaucccgaugagcaccuacggguggaaccucgugcgccuacaguccggcgucgacguguuuuucauuccgcccgagaagugcgacacccuucucugcgacaucggugaaagcucccccaaccccacgguggaagcgggccggacccuccgcguccugaaucucguagaaaacuggcugaacaacaacacccaguuuuguaucaagguccugaaucccuacaugcccagcgucaucgagaagauggaggcccuucagcggaaguacggcggggcccucgugcgcaacccccucagccggaacuccacccacgagauguacugggugagcaaugccuccggcaacauagucagcucggugaacaugaucagccgcaugcugaucaaucgguucaccaugcgccacaagaaggccacguaugagcccgacguggaccucgguuccggcacacggaacaucgggauagaaagcgagguccccaaccuggacaucaucgggaaaaggaucgagaaaaucaagcaggagcacgagaccuccuggcauuacgaccaggaccaccccuacaagaccugggcguaccacgguagcuacgagacgaagcagacugguuccgcgagcuccauggugaauggcgugguccggcugcucaccaagccgugggaugugcuccccaccgugacgcagauggccaugaccgacacuacuccguucgggcagcagcgugucuucaaggagaagguggacacgcgcacucaggagcccaaggagggcaccaagaagcugaugaagaucaccgccgaguggcucuggaaggagcugggcaagaagaagacgccacggaugugcacccgcgaggaguucacccggaaggugcgcucaaacgccgcguugggggcgaucuucaccgaugagaacaaguggaaguccgcccgggaggccgucgaggacucccgcuucugggagcucguagacaaagaacggaaccugcaccuggagggaaagugcgagacgugcgucuacaacaugauggggaagcgcgagaagaagcuaggggaguuugggaaagccaagggcucccgggccauuugguauauguggcugggagcgcgauuccuggaguucgaggcccucggguuucugaacgaggaccacugguuuagccgugaaaacucccugucuggcgucgagggggagggccuccacaagcugggguacauccugcgagacgugagcaagaaggaaggcggcgcaauguacgccgacgacaccgcggguugggacacccggauaacccucgaggaccugaagaaugaggagauggucacgaaccacauggagggcgagcacaagaagcuggccgaggcuaucuucaagcucaccuaucagaacaaagugguccgugugcagcggcccacgcccagggggaccgugauggacaucaucucccgccgcgaccagcgcggcagcggccagguggggacguauggccugaacaccuucaccaacauggaggcccaacugauccggcagauggagggggaaggcgucuucaagaacauccagcaucucaccgugacggaggagguggcgguccagaacuggcuagcgcggguggggcgcgaacgccugucccggauggccaucucgggcgacgacugcguggucaagccccucgacgacagauucgccaacgcccucaccgcccugaacgacaugggcaagaucaggaaagacauccagcagugggagccguccaaaggguggaacgacuggacccagguccccuucugcagccaccacuuccaugagcucaucaugaaggacggccgcgugcugguggugcccugccggaaccaggacgagcugaucgggcgcgcgcguauuucccagggcgccgguuggagccuccgcgagacggccugcuuaggcaaguccuacgcccagauguggagccugauguacuuccaucggcgcgaccuccggcuggccgcgaacgcaaucugcuccgccgugccuagccacugggucccgaccucccgcaccaccuggagcauacacgcuaagcacgaguggaugacuaccgaggacaugcugacaguauggaaccgcguguggauccgcgagaacccauggauggaggacaagacccccgucgaguccugggaggagauccccuaccucggaaaacgggaggaccaguggugcgggagccuuaucggccugacaucccgcgccacgugggcgaagaacauccaagccgccaucaaccaggugcggagcuuaaucgggaacgaggaguacacggacuacaugccuagcaugaagcgcuuucggcgcgaggaggaggaggcuggcgugcugugguga

SEQ ID NO: 24974 - RNA, 9876 nt, Artificial Sequence
  derived and/or modified CDS sequence (opt11) from DENV-2__FJ639708__SS-prME
agcgcggggaugaucaucaugcugauccccacggugauggccuuucaccucacaacccgcaacggggagccccacaugaucguuggaauccaggagaaggggaagucccugcuguucaagaccgaggacggcgugaacaugugcacccucauggccauggaccugggggagcugugcgaggacacaaucaccuauaagugcccccuccugcggcagaacgagcccgaggacauugacugcuggugcaacagcaccagcaccugggugaccuacgggaccugcacaaccaccggcgagcaucgccgggaaaagcgaagcgucgcccuggugccccacguggggaugggccuggagacccggacggagaccuggauguccagcgagggggccuggaagcacgcucaacgcaucgagaccuggauccucagacaccccggcuucacgaucauggccgcgauucuggccuacaccaucgggaccacccacuuccagaggguccucaucuucauccugcugacggccguggcccccuccaugaccaugcggugcaucggcaucagcaaccgagacuucguggaaggcgucuccgggggcagcuggguggacaucgugcucgaacauggguccugugucaccaccauggcgaagaacaagcccacgcuggacuucgaacugaucaagacggaggccaagcagcccgccacacuccggaaguacuguaucgaggcaaagcugaccaacacgaccacggagagccgcugucccacccagggugagcccuccuugaaggaggagcaagacaagcgguucgugugcaagcacagcaugguugaccggggcugggggaacggcugcggccuuuucggcaagggugggaucgucaccugcgcgauguucacgugcaagaagaacauggagggcaagaucgugcaaccugagaaccuugaguacaccaucgugguuacgccccacucuggggaggagcacgcgguggguaacgacacgggaaagcacggcaaggagaucaaggugaccccgcagagcuccauuacggaggcugagcuaacaggguacggcaccgucacgauggagugcucuccccgcaccggccucgacuucaacgagaugguucugcugcagauggagaacaaggccuggcucgugcaccgccagugguuccuggaccugccguuacccuggcugccaggggccgacaagcaggagucaaacuggauccagaaggagacccuggucaccuucaagaacccccacgccaagaagcaggacguggucguccucggcagccaagagggggcgaugcacacugcccugaccggcgcgacggagauccagaugagcucuggaaaccuacuguucaccggccacuugaagugccggcugcgcauggacaagcuccagcugaaaggcaugagcuacuccaugugcaccgggaaguucaaggugguaaaggagaucgcugagacacagcacggcaccauagucauccggguccaguacgagggggacggcagccccugcaagauucccuucgagaucauggaccuggagaagcgcuacauccucggccggcugaucaccgucaaccccaucgugacagagaaggacucccccgugaacaucgaagccgagccgcccuuuggcgacaguuacaucauuauaggggucgagccggggcagcuaaagcugaacugguucaagaagggcuccagcaucgggcagauguuugaaaccaccaugcggggcgcgaagcgcauggccauccugggcgacaccgccugggacuucgggucccugggcgggguguucacgagcaucggcaaggcccuccaccagguguucggggccaucuacggcgcggccuucuccggcgucagcuggaccaugaagauacugaucggggugaucaucaccuggaucggcaugaacucccggagcacuucccugagcgugucccugguccucguggggaucgugacgcuguacuuaggcgucaugguucaagccgacagcgggugcguggucuccuggaagaacaaggagcucaagugcggcuccggcaucuucaucaccgacaacgugcacaccuggaccgaacaguacaaguuccaacccgagagccccuccaagcuggccagcgcgauccagaaggcccaggaggaggggaucugcggcauccgcagcgugacgcggcuggagaacuuaauguggaagcaaaucacccccgagcugaaccacauccuggccgagaacgaggucaaguugaccauuaugaccggggacaucaaggggauaaugcaggccgggaagcgcucucugcgaccgcagcccacggagcugaaguacuccuggaagaccuggggcaaagccaagaugcucagcacggaguccuacaaccagaccuuccuaaucgacggccccgagacggcggagugcccuaacaccaaccgcgcauggaacagccuggagguggaggauuacggguucggcguauucacaaccaacaucuggcucaagcugaaagaaaagcaggacgccuucugcgacuccaagcugaugucggccgccaucaaggacaaccgggcgguccacgccgacaugggguauuggaucgagagcgcccucaacgauacguggaagaucgaaaaggccagcuucaucgaggugaagaacugucacuggcccaagucccauacccuguggagcaauggcgugcuggaguccgagaugaucauccccaagaaccuugccggccccgucagccagcacaacuaccguccggguuaucacacccagaucgcgggccccuggcaucuggggaaacuggagauggacuucgacuucugugauggcaccaccgugaucgucacugaggacugcgguaaccguggccccagucuccgcaccaccaccgcuagcggcaagcugaucacggaguggugcugccgcagcugcacccugcccccgcuccgcuaccgcggggaggacggcugcugguacgggauggagauccgcccccugaaagagaaggaggagaaccuggugaacucuuuagugaccgccggccacggccagguggauaacuucagccugggcgugcucggcauggcccuguuccuggaggagaugcugcggacccgcguggggacgaagcacgcgauccuccugguagccguauccuucaugacccugaucaccgggaacaugagcuucaaggacuuagggcgggugguggucauggugggcgccaccauggccgacgacauugggaugggugugaccuaccuggcacugcucgcggcuuucaagguccgucccaccuucgccgccggccugcugcuccggaagcuaaccuccaaggagcugaugaugaccacgaucgggaucgugcuccucagccagucuacuauccccgagaccgugcuggagcuaaccgaugcccuggcgcugggcaugauggugcuuaagaucgugcgaaacauggagaaguaccagcuggccgugacgauuauggcgauccugugcgucccaaaugccgugauccuccagaacgccuggaagguuagcugcacgauccuggcggugguguccgucagcccccugcuccugaccuccagccaacagaagaccgacuggaucccccuggcgcucacgaucaaggggcugaaucccaccgccaucuuccugacuacccucucgcgcacgaacaagaaacggagcuggccacugaacgaggcaaucauggcgguuggaaugguguccauccuggccagcucccuccugaaaaacgacauaccgaugaccggcccccuggucgccgggggccugcugacaguaugcuauguucugaccgggcgcagcgcggaccucgagcuggagcgggccacggacgucaagugggaggaccaggcugaaaucuccggcagcagcccaauccugucaaucaccauaagugaagacggguccaugagcaucaagaacgaagaggaggagcagacccucacaauccucauucguacgggcuuacucgugauauccggccuguucccgaucaguauccccauaaccgcagccgcgugguaccugugggaagugaagaaacagcgggccggcguccuaugggacguuccgagcccgccgcccaugggcaaggcggagcuggaggacggcgcuuaccgcaucaagcagaagggcauccuaggguacagccaaaucggcgccgggguguacaaggaggggaccuuccacaccauguggcacgucacccguggggccgugcuaaugcacaaagggaagaggaucgagcccuccugggccgacgugaagaaggaccugaucucguacggggggggcuggaaguuagagggcgaguggaaagagggggaggagguucaggugcuugcgcuggaaccaggcaagaacccccgggccguccagacaaagcccgggcuguuuaagaccaauaccggcaccaucggggccgucucccucgacuucucucccggcaccuccggcagccccauuaucgacaagaaggggaagguggugggccuguacgggaacggcgucgugacccgcuccggcgccuacgugagcgcaauugcgcagacggagaaauccauagaggauaaccccgagaucgaggaugauaucuuccggaagcgacggcugaccaucauggaccugcaccccggggccggcaagacgaaaagauaucuccccgccaucguccgggaggccaucaagcgcgggcuacggacucugauccucgcgccgacccgcgugguggccgccgagauggaggaggcccugcgggggcugcccauccgcuaccagaccccggcaauccgggcggagcacacggggcgcgagaucguagaccucaugugccacgccaccuucaccaugcgccugcugagccccgugcgggugccgaacuacaaccucaucaucauggacgaggcccacuucaccgacccggccuccaucgccgcccgcggcuacaucagcacgcgagucgagaugggcgaagccgccgggaucuuuaugaccgccacgccgcccggcucccgagacccguucccccaguccaacgccccuaucaucgacgaggagcgggagauccccgagagaagcuggaacuccggucacgaaugggugacagacuucaagggcaaaacggugugguucgucccgagcaucaaagcggggaacgacauagccgcgugccugcggaagaacgguaagaaggugauacagcugucccgcaagaccuucgacagcgaguacgugaagacccgaaccaacgacugggacuucguggugacaaccgacaucuccgagaugggcgccaauuuuaaggcugagagagugaucgacccccggcgcuguaugaagcccgucauccucacugacggagaggagcgugugauccuggccggccccaugccgguuacccacagcuccgccgcccagagacgcgggcgaaucggccggaaccccaagaacgaaaacgaccaguauaucuacaugggugaaccccuggagaaugacgaagauugugcgcacuggaaggaggcgaaaaugcucuuagacaacaucaacacgcccgagggcaucaucccgagcauguucgagcccgagcgcgagaaggucgacgccaucgacggcgaguacaggcugcgcggggaggcgcgcaagaccuucguggaccucaugcggcgcggcgaccugcccguguggcuggccuacaaggucgcugcggaggggaucaacuacgcugaucggagguggugcuucgacggcauaaagaacaaccagauccucgaagagaacguagagguggagaucuggaccaaggagggggagcggaagaaacugaaaccgcgcuggcuggacgcccggaucuacuccgacccccucgcccuaaaagaguucaaggaguucgccgcgggucgcaagagccugacccucaaccuaaucacggagaugggccgucugcccaccuuuaugacccagaagacccgcgacgcccucgacaacuuagcaguuuugcacacggccgaggccggcgggcgggccuacaaccacgcccucuccgagcugcccgagacccuggagacccuccugcuguugacacugcuggccacgguaaccggcggcaucuuccucuuccugaugagcggccgcgggaucggcaagaugacccuggggaugugcugcaucauaaccgccuccauccuccugugguacgcacagauccagccgcacuggaucgccgccagcaucauccuggaguucuuccucauuguccugcugauccccgagcccgagaagcagcggacgccucaggacaaccaguuaacauacguggucaucgccauacugaccgucguggccgcgaccauggccaacgagaugggcuuccuggagaagaccaagaaggaccucgggcugggcuccaucgccacgcagcagccggaaagcaacauccuggacaucgaccuccgccccgccuccgccuggacccucuaugcgguggccaccaccuucgucacgccgaugcugaggcacagcauagaaaacagcuccgugaacgugagccucaccgccaucgcgaaccaggccaccguccugaugggccuugguaagggcuggccccucuccaagauggacaucggagugccgcugcuggcgaucggcuguuacucccaggugaaccccaucaccuuaaccgccgcccugcuccuccuggucgcccacuaugcuaucaucggaccuggccugcaggccaaggccacgcgcgaggcccagaagagggccgcggcaggcaucaugaagaauccaaccgucgacgggaucacggugaucgaccucgauccaauccccuacgaccccaaguuugagaagcagcugggccaagucaugcugcucauccugugcgugacccaggugcugaugaugaggacuaccugggcucucugcgaggcccugacccuggccacaggaccgaucuccaccuugugggagggcaacccggggcgauucuggaacacuaccaucgcgguaagcauggccaacaucuuccguggcucauacuuggccggggccgggcuccucuuuuccaucaugaaaaacacgaccaacacccggagagguaccgggaauaucggggagacgcugggagagaaauggaagagucgccugaacgcccuugggaaguccgaguuccagaucuacaagaaguccggcauccaggagguggaccggacucucgcgaaggaggggaucaagcgcggcgagaccgaccaccacgccgugucucggggguccgccaagcugcgcugguucgucgagcggaacauggugaccccagagggcaagguggucgaccucggcugcgggcgcggcggguggagcuacuauugcggcgggcugaaaaacgugcgggaggugaagggccugacgaagggagggccaggccacgaggagccaaucccgauguccaccuauggguggaaccucguccgccugcagagcggcguugacguguucuucaucccacccgagaagugcgacacccuacucugcgacaucggggaguccagccccaacccgaccguggaggccggccggacgcugcgcgugcugaaccucgucgagaacuggcuaaacaacaacacgcaguucugcaucaagguccuuaauccguacaugcccuccgucaucgagaaaauggaggcgcugcagcggaaguacggcggggcccuuguuagaaacccacucagucggaacagcacccacgagauguacuggguuuccaacgccagcgguaacaucgucuccagcgugaauaugaucagcaggaugcugauuaaccgguucaccaugcgccacaaaaaagccaccuacgagcccgacguugaccucgggucaggcacacggaacaucgggaucgaguccgaggugcccaaccuugacaucauugguaagcgcauagagaagauaaagcaggagcacgagaccucauggcauuaugaccaggaucacccauacaagaccugggccuaccacggcucauacgagacgaagcagacggggagcgcgaguucaauggugaacggcgucgugcgucugcucacaaaaccaugggaugugcugcccacugucacccagauggcgaugacggacaccacccccuucgggcagcagcggguguucaaggagaaaguggacacccgcacgcaggagccuaaggagggcaccaagaagcugaugaagaucacagccgaguggcucuggaaggaguuagggaaaaagaagaccccccggaugugcacacgcgaggaguucacccgaaagguccgcucuaaugccgcccugggggcgaucuucaccgacgaaaacaaguggaaguccgcucgggaggccguggaggacucccgcuucugggaguugguagacaaggagcggaauuugcaccuggaaggcaagugcgagacgugcguauacaacaugauggggaagcgcgaaaagaaacucggcgaguucgggaaggccaagggcagccgggccaucugguacauguggcugggcgcgcgcuuucuggaguucgaggcacucggguuccugaacgaggaucacugguucagccgggagaacucgcuguccggcguggagggugagggccuacacaaacugggguacauccuucgcgacgucucuaagaaggagggcggcgccauguacgccgacgacacggcggggugggacacccggaucacccucgaggaccugaagaacgaggagauggugaccaaucacauggagggcgaacauaagaaacuggccgaggccaucuucaagcucacauaccagaacaaggugguccgcgugcagcggcccacgcccagaggaaccgugauggacaucauaagccggcgcgaucagcggggcucagggcaagucggcacguacgggcugaacacauucacgaacauggaggcccagcugauccgccagauggaaggggagggcguguuuaaaaauauacagcaucucaccgugaccgaggagguugccgugcagaacuggcuggcccggguugggcgcgagcggcugagcagaauggccaucucuggcgacgacugugucguuaagccccucgacgaccgcuucgccaacgcccugacagcccuuaacgacaugggcaagauccggaaggacauccaacagugggagccguccaagggcuggaacgacuggacccaggugcccuucugcucccaccacuuccacgagcucaucaugaaggacggacgcgucuuaguggugcccugccggaaccaagacgagcugaucgggcgcgcgcggaucucccagggcgccggguggucccuccgugagaccgccugccuggggaagagcuacgcccagauguggagucuuauguacuuccaccggcgggaccuccggcuggcggcgaacgccauuugcagugccguccccucccacuggguuccaaccagccgaacgaccugguccauucacgcuaagcacgaauggaugaccacggaggauaugcugaccguguggaaccgggucuggauccgcgagaacccguggauggaggacaagacgcccguggaaagcugggaggagaucccguaccucggcaagcgggaggaccaguggugcgggucccugaucggccugaccagccgugccaccugggcuaagaacauccaggccgccaucaaccaggugcgcucccucaucggcaacgaggaauacacugacuacaugccgagcaugaagcgcuuccggcgcgaagaggaagaggccggcgucuuaugguga

SEQ ID NO: 24975 - RNA, 9876 nt, Artificial Sequence
  derived and/or modified CDS sequence (opt11) from DENV-2__FJ639709__SS-prME
uccgccgguaugaucauaaugcuuauccccaccgugauggccuuccaccucacuacacguaacggggagccgcauaugauugugggcauccaagaaaagggcaagagccugcuuuucaagacagaagacgggguaaauauguguacccucauggcuauggaccuaggggagcugugcgaagacaccaucacuuauaaauguccccucuugcgccagaaugagcccgaggacaucgauugcuggugcaacagcaccagcacuugggugaccuacgggacuugcacaacuacgggggaacaccgccgggaaaagcgcucgguggcccuagugccccauguagggaugggcuuggagacgcggaccgaaacauggauguccucagaaggagccuggaaacacgcucagcgcauagagacuuggauccugcggcacccaggcuucacgaucauggcagcgaucuuggccuacaccaucgguacuacucacuuccagcgggcccucauuuucauccugcugacggccguagcgccguccaugacgaugcggugcauaggcauaaguaaucgcgacuucguggagggugucagcggcgguagcuggguugacaucguguuggagcacgguucgugcgugacgaccauggccaagaacaaacccacgcuggacuucgaacugaucaaaaccgaagcgaaacagcccgccaccuuacggaaauacuguauagaagccaaacuuaccaacaccacaacggagagccgcugccccacccagggugaacccagucugaaagaggaacaggacaagcgguucguuuguaagcacagcaugguagaccgcggcugggguaacgguuguggccuauucggaaagggcgggauaguuacgugcgcgauguuuaccugcaaaaagaacauggagggcaagaucgugcagccggagaaccuugaguacaccaucguugugacgccacauuccggagaggaacacgccguagguaacgacacgggaaagcauggcaaggagaucaaggugaccccgcagucguccaucacugaggccgaacugaccggguacggcaccguaacgauggagugcagcccccggacuggccucgacuucaacgagaugguccuuuugcagauggagaacaaggcguggcuuguccaccgccagugguuucuggaucuucccuuacccuggcuuccuggcgccgauaaacagggcuccaacuggauccagaaagagacccuggucaccuuuaaaaacccacaugcuaagaaacaagacgucgucguccucggaucccaggaaggagccaugcauacggcccugaccggugccacagaaauccagauguccuccggcaaccugcuguuuaccggccaccugaagugcagguuacgcauggacaaacuccaacugaagggcaugaguuacuccaugugcacgggcaaguucaagguggucaaggagaucgcggaaacgcagcacgggaccaucgucauccguguucaauacgagggagacggcagccccugcaagaucccguucgagaucauggaccuggagaagcgcuacgugcucgggcggcuaaucaccgucaauccgaucgugacagagaaggauucacccgugaacauagaggcggagccgcccuuuggcgacagcuacaucaucaucggcgucgagccgggccaacugaagcucaacugguuuaagaaaggcucgagcauuggccagauguucgagaccaccaugcgcggcgccaagcguauggccauucugggagauaccgccugggacuucgggucccucggcgggguguucacgagcaucgggaaggcccuccaccaaguguucggagccauuuacggcgccgccuuuuccggugucagcuggacuaugaaaauccugaucggcgugaucaucacuuggauugggaugaacucucggagcaccucacugagcgugucgcugguccucguagguaucgucacccuguauuuaggcgucauggugcaggccgacucuggcugcguggugagcuggaagaacaaggaacugaagugcggcucagggaucuucaucacugacaacguucacaccuggacagagcaauacaaguuccaacccgaaucgcccagcaagcuggcgagcgccauccagaaggcucaggaggaagggaucugcgggauacgcuccgugacccgccuggagaaccucauguggaagcagaucacaccugaguugaaucacauccuggcugagaacgaagucaaauuaacuauaaugaccggcgacaucaaggggaucaugcaggccggcaagcgcagccuaaggccgcaacccacagaguugaaguauuccuggaagaccuggggaaaggcgaagaugcucucaaccgagucccacaaucagaccuuccuuaucgacgggccggaaacggccgagugcccuaacaccaaccgcgccuggaacagccuggaaguggaggacuacgguuucgggguauucacuaccaacaucugguugaagcugaaggagaaacaggacgccuucugcgacuccaaacugaugucugccgcgaucaaagacaaucgggcaguccacgccgacaugggcuauuggaucgaauccgcccucaacgacaccuggaaaauagagaaagccuccuucaucgaggugaaaaacugucacuggcccaagucccacacccuguggagcaauggcguacuggagucugagaugauuaucccgaagaaucucgcggggccagucagccagcacaacuaccgcccgggcuaccacacgcagauugcggggcccuggcaucuaggcaagcuggagauggacuucgacuucugcgacgguacaaccguaaucgucacggaggacugcgguaaccggggucccagucuccgcaccacuaccgcaucagggaaacugaucacggagugguguugccggucgugcacccugccgccgcuccgguacagaggcgaggaugggugcugguaugguauggaaaucagaccccugaaagaaaaggaagagaaccuagucaacucucucgucacggcgggccacggacagguggacaacuucagccuggguguccuggggauggcccuuuuccuugaggagaugcugcggaccagagugggcacgaagcacgccauucuacugguggcgguguccuucguuacccucaucaccgggaacaugagcuucaaggacuugggacggguagucgugauggucggggccaccaugacggaugacaucgguaugggggucacguaccuggcccugcucgcggcguuuaaggugcgcccaaccuucgccgccggacugcugcugcggaagcucacgaguaaggagcucaugaugacgaccaucggcaucgugcuacugagccagacuaccauccccgaaaccauccuggaacucacggacgccuuagcgcuagggaugaugguccucaagaucguccgugacauggagaaguaccagcuggccguaacaaucauggccauccucugugucccgaacgcagugaucuuacagaacgccuggaaggucuccugcaccauccucgcgguagugagcgucaguccccuucuccugacgagcagucagcagaaaaccgacuggaucccccuugcgcuaacaaucaaggggcuaaaccccacggcaauuuucuugacuacuuugagccgcacgaauaaaaagcgcucauggccgcugaacgaagccaucauggccgucggaauggugucgauccuggccuccagccuccugaaaaacgacauacccaugaccggaccccugguagccggcgggcuccuuacggugugcuacgugcugaccgggcguuccgcggacuuggagcuagagcgggcgaccgacgucaaaugggaggaccaggcggaaaucucggguuccuccccuaucuugagcaucaccaucuccgaggacggaagcauguccaucaaaaacgaggaagaggaacagacucucaccauccugauacgcaccggauugcucgucaucuccggucuguuuccgguguccauucccauuaccgccgcggccugguaccugugggaggucaagaagcaacgugcuggagugcucugggauguccccuccccgccgccaauggggaaggcggaacuggaggacggagccuaccgcauuaaacaaaagggcauacugggcuauucccagauaggcgccgggguuuacaaggagggaacuuuucacacuauguggcacguaacgcgcggugcgguccucaugcacaaggggaagcgcaucgagccaagcugggcagacgucaagaaagaccugaucuccuacggggguggcuggaaauuggagggagaguggaaagaaggcgaggaaguccaagucuuagcgcuggagccagggaagaaccccagggccguucagaccaaaccuggccuguucaagacuaacacagggacuaucggcgccguaagucuagacuucucucccggcacaagugggagucccauuauugacaagaaaggcaagguggucgggcuguacggcaaugggguggugacccgcagcggggccuacgugucagcaauugcgcaaacggagaaauccaucgaagacaaccccgagaucgaagaugacauauuucggaagcgaaggcugaccaucauggaucugcaccccggcgcggggaagaccaagcgcuaccuccccgcgaucguacgggaggccauaaaacgcggccugcggacccugauucucgcaccgacgcgggucguugccgccgaaauggaagaggcccugagagggcugcccaucagauaucagacccccgccauccgcgcugaacacacgggccgcgagaucgucgaccuaaugugucacgcaacuuuuacgaugagacugcuuucccccguucgggugccgaacuacaaucuuauuauaauggacgaggcccacuucacugaucccgccagcaucgccgcucgcggcuauaucuccaccaggguagagaugggagaggcugcagggaucuucaugaccgcaaccccucccgggagcagggacccauucccgcagagcaacgccccgauaaucgacgaggaacgggagauccccgagcgguccuggaacagcggccacgagugggugacugacuucaaggggaagacagucugguucgucccguccaucaaggcagguaacgauauagccgcaugccugaggaagaacgguaagaaggugauccagcucagucgcaagaccuucgacagcgaguacgucaagacgcggaccaacgacugggacuuuguggucaccaccgacaucagugagaugggggcuaacuucaaggccgagcgcgucaucgauccccgacgcugcaugaagccuguaaucuuaacggauggugaggaacgcgugauccuugcugggccaaugccggucacccauuccucggcggcccaacgccggggccgcauuggccggaaccccaagaacgaaaacgaccaauacaucuacaugggcgagccccuagaaaacgacgaggacugugcucauuggaaggaggcuaaaaugcuccuggacaacaucaacaccccagagggcaucaucccguccauguucgagccggagagagagaaaguggaugccaucgauggggaguaccggcuucgcggagaggcacgcaagaccuuuguggaccucaugcggagaggggaccugcccguauggcuggcauauaagguggcagccgagggcaucaacuacgccgaccggagauggugcuuugaugguaucaaaaauaaucagauccucgaggagaauguggaggucgaaaucuggaccaaagagggcgaaaggaagaaacuuaagccccgauggcuggacgcucggaucuacucagacccgcucgcccugaaggaguuuaaggaguucgccgcgggucgcaagagcuugacgcuaaaucugauuaccgagauggggagauuacccaccuucaugacgcagaagacaagggacgcucucgauaaccucgccguacugcacaccgccgaggcuggagggagggccuacaaccacgccuuaagcgagcugcccgagacccuugagacgcuucugcugcucacgcuucuggcaaccguuaccggcggcaucuucuuguucuugaugucaggucgcggcauuggcaagaugacccuuggcauguguuguauaaucacagccagcauucugcuguggaacgcgcagauacagccccacuggaucgccgccagcaucauauuagaguucuuuuugaucgugcucuugauucccgagccugagaagcagcgcacgccccaggacaaccaguuaaccuaugugguaaucgcuauucugaccgugguagccgcuacgauggccaacgagaugggcuuccuggagaagaccaagaaggauuuagggcuggguucuaucgccacacagcaaccugagaguaacauccuggacaucgauuuacgccccgccagcgcuuggaccuuguaugcugucgcaacgaccuucguaacccccaugcugcgucacucgaucgaaaacucgagcgugaacgucucacuuaccgccaucgccaaccaagccacggugcuuaugggucugggcaagggguggccccuaucaaagauggacaucggggucccucugcuggcgaucggguguuacucccaggucaaccccauuacccucaccgccgccuugcuguuacucguggcccauuaugcaauaaucggccccggccuucaggcgaaagcaacccgagaggcucagaaacgggcggcagcagggauuaugaaaaauccgacgguggacggcaucaccguuauugaccucgauccgauccccuacgaccccaaauuugagaagcaacucggccaggugaugcugcugaucuugugcgugacccagguguugaugaugcgcaccacgugggcccuaugcgaggcgcugacccuggccaccggcccuauuagcacccucugggaggggaacccgggacguuucuggaacacgaccaucgcgguaucgauggcgaacaucuuccgaggaagcuaccuggccggugccggucuccucuuuuccaucaugaagaacaccaccaacacacggcgcgggacuggaaacaucggugagacccugggggagaaguggaagagucgccuaaacgcccuuggcaagucagaguuccagaccuacaagaaguccggcauccaagagguggaccggacucucgcuaaagagggcaucaaaagaggggaaacugaucaccaugccguuucuagggggagcgcuaagcuacgcugguucgucgagcggaacauggugacgcccgaaggaaagguaguggaccugggaugcgggcgcgguggcuggucguauuacugcgggggccugaagaacguacgggagguaaagggccuaaccaagggcgggccagggcacgaggagcccauuccuaugagcacguauggcuggaaccucgugcgauuacagagcgggguggacgucuucuucaucccuccugagaaaugcgacacccugcucugugacaucggagaaagcucucccaacccgaccguggaggccggcagaacacugcgcguucugaaccuagucgagaacuggcugaacaauaacacccaguucugcaucaaggugcuaaaccccuacaugcccagcgugauagagaaaauggaggcgcugcaacggaaguaugggggcgcccucguucgcaacccgcugucccgcaauagcacucaugagauguacugggugucgaacgccuccgggaacaucgucucaucagucaacaugaucagccgcaugcugaucaaccgguucacgaugcgccacaagaaggcaacauacgagcccgacguggaucucggcuccggcacgcggaauaucggaauagagagcgagaucccuaaucuggauaucaucggcaagagaauagagaagaucaagcaagagcacgagaccucguggcacuacgaccaggaccacccguacaagaccugggccuaccauggaagcuacgagaccaagcagacaggcuccgcgagcuccauggugaacggggucguacggcugcucaccaagccgugggacgucuuacccaccguuacacagauggccaugaccgacacgacuccuuuuggccaacagcgcguguuuaaggagaaggucgauacucgcacucaggagcccaaggagggcacgaagaagcugaugaaaauaacggcugaguggcuauggaaagagcucggaaagaagaagaccccgcggauguguacccgcgaggaguucacccgaaagguucgcagcaacgcggcucugggcgcgaucuucaccgacgagaacaaguggaaguccgcgcgggaagcgguagaggacagccgcuucugggaguuaguggauaaggagcggaacuugcaccuggaggggaagugcgagaccugcguuuauaauaugaugggcaagcgcgagaagaagcucggggaguucggcaaggcaaaaggaucccgggccauaugguacauguggcugggggcucgcuuucuggaguucgaagcccuaggcuuccugaacgaagaucacugguucagccgugagaacucgcuguccgggguggaaggagaaggguuacauaagcucggcuacauauugcgcgacgucaguaagaaagaggguggggccauguacgcggaugacacagcgggcugggauacgcggauuaccuuggaggaucugaagaacgaggagauggugacuaaccacauggagggggagcauaagaaauuggcagaagccaucuucaagcugaccuaccagaacaagguaguccgcgugcaacggcccacgccccgcggcaccguuauggauaucauaagcagacgcgaccaacgcgggagcgggcaggucggaacauacgggcugaacaccuuuacgaauauggaggcccaacugauacgucagauggagggcgaagggguauucaagaauauccaacaucugaccgcuaccgaagagguggcaguacagaacuggcuggcccgggucgguagagagcgcuuaucgcggauggccaucucgggcgacgacugcguuguuaaaccucuugacgaccgcuuugcuaaugcccugaccgcgcugaacgacauggggaagauccguaaggauauccagcaaugggagccaagcaagggcuggaacgacuggacccaggugccauucugcagccaccacuuccacgagcucauuaugaaagacggucgcguguuaguugugccaugccgaaaucaggacgaacugauagggcgagccaggauaucccagggugccggguggagcuuacgcgagaccgccugccugggcaagucguacgcacagauguggagucugauguacuuccaccggcgcgaucuccggcuggccgccaacgccauuugcagcgccgugcccagccacuggguuccgaccaguaggaccacuuggagcauacacgccaagcacgaauggaugacgaccgaggacaugcugaccguguggaaccgggucuggauccgcgagaaccccuggauggaggauaagacccccguugaguccugggaagaaauucccuaccucgggaagagagaggaccaauggugcgguucucugauugggcugacguccagagccacaugggcgaaaaacauccaggccgccauuaaucagguacgcagucucaucggaaaugaggaguacacagacuacaugccgagcaugaagcgcuuucggcgcgaggaagaggaggcgggcguauuaugguaa

SEQ ID NO: 24976 - RNA, 9876 nt, Artificial Sequence
  derived and/or modified CDS sequence (opt11) from DENV-2__FJ639710__SS-prME
ucggcgggcaugaucaucaugcugauacccacggugauggccuuccaccucacgacucgaaacggggagccccauaugauugucggcauccaggagaagggcaagagccugcuuuucaaaaccgaagacggcguaaacaugugcacgcucauggcaauggacuuaggggaacugugcgaggacacuaucacguacaagugcccccuccugcgucagaacgagccggaggacaucgacuguugguguaacucuacauccacaugggugacauacgggaccugcaccaccacgggcgaacaucgccgggaaaagcgcagcguggcccuggugccccacguggggaugggccucgagacccgcacagagaccuggauguccagcgaaggggcuuggaagcaugcccagcgcaucgaaaccuggauccugcggcacccgggcuuuacgaucauggcugcaauccuggcauauacgaucggcaccacacacuuccagcgcgcgcucauuuucauccugcugacggccguugcuccauccaugaccaugagaugcaucgggaucagcaaucgggauuucguggagggcguuuccgggggcucgugggucgacaucguucuugagcauggguccugcgugaccacaauggccaagaacaagcccacgcuggacuuugagcucaucaagaccgaagccaaacaacccgccacacuucggaaguauugcauugaggccaagcugaccaacacgaccaccgagagccgcugccccacccagggcgagcccucccugaaggaggagcaagacaaacgauucgucuguaagcauaguaugguggaccgcgguugggggaacggaugcgggcuguucggcaagggggcgaucgugacaugugccauguucacauguaagaagaacauggagggcaagauaguccagcccgagaaccuagaauacaccaucguggugacaccgcauagcggggaagagcacgcuguugggaacgacacuggcaagcacggcaaggagaucaaagucaccccgcagagcuccaucaccgaggccgagcugacggguuaugggaccgugacgauggagugcagcccccgaaccggguuagacuuuaaugagauggugcugcugcagauggagaacaaggcguggcucgugcaccgccagugguuccuagaccuuccacuuccuuggcugccaggcgcggacaaacaggaaaguaacuggauccagaaggagacacuggugaccuucaagaacccccacgccaagaagcaggacgucgugguucuugguucccaggagggcgcuaugcacaccgcccugacaggggccacugagauacaaaugagcuccgggaaccucuuguucaccggucaucugaagugccgccugcgcauggacaagcuccaacugaaaggcaugucuuacaguaugugcacgggcaaguucaagguggugaaggagaucgcggagacgcagcacggaacgauagugauccgggugcaguacgagggagacgggucucccugcaagauccccuucgagaucauggaccuggagaagcgcuacgugcuuggucgguuaaucaccgucaaccccauugugaccgaaaaggauucccccgucaacaucgaggccgagccgccguucggcgacagcuauauaaucauaggggucgagccgggccaguuaaaacuuaauugguucaaaaaggggagcucuaucggccagauguucgagaccaccaugaggggugccaagcgcauggccauccuaggcgacacggccugggacuucgggucccuaggagggguguucacaagcauaggcaaggcgcuccaccagguguucggggcaaucuacggggcggccuucaguggcgucuccuggaccaugaagauccugauuggcgugaucauaacauggaucgggaugaacucgcggagcacaucccugagcguaucccugauccuagucgggaucguuacguuauaccuggggguaaugguacaggccgacagcggaugcguggugucauggaagaacaaggaguugaagugcgggagcgguaucuuuaucacggacaacgugcacacguggaccgagcaguacaaauuccagcccgagagccccuccaagcuggccagcgcaauccaaaaggcccaggaagaagggaucugcggcauccgcuccgugacccggcuggaaaaccuaauguggaaacaaaucacccccgagcugaaucacauccuagccgagaaugaggugaaguugaccauaaugaccggcgacaucaaagggaucaugcaggccggcaggcggagccugcgcccgcagcccacggaacugaaauacuccuggaagacaugggggaaggcaaagaugcuuagcacggaguccuacaaccagaccuucuugaucgacggucccgaaacgacugagugccccaauacgaaccgggccuggaacucccuggaggucgaagacuauggcuuugggguguucacuacaaacaucuggcuaaagcugaaggaaaaacaggacgccuucugugacuccaaguugaugagcgccgccaucaaggauaaccgcgccgugcacgcugacaugggcuacuggaucgaguccgcccuuaacgacacauggaaaaucgagaaagccagcuucaucgaagucaaaaacugccacuggcccaaaucccacaccuugugguccaaugguguccuggaguccgagaugaucaucccaaagaaucucgccggccccgugucucaacacaacuaccguccaggcuaccacacccagauugcagggcccuggcaccuaggcaagcuggagauggacuuugacuucugcgacgggaccacuguaauagugaccgaggacugcgggaacagggggcccucccucagaaccacuacggccuccggcaagcucaucaccgaguggugcugucgcucuugcacccugcccccgcuccgguauagaggcgaggacgggugcugguacggcauggaaauccggccccugaaggagaaggaagagaaccuggugaacucccuggucaccgcugggcacggacaaguggacaauuucagccugggagugcuuggaauggcucuauuccuagaggagaugcugcggacacgugucggaacgaagcacgccauccuccuaguggccgucucguucguuacccucaucacagggaauaugucuuucaaggaccucggcagagugguggucauggugggcgccacgauggcugacgacaucgggaugggcguaaccuaccucgcccugcuagcugccuucaaggugcggccuaccuucgcagcgggccugcugcuccgcaaguugacgagcaaggagcugaugaugacuacuauaggcaucgugcugcugagccagaguaccauccccgagacuauccuggaacuuacggacgcccuggcccuggguaugaugguguugaaaaucguccgcaacauggagaaguaccagcuggccgugacuaucauggccaucuuauguguccccaacgccgucauccuacagaacgccuggaaggugagcuguaccauccuggcagucguguccgugagcccccugcuccugacauccagucaacagaagacggacuggauaccgcuggcccucaccaucaagggccucaaccccaccgcuauauuccugacuacguuauccaggaccaacaagaagcggagcuggccgcugaacgaggcaaucauggccgucgggaugguuucgauccuggccagcucccuccuaaaaaacgacauccccaugaccggcccccuggucgcuggcgggcuccugaccgucuguuacguguuaacgggccgcagcgccgaucucgagcuugagagggcuaccgacgugaagugggaggagcaagccgagauuucggggagcucacccauccugucgauuacgaucagcgaagacggcuccaugagcauuaagaacgaggaggaagagcagacccugaccaucuugauccggacagggcugcuggucauaagugguuuauucccgauuagcaucccgauuacggcugccgccugguacuuaugggaggugaaaaagcaaagagcgggcguucugugggacgucccaagcccgccgccgauggggaaggcggagcuggaggauggggccuaccggaucaagcagaaggggauccugggauacucucagaucggugccggaguguacaaggaaggcacguuccauaccauguggcacgugacgcgcggcgccguccucaugcacaaaggcaaacggaucgagcccuccugggcggauguuaagaaggaccugaucagcuaugggggcgguuggaagcuggagggcgaauggaaggagggugaagaggugcagguccucgcccuggagccagggaagaacccccgggcuguccaaaccaagcccgguuuauuuaagaccaacacagggaccauaggagccgugucccucgacuucagccccgggaccuccggcagccccauuaucgauaagaaggggaaggucgugggacuguacggcaacgggguggucacccgguccggugccuacgugucagcgauugcccaaacugagaaguccaucgaggacaaccccgagauagaagacgacaucuuccgcaagcgacgccugacaaucauggaccugcaccccggugccgggaagaccaagagguaccuacccgcaauagugcgcgaggcgaucaagcggggcuuaagaacccugauccucgccccgacuagagucgucgcagccgaaauggaggaggcccugcgcggacugcccauccgguaccagacgcccgcgauccgugcagaacacacggggcgcgagaucguggaccucaugugccacgccaccuucaccaugcggcuguuaucccccguccgcgucccgaauuacaacuugaucaucauggacgaggcccacuuuacggaccccgccuccaucgcggcccguggauacauuagcacccgcguggagaugggugaagcagccggcaucuuuaugaccgccacuccgcccgggagccgagacccguucccacaguccaaugcucccaucaucgacgaggaacgagagauccccgagcggagcuggaacaguggccacgaguggaucacagacuucaaagggaaaacggucugguuugugccgagcauaaaagccggaaaugacaucgccgccugccugaggaagaacgggaaaaaggugauccagcugucccggaagacauucgauucagaguacguaaagacccgcacgaacgacugggacuucgucgugaccacagacaucagcgagaugggcgcgaauuucaaggccgagcgcgugaucgacccccgccggugcaugaaacccgugauccuaaccgacggcgaagagcgcgugauccuggccgggcccaugccgguaacgcacagcuccgccgcgcagaggcggggccgcauagggcgcaaccccaagaaugagaacgaucaguacaucuauaugggcgagcccuuggagaaugacgaggacugcgcucauuggaaggaggccaagauguuacuggauaacaucaacacccccgaagggaucaucccgagcauguucgaaccugagagagagaaaguugacgcaauagacggugaauaccguuuacgcggcgaggcccgaaagaccuucguggaucuaaugcgccgaggggaucugccgguauggcuggccuauaaggucgcagcggagggcaucaacuaugcagaccguagguggugcuucgacggcaucaagaacaaccagauccucgaggagaauguggaagucgagaucuggaccaaagagggcgagaggaagaaguuaaagccgagguggcuggaugcacggaucuacuccgacccucuagcucugaaggaguucaaggaguuugcggcuggcaggaagucccugacgcucaacuuaaucaccgagaugggccgccugcccaccuucaugacgcagaagacgcgcgacgcccuugacaaucuggccguguuacacaccgcggaagccggggggagggccuacaaccacgcauuguccgaacugcccgagacccuggaaacacuccuuuugcucacgcucuuagccaccgugaccggcgggaucuuccuguuccuaaugagcgguagaggcaucggaaagaugacccugggcaugugcugcauaaucaccgcguccauacuccuaugguaugcgcagauccaaccgcacuggauugcagccuccaucauccuggaguuuuuccucaucguucugcugauccccgagcccgagaagcaacggacaccccaagacaaccagcucaccuacguggucaucgccauccugacaguuguagccgcaaccauggccaacgagauggguuuccuggagaagacuaagaaagaccuggggcuaggguccaucgccacccagcagccugagaguaacauccuggacaucgauuugcggcccgccucagcguggacgcuguacgccgucgccaccacuuucaucaccccaaugcuccgccacucuaucgagaacagcuccguaaacaccucucucacugccaucgcuaaucaggcgacgguguugaugggucugggcaagggguggccacucucgaagauggacaucggggucccgcuccuggcgaucggaugcuacagccaggugaaccccaucacccucaccgcggcacuacuacucuuggucgcucauuacgccaucaucggcccagggcugcaggccaaggccacccgggaagcccagaaaagggcggcagccggcaucaugaagaaccccacggucgacggcaucacggugauugaccucgauccgauccccuacgaucccaaguucgagaagcagcuuggccaggucaugcugcuaauccugugcgucacccaggugcugaugaugaggaccacgugggcccucugcgaggcccugacccuggcgaccgguccaaucuccaccuuaugggaggggaauccggggcgcuucuggaacacgaccauugccguaagcauggccaacaucuuccggggguccuaucuagccggugccggccuccucuucaguaucaugaagaacaccacaaacacgcgccgcgggacuggcaacaucggggagacccugggggagaaguggaagagucggcugaacgcgcucggcaagucugaauuucagaucuacaagaaguccgggauacaggagguugaccgcacccuugcaaaggagggcaucaagcgcggggagacggaccaccaugcugucagcagaggcucugccaagcugcggugguucgucgagaggaacauggucacccccgaagggaaagugguggaccucggcugcggccgcggcggguggagcuacuacugcgguggccugaagaacgucaaagaagugaagggguuaaccaagggcggacccgggcacgaggagccgauccccaugucgaccuauggcuggaaccucgugcgccugcagagcggcgucgauguguucuucaucccccccgagaagugcgacacgcugcugugcgacauuggcgaguccagccccaacccgaccguggaggcgggucggacacugcgcguacugaaccuuguggagaacuggcuuaauaacaacacccaguucuguaucaaggugcugaacccauauaugcccucagucauugagaagauggaggcccugcagaggaaauacggcggcgccuuagugcgcaacccgcugucccggaacaguacucacgagauguacuggguguccaacgccagcgggaacaucgucuccucggugaacaugaucagccgaaugcugaucaaucgguuuacgaugaggcacaagaaggccacguacgaaccggacguggacuuaggaagcgggacccgcaacauagguauugaguccgaaguccccaaccuggacauuaucggaaagcgcaucgagaagaucaagcaagagcaugagaccagcuggcacuacgaccaagaucaucccuacaagacuugggccuaccacggcaguuacgaaaccaagcagaccggcagcgccucgucuauggugaacggugugguccggcugcuaacaaaaccgugggacguccugccaacgguaacucaaauggccaugaccgacaccacccccuucggccaacagcgcguauuuaaggaaaagguggacacccgcacucaagagccaaaggaggggaccaaaaaauugaugaagaucacggccgaguggcucuggaaggagcugggcaagaagaagaccccgcgcaugugcacccgcgaggaauucacccgcaaagugcgcaguaacgccgcccugggggccaucuuuacggaugagaacaaguggaaauccgcccgggaagccgucgaggacucccgcuucugggagcucguagauaaggagcgaaaccugcaccucgaggggaagugcgagaccugcguguacaauaugaugggaaagcgcgagaagaaacuuggggaguucggcaaagccaaggggucucgggcaaucugguacauguggcugggcgcucgcuuuuuggaguucgaagcccucggauuccugaacgaggaccacugguucucccgggagaacagucuguccgggguugagggugaggggcuccacaaguugggauacauccugcgcgacguuagcaagaaggagggcggcgcgauguacgcggacgacacagcggggugggacacccggaucacguuagaggaccugaagaacgaagagauggugaccaaccacauggaaggggagcauaagaagcuggccgaggccaucuucaagcugaccuaccagaacaaggucgugagaguacagcggcccacgccucggggaacagugauggacaucaucagccggcgagaccagcgggggucgggccagguagggaccuacggucuuaacaccuuuaccaacauggaggcccaguuaauccgucagauggagggugagggggucuucaaaaacauccaacaccucacggugaccgaggaggucgcgguacagaacuggcuagcccgggugggccgggagcgacucagccggauggccaucuccggggacgacugcguugucaagccccucgacgaucguuucgccaacgcccugaccgcccugaacgauaugggcaagauccggaaggacauacagcagugggaaccuucuaaaggcuggaacgacuggacccagguucccuucugcucacaccacuuccacgagcucaucaugaaggacgggcgcguguugguugugccaugccgcaaccaggacgaacugaucggccgugcucguaucagccagggggccgguuggucccuccgcgagacagcgugccuagggaaaagcuacgcccagauguggucccugaucuacuuccaucggcgcgacuugcgccuagcggcaaacgccaucugcagcgcggugcccucccauuggguuccaacgagccguaccaccugguccauccaugccaaacaugaguggaugaccacggaggacaugcugacuguguggaaccggguguggauccgcgagaaccccuggauggaggacaaaacucccgucgagagcugggaggagauucccuaccuuggcaagagagaggaccaguggugcggcagucugauagggcugaccaguagggccacuugggccaagaacauccaagcggccaucaaccaggugcggucauugauagguaaugaggaguacaccgacuacaugcccagcaugaaacgguuccggcgcgaggaggaggaggcgggggugcugugguga

SEQ ID NO: 24977 - RNA, 9876 nt, Artificial Sequence
  derived and/or modified CDS sequence (opt11) from DENV-2__GQ868623__SS-prME
agcgccggcaugaucaucaugcugauccccaccgugauggccuuccaccucaccacucggaauggagagccccacaugaucgucggaauccaggagaaggggaaaagccugcuguucaagaccgaggacggcguuaauaugugcacccucauggcgauggaucugggggagcugugcgaggauacgaucaccuacaagugcccccugcugcggcagaacgagcccgaagacaucgacugcuggugcaauagcaccuccaccugggugacguacgggaccugcacaacgaccggagagcaccgcagggagaagcgcagcgucgcccuggugccccacguggggaugggccucgagacgagaaccgagaccuggauguccagcgagggagccuggaagcacgcccaacgcaucgagaccuggauccugcgacacccgggcuucacgaucauggccgcgauccuggccuacaccaucgggaccacacauuuccagcgcgcccucaucuucauccugcugacggccgucgccccguccaugacgaugcggugcauuggcauaagcaaccgcgacuuuguggagggcguguccggggguagcugggucgacaucgugcucgagcacgggucuugcgugacaaccauggccaaaaacaagcccacgcuggacuucgagcugauuaagaccgaggcgaagcagccagccacccuccggaaauauugcaucgaggccaagcugaccaacacgaccaccgagagccgcugccccacccagggugagcccucccugaaggaggagcaagacaagagguucgucugcaagcacagcaugguggaucgggggugggggaacggcugcgggcuguucggcaagggcgggauaguuacgugcgcgauguuuacgugcaagaaaaacauggaggguaagaucguccagccagagaaccuggaguacaccaucgugguaacuccucacuccggggaggagcacgccgucggcaacgacacggggaagcacggcaaggagauaaaggugaccccacagagcuccauuacagaggccgaauugaccggguacggcacuguuacgauggaguguagcccccggaccggccucgacuuuaacgaaaugguccugcugcagauggagaacaaggccuggcucgugcaccgccaaugguuccuggaucugccccuccccugguugccgggggcagacaagcagggcuccaacuggauccagaaggagacucuggugaccuucaagaacccccacgcgaagaagcaagaugucgugguccucgggucucaagagggcgccaugcacacggcccugacuggagccaccgagauccaaaugagcucuggcaaccuccuguucaccggucaccugaaaugccggcugcgcauggacaagcuccagcugaagggaaugaguuacuccaugugcacuggcaaguucaagguggugaaggagaucgccgagacccagcacgggaccaucgucauccgggugcaguacgagggcgacggcagccccuguaagauucccuucgagaucauggaccuggagaagcgcuacguauuggggcggcuaaucaccguaaacccgauaguaacugagaaggacucccccguuaacaucgaggcggagccgccuuucggggacucguacaucaucaucggugucgagccgggacagcugaagcuaaacugguucaagaaaggguccagcaucggccagauguuugagaccaccaugcgaggcgccaagcgcauggcgauccugggggauacugccugggacuucggcucccuaggcgggguuuucacgagcaucgggaaggcccuacaccagguguucggcgccaucuacggcgcagcuuucucgggugugucauggacuaugaagauacugaucggcguaauuauuaccuggaucgggaugaauucccggagcaccucccugucggucucccugguccucgugggcaucgugacgcuguacuuggggguaauggugcaggcugauagcggcugcguggucuccuggaagaacaaggaacucaagugcggcagcgggaucuucaucaccgacaacgugcacaccuggaccgagcaguauaaguuucaacccgagagcccuuccaagcuggcuagcgccauacagaaggcgcaggaggagggcauaugcggcauccgcagcgucacgcggcuagagaaccugauguggaagcagaucacucccgagcuaaaccauauacucgccgagaacgaagucaagcucaccaucaugaccggcgacaucaaagggaucaugcaggccgggaagcguagccugcggccgcagcccacggaacuaaaguacucuuggaagaccugggggaaggcuaagaugcucucuaccgagucccacaaucagacuuuccugaucgacgggcccgagacggccgagugccccaacaccaaccgcgccuggaacucucuggaaguugaggacuacggcuuuggggucuucaccaccaacaucuggcucaagcugaaggagaagcaggacgccuucugcgauuccaagcugaugagcgccgcgaucaaggacaaccgggccguccaugccgacaugggcuacuggaucgaguccgcccucaacgacacguggaagauagagaaagccagcuucauugaagugaaaaacugccacuggcccaagucccacacccucuggagcaacggcgugcuugaaagugagaugaucauccccaaaaaccucgcagggccuguaucacagcacaacuacagaccgggcuaucacacccagaucgccgggcccuggcaccuggggaagcuggagauggacuucgacuucugcgacgggaccaccguaaucgugaccgaggauugcggcaaucgggggcccucccuccgcaccaccacugccagcgggaagcucaucacggaguggugcugucggagcugcacguugccaccgcuaagguaccggggcgaggacggguguugguacggcauggaaauccgcccccugaaggagaaggaggagaaccuggucaauucccucgugacagccgggcaugggcagguggacaacuucagcuugggcguccuggggcucgcacuguuccuggaggagaugcuccggacccgcgugggcaccaaacaugccauccugcuaguggccguuucuuuugugacccucaucaccgggaacaugucugugaaggaccuuggacgggucgucgugauggucggggccaccaugacggacgacaucggcaugggcgugaccuaccuugcucuccuggcggcguucaaggugcggcccacauucgccgccggauugcuccugcggaagcugaccuccaaggaacucaugaugacuaccauaggcaucgugcugcugagccagagcaccauccccgagaccauccucgaacugacggacgcccuggcgcucgggaugaugguccugaagauugugcgcgacauggagaaguaccagcuagccgugaccauaauggcuauccucugcgugccgaacgccgucauccugcagaacgcauggaagguuagcuguaccauccuagcgguagucuccgugagccccuuacuacugaccuccagccagcagaagacggacuggauuccucucgccuuaacgaucaagggccugaaccccaccgccauuuuccucaccacgcugagcaggaccaacaagaagcgcucguggccguuaaaugaggccauuauggcgguggguauggucucuauacucgccuccucacugcugaagaacgacaucccgaugacagggccccucguggcgggcgggcugcuuaccguguguuacguccugacgggcaggagcgccgaccuggagcuggagagagccacggacguaaagugggaggaccaggcugagaucuccgguagcagccccauccucucgaucaccaucagcgaggacggauccaugaguaucaagaacgaggaggaggagcagacccuuacgauauugauccgcaccggccuccugguuaucagcgggcuguuuccggucucuauccccaucaccgccgccgccugguaucucugggaaguuaagaagcaacgggccggcgugcugugggacguaccaagcccaccucccauggggaaagcggagcuggaggauggcgccuaucguauuaaacagaagggaauccugggcuacucacagauaggugccgggguguacaaggagggcaccuuucacaccauguggcaugugacgcgaggagcgguccuaaugcacaagggcaagcgcaucgagcccuccugggcggacguuaagaaagaccugaucagcuacggggggggcuggaaauuagagggggaauggaaggagggggaggaggugcagguccuggcacuggagccagggaaaaauccccgcgccgugcagaccaagcccggccucuucaaaacgaacacugguacgauuggugccgugucacuggacuucagccccggaaccucaggaucccccaucauagacaagaaggggaagguaguggggcuguacggcaacgggguggucaccagguccggugccuacgugagcgccauagcacagaccgagaaguccaucgaggacaacccugagaucgaggacgacaucuuucggaagcgccggcucacgaucauggacuugcaccccggagccgggaagaccaagcgauaccuucccgccaucgugcgggaggcuaucaagcgaggccugcggacccucauccuggccccgacccgagucguugccgccgagauggaggaggccuuacgggggcugcccauccgcuaccagacgccagccauccgggcggaacauaccggccgcgagaucguagaccugaugugccacgccaccuucaccaugcgccugcucagcccgguccgggugccgaacuacaaccugaucaucauggacgaggcccauuucacggaccccgccucuaucgccgcgcgcggauauaucucuacccgcguugaaaugggggaggccgccggcaucuuuaugaccgcuacgccgcccgggagccgcgacccauucccccaguccaacgcccccaucaucgacgaggagagggagauccccgaacgcucauggaacuccggccacgaaugggucacggacuucaaggguaagacuguuugguucgugccgagcaucaaggcgggcaacgacaucgccgccugccugcggaaaaacggcaagaaggucauccagcucucccggaagaccuucgacagcgaguacgugaagacccggaccaacgauugggacuucguggugaccaccgauauauccgaaaugggugcuaacuucaaggcggagagggucaucgacccucggcgcugcaugaagcccgugauccugaccgauggcgaggagcgggucauccuggccgggcccaugccagucacgcacagcuccgccgcgcagcgccggggccgcaucgggcggaaucccaagaacgagaacgaucaguacaucuacaugggcgaaccccucgaaaacgacgaggacugcgcgcacuggaaggaggcuaagaugcuguuggacaacaucaauacccccgaggguauaaucccgagcauguucgagcccgaacgagagaagguggacgccaucgauggggaauaccgucuccgcggcgaggcucgaaagacuuuugucgaccuuaugcggcgcggcgaucugcccgugugguuggccuacaaaguggccgcggagggaacgaacuacgccgaccggcgcugguguuucgaugggaucaagaacaaccaaauccucgaggagaacguagagguggagaucuggacgaaggagggcgagcggaagaagcuuaagccgcgcuggcucgacgcccggauauacuccgacccacuggcccucaaggaguuuaaggaguucgccgcaggccgaaagagccucacccugaaccugauaaccgagauggguagauugcccaccuuuaugacucagaagacccgcgaugcccuggauaaccuggccguccuccacaccgccgaggccggcggacgggccuacaaccaugcgcuguccgagcugcccgagacccucgagacguuacugcuccugacccugcucgccaccgugacgggcggcaucuuccuguuccugaugagcggcagggguauagggaagaugacucucggcaugugcugcauaaucacagcauccauccuucugugguacgcgcagauccagccgcacuggaucgccgccagcaucaucuuagaguucuucuugaucgugcugcucaucccugagcccgagaagcaacggacuccccaggacaaccagcugaccuacgucgucaucgccauccugacgguggucgccgccaccauggccaaugaaaugggguuccucgagaagacaaagaaggaccugggccugggcagcaucgccacucagcagccggagucuaacauccucgacaucgaucugcgcccugccuccgccuggacccuguacgcgguugccacgaccuucgugaccccaauguuacggcacagcaucgagaacagcuccgugaacgugagccucaccgcgaucgccaaccaagccaccgugcuuauggggcucggcaagggguggcccuugagcaagauggacaucggcgucccgcuguuggcgaucggaugcuacagccaggugaaccccaucacccugaccgccgcccugcuccugcuuguggcacacuacgcgauaauuggccccggccuccaggccaaagccacccgcgaggcccagaagcgggccgcggccgggauuaugaagaaccccacggucgacggaaucacggucaucgaccuggacccgauccccuacgaccccaaauucgagaaacaacugggccaggugauguuacugauccugugcgugacgcaggugcucaugaugcgcaccacgugggcccugugcgaggcgcugacacucgccaccggccccaucuccacccugugggaggggaacccaggucgguucuggaacacgaccaucgcggugagcauggcgaacaucuuccgcgguuccuaccuagcaggggccggccuccuguucagcaucaugaagaacaccaccaauacacggcgcgggacuggcaacaucggcgagaccuugggggaaaaguggaagagucgucuuaacgcacugggcaagagcgaguuucagaccuauaaaaagucggggauccaggaggucgaccggacgcuggcuaaggagggcaucaagaggggcgagaccgaucaccacgcagucagccgggguuccgccaaguugcgcugguucguggaacggaauauggucacccccgagggcaagguaguagaccuggggugcggcagagggggcuggagcuacuacugcggcgggcuaaaaaacguccgggaggugaaggggcucaccaagggcgggcccgggcacgaggagcccaucccgaugucuacguacggcuggaaucuugugcgccugcagagcggcgucgacguauucuuuauaccacccgagaagugcgacacacuccugugcgacaucggcgagucuagccccaauccgaccguggaagccggccggacgcugcgcguccuuaacuuaguggagaacuggcugaacaacaacacccaguuuugcaucaaggugcugaaccccuacaugcccagcgucaucgagaagauggaggcgcugcagcggaaacacgggggcgcccugguccgcaacccguuaagccggaacagcacgcacgagauguacuggguguccaacgccagcgggaacaucguauccagcgugaauaugaucagccgcaugcucaucaaccgguucaccaugcgccacaaaaaagccaccuaugaacccgacguggacuuggguagcgggacccggaacaucgggaucgagucugagauccccaaucuggacaucaucggcaagcgcaucgagaaaaucaagcaggagcacgagaccaguuggcacuacgaucaagaccaccccuacaagacaugggccuaccacggguccuacgagaccaagcaaacgggcagcgcguccagcauggucaacggaguggugcggcuccugacgaagccgugggacguccugcccaccgugacacagauggccaugacugacacgacccccuucggccaacagcgcguguucaaagagaaggucgacacccgcacccaagagcccaaggaggggacgaagaagcucaugaagaucaccgccgaauggcuguggaaggagcugggaaagaaaaagaccccgcggaugugcacccgugaggaguucacgcggaaggugcgcuccaacgcugcccucggcgcgaucuucacagaugagaauaaguggaaguccgcccgugaggcuguggaggacucacgcuucugggaguuaguugaccgggagcgcaaccugcaccucgaggggaagugcgagaccugcguguacaacaugaugggcaagcgggagaagaagcugggggaguucggcaaagcgaaaggcagccgcgccaucugguacauguggcugggggcgcgauuccuugaguucgaggcccugggcuuccuaaacgaggaccacugguuuagccgcgagaauagccuuuccggggucgagggcgaaggacugcauaagcuuggcuacauccuccgggacgugagcaagaaagagggcggggccauguacgccgacgacaccgcgggcugggacacucguaucacccuggaggaccugaagaacgaagaaauggugaccaaccacauggagggugagcacaagaaacucgccgaggccaucuucaagcugaccuaccaaaacaagguaguucgcgugcagcgccccacgccccggggcaccgucauggacaucaucagcagacgugaccagcgcgggucuggccaagugggcaccuacgggcugaacaccuucacgaacauggaggcccagcuaauccgucagauggagggcgaggggguguucaagaauauccaacaccugacggccaccgaggaggucgcggugcaaaacuggcuggcccgcgugggccgcgagcggcucagccgcauggccauauccggcgacgacugcgucgugaagccccuggacgaccgguucgccaaugcccugaccgcguuaaacgacauggggaaaaucagaaaggacauccagcaaugggagccaagcaaggguuggaacgacuggacgcaggucccguucugcagccaccacuuccacgaguuaaucaugaaagacgggcgugugcugguggugccgugucgcaaccaagacgagcucaucggccgugcucgcaucagccagggggccggcuggucucugcgggagaccgcgugucuggggaagagcuaugcccagauguggucccucauguacuuccacaggcgggaucugcgccuggcagccaacgccauuugcagcgccguccccucccacugggugccgacaagcagaacaaccugguccauccacgccaagcacgaguggaugacgaccgaggacaugcucaccguguggaaccgcgucuggauucgggagaaccccuggauggaggacaagaccccagucgagagcugggaggagauccccuaccuggggaaacgcgaagaucagugguguggcucccucaucggucucacgucccgggcgaccugggccaagaacauccaggccgccaucaaccaggugcgcuccuugauuggaaacgaggaguacaccgacuacaugccgagcaugaagcgguuccgccgcgaggaggaggaggcugguguccugugguaa

SEQ ID NO: 24978 - RNA, 9876 nt, Artificial Sequence
  derived and/or modified CDS sequence (opt11) from DENV-2__GQ868624__SS-prME
agugcgggcaugaucaucaugcugauucccaccgugauggccuuccaccucaccacccgcaacggggagccccacaugaucgucgguauccaggagaaggggaagucccugcucuucaaaaccgaggauggcgugaacaugugcacgcucauggcgauggaucugggggagcugugcgaggacaccauuaccuacaagugcccccuccugcggcagaaugagcccgaggacaucgauugcuggugcaacagcaccagcaccugggugaccuacgggaccugcaccaccaccggcgagcaucgccgggagaagcgcagcgucgcccuggugccccacguggggaugggccucgagacccggaccgagaccuggauguccagcgagggggccuggaagcacgcccagcgaaucgagacuuggauccuucggcacccgggcuucacgaucauggccgcaauccuggcuuacaccaucgggaccacccacuuccagcgcguccucaucuucauccuguugacggccguggccccguccaugaccaugaggugcaucggcaucagcaaccgcgacuucguugagggcgucucugguggcagcuggguggacaucgugcucgagcacggguccugcgucaccaccauggcgaagaacaagcccacacuggacuucgagcugaucaagaccgaagccaagcagcccgccacccuccggaaguacugcaucgaggcgaagcugaccaacacgaccaccgagagccgcugccccacccagggcgaacccucccugaaggaggagcaggacaaacgguucgugugcaagcacagcaugguggaccgcggaugggggaacggcugcggccuguucggaaagggcgguaucgucacgugcgccauguucacgugcaagaaaaacauggagggcaagaucgugcagccggagaacuuagaguacaccaucgugguuacgccccacuccggggaagagcacgcggugggcaacgacacggggaagcacggcauggagaucaaggugaccccgcagagcuccaucaccgaggccgagcugacuggguacggcaccgucaccauggagugcucuccccggaccggccucgacuucaacgagauggugcugcugcagauggagaacaaggccugguuagugcaccgccagugguuccucgaccugccccuccccuggcugccgggggccgacaagcaggaaucaaauuggauccagaaggagacccugguaaccuucaagaacccccacgccaagaagcaggacguggucgugcucggcagccaggagggcgcgaugcacaccgcccugaccggcgccaccgagauccaaaugagcuccgggaaccuccuguucacgggccacuugaagugccggcugagaauggacaagcuccagcugaagggcaugagcuacuccaugugcacggggaaguucaagguggucaaggagaucgcagagacccagcauggaaccaucgugauccgggugcaguacgagggggacggcagccccugcaagauccccuucgagaucauggaccuggagaagcgcuacguccucggccggcugauaaccgugaauccgaucgugacggagaaggacucccccgucaacaucgaggccgagccgcccuucggggacucguacaucauaaucggcguggagccgggacagcugaagcucaacugguucaaaaagggcuccagcaucgggcagauguucgagaccaccaugcgcggggcgaagcgcauggcaauucugggcgacaccgccugggauuucgggucccugggcgggguguucacgagcaucggcaaggcccuccaccaggucuucggggccaucuacggggcagccuucucuggcgugagcuggaccaugaagauacugaucggggugaucaucaccuggaucggcaugaacucccggagcaccagccugagcgugucucugguacucguggggaucgucacgcuguaucugggagugauggugcaggcugacagcgggugcgucguuucauggaagaacaaggagcucaagugcggcagcggcaucuucaucacggacaacgugcacaccuggaccgagcaguacaaguuccagccagagagccccuccaagcuugccagcgcgauccagaaggcccaggaggagggaaucuguggcauccgcuccgucacgaggcuggagaaccucauguggaagcagaucaccccagagcugaaccacauacuggccgagaacgaagugaagcucaccaucaugacgggggacaucaagggcaucaugcaggcagggaagcgcucccugcggccgcagcccacggagcugaaguacuccuggaagaccuggggcaaggccaagaugcucagcaccgaguccuacaaccagaccuuccuaaucgacggccccgaaacggcggagugcccgaacaccaaccgcgccuggaacagccuggagguggaggacuacggcuucggagucuucaccacaaacaucuggcucaagcucaaggagaagcaggacgccuucugcgacuccaagcugaugagugccgccaucaaggacaaccgggcgguccacgccgacaugggguacuggaucgagucagccuuaaacgauacguggaagaucgagaaggcuagcuucaucgagguaaagaacugucacuggcccaagucccacacccuguggagcaacggcguccuggaguccgaaaugauaauucccaagaaccucgccggccccgugucccagcacaacuaccgcccgggguaccacacccagauagcgggccccuggcacuuagggaagcuggagauggacuucgacuucugcgacggcaccaccgugaucgucacugaggacugcgggaaccggggccccucccuccgcaccacgaccgccagcggcaagcugaucacggaguggugcugccggagcuguaccuuacccccgcuccgcuaccgcggagaggacgguugcugguacgggauggagauccgcccccuuaaggagaaggaggagaaccuggugaacucccucgugaccgccggccacgggcaggucgacaauuucagccugggcguucugggcauggcccucuuccuggaggaaaugcugcguacccgcguggggacgaagcacgcgauccuccuggucgccguguccuucgucacccugaucaccggcaacaugagcuucaaagaccucgggagggucguggugauggucggcgcuaccauggccgacgacaucgggaugggcgugacguaccuggcccugcucgcggccuucaagguacgccccaccuucgccgccggccuguugcucagaaagcugaccuccaaggaacugaugaugaccacaaucgggaucguccuccugagccaguccaccauccccgagaccgugcuggagcugaccgacgcccuggcgcugggcaugauggugcucaagaucguccgcaacauggagaaguaucagcuggcaguuacgaucauggccauccugugcgucccgaacgccgugauccuucagaacgccuggaaggugagcugcaccauucuggcggucguguccgugagcccccugcuccugaccuccagccagcagaaaacugacuggaucccccuggcccucacgaucaaggggcugaaccccacggccaucuuccugaccacccucucccgcacgaacaaaaagcggagcuggccgcugaacgaggccaucauggcggucggcaugguguccauacuggccagcucccuucugaagaaugacauccccaugaccggcccccuuguggccgggggucuccuuaccgucugcuacgugcugaccggccggagcgcugaccucgagcuggagcgggccacggacgugaagugggaggaccaggcggagaucuccggcagcagccccaucuuguccauaaccaucagcgaggacgggagcaugagcauuaagaaugaggaggaggagcagacacucacuauccugauccgcacgggacugcucguaaucuccggccuguucccgaucagcauccccaucacugccgccgcuugguaccugugggaggugaagaagcagcgggccggggugcucugggacguccccagcccgccgcccaugggcaaggcggagcuggaagacggggccuaccgcaucaagcaaaagggcauccugggguacagccaaaucggcgccggcgucuacaaggaggggaccuuccacaccauguggcacgugacccgcggcgccguacucaugcacaaggggaagcggaucgagccgucaugggcugacgugaagaaggaccugaucagcuauggcggaggcuggaagcuggagggcgaguggaaggagggugaggaggugcagguccucgcguuagagcccggcaaaaacccccgggccgugcagacaaagcccgggcuguucaagaccaacaccggaaccaucggggccgugucccucgacuucagccccggcacauccggcagccccaucauagacaagaaggggaaggucgugggccuguacgggaacggcguggucacccgcuccggcgcguacguaagugcaaucgcgcagaccgagaaguccaucgaggacaaccccgagauagaggacgacaucuuccggaagcgccggcugaccaucauggaccugcaccccggggccggcaagacaaaacgcuaucuccccgccaucgugcgggaggccaucaagcgcgggcugcggacccugauccucgcgccgacccgcgucguggccgccgagauggaggaggcccugcggggccugcccauccguuaccagacccccgccauccgggcggagcacacgggccgcgagaucguggaccucaugugucacgccaccuucaccaugcgccugcuauccccaguccgcgugccaaauuacaaccucaucaucauggacgaggcacacuucaccgaucccgccuccaucgccgcacgcggcuacaucagcacgcggguggagaugggggaggccgccgggaucuucaugaccgccacgccgcccggcagccgagacccguuuccucaguccaacgcccccaucaucgacgaagagcgggagauccccgaaaggagcuggaacuccgggcaugagugggucacagacuucaagggcaagacggugugguucgugccgagcaucaaggcggggaacgacaucgccgccugucugcggaagaacggcaagaaggucauccaacugucccgcaagaccuucgacagcgaguacguaaagacccggaccaacgacugggacuucguugucacgaccgacaucuccgagaugggcgccaacuucaaggcggagcgcgucaucgacccccggcgcugcaugaagcccgugaucuuaaccgacggggaggagcgggucauccuggccggccccaugccggugacccacaguuccgccgcccagcgccgggggcgcaucggccggaaccccaagaacgagaacgaccaauacaucuauaugggggagccucuggagaacgaugaggacugcgcucacuggaaagaggcgaagaugcuacuggacaacauaaacacgcccgagggcaucaucccuagcauguucgagccugagcgcgaaaaaguggacgccaucgacggcgaguaccggcuucgcggggaagcccgcaagaccuucgucgaccucaugcggcgcggcgaccugcccguguggcuugccuacaagguggccgcggaggggaucaauuacgccgaccggcgcuggugcuucgacgguaucaagaacaaccaaauccuugaggagaacgucgagguggagaucuggaccaaggagggggagcggaagaagcugaagccgcgcuggcuggacgcccggaucuacuccgacccccucgcccugaaggaguucaaggaguucgccgcuggccgcaagagccugacccucaaccugaucacggagaugggccggcugcccacuuuuaugacccagaagaccagggacgcccucgacaaccuggccguccugcacacggccgaggccggcgggcgggccuacaaccacgcccucuccgagcugcccgagacccuagagacccuccugcugcucacucugcuggccacgguaacagggggcaucuuccucuuccugaugucaggccgagggaucggcaagaugacccuggggaugugcuguaucaucaccgccuccauccuccugugguacgcgcagauccagccacacuggaucgccgccagcaucauccuggaguucuuccucaucguguugcugauccccgagcccgagaagcagcggacgccccaggacaaccaacucacguacgucgugaucgccauccugaccguggucgcugcgacaauggccaacgagaugggcuuccuggagaagacaaagaaggaccucgggcugggcuccaucgccacgcaacagccggaguccaacauccuggacaucgaccuccgcccggccuccgcauggacucuguacgcuguggcaaccacguucgugacgcccaugcugcggcacagcaucgagaacagcuccgucaacgugagccucaccgcuauugccaaccaggccacggugcugaugggccuugggaagggcuggccccucuccaagauggacaucggggucccgcugcuggcgaucggcugcuacucucagguuaaucccaucacucugacggccgcccugcugcuccugguggcccacuacgcgaucaucgggcccggccugcaggccaaggccacccgcgaggcccaaaagcgggccgcagccggcaucaugaagaaccccaccgucgacgggaucaccgugaucgaccucgacccaauccccuacgaccccaaguucgagaagcaacuuggccaggugaugcugcucauccugugcgucacccaggugcugaugaugcgcaccaccugggcccucugcgaggcccugacccuggccacggggcccaucaguacacucugggagggcaacccggggagauucuggaacaccaccaucgcaguaagcauggccaacaucuuccgcggcuccuacuuggccggcgccgggcuccucuucagcaucaugaagaacacgaccaacacccggcgcggcaccgggaacaucggcgagacguugggcgagaaguggaagucccgcuugaacgcccucgggaaguccgaguuucagaucuacaagaaguccggcauccaggaagucgaccggaccuuagcgaaggaggggaucaagcgcggggagacggaccaccacgccgugagccgggggucggccaagcugcgcugguucguagagcggaauauggucacccccgagggcaaggucguggaccucggcugugggcgcggcggguggagcuacuacugcggcggucugaagaacguccgggaggugaagggccugacgaagggcggccccggccacgaagagcccaucccgauguccacguacggguggaaccucgugcgccugcaaucgggcgucgacguguucuucaucccgccugagaagugcgauacccugcucugcgacaucggagaguccagccccaacccgaccguggaggccgggcggacgcugcgcguacugaaccucguggagaacugguuaaacaacaauacccaguucuguaucaaggugcugaaccccuacaugccuuccguuaucgagaagauggaggcgcugcagcggaaguacggcggagcccucgugcggaacccucugagccggaacagcacccacgagauguauugggugagcaacgccagcggcaacauagucuccucagugaacaugaucucccgcaugcugaucaaccgguucacaaugcgccacaagaaggccaccuacgagcccgacguggaccucgggagcggcacgcggaacaucgggaucgagagcgaaauccccaaccuggacaucaucggaaagcgcaucgagaagaucaaggaggaacacgagaccagcuggcacuacgaccaggaccaccccuacaagaccugggccuaccacggcuccuacgagaccaagcagacggggagcgcguccagcaugguaaacggcguggugagacuguugaccaagccgugggacgugcugcccaccgugacccaaauggcuaugacugacaccacccccuucgggcagcagcgcgucuucaaggagaaggucgacacccgcacgcaggagcccaaggaaggcaccaagaagcugaugaagaucaccgccgaguggcucuggaaggagcugggcaagaaaaagaccccgcggaugugcacgcgcgaggaauucacccgcaaggugcgcuccaacgcagcccugggggcgaucuucaccgacgaaaacaaguggaagagcgcccgggaggcaguggaggacagucgcuucugggagcucgucgacaaggagcggaaucugcaccuggagggcaagugcgagaccugcguguacaacaugauggggaagcgcgagaagaagcucggcgaguuugggaaggccaagggcucacgggccaucugguacauguggcugggcgcgcgcuuccuggaguucgaggcccuugguuuccugaacgaggaccauugguucucccgggagaacagccuguccggcgucgagggggagggccuccacaagcugggguacauacuacgcgacgugagcaagaaggaaggcggcgcaauguacgcugacgacacggcggguugggacacccggaucacccucgaggaccugaagaacgaggagauggugaccaaccacauggagggcgagcacaagaagcuggcugaggccaucuuuaagcucacguaccagaacaaggucgugcgcguucagcggcccacgccccgggggaccguaauggacaucaucagccggcgcgaccagcggggcuccggccagguggggaccuauggccucaacacguucaccaacauggaggcccagcugauccgccagauggagggggagggcguguucaagaacauccagcaccucacugucaccgaggaggccgcggugcagaacuggcuggcccggguggggcgcgagcgccugagccgaauggccauauccggcgacgacugcgucguaaagccccucgacgaccgcuuugccaacgcccugacggcucugaacgacaugggcaagauccggaaggacauccagcagugggaaccgagcaagggguggaacgacuggacccaggugcccuucugcucccaucacuuccacgagcucaucaugaaggacgggcgcguccugguggugcccugccggaaccaggaugagcugaucgggcgcgcccggauuucccagggcgccgguuggucccuucgcgagaccgccugccugggcaagagcuacgcccagaugugguccuugauguacuuccaccggcgcgaccucaggcuagcggccaacgccaucugcagcgcgguccccucccacugggugccgacaagccgcacgaccuggucuauccacgccaagcacgaguggaugaccacugaggauaugcugaccgucuggaaccgggucuggauccgcgagaaccccuggauggaggacaaaacgcccguggagagcugggaggagaucccuuaccucggaaaacgugaggaccaguggugcggaucccugaucggccugaccagccgcgcgaccugggcgaagaacauccaggcagccaucaaccaggugcggucccuaaucgggaacgaggaguacaccgacuauaugccgagcaugaagcguuuccggagagaggaggaggaggcgggcguccugugguag

SEQ ID NO: 24979 - RNA, 9876 nt, Artificial Sequence
  derived and/or modified CDS sequence (opt11) from DENV-2__FJ639717__SS-prME
agcgcuggcaugaucauuaugcugaucccuacugugauggccuuccaccucaccacccgcaauggggaaccccacaugaucgugggcauccaggaaaagggcaagagccugcuauucaagaccgaagauggcgugaauauguguacccucauggcgauggaccugggggagcuaugcgaggacaccaucaccuauaaaugcccccuccugcggcaaaacgagcccgaggauaucgacuguuggugcaacagcacuagcacuugggugacuuacgggaccuguaccaccaccggcgagcaccgccgggagaagcgcagcguagcccugguaccucacguggggaugggccuugagacccgaaccgagaccuggaugucuagcgagggggccuggaagcacgcucagcgcaucgagaccuggauccugcgccauccgggcuucacgauuauggccgcgauccuggccuacaccauugggaccacccacuuucagcgcgcccucauuuucaucuugcugacggcugucgcgcccuccaugaccaugcggugcaucgggaucaguaaccgcgacuucguggaaggcgugagcgggggaucgugggucgacaucguguuggagcacgguuccugcgugaccacuauggccaagaacaagccuacgcuggacuucgagcugaucaagaccgaggcgaagcaacccgccacccugcggaaguauugcauugaagccaagcugaccaacaccaccaccgagagccgcugccccacccagggugagcccagucugaaggaggagcaggacaagcgcuucguaugcaagcacagcaugguggaccgcgggugggggaacgggugcgggcuauucgggaaaggagggaucgugacgugugcgauguuuacgugcaagaagaacauggagggcaagaucguccagcccgagaaccuggaguacaccauugugguaacgccccacuccggggaggagcacgccgucggcaacgacacggggaagcacgggaaggagauaaaggugaccccgcagagcuccaucaccgaggccgagcugaccggguacggcaccgugacgauggagugcagcccccggacgggccucgauuucaacgagaugguccugcugcagauggaguccaaggcuuggcucgugcaccgccagugguuccuggaccugccacuccccugguugccuggcgccgacaagcagggcagcaacuggauccagaaggaaacucuggugaccuucaagaacccccacgcgaagaagcaggacgucguggugcucgguucucaggagggcgcaaugcacacggccuugaccggggccaccgagauccagauguccagcggcaaccuccuguucaccggccaccugaagugccggcuacgcauggacaagcuccagcugaaggggauguccuacagcaugugcaccggaaaguucaagguggugaaggagaucgccgagacgcagcacgggaccaucgucauccggguccaauacgagggcgacggguccccaugcaagaucccguucgagauuauggaucuggagaagcgcuacgugcucgggcggcuuaucaccgucaacccgaucgugacggagaaagacaguccugugaacaucgaggcggaaccgcccuucggcgacuccuacaucauuaucggugucgagccgggccagcugaagcucaacugguucaagaaggggagcuccaucgggcagauguucgagaccaccaugcgcggugcuaagcgaauggccauucucggggacaccgccugggacuuuggcagccucggcgggguauucacguccauagggaaggcccuccaccaagucuucggggcuaucuacggcgccgccuucagcggggucucauggaccaugaagauucugauuggaguuauuaucaccuggauugggaugaacagccgguccaccucgcuguccgugagccugguccuggugggcauagugacgcuguaucuuggggucauggugcaagccgacaguggcugcguagucagcuggaagaacaaggagcuaaaguguggcucagggauuuucauuaccgauaacgugcacaccuggaccgagcaguacaaguuucagccugagaguccuagcaagcuggccuccgccauacagaaggcacaggaagagggcauaugcggaauacgaucggugacgcggcuggagaaucuaauguggaaacagaucaccccagagcuuaaccacauccuggccgagaacgaggucaaguuaaccaucaugaccggcgacauaaaggggauuaugcaggccggcaagcggucccugcgcccgcagcccacugagcugaaguacagcuggaaaaccuggggcaaggcgaagaugcucuccaccgagagccacaaccagaccuuccugaucgacgggcccgagacggcagagugcccgaacacaaaucgggccuggaacucccuggaggucgaggacuacggauuugggguguucaccacaaacaucuggcuaaagcucaaggagaagcaggaugccuucugcgacaguaaguugaugucggccgcgaucaaggacaaucgggccguccacgcggacaugggcuacuggauagaaagcgcccucaaugacacguggaagaucgagaaggccaguuucaucgaggugaagaacugccacuggcccaagagccacacccuguggucuaauggcgugcuggaaagcgagaugaucauccccaaaaaccuagcugggcccgucucccaacacaacuaccgcccgggcuaccacacccagaccgcagggccuuggcaccuggggaagcuggagauggauuucgauuucugcgacgguaccacggugaucgugaccgaggacugcggcaaucgaggcccgagccuccgcaccaccacggccagcggcaaacugaucaccgaguggugcugccggucuugcacccugcccccgcuucgauaccggggcgaggauggguguugguacgguauggagaucagaccccugaaagagaaggaggagaaccuggucaacagccucguuaccgccggacacggccagguggacaacuucucacugggcguccuggggauggcccuguucuuggaggagaugcugcggacgcgcgucggcaccaagcacgccauccucuugguugccgucagcuucgugacccugaucaccgggaacauguccuucaaggacuuaggccgcguggucgugaugguggggacgaccaugacagacgacauaggcaugggugucacuuaccuggcccuguuggccgcguucaaggugcgccccacauucgccgccgggcugcuguuacggaagcugaccagcaaggaguugaugaugaccaccaucggcaucgugcuccugagucagagcacgaucccugagacgauccuggagcucaccgacgcacuggcccuugggaugaugguccuuaaaaucgugcgcgacauggaaaaauaccagcuggcagugaccaucauggccauccugugcgucccgaaugccgugauccuccaaaacgccuggaaggucuccugcaccauccuggcgguggugagcgucagcccccugcuccugacgagcucccagcagaagacggauuggaucccccuagcgcucaccaucaagggccugaaccccacggccaucuuccugacaacccucagccgaacuaacaaaaagcguuccuggccgcugaacgaggccaucauggcggugggcauggugaguauccuggcuuccucacuccuuaagaacgacauccccaugacggguccccuggucgcuggcgggcuccugaccgugugcuacgugcugaccggcaggagcgcggaccucgagcuggagcgugccaccgaugucaagugggaggaucaggccgagaucucggggagcucccccauccugagcaucaccaucucagaagauggcaguauguccauuaagaacgaggaggaggaacagacucucacuauacugauccgaacuggcuuacucgugaucagugggcuguuccccguuuccauaccgaucaccgcggccgccugguaucugugggagguaaagaagcagcgggccggcgugcucugggacgugcccuccccaccgcccauggggaaggcugaguuggaggacggcgcguaccgcaucaagcagaagggaauccuggguuacucccagaucggcgccggagucuacaaggagggcacguuccacaccauguggcacgugacccgcggagcgguccucaugcacaagggcaagcgcaucgagccuaguugggccgacguuaagaaggaccuuaucuccuacgggggcggcuggaagcuggagggggaguggaaggagggagaggagguccaggugcucgcccuggaacccggcaagaacccgcgggcgguccaaaccaagccaggacuguucaagacgaacaccgggaccaucggcgccgugagccucgauuucucgcccggcaccagcggcuccccuauaaucgauaagaaaggcaaggucgucgggcuguacgggaacggcguugugacgcgcagcggggccuacgucuccgccauagcccagaccgagaaguccaucgaggacaaccccgagauagaagacgacaucuuccggaagcgccgguuaaccauaauggaccugcacccaggugcagggaaaaccaagcgcuaccucccugcaaucgugagagaggccaucaagcgcggccugcgaacgcugauccucgcccccacccgcguggucgcggcugagauggaggaggcccugcggggguugcccauccgcuaccagacccccgccauccgcgccgagcacaccgggcgcgagaucguggaccucaugugccacgcaacguucacuaugcgucuucugucccccgugcgggucccgaacuacaaucucaucaucauggacgaggcccacuucacagaucccgcgucaaucgccgcccguggcuacaucagcacccggguggaaaugggugaggcggccggcauauuuaugacggccacgccgcccgggucccgcgacccguucccacagagcaaugcccccauaaucgacgaggagcgggagaucccggagcgcuccuggaauaccggccacgaguggguuaccgacuucaaggggaagacggucugguucgugccaaguaucaaggcaggcaaugacaucgcggccugccugcgaaagaacggcaagaaggugauccagcugucccgcaaaaccuucgauagugaguacgugaagacccggaccaaugacugggacuucguggugacgaccgacaucuccgaaaugggggcuaauuucaaggccgagcgcguaaucgacccccggcgcuguaugaagcccguuauccuuaccgacggcgaggagcgggugaucuuagcggggcccaugccggucacccacagcuccgccgcacagcgccggggccgcaucgggcggaacccaaagaacgagaacgaccaguacaucuacaugggcgagccccuugagaacgacgaggauugcgcccacuggaaagaggcuaagaugcuccuagacaacaucaacacgccugagggcaucaucccgagcauguucgagcccgagcgugagaagguagacgcuaucgacggagaguaccggcugcgcggugaggcacgcaagaccuucguggaccucaugaggcgaggggaccugcccgucuggcuggccuacaagguagccgccgagggcaucaacuacgcggacagacgcuggugcuucgacgggauuaagaacaaccagauacucgaggaaaacgucgaggucgagauuuggaccaaggaaggcgagcggaagaaacuuaagccucgcuggcucgacgcccgcaucuacuccgacccccucgcgcugaaggaguucaaggaguucgccgccggccgcaagagccuaacccucaaucucaucacggagauggggcggcugcccaccuucaugacccagaagacccgcgacgcccucgacaauuuggccguauuacacacggccgaggccggcgggcgggcguacaaccacgcccucuccgagcugcccgagacccuggagacccuucugcuguuaacguuacuugccaccguuacgggcggaaucuuccucuuccugaugagcggacgcggcaucgggaaaaugacccugggcaugugcugcaucaucaccgccuccgugcuacucugguacgcccaaauccaaccgcacuggaucgcggccucgaucauucuugaguucuuccucauagugcuccuuaucccggagcccgaaaagcagcggacgccccaggacaaccagcucacguauguagugaucgcgauccugaccguagucgcggccaccauggcgaacgagaugggguuccuggagaaaaccaagaaggaccucggccugggcuccaucgcgacacagcagccggagagcaacauccuggacaucgaccuccgcccggccuccgccuggacccuguacgcaguggcgaccaccuuugugacgcccauguuacggcacagcauagagaacagcuccguuaacgucagccucacagccauagccaaucaggccaccguucugaugggguuagguaagggguggccccucuccaagauggauauuggcguuccgcuccuggcuaucgggugcuacagccagguuaaccccauaacccucacggcggcccugcugcuuuuaguggcccauuacgccaucaucggcccuggccugcaggcgaaagccacccgcgaggcgcagaagcgggccgccgcaggcaucaugaagaaccccaccgucgacggcaucaccgucaucgaccucgacccgauccccuacgacccgaaauucgagaaacagcugggccaggucaugcugcucauccugugcgucacccagguguuaaugaugcgcaccaccugggcccucugugaggcacugacucuggcaacgggccccaucuccaccuugugggaggggaacccgggcagauucuggaacaccaccaucgccgugaguauggcgaacauuuuccgcggcucuuaccucgcuggcgccggccuccucuucagcaucaugaaaaauacuacgaacaccaggagagggaccggcaacaucggcgagacccugggggagaaguggaagucgcgccugaacgcccucggcaagagcgaguuccagaccuauaagaaguccgggauucaggaagucgaucggacccuggccaaggaaggcaucaagagaggggaaacggaccaccacgcggugagccgaggguccgccaagcugcgcugguucguggagcggaacauggucacucccgagggcaaggugguggaccucgguugcggccgagggggcuggucuuauuacugcgggggccuuaagaacguccgggaggugaagggccugaccaagggcggaccggggcacgaggagcccaucccgauguccaccuauggcuggaacuuggugcgccuacagucgggggucgauguguucuuuaucccgcccgagaagugugauacccugcucugcgauaucggcgaguccagccccaauccgaccguggaagccggccgcacgcugcguguccugaaccucguggagaacuggcuaaacaacaacacccaguucugcauaaaggugcugaaccccuacaugcccagcgucaucgagaagauggaggcccugcagcggaaguacgggggcgcgcucgugcgcaacccgcugagccggaacuccacccaugagauguacugggugucuaacgccucggggaauaucgucucuucgguaaacaugaucucccgcaugcugaucaaccgauucaccaugcgccacaagaaggccacguacgagcccgacguggaccuagggagcgggaccagaaacaucggcaucgaauccgagauccccaaccuggacaucauuggcaagcgcaucgagaaaaucaaacaggaacaugagaccucguggcacuacgaccaagaccacccguauaagaccugggccuaccacggguccuacgaaacgaagcaaaccggcagcgccuccagcauggugaacggggucgugcggcugcucacaaagcccugggacguccugcccacggugacucagauggcgaugaccgacaccacccccuuuggccagcagcgcguguucaaggagaaagucgacacgcgcacccaggagccgaaggagggcacgaaaaagcugaugaagaucacggcggaguggcuguggaaggagcugggcaagaagaagacgccccggauguguacccgcgaggaguucacccggaaaguccgguccaacgcggcccugggagccaucuucaccgacgagaacaaguggaaguccgcgcgggaggcgguggaggacucgcgauucugggaacucgucgacaaggagcgaaaccugcaccuggaggggaaaugcgagacguguguguacaacaugaugggcaagcgugagaagaagcuaggggaguucggcaaggcuaagggcagccgggccauuugguacauguggcugggggcccgcuuccucgaguucgaggcgcucggcuuccuaaacgaggaccacugguuuucccgggagaacucacuguccggugucgaaggcgaggggcuacacaaacuugguuacauucugcgcgacguauccaagaaagagggcggggccauguacgccgacgacaccgccggcugggacacccggaucacccucgaggaucugaagaaugaggagaugguuacgaaccacauggagggcgagcauaagaagcuggcggaggcgaucuucaagcucacauaccagaacaaggucgugcgcgugcagcggcccacgccccggggcacugucauggacaucaucagcagacgcgaccagcggggguccgggcaaguaggaacguacgggcugaacacauucaccaauauggaagcccagcugaucaggcagauggagggcgaggggguauucaaaaacauccagcaccucaccgccacggaggaagucgccgugcagaacuggcuggcgcgagugggccgcgagcgccugagccggauggccaucuccggcgacgacugcguagugaagccuuuggacgaucgcuucgccaacgcccugacggcccugaacgacauggggaaaauccggaaggacauucaacaaugggagccgucaaagggcuggaacgacuggacccaggugcccuucugcucccaccacuuccacgagcucauuaugaaggacgggcgcguccugguggugcccugcaggaaccaggaugaacugaucggccgcgcgagaaucagccagggggccggcuggucuuuacgugagaccgccugucugggaaagagcuaugcccaaauguggucccugauguacuuucaccgccgcgaccuccgacuugccgcgaacgccauauguagcgccgucccuucccacugggucccgacaagucgcacuaccuggucuauccacgccaagcacgaguggaugaccacagaggacaugcugacgguuuggaaccgggucuggauccgcgagaacccauggauggaggacaagacucccguggagagcugggaagagauccccuacuuagggaaacgggaggaccaguggugcgguucccucaucggucugaccagccgcgcgacaugggcuaagaacauccaggcugccauaaaccaagugcggucccucauaggcaacgaggaguacacggacuacaugccuagcaugaaacgcuuccggcgcgaggaggaggaggccgggguccugugguga

SEQ ID NO: 24980 - RNA, 9876 nt, Artificial Sequence
  derived and/or modified CDS sequence (opt11) from DENV-2__FJ639718__SS-prME
uccgcuggcaugaucaucaugcugauccccaccgugauggccuuucauuugacaacacgcaauggggagccccacaugaucgucgguauccaggagaagggcaagucccugcuguucaagacagaggacgguguuaacauguguacccugauggccauggaccugggggagcugugcgaggacacuaucaccuauaagugccccuuacugcggcagaaugagcccgaagacaucgacugcuggugcaacagcacaagcaccugggugaccuacgggacgugcacuaccaccggugagcacaggcgagagaaacgcagcgucgcccuggucccucauguggggaugggccucgaaacccguaccgaaacauggauguccagcgaaggggccuggaaacaugcccagcgcaucgaaaccuggauacugcggcaucccggcuuuacgauaauggcagcgauccucgccuauaccaucggcaccacccacuuccaacggguucugaucuucauccugcugacggccgucgcccccuccaugaccaugcgauguaucggcauaucaaaccgcgacuucguggagggcgucaguggagggagcuggguagacauugugcucgaacacggguccugugucacgaccauggcgaagaauaagccuacgcuggacuucgagcugaucaagaccgaggccaagcagcccgccacccugagaaaguacugcaucgaggccaagcugacuaacaccacaacugagucgcgcugucccacccagggggagccuucccugaaggaagaacaagacaagcgguucgugugcaagcacuccaugguggaccgcggauggggaaacggcuguggauuauuugggaagggugggauugucacgugcgccauguuuacgugcaagaaaaacauggagggcaagaucgugcagcccgagaaccuggaguacacuauugugguaacuccccacagcggcgaggagcacgcgguugguaacgacacagggaaacacggcauggagaucaaggucaccccucagucuagcaucaccgaggcagaacugacuggguacggcaccgucacgauggagugcagcccgaggaccggcuuggacuucaacgagaugguucugcugcagauggagaacaaggccuggcucgugcacaggcagugguuucuggaccugccacuccccuggcuuccuggggccgacaaacaggaguccaacuggauccaaaaagagacacuggucaccuuuaagaacccccacgccaaaaagcaggacgugguagugcucggcagccaggagggugcaaugcacacggcccugacaggcgccaccgagauucagaugagcuccgggaaccuucuguuuaccgggcaccuaaagugccgguugaggauggacaaacuccaacugaaggguaugagcuacucuauguguaccggcaaauucaagguagucaaggagaucgccgagacccagcacggcaccaucgugaucagagugcaguaugagggggacggcagccccugcaagauccccuucgagaucauggaucuggaaaaacgcuacguccuuggccgguugaucaccgugaacccgaucguuacggagaaggacucgccagucaacaucgaggccgagccgccguucggggacagcuauaucauuauugggguagagccgggacaacucaaguuaaacugguucaagaagggcuccagcaucggacaaauguucgaaaccaccaugcgcggcgcgaagcgcauggcuauccucggcgacaccgccugggauuucgguagccuuggcgggguguucacgagcaucggcaaggcucuccaccaggucuucggagccaucuacggcgcggcguucuccggcgugucuuggaccaugaagaucuuaaucgggguuauaauaaccuggaucgguaugaacucccgaagcaccucacucagugugucguugguauuggucgggaucgugacccuguaccugggcgucauggugcaggcugacagcgggugcgugguauccuggaaaaacaaggagcuuaagugcggaaguggcaucuucaucacugacaacguucacaccuggaccgagcaguacaaguuccagcccgaaagccccuccaaauuagcaagcgcaauucagaaggcgcaggaggaggggaucugcggcaucaggagcguuacgaggcuggaaaaccucauguggaagcagauaacgcccgagcugaaucacauccuggccgagaacgaggugaagcucaccaucaugaccggggacauuaagggcaucaugcaggccggaaagcgcucgcugcggccgcagccuacugagcugaaguacuccuggaagacuuggggaaaggccaagaugcucucaacugaauccuacaaccaaacuuuccugaucgacgggccagagacggcggaaugucccaacaccaaccgcgccuggaauagccuggagguggaggacuacggguucggcguuuucaccaccaacaucuggcucaagcugaaggagaagcaggacgcauucugcgacuccaagcugaugagugccgccaucaaggacaaccgcgcugugcacgcagacaugggguacuggaucgagagugccuugaacgacacguggaaaauagagaaagccagcuucaucgaggugaagaacugccacuggccaaagucccacacgcuguggagcaacggcguccuggaguccgaaaugaucaucccgaagaaccuggcugguccuguaucacagcacaacuacagaccgggguaccacacgcagaucgcaggccccuggcaccuggggaaacuugagauggacuuugacuucugcgaugggacgacagugaucguuacggaggacugcggcaauaggggccccucccuccgcacgacuaccgccucgggcaaacucaucacggaguggugcugcaggagcuguacccuaccuccgcugagauaccgaggggaggacggcugcugguacgggauggagauccgcccccucaaggaaaaggaagaaaaccuggugaacucccucgugaccgcuggucauggucagguagacaauuuuagccugggggugcuagguauggccuuauuccuggaagaaaugcugcggacuagaguggggacgaagcacgcgauccuccuuguugcugucuccuucgugacccugaucaccgggaacaugagcuucaaagaccucgggcgcgucguggucauggucggagccacuauggccgaugauauagggaugggugugacguaccuggcguuacucgcggccuucaaggugcgccccacguucgccgccggccugcugcuccgaaagcugaccuccaaggagcucaugaugaccacuauuggaaucguccuccugagccagaguacuaucccagagaccgugcuggaacucacagacgccuuggcacugggcaugauggugcucaagauuguccguaacauggagaaguaucaguuagccgugacgaucauggccauccugugcgucccgaacgccgugauccuccaaaacgccuggaaggugagcugcaccauccuggccgucgugucagugagccccuugcuccucaccuccucgcaacagaagaccgacuggauccccuuggcucucacgauuaaggggcucaaucccaccgccaucuuucucaccaccuuaagccgcacgaacaaaaagcgcagcuggccgcugaacgaagccaucauggccgucggaauggucuccauacuagcaagcucccuccuaaagaacgacauacccaugacggguccccuggucgccggaggccuccugaccguaugcuacgugcugaccgggcgcagcgccgacuuggaguuggagaaagccaccgaugugaagugggaggaccaggcagagaucuccgggagcagcccuauccugucaauaaccaucuccgaggacggguccaugagcaucaagaacgaggaggaggagcagaccuuaaccauccuuauccgcacgggucugcucgugauuuccggccuguucccaaucucgauccccaucacagccgccgcgugguaccugugggaggugaagaagcaacgugccgguguacuuugggacguccccucgccgccgccuaugggcaaggcugaacuggaggacggggccuaccggaucaagcagaaagggauccuuggguacucgcagaucggggccggcguguauaaagagggcacguuccauaccauguggcaugugacucgcggugccguccucaugcauaaggggaagcggaucgagcccaguugggccgacgucaaaaaggaccuaauuagcuacggcgggggcuggaagcuggagggugaguggaaggagggugaggagguacaaguccucgcgcuggagccagguaagaaccccagggccguccagaccaagcccgggcuguucaagacuaacacaggcaccauaggggccgugaguuuggauuucaguccaggcacguccggcagcccgauuaucgacaagaaggggaaggucgugggccuguauggcaauggaguggucacacggagcggggccuacguaagcgccaucgcgcaaaccgagaaguccaucgaggauaauccugaaaucgaagacgacaucuuccgcaagagacgauugaccaucauggaccugcaucccggugccggcaaaacaaagcgguaccuccccgcgaucguuagggaagcuauaaagcgggggcugcgcaccuuaaucuuagcgccgacuagggucguggcugccgagauggaggaggcacugcgcggcuugccgauucgcuaccagacucccgcuauccgcgcggagcauacggggcgcgagauaguggaccucaugugccacgccaccuuuacaaugcggcuacucagccccgugcgggugccaaacuauaaccugauuaucauggacgaggcucacuuuacagaucccgcguccaucgccgcucggggcuacaucucaacgcgcguggagaugggcgaggccgccgggaucuucaugaccgccacgccuccaggcagccgggacccguucccucaguccaacgcccccaucaucgacgaggagcgcgagauccccgagcgcucguggaauagugggcacgagugggucacugacuucaagggcaagacggugugguuugugccgagcaucaaggccggaaacgacaucgccgccugccugcgcaaaaacggcaagaaggucauccagcucucccggaaaaccuucgacagugaauacgucaagaccaggaccaaugacugggacuucguggucacgaccgacaucucggagaugggcgccaacuucaaggcggaacgagugaucgacccccgccggugcaugaagccagugauccucaccgacggggaggagcgcgugauccuugcagggcccaugccugugacgcacagcuccgcugcccagcggagggggcggaucgggcgcaaucccaagaacgagaacgaccaguacauauacaugggcgagccccuggagaacgaugaggacugcgcccacuggaaggaggcgaaaauguuauuagacaacaucaauacacccgagggcaucaucccguccauguuugagccugagcgugagaagguggaugcuaucgacggcgaguaccgccugcgcggggaggcgcgaaaaaccuucgucgaccucaugcgccggggcgaccugcccgugugguuggccuacaagguggcugcggaggggaucaacuaugccgauagaagguggugcuuugacggaauaaagaacaaucaaauccucgaggagaacgucgagguggagauauggaccaaggagggggagcgcaagaaacugaagccgcgauggcuggacgcucgcaucuacucagaccccuuggcccugaaggaguuuaaggaguucgccgcaggccgcaagagucuuacucucaacuugaucaccgagaugggacgccuucccaccuuuaugacgcagaagacccgggacgcgcuagauaaucuggccguccugcacacagccgaggcaggcgggcgagcauacaaucacgcuuuauccgagcugccugagacacuagagaccuuguugcuacucacacuccuggccacagugacaggggguaucuuuuuguuccugaugagcggccggggcauugggaagaugacgcuggggauguguugcaucaucaccgccucgauccuacugugguacgcccagauccagccgcacuggaucgccgcauccaucauccuggaguucuuccucauuguccuguugaucccugaacccgagaaacaacguacuccccaagacaaccagcucaccuacgucguuaucgccauccugaccgucgucgccgcgaccauggccaacgagaugggauuccuggagaaaaccaaaaaggaccuugggcugggcagcaucgcuacgcaacagccugagagcaacauucuggacauagaucuccgacccgccagugccuggacucuuuaugcaguagcuaccaccuuugucacgcccaugcugcgccacagcaucgagaacagcucggucaacgugagccucaccgcaaucgcgaaccaggccaccgugcugaugggccugggaaagggcuggcccuuauccaagauggacaucggggucccgcugcuugcgauuggcugcuacagccaggugaaucccauuaccuuaacggccgcccugcugcuccugguugcccacuacgcgaucauagggcccgggcugcaggccaaggcaacccgggaggcucagaaaagggcggcggccgggaucaugaaaaaccccaccgucgacgggauuaccguuaucgaccucgacccgauccccuacgaccccaaguucgagaagcaacugggacaggugaugcugcucauccugugcgucacccaggugcugaugaugcggaccaccugggccuugugcgaggcccugacccuugccacggggccaaucuccacauuaugggagggcaacccagggcgcuucuggaacaccaccaucgcggugagcauggccaacaucuuccgugggagcuaucuugcgggggccgggcuccucuuuucaaucaugaagaauacgaccaacacccgcagggguaccgggaacauuggcgagacgcuuggugagaaguggaaaucgcgcuugaacgcccuaggcaagucggaguuccaaaucuauaagaaguccggcauccaggaaguagaccgcacccuggcgaaggaggggaucaagcguggagagacggaccaccacgccguuucucgagggagcgcgaagcuccggugguucguggaacguaacauggucacgcccgagggcaaaguuguagaccuaggcugugggcggggcggauggagcuacuacugcggcgggcuaaagaacgucagggaagugaagggccuaacgaaaggcgguccgggacacgaggagcccaucccuauguccaccuacggauggaaccucguccgccugcagagcggcgucgacgucuucuuuauuccgcccgagaagugcgauacccugcugugcgacaucggggagucuagccccaacccgacgguugaggccggccgcacacugcggguccuuaaucucguggagaacuggcugaacaacaacacccaguucugcaucaagguacugaaccccuauaugccuucagucauugagaagauggaagcgcugcaacgcaaguacgguggggcccucgugcggaacccguugagccgcaacagcacacacgagauguauuggguguccaacgccagcggcaacaucgucagcagugugaacaugaucucccggaugcugauuaaucgcuucacgaugcggcacaagaaggcgacguacgaaccugacguggaucuugggagcggcacaaggaauaucgggaucgaguccgagauccccaaucucgacaucaucggcaagagaaucgagaagaucaaagaggagcacgagaccagcuggcacuacgaccaggaucaccccuacaagaccugggccuaccacggcuccuacgagaccaagcaaacugggagcgcgucauccauggucaacgguguggugcgccugcucacgaaaccgugggacgucuuacccaccguaacgcagauggccaugacggacaccaccccauucgggcagcagcggguguucaaagagaaaguagacacacgaacgcaagagcccaaagagggcacgaagaagcugaugaagauaaccgccgaguggcucuggaaagaacucgguaagaagaagaccccaaggaugugcacgcgggaggaguucacccggaaggugcgcucgaaugcggcccuaggagcaaucuucaccgacgagaacaaguggaagucugcacgggaagcgguagaggauaacagauuuugggagcucgucgacaaggaacgcaacuugcaucuggagggcaagugcgagacaugcguguacaacaugauggggaagcgcgagaagaagcucggcgaguucgggaaggccaaggguucccgcgccaucugguacaugugguugggugcgcgguuucuggaguucgaggcucucggguuccugaaugaggaccacugguucagucgcgagaacucccugagcggcgucgagggggagggccuccacaagcugggguacauacuccgggacguguccaaaaaggagggcggcgccauguacgccgacgacacggcggguugggacaccagaaucacccuggaagaccugaagaacgaggagauggugaccaaccacauggagggcgagcacaagaaacuugcugaggcaaucuucaaguugacguaucagaacaagguugugcgggugcagcgcccuacgccucgugggacggucauggacaucaucagccgccgggaccagcggggcuccggccagguggguacuuacggccugaacacauucacaaacauggaggcucagcugauccgacagauggaaggggagggcguuuucaagaacauacagcaccucacggucaccgaggaggcagccgugcagaauuggcuggcccguguggggcgggagcgccugucacgcauggccauuagcggcgacgauugugucgugaaaccucucgacgaccgguucgccaacgcccuuacggcgcuuaacgacaugggcaaaaucagaaaggacauccagcagugggaaccgucaaagggcuggaacgacuggacucaggugcccuucugcagccaccacuuccacgagcuagucaugaaggacggccgagugcugguggucccaugccguaaccaggacgaguuaaucgggcgggcucgcaucucacaaggcgccggguggagccuccgggagaccgccugccugggcaaauccuacgcccagauguggagccugauguacuuccacaggcgggaucuucgccuggcggcuaacgccaucugcuccgccguucccagccacugggugccgacaagucgcacgaccuggucuauccacgcgaaacaugaguggaugaccaccgaagacaugcugacugucuggaaccgcguguggauccgcgaaaaccccuggauggaggacaagacuccgguggagucuugggaggaaaucccauaccucggcaaacgcgaggaccaauggugcggcagccugauaggcuuaacgucccgcgcgaccugggccaagaacauccaggcagccaucaaccagguccgcagccuaauugggaacgaggaguacaccgauuacaugccguccaugaagcgguuccgccgggaggaggaggaggcgggcgugcugugguga

SEQ ID NO: 24981 - RNA, 9876 nt, Artificial Sequence
  derived and/or modified CDS sequence (opt11) from DENV-2__GQ868625__SS-prME
ucugcggggaugaucaucaugcugauccccacggugauggccuuucacuugaccacgcgcaacggggagccccacaugaucguugggauccaggagaaggggaagucccugcuguucaagaccgaggacggcgugaacaugugcacccucauggcgauggaucugggggagcuuugcgaggacaccaucaccuacaaaugccccuuacugcggcagaacgagcccgaggacaucgacugcuggugcaacuccacaucaaccugggugaccuaugggacgugcaccacaaccggcgaacaucgccgggagaagcgcagcgucgccuuggucccccacguggggaugggcuuagagaccagaaccgaaacguggaugagcucugagggcgcuuggaagcacgcucagcgcauagagaccuggauccuccggcacccgggauucacgaucauggccgcgauccuugccuacaccaucgggaccacccacuuccaacgcguucucauuuucauccugcugacagccguagcgcccuccaugacaaugcggugcaucggaauaagcaaccgcgauuucguggaaggcgucuccgggggcucguggguggacaucgugcucgagcaugggagcugcgucacgaccauggccaagaacaagcccacucuagacuucgagcugaucaagacagaggcaaaacagccugccacgcuccggaaauacugcaucgaggcgaaauuaaccaacacgacaacggagagccgaugccccacccagggcgagcccucacugaaggaagagcaggauaagcgauucguuugcaagcauagcaugguggacaggggcugggggaacggcugcggccuguucggcaagggcgggaucgucacaugcgcgauguuuacgugcaaaaagaacauggagggcaagaucgugcagccagagaaucuggaguauacuaucguggucacgccacauuccggagaggagcaugcgguggggaacgacacgggcaagcauggcauggagaucaaggucaccccacagucuuccauuaccgaggcagaacugaccggcuacggcacugugacgauggaaugcagccccagaaccggccucgacuucaaugaaauggucuuauuacaaauggagaauaaggccuggcucgugcaccgccagugguuccuggaccugccccuccccuggcugccgggggccgacaagcaagaguccaacuggauccagaaggagaccuuggucaccuucaagaacccucacgccaagaagcaggacguggucguguugggcagccaggagggggcgaugcacacugcccugaccggcgccaccgagauacagauguccuccgguaaccuccuguucacgggacaccugaagugccggcuucgcauggacaagcuccaacugaagggcaugagcuacaguaugugcacggggaaguucaagguggucaaggagaucgccgagacacagcacggcaccaucgugauccgggugcaguacgagggugacgggaguccuugcaagauccccuucgagauaauggaccucgagaagcgguauguacucggccgccucaucacagugaauccgaucgugacggagaaggacucccccgucaacaucgaggccgagccgcccuucggagacagcuauaucaucaucggcguggagccggggcagcugaagcucaauugguucaaaaagggaucgagcaucgggcgcauguucgagacaaccaugaggggugcgaaaaggauggccauccugggcgacacggcgugggacuucggaucacugggcgggguguucacgagcaucgguaaggcccuccaccagguauucggggccauuuacggcgcagccuucagcggcgugagcuggaccaugaagauacugauuggggugaucauaaccuggaucggcaugaacucccgcagcaccucccugagcgucucccugguauuaguggguauugucacgcuguaccugggcgucauggugcaggccgacucaggguguguuguguccuggaagaacaaggagcuaaagugcggcagcggcaucuucaucaccgacaacgugcauaccuggaccgagcaguacaaauuccagccugagucccccuccaagcuggccucugcaauccagaaagcgcaggaggaggggaucugcggcaucagguccgugacgcgccuggagaaccuaauguggaagcagaucacccccgagcugaaccauauacuggccgagaacgaaguuaagcuuaccaucaugaccggggacaucaagggcaucaugcaagcagggaaacgcagucuaaggccacagcccacggagcugaaguacuccuggaaaaccuggggcaaggcaaagaugcucagcaccgaguccuacaaccagaccuuccugaucgauggccccgagacggcggagugccccaacaccaacagggcauggaacagccuggagguggaagacuacggauuuggcguuuuuaccaccaacaucuggcucaagcuaaaggaaaagcaggaugccuucugcgacuccaagcugaugucggccgcuauaaaggacaaccgcgcgguccacgccgacaugggauacuggauugaguccgcccucaaugacacguggaagaucgagaaggccagcuucaucgaggugaagaacugccacuggccaaagucccacacgcuguggaguaauggcguccuggaguccgagaugauaauccccaagaaccucgccggcccugucagccagcacaauuaucggccgggguaccacacccagauugcgggucccuggcaccuaggaaagcuggaaauggacuucgacuucugugacggaacgaccgucaucgucaccgaggacugugggaaccguggccccaguuugcggaccaccaccgccagcggcaaacugaucacggaguggugcugccgaagcugcacccugcccccgcuccgguacagaggggaagauggcuguugguacggcauggagauccggccccugaaggagaaggaggaaaaccuggugaacucucucgugaccgccggccacggucaagucgauaacuucucgcugggcguucuaggaauggcccucuuucuggaggagaugcugcgcacccgggucgggacgaagcacgcgauccuacuagucgccguuuccuucgugacgcugaucaccggcaacaugagcuucaaagaccuggggagggucguggugaugguuggcgccaccauggccgacgauaucgguaugggcguaacguaucuggcccugcucgcugcauucaagguucggcccaccuuugccgccggccuucuccuccgcaagcugaccucaaaggagcuuaugaugacaacgauugggaucguccucuugagccaguccaccauucccgagacggugcuggagcucaccgaugcccuggcgcuggggaugaugguacucaagauaguccgcaacauggagaaguaucaacuggccgugacgaucauggccauucucugcguuccgaacgccgucauucuccaaaacgccuggaaagugucgugcaccauccucgcggucguguccgucagcccccugcuacugacauccagccagcagaagaccgauuggaucccgcuggcgcucacuaucaaggggcuuaacccaaccgcaaucuuccugaccaccuuauccaggacaaacaagaagcgcuccuggccgcugaacgaggccauaauggcgguuggaaugguuuccauacuggccagcucgcuccugaaaaacgacaucccgaugaccggcccccugguggccggggguuuacuuaccguaugcuacgugcuaacugggcgguccgccgaccucgagcuggagcgcgccaccgacgugaagugggaggaccaggcggagaucuccggcagcagccccauccucuccauuaccauaagcgaagacggcucaaugagcaucaagaacgaggaagaagagcagacccucaccauuuugauccggacuggcuuacucgucaucuccggcuuguucccgaucucuaucccgaucaccgccgccgccugguaccugugggaggugaagaagcaacgcgccggggugcucugggacgucccuagcccuccgcccauggggaaggcggagcuggaagacggggccuaccggaucaaacagaagggcauccugggguacagccagaucggagccggcgucuacaaggaggggaccuuccacacgauguggcacgucacccgcggugcaguccucaugcacaagggcaagcggaucgagcccagcugggccgaugugaagaaggaccuuaucucguacggcggggguuggaagcuggagggcgaguggaaggagggggaggagguccaggugcucgcgcuggagcccggcaagaaccccagggccguccagacuaagccuggacuguucaagaccaacaccggcacuaucggcgccgugucccucgacuucucgcccggaacgucgggaagcccuaucaucgauaagaaggggaaggucguaggacucuaugguaacggaguggucacccgcuccggcgcauacgugucugccaucgcgcagaccgagaaguccauagaggacaaccccgagaucgaggaugacauauuccgcaagaggcgccugaccaucauggaccugcaccccggagccggcaagacgaagcgguacuugcccgccaucgugcgcgaggccaucaagcggggacuacgcacccugaucuuagcgccgacccgggucguggcugccgagauggaggaggccuugcgaggccugcccauccgguaucagacccccgcaauccgcgcggagcacacgggacgcgaaaucguggaccucaugugccacgccaccuucaccaugcgccugcugagccccguuagagugccgaacuacaaucuuauaaucauggacgaggcacacuuuaccgauccagcguccaucgcugcaaggggcuacaucuccacgcgcguggagaugggugaagcggccggcaucuucaugacugcgacgccgcccggcucgcgggacccguucccccagucaaacgcgcccauaaucgacgaggaaagagagaucccugagcggagcuggaauuccggacacgagugggucaccgauuuuaagggcaagacggugugguucgugccuucaauuaaagcggggaacgauauugccgccugccugagaaagaacggcaagaaagucauccagcugucccggaagaccuucgauagcgaguacguaaagacccguacaaacgacugggacuucguggucacgaccgacaucuccgagaugggagccaacuucaaggccgagcggguaaucgacccccgcaggugcaugaagcccgugauuuuaaccgauggggaggaacgcgucauccuggccgggcccaugccggugacccacagcuccgcagcacagcggcgggggcggauaggccguaacccgaagaacgagaaugaccaguacauauacaugggggagccucuggaaaacgacgaagauugcgcccacuggaaggaagccaagaugcuccuggacaauaucaauacgcccgaggggaucaucccauccauguucgagcccgaaagagagaagguggacgccaucgacggggaguaucgcuugcgcggggaggcccggaagacguucgucgaccucaugcgccgcggcgaccugcccguguggcuggccuacaagguggccgcggaagggaucaacuaugccgaccgccgguggugcuucgacggcaucaaaaauaaccagauacucgaggagaauguagagguggagaucuggaccaaagagggggagcgcaagaagcuaaagccgagauggcuagacgcccguaucuacucugaucccuuggcacucaaggaauucaaggaguucgccgcgggaagaaagucucucacauugaaccugaucacggagaugggccgccugccaaccuucaugacccagaagacccgggacgcguuagacaaccuggccguacugcauaccgccgaagccggcgggcgcgcuuacaaccacgcucuaagugagcugccggagacccuggagacccuccuuuuauugacccugcuggccacggugaccgggggcaucuuccucuuuuuaaugagcggccgggggaucggcaagaugacccuggggauguguugcaucaucacagcauccauccuccugugguacgcgcagauccagccgcacuggaucgccgcgagcauaauucuggaguucuuccucaucgugcugcugauucccgagccugagaagcagcgcacuccgcaggauaaucagcucacuuacgucgugauugccauccucaccgugguggccgcgacgauggccaacgagaugggcuuccuggagaagacgaagaaggaucucgggcugggcuccaucgccacacagcagccggaaagcaacauacuggacaucgacuugcgucccgccuccgccuggacgcuguaugcaguggccaccaccuuugugacgcccaugcugcgacacucuaucgaaaacagcuccgucaaugugagccuaaccgcgaucgccaaccaggccaccguguuaaugggucuggggaagggcuggccccuauccaaaauggacauuggggucccgcuccuggcgauuggcugcuacagccagguuaaccccauaacccuaacggcagcccuguugcuccuggucgcacacuacgcgaucaucgggcccggacugcaggcuaaggccacccgggaggcucaaaaacgcgccgcggccgguaucaugaaaaaccccacuguagacgggaucacugucaucgaucucgacccgaucccguacgacccgaaguucgagaagcagcugggccaagucaugcuucucauccugugugucacccaggugcugaugaugcgcaccacaugggcccucugugaggccuugaccuuagcgacgggucccaucuccacccuuugggaaggcaacccggggagguuuuggaacaccaccauagcgguuagcauggccaacaucuuccgcggcaguuaccuggcaggcgcgggacuccucuucuccaucaugaagaacacgacgaacacgaggcgcggcaccggaaauauaggugagacgcugggggagaaauggaagucccggcugaaugcccucggcaagucagaguuccagaucuacaaaaaaucaggcauccaggaggucgaucgcacccuggcgaaggagggaaucaagcggggggagacggaccaucaugccgugagccgcgggagugccaagcugcggugguucguggagcggaacauggucacaccagaggguaaggugguugaccuaggcugcggcagaggcggguggucuuauuacugcggcgggcuaaaaaacguccgcgagguuaagggacugacaaaaggcgggccuggccaugaggagcccauccccaugucuaccuacggguggaaccucgugcggcugcagagcggcguagacguguucuucaucccgccagagaagugcgacacacugcucugcgauaucggggaguccagucccaacccgacgguggaggccgggagaacgcugcguguccugaaccucgucgaaaacuggcugaacaauaacacccaguucuguaucaaggugcugaaucccuacaugcccucggucaucgagaagauggaggcgcugcaacggaaguauggcggugccuuggugcguaacccucugucccguaauucuacacacgagauguacuggguuuccaacgccagcgggaacaucguuuccucugugaacaugauaagucgaaugcugaucaaccgcuuuaccaugcggcacaagaaggccacguacgagccagacguugaccucgggagcggaacgcgcaacaucggcauagaguccgagaucccaaaccuggacauuauaggcaaacggaucgagaagaucaaggaggagcaugagaccaguuggcauuacgaccaggaucacccuuacaagaccugggcauaccacggcucguacgagacgaaacagacggggagcgcgaguagcauggucaacggcguuguccgccugcucaccaagccuugggacguccuacccaccgugacccagauggccaugacggacacuacccccuucgggcagcagcgcguguuuaaggagaaggucgacacccggacgcaggagcccaaggagggcacgaagaaacugaugaaaauuaccgccgaauggcucuggaaagagcugggcaagaagaagacuccgcgcaugugcacucgggaggaguucaccaggaaggugcgcuccaacgccgcgcugggcgccauauucaccgacgagaacaaguggaagagugcccgggaggccguggaggacucccgguucugggagcucgucgacaaagagcgcaaccugcaucuggagggcaagugcgagaccugcguguacaacaugauggggaagcgggagaaaaagcugggcgaguucgguaaggccaagggcagucgcgcgaucugguacauguggcugggcgcucgguuucuggaguucgaggcgcuaggguuccuaaaugaagaccacugguucucccgcgagaacagccugucuggugucgagggggagggccugcacaagcugggguacauccugcgggacgugucgaagaaggaaggcggcgcaauguacgccgaugauaccgcaggcugggacaccaggauuacgcuugaggaccugaagaacgaggagaugguaaccaaucacauggagggggagcauaaaaagcuggccgaggccaucuucaagcucacguaucagaacaaagucguccgggugcagcgaccuacgccccgggggaccguaauggacauaaucagccgccgggaccagcgcggcucugggcaggugggaaccuacgggcuuaacacguucaccaacauggaggcccagcugauccggcagauggagggggagggcguguucaagaauauccagcaccuaaccgucaccgaggaggccgcagugcaaaacuggcuagcccggguggggcgcgagcggcugagccgcauggccaucagcggcgacgacugcgucgugaagccacucgacgaccgguuugcaaacgcccugacugcgcugaaugacaugggcaagauccgcaaggauauccagcaaugggagccgaguaagggguggaacgacuggacgcaagugcccuuuugcagucaccauuuucacgaguuagucaugaaggauggcagggugcuggugguccccugccgcaaccaggacgagcucaucgggcgggcacgcaucucccagggagccggguggucccuccgggagaccgcaugccugggcaagagcuacgcccagauguggucccugauguacuuccaccgccgggaccuccggcuagcggccaaugcaaucugcagcgccgugcccagccacugggugccgacuagccggacgaccugguccauacacgccaagcacgaguggaugaccaccgaggauaugcugaccgucuggaaccgcguguggauccgggagaauccuuggauggaagacaagacgcccgucgagucgugggaagagauccccuaccucggcaaacgcgaagaccaguggugcgggucccugauaggccucaccucucgggcgaccugggccaagaacauccaggccgccauuaaccagguacgcucccuaaucgggaacgaggaguacaccgacuacaugccgagcaugaagcgguucaggcgcgaggaggaggaggcuggcguucuuugguag

SEQ ID NO: 24982 - RNA, 9876 nt, Artificial Sequence
  derived and/or modified CDS sequence (opt11) from DENV-2__KF955401__SS-prME
agcgccgggaugaucauuauguuaauccccaccguuauggcuuuccacuugacgacccgcaauggggagccccacaugauuguagggauucaggagaaagguaagagccuccuguucaagaccgaagacgggguaaacaugugcacccucauggcgauggaccugggggagcugugcgaagauacuaucacuuacaaaugcccccuccugcgucagaacgaaccggaggacauagacugcuggugcaacaguaccucaacauggguuaccuacgggacuuguaccacgaccggagaacaccgaagggagaagcgcagcguggccuuagugccccaugucgggaugggccucgagacacggaccgagacguggauguccuccgaaggggccuggaaacacgcccaacgcaucgagacauggauccugagacaccccggcuucacuaucauggccgcgaucuuggccuacaccauagggaccacccauuuccagcgcguccucauuuuuauccugcugacagccguggcccccaguaugaccaugcggugcauagguauaagcaaccgcgauuucguggagggcgucuccggcggcucuuggguugauauugugcucgaacacgguuccugugucacgaccauggcaaagaacaagcccacuuuagacuuugagcugaucaagaccgaggccaagcagcccgcuacccugcggaaguacugcauagaggccaagcugaccaacacgacgaccgagucgcggugucccacacagggggagccguccuugaaggaggagcaggacaagagguucgugugcaagcacagcaugguggaccgcgggugggggaauggcugcggccuguucgguaagggcgggauagucacgugugcaauguucacgugcaagaaaaauauggagggcaagaucgugcagccagagaaccuggaguacacgaucguggugacgccccauuccggcgaggaacacgcggugggaaacgacaccgggaagcacggcauggagaucaaggugaccccacaaucguccaucaccgaagcagaguugacaggcuacggcaccgucacgauggagugcagcccccggacuggguuagacuucaaugaaauggugcuucugcaaauggagaacaaggcguggcucguucauagacagugguuccuggaccugccacugcccuggcucccaggggccgacaagcaggaguccaacuggauccagaaagaaacccuugugacguucaaaaacccccacgcaaagaagcaagauguugucguacucggcagccaggagggcgcaaugcacacggcacucaccggagccacggaaauucaaaugaguuccgggaacuugcuguucacuggccaccuaaaguguaggcugcgcauggacaaacuacaacugaaggggaugucauacagcaugugcacggggaaauucaaaguagucaaggagaucgcggagacucagcacggcacgaucgugauucgggugcaguaugagggggauggcagccccugcaagauccccuucgaaauaauggaccuggagaagagauacguacucggcagacugauaaccgugaacccgauugugacggagaaggauucccccgucaacauagaggccgagccgcccuucggggauagcuacaucauaauaggaguggagccgggacagcugaagcucaacugguucaagaagggcuccucgaucgggcagauguucgagacuaccaugcguggggcgaaacgcauggccauauugggcgacaccgcuugggacuucgggagucuaggagggguguucacgagcaucggcaaggcccuccaccaggucuuuggggccaucuacggcguagcguucuccggcgugagcuggacaaugaaaauccugaucgggguaauaaucacguggaucggcaugaacucgcggucaacgucccugagcguuucccugguucucguggggaucgugacacuguaccugggaguaauggugcaggccgauagcggcugcguaguaucguggaagaacaaggagcucaagugcggcuccggcaucuuuaucaccgacaacguccacaccuggacggaacaguacaaauuccagcccgagagucccuccaagcuggcgagcgccauccagaaggcgcaggaggaagggaucuguggcauccgcuccgugacgcgccuggagaaccugauguggaagcagaucacgcccgagcugaaucacauacuggcagaaaacgaggugaaguugaccauuaugacgggcgacaucaagggcaucaugcaagccgggaagagaucgcugcggccccagccuacugagcugaaguacuccuggaagacgugggggaaggcgaaaaugcuauucacggagagcuacaaucaaacuuuccugauagauggacccgagaccgcugaguguccgaacacaaaccgggcguggaacucccuagaggucgaggauuacggguucggaguguucacuaccaauaucuggcuaaaauuaaaggaaaagcaggacgcauuuugcgauagcaagcugauguccgccgccaucaaggacaaucgggcggugcacgccgacaugggcuacuggaucgagagcgcccuuaacgacacguggaagaucgagaaggcguccuucaucgaaguuaaaaacugccacuggcccaagagccauaccuuaugguccaacggcgugcuggagagcgaaaugaucaucccgaaaaaccucgccggccccgugucccagcacaacuaucggccagguuaucacacccaaauagccggccccuggcaccuagguaagcuggaaauggacuucgauuucugcgauggcacgaccgugauagugacggaggacugcggaaaccggggacccucuuugcgcaccaccaccgcguccggcaagcugauaacggagugguguugucgaagcugcacucugcccccucuccgguaccgaggcgaggacggcugcugguacggcauggaaaucagaccccucaaagagaaggaggagaaccugguaaauagccugguuaccgccggccacggccaaguggacaacuucucccuaggcguguugggcauggcguuauuccuggaggagaugcugcgcacccgcgucggaacuaagcacgccauccuccugguagccgucagcuucgucacuuuaauaaccggaaauaugucuuucaaagaucucgggagaguggugguuauggucggugccaccauggccgacgacauugggaugggagugacuuaccuggccuuacucgccgcguucaaaguucggcccaccuucgccgccggucuccugcucaggaaacugaccagcaaggagcuuaugaugaccacgaucgggauagugcuccugucccagagcaccauccccgagaccgugcuggagcucaccgacgcacucgcccuaggcaugauggugcucaagaucguccguaacauggagaaguaccagcuggcggucacgaucauggccauccugugcguuccgaacgccgugauccuccagaaugcauggaaagucuccugcacuaucuuggccguagugucuguaagcccccuccuccugacuuccucacagcagaaaaccgacuggaucccccuggcgcucacaauuaagggucugaacccgaccgccaucuuccuaaccacccucagccgcacaaacaagaaacgguccuggccgcugaacgaggcuaucauggccgucggaauggugucuauauuggcguccagccuccugaagaacgacauccccaugacaggcccccugguagcugggggacuccucaccgugugcuacgugcugaccgggcgauccgcugaucuggaguuggagcgggccaccgacgucaagugggaggaccaggccgagaucucuggcuccucccccauccugagcaucaccaucuccgaggaugggucaauguccaucaagaacgaagaagaggaacaaacccucaccauccucauccgcacuggccuccucgucaucucgggucuuuucccuauuaguauucccaucacggcggcagccugguaccuaugggaggugaagaagcagcgggccgggguccucugggaugugccaagcccgccgccgaugggaaaggccgagcuggaggauggugcguaucguaucaaacagaaggggauccuagguuauucucagaucggcgccggcguguacaaggaggggaccuuucacaccauguggcacguaacacggggcgccguacugaugcacaaggggaagcgcaucgaacccaguugggccgauguuaagaaagaucugaucucauacggcgggggauggaagcuggagggcgaguggaaggagggggaggagguccaggugcucgcccuggagcccggcaagaaccccagagcgguccaaacgaaacccggguuguucaagacgaacaccgggaccauuggcgccguuagccucgacuucuccccaggcaccagugguucccccaucaucgacaagaaggggaaggugguuggcuuauaugggaacggagucgugaccagaucgggggcuuacguguccgcuauagcccagaccgagaaguccaucgaagacaaccccgagauugaggacgacaucuuccgcaagcgacggcugaccaucauggaccuucaccccggcgcgggcaagacaaagcgauaccuacccgccaucguccgugaggccauuaagcgcgggcugcggacccugauacucgcccccacucgcguggucgcggcggagauggaagaggcccugcgcgggcuuccaauccgcuaccagacccccgccauccgagcggaacacacaggcagggagaucgucgacuuaaugugccacgccacauuuacaaugaggcugcugucccccgugcggguaccgaacuauaaccucauaaucauggacgaggcccacuuuaccgaucccgccagcauugccgcccgcggcuacaucagcacgcggguggagaugggcgaggcggccggaaucuucaugacugcaacuccgcccggcagucgugacccuuucccccaaagcaacgcuccgaucaucgacgaggagagggaaauacccgagagguccuggaacagcgggcacgagugggugaccgacuucaagggaaaaaccgugugguucgucccguccaucaaggccggaaacgauauugccgccugccuucggaaaaacggcaagaaaguaauccagcugagccgcaagaccuuugacagcgaguacgucaagacacggacuaacgacugggauuucgucgucacgaccgacaucucugaaaugggggcaaacuucaaggcggagcggguaaucgacccccggcgcuguaugaaacccgucauccugaccgacggggaggaacgggugauccuggccggccccaugccggugacccacagcagcgccgcccaaagacgcgggcgaauaggccggaaccccaagaaugagaacgaccaauacaucuauaugggggagccccuggagaacgacgaagacugcgcccacuggaaggaggccaagaugcuccuggacaacauuaacacgcccgaaggcaucaucccuucgauguucgagcccgagcgcgagaagguugacgcgaucgacggcgaguaccggcugcgcggggaagcccgcaagaccuucguggaccugaugcggcgcggcgaucuucccguguggcuggcauauaagguggccgccgagggaaucaacuaugcggacaggagauggugcuucgacgguaucaagaacaaccagauccucgaggaaaacgucgagguagaaaucuggacgaaggagggugagcggaagaaacugaagccacgcuggcuggacgccaggaucuacagcgaccccuuggcccugaaagaguuuaaggaguucgcagcugggcgcaaaagucugacccucaaccucaucacggagaugggccggcugcccaccuuuaugacccagaagacgcgugaugcguuagauaaccuagccguacugcacacggccgaggcugggggccgggcguacaaccacgcgcucagcgagcugcccgagacauuagagaccuugcuguugcuaacccugcuugccacggugacaggggguaucuuccucuuccuaaugucaggccgcgggaucggcaagaugacccuggggaugugcuguaucaucacagccagcauacuccugugguacgcccagauccagccgcauuggaucgcggccagcauuauccucgaguuuuuccuuauuguccugcugauccccgagcccgagaagcagcggacgccccaggacaaucagcucacguacgugguuaucgccauucucaccgucguggcggccacgauggccaacgagauggguuuucuggaaaagacaaagaaggaccucggucugggcagcaucgccacacagcagccggagucgaacauccuagauaucgaccuccgccccgccagcgcauggacccuauacgccguggccaccaccuucgugacaccgauguugagacauuccaucgagaacagcucggugaauguuucccucacagccaucgccaaccaggccaccguucugaugggccuugggaaggguuggccgcuaagcaagauggacaucggugugccguugcuggccaucggcugcuacucccaagugaacccgauuacccucacggcugccuugcuucuccuggucgcccacuacgccaucauugggccuggccuucaggcuaaggccacccgagaggcacagaagagggcugccgcgggcaucaugaagaaccccaccguggacgggaucacggugaucgacuuggacccgauccccuacgacccaaaguucgaaaagcagcuggggcaggucauguugcuuauccuaugcgugacccagguauugaugaugcgcaccacgugggcauugugcgaggcccuuacgcuagcgacggggcccaucagcacccucugggagggaaauccggggcgguucuggaacaccacgaucgcggucuccauggcuaacaucuuccgggguagcuaucuggcgggcgcagggcuucucuucuccaucaugaaaaacaccacuaacacccggcgcggaacugggaacaucggcgagacguugggagaaaaauggaagucuaggcugaacgcccucggcaaguccgaguuccagaucuauaaaaaguccgguauucaggagguggaucggacucuggcaaaggaggggaucaagcgaggcgagacggaccaccacgccgugucccgggggucugcaaagcugagaugguucgucgaacggaauauggucacccccgaaggcaagguuguagaccucggcugugggcguggcgggugguccuacuacuguggagggcugaaaaacguacgggaggugaagggucugacuaagggcggcccuggccacgaggaacccauuccgaugagcaccuacggguggaaccucguccgucugcaguccggcguggacguguuuuucaucccgcccgaaaagugcgacaccuuguugugcgauaucggagaaagcucccccaauccgacaguagaagccggccgaacguugcgaguccugaaccucgucgagaauuggcugaacaauaacacgcaguuuugcauuaaaguccugaaccccuauaugcccagcguaaucgagaagauggaggcgcuccaacggaaauacggaggggcgcucgugcgcaauccgcuaucuaggaacucuacccacgagauguacugggucagcaacgccuccggcaacauagugagcuccgugaacaugaucucacgaaugcugaucaacagauuuaccaugcggcauaaaaaggccaccuacgaaccggacgucgaucucggguccggaacucggaacaucgggauugaaagcgagaccccuaaccuggacaucaucggcaagcgcauagagaagauaaaggaggagcaugagacguccuggcauuacgaucaagaccaucccuacaaaacgugggccuaucacggcagcuacgagaccaaacaaacgggauccgccagcuccaugguuaacggcgugguccggcuucucaccaagccgugggauguucugccuaccguuacacagauggcgaugaccgauacgaccccuuucggucagcagagaguuuucaaggaaaagguggacacgcgcacccaggagcccaaagaggggaccaagaagcuaaugaagaucaccgccgaguggcucuggaaggaguuaggcaagaagaagaccccacggaugugcaccagagaggaguucacccggaaggugcgcagcaacgcagcccuaggggcaaucuuuacagaugagaacaaguggaaaagcgcgagggaagcaguggaagauagccgcuucugggagcucguggacaaggagcggaaccugcacuuagaagggaaaugcgaaacgugcgucuacaauaugauggggaaacgcgaaaagaagcucggggaguucgggaaggccaagggcagucgggcuauaugguacauguggcugggugcccgcuuucuagaguucgaggcgcucggguucuugaaugaagaccacugguucaguagagaaaacucccuguccggcguagagggggagggcuuacacaaacuuggcuauauccugcgagacgugaguaaaaaggagggcggcgcaauguacgcggacgacaccgccgggugggauaccagaaucacccucgaggaccugaagaacgaggagauggucacgaaccacauggaaggggagcacaagaagcuagcggaggccaucuuuaagcucacauaccagaacaaggucgugcgcguccagcggccgacgccccgcggaaccgugauggacauaaucagucggcgagaucagcggggaucgggccagguggggacguauggauugaacacuuucaccaacauggaggcgcaguugauucgccagauggagggugaaggagucuucaagaacauucaacaccucaccgugacagaggaggccgcggugcaaaacuggcuggcuagggucgggagagaacgccugucccguauggcaaucucuggugaugacugcgucgugaagccccuagacgaccgcuucgccaacgcccugacggcccuuaacgacaugggcaagauccggaaggauauccagcagugggagccgucaaagggcuggaacgacuggacucagguccccuuuugcucucaccauuuccacgaacucaucaugaaggauggccguguguugguggucccaugcaggaaccaggacgaacugauugggcgcgcgcgcauaucgcagggcgcaggguggagccuccgcgagaccgcuugccugggaaagucguacgcccagauguggagccugauguacuuccaucggcgcgaccuccgacuagcugccaaugcuaucugcuccgcagucccuagccauugggugccgacuucacgcaccaccuggaguauccacgccaagcacgaauggaugaccaccgaggacaugcugacuguuuggaaucggguguggauacgcgagaacccauggauggaagacaaaacccccguggagaguugggaggagaucccguaucugggcaagcgggaggaccaguggugcgggagccugaucggccugaccagucgcgcgaccugggcaaagaauauacaagccgccauaaaccaaguccggagucucaucgggaaugaggaguacacagacuacaugcccuccaugaagagguucagaagggaagaggaggaggcaggcguuuuaugguga

SEQ ID NO: 24983 - RNA, 9876 nt, Artificial Sequence
  derived and/or modified CDS sequence (opt11) from DENV-2__JF730047__SS-prME
agcgcaggaaugaucaucaugcugauccccacggugauggcauuccaccucaccacccgcaacggggagccccacaugaucguggguauccaggagaagggcaagagccugcuguucaagaccgaggacggcgugaacaugugcacccucauggcgauggaccugggugagcugugcgaggacaccauaaccuauaagugcccccuccugcggcaaaacgaacccgaagacaucgacugcugguguaauucaacgagcaccugggugaccuacgggaccugcaccacaacuggugagcaccgccgggagaagcgcuccguggcgcuugugccacacguggggaugggacuggagacccgcaccgaaaccuggauguccagcgagggggccuggaagcacgcucaacguauagagaccuggauucugcggcauccaggcuucaccaucauggccgcgauacuggccuauacgaucgguaccacacauuuccagcgagcccucaucuucauccugcugaccgccguugcgccuuccaugaccaugcgguguaucggaauuucaaaucgcgacuucguagagggaguuucggggggcucauggguugacaucguacucgagcacgggucgugcgugaccaccauggcuaagaacaagcccacgcuagauuucgagcugaucaagacugaggccaagcagcccgccaccuugcggaaguauuguaucgaggccaagcugacaaauacgaccacggagagccgcugccccacccaaggcgagcccucacugaaggaagagcaagacaaacgcuucgucugcaagcacucuaugguggaccgaggcugggggaauggcugcggucuguuuggcaaggggggcaucgugaccugugcgauguucacgugcaagaaaaacauggagggcaagauaguccaaccugagaaccuugaguacacaaucguggugaccccccacuccggagaggagcacgccgucggcaacgauacggguaagcacggcaaggaaauaaagguaacuccgcagagcuccaucaccgaagcugagcugacaggguacggcaccgugacgauggaguguagcccccggaccggccucgacuucaacgagaugguccugcugcagauggaauccaaggcguggcucgugcaccgacagugguuccucgaccugccccucccauggcugccgggggccgacaagcagggcaguaacuggauacaaaaggagacccuggucaccuucaagaauccccacgcgaagaagcaggacguaguggucuuggggucgcaagagggcgccaugcacacggcgcugaccggcgccaccgagauacagauguccucaggcaaucuccuguuuaccggccaccugaagugucggcugcguauggauaaauugcaacugaaggggaugucauacagcaugugcacgggcaaguucaaaguggugaaggaaaucgccgagacccaacacgggaccaucguaaucagagugcaguaugaaggggacggcucacccugcaagauccccuucgagaucauggaccuggagaagcgauacguucuaggccgucugauuaccgucaauccgauugucacagaaaaggauagcccaguaaacauagaagcggagccccccuucggcgacucuuacaucaucauugguguugagccgggccagcugaagcucaauugguucaagaaaggaagcuccauaggccaaauguuugagacuaccaugcgcggcgccaagcgcauggcuaucuugggggacacagccugggacuucggcagccucggcggaguguucacuucgaucgggaaggcacugcaccagguguucggagcuauauacggggcagcguucuccggagucaguuggacaaugaagaucuuaaucggcgugaucaucaccuggaucgggaugaauagccguucaaccucccuguccguuagcuugguccucgugggaauaguaacgcuguaucugggcgucauggugcaggccgacuccggaugugugguuaguuggaagaacaaggagcucaaguguggcagcgguaucuucauaacagacaacgugcacaccuggaccgagcaguauaaguuccagccagagucccccagcaagcuugcgucagccauacagaaggcccaagaggagggcaucugugggauccgcagcguaacgcggcuggagaaucucauguggaagcagaucacccccgagcugaaccauauccuggccgagaacgaggucaagcucaccaucaugaccggcgacauuaagggcaucaugcaggccgguaaacggucccuccggccgcagcccacagaacucaaauacagcuggaagacauggggcaaggcgaagaugcucuccacagagagccauaaccagacuuuccugaucgacgggcccgagacggcggagugcccuaacaccaaccgcgccuggaacucacuugaaguggaggacuacggcuucgggguguucaccaccaacaucuggcucaagcucaaggagaaacaggacgccuucugcgacagcaaacugaugucugcagcgauuaaggacaaccgggccguccacgcggacaugggcuauuggaucgagucagcccucaacgacacguggaaaaucgaaaaggcguccuucaucgaggugaagaacugccauuggccaaaaagccacacguugugguccaacggagugcuugaguccgagaugauuaucccuaagaaccuagcggggcccgucucccaacacaacuaucgcccgggcuaccacacccagaccgccgggccguggcaccuaggcaaacuggagauggacuuugauuuuugcgacgggaccacggugaucguuaccgaggacugcggcaaccggggccccagccuccgcacaaccacggccagcgggaaacugaucacggagugguguugcaggucguguacacucccuccgcuccguuaccggggcgaggacggguguugguauggcauggaaaucagaccucugaaggagaaagaagagaaccuaguuaauagccucgugaccgccggacacggacagguggauaacuucucccuuggggugcuggggauggcguuguuucuggaggagaugcugcggacgcgcgugggcaccaagcaugcuauccuccugguggcugucaguuucgugacccugaucaccgggaacaugaguuucaaggaccucggccggguggucgucauggugggaaccaccaugacagacgacauaggcauggguguaacguaccuggcccugcucgccgcguucaaagugcguccgacguucgccgccgggcuguuauuacggaagcuaacgucaaaggagcugaugaugaccaccaucgguauagugcuacugucccaaaguacgaucccggagaccaucuuagaacucacagaugcccuggcccuggguaugaugguccucaagauugugagggacauggagaaguaccagcuggcggugaccaucauggccauccugugcguuccaaacgcugugauacuccagaacgcguggaaggucagcuguacgauacuggccguggugagcgucagccccuugcucuuaaccagcucucagcagaagaccgauuggaucccccuggcguugaccaucaaaggucugaaccccaccgcuaucuuccucacuacucucagccgcaccaacaaaaagcgguccuggccgcugaacgaggcuaucauggccgugggcauggugagcauccuagccuccucgcugcugaaaaacgacauccccaugacgggaccccucgucgcuggcgggcuucucaccgucugcuacgugcucaccggccgcuccgcagaccuagagcuagaacgggcuaccgacgucaagugggaggaccaggccgagauaagcgggagcagcccuauacuuagcaucacgauuuccgaagacggcucaaugagcaucaagaacgaggaggaggagcaaacccucaccauccugaucagaaccggccugcuggugauuucugggcucuucccggugagcauccccauaaccgcggccgccugguaccuuugggaggucaagaaacagcgggcaggcgugcugugggacguacccuccccuccucccauggggaaggccgaacuggaggacggcgcguaccgcaucaagcagaaggggauucuagguuacagucagauuggcgccggagucuauaaggagggcacguuccauaccauguggcacgugacccgcggggcgguacucaugcacaagggcaagcgcauugaaccuagcugggccgacgucaagaaagaccucaucuccuacggaggcggcuggaaguuagagggggaguggaaggaaggcgaggaaguccaaguauuagcccuggaacccgggaagaacccacgggcgguccagaccaagccuggccuguucaagacgaacaccggcacuaucggagccgugagcuuagacuuuucccccggcaccucggggucccccauaaucgacaagaaggggaagguggucgggcuuuacggcaaugggguggugacccgcucuggggcuuacgucucugccaucgcccagacggaaaaaucaaucgaggacaaccccgagauugaggacgacaucuucaggaagaggcggcugaccaucauggacuuacacccuggggccgggaagaccaagcguuaccuucccgccaucgugcgggaggccaucaagcgcggccugcggacguugauccucgcccccacccgcgugguagcggccgagauggaggaggcccugcgcgggcugcccauccgcuaucagacccccgccauccgggcggagcauacaggccgcgaaaucguagaucugaugugucacgcgacguuuaccaugcgcuugcuuagucccgugaggguuccgaacuacaaccucauaauaauggacgaggcccacuucacugaccccgccucuauugccgcccgcgguuacaucagcacccgggucgagaugggugaggccgcuggcaucuucaugacggccacgcccccugggucccgcgacccguucccucagagcaacgcucccaucaucgacgaggagcgggagauaccggagcgcucauggaacaccgggcacgaauggguuaccgauuucaagggcaaaacggucugguucgugccgagcaucaaggccggcaacgauaucgcggccugccugcggaagaacggcaagaaggucauccagcuguccaggaaaacuuucgacagcgaguauguuaaaacccggacaaacgacugggacuucguggugacgacggacaucuccgagaugggggccaauuuuaaggccgagcgcguuaucgacccucggcggugcaugaagccggugauauugacugacggugaggagcgggucauacuggcgggccccaugccagucacccacagcuccgccgcccagcgccggggacgcauagggcggaaccccaagaacgaaaaugaccaguauauuuacaugggcgagccgcuggaaaacgaugaggacugcgcccacuggaaggaggccaagauguuacuggacaacaucaacacgcccgagggcauuauaccaagcauguucgagcccgaacgagagaaagucgacgcgauagacggggaguaucguuugcggggugaagcacguaagaccuucguggaucuuaugcggcgcggggaucuccccguaugguuagccuacaagguggccgccgagggcaucaauuacgccgacagacgguggugcuucgacgggaucaagaacaaccagauccucgaggaaaacguggaagucgagaucuggacaaaggagggggagcggaaaaagcugaaaccacgauggcuggaugcccguauauacuccgauccgcucgcgcugaaggaguucaaggaguucgcggcuggccguaagucucugacgcuaaaccugaucacggagauggggcggcugcccacauuuaugacucagaagaccagggacgcgcucgauaaccuggccguguugcacacggccgaggccggcgggcgggcauacaaccacgcacucuccgagcugcccgagacccuugagacacuacuacuguugacccuacuggccacagucacgggcggcaucuuccucuuccugaugagcggccgcggcaucgggaagaugacccugggcaugugcugcaucaucaccgccuccauacuccugugguacgcccagauccagccgcacuggaucgcggccagcauuauccuggaauucuuccucaucguacuacugauccccgagcccgaaaagcaacggacaccccaagacaaccagcucacguauguggugaucgcuauccugaccgucguggcugccaccauggccaacgagaugggguuccuggagaagaccaagaaggaucucggccugggcuccauagcuacgcagcagccagagagcaacauacuggacaucgaccuccggcccgcauccgccuggacccuguacgcaguagcgaccaccuucgugacgcccaugcugcgucacagcauagaaaauagcuccguaaacgucagccucacggccauagccaaccaggccacagugcugaugggucugggcaagggguggccccucucaaagauggacaucggcguaccgcugcuggccaucgggugcuacagccaggucaacccgauaacccucacggcagcccugcugcuccugguagcccacuacgccaucaucggacccgggcugcaggcgaaagcaacccgcgaggcacagaaacgggccgccgcggggaucaugaagaaucccacuguagacggcaucacggucaucgaccucgacccuauccccuaugaccccaaguucgagaaacagcugggccaggucaugcugcucauacugugcguuacucagguccugaugaugcgcacuacgugggcccucugugaagcccugacccuggccacugggccaauuuccaccuuaugggaggggaacccgggacgguucuggaacacgaccaucgccgugagcauggcgaacauuuuccgcggauccuaucuggcaggggccgggcuccucuucaguauuaugaaaaacacuacuaauacacggcgcgggaccggaaacaucggcgagacgcuaggggagaaguggaagucccgucugaacgcucucggcaagagcgaguuccaaacuuacaagaaguccgggauccaagaaguggaccggacccuggcgaaagagggaaucaagcgaggggaaaccgaccaucacgcggucagccgaggcuccgccaaguugcgcugguucguggagcggaacaugguaacgcccgagggcaaggucguagaccugggguguggccgugggggcuggagcuacuacuguggcggcuuaaagaaugugcgggaggugaaggggcucacuaagggcgggcccgggcacgaggagccaauaccgauguccaccuauggcuggaaccuagugaggcuccagucagggguggacgucuucuucaucccgcccgaaaaaugcgauacucuguugugcgacauaggugaguccagcccaaaccccaccguugaggccgggcguacguugagagugcugaaccucguugagaacuggcuuaacaacaacacccaguucugcaucaaggugcugaaccccuacaugccuuccgugauagagaagauggaggcccugcagcgcaaauacgggggugcgcuaguacgcaacccucugagccggaacuccacucacgagauguauuggguguccaacgccuccggaaacauuguguccagcguuaacaugaucucccgcaugcugaucaaccgguucaccaugagacacaaaaaggccacguacgagcccgacguggaccucgggagcgggacacggaacauuggaauugaaagugaaauccccaaccuggacaucauaggcaagcgcauagagaagauaaaacaagagcacgagaccucuuggcacuacgaccaggaccaucccuacaaaacuugggccuaccauggguccuacgaaacgaagcagacgggaucugcuucaagcauggugaacggcguugugcggcuacucaccaagcccugggacguucugccgaccgucacgcagauggcgaugaccgacacgacccccuucggacaacagcgcguguuuaaggagaaaguggacacgcgcacccaggaacccaaggaagggacgaagaagcugaugaagaucacagccgagugguuguggaaggagcuggggaagaagaagacgccgcggaugugcacccgcgaggaguucauccggaaggucagauccaaugcagcccuuggcgccauuuuuacggacgagaacaaguggaagucggcgcgggaagccguggaggauucacgcuucugggaauuggucgacaaggagcggaaccugcauuuggagggaaagugcgagacaugcguauauaacaugauggguaaacgcgagaagaaacucggggaguucggaaaggccaaaggcagccgggccaucugguacauguggcuuggggcccgcuuucuggaguucgaggccuugggcuuccuaaacgaagaucauugguucagucgcgaaaacucgcuguccgggguggagggcgagggucuccacaagcugggcuacauacuccgcgaugucagcaagaaggagggcggggccauguacgccgacgacacggcgggcugggauacacggaucacgcucgaggaucuuaagaaugaggagauggugaccaaccacauggagggagagcauaagaagcuggcggaagcaaucuucaagcucacguaccaaaacaagguagucagagugcaacgacccacgccgcggggcaccgucauggacaucauaagccggcgcgaucaaagagggaguggacaggucggcacguacgggcugaacacguucacaaacauggaggcccagcuaauccgccagauggagggcgaagggguguuuaaaaacauccaacacuuaaccgccacggaggagguggccgucaagaacugguuggcacgggugggacgagagcgccugucacgcauggcgaucucaggcgacgacugcgugguuaagccacuagacgaccgguuugcgaacgcgcugacggcccucaacgauauggggaagaucaggaaagacauccaacagugggagccaucaaagggcuggaacgacuggacccaggugccauucugcucgcaccacuuccacgaguugaucaugaaggaugggcgcgugcugguuguucccugcaggaaccaagaugagcuuaucggccgcgcgcguaucagccagggggccggcuggucccuccgcgagaccgcgugcuugggcaaaagcuacgcccagauguggucccugauguacuuccaccggcgagauuugcggcuugcugcgaaugcaaucuguagcgcagugccgucccacugggucccgaccagccgcacuacgugguccauacacgccaagcacgaguggaugaccacugaggacaugcucacuguauggaaccggguguggauccgcgaaaaucccuggauggaggacaagacucccguugagagcugggaggagauccccuaccucgguaagagagaggaccaguggugcggcucccugaucggguuaacgagccgcgccaccugggcuaagaacauccaggccgcaaucaaucaggugcguucgcuuauaggcaacgaggaguauaccgacuauaugccgagcaugaagcgcuuccggcgcgaggaggaggaggccgggguguuaugguaa

SEQ ID NO: 24984 - RNA, 9876 nt, Artificial Sequence
  derived and/or modified CDS sequence (opt11) from DENV-2__JF730048__SS-prME
uccgcaggaaugaucauuaugcugauccccaccgugauggccuuccaucucacuacucgcaacggggagccccacaugaucgugggcauccaggagaagggcaagagccuccucuucaagaccgaggacggcgugaacaugugcacucucauggcgauggaccugggugaguuaugcgaagacaccaucaccuacaaauguccccugcugcggcaaaacgagccagaagauaucgacugcugguguaacuccaccagcaccugggugaccuacgggaccugcaccaccaccggagagcaucgccgggaaaaacgcagcgucgcucuaguaccccacguggggaugggccuggagacucggaccgagaccuggaugagcuccgagggagcuuggaaacacgcccaacgcauagagaccuggauccuucggcacccgggauuuaccaucauggccgcuaucuuggcuuacaccauuggaaccacccauuuccagcgcgcccucaucuucaucuugcugacggccguugcgcccuccaugaccaugcggugcauaggcaucucgaaccgcgacuuuguggaggguguauccgggggcagcugggucgacaucgugcucgagcacggauccugcgugaccaccauggcaaagaacaagcccacgcuggacuucgagcuaaucaagaccgaggccaagcagccagccacgcuacgaaaguacugcauugaggcgaagcuaaccaacacgacaaccgagagcagauguccuacccagggcgaacccucccugaaggaggagcaggacaagcgguucgucugcaagcacagcaugguagaccgcggcugggggaacgggugcgggcuuuucggcaaggguggaaucgugacgugcgcgauguuuacgugcaagaagaauauggagggaaagaucguccagccggagaaccuggaguacaccaucguggugacgccccacucuggggaggagcaugcugucggcaaugacacgggaaagcacggcaaagagaucaaggugaccccgcagaguucgauaacggaggccgagcuuaccggguacggcaccgugacuauggaaugcagcccacggacgggccuagacuucaacgagauggugcugcugcagauggagucuaaagccuggcuggugcacaggcaaugguuccuugacuugccacuccccuggcugccaggggccgacaaacagggcagcaacuggauccaaaaggagacccuuguuaccuuuaaaaacccccaugcgaagaagcaagacgucgugguccuggggagccaggagggggcuaugcacaccgcccugaccggggccaccgagauccagauguccagcggcaaccuccuguucaccggccaucugaagugccggcugcgcauggacaagcuccaacugaaagggaugagcuacucuaugugcacgggcaaguucaagguaguaaaggagauagccgaaacucaacacggcaccaucgucauucggguucaguacgaaggcgauggcucccccugcaagauucccuucgagaucauggauuuggagaaacgcuacgugcuaggacggcugaucaccgucaauccgaucgugacggagaaggacagccccguaaacauagaagcggaaccgcccuuuggcgacuccuacaucaucauaggggucgagccgggacagcugaaguugaacugguucaaaaaggggucauccauuggccagauguucgagacuaccaugcguggcgcgaagcgcauggccaucuuaggggacaccgccugggacuucggcagccucggcgguguguucacaucgaucggaaaagcccuccaccagguguucggggcuauuuacggcgccgccuuuagcggggucucguggaccaugaagauacugaucggcguaauuaucaccuggaucgggaugaacagccgaaguaccagccuguccgugagccugguacucgugggcaucgugacgcuguaccuuggggugauggugcaggccgacuccggcugcguaguuagcuggaaaaacaaggaacucaagugcggcagcggaaucuucaucaccgacaacgugcacaccuggaccgagcaauauaaguuccagcccgagucccccucuaagcuggcguccgccauccaaaaggcccaggaggagggcauaugcgggauccgcagcguaacgcggcucgagaaccucauguggaagcagaucacccccgaacuaaaccauauucuggccgagaacgaagucaagcucaccaucaugaccggcgacauaaaggggaucaugcaggcugggaagcgcucccugcggccucagcccacggagcuaaaauauucguggaagaccuggggcaaggcgaagaugcucuccaccgagagccauaaccagacguuccugaucgacgggcccgagacggccgagugcccgaauacuaaccgcgccuggaacucccuggagguggaggacuauggcuucgggguguucaccacuaacaucugguuaaagcugaaagagaagcaggacgccuucugcgacucuaagcugauguccgcagcgaucaaggauaaccgggccguccacgcggauauggguuauuggaucgaaucugcccucaacgauacguggaaaauugagaaagcuaguuucaucgaggugaagaacugccacuggccaaagagccacacgcugugguccaacggcgugcuggagagcgagaugaucauacccaagaaccucgcgggucccguaucccagcacaacuacagaccgggcuaccacacccagacagcaggucccuggcacuuaggcaagcuggagauggacuucgacuuuugcgacgggacuacugugaucgugaccgaagacugcggaaaccgaggcccaagccuacgcacuaccacggccagcgggaaacuuauaaccgaauggugcugccgguccugcacccuucccccgcuccgcuauagaggcgaggacgggugcugguacgggauggagauucggccccugaaggagaaggaagaaaaccuggucaacucacuggugaccgccggccacggccagguggacaacuucuccuuaggcguucuggggauggcccuuuuccuggaagagaugcugcggacgcgcgugggcaccaagcacgcuaucuuacugguggccgucaguuuugucacccugaucacagguaacauguccuucaaggacuuaggccggguggucgucaugguggggacgaccaugaccgacgacaucggcaugggugucacguaccuggcuuuguuggcugcguuuaaggugcgcccaacguucgccgcagggcugcugcuucggaaacugaccagcaaggagcugaugaugaccaccaucggcaucguacuccuuucacagagcacgauccccgaaaccauccuagaacucaccgaugcgcuggcacugggcaugauggucuugaagauaguccgugacauggaaaaguaccaguuggccgugaccaucauggccauccuguguguccccaacgccgugauacuccagaacgccuggaagguauccugcacaauccuggcgguggucagcgucagcccccugcuccugacuucaucccaacagaaaaccgacuggaucccccuggcacucaccaucaagggccucaaccccacggcgauuuuccucaccacccuuagcaggaccaacaagaaacgguccuggccccugaaugaggccauaauggccgucggcauggucagcauccuggccuccagccuacugaagaacgacauccccaugacggggccccuggucgccggcgggcucuuaacagugugcuacguucugaccggccgcuccgcagaccucgagcuggagcgggccaccgacgucaagugggaggaucaggccgaaaucagcgguaguagccccauauuaagcaucacgaucuccgaggacggcagcauguccaucaagaaugaggaggaggagcaaacccucaccauccugauccgcaccggccuacucgugaucagcggucuguucccgguuagcauccccauuaccgcggccgccugguauuuaugggaagucaaaaagcagcgggcugguguguugugggaugugcccagcccgccgcccauggggaaggcagaacuggaggauggcgcguaccggauaaagcagaaggggauccugggcuacucccagauuggcgccggggucuacaaggagggaacuuuucacaccauguggcacgugaccaggggagcggugcucaugcacaagggcaaacgcaucgagcccucaugggcagacguuaagaaggacuugauauccuacgggggcggcuggaagcucgagggugaguggaaggagggugaggaaguccaggugcucgcccuggagcccgggaagaacccccgagcgguccagaccaagcccggccuguucaagacgaacaccgggaccauaggugcggucagccucgauuuuucaccgggaacuucggguucgcccaucaucgacaagaaggguaagguagucgggcuguacggcaacggcguugugacgcgcaguggggccuacgucagcgccaucgcccagaccgagaaaaguaucgaggacaaccccgagaucgaggacgacaucuuccggaagcgccggcugaccaucauggaccugcaccccggcgcggggaagaccaaacgcuauuuaccugcgaucgugagagaagcuaucaagcggggucugcggacgcugauacucgccccaacgcgcgugguggcggcggagauggaggaggcccuacgggggcugcccauacgcuaccagaccccugccauacgggccgagcauacaggccgcgagaucguggaccucaugugucacgccacguucacaaugcgacuucugucccccgugcguguaccgaacuacaaccuaaucaucauggacgaagcccacuucacugaucccgcuucaauagcugcgcgcggcuacaucagcacccgcgucgagaugggcgaagccgcaggcaucuucaugacggccacgccacccggcucccgggacaguuucccgcaguccaaugcccccaucaucgacgaggagcgggagauccccgagcgcagcuggaacaccgggcacgaaugggucaccgacuucaagggcaagacggucugguucgugcccuccaucaaggccggaaacgacaucgcugccugccugcggaagaacggcaagaaggugauccagcugucccgcaagacuuuugacuccgaguacgucaagaccagaaccaacgauugggacuucguagucacgacagacaucagcgaaaugggagccaacuucaaggccgagagaguaaucgauccccgucgcuguaugaagccgguuauccucaccgacggcgaggagcgugugauccuggcggggccgaugccugucacacacuccagcgccgcacagcgccgggggcgcaucgggcggaaucccaagaacgaaaacgaccaauacauuuacaugggagagccccuggagaacgacgaggacugcgcgcacuggaaagaggcgaagaugcuacuggacaacauuaauacgcccgaggguaucaucccauccauguucgagccggagcgcgagaagguggacgcgaucgacggggaguaccggcugcgcggcgaggccaggaagacuuucguugaccucaugcggcgcggggaccugccaguuuggcuggcguauaaaguggccgcagagggcaucaauuaugcggaccggcggugguguuucgacgggaucaagaacaaccagaucuuagaggagaacguggaaguugagauauggacuaaagagggcgagcgcaaaaaguuaaagccgagguggcuggacgcccggaucuauagugacccgcucgcccuuaaggaguucaaggaguucgccgccggccgcaagucccugacccuuaaucugaucacggagaugggacgacuccccacuuucaugacccagaagacccgugacgcgcuagacaaccucgccguccugcauacggcagaggccggagggcgggcauacaaccaugccuuaagugagcugcccgagacccuggagacacugcugcuccucacucuguuggccaccgucacgggcggcauuuuccucuuccugauguccgggcgcggcaucgguaagaugacccugggcaugugcugcauuaucaccgccagcauucucuugugguaugcccagauacagccgcauuggaucgcggccuccaucauccuggaauuuuuccucaucguccugcuaaucccagaacccgagaagcagagaacaccccaggacaaucaguuaacguacgugguuaucgccauccugaccguggucgccgcuacuauggcgaacgagaugggguuccuggagaagaccaagaaggaucuaggauuggguagcauagccacgcagcagcccgaguccaacauccuagacauagaucuccguccggccucugccuggacgcuguacgccguggccacgacauucgugacccccaugcugcggcacagcaucgagaacagcagcgugaaugucuccuuaaccgccaucgccaaucaagccaccguguugaugggauuaggcaagggguggccccucagcaagauggauaucggcgugccccugcuugcuaucggguguuacagucaggugaacccgaucacccucacggcggcccugcugcuccuuguggcccacuacgccauuaucggcccuggccugcaggcgaaggccacccgugaagcccagaagcgggccgcggcugggaucaugaagaacccaaccguggauggcaucaccgucaucgaccucgaccccauaccuuacgaccccaaguucgagaaacagcuaggucagguaaugcugcucauucuguguguuacgcaaguucugaugaugcgaaccaccugggccuugugcgaggcccugacccuggcgacgggccccaucagcacacucugggaggguaaucccggccgguucuggaacaccaccauagccguuuccauggcgaacaucuuccgcggcaguuaccuggccggggccggacuccucuucagcaucaugaagaauacgacuaacacccggcgcgguacaggcaacaucggcgagacgcugggggagaaauggaaaucacgcuuaaacgcccugggcaagagcgaguuccagaccuacaagaagucgggaauccaagagguggaucggacccuggcaaaggagggaauuaagcggggagagaccgaccaccacgcgguuucccggggcuccgccaaacuucgcugguuuguugagcgcaacauggugacaccggagggcaaggucguagaucucgggugcggucgcgggggcuggagcuacuacugugggggccugaaaaacguuagagagguuaagggucugaccaagggcgggcccgggcacgaggagcccaucccgaugucgacuuacggcuggaaccucgugagacugcagucuggggucgacgucuucuucaucccgcccgagaagugcgauacccugcucugcgauaucggugagucguccccaaaccccaccguggaggccgggcggacgcuacgcgucuuaaaccuugucgagaauuggcugaauaacaacacccaguucugcaucaaagugcugaauccguauaugcccagcgugaucgagaagauggaagcccuacagcggaaguaugggggcgcgcucguccgcaaccccuugagccggaacuccacgcacgagauguacuggguuagcaaugcguccgguaacaucguguccagugucaauaugauuagccgcaugcugaucaaccgcuucaccaugcgccacaaaaaggcaacauaugagccggacguagaccucggcuccggaacccggaacaucggaaucgagagcgagauccccaaccuggauaucaucggaaagcgcaucgagaagaucaagcaggagcaugagacuucauggcauuacgaccaggaucacccuuacaaaaccugggccuaccacgggagcuaugagaccaaacaaacgggcuccgccaguuccauggugaacgggguagugcgguugcucaccaagcccugggacguacugccgacagucacgcagauggcgaugaccgacaccacccccuuuggccagcagcgcguguucaaggagaagguggacacacgcacacaggagcccaaggagggcacuaagaagcugaugaagauuacggcagaguggcuguggaaagagcuagggaagaagaagacgccccggauguguacccgcgaggaguucacccggaagguacgcagcaacgccgcccuuggcgcaaucuucaccgacgagaacaaguggaaauccgcccgggaggccguggaggacucacgcuucugggaacucguggacaaggagcggaaccugcacuuggaggguaagugcgagacgugcgucuacaacaugaugggcaagcgugagaaaaagcucggggaguucggcaaggccaagggcucccgggcgaucugguacauguggcuaggggcccgauuccucgaguucgaggcgcucggguuccugaacgaggaccacugguucucaagagagaacucccugucggguguggagggcgaggggcuccauaaacugggcuacaucuugcgcgacgucagcaagaaggagggcggggccauguacgccgacgauaccgcuggcugggacacccggaucacccuggaggacuuaaagaacgaggagauggugacgaaccauauggaaggggagcacaagaagcuggcggaggcuaucuuuaagcucacguaccagaacaaggugguucgcgugcaaaggcccacgccucggggcaccguuauggauaucauauccaggcgcgaccagagggggagcggacaggucgggacguacgggcugaacacauucacaaacauggaggcccagcugauacgccagauggagggggaggggguguucaaaaacauccagcaccucaccgccacugaggagguggcggucaagaacuggcuugcgcgggugggccgcgagcgacugagucggauggccauaagcggcgacgacugcguggucaagccccuugaugaccgcuucgccaaugcgcugaccgcccugaacgacaugggaaagauccggaaggauauccagcagugggagcccucgaagggcuggaacgacuggacacaggugcccuucugcagccaccacuuccacgaauuaauaaugaaggacggacgcgugcuggucguuccaugucgaaaucaggacgaacugaucggccgcgcucggaucucccagggggccggcuggagccuacgcgagacggcuugccugggcaaguccuacgcccagauguggucucugauguauuuucaucggcgcgaccuccgucuagccgcgaacgcuaucugcuccgccgugcccagccacuggguucccaccucacguacgacguggucuauccacgcuaagcacgaguggaugaccaccgaggacaugcuaacgguguggaaccguguguggauccgcgagaacccguggauggaggauaagacccccguagagucaugggaggagauccccuaucucgggaagcgggaggaccaaugguguggcagccugaucggguuaaccuccagggccacaugggccaagaauauccaggcagccaucaaucaggugcgcucucugaucggaaaugaggaguacacagacuacaugcccucaaugaagcguuuccgaagggaggaagaagaggccggggugcugugguga

SEQ ID NO: 24985 - RNA, 9876 nt, Artificial Sequence
  derived and/or modified CDS sequence (opt11) from DENV-2__KF955402__SS-prME
ucugcagggaugaucaucaugcugaucccaaccgugauggcguuccaccucacgacccguaacggggagccccacaugaucgucgguauccaggagaaaggcaagucacuucuguucaaaaccgaggacggcgucaacaugugcacgcucauggcaauggaucugggggagcucugugaggauacuaucacguacaaguguccauuacugcggcaaaacgagccggaggauaucgacuguuggugcaacagcaccuccacgugggugaccuacgggaccuguacgaccacaggagagcaccggcgggagaagaggucagucgcccucgugccccacguggggaugggucuggagacccguaccgagaccuggaugaguagcgagggggccuggaaacacgcccagagaaucgagacguggauccugcgucacccuggcuucacgaucauggccgcgauucuggcuuacaccauaggaacaacccacuuccaacgcguccucaucuucauccugcugacggccguugcacccuccaugaccaugaggugcauagguaucucuaaccgcguauucguagagggggugucggggggcagcuggguagacaucgucuuggagcacggguccugugugaccaccauggcuaagaacaagcccacgcuggauuuugaacucaucaagaccgaggccaagcagcccgccacgcucagaaaguacugcaucgaggcgaagcugaccaacacuaccaccgagucgagaugccccacucagggcgagcccucccugaaggaggagcaggacaagcgguucguauguaagcacagcaugguugaccgcgggugggggaacggcugcggacuguucgguaagggcgggaucgugacuugugccauguucacgugcaagaagaacauggaggguaagaucgugcagcccgagaaccuagaguacacuauuguagugacuccccacucuggggaagagcacgccgugggaaacgauacgggaaagcacggaauggagaucaaaguaaccccgcaaagcucgaucaccgaggccgagcugaccggguauggcaccgugacaauggagugcagcccacggaccggccucgauuucaacgaaauggugcugcugcagauggagaauaaggccuggcucguccaucgccagugguucuuggaccugccgcucccaugguugccgggggcugauaagcaagagucaaacuggauucagaaggagacccucgucaccuucaagaacccgcacgcaaagaagcaagacguuguugugcucggcagccaggagggggcgaugcacacggcccugaccggcgccaccgagauccagaugagcagcgggaaccugcuguuuaccggucauuuaaagugccgguugcgcauggacaaacuccagcugaaaggcaugagcuacuccaugugcacggggaaguucaaagucgugaaggagaucgccgaaacgcagcacggcaccauagugaucagggugcaguacgagggcgacggcagcccgugcaagauacccuucgagaucauggaccuggagaaaagauacguccucggccgacugauaacugugaacccgauaguaacggagaaggacucccccgugaacauugaggcugagccgccguucggggacucuuauauaauuauaggcguggagccaggccagcugaaauugaacugguucaagaagggcuccagcaucgggcaaauguucgagaccaccaugcgaggcgcaaagcgcauggccauccugggcgauaccgccugggacuucggcuccuuaggagggguuuuuacuagcaucggcaaggcccuccaccagguguucggcgccaucuacgggguagcguucuccgguguuagcuggaccaugaagauccugaucggggugauuaucaccuggaucgguaugaacagccggagcaccucgcuuucugugagcuuaguccuuguggggaucgugacgcuguacuugggcgucaugguccaagccgacagcgggugcgucgucuccuggaagaauaaggagcucaagugcgggagcggaaucuucaucaccgacaaugugcauaccuggaccgagcaguacaaguuccagccagaaagccccuccaagcuggccucugccauccagaaggcgcaggaggaggggauuugcggcauccgcagugugacgcgucuggagaaccuaauguggaaacagaucacccccgagcugaaccauauccuggccgagaacgaggucaagcuuacuauuaugacuggggacauaaagggaaucaugcaggccgggaagcgcagccuccgcccgcaacccacggaguugaaguauuccuggaaaaccuggggcaaggccaagaugcugaguaccgaguccuauaaucaaaccuuccugaucgacggaccugagacggcugaaugcccgaacaccaaucgcgcguggaauucacuggagguggaagacuacggguucggcguguucacgaccaacauauggcucaagcuaaaggaaaagcaggacgcauucugcgacuccaagcugaugagcgcggccauaaaagacaaccgugccguccacgcggacaugggguacuggauugaguccgcccucaaugacacguggaagauagagaaggcaagcuucauugagguuaagaacugccacuggccgaaaucgcacacccuguggagcaauggcgugcucgagucagaaaugauaauccccaaaaaccucgcagggccugucagccagcacaauuaccgcccgggauaccacacccaaaucgcgggucccuggcaccugggaaagcuugagauggacuuugacuucugcgacggcacuacagugaucguaacggaggacugcgggaauaggggccccuccuugcgcacuacaaccgcgagcggcaaacugauaaccgaauggugcugccggucguguacacuuccgccacugagauaccgcggggaggauggcuguugguacgggauggagauccgccccuuaaaggagaaggaggagaaccuggugaauucccucgugaccgcgggccacggccagguggacaacuucagccugggcguccugggcauggcgcucuuccuggaggagauguugaggacucgaguggggacuaagcacgccauccuccucguggcggucuccuucguaacgcugauaaccggcaacaugagcuucaaggaucucgggcggguggucgugauggugggagcgaccauggcggacgacaucggaaugggcgucacguaccuggcacuuuuggccgcguucaaggugcgccccaccuucgcagcggggcucuuacuccggaagcuaaccuccaaggagcugaugaugacuacgaucgggaucgugcuucugucucaauccaccauacccgaaacaguccuggagcucaccgaugcccuugcccugggcaugauggugcucaagaucguccgaaacauggagaaguaccagcuggcagucacaauuauggccauucugugcguaccuaacgccgucauccuccaaaacgccuggaaggugagcugcaccauucuggcaguggucucagucagccccuuauuacugacuuccagccagcaaaagacggacuggaucccucuggcgcuuacgaucaagggacugaaccccaccgccauuuuccugaccacucugucccgcaccaacaagaagcggagcuggccgcuaaacgaggccaucauggccguggguaugguuuccauccuagcuucaucccuccugaaaaaugacauccccaugaccggcccccugguugccggcggccucuuaacuguuugcuacguccugaccggacgcagcgccgaucucgagcuugagcgcgcgacggaugugaagugggaggaucaggccgaaauuagugguaguucucccauccuguccaucaccauuagcgaagacggguccaugucgauuaagaaugaggaggaagagcagaccuuaaccauccuuauucgaacgggcuuacucgugaucuccggccuuuuuccaaucagcauccccaucaccgcugcggccugguaccugugggagguaaagaagcaacgggccggcgugcucugggacguuccuucacccccgccaaugggcaaggccgagcuggaggacggggcguaccgaaucaagcaaaaggguaucuugggguacagccagaucggcgccggugucuacaaagaggggaccuuccacacaauguggcacgugacgagaggcgccgugcugaugcacaagggcaaacgcaucgagcccuccugggccgacguuaagaaggaccugaucagcuacggggggggcuggaagcuggagggcgaguggaaggagggggaggaaguccaggucuuagcacucgaacccggcaagaacccacgggcgguccagacuaagcccgggcuguucaagacaaauaccggcacgaucggagcagugucguuggacuucagcccgggaacuuccggcagccccaucauugacaagaagggaaagguagucggccuuuaugguaacggcgucgugaccagguccggagccuacgucagcgccaucgcacaaaccgagaaguccaucgaggacaaccccgagaucgaggacgacaucuuccggaagaggcggcucacgaucauggaucugcacccaggggcggguaagacgaaacgcuacuuacccgccauagugagggaggcaaucaagcgugggcugagaacgcugauccuggcuccaacucgcguggucgcggcggagauggaggaggcuuuaagaggccugccgauucgcuaccagaccccagccauucgagccgagcacacggggcgcgagaucguggaccucaugugccacgcgacuuucacuaugcgccugcugagccccgugcgggucccuaacuacaacuuaaucaucauggacgaggcccacuuuaccgaccccgccagcaucgcugcucgcgguuacaucagcacacgaguggaaaugggugaggcggccgggaucuucaugaccgccacgccgcccggcagccgcgauccguucccccaguccaacgcccccaucauugacgaggaacgggagaucccggagagaaguuggaacuccgggcaugaauggguuaccgacuucaagggaaagacugucugguucguuccgucaaucaaggccgggaacgauaucgcggccugucugcgcaagaacggcaagaaggucauccagcuuucccggaagaccuucgacucagaguauguaaagacaagaaccaacgacugggauuucguggucacgaccgacaucuccgagaugggcgccaacuuuaaagccgaacgcgucauugacccccggaggugcaugaagccggugauccucacugacggugaggagcgcgugauccuggcgggucccaugccggucacccauagcuccgccgcccaacgcagagggagaauaggccggaauccaaagaacgagaacgaucaguacaucuauaugggggagcccuuagagaacgacgaggacugcgcccauuggaaggaagccaagaugcuccuggauaauaucaacacgcccgaaggcauaauaccaagcauguucgagcccgagcgggagaagguggacgcgaucgauggcgaguaccggcuccgcggggaggcccgcaagaccuucguagaccucaugagaagaggugaccugcccgucuggcuggcguacaagguagcugccgaggggaucaacuacgcagaccgacgcugguguuucgaugguauuaagaacaaccagauuuuagaggagaacgucgagguggagauauggaccaaggagggugagcgaaagaaacugaagccgagguggcuggacgcccggaucuauucagacccccuagcccugaaggaguucaaggaauucgccgcaggccgcaagucucugacccucaaccugaucaccgagauggggagacugcccaccuucaugacccaaaagacccgcgacgcacucgacaaucuugccgugcuacacacggccgaggccgggggccgggcguacaaccaugccuuauccgagcugcccgaaacccuggagacccugcuacuacucacccuuuuagccacggucaccgggggcauauuuuuauuccucaugucgggcagggguauaggcaagaugacacuggggaugugcugcaucauaaccgccucaauacuccugugguacgcgcagauccagccgcacuggaucgcggccucgaucaucuuggaguucuuucuuaucgugcugcuaauccccgagcccgaaaaacagcggacgccacaagacaaucaguuaacguacguggucaucgcgauccugaccgugguggcagccaccauggcgaacgagauggguuuccuggagaagaccaagaaggaccucgggcugggcuccaucgccacgcaacaaccggagagcaacauccuggacaucgaucuaaggcccgccuccgcuuggacucuguacgccgucgcuaccaccuuugugacccccaugcugcggcacagcauugagaacagcuccgugaaugucagcuugacugccauagccaaucaagcgacugugcugaugggauuagggaagggcuggccccucucaaagauggacaucgggguuccgcugcuggcaaucggcugcuacagucaggugaacccuauaacccucacugcagccuugcugcuccugguggcccauuaugccauuaucgggcccggccugcaagcaaaggccacccgcgaggcccagaagcgggccgcagcggguauaaugaagaaccccacaguugacgggaucaccguuaucgaccucgacccuauccccuacgacccuaaauucgaaaagcaacugggccaggugaugcugcucauccugugugugacgcagguccugaugaugagaaccaccugggcccucugcgaagcgcugacccuggccacggggcccaucuccaccuugugggagggcaacccugggagauucuggaacacaaccaucgccgugagcauggcgaacaucuuccgaggcaguuaccuggccggcgcuggccuccuuuucuccaucaugaagaacacuaccaacacccggcggggaacagggaacaucggcgagacucugggcgaaaaguggaagucacgccugaacgcacuggggaaauccgaguuccagaucuacaagaagaguggcauccaggagguggaccggacccucgccaaggaggggaucaagcgcggcgaaaccgaccaucacgcgguuagccgcggguccgccaagcugcggugguucguggaacggaacauggugacccccgagggcaaagugguggaccuaggcugcgggcgcgguggguggucguacuacugcggagggcugaaaaacgugcgugaagucaagggacuaacgaagggcggucccggccacgaggaacccaucccgauguccacauacggguggaaucuagugcgucugcaguccggcguggaugucuucuucaucccgcccgagaagugcgacacccugcuuugcgacaucggggaauccucacccaauccgacggucgaggccggccggacgcuaagagugcugaaccucgucgagaacuggcugaacaauaauacccaguucugcauaaagguucucaauccuuauaugccaagcgugaucgaaaagauggaggcccugcagcggaaguacggaggagcgcucguccgcaacccacuaagccgaaacaguacccacgagauguacugggucuccaaugcuagcgggaacaucgugucuucaguuaacaugauaucccgcaugcugaucaaucgguucaccaugcgccacaaaaaagccaccuacgagccagacguggaccucggcucuggcacgcgcaacaucgggauagagucagagacucccaacuuagauaucaucggcaagcggaucgagaaaaucaaagaagaacacgaaaccuccuggcauuaugaccaggaucacccauacaagaccugggccuaucacggcuccuaugagacuaagcagaccgggagcgccagcucgauggugaauggugucguacgacuacugaccaagccgugggacguguuaccaaccgucacgcagauggcgaugaccgacacuacccccuucgggcagcagcgcguguucaaggagaagguggauacccggacccaggaacccaaggaggguaccaagaaacuuaugaaaaucaccgccgagugguuguggaaggaacuaggcaagaagaagacgccgagaaugugcacgcgugaggaguucaccagaaaaguccgcuccaacgccgcccugggugccauauucaccgaugagaacaaguggaaguccgcgcgagaggccguggaggacucccgauucugggagcucguugacaaggagcggaaccugcaccuugaggguaagugugaaacgugcguguacaacaugauggggaagagagaaaagaaacucggugaguuuggaaaagcgaaggguagccgggccaucugguacauguggcucggagcccgcuuucuagaguucgaggcgcucggcuuucugaacgaggaccacugguuuucccgggagaacagccugagcggcguagaaggggagggucuucauaaacugggguacauccuucgugacgucucuaagaaggaaggcggcgccauguacgccgacgacacugccgggugggacacacggaucacccucgaggaucuaaaaaacgaggagauggugacgaaucacauggagggcgaacacaaaaagcuggcggaggcaauauucaagcucaccuaccagaacaaggugguccgcgugcagaggcccacgcccagagggaccgugauggauaucauuagccggcgcgaccagcgcggcucggggcaggucggcacguacggucugaacacauuuaccaacauggaggcucagcuuauccgacagauggagggggagggcguguucaaaaacauccagcaccucaccgugacggaggaggccgccgugcagaacuggcuagcgcgagucgggcgggagcgccuaagccggauggccauuuccggcgacgacugcguggucaagccacucgacgaccgcuucgccaacgccuugaccgcccugaacgacaugggcaagauccggaaagacauucagcagugggaacccagcaaaggguggaacgacuggacccaggugcccuucugcucccaccacuuccaugagcucauuaugaaggauggucgagugcuggucgugccuugccggaaccaagacgaacugauugggcgcgcccguaucagccaaggcgccggguggucccuccgcgagaccgccugccuggggaagagcuacgcucagauguggagccugauguacuuccaccggagggaccuccgccuggcggcaaacgccaucugcagcgcuguuccaucccacugggucccaacgagccgcaccaccugguccauccacgccaagcacgaguggaugaccaccgaggacaugcugacggucuggaaccggguguggauccgcgagaauccuuggauggaggacaagacccccgucgagaguugggaggagauccccuaucucggcaagcgggaggaccaguggugcgggucccugaucggccugaccagccgcgccaccugggcgaagaacauucaggccgccaucaaccaggugcggucccuuaucggaaacgaagaguacacggacuauaugccgucuaugaagcgcuuccggcgcgaggaggaggaagccggcgugcuaugguaa

SEQ ID NO: 24986 - RNA, 9876 nt, Artificial Sequence
  derived and/or modified CDS sequence (opt11) from DENV-2__FJ898460__SS-prME
accgccggcgugaucgucaugcugauccccaccgccaucgcguuccaccucaccacccggaacggggagccccacaugaucgugggcagacaggagaaggggaagucccugcuguucaagaccgaggacggcgugaacaugugcacccucauggccaucgaccugggcgagcuaugcgaggacaccaucaccuacaagugcccccuccugcggcagaaugagcccgaggacauugauugcugguguaacagcaccagcacuugggugaccuacgggacgugcacaaccacgggcgagcaucggcgcgagaagcgguccguggcccuggugccccacgucgggaugggccucgagacccgcaccgaaaccuggaugagcagcgagggagccuggaagcacguacaaaggaucgagacguggauccugcggcacccgggcuuuaccauuauggccgcgauccuggccuacaccaucgggaccacgcacuuccagcgggcucucaucuucauccuucugaccgccguggcgcccuccaugaccaugcgcugcaucggcaucuccaaccgggacuucgucgagggugugagcgggggcuccuggguggacauagucuuggaacacggguccugcgugacuacaauggcuaagaacaagcccacccuggacuucgaguuaaucaagaccgaggccaagcagcccgcuacccuccgcaaguacuguaucgaggccaagcugacgaacaccaccacagagucccggugcccgacgcagggggagcccagcuuaaacgaggagcaggacaagcgcuucaucugcaagcacaguauggucgaccgaggcugggggaauggcugcgggcuguucggcaagggcgggauagugaccugcgcuauguucacgugcaagaagaacauggagggcaagguggugcagcccgagaaccuggaguacaccaucgucaucacgccucacucgggggaggagcacgccgugggcaacgacaccgggaaacacggcaaggagauaaagauuacgccgcaguccagcaucaccgaggccgaacugacaggguacggcacggucaccauggagugcagcccccggaccggucucgacuucaaugagaugguacugcugcagauggaggacaaggccuggcucgugcaccggcagugguuccuggaucugccacucccauggcucccaggggccgacacccaaggcagcaacuggauccagaaggagacguuggugaccuucaaaaacccccacgcgaagaagcaggacgucgugguccucgggagccaggagggcgccaugcacaccgcccugaccggagccacagagauccagaugagcucuggcaaccuccuauucaccggccacuugaagugucgccuccguauggacaaacuccagcugaagggaauguccuacagcaugugcaccggcaaguucaaaauagugaaggagaucgccgagacccagcacggaacgaucgugauccgcguccaauacgaaggcgacggcucaccuugcaaaauucccuuugagaucacggaccuggaaaagcggcacgugcucgggcgccugaucaccgugaacccgauugucaccgagaaggauagccccgugaacaucgaggcggagccgcccuucggcgacucguacaucaucaucgggguggagccgggacaacugaagcuaaacugguucaagaaggggagcuccaucggucagauguuugagacgaccaugcgcggugccaagcggauggccauccucggggacaccgccugggacuucgggagccucggaggggucuuuaccagcaucgguaaggcacuccaucagguauucggagcuauuuacggcgcggccuucaacgggguuagcuggacgaugaagauccuuaucggcguuaucaucaccuggaucgggaugaacucccgcagcaccucacugagugugucgcuggugcucgucggcgucgugacccuguaccugggggccaugguccaggcggacagcggcugcgugguguccuggaagaacaaggagcucaagugcggcucgggcaucuucauuacggauaacguacacaccuggaccgagcaauacaaguuccagcccgagucccccagcaaguuagccagcgccauccagaaggcccacgaggagggaaucugugggauccgguccgugacccgccuagagaaccucauguggaagcagauuacgcccgagcugaaccacauccugagcgagaacgaggugaagcucaccaucaugaccggcgauauaaagggaaucaugcaggccggcaaacggucccugcgcccgcagcccaccgagcucaaguacagcuggaaaacguggggcaaggcgaagaugcucuccacggagagccacaaccagacguuccugaucgacgggccugagaccgccgaguguccgaacacgaaccgggccuggaacucccuugaggucgaggacuacggcuucgggguguucagcaccaacaucuggcucaagcuucgcgagaagcaggacgucuucugcgauuccaagcugaugagcgccgccauuaaggacaaccgcgcgguccacgccgacaugggcuacuggaucgagucggcccucaacgacacguggaagauggaaaaggccagcuucaucgaagugaaguccugucacuggcccaagucccacacucuaugguccaacggcguccucgagagcgagaugaucauccccaaguccuucgccgggcccgucagccagcacaauuauaggccgggcuaccacacccagacggcgggccccuggcaccuaggcaagcuggagauggacuuugacuucugcgaggggaccaccgucguggucaccgaagacugcggcaaucggggccccagccugcgcacgaccacggccuccggaaagcucaucaccgaauggugcugucggagcugcacgcugcccccuuugcgcuaccggggcgaggacgggugcugguacggcauggagauccgcccccuaaaggagaaggaggagaaccuggugaauucccuggugaccgccgggcacggccagaucgacaacuucagccucggcguccuggguauggcgcuguuccucgaggagaugcugcggacccgagugggcaccaagcacgcgauccugcuaguggccgucuccuucgugacgcugaucaccgggaacaugagcuuccgagaccuggggcgcgugauggucaugguaggggccaccaugaccgacgacaucggcaugggcgugacguaccucgcccuucuggccgcguucaaggugaggccaacguucgccgccgggcucuuacugcggaagcucaccuccaaggaacugaugauggccaccauuggcaucgcccugcucagccagucgacgaugcccgaaaccauucuggagcugaccgacgcgcucgcccuggggaugauggugcugaagaucgugcgcaacauggagaaguaccagcucgccgucaccauaauggcgaucagcugcgucccaaacgccgugauccuccagaacgcguggaaggucuccugcacgauacuggccgccgucagcgucagccccuugcugcugaccagcucccagcagaaggccgacuggauaccccucgcacuaaccaucaagggucugaaccccaccgccaucuucuuaaccacccugagucggaccaguaaaaagcgcagcuggccgcugaacgaggcuaucauggcagugggcaugguaucgauccucgccagcagccugcugaagaacgacauccccaugaccgggccgcucguggccggcgggcugcugacgguuuguuacgugcucaccggccgguccgccgaccuggagcuggagagagccgccgacguaaagugggaggaccaggccgagauuagcggguccagccccauccucuccaucaccaucagcgaggauggcuccaugagcauaaagaacgaggaggaggagcaaacccuaacgauccugauccggaccggauuacuggugaucuccgggguguucccggucagcauccccaucaccgcggccgccugguaccucugggaggugaagaagcagcgugccgguguucucugggauguccccagcccgccgcccguugggaaggccgagcuggaggacggcgcguaccggaucaagcaacgcgggauccugggcuauagccaaaucggcgcggggguguacaaggagggcaccuuccacaccauguggcacgucacacggggggccgugcucaugcaccgcggcaagcggaucgagcccagcugggccgacgugaagaaggaccuuaucagcuauggggggggcuggaagcuggagggggaguggaaggagggcgaggaaguccaggugcucgccuuagaacccgggaagaacccccgcgcggugcaaacaaagcccgggaucuucaagaccaacaccgggacgaucggugccguaagucuggacuucagccccggcacguccgggagccccaucguggaccggaagggaaagguggucgggcucuacggaaacggcguggugacccgguccggggccuacgugagcgccaucgcgcagacugaaaagagcaucgaggauaaucccgagaucgaagacgacauuuuccggaagaagcgccugacgaucauggaucuacaccccggcgccgggaagacaaagcguuacuuacccgcuaucgugcgagaggcaaucaagcggggccugcgcacucugauccuggccccgacucgcguggucgcggccgagauggaggaggcccuccgggggcugcccauccgcuaccagacgccggccauccgggccgagcacaccggccgcgagauaguggaucugaugugccacgcgaccuucaccaugcggcuccugucccccguucgggucccaaacuacaaccugaucauaauggaugaggcccacuucacggaccccgcaagcaucgccgcccggggcuacaucuccacccgcguggagaugggggaggcggccggcaucuucaugaccgccacgccgcccgggagccgggacccguuuccccaguccaacgcgcccaucauggaugaggagcgcgagaucccggagcggucauggaauucuggucacgaguggguaacugacuucaaggggaagaccgucugguucgugccgagcaucaaagcgggcaacgacauagccgccugucucaggaaaaacggcaagaaggugauccaacugagucggaagaccuucgacagcgaguacgucaagacccgcgcaaacgacugggacuucguggugacgacggauauuuccgagaugggagccaacuucaaagcugagcgggucaucgacccccgucggugcaugaagcccgugauccugaccgacggcgaggagcgcguaauccucgccgggcccaugccgguaacccacagcuccgcggcacagcggcgcggccgcaucgggcgcaacccgaagaacgagaacgaucaguauaucuacaugggcgaaccccuggagaacgacgaggauugcgcccacuggaaagaggcgaagaugcugcucgacaacaucaauacgcccgagggcauuaucccgagcauguuugagcccgagcgcgagaagguggaugccaucgacggggaguaccggcugagaggcgaggcucggaagaccuuuguagaccuaaugcgucgcggggaccuccccgucuggcuggcuuacaagguggccgccgaggggauaaacuacgcugaccgcaaguggugcuucgacgggaucaagaacaaucagauccuggaggagaacguggaggucgagaucuggaccaaagagggcgaacggaagaagcucaagccucgcuggcuggaugcccggaucuacuccgacccccucgcccucaaggaguucaaggaguucgcggccggcagaaagagccugacccugaaccucauaaccgagauggggcggcugcccaccuuuaugacucagaaggcccgcaaugcacuggacaaccuugccgugcugcacaccgcggaggccggcggccgggccuacaaccacgcccuguccgaacuccccgagacgcuggagacccugcuccugcucacccuccuggccaccgucacgggcggcaucuuccuguuccucaugagcggaaagggcauugguaaaaugacccugggcaugugcuguaucauuaccgcgaguauccugcuuugguacgcccagauccagccucacuggauugccgccagcaucauccuggaguucuuccugaucgugcuccugauccccgaacccgagaagcagcgcacgccccaggacaaccaguugaccuacguggucaucgccauccucacggugguggccgccaccauggccaacgagaugggguuccuggagaagacgaagaaagaccugggccucggcagcaucaccacacaggaguccgaaagcaauauccuugacaucgacuuacggccggccuccgccuggacccucuacgcggucgccacuaccuucguuacgcccauguugcgccauagcaucgagaacaguagcgugaacgugucccugaccgcaaucgccaaccaggcuacggugcucauggggcuggggaagggguggccccugagcaagauggacaucggcgugccccuccuggccaucgggugcuacucccaggucaacccgauuacauuaacggccgcccucuugcuccucguggcccauuaugcgaucaucggcccggggcugcaggcgaaggccacgcgggaggcccagaagcgagccgcagccgggaucaugaagaaucccaccgucgacggcaucaccgucaucgaccuggagcccaucccguaugaccccaaguucgagaagcagcuaggccaggucaugcugcugauccucugugugacacagguacugaugaugcgaaccaccugggcccugugcgaggcccucacccuggccacgggccccaucagcacccugugggagggaaacccuggccgcuucuggaacaccacuaucgcggugagcauggccaacaucuuccgcggaagcuaccucgccggggccggccugcuguucucaauuaugaagaacacgacgaacacccggcgcgggaccggcaacaucggagagacgcucggggagaaguggaaaucccggcugaacgcucugggcaagucagaguuccagaucuacaaaaaguccgggauccaggagguggaccgaacccucgcgaaggagggaaucaagcgcggggaaacagaccaccacgccgucucccgcggcagugccaaguuaagaugguucguggagcgcaacauggugaccccggagggcaaggucguggaccugggaugcggccgcggcggcugguccuauuauugcggagggcucaaaaacgugcgcgaggucaaagggcugacgaaggguggccccgggcacgaggagcccguccccaugucuacguacggguggaaccuggugcggcuccagucuggggucgacguguucuucacgccgcccgagaagugcgauacccugcugugcgacaucggcgaguccucgcccaaccccacgaucgaggcuggccgcacacuccgggugcugaaccugguggaaaacuggcucaacaacaacacucaguucugcaucaaagugcugaacccguacaugccguccgugauagagaaaauggaaacccugcagcgcaaguacgggggcgcgcucguccggaacccgcugagccgcaacuccacccacgagauguacugggugagcaacgccacugggaacaucguguccagugucaacaugaucucacguaugcugaucaaccgcuucaccaugaagcacaagaaggccaccuacgagccggacguggacuuaggcucagggacccguaacaucggcaucgaguccgaaacacccaaccuggacaucaucggcaagcgcaucgagaagauuaagcaggagcacgagaccagcuggcauuacgaccaggaccaccccuacaagaccugggccuaccauggguccuacgagaccaaacagacuggcagcgccuccagcauggugaacggggucgugcgccugcugaccaagcccugggacgugguuccuauggugacccagauggccaugaccgacacgacucccuucggccagcagaggguguucaaggagaaggucgacaccagaacccaggagccgaaggagggcacgaagaagcuaaugaagaucacagccgaguggcuguggaaggagcuggguaaaaaaaagacgccccggaugugcacccgagaggaguucacgaagaaggugcgguccaacgccgcccucggcgccaucuucaccgaugagaacaaguggaagagugcgcgcgaagccguggaggacgggcgcuucugggagcugguagaccgcgagcggaaccugcaccucgaggguaagugcgaaaccugcguguacaacaugauggggaagcgcgagaagaagcuuggcgaguuuggcaaagccaagggcucccgagcgaucugguacauguggcugggcgcgcgcuuccuggaguucgaagcccugggguuccugaacgaggaccacugguuuucccggggcaacagccucuccggugucgagggagagggccugcaccgacugggcuauauccuccgggaagugggcaagaaggagggcggcgccauguacgccgacgacaccgccgggugggacacgagaaucacccuggaggaccugaagaacgaggagauggugaccaaccacaugaaaggcgagcacaagaagcucgcggaggcuaucuucaagcugaccuaucagaacaaggucgugcgaguucagcgcccgacgccacggggcacagucauggacaucaucucccgccgggaucagcgcgggagcggccagguagggaccuacggccugaacaccuucacgaacauggaggcccagcucauccgccagauggagggagaggguaucuucaagagcauccagcaccuaaccgccaccgaggagaucgccgugcagaauuggcuggcgcgugucggccgcgaacgccugucccgcauggccaucagcggggacgacugcguagugaagcccaucgacgaccgguucgccagcgcccugaccgcccuuaacgacaugggcaaaguccgcaaggauauccagcagugggagcccagccggggguggaacgacuggacgcaggugccguucugcucccaccacuuccacgagcucgugaugaaagacggccgcguccugguggugcccugccggaaccaggacgagcuuaucggccgcgcgcgcaucagccagggggccggauggucccucaaggagaccgccugccuagguaagagcuacgcccagauguggacucugauguacuuccaccgccgggaccuccgccuggccgcuaacgccauuugcuccgcuguccccagccacugggugcccacuuccaggaccacguggagcauccacgccaagcacgaguggaugaccaccgaggacaugcuugcgguuuggaaccgcgucuggauccaggagaacccguggauggaggacaagacccccguggaaaguugggaggaggugcccuaccugggcaagcgagaggaccaguggugcggcagucugauagggcugacgagccgcgccaccugggccaagaacauccagaccgccauuaaccagguccggagucucaucggcaaugaggaguacaccgacuacaugccaagcaugaagcgcuuccgccgggaggaggaggaggccggugugcugugguga

SEQ ID NO: 24987 - RNA, 9876 nt, Artificial Sequence
  derived and/or modified CDS sequence (opt11) from DENV-2__FJ882602__SS-prME
acugcugggaugaucaucaugcuaauccccaccgccauggcguuucaccugaccacccgcaacggugaaccucacaugaucgugagccggcaggaaaaaggcaagagccuucuguuuaagaccgaagacggcgucaacaugugcacccucauggccauggaucugggcgagcugugugaggacaccaucaccuauaacugcccacuuuuacgccagaacgagcccgaggauaucgacugcugguguaacagcaccaguaccugggugaccuaugggaccugcacugccaccggcgagcaccggcgcgagaagcggagcgucgcccuggucccccacgugggcauggggcuggagacccggaccgagacuuggauguccagcgaaggcgcuuggaagcaugcgcaacgaaucgagaccuggauacuucggcacccgggguucaccaucauggcagccauccucgcauacaccaucggcaccaccuacuuccagagggugcugaucuuuaucuuacugacggccgucgcccccuccaugaccaugcgcugcaucgggauaucgaaccgcgauuucguggagggcguguccggagguagcuggguggacaucgugcucgaacauggcagcugcgugacuaccauggccaaaaauaagccuacgcuggacuucgagcugaucaagaccgaggccaagcagcccgccacguuacgcaaguauugcaucgaggcgaagcugaccaacaccaccacagcaaguaggugcccgacacagggagaacccucccuaaacgaggagcaagauaagcgcuuugucugcaagcauucuaugguggaccggggcuggggcaacggguguggauuauucgggaagggcgggaucgugacuugcgcgauguuuacauguaagaaaaacauggaagggaaaaucgugcagcccgagaaccuggaguacaccaucgugaucacgccgcacuccggggaggagaaugccguggggaaugacacgggcaaacaugggaaggagaucaaggucaccccgcaaagcucaaucaccgaggcggagcugaccggcuacggaacuguaaccauggaauguagcccccgcaccggcuuggacuuuaaugagauggugcuucuacagauggaaaauaaggcgugguuaguccaccgacaaugguuccuggaccugccccucccuuggcugccgggcgccgacacccaggggagcaacuggauccagaaggagacuuugguaacguucaagaauccgcacgccaagaagcaagauguaguagugcucggcagccaagagggggcgaugcacaccgcccugaccggcgcgaccgagauccagaugucauccgggaaccuccuauuuacgggccaucugaagugcaggcugcggauggacaaguuacagcuuaaaggaaugucuuacuccaugugcaccggaaaguuuaaggugguuaaggagaucgcugagacccagcacggcaccaucgugauacgcguccaguacgagggggauggcagccccuguaagauccccuucgaaaucauggaucuugagaagcggcacgugcuuggccgccugaucaccgugaacccgaucgucaccgagaaggacucgcccgugaauaucgaggccgagccgccguucggcgacucuuacaucaucauaggcguggaaccggggcagcucaaguuauccugguucaagaaggggagcuccaucggucagauguucgagaccaccaugcgcggcgccaagcggauggccauccugggcgauacggcaugggacuucgggagccugggaggagucuucaccuccauuggcaaggcuuugcaccagguauuuggggccaucuacggcgcagcuuucaguggcguguccuggaccaugaagauccugauuggggucgugaucaccuggauuggcaugaauagcaggucuaccagcuuaagcguggcuuugguccuaguggggguggucacauuauaccuuggcguuauggugcaagccgauagcgggugugucgugucguggaagaacaaggagcugaagugcggaucuggcaucuucauuaccgacaacgugcacaccuggacggagcaguauaaguuccagcccgagagcccguccaagcuggccagugccauccagaaggcgcacgaggaggggauaugcggaauccggaguguaacccgccuggaaaaucucauguggaagcaaauuacccccgagcugaaccacauccuauccgaaaaugaggugaaguuaaccauaaugacgggggacaucaagggcaucaugcaggccgggaagcggucccugcggccccaacccaccgagcugaaguacagcuggaagacguggggcaaggccaagaugcucucaaccgagccccacaaccagacguuccugauugauggcccagaaaccgccgagugccccaauaccaaccgggccuggaacagccuggagguggaggauuacggguucggagucuuuacuacgaacaucuggcucaaacuaaaggaacgucaagacguauucugugacuccaagcugaugucggcagccauuaaagacaaccgggccguacacgccgauaugggguacuggaucgaaagcgcccugaacgacaccuggaagaucgagaaggccagcuucauugagguuaaguccugccauuggcccaagagccauacccuaugguccaacggcgugcuggagagcgagaugaucauacccaagaacuucgcuggcccagugucgcagcacaauuauagaccuggguaccacacccagaccgccggccccuggcaccucgggaagcuggagauggauuucgacuuuugcgagggcacgacagugguggugacggaagacugcgggaacagaggcccuagcuugcgcacgacgaccgccagcggcaagcucaucaccgaguggugcugccgguccugcacccucccgccucugagauaccgaggggacgacggcugcugguacgggauggagauccgccccuugaaggagaaggaagagaaccuagucaacagccugguaacggcgggcuaugggcagauugacaauuucucccugggcguacugggaauggcccuguuccucgaggagaugcugcggacucgaguagggacgaagcaugcggugcugcucguagccgucagcuucaugacccugaucacgggcaacauguccuuuagagacuuggggcgggugguuguaauggugggcgccgcgaugacggaugacaucggcaugggcguaaccuacuuggcccugcuggcggcauucaagguccgacccaccuuugccgcuggccuccugcuccggaagcucacaagcaaagaacugaugaugacuacuauugggaucguacugcuuucccagagcaccauccccgagacgauccuggagcugaccgacgcccucgcccugggcaugaugauccugaagaucgugcgcaauauggaaaaguaccagcuugccgugaccaucauggccauacucugcguucccaacgccgucauucugcagaacgccuggaaggucagcugcaccauccucgcugucgucaguguuagcccccuacugcucacgaguagucaacagaaggccgacuggaucccccuggcgcugaccaucaagggacucaaccccacggccaucuucuugaccacgcuuucucggacuaacaaaaagcgcuccuggccucucaacgaggccauuauggccguugggaugguuucgauuuuagccuccagccugcucaaaaacgauauccccaugacaggcccucucguagccggagggcuguuaaccguuuguuauguccucacaggcagguccgccgaccuggaacuugagcgcgccgcagacgugaggugggaggaccaagccgaaaucucugggucaagccccauauuaaguaucacaaucuccgaggacgggagcaugucgaucaagaaugaggaggaggaacagacccugaccauccucauccgcacgggacugcucgugaucagcggccuguuccccgucuccauccccaucaccgcggcggcuugguaccugugggaggugaaaaagcagcgggccggggugcugugggacgucccuucuccuccgcccguggggaaggccgagcucgaggacggggcguacaggauaaagcagaagggaauccugggcuauucccagaucggcgcaggcguuuacaaggaggggaccuuccacaccauguggcacgucacaagaggggccgugcucaugcacaaggggaagcgcauagagccgagcugggccgacgugcguaaagaccucaucuccuacggcggggguuggaaacuggagggggaguggaaggaaggggaggaaguccaggugcuugcccucgagccuggcaagaacccgcgcgcggugcagacgaagcccggacucuucaaaacaaacaccggcaccaucggggccgucagccuggacuucucaccgggaacgagcggaucccccaucgucgacaagaaggggaagguugucggguuauacgggaacggcguggugacccgcagcggcaccuaugucuccgccaucgcacaaacagagaagucgaucgaggacaaccccgagaucgaggaugacaucuuccgcaagcggaggcugacuauuauggaucugcacccaggugcgggcaagaccaagcgcuaccuuccggcgaucgugcgcgaggccaucaagcgcgggcugcgcacccucauccuggcccccacccgcguugucgccgcggaaauggaggaggcccuccggggccuacccauccgcuaccagacuccagcaauccgggccgaacacaccggucgcgagaucguggaccugaugugccacgccaccuuuaccaugcggcuccuuuccccugugcgcguccccaacuacaaccugaucaucauggacgaggcgcacuucacggacccggccagcauugccgcucggggcuacaucagcacccgcguggagaugggcgaagccgcggggauauuuaugacugccacaccucccggcucccgggaccccuucccccagaguaacgcccccaucauggaugaggagcgcgagaucccggaacguucuuggaacagcgggcaugagugggugacggacuucaagggcaagaccgucugguuugugcccuccaucaaggccgggaacgacaucgcagccugucuccgcaagaacggcaagaaagucauccagcugagccggaagaccuucgacuccgaguacauaaaaacacgcacaaacgauugggauuucguuguaacgaccgacauaagcgaaaugggagccaacuucaaggcggaacgcgugaucgauccccgccggugcaugaagcccgugauccugacugauggggaggagcgcgugauccucgccgggccuaugccugugacacauuccucagcugcccagcggagaggacgcaucgggcggaacccaaagaacgagaacgaucaguacaucuacaugggggagcccuuagaaaacgaugaggacugugcccacuggaaggaagccaaaaugcuucucgacaacauaaacaccccugaaggcaucauacccagcauguucgaaccagagcgcgaaaaggucgaugccaucgacggggaauaccggcuacgcggugaggcgcgaaaaaccuucguagaccugaugagacgaggcgaccugccuguuuggcuggccuaccgcgucgccgccgaggggauaaacuacgcugaccggcgcuggugcuuugacggcauaaagaacaaucagauucuggaagaaaacguggaaguagagaucuggaccaaggagggggagcgcaagaaauuaaagccccgcuggcuagaugcgcggaucuacagcgacccccuggcccucaaagaguuuaaggaguucgcagccggcaggaaaucccuuacgcugaacuugauaaccgaaaugggccggcugcccaccuuuaugacucagaaagcgcgcaacgcgcuggauaaccuugccgugcugcauaccgccgaggccgggggacgggcguauaaccacgcccugagcgagcuccccgagacccuggagacgcugcuccugcugacauugcucgccacggugaccgggggcaucuuucuuuuccucauguccggcaaggggaucggaaagaugacacuggggaugugcugcaucauaacggccuccauacuauugugguacgcccaaauccaaccccacuggauugcagcguccauaauccuggaguucuucuuaauaguuuuacuuauccccgagcccgagaaacagcgaacaccgcaagacaaccaacugacuuacguggugaucgcaauucucaccguaguggcugccaccauggcgaacgagaugggcuuccucgaaaagaccaagaaagaccugggccucggcagcauugccacucaacagccugaguccaacauccuggacaucgaccugcggcccgccagcgccuggacccucuacgcgguggcgaccacauucaucaccccaaugcugcgacauagcaucgaaaauucaagcgucaacgugagccugacagccauagccaaucaggccacggugcucaugggucuggggaagggcuggccccugucgaagauggacaucggagucccuuuacuggcgaucggcugcuacucccaggugaaccccaucacccugacggccgcguugcugcuucugguggcccauuacgccaucaucgggcccggccugcaggcgaaagccacccgggaggcccagaagcgggcugccgcgggcaucaugaagaacccaacggucgacgggaucaccgucaucgaccuggaccccauccccuacgaucccaaauucgagaagcagcucggccaagugaugcuucucguccucugugucacacaggugcugaugaugcgcaccacgugggcucugugcgaagcccuaacucuggccacagguccaauaagcacccugugggagggaaaccccgggcgguucuggaacacaaccaucgcagucuccauggcgaacaucuuccgaggcucuuaccucgccggcgcagggcuguuauuuuccauuaugaaaaacacgaccaacacccggcgcggcaccgggaacacgggcgaaacccucggggagaaguggaagaaccgccuuaaugcucuggguaagucggaguuccagaucuacaaaaaguccggcauccaggaaguugaccgcacccucgccaaggagggaaucaagcggggcgagacggaccaccaugccgugagccggggguccgccaaguuaagaugguucgucgagaggaaccuggugacgcccgagggaaaggugguugaccucgggugcggccggggcggguggagcuauuacugcggugggcuuaagaacgugcgcgaggucaagggucugaccaagggcggucccggccacgaggaaccgauccccaugaguaccuauggauggaaccucgugaggcugcagaguggggucgacguguucuuuacgccgcccgagaagugcgacacucugcucugcgacaucggggagucgagcccuaaccccacgguggaagcaggccgcacccuucgggugcuaaaccucguggagaauuggcugaacaacaauacacaguucuguauaaagguacuuaauccauacaugccgucagugaucgagaaaauggaggcgcugcagcgcaaauacgguggugcguuggugcggaacccccugagccgcaacagcacccacgagauguacugggucuccaacgccagcggaaauaucguguccucugucaauaugaucucacggauguuaaucaaccgguucacgaugaggcacaagaaggcaaccuaugaaccugacguagaccucgguagcggcacacguaauauugggauugagucugagaccccaaaccuugauauuaucggcaaaaggauagaaaagaucaagcaggagcacgagacgucuuggcauuaugaccaggaccacccguacaaaaccugggcuuaccaugguuccuacgagacaaagcagacggggagcgccaguagcauggugaacggcguaguccggcugcucacuaagccaugggacgugaucccaauggucacgcagauggcgaugaccgauaccacgcccuucgggcagcagcgcgucuucaaagagaagguggacacgaggacccaggagcccaaggagggaaccaagaagcugaugaaaaucacugccgaguggcuguggaaggagcuaggcaagaagaagacgccuaggaugugcacccgggaggaguucacccgcaaggugcgauccaacgcggcacugggggccaucuuuacggacgaaaacaaguggaaguccgcgcgcgaggcaguagaggauucccgguuuugggaacuuguggacaaggagaggaacuuacaccuggagggcaagugcgaaacgugcguauacaacaugauggggaagcgggagaagaagcugggcgaguucgggaaagccaagggcagccgcgcaaucugguauauguggcucggcgcgagguuucucgaguuugaggcccugggguuccucaacgaagaccacugguucagcagggaaaacagccuguccggcguugaaggagaggggcugcacaagcucggguacauucuuagagacgugagcaagaaggagggcggcgcuauguacgccgacgacaccgccgggugggacacucgaauaacgcuggaggaccugaagaacgaggaaauggucaccaaucacauggaaggugaacacaagaaacuggcggaagccaucuucaagcugacuuaccagaacaagguggugcgaguacaacggcccacgccccgugggacugugauggacaucaucagccgucgcgaccagagaggcucaggacagguggggaccuacggccucaacaccuuuaccaacaugggggcccagcugaucagacaaauggagggcgaggagguauucaaggggauccagcaccugacggccacugaagagaucgcaguacagaauuggcucgcgagagugggccgagagcgguugucgcguauggccaucucaggugacgacugcguaguaaagccguuagacgaccgguuugcaagcgcccucaccgcauuaaacgacauggguaaagugaggaaagauauacagcagugggagccuucccgcggcuggaacgacuggacccaggucccauucugcucacaccacuuccacgagcugaucaugaaagaugggcggguacuugugguacccugccgcaaccaggacgaguuaaucggccgcgcgcgaaucucccagggggcaggcuggucucugagagagacggcaugcuugggcaagucuuaugcccagauguggucccugauguacuuccaccggcgcgaucugagacucgcagcgaacgccaucuguuccgcagugccgagccacugggugcccacgucccgcaccaccuggagcauccacgcccggcacgaguggaugaccacggaggacaugcugaccgucuggaaucgcguguggauccaggaaaacccguggauggaggacaaaacccccgucgaguccugggaggagaucccguaccucggaaagcgagaagaccaguggugcggcucgcucauuggucugacaucacgagcgacgugggccaagaacauccagacagccaucaaccaggugcgcagccucauagguaacgaagaguacaccgacuacaugcccucuaugaagcgguucagacgggaggaggaagaggccggagugcucugguga

SEQ ID NO: 24988 - RNA, 9876 nt, Artificial Sequence
  derived and/or modified CDS sequence (opt11) from DENV-2__GQ252676__SS-prME
acagcagggguaauaauaaugcuaauuccgacggcaauggcauuccauuugaccacacgaaacggagaaccccacaugaucguaaguaaacaggaaaaaggaaaaagccuacuauucaaaaccgaagaaggugugaacaugugcacgcuaauggccauggaccucggggaacucugcgaagauacaauaacguauaacugcccucuucuacgacaaaacgaaccggaagacaucgacuguuggugcaacagcacgagcacaugggucaccuacggaacaugcacggcaacgggagagcacaggcgugagaaaagguccguggcacucgugccgcauguagggaugggacuagagacucgcaccgagaccuggaugaguagcgaaggcgcguggaaacacgcccagcgcauagaaacauggauucuccgccaccccggguucacgauaauggccgccaucuuagcguacaccaucggaaccacauacuuccagaggguccuaaucuucauccuccugacagcggucgcgccguccaugacaaugcgcugcauaggaaucuccaaucgggacuucguugaaggaguaagcggaggcaguuggguagauaucguacuggaacacggcagcugcgugacgacaauggcuaaaaauaaaccaacacuggacuucgaauuaauaaagacagaggcaaagcagccggccacacuacgaaaauacugcaucgaagcaaaacucacgaacacuacaacagcaagucgauguccgacacaaggcgaaccaagccugaacgaggaacaagacaaacgguucguaugcaagcacucuauggucgaccgcggaugggguaauggaugcggacuauucggcaaaggagggaucgugacgugcgcaauguuuaccugcaagaagaacauggaaggcaagauaguacagccagaaaaccuggaauacaccauaguuguaacaccacacucuggcgaagagaacgcugucggcaacgacaccggaaaacauggcaaagagauaaaggugacuccacagagcucgaucacugaggcugaacuuacuggauaugguacaguuaccauggagugcucaccgcgaacgggccuugauuucaacgaaaugguacugcuccaaauggagaauaaagcauggcuaguacaccgccagugguucuuggauuuaccacugcccuggcucccaggcgccgacauucaagguaguaauuggauucaaaaggagacacuggugacuuucaagaauccacacgccaagaaacaggacguggucgugcuuggaucgcaagaaggugccaugcacacggcccuuacgggcgccacagaaauccaaaugagcuccggaaaccuccuauucacgggucaccucaaaugccgccuccgaauggacaagcuccaguugaaaggaaugucauacagcaugugcacagggaaauucaaggucgugaaggaaauugcugaaacccagcacgguacgaucgugguacgaguccaauacgagggcgauggaagcccguguaaaaucccauucgaaaucauggacuuagagaaaaggcacgugcugggcagacugauaaccguaaacccaauagucaccgagaaggacagcccaguuaacaucgaggccgagccacccuuuggugacagcuacaucauaaucggcguagaacccggucagcuaaaguugagcugguucaagaaggggaguucaauaggacagauguucgagacaacaaugcgcggagccaaaaggauggcaauucucggagauaccgccugggacuuuggcucguuggguggaguauucaccagcauaggcaaggcgcuacaccagguauuuggcgcgaucuacggcgccgccuucucaggggucuccuggacaaugaaaauacucaucggcgucguaauuaccuggauagggaugaacucgcguucaaccagccucagugugagccuagugcugguuggaguugugacguuauaccuaggagucauggugcaggccgacagcgggugcguggucagcuggaagaacaaggaacugaaaugcgggagcggcauauuuauaaccgacaaugugcacacuuggaccgagcaauacaaauuucagccagagaguccaagcaagcuagccucugcaauacagaaagcacaugaagaaggaauaugcggcauucgaaguguaacccgacuugagaaccuuauguggaagcaaauaacgccugaacuaaaccauauccucagcgaaaacgaagucaaacuguccauaaugacaggcgauauaaaagguauaaugcaggcuggcaaacguagcuuacgaccucaaccaacggaauuaaaauacaguuggaaaacuuggggcaaggcuaagaugcugaguaccgagccacacaaccaaacguuccuaauagacggcccagaaacagcggagugcccaaacacuaacagagcauggaacucacuagaagucgaagacuauggcuuugggguuuucaccacaaacaucugguugaaguugaaagaaagacaggacguauucugcgacagcaaacuaauguccgcagccaucaaggacaauagagcagugcaugcggacaugggauacuggauagaaagcgcacuaaacgauaccuggaagauugaaaaagcgagcuucauagaagugaaauccugccacuggccuaagagccauacauugugguccaauggaguacuggaauccgaaaugauaauccccaagaauuucgcaggaccagucucacaacacaacuaucgccccggauaccacacgcaaacagccggucccuggcacuuaggaaagcuagagauggacuucgauuuuugcgaagggacaaccguaguagugacggaagacuguggaaaccguggccccucgcucagaacuacgaccgcaagcgguaaacuuauaacagaauggugcugccggucuuguacacucccaccgcuccgcuaucguggggaagacggcugcugguacggaauggagauucgcccgcugaaggagaaggaagaaaaccuggucaacucgcucgugacggcgggacacggccaaauagacaacuucagccuaggcguacuaggaauggcucuauuccucgaagaaauguuacgcacaagggucggaacaaaacaugcagucuugcucguagcggugaguuuuaugacgcugauaacgggcaacaugucauuucgagaccuaggacgcguuauggucaugguaggugcagcgaugacagaugacaucgggaugggagugacauaucucgcgcuccuggcggcauucaaaguaagacccacauuugccgcaggccuuuugcuacguaaacucacaucgaaagaacucaugaugacaacgaucggcaucguccuacucagucaguccacgauccccgaaacaauccuagaauugacagaugcacuggcacucgggaugaugauacuaaagauagucagaaauauggagaaauaccagcucgcagucacgaucauggcuauccuaugcguuccaaaugccguuauccuacagaacgccuggaaggucagcugcacaauauuagcagcagugucagucucaccucuauugcucacgaguagucaacaaaaggccgacuggauaccccuagcucucacaauaaagggacuuaacccgacggcaaucuuccuaacgacucuaagccggacaaauaagaaacgcagcuggccacucaacgaagcaaucauggcagucggaaugguuaguauauuggcgagcagccuacuaaagaacgauauacccaugacggggccacucguugccggcggccuccucaccgugugcuacguacuuacaggccgaucugcagaccuagaacucgaacgggccgcagacguacgcugggaagaucaggcagaaaucucuggaagcagcccgauacuuaguauuacaaucucugaggacggguccaugaguaucaaaaaugaggaagaggaacaaacccugaccauccuaauccgaacaggacuccuggucaucucaggguuguucccagucagcauucccauaacggcggcggcaugguauuuaugggaggucaagaaacagcgagcagggguccucugggacguaccuucgccaccaccugucggcaaggcagaacuagaagacggugcguaucgaaucaagcaaaaaggcauacuaggauacagccaaauaggcgcaggggucuacaaagaaggcaccuuccauacuauguggcauguaacacggggugcuguccuaaugcacaagggaaaacggaucgaaccgagcugggcagacguacgaaaggaucugauauccuacggaggaggcuggaagcuggaaggugaauggaaagaaggagaagaaguacagguccuugcccuugaacccggcaaaaauccaagggcuguccaaacaaagcccgggcuuuucaagacuaacaccggcacuauuggggccgucucucuagauuucagcccuggcacaagcggaucgccaaucguggauaagaaaggcaagguaguggggcucuauggcaacggagucgugaccagaaguggaaccuacgugagcgcgauagcacagacugagaaaagcauagaagacaacccggagaucgaagacgacauauuuagaaagaagagauuaacaaucauggaucuucacccuggggcagguaaaacgaaaagauaucuacccgcaaucgugcgugaggcuaucaaaagaggccuacgaacacuaauccucgcaccaacccgcguuguggcggcggaaauggaagaagccuuaagggggcuacccauaagauaucaaacuccagcgauaagagcagagcacaccggcagagagauaguugaccuuaugugccacgccaccuucacgaugcgucuucucucacccguccgcguacccaacuacaaccucauaauaauggacgaggcccauuuuaccgaccccgcauccaucgccgcgcgaggcuacauuagcacacgaguagaaaugggagaggccgccggcaucuucaugacagcaacuccacccgggagccgagaccccuucccccagucaaacgcccccaucauggacgaagagagggagaucccagaacgcagcuggaacagcggccaugaauggguuacagacuucaaaggaaaaacagugugguuuguuccaucuaucaaggcaggaaacgacauugcagccugccuccggaaaaaugggaaaaagguaauccaacucucacggaaaacguucgacucagaauacaucaaaacucgcaccaacgacugggacuucguugugacuacugacaucuccgagaugggggccaacuucaaggcggagcgcgugauugauccacggcgauguaugaaaccggugauacucacagauggugaagaacgcgucaucuuagcagggccgaugcccguuacacauaguagugcagcacagagacgaggccgcauaggcagaaaccccaaaaacgagaacgaccaauacaucuacaugggggagccucuggagaacgacgaagacugcgcucauuggaaagaagcaaaaaugcuuuuggauaacaucaacaccccagaagggauaauaccgucaauguuugaaccagagagggaaaaaguugacgccauugacggcgaauauaggcucagaggugaggcgagaaaaacuuucgucgacuugaugcgcagaggggaucuaccaguauggcuggccuaccgcguagcugccgagggaaucaauuacgcugaccgucgguggugcuucgauggaauaaagaacaaccaaauucuugaggaaaacgucgaagucgagaucuggacaaaagaaggugaaagaaagaaacuaaagccacguuggcucgaugcccggaucuacucagacccgcuggcguuaaaagaguucaaggaguucgcagccgggaggaaaucacucacgcucaaccuaauaaccgaaauggggagacucccuaccuucaugacccagaaagcccggaacgcccucgacaaccucgcaguucuccacacagcagaggcaggcggccgggcguacaaccaugcacuaucggagcuaccagagacacuggaaacacugcuccuauuaacguugcuugcaacaguuaccggcgggaucuuccucuuccuuaugagugggaagggcauaggcaaaaugacucugggcaugugcugcauaauaaccgccaguauacuccucugguaugcacagauacaaccccacuggauugcagcauccauaauucuagaguucuuuuugaucguacucuuaauaccagagcccgaaaaacaaaggacgccgcaggauaaucaacugaccuauguggucaucgcaauacuaacuguaguggcggccacaauggccaacgaaauggguuucuuagagaaaacaaagaaagauuuuggccuuggcucaauagccacgcagcagccagaaucaaauauucucgauauagaccuacgcccagccagcgcauggacucucuacgcaguagcgaccaccuucaucacgccaaugcuacgacacagcauagagaauagcagugucaacguaucucuaacggccauugcaaaucaggccacuguccuaaugggacucggcaaaggauggccacucagcaaaauggauauagguguaccccuacuggccaucgggugcuacucccaagucaacccgaucacacuuacugcagcgcucuuacuucugguggcgcacuacgcaauaaucggaccaggacuccaggcuaaagcaacacgagaagcucagaaacgagcagcggcugggaucaugaaaaaccccacagucgacggaaucaccgucaucgaucuugaccccauccccuacgacccgaaguucgaaaagcaacugggucaggugaugcuccuaguacuaugcguuacccaagugcuuaugaugaggacgacuugggcgcuaugugaggcgcugacccuggcaacagggcccauaagcacacuaugggagggaaauccaggccgauuuuggaacacaacaauagccguuagcauggcgaauaucuuuagagguaguuaccuugcuggggcgggccuacuauucucgaucaugaaaaacacaacaaacaccaggagaggcacuggcaacacgggcgagacccucggagagaaguggaagaaucgccuaaauuccuuagguaaguccgaguuucagauauacaaacggucagggauccaggaaguggaccgaacauuggccaaagagggcauuaagcggggagaaacugaccaucaugcuguaucaagaggcuccgcgaaacugaggugguuuguagaacgcaaccugguaaccccagaagguaaaguugucgaucuuggcugcgguagaggaggauggucauauuacugcggaggucucaaaaauguccgugaagucaagggcuugaccaagggcggacccgggcacgaagaaccgauaccuaugucaacguacggauggaaucuugucagacuacaaagcggagucgacguuuucuuuacaccucccgaaaagugcgacaccuugcuaugcgacauaggcgaaucuaguccaaacccaaccguggaagcgggacgaacacuucggguccuaaauuugguggaaaacuggcucaacaacaacacccaguucugcaucaagguacugaacccauacaugccgucuguuauugagaaaauggaaacacugcagcgaaaguacggaggggcccuaguccgcaauccgcuaucuagaaacaguacgcaugagauguacuggguaucaaacgcgagcggaaacauuguaucgagcguaaauaugauaucccguaugcuaauaaacagauucacgaugagacacaagaaggcgacauaugaaccugacgucgaucuaggcagcgguacaagaaacauugggauagaaagcgagacuccgaacuuagauauaauaggcaaacgaauagagaaaaucaagcaagaacaugaaacgagcuggcauuacgaccaggaccaccccuacaaaacaugggccuaccacgguucguacgagaccaagcagacgggaagugcaagcagcaugguaaauggaguuguuagacuucuuacaaagccaugggacguaauacccaugguaacacaaauggccaugacggacaccacacccuucggccaacagcgagucuucaaggaaaaagucgacacccgcacucaagaaccaaaagagggaaccaagaaacucaugaaaauaacagccgaguggcucuggaaggaacuagggaagaagaagacgccacgcaugugcacccgcgaagaguucgcccgaaaaguccggagcaacgcggcgcuuggagcaaucuuuacagacgaaaacaaauggaaaagcgcacgcgaagccgucgaagauagcagguucugggaacuuguggacaaagaaaggaaucuccaucucgaggggaagugcgagaccuguguauacaacaugauggggaaaagagagaagaaaaucggagaguucggcaaagcgaaaggcagccgagcgauaugguacauguggcucggcgccagguuccuggaguuugaagcacuagguuucuuaaacgaggaccacugguucucaagagaaaacagccucagcggcguugaaggggaaggccuacacaaacuaggcuauauccugagggaaguguccaaaaaggagggcggggcaauguacgcggacgacaccgccggcugggacacgcgaauaacauuggaggaccucaaaaaugaggagaugguaacaaaccacauggaaggggaacacaagaaacuagcagaagcaauauucaagcuaaccuaccagaauaaaguaguccgcguccagagaccaaccccgcgagguacaguaauggauauaaucucacgcagagaucaaagagggagcggccagguggguacauacgggcuaaacacuuucaccaacaugggagcgcaacugauccgccagauggagggggaaggcguauucaaaggcauucagcaccucacugcaacggaagagguagcggugcaagacuggcuagcgcgugucggacgagaacgccuuucuagaauggcuauuucuggagacgauugcguggucaagccucuagacgaccgauucgcauccgcccuaacggcguugaacgauaugggcaaaguccgaaaggacauacaacaaugggaaccaagcaggggguggaacgacuggacacaagucccuuucuguucacaccauuuccacgaacucaucaugaaggacggaagaguuuugguaguaccgugucgcaaccaagaugaacucauuggccgcgcacgaauaucacaaggggccggauggucccuacgggagaccgccugccucgggaagucauacgcccagauguggucgcuuauguauuuccaccgccgagaccugagacuugcagcuaacgcgauuugcagcgcggugccgagccauuggguaccuacaagucgaacaacguggagcauucacgcaaggcacgaauggaugacuacagaggacaugcugaccguauggaauagaguguggauacaagaaaacccguggauggaagacaagacaccgguagaaagcugggaagaaaucccguaccucgggaaaagagaggaucaauggugcggcucucuaauaggccuaacaagccgggcgacaugggccaaaaacauccagaccgcuauaaaccaaguccgaagccuaauagguagcgaagaauacaccgacuacaugccuagcaugaaacgcuuccgucgcgaggaagaggaggccggcgugcuaugguag

SEQ ID NO: 24989 - RNA, 9876 nt, Artificial Sequence
  derived and/or modified CDS sequence (opt11) from DENV-2__GQ252677__SS-prME
accgcuggcgugaucaucaugcugauacccacagccauggcguuccaccucaccacccgcaacggcgagccccacaugaucgugucgaagcaggagaagggcaagucccugcuauuuaaaaccgaagagggagugaacaugugcacccucauggcgauggaccugggcgaacucugcgaggauacaaucaccuacaacugcccucuccugcggcaaaacgaacccgaggauauugacugcugguguaacagcacauccaccugggugaccuacggcaccugcaccgcgaccggcgagcaccgccgggagaaacgcuccgucgcccuggugccucacgugggcauggggcuugaaacucggaccgaaaccuggauguccagcgagggcgccuggaagcacgcgcagcggauugagaccuggauccugcggcaccccggguucaccauuauggccgccauccuggccuacaccaucggcacaaccuacuuccagcgcguccucauauuuauccuauuaacggcuguggcccccuccaugaccaugcggugcaucgggaucagcaaucgcgacuucguggagggcgugaguggcgguucaugggucgacaucguguuagagcacggcuccugcgugaccaccauggccaagaacaagcccacgcuggacuuugaacuuaucaagaccgaggcgaagcaaccugccacacuccgaaaguacugcauagaagcgaagcugacaaacacuaccacagccucgcgcugcccgacccagggggagcccagccugaacgaggagcaggacaagcgguuugugugcaagcacagcaugguggaucgggguuggggcaacgggugcggccucuuugggaagggagggaucgucacgugcgccauguucacgugcaagaagaacauggagggcaagauagugcaacccgagaaccuugaauacacaaucgugguuacgccccauagcggugaagagaaugccgugggcaaugacacgggcaagcacgggaaggagauuaaggucaccccacagagcagcaucacugaggcagagcugaccggcuacggcaccguuacgauggaguguagcccccguaccggucucgacuucaacgaaauggugcugcugcagauggagaauaaggcguggcucgugcacaggcaaugguuucuggaccugccccucccuugguuaccuggcgcagacauccagggguccaacuggauccagaaggagacccuggucaccuucaagaacccccacgccaagaagcaggacgucgucgugcucggcagccaggagggggccaugcacacggcgcugaccggcgcgaccgagauccaaauguccucgggcaaccuacuuuucaccggucaccugaaaugccggcugcgcauggacaagcuacagcugaagggcaugucuuacuccauguguaccgggaaguuuaagguggucaaggagaucgcggaaacccagcacggcacuaucgugguccggguccaauaugagggugacgggagccccugcaaaauccccuucgagauuauggaccucgagaagcgucacguucuuggccggcugaucaccguuaacccgauaguuacggaaaaagacucucccgugaacaucgaggccgagccgcccuucggugacagcuacaucauuaucggugucgagccggggcagcuaaagcuauccugguucaagaaaggcagcuccauagggcaaauguucgagaccaccaugcgcggcgccaaacgcauggcuauucugggcgacaccgcgugggacuucgggagccuagggggcgucuucacgaguaucggcaaggcacuccaccaaguguucggcgcgaucuauggcgccgcuuucagcggcguguccuggaccaugaagauacuaaucggugucgugauuaccuggauagguaugaacagccggucgacgagccuuuccgugagcuugguccucguggggguaguaacauuguauuuaggcgugaugguacaggccgauuccggcugcgucguaagcuggaagaacaaggagcugaagugcgguagcgguaucuucaucacggacaacgugcauaccuggaccgagcaauacaaauuucagcccgagucacccagcaaguuagcguccgccauccagaaggcucaugaggagggaaucugcgggauccgcucaguaacccgacuggagaaccuuauguggaagcagauuacccccgaguuaaaccacauccuguccgagaacgaggugaagcugagcauuaugaccggggacaucaaaggcaucaugcaggcagggaagcgcucccugcggccgcaacccacagagcucaaguacagcuggaagacguggggcaaggccaagauguuguccaccgagccccacaaucagacauuccugaucgauggcccggagacagccgaaugccccaacaccaaucgcgcguggaacucgcuggagguggaggacuacggguuuggcguguucaccaccaacaucuggcucaaacugaaggaaagacaggacguguuuugugacuccaaacugaugagugccgcgauuaaggacaacagggccgugcacgccgacaugggguacuggaucgagagcgcccucaaugauacuuggaagaucgagaaggccagcuuuauugaaguaaaaucuugccacuggccgaaaagccacacgcugugguccaacggcguguuagagagcgagaugaucauaccaaagaacuucgcgggcccggugagccagcacaauuaccgcccaggguaccacacccagaccgcgggccccuggcauuugggaaagcuggagauggacuucgacuucugugaggggaccacagucguggugacugaagacugcgggaaccgcgggcccagucugcgaaccaccaccgcgagcggcaagcucaucaccgaguggugcugccgcuccuguacccugcccccccuccgguaccgaggggaggauggcugcugguaugggauggagauccgaccgcuaaaagagaaagaggagaaccuggucaauagccuggugaccgcagggcacgggcagauugacaacuuuucacucggcgugcugggaauggcgcucuuccucgaggaaauguuacgcacgaggguagggacgaaacaugccgugcugcucguggccgucucuuucaugacccuuauuacuggcaacauguccuucagggaccuagggagggugaugguaauggucggcgccgccaugaccgacgacaucgggaugggcgugacguaccuugcgcugcuggccgcauucaaaguccgccccacuuucgccgcggggcuccuguugcgcaaacugacgagcaaggaacugaugaugaccacgaucgggaucguccugcucucccagagcaccaucccggagaccauccuggagcugacggaugcgcucgcgcugggcaugaugauacugaagaucgugcggaacauggagaaguaucagcucgccguuacgaucauggccauauuaugcgugcccaacgccgucauacuccaaaaugcuuggaagguaaguugcaccaucuuggcagccgugagcgugagcccgcugcugcucaccuccagucagcagaaggccgacuggaucccccuagcucugaccaucaagggacugaacccgacggccaucuuccugaccacccugagccgcacgaacaagaagagauccuggccguuaaacgaagccaucauggcggucggaauggugucuauccuugccaguucuuuacucaagaacgacaucccaaugacgggaccccugguggccggugggcuacucacagugugcuacguuuuaaccgggagaagcgccgaucuugagcucgaacgagccgcggacgugagaugggaggaccaggccgaaauuuccggcagcuccccgauccuuagcauuaccauaucugaggacgguagcauguccaucaagaacgaggaggaggagcagacuuuaaccauccugauucgaaccggccugcugguaaucaguggcuuauuucccguguccauccccaucaccgcggccgcaugguaccuaugggaagugaagaagcaaagggcaggcguacuaugggacgugccuagcccgccgccggugggcaaggccgagcucgaggacggcgcguaccggauuaaacagaagggcauacugggauauucacagauuggcgccggcgucuauaaggaggggacguuccacacuauguggcaugugacccgcggcgcuguucucaugcacaaggggaagagaauugagccgagcugggccgacgugcgcaaggaccucaucucuuacggcgggggauggaagcuggagggggaguggaaggagggggaggagguccagguccuggcccuugaaccuggcaaaaaccccagggcugugcaaaccaaacccgggcuguucaagaccaacacagguacuaucggggcugugagccuggauuucucuccggguaccagcgguucccccaucguugacaagaaagggaaggucgucggauuguacggcaacggcguggucacuagaagcggcacguauguguccgccauagcgcagaccgaaaaauccaucgaggacaaccccgagaucgaggacgacaucuuccgcaagaaacgccugaccaucauggaccugcaccccggggcgggcaagaccaagcgguaucuaccggccaucgugagagaagccauaaagcggggucuccgaacgcugauccuggcacccaccagggucguggccgccgagauggaggaggcccuccgcggacugcccauccgauaccagacccccgcgaucagagcagagcacacggggcgagagaucguagaccucaugugccaugccacguucaccaugcggcuccugagcccgguccgcguucccaauuacaaucugaucaucauggacgaagcacacuucacugacccagccucaaucgccgcccggggauacaucagcacucgcguggagaugggagaggccgcggggauuuucaugacggccacgccgccaggcagucgggacccuuuuccccagagcaacgcccccauuauggacgaggagagagagauucccgagcgauccuggaauagcgggcacgagugggucaccgacuucaagggaaagaccguaugguucguccccuccaucaaggccgggaaugauaucgcugccugccuccggaagaacggcaagaaggucauccaguugucccguaagaccuucgacuccgaauauaucaagacccgcaccaacgacugggacuuugucguuaccacggacauuucugaaaugggcgccaacuucaaagcagagcgugucaucgacccccggaggugcaugaagcccgugauacugaccgauggggaggaacgcgugauccuggccggcccgaugcccgucacccacuccagcgcggcgcagcggcgcgggagaaucggccgcaaucccaaaaacgagaacgaccaauacauauacaugggggaacccuuggagaaugacgaggacugcgcccauuggaaggaggccaaaauguuacucgacaacaucaacaccccggagggcauuauucccuccauguucgagcccgagcgugagaaaguggacgccaucgacggugaguaccggcugcgcggagaggcgcggaagacuuucguggaccugaugcgccggggcgacuugccuguauggcuggccuauaggguagccgcagaggggaucaacuacgccgaccgucgcuggugcuucgacggcauaaagaacaaucaaauccuggaggagaacgucgagguugagaucuggacaaaggagggagagagaaagaaauugaagccccgauggcuggacgccagaaucuacagcgacccccuugcucucaaggaguucaaggaauucgccgcgggccggaagucccugacccucaaccucaucaccgaaaugggacggcugcccacguucaugacccagaaagcccgcaacgccuuagacaaccuagccgugcugcacaccgcagaggcggggggccgggcauauaaccacgcccugagcgagcucccugagacccuggagacacugcucuugcugacccuccuggcuaccgucaccgggggcaucuucuuguuucucauguccgguaagggcaucggcaagaugacgcucgggaugugcugcaucaucacagccucuauucugcucugguacgcacagauacaaccacacuggaucgcggcauccauuaucuuggaguucuuuuuaaucguccuccucaucccugagcccgaaaagcagcgcacgccgcaagacaaucagcugaccuacgugguaauugccauccucaccgugguggccgccacgauggcaaacgagaugggcuuccuggaaaagaccaagaaggacuuugggcugggaucaauagccacccagcaacccgagucgaacauccuggacaucgaccugcggcccgccuccgccuggaccuuauacgcuguugcaacuacauucaucaccccaaugcugcgccauagcaucgagaacaguagcguuaacguguccuuaacggccaucgcgaaccaggcuacggucuugaugggcuuggggaaaggguggccccugagcaagauggauaucgggguaccauuacucgcgauaggcugcuacucccaggugaaccccaucacccugacggccgcccugcuccugcuggucgcccacuacgccaucaucgggcccggccuucaggcaaaggccacccgugaggcgcagaagcgcgccgccgccggaaucaugaaaaacccgacgguggacgggaucaccgugaucgaccuugaccccauccccuacgaccccaaguucgaaaagcaacugggccaagucaugcucuuggucuuguguguuacccaggugcucaugaugcggaccacgugggcccugugcgaggcccugaccuuggcaaccgggccgaucaguacuuuaugggagggcaaccccggcagauucuggaacacgaccaucgcuguaucuauggccaacaucuuccgcggcucguaccuggccggcgccgggcugcuguucaguauuaugaagaacacaaccaauacgcggcgcggcaccgguaacaccggcgagacccugggcgagaaguggaagaaccggcucaacuccuuaggaaaguccgaauuccagaucuacaagcgcagcggcauacaggagguggaccggacucuggccaaggaggggaucaaacgcggcgaaaccgaccaccacgcggugucccggggaucagccaaguuacgcugguucguggaaagaaaccugguaaccccagaaggcaaggucguagaccugggcugcgggcgcggcgggugguccuacuacuguggagggcucaagaacgugagggaggugaaagggcugaccaagggugggccuggccacgaggagccaauccccaugagcacuuacgguuggaacuuagugcggcuccaaaguggcguggauguuuucuucacgccgccugagaagugcgacacccugcugugcgauaucggcgagagcagcccgaauccgaccguggaggcuggccguacgcuccgcgugcuaaaucugguugagaacugguugaacaacaacacccaguucugcauaaaggugcuaaaccccuauaugccguccgugaucgagaaaauggaaacccuucagcggaaauauggcggggcacugguucggaacccccucucgcgcaacuccacucacgagauguacugggugagcaacgccuccggcaacaucgugagcuccgucaacaugaucagccgcaugcuaaucaaucgguucaccaugcggcacaagaaggcgaccuacgagcccgacgucgaccugggguccggcacccgcaacaucgggaucgagagcgaaacccccaaccucgauauaaucggcaagagaauugagaaaauuaaacaggagcacgaaaccucauggcacuacgaccaggaccacccguacaagacgugggccuaccauggcagcuacgagaccaagcagacgggguccgccagcagcauggugaacggcguggugcgccugcugaccaagccgugggacgugauccccauggucacccagauggccaugacggacacuaccccuuuugggcagcagcggguguuuaaggaaaagguagacacgaggacccaggagccaaaagagggcaccaagaaacucaugaagaucaccgccgaguggcucuggaaggagcuacgcaaaaagaagacgccacguaugugcacccgggaggaguucgcgcgcaaaguccggagcaacgccgcacucggcgcaaucuucaccgaugaaaacaaauggaaauccgcccgcgaggcgguggaggacagccgguuuugggagcugguggacaaagagcggaaccugcaccuugagggcaagugcgagaccugcguuuacaacaugauggguaaacgagagaaaaagaucggcgaguucggcaaggcuaaggguucccgcgcuaucugguacaugugguuaggagcccguuucuuggaguucgaggcgcucggcuuccugaacgaagaccacugguucagccgcgagaauucgcuuuccgggguggagggagaggggcuucacaagcuuggcuacauccuaagggaggugucgaagaaagagggcggcgcaauguacgccgacgacacggcuggcugggacacccgcaucacucucgaggaccucaaaaacgaagaaauggucacgaaccacauggaaggggagcacaagaagcuugccgaagcuaucuuuaaacucacguaucagaacaaagugguccgagugcagaggcccacaccccggggaaccgugauggacaucaucucacgcagagaccagcgggggagcggccagguaggaacguauggccuuaacacauuuaccaacaugggggcccagcugauccgccagauggagggagagggcguguucaaagguauacagcaucucaccgccaccgaggagguggcaguucaggauuggcuggcccgaguuggccgcgagagacugucccggauggcgaucucaggggacgacuguguggucaaaccgcucgacgaccgguucgcuuccgcacugacggcacucaaugauauggggaaggugcgcaaggauauccagcaaugggagcccagucggggcuggaacgacuggacccaggugcccuucugcucccaccauuuucacgagcucaucaugaaggaugggcgcguccugguggugcccugcagaaaucaggacgagcuaauaggccgcgcccggaucagccagggagcgggcuggucgcuccgugagacggccugccuuggaaagucauacgcccagauguggagucugauguacuuccaccggcgcgaccuccggcuagccgccaacgcgaucuguagcgccgugcccucccacugggugcccaccucgcgcacgacuugguccauacaugcccggcacgaguggaugaccaccgaggacaugcugaccguauggaaucggguuuggauucaggaaaaccccuggauggaggacaagacgcccguggagucuugggaagagaucccuuaucucgggaaacgcgaagaccaaugguguggcagccugaucggguuaaccagccgggccacuugggcgaagaauauacagacggcuaucaaccaggugcgcagccucaucgguuccgaggaguacacagacuacaugccgucuaugaaaagguuccgucgggaggaggaagaggcuggcguccugugguga

SEQ ID NO: 24990 - RNA, 9876 nt, Artificial Sequence
  derived and/or modified CDS sequence (opt11) from DENV-2__FJ898438__SS-prME
accgugggcgucaucgucauguugauccccaccgccauggccuuccaccucaccacccgcaacggggagccacacaugaucgugggccggcaggagaagggcaagucccuguuguucaagacggaggacggcgucaacauguguacccucauggcaaucgaccugggggagcugugcgaggacaccauaaccuacaagugccccuugcugcgccagaacgagcccgaggacaucgacugcuggugcaauagcaccucuaccugggugaccuacgggaccuguuccaccacaggcgagcaucggcgcgagaagcguucaguggcccuagucccccacguggggaugggccucgagacccgcaccgagacauggaugucaagcgagggggccuggaagcacgugcagaggaucgagaccuggauccuacgccacccuggguucacgaucauggccgccauccuggcguacaccaucgggacaacccacuuccagcgugccuugaucuucauacugcugacggccgucgccccaucgaugacuaugcgcugcaucggcauaagcaaucgcgauuucguggagggcguguccggcgggagcugggucgacaucgugcucgagcauggguccugcgugaccacgauggcaaagaacaagcccacgcuggacuuugagcugaucaaaaccgaggccaagcagcccgcuacccuccgcaaguauugcauagaagccaaguugacaaacacgaccaccgagucucggugcccgacucagggggaacccucucugaacgaggaacaagacaaacgguucauaugcaagcacagcaugguugaucggggaugggggaacggcugcgggcuguucggaaagggcgggaucgucacgugcgccauguucacgugcaagaagaauauggagggcaaggugguucagcccgagaacuuugaauauaccaucgugaucacgccucauuccggggaggaacacgcggugggcaacgacacgggcaagcacggcaaagagaucaagaucacaccacagagcuccaucaccgaggccgagcugaccggguacggcaccguaacgauggagugcagcccccggacuggccuggacuucaacgagaugguacuccugcaaauggaggacaaggcuuggcuggugcaccggcaaugguuccucgaccugccacugcccuggcuaccuggggccgacacccagggcuccaacuggauacaaaaggagacgcuggucacguucaagaacccccacgccaagaagcaagacguggucgugcuggggagccaggagggcgcaaugcacaccgcccucacuggggccaccgagauucagaugagcucaggcaaucuucuguucacgggccaccucaagugucgccugcggauggacaaguuacagcucaagggaaugagcuacuccaugugcaccggcaaguucaagaucgucaaagagaucgccgaaacccagcaugguaccaucgucauccgcguucaguacgagggcgacggaagccccugcaagauccccuucgagauaacggaccuggagaagcggcacguguuggggcgccucauuacagucaacccaaucguaacugagaaggacucccccgucaauaucgaggccgagccgccauucggcgacagcuauaucaucaucggugucgagccgggccagcugaagcugaacugguucaagaagggcuccagcauuggccagauguucgagacuacuaugcgcggagcaaagcggauggccaucuugggggacaccgccugggacuucgguagccucgggggcgucuuuaccagcaucgggaaggcacugcaccagguguuuggggccauuuacggcgcagccuucuccggggucagcuggaccaugaagauacucaucggcgugaucaucacguggauagggaugaacucacgcagcaccucccugagcgugucccugguccuggugggcguggucacccucuaccugggggcaauggugcaggccgacuccggcugcguggucuccuggaagaacaaggaacuuaagugcggcagcgggaucuucaucaccgacaacgugcacacguggaccgagcaguauaaguuucagcccgagagccccucuaagcucgcgagcgccauccagaaggcacacgaggagggcaucugcggaauccgguccgugacccgccuggagaaccugauguggaaacaaaucacccccgagcucaaucacauccugagcgagaaugaagucaagcucacgauuaugacgggcgacauaaaggggaucaugcaagccggcaagcggucccuccgcccgcagcccaccgagcugaaguacagcuggaagacaugggggaaagccaagaugcuguccacggagagccacaaccagaccuuccucaucgacggacccgaaaccgcggagugcccgaacuccaacagagccuggaacagccucgagguggaggauuacggcuucggaguguuuacuacgaacaucuggcugaagcuacgcgagaagcaggacgucuucugcgacucuaagcugaugagcgcugccaucaaggacaaucgggccguucacgcugacaugggcuacuggaucgaguccgcccugaacgacaccuggaagauggagaaggccagcuucaucgaggugaaguccugucacuggccgaaaagccacacacucugguccaacggcguacucgagagcgagaugaucauccccaagaacuuugccggacccgugucacagcauaacuacaggccggguuaccacacgcagaccgcugggcccuggcaccugggcaaacucgagauggacuucgauuucugcgaggggacgacgguggucgugacugaagacugcgguaaucggggaccuucccugcgcaccacgaccgcaucugggaagcugaucaccgaguggugcugccgguccugcacccucccgccccuacgcuaccguggcgaggacgggugcugguacggcauggagauccgcccccucaaggagaaggaggaaaaccucguaaauucuuuggucacugccgggcacggccagauugacaacuuuucccucggcguccucggcauggcgcuauucuuagaagagaugcuccggaccagaaucggaaccaagcacgccauacugcuggucgccgcaaguuucgucacucucaucacggggaacaugaguuucagagaccuuggucgcguaauggugauggucggggccaccaugacagacgacaucggcaugggcgugaccuaccuugcccuccuggccgcguucaaggugcgccccacguuugccgccgggcugcuccugcggaagcugacguccaaggaguuaaugauggccaccaucgguaucgcccugcugucccaaagcacuaucccggagacgauuuuagaacugaccgacgcgcuggcccucgggaugaugguauuaaagaucgugagaaauauggagaaguaccagcuggccgugacuaucauggccaucuccugcgucccgaacgcugucauccugcagaacgcauggaaggugagcugcacuauccuggccgccgucuccgugagcccccugcuccuaacauccucgcagcagaaggccgauuggauccccuuagcccuaaccaucaagggccugaaccccacugccaucuuccugaccacgcucucccggaccagcaagaaacgcuccuggccguugaacgaggcagugauggcagugggcauggugagcauccuggccagcucccuccugaagaacgacauccccaugaccgguccgcuggucgcaggaggguuacucaccgugugcuacgugcugacaggccgguccgccgaccuggagcuggaacgcgccgccgacguaaagugggaggaucaggcagaaaucucggggucuucucccauccugagcaucaccaucuccgaggacggcagcauguccauuaagaacgaggaggaggagcagacccucaccauccugaucaggacuggccuacucgugauuucagggguguucccggucuccaucccaauuaccgcggcugcgugguaccugugggaggugaagaagcagcgcgccggcgugcugugggacguucccagcccgccgccugugggcaaagccgagcucgaggauggcgcguaccggaucaagcagcgcggcauccuuggcuacucccagaucggcgccgggguguacaaggagggaacauuccacacaauguggcaugucacccgaggggcgguucugaugcaucgcggcaagcggaucgaacccagcugggccgacgugaaaaaggaccuuaucucuuaugggggcggcuggaagcucgagggggaguggaaggagggggaagagguccaggugcuggcucucgagcccgggaagaacccccgcgcgguacagacgaagcccgguaucuucaaaacaaauacggggaccaucggcgccgucagccuggacuucagccccggcacgucggggucccccaucguggaccggaagggcaaggugguagggcuguacggcaacgguguggugacaagaagcggggccuacgugucugccauagcgcagaccgagaaguccaucgaggauaaccccgagaucgaggaugauaucuuccgaaagaagcgccucaccaucauggaccugcaccccggagcggggaagacgaaacgguacuugccugccaucguacgcgaggccauuaagcggggccugcguacccugauccuggccccgacccgcgucgucgcggcagaaauggaagaggcccugcgggggcuccccauccgcuaccaaacccccgccauaaagacagagcacaccgggcgggagaucguggacuuaaugugucaugcgaccuuuaccaugcgccuucucagccccgugcggguccccaacuacaaucucaucaucauggacgaagcacacuuuacggacccggcguccaucgccgcccgcggauauaucagcacccgcguggagaugggggaggcggccggcaucuucaugaccgccacgccgcccgggucccgcgacccguucccccaaagcaacgcacccaucauggacgaggagcgggagauccccgaacgcuccuggaacagcggacacgagugggugacggauuucaaggggaagaccgucugguucgugccguccaucaaggccggcaacgacaucgcggccugccuacggaagaacggcaagaaggugauccaacucagccguaagaccuucgacuccgaguacgucaagacuagagccaacgacugggauuuuguggugacgaccgacaucagugagaugggugccaacuucaaggccgagcgcgucauugacccccggcgcugcaugaaaccugugauccugacggacggcgaagaacgggugauacuggcggggcccaugccggucacccacuccagcgcagcccagcgccggggacgcaucgggcgcaaccccaagaacgagaaugaccaguacauuuacaugggcgagccccuggagaacgacgaggacugcgcccacuggaaggaggccaagaugcugcuggacaacaucaacacucccgagggcauaaucccguccauguucgagcccgagcgggagaagguggaugcuaucgacggggaguaccgccuccggggcgaggcccgcaagaccuucguggaucuaaugcggcgcggggaccugcccgucuggcucgccuacaagguggccgccgagggcauaaauuacgcggacaggaagugguguuucgacggaauuaagaacaaccagauucucgaggagaauauggagguggagaucuggaccaaggagggcgagcggaagaaauuaaagccgcgguggcucgacgcccguaucuacagcgacccccuggcccugaaggaguucaaggaguucgccgcggggcggaagucccucacccugaaccugaucacugagauggggcgccuccccaccuucaugacccagaaggcucggaaugcccuggacaaccucgccguauugcauaccgccgaggcgggcgggcgcgccuacaaccacgccuugagcgagcugcccgagacguuggagacccugcuacuccugacccuguuggccacaguaacuggagggaucuuccuguuuuuaauguccgggaagggcauagggaagaugacguugggcauguguugcaucaucaccgccagcaucuuacugugguaugcgcagauccagccgcacuggaucgccgccucgaucauccucgaguucuuucugauaguccugcucauccccgagcccgagaagcagcggacgccccaggacaaccaacugaccuacgugguaauugccauccugacggucguggccgcgacaauggccaacgagaugggguuuuuagagaagaccaaaaaggaccugggccugggcucuaucaccacgcaggaaagcgaguccaacauccucgacaucgaccuacgcccugccagcgccuggacccucuaugccguggcuacaaccuucguaacgcccaugcuacggcacucaauugagaacuccuccgugaacgugagccugacagccaucgccaaccaggccaccguccugauggggcucggcaagggguggccccugagcaagauggacaucggcgugccccugcucgcgaucgguugcuauucacaagugaacccgaucacccugacugccgcccugcuccugcuggucgcccacuacgccaucauaggccccggacuucaagcgaaggccacgcgcgaagcccaaaagcgggccgcagcggggaucaugaagaaccccaccguggacggcaucaccguuaucgaccuggagcccauuccguacgacccuaaguucgagaagcaguuagggcaggucaugcuccugauucuaugcguuacccaggugcugaugaugcgcaccaccugggcccugugcgaggcccugacccuugccaccggccccaucuccacucugugggaggggaaccccggucgguucuggaacaccaccauagccguuagcauggccaacaucuuucguggcuccuaccuggccggcgccggacuccuuuucaguaucaugaagaacacgaccaacacccgccgggggaccggcaacaucggagagacgcugggagagaaguggaagagucgccucaacgcgcugggaaagagcgaguuccagaucuauaagaaguccgggauccaagagguggaccggacccuggcgaaggagggcauaaagcgaggggagaccgaccaucacgccgugagccguggcucagcgaagcuccggugguucguagagcggaacauggugaccccggagggcaagguggucgaccuggggugcggaagagggggauggagcuacuacugcgguggccugaagaacgugcgggaggugaagggccucacgaagggcgggcccgggcaugaggagcccaucccuaugagcaccuacggguggaaucuggucaggcugcaguccgggguggacguauuuuucacucccccagaaaagugcgacacccuccugugcgacaucggcgagagcucccccaaucccacgaucgaggccggccggacguuacgcguccuuaaccuugucgagaacuggcuaaacaauaacacccaguucugcaucaaggugcucaacccauacaugcccagcgucaucgagaagauggagacacugcaacggaaauaugggggcgcgcuggugcgaaacccccucuccagaaauucgacccacgagauguacugggugucaaacgcgacgggcaacaucguuagcuccguaaacaugauaagccgcaugcugauuaaccgguucaccaugaagcacaaaaaggcaaccuacgagccggacguggaccugggcuccgggacccgcaacaucggcauagagagcgaaauccccaaccuggauaucaucggcaagcggaucgagaaaaucaaacaggagcacgagacguccuggcacuacgaccaggaccaccccuauaagaccugggccuaccacgggucauacgagaccaagcagaccgguagcgcuucauccauggucaacgggguggugcgccuccugacgaagcccugggacguagugccgauggugacucagauggccaugaccgacacaacgcccuucggccagcagcgcgucuucaaggaaaaaguggacacccguacccaggaacccaaggagggcaccaagaaacugaugaagaucacggcggaguggcucuggaaggagcuggggaagaagaagacgccccgcaugugcacacgcgaggaguuuaccaggaaggugcgaucuaacgcugcccugggcgccaucuucacggacgagaacaaguggaaguccgcccgcgaggcggucgaggacgggcgguucugggagcucguggaccgcgagcggaaccuccaucuugagggcaagugugagacgugcguguacaacaugauggggaagcgcgaaaagaagcucggggaguucggaaaggccaaggggagccgggcgaucugguacauguggcugggagcccgcuuccuggaguucgaggcgcucggguuccugaacgaagaccacugguucagccggggcaacucccucaguggggucgagggggagggcuugcaccggcugggguacauccugcgggacgugggcaaaaaggagggcggagccauguacgccgacgacaccgccgggugggacacccguaucacacucgaggaccuuaagaacgaggagauggucaccaaccauaugaagggcgagcacaagaagcuagcugaggcgauauucaagcucaccuaccagaacaagguggugcggguccagcgcccgacaccccgcgguaccgugauggacauaaucucccgccgggaccagcgcgggagcgggcaaguuggaaccuacggccugaacacauucaccaacauggaggcgcagcugauccgccagauggagggcgaaggcaucuucaaguccauucaacaccucacggccacugaggagaucgcugugcaaaacugguuggcccggguaggccgugagagguuaagccgcauggcgaucaguggggaugacugcguggucaagccaaucgaugacagguucgccagcgcccucacagcccugaacgacaugggaaaggugaggaaggacauccagcagugggagccuucccggggguggaaugacuggacccaggugccguuuuguucccaccacuuccacgagcuuguaaugaaggauggccgcgugcucgugguccccugccggaaccaggacgagcucaucggccgcgcacguaucucccagggggcgggcuggucgcuuaaggagacggccugccucgggaagaguuaugcccagauguggacccugauguacuuucauagacgggaccugcgccucgccgccaacgcgaucugcagugccgugcccucucacugggugccuaccagccggacaaccugguccauccaugcuaagcaugaguggaugacgaccgaggacaugcuggccgucuggaaccgcgucuggauacaggagaacccguggauggaggacaaaaccccgguggaaagcugggaagagguccccuaccugggcaagcgggaagaccaauggugugggagccucaucggucugaccucuagggcgacgugggccaagaacauccagaccgccaucaaccaggugcggagccugaucggcaacgaggaguacaccgauuacaugcccucuaugaagcgcuuccgucgggaagaggaggaagccgggguguugugguga

SEQ ID NO: 24991 - RNA, 9876 nt, Artificial Sequence
  derived and/or modified CDS sequence (opt11) from DENV-2__GQ199893__SS-prME
accgcgggugugaucgucaugcucauuccaacggccauggcuuuccaccuuaccacccgcaacggggagccacacaugaucgugggccggcaggagaaggggaagucucugcuguuuaagaccgaggacggugugaacaugugcacgcucauggccaucgaucugggcgaacugugcgaagacaccaucacauacaagugcccacugcuccggcagaacgagccugaggacauagacuguuggugcaauucuaccagcaccuggguuacguacgggaccuguaccaccacgggggagcaccggcgcgagaagcgguccguugcccuggugccacaugucggcaugggccucgaaacccgcacggagaccuggaugagcucugaaggggccuggaaacacgugcagcggaucgagacuuggauccuccgucacccuggcuucaccaucauggccgcgauccucgccuacacuaucgggaccacgcacuuccagaaggcacucauuuucauccugcugaccgccguggcgcccagcaugaccaugcggugcaucggcaucuccaacagggacuuugucgagggugugucggguggcuccuggguggauaucguccucgagcacgguagcugcgugaccacgauggcaaagaacaagcccaccuuggacuucgaguuaaucaagaccgaggccaagcagcccgcaacccuccggaaguacugcaucgaggccaagcugacaaacaccaccaccgaguccaggugccccacgcagggagagcccagcuugaacgaggagcaggacaagcgguucaucugcaagcacagcaugguagaccgcggcugggggaauggcugcggacuauucggcaaaggcgggaucgucaccugcgcgauguucacgugcaagaagaacauggagggcaagguggugcagcccgagaaccuggaguacaccaucguuaucacgccccacagcggggaagagcacgccguggggaacgacacgggaaagcacggcaaggaaauaaaaauuaccccgcagucgagcaucacagaggccgagcugaccggguacggaacggugaccauggagugcagcccccggacagggcucgacuucaacgagaugguccugcugcagauggaagacaaggcguggcucgugcaccgccagugguuccuggaccugcccuuacccuggcugccuggugcagacacccagggcucgaacuggauacagaaggagacgcuagugaccuucaagaacccccaugcgaagaagcaggacgucgugguucuugggucccaagaaggagccaugcauaccgcccugaccggagccacugagauacagaugagcagcggcaaccuccuguucaccggccaccugaaaugccgguugcgcauggacaaacuacagcugaagggaauguccuacuccaugugcaccggcaaguuuaagaucgugaaggagaucgccgaaacccagcacggaacgauugugauucggguccaguacgagggcgacggcagucccugcaaaauccccuucgagaucacugaccuggaaaagcgccacguacucgggcggcugaucacugugaacccgaucgucaccgagaaagacagccccgugaacaucgaggcugaaccccccuucggcgacuccuauaucaucaucgguguggagccgggccagcugaagcucaacugguucaagaaggggagcucgauuggccagauguuugagacgacaaugcgcggggccaagcgcauggccauccuaggggacaccgcaugggauuucggcagccucggcggcgucuucaccucgaucgggaaggcccuccaccaggucuucggugcgaucuacggcgccgccuucagcgggguguccuggacgaugaagauccugaucggcgucaucaucaccuggaucgggaugaauagccgguccacgagccugucggugagccuggugcucgucggcguggugacccuuuaccugggggccaugguccaggcagacuccgguugcguggugagcuggaagaacaaggagcucaaaugcggcucugggaucuuuaucacggacaacguccauaccuggaccgagcaguauaaguuccagccugagagccccagcaagcuggccuccgccauccagaaggcccaugaagaggguaucugcgggauccgcagcgugacccggcuggagaaucucauguggaagcagaucacucccgagcugaaccacauacuguccgagaacgaagugaagcucacuaucaugacgggcgacaucaaggggaucaugcaagccggcaagagaucgcugcggccgcaacccacugagcugaaauacuccuggaagacguggggcaaggcgaagaugcucagcacugagucucacaaccagacuuuccugaucgacgggcccgagaccgccgagugcccgaacacgaaccgcgccuggaauagucuggagguagaagacuauggcuucgggguauucaccaccaacaucuggcucaaacugcgggagaagcaggacguguucugugacaguaagcuaaugagcgccgccauaaaggacaaccgcgcaguccaugccgauaugggguacuggauagaguccgcccucaaugacaccuggaagauggagaaggccagcuucaucgaggugaaauccugccauuggcccaaaagccacacccugugguccaacggggugcuggagagcgaaaugaucaucccaaaaaacuucgcagggcccgucucccagcacaauuaccggccgggcuaccacacgcagaccgcaggacccuggcaccucggcaaacuggagauggacuucgaccugugcgaagggaccaccguaguggucacggaggacugcgguaaccgcgggcccagccuccggaccaccaccgcuucugggaaacugauaacggaauggugcugcagauccugcacucugccuccgcuccgguaccgcggcgaggacggcugcugguauggcauggagauccggccccugaaggagaaggaggaaaaccuggugaauucgcuugugacugccgggcacgggcagauagauaacuucucccugggggugcuggggauggcccucuuccuggaggaaaugcugcgcacccggauuggcacgaagcacgcgauccuccugguggccgugagcuucguaacacugaucacugggaacauguccuuucgcgaccuaggccgggucauggugauggucggggccaccaugacggacgacaucggcaugggagugaccuaccuggcccucuuggccgcguucaaggugcgccccaccuucgccgcaggacugcuucuccgcaaacuuaccagcaaggaacugaugauggccacgaucggcaucgcgcuccugucccagagcaccauccccgagacaauccuggagcucacagacgcgcuggcacuggggaugaugguccucaagaucgugcggaacauggagaaguaccagcuggccguaaccaucauggccaucuccugcguccccaacgccguaaucuugcagaaugccuggaagguguccugcacaauccucgccgccgucucaguuagcccgcugcugcuuaccucaagccagcagaaggccgauuggauuccccucgcgcugaccaucaagggccucaaccccaccgccaucuucuuaaccacucugucccgcaccucuaagaagcgguccuggccccucaacgaggcaauaauggcagucggcauggugagcauccucgccuccagccuucucaagaacgacauccccaugacggggccccugguggcgggcgggcugcucaccguuuguuacgugcuuaccgggcgcagcgccgacuuagagcucgagcgagccgccgacgugaagugggaggaccaggccgaaaucagugguagcucccccauccugucuauaaccauuuccgaggauggcagcauguccaucaagaacgaggaggaagaacagacucugaccauccucauucgcaccggcuuacuggugaucagcgggguuuucccggugagcauccccauaacggcggccgccugguaccucugggagguaaaaaagcagcgggcaggcgugcugugggacgugcccuccccgcccccuguugaaaaagccgagcuggaagacggggcguaucgcauaaagcagcggggcauacucggguacucccagaucggcgccggcguauacaaggaggggaccuuccacaccauguggcaugugaccaggggcgccguccugaugcaccgagggaagcgcauagagcccagcugggccgacgugaagaaggaccucauauccuacggcgggggcuggaaguuggagggcgaauggaaggaaggagaggaggugcagguucuggccuuggagcccggcaagaacccccgggcgguucagaccaagcccgguaucuucaagacuaauacgggcacaauaggggccgugagccucgacuucagucccggcacuagcggaucccccaucgucgacaggaaggggaagguggugggccuauacgggaacggcguugugacccgaagcggagcuuacguguccgccaucgcacagacggagaaguccaucgaggacaacccggagaucgaggacgauaucuuccgcaagaaacggcuaaccaucauggaccuacaccccggggcaggcaagaccaagcgcuaccuccccgccaucguccgugaggcgaucaagcgagggcugcggacacuuauccuagcccccacgcgcgugguggcggccgagauggaggaggccuugcgcgggcugcccauacgguaccagacacccgccauuaagacggagcacaccggacgcgagaucguagaccucaugugccacgcaaccuuuacgaugcggcugcugagucccguacgcguaccuaacuacaaccugaucaucauggacgaggcgcacuucaccgaucccgccuccaucgcagcccggggcuacaucagcacccgcgucgagaugggcgaagcugcgggcaucuucaugacggccacgccccccggcucgagggacccauuuccccaguccaaugcccccaucauggacgaagaacgagagauccccgaacguuccuggaauucagggcacgaauggguuaccgacuucaagggcaagaccgugugguucgucccaagcaucaaggccggaaacgacaucgcggcgugccugcgcaagaaugguaagaaggucauacagcugagucggaagacguucgacuccgaguacguuaaaacccgcgcgaacgacugggacuucgucgugaccaccgacaucagcgagaugggugccaacuucaaggccgagcgggugauugaccccaggagaugcaugaagcccgucauccucacggacggagaggagcgcguaauccuggcuggucccaugccgguaacucacuccagcgccgcgcagcggcgcggccggaucggccgcaaccccaagaacgaaaacgaccaguacaucuacaugggggaaccacucgaaaacgacgaggacugcgcccacuggaaagaggccaagaugcuccuggacaacaucaacacccccgagggcaucaucccauccauguucgagcccgagcgagaaaaggucgacgcgaucgauggcgaguacaggcuucgcggggaggcccggaagaccuucguggaccucaugcgccggggagaccuucccguuuggcuggccuacaaggucgccgccgaagggaucaauuacgcggaccgcaagugguguuucgacggcaucaagaacaaccaaauccucgaggagaacaucgaaguggagaucuggacgaaggagggagagcggaagaagcugaagccgcgcuggcuggaugcgcgcaucuacucggacccccucgcccugaaggaguucaaggaguucgcagcgggccgcaagucccugacccucaacuugaucacggagaugggccgucugcccaccuucaugacacagaaggcccgcaacgcguuagacaaccuagccgugcugcacaccgccgaagccgggggacgggccuacaaucacgcccucagcgagcugcccgagacacuggaaacccuccugcugcucacgcugcucgccacagucacugggggcaucuuccucuuccuuauguccggaaaggggaucggcaagaugacccuggggaugugcuguauuaucaccgccagcauccucuugugguacgcacaaauccagccgcauuggaucgccgcauccaucauccuggaguucuucuugaucgugcuauuaauacccgagcccgagaagcagcgcacgccccaagacaaucagcucacauacgucgugaucgccauccucaccgugguugccgcgacgauggccaacgagauggguuuucuggaaaagacgaaaaaggaccucggacugggcagcaucaccacgcaggagagcgaguccaacauccuggauaucgaucuccggccggcuagcgccuggacccuguacgccguugccacgaccuucgugacccccaugcuacgccacagcaucgagaacagcuccgucaaugugagccugaccgccauagcuaaucaggccacggugcugauggggcugggcaaaggcuggccccucuccaagauggacaucggggucccccugcuggcuauugggugcuacagccaggugaacccgaucacccucaccgccgcccugcugcuccugguggcccacuacgcgaucaucgggccuggcuugcaggccaaggccacccgggaggcacagaagcgcgcugccgcgggcaucaugaagaaccccacggucgacgggauaaccgugaucgaccucgagcccauaccguacgaccccaaguucgagaagcaguuaggccaggugauguugcucauccugugcgucacccaggugcuaaugaugcggaccacgugggcccucugcgaggcccugacccuggcuaccggaccuaucagcacccucugggagggcaaccccgggagguucuggaacacgaccaucgccguaagcauggcaaauaucuuccggggcuccuaccuggccggugcagggcuccuguucagcauaaugaagaacacuaccaauacgcgccgcgguaccgguaacaucggcgagacucugggcgagaaguggaagucccggcugaacgcccucggaaagagcgaguuccaagucuacaagaaguccggcauccaggagguggacagaacccuggcuaaggaggggauaaagcgaggcgagacggaccaccacgcgguaagccggggguccgcgaaacugcggugguucguugaaaggaacaugguaaccccggagggcaagguggucgaccucgggugcgggcggggcggguggucuuacuacugcggcgggcugaagaacgugcgcgaagugaagggccugaccaagggcgguccuggccaugaggaacccauccccaugucaacuuauggauggaaccucguccggcuacagucgggcguggacguguucuucacuccgcccgagaaaugcgauacccugcucugcgacaucggggagagcucucccaacccgaccaucgaggccggacgcacccugcggguccugaaccucgucgaaaacuggcugaacaacaacacccaauucugcaucaaggugcugaaccccuacaugccgagcgucaucgagaagauggaagcccuccagcgcaaguacggcggggcgcuggugcggaacccgcuuagucguaacagcacgcacgaaauguacuggguuuccaaugccacaggcaacaucgucagcuccgugaacaugaucagccggaugcugauuaaccgcuucaccaugaaacacaagaaggccaccuaugagcccgacguggaccucgguuccggcacgcggaacaucgggaucgaguccgagauccccaaccucgauaucaucggcaagcggaucgagaagaucaagcaggagcacgagaccuccuggcacuacgaccaggaucaccccuacaagaccugggccuaucacggcagcuacgagacaaagcagacugggucugccagcuccauggugaauggcgugguucgucugcucaccaagcccugggacguugugccgauggugacacagauggcgaugacagacaccacccccuucggacaacagcgagucuuuaaggagaagguggacacccgcacucaggagcccaaagagggcacgaagaagcuaaugaagaucaccgccgaguggcuguggaaggagcucggcaagaagaagacgccccggaugugcacccgcgaagaguucacacggaaggugcgcagcaacgccgcgcugggggcgaucuucacugacgaaaacaaguggaagucagcgcgggaggccguagaggauggccgcuucugggaacuuguggaccgagagcguaacuugcaccuggagggaaagugcgagaccugcguguacaacaugaugggcaagcgggagaagaagcuaggugaguuuggcaaagccaagggcucuagggccaucugguauauguggcucggggcgcgguuuuuggaguucgaggcccugggcuuccucaacgaggaccacugguucaguagggggaacagccuuagcggcgucgagggcgagggccugcaccggcucggcuacauccugcgagacgucgggaagaaggagggcggggccauguacgccgacgacaccgccgguugggauacucguaucacccuggaggaccucaagaacgaagagauggucacaaaccauaugaaaggggagcacaagaagcuggcggaggcaaucuucaagcugacauaccagaacaagguggugcgcguccagcggccgacgccccgcggaaccguaauggacaucaucuccagacgcgaccagcggggcagcggccaggucggcaccuacggacugaacaccuucacgaauauggaggcccaguuaaucaggcagauggagggcgagggaaucuuuaaguccauccagcaucucaccgccacugaggagaucgccguccagaacuggcucgcacgcgugggaagagagcgcuuaagccggauggccaucucgggcgacgacugcgucguaaaacccauagaugaccgcuucgccucggcccugaccgcccucaacgacauggggaaggugcggaaggacauccagcagugggagccaucccgcggcuggaacgacuggacucaggugccguucugcucucaccacuuucacgagcugguaaugaaggaugggcggguccuggugguccccugccgcaaccaggacgagcugauaggccgggcacgcaucagucagggcgccggguggagucugaaggagaccgccugccugggcaagucuuacgcucagauguggacccucauguacuuccaccggcgcgaccugcgccuggccgcgaacgccaucugcagcgccguaccgccccacugggugcccaccucccgaaccacguggagcauccacgcgaagcacgaguggaugaccaccgaggacaugcucgcagucuggaaccggguguggauucaggaaaaccccuggauggaggacaagacccccguggagaguugggaagaggucccuuaccugggaaagcgcgaagaccaguggugcgguucucugaucggguugaccucccgggcuaccugggccaagaacauccagaccgccaucaaccaagugcgcagccuuaucggcaacgaggaguacaccgacuacaugccgagcaugaagcgguuccgccgugaggaggaggaggccggcgugcugugguaa

SEQ ID NO: 24992 - RNA, 9876 nt, Artificial Sequence
  derived and/or modified CDS sequence (opt11) from DENV-2__GQ199894__SS-prME
acagccggcguuaucgucauguugaucccaaccgccauggcguuccaccucaccacccgcaacggggagccucacaugaucguuggcagacaggagaaggggaagagucuccuguucaagacagaggacggaguaaacaugugcacccucauggcaaucgaccuaggggagcugugugaggacaccaucaccuacaaaugcccccuccugcgccagaacgagcccgaggauaucgacugcuggugcaacagcaccagcaccugggugacuuacggaaccugcaccaccacgggcgagcaccggcgcgagaagcgguccguggcccuggugccgcauguaggcaugggacucgagacccgcaccgaaaccuggaugagcucggagggggcuuggaagcacgugcagcggaucgagacguggauccuacgccacccgggcuucacgaucauggccgcgauccuggcauacaccaucgggacgacgcauuuccagaaggcgcucauauucauccugcucaccgccguggcacccagcaugacaaugcggugcauugggaucuccaaccgcgacuuugucgagggugugagcggaggcuccuggguggacaucguccucgagcacgggagcugcgugacaacgauggccaaaaacaaacccacccuggacuucgagcugaucaagaccgaggccaagcagcccgcuacccuccgcaaguacuguauagaggcaaagcugacgaacaccacaaccgaaucccgaugcccaacucagggagaacccagccugaaugaagaacaggacaagcgguuuauuugcaagcacuccaugguggaccgcggaugggggaacggcugcgggcuguuuggcaagggcgggaucgugacgugcgccauguucaccugcaagaagaauauggaaggcaaggugguucagccugagaaucuggaguacaccauagugauaacuccccauucgggggaggagcaugccgugggcaacgacacggggaagcauggaaaggagaucaaaaucaccccgcaguccagcaucaccgaggccgagcuuaccggguacggcacggucaccauggagugcucaccacggaccggccucgacuuuaacgaaaugguccuguugcagauggaggacaaggcguggcucgugcacagacagugguuccuggaccucccucuucccuggcuuccgggggccgacacccaaggcuccaacuggauccagaaggaaacccucguaaccuuuaagaauccgcacgcaaagaagcaggacguggugguccuggggucacaggagggggccaugcacaccgcccugaccggggccacggagauccagaugagcagcggcaacuuacuguucaccggccaccugaagugucgacugcgcauggacaagcuccagcugaagggaaugucguacagcauguguaccgguaaauucaagaucgugaaggagauugcugagacccagcacgggacgaucguuauccggguccaguacgagggcgacggcucuccgugcaaaauccccuucgagauuaccgaccuagagaagcgccacgugcucgggcggcugaucacggugaacccgaucguuaccgagaaggauagcccagugaauaucgaggcggagccgcccuucggcgacuccuauaucaucaucgggguggagcccggccagcugaagcucaacugguucaaaaaggggagcuccaucggccagauguucgaaacgaccaugcgcggcgcaaagcgcauggccauccugggcgauacagccugggauuucggcagccucggcggggucuucaccuccaucgguaaggcccuccaucagguauuuggagcgauuuauggcgcggccuuuagcgggguguccuggacgaugaagauccugaucggcguaaucaucaccuggauugggaugaacagccggucgaccagucugucggugagcuugguacuggucggagucgugacgcuauaccugggggcaaugguccaggccgacagcggcugcguaguuagcuggaagaacaaggaacuaaagugcggcagcgggaucuuuaucacggacaacguccacaccuggaccgagcaguacaaguuccagccagagagcccgucgaagcuggcuuccgccauccaaaaggcccacgaggaggggaucugugggauucgaagugugaccagauuggagaacuugauguggaagcaaaucacgccagagcugaaccacauccugagcgagaacgaggucaagcugaccaucaugacgggugacauuaaggggaucaugcaggcggggaagcgaagucugaggccgcaacccaccgagcuuaaguacuccuggaagacguggggcaaggcaaagaugcucucaacugagucacacaaccagaccuuccugaucgacgggcccgagaccgcagaaugcccgaacacgaaccgggccuggaacucacuggaagucgaggacuacggcuucggaguuuucaccaccaacaucuggcucaagcugagagagaagcaagacguguucugcgauuccaagcugaugagcgccgccaucaaggauaaccgcgccguccacgccgauaugggauacuggauagaguccgcccucaacgacaccuggaaaauggagaaggccagcuuuaucgaggugaaaagcugccauuggcccaagagccacacccugugguccaauggagugcuggagagcgagaugaucauccccaagcacuucgcugggccaguaucccagcacaacuaccggcccggcuaccauacgcagacagcggggcccuggcaccucggcaaacuggagauggacuucgaccucugcgaagggacgacugugguggucacggaggauugcggcaaccgcggccccagcuugcggaccacuaccgccucagggaagcuaaucacggaauggugcugccgcuccuguacccugcccccguuacgguaccgcggagaagacggguguugguacggcauggaaauccggcccuuaaaggagaaggaggagaacuuagugaacagccuagugacugccgggcacggccaaaucgauaacuucucccugggcguccucgggauggcccucuuccuggaagagaugcugcgcacucguaucggcacgaagcaugcgauccuccuuguggccgccagcuucgugacccugaucacggggaacaugucguuccgagacuugggacgggucaugguaauggugggggccaccaugacggacgacaucggcaugggcgugaccuaccuggcccugcucgcggccuucaaggugcgucccacauucgccgcaggccugcugcuccguaagcugacaagcaaggagcugaugauggccacgaucggcaucgcgcuucuuagccagagcaccauucccgagaccauauuggagcucacugacgccuuggcccuggggaugaugguacuaaaaaucguccggaacauggaaaaguaccagcuggccgugacgauuauggccaucagcugcgugccgaacgcggucauacuucagaacgccuggaaggugucuugcacgauccucgcggccguguccgucagcccccugcuucucaccagcagccaacagaaggcggacuggaucccucuagcccugaccaucaagggccucaaccccacggccaucuuccugacgacccugucacgcacuagcaagaaacgguccuggccucucaacgaggccauuauggcggugggcauggucagcaucuuggcguccagccugcucaagaaugacauccccaugacggguccccugguggccggcgguuugcucacagugugcuacgugcugaccggccgcagcgcggaccuggaguuggagagagccgcggacgugaagugggaggaucaggcagagaucuccgggagcuccccaauccugagcaucacaauuucggaggacgggucuauguccaucaaaaacgaggaggaggaacaaacgcugacaauccucauccgcacaggccugcuggugaucagcggggucuuccccgugaguauccccauaaccgccgccgcuugguaccuaugggaagucaaaaagcaacgggccggagugcucugggacgugccgucgccgccgccgguugagaaagcugagcuggaggacggagccuaucgcaucaagcaacggggcauccucggauacucccagaucggcgcaggaguguacaaggaggggaccuuucacacgauguggcauguaacgcgcggagccguacucaugcaccgggggaagagaaucgaacccagcugggcugacgucaagaaggaccucaucuccuacggcgggggcuggaagcuugagggcgaauggaaggagggggaggagguccagguuuuggcccuggaacccggcaagaacccccgggcaguccagacaaagccuggcauuuuuaagaccaacaccggcacaauaggggccgugagccucgacuucagccccggcaccucuggcucccccaucguggaccgcaaggggaaggucguaggacuguacgggaacggcguggucacccgguccggcgccuacgucuccgcgauagcacagacggaaaaguccauagaggacaaccccgagaucgaggacgacauuuuccgcaagaaacgguuaaccaucauggaccugcaccccggggccggcaaaaccaagcgcuaccugcccgcgaucgugcgggaagccauuaagcgugggcugcggacccugaucuuagcgccgacgcgcgucguggccgcagagauggaggaggcucuucgcggucugccgauccgguaccagacucccgccaucaagacggagcacacagggcgcgagauagucgaccucaugugccacgcgacguucacgaugcggcugcugagccccguccgggugccuaauuauaaccucauaaucauggacgaagcccacuucaccgaucccgcuuccaucgcagcccgcggcuacaucuccacccgcguugaaaugggcgaggcggccgggaucuuuaugacagcaacaccccccgggucccgcgacccguucccccagagcaacgcaccuaucauggacgaagagcgcgagauccccgagcggagcuggaacagugggcaugaaugggucaccgacuucaagggaaagaccgugugguucgugccuuccaucaaggcuggcaacgacaucgcggcaugccugagaaagaauggaaagaaagucauccagcugucucggaagacguucgauuccgaauacgugaagacucgcgccaacgacugggacuuuguugucaccaccgacaucucagagaugggcgcuaacuucaaggccgagagggugaucgacccccgccggugcaugaagcccgugauccucacggacggggaggaacgcgucauccuggccggccccaugccggugacccacuccagcgcugcccagcggcgcgggcgaauaggccgcaaccccaagaacgagaacgaucaguauaucuacaugggggagccgcuugagaacgacgaggauugcgcccacuggaaggaggcgaagaugcuccuggacaacaucaauacccccgagggcaucaucccguccauguuugagcccgagagagaaaagguggacgccauagacggcgaauaccgccugcgcggggaggcucggaagaccuucgucgaccucaugaggcgcggcgaucugcccguguggcuggccuacaagguugccgcggaggggaucaacuacgccgaccgcaaguggugcuucgacggcauuaagaauaaccagauccuugaagagaacaucgaaguagagaucuggacgaaggagggcgagcggaagaagcugaagccgcgcuggcuugacgcccgaaucuacagcgacccccucgcccugaaggaguuuaaggaguucgcagccggcagaaagucccugacuuuaaaccugaucaccgagaugggccgguugcccaccuucaugacgcaaaaggcacgcaaugcccucgauaaccuggccgugcugcacaccgcggaggcagggggucgggcuuacaaccacgcccugagcgaacugcccgaaacccuggagaccuuacugcugcucacacugcuggccaccgugacgggugggauauuuuuguuccucaugucgggcaaggggaucggcaagaugacgcuggggaugugcugcauaaucaccgcgucgauuuugcugugguacgcacagauucagccccacuggaucgccgccuccaucauccuugaauucuuccugaucgugcugcugauucccgagccagagaagcagcgcacgccacaggacaaccaacucaccuacguggucaucgccauccugaccguaguugcggccaccauggccaacgagaugggauuccuggagaagacgaagaaagaccucgggcucggcagcaucaccacccaggagagcgaguccaauauccuggacaucgaccuccgcccggccagcgccuggacguuauacgcgguugccacgaccuucgugacacccaugcugcgccacaguaucgagaacagcucggugaacgucagccucaccgccaucgcuaaccaggcgacgguuuugaugggcuugggcaaggguuggccccucuccaagauggacaucgggguuccccugcuggcaaucgguugcuacagccaggucaacccgaucacacucaccgccgcccugcugcuccugguugcccacuacgcgaucaucgguccgggccugcaagcuaaggcgacccgggaggcccagaagcgcgccgcggccggcaucaugaagaaccccacaguggacggaaucacgguaaucgaccucgaacccaucccguacgacccaaaguucgagaagcagcugggccaagugaugcugcucauccuaugcgugacccaggugcugaugaugcggaccacgugggcgcucugcgaggcgcugacccuggcgacagggccgaucucuacacucugggagggaaaucccgggcguuucuggaacacgacaauugccgugagcauggccaacaucuuccggggcuccuaccuggccggagccgggcugcuguuuagcauaaugaagaacaccacaaacacacgccgcgggaccgguaacaucggcgagacccugggagagaaguggaagucccggcugaacgcgcugggcaagagcgaguuccagguguacaagaaauccgguauacaagaggucgaccgaacucuggcuaaggaggggaucaagaggggagaaacugaccaccacgcggugagccgcggguccgccaagcugagaugguucguggagcgcaauauggucaccccggagggaaaggugguggaucucgguugcggccggggcgguuggagcuacuacugcggugggcugaagaauguucgugaggugaaggggcuuaccaaaggcggacccggucacgaggagccgauccccauguccacuuacggguggaauuuaguacggcugcaaagcggcgucgauguguucuucacgccgcccgagaagugcgacaccuugcuuugcgauauaggcgaguccucccccaaccccaccaucgaggccggccgcacccugcguguacugaaucucguggagaacugguuaaacaacaacacgcaauuuuguaucaaggugcuaaacccguacaugcccagcgugauugaaaagauggaggcccuccagcgaaaguacgggggggcacugguccggaacccguuaucgcgcaacagcacgcaugagauguacuggguguccaacgccaccggcaacaucgucagcuccgucaacaugaucagcagaaugcugaucaaucgcuucaccaugaagcacaagaaggccacguaugagccggacguagaccucggguccggcacgcgaaacauugggaucgagagcgagauccccaaccuggacaucauuggaaagagaaucgaaaaaaucaagcaggaacacgagaccaguuggcauuacgaccaggaccaccccuacaagacaugggccuaccacggcagcuacgaaacgaaacagaccggguccgcuagcuccauggugaacggcgucgugcgguuguugaccaagcccugggacguggucccgaugguuacccagauggccaugacggacacuacccccuucgggcagcaacgcguauucaaagaaaaggucgauacccggacccaggaacccaaggagggcaccaaaaaguugaugaagauuaccgccgagugguuauggaaggagcucggcaagaagaagacgccccggaugugcacacgcgaggaguuuacgcggaaagugcguucgaacgcggcacugggugcaaucuucaccgaugaaaacaaguggaaguccgccagagaggcgguggaggauggccgguuuugggagcucguugaccgggagcgcaaccuccacuuggagggaaagugcgagaccugcgucuacaacaugaugggcaaacgggagaaaaagcugggggaauucggaaaggccaagggcagccgcgcgauuugguacauguggcucggggcccgguucuuagaguucgaggcucuuggcuuccucaacgaggaccacugguucucccgcgggaacagcuuaagcggcgucgagggggaggggcugcacagacugggcuacaucuuacgcgaugucgggaaaaaagagggcggagcgauguaugcagacgacaccgcgggaugggacacgcggaucacccuggaggaccucaagaacgaagagaugguuacgaaccacaugaaaggggagcacaagaagcuggcagaagcgauuuucaagcugaccuaccagaacaaggucgugcgagugcaacgcccuacgcccagaggcaccgucauggacauuaucaguaggcgcgaccaacguggcagcggccagguaggcacauaugggcucaacacguucacgaacauggaggcucagcugauccgccagauggagggcgagggcaucuuuaaguccauccagcaccugacagccaccgaggagaucgcagugcagaacuggcucgcccgggucgggcgggagcgccugucgaggauggcuaucuccggcgacgauugcgucgucaagcccaucgacgaccguuucgcuagcgccuuaacagcacucaacgacaugggcaagguccguaaggacauccagcagugggagccuuccagaggcuggaacgacuggacccaagugccguucugcagccaccacuuucaugaguuagugaugaaggacgggagagugcugguggugcccugccgaaaccaggacgaacuaaucggucgggcccgcauuucccagggugcaggguggagccugaaagagaccgccugccuggguaaguccuaugcccaaauguggacuuuaauguauuuccaccgucgcgaucugcgccuggcggccaaugccaucugcucugccgugccgccccauugggucccgacgucccgcaccacguggagcauccacgcgaagcacgaguggaugaccaccgaggacaugcucgccguguggaaccgggucuggauccaggaaaaccccuggauggaggacaagacccccguagagucuugggaggaaguacccuacuuggggaagcgcgaggaccaguggugugggagccuuaucgggcugacgucaagggcuaccugggccaagaauauccagacggccaucaaccaggucagaagcuugaucggcaacgaggaguacaccgacuacaugccgaguaugaagcgguuccgccgggaagaggaggaggcgggcguguuaugguga

SEQ ID NO: 24993 - RNA, 9876 nt, Artificial Sequence
  derived and/or modified CDS sequence (opt11) from DENV-2__FJ898439__SS-prME
acagccggggugaucgucaugcuaauccccaccgccauggcuuuccaccucaccacccgaaauggggaaccccacaugauuguggggcggcaggaaaaggggaagucccugcuguucaagaccgaagacggcgugaacaugugcacccucauggccaucgacuuaggcgaacugugcgaggauacuaucaccuacaagugccccuugcugcggcagaacgagcccgaggacaucgauugcuggugcaacagcaccaguacuugggucacguacgggacgugcuccaccaccggcgaacacaggcgcgagaagcguagcguggcccugguaccccauguagggaugggccucgagacccggacagagaccuggaugagcagcgagggggccuggaagcacgugcagcggauagagaccuggauccuccggcauccaggauucacuaucauggcggcgauacuggcguacaccaucgggaccacucauuuccagcgggccuuaaucuucauccugcugacugcgguggcccccagcaugaccaugcguugcaucggcauaucaaaccgggacuucguugagggcguguccgguggaagcuggguggacaucguacuugaacacgguucgugcgugacaaccauggccaagaacaagccuacgcuggacuucgaguuaauaaagaccgaggcgaagcagcccgccacccuccgcaaauacugcaucgaggccaaguuaaccaacacgaccaccgagagccggugcccgacccagggcgagccgucccugaaugaggagcaagacaagcgcuucaucugcaagcacagcaugguggaccggggcugggggaacggcugcggccuguucggcaagggcgggaucgucacaugcgcgauguucacguguaagaaaaauauggagggcaaggugguccagcccgagaaccuggaguacaccaucgucauaacgccccacuccggagaggagcaugccgugggcaacgacacggggaagcacggcaaggagaucaagauaacgccccagagcucgaucaccgaggccgagcugaccggguacgggaccgugacgauggagugcagcccucgcaccggacucgacuucaacgagaugguccuccugcagauggaggacaaggccuggcucguacaucggcagugguuccuggaccugcccuugccgugguuaccgggggccgacacgcagggcuccaacuggauccaaaaggaaacccuggugacguucaaaaacccgcaugcgaagaaacaggaugucgugguucuagggagccaggaaggugccaugcacaccgcccuaaccggggccaccgagauccagaugagcuccggcaacuuauuauuuacaggccaccugaagugccgacugcggauggacaaauugcaacugaagggcaugagcuacuccaugugcacaggcaaguucaaaaucgugaaggaaaucgcugagacccagcacggaaccaucguaauccgcguccaguacgaaggcgacggcagcccaugcaagauccccuucgagauuacggaccuggagaagcggcacgugcucgggaggcugaucaccgugaauccuaucguaaccggcaaggacaguccuguuaacaucgaggcggagccgcccuucggggacagcuacaucaucaucggcgucgaacccgggcagcuuaaguuaaacugguucaagaaggguucgagcaucggccagauguucgaaaccacgaugagaggggccaagcggauggccauccugggcgauaccgccugggauuucggguccuuagguggggucuucacgucgaucgguaaggcccuccaccaggucuuuggcgcuauauacggggccgccuucuccggcgugagcuggacaaugaagauacucauagggguaaucauuacguggaucggcaugaacucccgcagcaccucccugagcgugucccugguacucgucgggguggugacccuguacuuaggagccaugguccaggcggacagcggcugcguggugucguggaaaaacaaggagcuuaagugcgguucggguaucuucaucaccgacaacgugcacacuuggaccgagcaguacaaguuccagccggagucccccuccaagcuagccagcgccauccagaaggcccaugaggaggggaucugcggcauccgcuccguuacccgccuggagaaccucauguggaagcaaaucacccccgagcugaaccacauccugagcgaaaaugaggugaagcucacgaucaugacaggggacaucaagggcaucaugcaggccggcaagcgaucacugcgcccacagccgacggagcugaaguauagcuggaagaccugggggaaagcgaagaugcuauccacggagucacacaaccagaccuuccugaucgauggcccugagacugcagagugcccgaacaccaaccgugccuggaacucgcuagaggucgaggacuacggguucggcgucuucaccacuaauaucuggcucaagcugcgcgagaagcaggauguguucugcgacuccaagcugauguccgccgcaaucaaagacaaccgggcgguccacgccgacaugggcuacuggaucgagagcgcccucaaugacaccuggaagauggagaaagccuccuucaucgaggucaagagcugccacuggcccaagucccacacccuauggaguaacggggugcuggagucggagaugaucauccccaagaacuucgccggccccguaucucagcauaauuaccguccgggguaccacacccagacggcgggccccuggcaccucgguaagcuggagauggacuucgaccugugcgaaggcaccaccgugguggucaccgaggacugcgguaaccggggucccagccuccgcacgacaaccgccuccgggaaguuaaucaccgaguggugcugcaggagcugcacgcugccaccccugcgcuacagaggggaagacgguugcugguacgggauggagauccgcccuuugaaggagaaggaggagaaccuggugaacucccucguaaccgccggacacggccaagucgacaacuucagccugggggugcugggcauggcccucuuccuggaggagaugcugcggacccgcauagggacgaagcacgcgauacuacugguggccgccucuuucgugacgcugaucaccggcaacaugagcuuccgugaccuagggcgcguaaugguaauggucggcgccaccaugaccgaugacaucgggauggggguaacguaccuggcucugcucgccgccuucaaggugcgccccacuuucgccgcaggucuguugcuacggaagcugacguccaaggagcucaugauggccacgauugggaucgcgcuccucagccaguccacgaucccugagaccauccuggaguuaaccgacgcccuggcacugggcaugaugguccucaagaucguacgcaacauggagaaguaucaacuugccguuaccaucauggccaucagcugcgucccgaacgcggugauccugcagaacgccuggaagguauccugcacgauccucgccgccgucagcgugucaccccuccugcucaccagcucccagcagaaggcggauuggaucccccuggcucugacgaucaaggggcucaauccaacugccaucuucuugaccacccugucccggaccucgaagaagagaagcuggccgcucaaugaagccgucauggccguggggaugguguccauucuggcgucuagccugcucaagaacgauaucccaaugacgggcccccuggucgcaggcggccuacucacggugugcuacgugcugaccgggcgaucugccgacuuagagcucgaacgcgccgccgacgucaagugggaagaccaggcagaaauaagcggcuccagcccaauccuguccaucacgauuagcgaggacggcuccaugagcaucaagaacgaggaggaggagcaaacccugacgauacucauacguacugggcugcugguuaucuccggcguguucccggugagcauccccaucacugccgcugcaugguaccucugggaaguaaagaagcaaagggccgggguacugugggacguccccagcccgccgcccguggagaaagcggagcuggaggauggcgcauaucggaucaagcagcgagggauccucggauacucccagaucggggccggaguuuacaaggaggguaccuuccacaccauguggcacgugacgcgcggcgcggugcugaugcaccgcggcaagagaauagagcccuccugggcggacgugaagaaggacuuaaucagcuaugggggcggcuggaagcucgagggggaguggaaggagggcgaggagguccaaguccuggcccuggagcccggcaagaacccccgcgcgguucagaccaagcccggcaucuuuaagaccaacaccgggaccaucggcgcagucucccucgacuucagccccggcaccuccgggucgcccaucguugaccggaagggcaaaguggucgggcucuacggcaacggcguggugacccgcuccggggccuacgucagcgcgaucgcccagacggagaagaguaucgaggacaaccccgagauagaggacgacaucuuccggaaaaagagacugacuauaauggaccuucaccccggugcugggaagaccaagcgguaccugcccgccauaguucgcgaggccaucaagcggggccugcggacccugauccucgcgccgacccgcguggucgccgccgagauggaggaagcacugcgggggcugcccauacgcuaccagacgcccgcgaucaagacugagcacaccggccgggagaucguggaucucaugugccacgcgaccuucacgaugagacugcugucccccguucgggucccaaauuacaacuugaucaucauggacgaggcacauuuuaccgauccggccagcaucgccgccaggggcuacaucuccaccaggguggagaugggagaggcggccggcaucuucaugaccgcaacgccaccggggagucgcgacccguuuccccaguccaacgcccccaucauggacgaggagcgggagauccccgagcgcagcuggaacagcggccacgagugggugaccgacuucaaagggaagacugucugguuugugccuagcauuaaggcggguaacgacaucgcagccugccuccggaaaaacgggaaaaaggugauccagcugucccgcaagaccuucgacagcgaguacgugaagacgcgggccaaugacugggacuucguggugaccaccgacaucuccgagaugggagcaaacuucaaggcugaacgggucauugacccuaggcgcugcaugaaacccgucauccugacggacggcgaggagcgagugauacuggcugggcccaugccgguaacgcacagcuccgccgcccagcgccggggccgcauugggcgcaaccccaagaacgagaacgaccaguacaucuauaugggagaaccccuggaaaacgacgaggacugcgcccacuggaaggaggcgaagaugcucuuagauaacaucaacacccccgagggcaucauuccgagcauguuugagccggagcgggaaaagguggacgccaucgacggggaauacagacugcggggcgaggcgcgcaagaccuucguggaccucaugcgccgcggggaccugccggucuggcuggccuacaagguggccgcggaggggaucaacuacgccgacaggaagugguguuucgacgggauuaagaacaaccagauccucgaggagaacauggagguggagaucuggaccaaggagggcgagcgcaagaagcugaaaccccgguggcuggacgcccgcauauacuccgacccccucgccuugaaggaguucaaggaguucgcggcgggccgcaagucgcugacgcucaaucugaucacggagauggggcgccugcccaccuucaugacccagaaggcccgaaacgcgcucgacaaccuggccguccugcacacggcggagacaggcgggaaggcguacaaccacgcccucuccgaguuaccagagacccuggagacccuucuacugcugacccugcuggccaccgugaccggcggcaucuucuuguuccugaugagugggaagggcaucgggaagaugacccugggaaugugcugcauaauaaccgccuccauccuccuuugguacgcgcagauccagccgcacuggaucgccgccucgauuauccucgaguucuuccucaucguccuccuuauaccagagcccgaaaaacagaggacgccccaggacaaucaguugacguacguggugaucgccauccugaccguaguggccgcgacaauggcuaacgagaugggguuccuagagaagacgaagaaggaccucggcuucggcagcaucaccacccaggaauccgagucuaacauccuggacaucgaccuccggccggcauccgccuggacccucuacgccguggccacaacguucgucacccccaugcugcgccacucgaucgagaacuccucuguuaaugugucccugacagccauagccaaccaggccacgguacuaaugggacugggcaaaggcuggccccugucaaagauggauaucggcgugccccuccuggcgaucggguguuacagccaggugaacccgaucacccugacugcggcccuccugcugcuugucgcccacuacgccaucgugggcccgggccugcaggccaaagccacccgggaggcacaaaagcgcgcggccgcagggaucaugaagaacccgacgguagacgguaucaccguuaucgacuuagagccaaucccguaugaccccaaguucgagaagcagcucggacagguuauguuacugauccucugcguaacccaaguccugaugaugcggaccacgugggcccugugcgaggcccucacccuggccaccggccccaucagcacccugugggaagggaacccaggccgcuucuggaauacuacaaucgccguuucuauggcaaacaucuuucgggggagcuaccucgccggagcaggccuacuguucuccaucaugaagaacaccaccaacacgcgccgcggcaccggcaacaucggcgagacuuugggggagaaguggaagucccggcugaacgccuuagguaaguccgaguuccagaucuacaagaaaagugggauacaggagguggacaggaccuuagcgaaggagggcauuaagcgcggggagacggaccaucacgccguuucccgcggcuccgccaagcugcggugguucguggagcgcaacaugguuaccccggagggcaaggucguggaccugggguguggccgcggugggugguccuacuacugcggcggcuugaagaacgugagggaggucaaggggcugaccaaggguggccccgggcaugaggagcccaucccuaugagcaccuacggguggaaccuagugcggcuccagagcgggguggacguuuucuucacgccgccggagaaaugcgacacgcuucugugcgacaucggggaguccagcccuaaccccaccaucgaggcuggucguacccuccggguucugaaccuaguggagaacuggcucaacaacaacacccaguucugcaucaagguccugaacccguacaugccauccgugaucgagaagauggagacgcugcagcggaaauacgggggcgcguuagugcgaaacccccugagccgcaacucaacccacgaaauguacugggucagcaacgcgaccgggaacaucgugaguagcgugaauaugaucucccggaugcugauaaaucgauuuaccaugaagcacaagaaggccacguacgagccggacgucgaccugggcagcgggacccggaacaucggcaucgagucagagaucccaaaccucgacaucaucggcaagcggauagagaagaucaagcaggagcacgagaccuccuggcacuacgaccaggaccacccuuacaagaccugggccuaccacggguccuacgagacgaagcagaccggcagugccuccagcauggugaacgggguaguucggcugcugacaaagcccugggacguggugcccaugguuacucagauggccaugacggacaccaccccguucggccagcagcgcguguucaaagagaagguggacacccgcacgcaagagcccaaggagggcaccaagaaacucaugaagauuaccgcggaguggcuauggaaggagcuggggaagcggaagaccccgaggaugugcacgcgggaggaguucacccgcaagguucgguccaacgccgccuuaggcgcaaucuuuaccgacgagaacaaguggaaguccgccagagaggcgguggaggacgggcgguucugggagcugguagaccgcgagcgaaaccugcaccucgagggcaagugugagaccugcgucuacaacaugauggggaagcgcgagaagaaacuuggcgaguucggcaaggccaagggaucccgggccauuugguacauguggcugggcgcccgcuuucucgaguucgaggcgcuuggguuccugaacgaggaccauugguucagccggggcaacagccuguccgggguggagggcgaggggcuacaccgccuuggauacauccugcgggacguaggcaagaaggagggcggggccauguacgccgacgauaccgccgggugggacaccagaaucacccuggaggaccugaagaacgaggagauggugacgaaccauaugaagggcgagcauaagaagcucgcggaagcgaucuucaagcugacguaucaaaacaaagugguccgagugcagcgcccgacgccccgggggaccgugauggacauuaucagccgccgagaccagcgcggauccggccaagucgguaccuacggccugaacacguucaccaauauggaggcccagcucauacgccaaauggagggcgaagggaucuucaagagcauccagcaccugaccgccaccgaagagguagcagugcagaacugguuagcgcgggucgggcgcgagcggcucucccgcauggcgaucagcggcgacgacuguguugugaagcccaucgacgaccgauucgcuagugcccugacagcccugaacgacauggguaaaguccgcaaggacauccagcagugggagcccagccgaggguggaacgacuggacccaggugcccuucuguucccaccacuuccacgagcucgugaugaaggacggccgcguccugguggugcccugccggaaucaggacgagcugaucggccgcgcccgcaucagccagggggcaggguggucccucaaggagaccgccugccugggcaagucauacgcacagauguggacccugauguacuuccaccgccgggaucugcgccuggcugccaacgcgauaugcuccgccguccccagccauuggguucccaccucccggacgacauggagcauccacgccaagcacgaguggaugaccacugaggauauguuggccguuuggaaccgcgucuggauccaggagaacccguggauggaggauaagacgccuguugagagcugggaggagguccccuaccucgguaagagggaggaccaauggugugggagccuaaucggccugaccucacgcgcaaccugggcaaagaacauccaaaccgccaucaaccagguccggucccucaucggcaacgaggaauacacggacuacaugcccucgaugaagcgcuuccgccgcgaggaggaggaggccggggugcugugguga

SEQ ID NO: 24994 - RNA, 9876 nt, Artificial Sequence
  derived and/or modified CDS sequence (opt11) from DENV-2__GQ868588__SS-prME
acggcgggcaugaucaucaugcugauccccaccguuauggccuuucaccucacaacccggaacggcgaaccccauaugaucgugucgcggcaggaaaagggcaagucacugcuuuucaaaaccaaggaugggaccaacaugugcacccugauggcgcuggacuugggggagcucugcgaggacaccauuacuuauaagugccccuuccugaagcagaacgaacccgaggacauugauugcuggugcaacaguaccuccacgugggugaccuaugggaccugcaccacgaccggcgagcaccgucgggagaagcgcuccguggcccugguuccccacgugggcaugggccuggagacccggaccgagacguggauguccagcgagggugccuggaaacacgcccaacgcaucgagacguggauccugcgacaucccggguucaccauuauggcugcgauucuugcauauaccaucggcacgacacacuuccaacgcguguuaaucuucauccucuugaccgcuaucgccccuuccauggccaugcggugcaucgggaucuccaaccgcgacuucgucgagggggugucaggcgggucauggguagacauaguccuagagcacggcuccugcgugaccaccauggccaagaacaagccaacccucgacuucgagcugaucaagaccgaggcaaagcagcccgccacccugcggaaguacugcauugaggccaagcugacgaacaccaccaccgacagucgcuguccaacacagggggagccuacccugaacgaggaacaggacaagcgguucguaugcaagcacucgauggucgaccgcgguuggggcaacggauguggguuauucgggaagggcgguauagugaccugcgcgauguucacgugcaagaagaacauggagggcaagaucguucagccugagaacuuggaguauacggucguaaucacgccccacagcggugaggagcacgccguggggaacgacacggguaaacacggcaaggaggucaagaucaccccgcaguccagcaucaccgaggccgaacugacgggcuacgguacagugacuauggagugcagcccccguaccggccucgacuucaaugagauggugcugcuucagauggaggacaaggccuggcucguucaucgccagugguuccuagaccugcccuugcccuggcugccgggcgccgacacacaggggagcaacuggauccagaaggagacccugguuacuuuuaagaacccccacgcaaagaagcaagauguggucgugcucggcagccaggagggugccaugcacacugcccucacaggcgccaccgagauccaaaugagcagcgggaaccuacuauucacaggccaucugaagugccgacugcgcauggacaagcugcagcuuaagggcaugucauacagcaugugcaccgggaaauucaagaucguaaaggagauagccgagacgcagcacggcacgaucgugauucggguucaguacgagggagacggcucccccugcaaaaucccuuucgagaucauggaucuggagaagaggcacguccucggccggcugauuaccguuaacccgaucgucacugagaaggacagcccagucaacaucgaagcggagccccccuucggggacuccuacaucaucaucgguguggaaccggggcaguuaaaguuggacugguuccgcaagggcagcuccaucgggcagauguucgagacgaccaugcgcggcgccaagcggauggccauccugggcgauacggccugggacuucggaagccugggugggguguucaccuccaucggcaaggcgcuccaucagguauuuggcgcgauuuacggcgccgccuucagcggcgucuccuggaccaugaagauacugaucggggugauuaucaccuggaucggcaugaacucgcgcucgacgagccugucagucucgcugguucucguggggaucgucacccuguaccugggcgugauggugcaggcugacuccgggugcgucgugucguggaagaacaaggaguuaaaguguggguccggaauuuucguaacagacaacguccacaccuggacggagcaguacaaguuucagcccgagucgcccagcaaacuagcguccgccauccagaaggcucacgaggaggggaucugcggcauacgcagcguuacucgccucgagaaccucauguggaagcagauaacuuccgagcucaaccacaucuuaucggaaaacgaggugaagcucaccauuaugaccggggauauuaaggggauaaugcaagucgggaagcgcucccuucgcccccagccgaccgagcugcgguauagcuggaagacguggggcaaagcgaaaaugcucuccacggaacuucacaaucagaccuuucugauugaugggcccgagaccgcggagugcccgaacacaaaccgcgcguggaacucgcucgagguggaggauuacggauucggcgucuucaccaccaacaucuggcugcgacugcgcgagaagcaggaugucuuuugcgacuccaaauugaugagcgccgccaucaaggacaaccgggccguacacgcugacauggguuacuggaucgagagugcgcugaacgauaccuggaaaaucgagaaggccagcuucauugaggugaaguccugccacuggcccaagagucacacccuguggucuaacggaguccucgagucugagauggugauucccaagaacuucgccggcccggugucccaacauaacaaccgucccggguaucacacacagacugccggcccguggcacuuggggaagcuggagauggacuucgacuucugcgaggguaccacugucgugguaaccgaggagugcggaaaucggggucccagccuccgcaccaccaccgccucaggcaaacugaucacggaauggugcugccgguccugcacccugccgccccugcgauaccgaggggaggauggcuguugguacggcauggaaauccggccgcugaaagagaaggaggagaaccucgucagcucguuagugaccgcaggacacggccagaucgacaacuucagccuagguauccuaggaauggcccuauucuuagaagaaaugcugcgaacucgcguggggaccaaacacgcgauccuccuugucgccguguccuucgugacccugaucaccggcaacaugagcuuccgugaucucgggcggguaauggugauggugggggcaaccaugaccgacgacaucgggaugggcgucaccuaccuggcccugcucgcagcguucaaggugcgcccuaccuucgcggcgggccuuuugcuccggaaacugacguccaaagagcugaugaugacgaccaucgggaucguucuccuuucccaauccagcauucccgagacaauccuugaacucaccgacgcccuugcccugggcaugauggugcucaagauggugcgaaacauggagaaauaucagcuggcagucacgauuauggccauccuguguguucccaaugcggugauccugcagaaugccuggaagguuucgugcacgauccuggccguggugaguguuuccccgcugcuccugaccagcucgcagcaaaaggcggacuggaucccccuggcccucaccaucaaggggcugaaccccacggcgaucuuccuuaccacccucucgcggaccuccaagaagcgcagcuggccacugaaugaggcgaucauggccguuggcaugguguccauccuggcgagcagucuccugaagaacgauauacccaugacgggcccccuugucgccgggggacucuuaaccgugugcuacgugcugacagggcgguccgccgaccucgagcuggagcgcgccacggacgucaagugggacgaccaggccgagaucagcggauccagccccauccuguccaucaccaucagcgaggacgggucaaugagcaucaagaacgaggaggaagagcagacccucaccauccugaucaggaccggcuuacuggugauuuccggccuguuccccgucagcaucccgaucacagccgcggccugguaccugugggaggucaagaagcagagggcuggcgugcugugggauauccccagcccgccgcccguggguaaagccgagcucgaagacggggccuaccggauuaagcagaaggggauacugggguacagccagaucggagccggcguauacaaagaggggacuuuccacaccauguggcacgucacacgcggcgcuguguuaaugcacaaagggaagaggaucgagcccuccugggccgacguuaaaaaggacuuaaucagcuauggugggggcuggaaacuggaaggugaguggaaggagggggaggagguccaggugcucgcucuagagcccggcaaaaauccgcgggccguccagaccaaacccggguuguuccggacgaacaccgguaccaucggugcggugagucuagacuuuagccccggcaccuccgguucacccaucgucgacaagaaggggaaggucgugggccuguacgggaacggcguugucacgcggagcggcgccuacgugucagccaucgcccaaaccgagaaaucaaucgaggacaacccggagaucgaagacgacauuuuccguaagcgccggcugaccaucauggacuuacaccccggagccggcaagaccaagaaguaccuacccgccauugugcgggaagccaucaagcgggggcugaggacgcugauacuugcccccacccgcgucguugcggcugaaauggaggaggcgcuccggggccugccaauccgcuaucagacucccgcuauucgggccgaacacacagggcgcgagaucguggauuuaaugugucacgcuacguucaccaugcggcugcugucgccaauacgcgucccgaacuacaaccuuauuauaauggaugaagcgcacuucaccgacccggcuagcaucgccgcccggggcuacaucaguacccgaguggagaugggcgaggccgcggggaucuucaugacggccacgcccccaggcucucgcgaccccuucccgcagagcaacgcccccaucauggacgaggagcgcgaaauccccgagcggucuuggaacuccgggcacgagugggugaccgacuucaagggcaaaaccgucugguucguuccuagcauuaagacggggaacgacaucgccgccugccugcgcaagaacggcaagcgggugauacagcugucccgcaagaccuuugacagcgaguacgucaaaacgcgaaccaacgauugggacuucguugucacgaccgacauuuccgagaugggcgcuaacuucaaggcggagagggucauagacccgcggcgaugcaugaagcccgugaucuugaccgacggggaggaaagagugauacuggcgggccccaugcccgucacccacagcagugcggcacaacgacgcgggcggaucggccgcaacccgcggaacgagaacgaccaguacauuuacaugggggagccccuggaaaaugacgaggauugcgcucacuggaaagaggccaagaugcuccuggacaacaucaauacgcccgaggguaucauuccgagcauguucgagcccgagcgagaaaagguggacgcaaucgacggcgaguaucggcugcgcggggaagcccggaagaccuucguggaccuuaugcgccggggcgaucugcccgucuggcuggcguacaagguggccuccgaggggaucaacuacgccgaccgccgguggugcuuugacggcacccggaauaaccagauccucgaagagaacguggaggucgaaaucuggacuaaggaaggagagcggaaaaaacugaagccccgauggcuggacgcccggaucuacagcgacccgcucgcgcucaaggaguucaaggaguucgcagccggccguaaaucccugacgcucaaucugaucacagagaugggccgguuacccaccuucaugacucagaaggcccgcgacgcccucgacaaccuggccgugcuacacacggcggaggccgguggcaaggccuacaaccacgcucucagcgaacugcccgagacccuggagacccuccugcugcucacccuacuggcgaccgucaccgggggcaucuuccucuuccugauguccgggagggggaucggaaagaugacccuggggaugugcugcaucaucaccgccagcauccugcugugguacgcccagauucagccccacuggaucgccgccagcauaauccuggaauucuuucucaucgugcugcugauuccagagcccgagaaacagcgaacgccccaggacaaccagcucacguacgugaucaucgcgauccugaccguuguggccgccaccauggcuaaugaaaugggguuccuggagaagaccaaaaaggacuugggcuugggccacaucgccacgcagcagcccgaguccaacauccuggacaucgaccuccggccggcgucugccuggacccuguacgcaguggccaccaccuucauaacgcccaugcugcgccacuccaucgagaacagcagugucaaugugucuuuaaccgccaucgcaaaccaggccaccgugcucaugggccuagguaagggcuggccccucuccaagauggacaucggcgucccccugcuggccaucgggugcuacagccagguuaacccgaucacccucacggccgcucuucuccuccugguggcccacuacgccaucaucgggcccggacugcaagccaaagccaccagagaagcgcagaagcgggccgccgccggcaucaugaaaaacccuaccgucgaugggaucaccgugaucgaccuagacccuauaccauaugacccgaaauuugagaagcagcugggccaggugaugcugcucguccugugcgugacccagguuuuaaugaugcgaacaaccugggccuugugcgaggcgcuuacccuagccacgggucccgucuccacccucugggaaggcaaccccgggcgguucuggaacaccacgauugcugugagcauggccaauaucuuccgcggauccuaccuggccggagcgggccuccucuucucgaucaugaaaaacacgaccuccacccggcggggaaccgggaacaucggcgagacacugggcgagaaguggaaguccaggcugaacgcacucggcaagagcgaauuccagaucuacaagaaguccgggauccaggaggucgaccgcacucuggccaaggaggguauaaagcgcggcgagaccgaccaccacgccguaucccgcgggagcgccaagcuucggugguuuguugaaagaaaucucgugaccccggaggguaaggucguggaccugggcugcgggcggggcgggugguccuacuacugugguggguugaaaaaugugcgcgaagucaagggccucacgaaaggugggcccggccaugaggagcccauaccgaugagcacauauggguggaacuuagugcggcuacagagcggcguggacgucuucuuuguuccgcccgagaagugcgacacccuccugugcgauaucggggagagcagccccaacccuacaguggaggcgggccgcaccuugcggguccucaaccugguggagaacuggcucaauaacaacacgcaauucugugugaaaguucugaacccguacaugccauccgugaucgagaggauggagacccugcagcggaaguauggcggggccuugguccgcaacccacugagucgcaacaguacgcaugagauguacuggguuagcaacgccucgggcaacaucgugagcuccgugaacaugaucagccgcaugcucaucaaccgcuucaccaugcggcacaaaaaggccacguacgagccggacguugaccugggguccggcacccgcaacauagggauugagucggagacccccaaccuggauaucaucgggaagaggaucgaaaagaucaaacaggagcacgaggcauccuggcacuacgaccaggaccaccccuacaagaccugggcuuaucacggcagcuacgagacgaagcagaccggaucggcaagcagcauggugaacggcgugguucgacuccuaaccaaaccaugggacguggugccuauggucacccaaauggccaugacggacaccacccccuucgggcagcagcggguguucaaagagaagguggacacgcguacgcaggagcccaaggaggggaccaaaaagcugaugaagaucacggcugaauggcuauggaaagagcugggcaagaagaagacgccccggaugugcacgcgcgaggaguuuaccaagaaggucagaagcaacgcggcccugggggccauuuucaccgacgagaauaaguggaaauccgcacgggaggccguggaggacaaucgguucugggagcuuguagacaaggagcgcaaccuccaccucgaggggaagugcgaaacaugcauuuacaacaugauggggaagcgggagaagaagcuuggcgaauucgggaaggcgaaggggagccgcgcgaucugguacauguggcugggugcucgcuuccuggaguucgaggcccuuggguucuuaaacgaagaccacugguuuagccgggagaacucccucagcggcguggagggggagggccuccacaagcugggguacauacugcgggaggugucuaagaaagagggcggugccauguacgcugaugacacggcugguugggacacccgcaucacgaucgaagaccucaagaaugaggagaugaucaccaaccacauggcuggcgaacacaagaagcuggccgaagcgaucuuuaagcugacguaccaaaauaagguggugcgggugcagaggccgacuccccgcgggaccgucauggacaucauuagccggcgcgaccagcggggauccggccagguggggacuuacggccucaacaccuucaccaacauggaggcccaguugauccgccagauggagggggagggcaucuucaagagcauccagcacuuaacggccuccgaggagaucgccgugcaggacuggcucgucagagucggucgcgagcgcuuaagucgcauggcgaucagcggcgacgauugcguggugaagccucuggacgaccgguuugcgagagcccucaccgccuugaaugacaugggcaaggugcggaaggauauucagcaaugggagcccagccgcggcuggaacgauuggacccaggugccguucugcucccaccacuuccaugagcugaucaugaaagacggccggauacucguagugcccugcaggaaccaagacgagcugaucgggcgcgcccgcaucucccagggcgccggguggucucugagggagacagcgugccucgguaaaucauaugcccagauguggucccugauguacuuucaccgccgggaccugcgccucgccgcgaacgcuaucugcagcgcugugcccucccacugggugcccaccagccgcaccacuugguccauccaugccucacacgaguggaugacgaccgaagacaugcugacuguguggaaccggguguggauccuggagaacccguggauggaagacaaaacccccgucgagagcugggaggaaauacccuaccucggcaagcgugaagaccaauggugcgguucccugaucggccucacgagccgugccaccugggccaagaacauccaaaccgccaucaaccaaguacgaucauuaaucgggaacgaagaguacaccgauuacaugcccagcaugaagcgguuccgucgcgaggaggaagaagcgggcgugcugugguga

SEQ ID NO: 24995 - RNA, 9876 nt, Artificial Sequence
  derived and/or modified CDS sequence (opt11) from DENV-2__GQ868590__SS-prME
acagcgggcaugauuaucaugcuuauccccaccgugauggccuuccaccucaccacccgaaauggcgagccccacaugaucgugagcagacaggagaagggcaagagccuacuguucaagaccaaggacggcaccaauaugugcacccuuauggcgauggaucugggcgagcuuugcgaggacaccaucaccuacaaaugcccauuccugaagcagaacgaacccgaagacauagacugcuggugcaacagcaccuccaccugggugaccuacgggaccugcaccacgaccggugagcaccggcgggagaagcgcagcguagcccuggugccacacgugggcaugggacuggaaacccggaccgagacguggauguccagcgaaggcgcauggaagcacgcccagcggaucgagaccuggaucuuacggcacccgggguucaccaucauggccgcgauccuggccuacacaauuggcaccacgcacuuccaacgcgugcugauauucauucucuuaaccgccaucgccccauccaugaccaugcggugcaucgggauuagcaaccgcgauuucgucgaggguguauccggcgggagcuggguggacaucguccucgaacacggcucuugugugacgaccauggcgaagaacaagcccacccucgacuucgaacucaucaaaaccgaggcuaagcaaccagccacccugcggaaguacugcaucgaggcuaaacucaccaacaccacgacggacagccggugccccacccaaggggagccgacccugaacgaagaacaggacaagcgguucgugugcaagcacuccauggucgaccgcgguuggggaaauggcugcggacucuucgggaaaggcggcaucgugaccugugcuauguuuacgugcaagaagaacauggagggcaagaucgugcagcccgagaaccuagaguacacuguaguuaucacgccccacucuggggaggagcacgcagugggcaacgacaccggcaagcacgggaaggaagucaagaucaccccccaguccucgaucacggaagccgagcugaccggcuacggaaccgucaccauggaaugcuccccccggacaggccuggacuucaacgagaugguucuccugcagauggaggauaaagccuggcugguccaccgccaaugguuucucgaccugcccuuacccuggcuacccggugcugacacccaggggagcaacuggauccagaaggaaacgcuagugaccuucaagaauccccacgcaaagaagcaggacguggucguacuuggcucccaggagggugcgaugcauacugccuuaaccggcgccaccgaaauccagaugagcucggggaaccuguuauucaccggccaccucaagugucggcugcguauggacaagcugcaguuaaaggguauguccuauagcaugugcacggguaaguucaagauaguaaaggagaucgcugaaacucagcacggcaccaucgucauccgagugcaguacgagggggacggcagcccaugcaagauccccuuugagaucauggaucuggaaaagagacacguccuggggcgguuaaucaccguaaauccuaucgugacggaaaaggacagcccaguuaacaucgaggccgagccccccuucggggacuccuacauuaucaucggcguggagccggggcagcuaaagcuggauugguucaagaagggcaguuccaucgggcagauguucgagaccacaaugcgcggggcgaagcgcauggccauccucggcgacaccgccugggacuucgggagucugggcggcauguuuaccagcauuggcaaagccuugcaccaggucuucggggccaucuacggcgcggccuucagcggagucaguuggaccaugaagauauugaucggggucaucaucaccuggauaggaaugaacagccguucuaccagccuaagugugucgcuagugcucgucgggaucgugacucucuaccuaggcgucaugguucaagcugacuccggaugcguggucuccuggaagaacaaggagcugaagugcggcuccggcaucuucgugaccgacaacgugcacaccuggaccgagcaguacaaguuccagccagagagcccuuccaaacucgcguccgcgauacagaaggcccacgaggaggggaucuguggaauccgcagugucacccggcuggaaaaccuaauguggaagcagaucacccccgagcucaaccacauucuaagugagaacgaggucaagcugaccauaaugaccggggauacgaagggaauaaugcaggucgggaagcgcucgcuucggccacagcccaccgagcuacgcuacuccuggaagaccuggggcaaggccaaaaugcuaccuaccgagcuccacaaucagacguuccugaucgacggccccgaaaccgccgagugcccaaacacaaaccgggccuggaacagcuuggaggucgaggacuauggguucggcguguucaccacgaauaucuggcuccgccugcgggaaaaacaagaugucuucugcgacuccaaacugaugagugcagccauuaaggauaaccgcgcuguccacgcugacaugggguacuggauagaguccgcgcuaaacgacacguggaagaucgaaaaggcgagcuuuaucgaggugaaaucuugccacuggcccaagagccacacccugugguccaacggcguucuagagucugagauggucauaccaaagaaccucgccgguccggugucccagcacaacaaccggcccgguuaccacacacagaccgccgggcccuggcaucuggggaaacuggaaauggauuucaacuuuugugagggcacgaccgugguagugaccgaggagugcggaaaccgcgggcccagccuccggacuacgacggcaagcggcaagcugaucaccgaaugguguugucgcagcugcacccuucccccccuccgguaccgcggggaggacgguugcugguacggaauggagauccggccccugaaggagaaggaagagaaccuggugagcucgcucgucacagccggucacgggcagauagacaacuucucucucggcauccugggcauggcccuauuccuggaggagaugcuccguacccggguagggacuaaacaugccauccuccugguggcugucuccuuugugacccugauaacuggcaacaugaguuuuagagaccucggucgcgugauggucauggucggagccaccaugaccgaugacaucgggaugggcgugaccuaucuggcgcuacucgcggcuuacaaaguccggcccacguucgcggccggccuguuauuacgcaagcugacuagcaaggagcugaugaugaccaccaucgggauaguccugcuaucccaaagcucaauuccggagacgauccuggagcuuaccgacgcucuggcacugggcaugaugguucucaagaugguucggaacauggagaaguaccagcucgcugucacaaucauggcuauacugugcguaccuaacgccgucauccuccaaaacgcauggaagguguccugcaccauucuggccgucgucagcguuagcccgcuguuauuaacgagcucgcagcagaaggccgacuggaucccccuagcccucaccaucaagggauuaaacccgacggcgaucuuccugaccacauuaucucgcaccuccaagaaacgaucguggccccugaacgaggcgauuauggccgucggcaugguuuccaucuuagcgagcucccuccugaagaacgacauuccaaugaccggcccccugguggcgggaggacuucugaccgugugcuacgugcugacgggucgcagcgcggaccuugagcuggagaaagccacugacguaaagugggacgaccaagccgagaucagcggcagcuccccgauccuguccaucaccaucagcgaggacggguccaugagcauaaaaaacgaggaggaggagcagaccuuaaccauucugaucaggacgggucuguuagucaucucaggcuuauuucccgugucuauacccaucaccgccgccgcaugguaccugugggagguaaagaagcagcgcgcugggguccucugggacgugccuuccccuccgcccgugggcaaggcugagcuggaggacggggccuaccggaucaagcaaaagggcauucugggauauucacagauuggagcuggcgucuacaaggaggggaccuuucacaccauguggcaugugacgcgcggcgcgguguugaugcauaaagggaagcggaucgagccgucaugggcugacgucaagaaggacuugauaucauacggugguggguggaagcuugaaggugaguggaaagagggcgaggagguacaggugcucgcccuggagcccggcaagaaucccagagccguccagacgaagccugggcuguuccggaccaacaccgguacgaucggggcuguaucccucgacuuuagcccugggaccuccggcagccccaucguggacaagaaggguaaagucgugggucuguacggcaacgggguggucacacgcuccggcgcauaugugagcgcuaucgcucaaaccgagaagagcauagaggacaaccccgagaucgaggaugauauuuuuagaaagcggcggcugacgaucauggaccugcacccuggagccggcaagacaaagaaguaccucccggccauugugcgcgaagcgaucaaaagggggcugaggacccugauacuggccccuacccggguaguggccgcggaaauggaggaggcgcugcgcggccugccgaucagguaucagacgcccgcgauccgggcagagcacacugggcgcgagauaguugaccucaugugucacgcaaccuucaccaugcgucugcuaagccccauccgggugcccaacuacaacuugaucauaauggacgaggcccacuucacagaucccgcgagcaucgccgcgcgggguuacaucuccacccguguggagaugggcgaggcggccgggaucuucaugaccgcgaccccgcccgggagccgggaccccuucccccaauccaacgcccccaucauggaugaggagcgagagauccccgagcgguccuggaacagcggccacgaguggguuaccgacuucaagggcaagaccguuugguucguucccagcaucaaaacggggaacgauaucgccgcgugucugcgcaagaauggcaagcgggucauccagcugucccgcaaaacguucgacuccgaauacguaaagacccgaaccaaugacugggacuucguagugacgacggacaucuccgagaugggcgcuaacuucaaggcggaacgcgucaucgauccccgccgcugcaugaagcccgugaucuuaacagacggggaggaacgggugauacuagccggcccgaugccugucacccacagcuccgcugcccagcgccgggggcgcaucggcaggaacccccguaacgagaaugaccaguacauauacaugggggagccccuagaaaacgacgaagacugcgcccacuggaaggaggccaagaugcuauuggauaacauuaacacccccgagggcaucauccccagcauguucgggcccgagcgcgagaagguggaugccaucgacggugaauaccggcugcgcggcgaagcccggaagaccuucguggaguugaugcgccgcggggaucuacccgucuggcucgcguacaagguggcguccgagggcaucaacuaugccgaccgcagauggugcuucgacgggacccgcaacaaucagauccucgaggagaacguggaaguugagaucuggacuaaagagggcgagaggaagaaacugaagccacgguggcuugacgcccggaucuacagugacccccucgcccuaaaggaauucaaggaguucgccgcggguaggaaaucccugacccucaaccugaucacggagauggggcggcugccaacguucaugacccagaaggcccgcgacgcccuugacaacuuggccgugcuccauaccgccgaggcaggcgggaaggccuacaaccacgcccuuagcgaacugcccgagacacuugagacccuccugcugcucacgcugcucgccaccgucaccggcggcaucuuccuuuuccugaugagcggacggggcaucgggaagaugacccugggcaugugcugcaucauuacggcuagcauccuccugugguacgcccagauccagccacacuggauugcugccaguauaauacuggaauucuuucucaucgugcuccuaaucccggagcccgagaagcagcgcacuccucaggacaaccagcucaccuaugugaucaucgccauccuaaccgugguggcggccacgauggccaacgagaugggguucuuggagaagaccaagaaggaccuaggccugggccauauagccacacagcagcccgagagcaacauccuggacaucgaccucagaccggcgucagcauggaccuuguaugcgguugccacgacguucauaacuccaaugcugcgccacuccauugagaauagcuccgucaauguaagccucacugcuaucgcaaaccaagcaacggugcuuaugggguuagggaagggauggccgcucuccaaaauggacaucggcgucccguuguuagccaucgggugcuacagccagguaaacccgaucacucuaacggcagcccugcuucuccugguggcgcauuaugcgauaaucggccccggccugcaggccaaggcuacccgugaggcccaaaagcgcgcugcggcagggaucaugaagaacccgacggucgauggcaucacgguuaucgaucucgacccuauccccuacgaccccaaauucgagaagcagcugggccagguaaugcugcucguacugugcgugacccagguacugaugaugcguaccaccugggccuugugugaagcgcugacccuggccacuggaccugugagcaccuugugggaggggaacccuggucgguuuuggaacacuacuaucgccgugagcauggccaauaucuuccgaggcuccuacuuagcaggggccggucuccuuuucagcaucaugaagaauacuaccucaacgcggcgcggcaccggcaacauuggcgaaacacugggugaaaaguggaaaagucguuuaaacgcgcucgggaaguccgaguuccagaucuacaagaagucgggcauccaagaaguggaccguacccuggcuaaggagggcauaaaacgcggcgagacagaccaccacgccguuucucgcgggagcgccaagcuccggugguucguggaacguaauuugguaacccccgaaggaaaaguuguggaccuggggugcgggcggggagggugguccuacuacugcggcgggcuaaagaaugugcgcgaggucaaggggcucacuaagggcggcccugggcaugaggagccgauacccauguccaccuacggcuggaaccuaguucggcugcaauccgggguggacgucuuuuucauuccgccggagaagugcgacaccuugcuuugcgacaucggcgagucgaguccgaaucccacggucgaggccggccgcacccugcgggugcucaaccuagucgagagcuggcugaauaacaacacccaguucugcgucaagguccuuaacccguacaugccaagcgucauugagcgcauggaaacacugcaacggaaguacgguggggcgcuagugcgcaacccccuaucucggaacagcacucacgagauguauuggguguccaacgcuagcgggaacgucguguccagcgugaacaugaucucccgcaugcucaucaaccgcuuuaccaugcggcauaaaaaggccaccuacgagcccgacgucgaucugggcagcggcacccgcaauauaggcaucgaguccgagacgcccaaucuggacaucauuggaaaacggaucgaaaagauaaagcaggagcacgaggccaguuggcauuacgaccaggaccaucccuacaagaccugggcauaucacggguccuacgagaccaaacagaccggaagcgccucgagcauggugaacggaguaguucgccugcugaccaaacccugggacgucgugcccauggucacccagauggccaugaccgacaccacgcccuucgggcaacagcggguguucaaggagaagguggacacgcgaacucaggaaccgaaagagggcaccaagaaauugaugaaaaucaccgccgaguggcucuggaaggagcucgggaagaagaaaacgccccgcaugugcacccgggaagaguucacuaagaagguccgaucaaacgccgcgcuaggcgccauuuucacggaugaaaacaaauggaagagugcuagggaagcaguggaagacaaucgcuucugggagcugguugacaaggagcggaaccugcaucuggaagggaagugcgagaccugcguauacaauaugaugggcaaacgcgagaagaaacucggcgaguucgguaaggccaagggaucccgggcgauuugguacauguggcugggugcuagguuucuggaguucgaagcucucggcuuccugaacgaggaccauugguucagccgcgagaacagccugagugggguggagggggaggggcuacacaagcugggcuacauccugcgggagguaaguaagaaggaaggcggagccauguacgccgacgacaccgcgggcugggacacacgcaucaccauagaggaucucaagaaugaagaaaugauuacgaaccacauggcuggggaacacaagaagcuggcugaagccauuuucaagcugaccuaucagaacaaggucgugaggguccagcgccccacacccaucggcaccguuauggacaucauuuccagacgcgaccaacgaggaagcggucagguuggcaccuacggucucaacaccuuuacgaacauggaagcucagcugauacggcagauggagggcgaggggaucuuuaaguccauccagcaccugacggccagugaggagaucgcuguccaggacuggcucgugcgcgugggccgggaacgccucucccggauggccauuucgggggacgauuguguagugaaaccgcuggacgaccgcuucgcgcgggcgcuaacagcucuaaacgacauggguaaagugcgcaaggacauccagcaaugggaaccaucccgaggguggaacgacuggacacagguacccuucuguagccaccauuuucaugagcugaucaugaaggacggucggacguuggugguccccugccggaaucaggacgagcuuaucggccgcgcccggaucagucagggggcaggguggagccuaagggagaccgcaugccucggcaaauccuacgcgcagauguggucgcugauguacuuccaccggcgcgaccugcgguuggccgccaacgcuaucuguuccgcagucccaagccacugggugccuacgucucgcacaacauggagcauccaugcgagccacgaguggaugaccacagaggacauguugacuguguggaacagagucuggauccuggagaaccccuggauggaggacaagacccccgucgaguccugggaggagaucccguaucucgggaagcgcgaggaccaguggugcgguucucugauagggcuaaccucccgagccacgugggcaaagaacauccagaccgccauaaaccagguccgcucucuuauaggcaacgaggaauacacugacuacaugcccuccaugaagcgcuuucggcgcgaagaggaggaggcggggguccugugguaa

SEQ ID NO: 24996 - RNA, 9876 nt, Artificial Sequence
  derived and/or modified CDS sequence (opt11) from DENV-2__GQ868497__SS-prME
acugcaagcguuauugucaugcugauaccuacugugauggccuuccaccucacaacucgcaacggcgaaccccacaugaucguaggccggcaagaaaagggaaagucccuguuguucaagacagaagacggugucaacaugugcacccuuauggcgaucgaccucggagagcugugcgaagacacgaucaccuacaaguguccccuccugcgccagaaugagcccgaggauauagacugcuggugcaacagcaccucuacaugggucacauacgggaccuguagcaccaccggggagcaccggcgggagaagagguccgucgcccuggugccccacguuggcauggggcucgagacacgcacggagacauggaugagcucugagggcgcuuggaaacacgugcagcggauugagaccuggauccugcgccacccaggguucacgaucauggcugcaauccuugccuauaccauaggcaccacccacuuccagcgcgcccucauuuucauucugcugacggccgucgcucccuccaugaccaugcgcuguauagggauaucaaaccgggauuucguggagggaguguccggcgggaguugggucgacaucgugcucgagcauggcagcugcgugaccacgauggccaagaacaaacccacucuggacuucgagcugaucaagacagaggcuaagcagcccgccacucuuaggaaguacugcauugaggccaaacugacgaacacgaccaccgagucccgaugcccgacccagggugagcccagccugaacgaagagcaagacaagcgcuuuaucuguaagcauucuaugguugaccggggcugggggaacggcugcgguuuauucgggaaaggcggaaucgugaccugcgccauguuuacgugcaagaagaacauggaggggaaggugaugcagccggaaaaccuggaauacacaaucgugauaacuccccacagcggggaggagcacgcuguggggaacgauacaggaaaacacggaaaggagauaaagaucacgccacaguccucaauuacagaagcagaacugaccggcuacgggacgguaacuauggaguguagcccccggaccgggcuagacuucaaugaaauggugcuguuacagauggaggauaaggccuggcucguacaucggcagugguuccuggaccucccccuaccaugguugccgggcgcugacacccaggggaguaacuggauucagaaggagacccuggugacguucaaaaauccccaugcgaagaaacaggacgucgugguuuuaggcagccaggagggggcgaugcacacggcgcugacgggagccacggagauccagauguccucagggaaccugcuguucacgggccaccugaaaugccgacuucggauggauaagcuccaacugaagggaauguccuacaguauguguacagguaaauucaagaucgugaaggagaucgcugaaacccaacacggcaccaucgugauuagaguccaguacgaaggcgacgguucccccugcaagaucccguucgagaucacggaucuugaaaaacggcacguccugggccgcuuaaucaccguaaacccaaucgugacugagaaggacagcccgguuaacauagaggcagagccgcccuucggagauucauacaucaucauugggguggagccagggcagcuaaagcuuaacugguuuaagaagggcucuuccaucgggcagauguuugagaccacgaugcgaggcgcgaaacggauggcgauccuuggagacaccgcuugggacuuuggaucccuaggcggcgucuuuaccaguaucggcaaagcccuccaccagguguucggggccaucuacggcgcggccuuuagcggcguguccuggacaaugaagauccugauugguguaauuaucacguggaucggcaugaacucccggucuaccucacuguccgugucgcugguguuagucggggucgugacccuguaccucggcgcuaugguacaggcggacuccggguguguaguaagcuggaaaaacaaagaauugaaaugcggcagcggcaucuucaucacggauaacguccauacguggacugagcaguacaaguuucagcccgaguccccgagcaagcuggcgagugccauacagaaggcccacgaagaggggauuugcggaauacggucagugacccgccuggagaacuugauguggaaacaaauuacccccgagcuuaaccacauccuguccgaaaacgagguaaagcuaacaaucaugacgggggacauuaaggggaucaugcaagcuggcaagcggagccugaggccucagcccacagaauugaaguauaguuggaagacauggggaaaggcuaagaugcuaagcaccgagucgcacaaccagaccuuccuuaucgacggucccgaaacggcggaaugccccaacacgaaccgggcauggaacagccuggaggucgaggacuacgguuucggcguguucacuacaaacauuugguugaaauuaagggagaagcaggacguauucugcgacuccaagcucaugucagccgccaucaaagacaaccgggccguucacgcugacaugggguauuggauugaguccgccuuaaacgacaccuggaagauggagaaagcaagcuucaucgaggugaagaguugccacuggcccaaaagucauacccuguggaguaauggcgugcuggagucagagaugaucaucccaaagaacuucgcagggcccgucucucaacacaauuaccgaccaggcuaccauacccagacugcgggccccuggcaccucggcaaacuugagauggacuucgacuucugcgagggcacuaccgugguagucacagaggacugcgggaaccgagggccgucucugaggacgacuacugcgucugguaaacugauaacagaguggugcugccgguccugcacgcugccaccccugcgauaccguggggaggacgggugcugguacggaauggagauuaggccgcucaaggagaaggaggagaaccucgugaauucccuagugaccgcgggacacgggcagaucgacaauuuuagccuuggcgucuuaggcauggcccuguuccuugaggagauguugcggacccgcaucgggacuaagcaugcgauccugcuuguagcggccucuuucguuacgcuuaucaccggcaacaugucguuccgggaccuggggcgugucauggugauggugggcgccacuaugaccgaugauauaggaaugggagucacguaccucgcacugcuggcggcguucaagguuagacccacauuugccgccggacuccugcuacguaagcucaccagcaaagagcucaugauggccaccaucggaaucgcacugcucagucagucuacgaucccggagacgauacuggagcuaacagacgcgcuagccuuagggaugaugguucuuaaaaucguucguaacauggagaaauaccaauuagcaguaacgaucauggcuaucucaugcguccccaacgcagugauccuccaaaacgcguggaaagugagcuguacaauccuggcugcaguauccgucagcccacucuugcuaaccucgagccagcagaaggcagacuggaucccccucgcgcugacuauaaagggccugaaccccaccgccauuuuccucacaacccuaucacggacgucuaagaagcgcucuuggccgcugaacgaagccgugauggccgucggcaugguguccauccuagccagcucucuucucaagaacgauauccccaugaccggcccccuuguggcgggcggguugcugacagucuguuacguccuaacagggcguagugccgaccucgaacuagagcgcgccgccgacgugaaaugggaggaucaggcagagaucagcgggagcaguccgauccugucgaucaccauaagugaggacgggucaauguccgugaaaaacgaggaagaggagcaaacacucacgauccugauccggacgggccuccuagugaucucuggcguguucccggucuccaucccuaucaccgcugcggccugguaucugugggaagugaaaaagcagcgcgcggggguucuuugggacgucccguccccuccgccagucgaaaaggcagagcuugaagacggcgcauaccgaaucaagcagcgugggauccugggcuacagucagaucggagcgggcguguauaaggagggcacguuccacacgauguggcacgucacccggggcgcagugcuuaugcaccgggguaagcggaucgagccaaguugggccgacgugaagaaggaccugauaucauaugggggcggguggaaacuggagggcgaguggaaggagggcgaagagguacaagugcuagccuuggagccagggaagaacccccgagcugugcagaccaagcccgguauuuucaagacuaauaccgggacuauaggagccguuagccucgauuucucccccggcaccuccggcuccccgauuguagaucggaaaggaaagguggucgggcuuuaugguaacgguguggucacccgcagcggcgcguaugucucggccaucgcgcagacagaaaaguccaucgaagacaacccagagaucgaggaugacaucuucaggaaaaagagacuuacaauaauggaccugcaucccggggccgguaaaaccaagagguaucucccggccaucgugcgcgaggccaucaagagaggccugcguacccugauacuggccccgacccgggucgucgcugcggagauggaggaggcccuccgagggcugcccauccgcuaccagacacccgcuauuaagacagaacauaccggccgggagaucguggacuuaaugugccaugccacguuuacgaugcgccuccugagccccguccggguaccgaacuacaaccugauaauaauggacgaggcgcacuucacugaccccgccuccauagccgcgcgcggguauaucagcacccggguggaaaugggcgaggccgccgguauauucaugaccgccacgccgcccgguucccgcgacccguucccccagagcaaugcuccaaucauggacgaagagcgggagauccccgagagauccuggaacagcggucacgagugggugaccgacuuuaaggguaagaccgucugguucgugccgagcaucaaggccgguaaugacauagcugccugucuccgaaagaacgguaagaagguuauccaacugagcaggaagaccuucgauucagaauacgucaaaacgagagccaacgacugggacuuugugguaaccaccgauaucagcgagaugggcgccaacuuuaaagccgagcgcgucaucgacccccggagguguaugaaacccgugaucuugacugacggcgaggagcgggugauccucgcagggccgaugccggugacgcacuccagcgccgcccagcggaggggccgaaucggacguaaccccaaaaacgaaaacgaucaauacauuuacaugggcgagcccuuagagaacgacgaagauugcgcccacuggaaggaagccaaaaugcuucucgacaacaucaacacccccgaggggaucauuccguccauguucgagccagaacgggagaaggucgaugcgauugauggcgaauaccgccugcggggcgaggcacguaagacauucguggacuugaugaggcgcggggauuugccugugugguuagcguauaagguugccgcagagggaaucaauuacgcggacaggaaauggugcuuugacgggauaaagaauaaucagauccuggaggagaacauggagguggagaucuggaccaaggagggugagcgcaagaagcucaagccgcggugguuagacgcccgcauuuauucggacccuuuagcacucaaagaguucaaggaguucgcggcagggcggaagucccugacguuaaaccucaucaccgagaugggccgccugccgacauucaugacucaaaaggcccgcaacgcccuggacaaccuggcaguauuacacacggccgaggccggcgggagggccuauaaccacgcccugagcgaguuacccgagacccuggaaacucugcuccugcuaacccuacuggccacgguaaccggugggaucuuccuguuccugauguccggcaagggaaucggcaagaugacucuggggaugugcugcaucaucacagcaagcauucuacucugguaugcccagauccagccgcauuggaucgcggcuucuaucauccuggaguucuuuuugauuguccuccuuauucccgaaccugaaaaacaacggacaccccaggacaaccagcugacuuacguggucaucgcuauccucacaguaguggccgcaacuauggccaaugaaaugggguuccuggagaagacuaaaaaggacuugggccucgggucaaucacgacucaggagagcgaaucuaacauacucgacauugaccugcgcccagccucggccuggacccucuacgccguggcgaccaccuuuguaacuccaauguugcggcacuccaucgagaacagcucggugaacgugagccugaccgccauagccaaucaggcuacuguccucauggggcugggaaagggguggccccuguccaaaauggauaucggcgucccgcucuuagccauugggugcuacagucaggugaaccccaucacgcugacagccgcccuucuacugcucgucgcacauuacgccauuaucggcccuggauuacaggcgaaggcaacccgagaggcucagaaaagagccgccgcaggcaucaugaaaaacccgaccguggaugggauaacggucaucgaccuggagccuaucccuuacgacccuaaguucgagaagcaacucggccaagugaugcugcugauauugugugucacacagguacugaugaugaggaccacaugggcccugugcgaggcccucacucuggcuacgggccccaucuccacgcucugggagggcaaucccggccgguucuggaacaccacgaucgccgucagcauggcgaauaucuuccgcggcucuuaucucgccggggcuggcuuacucuucagcaucaugaagaacaccaccaacacgcgucgggggacgggcaacaucggggagacccucggcgagaaguggaagucccgccugaacgcgcucggcaagucagaauuccagaucuacaaaaaguccgggauccaagaaguagaccggacccucgcgaaggaggguaucaaacggggggagacugaucaucacgcggugagccgcggcuccgccaaauuacgcugguucgucgagcggaacaugguaacgccagaagggaaaguggucgauuuggggugcggcagaggcggauggagcuacuauugugggggccuuaaggacguacgggaagugaaggggcugacgaagggcggcccgggucaugaggaacccauaccgaugagcaccuauggauggaaucugguccgccuccaauccgggauugauguguucuuuaccccucccgagaagugugacacgcugcugugcgauauaggcgaaagcucacccaauccuacuaucgaagcaggaagaacccucagggugcugaaccuggucgagaacuggcucaacaauaauacacaguucugcauuaaggugcugaacccguauaugcccagcgugaucgagaagauggagaccuuacagagaaaguacggaggcgcgcucguacguaauccguuaucucggaacucgacgcacgagauguacugggucucaaacgcgaccgguaacauaguuagcucugucaacaugauaagccgcaugcucaucaaccgguuuaccaugaaacacaagaaggccaccuacgagccggacguggaccuaggcuccggaacucgaaacaucgggaucgagucugagauaccuaaucuggacaucaucgggaagcgaaucgagaagauuaagcgcgagcaugagaccuccuggcauuaugaucaggaccacccguauaagaccugggccuaccacggcucuuaugaaaccaagcaaacgggcuccgcgaguucgauggucaauggggucgugcgccugcucacuaagcccugggacguggucccaauggugacccagauggcaaugaccgacacgaccccguucggccagcaacguguguuuaaagagaagguagacacccgcacccaggagcccaaagaggggacgaagaagcucaugaagauaaccgcggaaugguuguggaaggagcucggcaagaagaaaaccccuaggaugugcacccgugaggaguucacgcggaaggugaggucuaacgccgcccucggggcuaucuucaccgaugagaauaaguggaagagcgcccgcgaggcgguggaagacgggcgcuucugggagcuggucgaccgggagagaaaccuacaccucgagggcaagugcgagaccugcguguacaacaugaugggcaagcgggagaaaaagcugggcgaguucgggaaagccaagggcucucgcgccauuugguacauguggcugggcgcgcgcuuccuagaguucgaagcguuaggauuccugaacgaggaucacugguuuagucgcggaaauagccucagcgggguggagggcgagggauuacacaggcugggcuauauucuccgcgacguaggaaagaaggaggggggcgccauguacgcggacgacacggcuggcugggauacgcggaucacccuggaggauuugaaaaacgaggagauggugacaaaccacaugaagggcgagcacaagaaauuggccgaagccauauuuaagcugaccuaccaaaacaaggugguacgcguucagaggccuacgccacgcgggacagugauggauauaaucagccggcgcgaucagcggggcuccggucaggugggcacauacggccugaacacuuucacgaacauggaagcccagcucaucaggcagauggagggggagggaauauucaaaucgauccagcaucugacugccacugaggaaaucgccgugcagaauugguuagccagggucggcagagagcgccucagccggauggcgaucaguggggacgacugcguggugaagcccaucgacgaccgcuucgccucugcucuuaccgcucucaacgacauggguaagguccguaaggacauccagcaaugggagcccagccgcggguggaaugacuggacccaggugccuuucugcagccaucauuuccacgagcucgugaugaaggacggucggguccugguggugccgugccguaaccaagacgaauugaucggacgggcccgcauaucccagggggcaggcuggagccuaaaagagacggcuugccuggggaaauccuacgcccagauguggacucucauguacuuucaucggagggaccuccgucucgcugccaacgcgaucugcucagcggucccuagucacugggugcccacuagccggaccacaugguccauacaugccaagcacgaguggaugacuacagaggacaugcuggccguguggaaccgggucuggauucaggagaaccccuggauggaggacaaaacccccgucgaaucgugggaggagguacccuaccuaggcaagcgcgaggaucaguggugcgguagccugaucggccuaacuucccgggcgaccugggccaaaaauauccagacggcgaucaaccagguccggagccucauugggaacgaggaguacacagacuacaugccuagcaugaaacgcuucagaaaggaagaggaggaggcaggcgugcugugguga

SEQ ID NO: 24997 - RNA, 9876 nt, Artificial Sequence
  derived and/or modified CDS sequence (opt11) from DENV-2__GU131959__SS-prME
accgcgggcgugaucgucaugcugaucccgaccgugauggccuuccaucucaccacucggaacggggaaccacacaugaucgugggccggcaggagaagggcaaaucacugcuguucaagaccgaggacggcgucaacaugugcacccucauggcgauugaccuaggggagcugugcgaggacaccaucaccuacaaaugcccgcuccuacgccagaacgagcccgaggacaucgacugcuggugcaacagcacguccaccugggugaccuacgggaccugcuccaccaccggcgaacaccggcgcgagaagcggagcguggcccuggucccccacguggggaugggccucgaaaccagaaccgagaccuggauguccagcgagggcgccuggaagcacgugcagagaaucgagaccuggauucuacgccauccgggcuucacgaucauggccgccauccuggcguacacaaucgggaccacccacuuucagcgggcgcucauauucauccugcugacggcugucgcccccuccaugaccaugcggugcaucggcaucagcaaccgggacuucguggagggcguguccggcggcucgugggucgacaucguccucgagcacggauccugcgugaccaccauggcgaaaaacaaaccaacauuggacuucgagcugaucaaaaccgaagccaaacagcccgccacccuccgcaaauauugcaucgaagccaagcugaccaacacgaccaccgagagccguugcccgacucaaggcgagccgucccugaacgaagagcaggacaagcgcuuuaucugcaagcauagcauggucgaccggggguggggcaacggcugugggcuguucggcaagggagggaucgugacgugcgcuauguuuacgugcaagaagaauauggaagguaaggugguacagcccgagaaccuggaguacacaaucgugauuacgccccacuccggggaggagcacgcugugggcaacgacacagggaagcacgggaaggagaucaagauuaccccgcagagcucuauaaccgaagccgagcugaccggguacgggaccgucacgauggaguguucuccccgcaccggccucgacuucaacgagauggugcugcugcaaauggaggacaaggccuggcucgugcaucggcagugguuccuggaccugccccucccguggcugccgggugccgacacccaggguuccaacuggauccagaaggagacucuggucacguucaagaauccccacgccaaaaagcaggacguagucgugcucgggucacaggagggcgcuaugcacaccgcccugaccggggcaaccgagauccagaugagcucuggcaaccuccuguucacgggccaccucaagugccgcuuacgaauggauaagcuccagcugaagggcaugucguacuccaugugcaccggaaaguucaagaucgugaaggagaucgccgaaacacagcaugggaccaucgucauccgcgugcaguacgagggagacggcagcccuuguaagauccccuucgagauuacggaucuggaaaagcggcacgugcucggucggcugaucacaguuaacccgaucgucaccgaaaaggacucccccgugaacaucgaggcggagccgcccuucggugacagcuacaucaucaucggcgucgagccgggccaacugaagcucaacugguucaagaagggguccagcaucggccagauguucgagaccacaaugcggggcgcgaagcggauggccauccugggggacaccgccugggacuucggcucucucggugggguguucaccagcaucgggaaggcccuccaccaaguguucggggcgauauacggagccgccuucuccggcgucagcuggaccaugaagauauuaaucggcgugaucaucaccuggauuggaaugaacacccgcuccaccucacuuuccguaucucugguacucgugggcgugguuacccuguaccugggggccauggugcaagccgacuccggaugcguggucagcuggaagaacaaggagcucaagugcggcagugggaucuucauuacggacaacgugcacaccuggaccgagcaguacaaguuccagccggaaagcccuagcaagcuugcgagugccauacagaaagcccaugaggagggcauuugcgggauccggagcgugacccggcucgaaaaccucauguggaagcaaaucacgccugaacugaaucacauucuauccgagaacgaggucaagcucaccaucaugacgggcgacauaaaggggaucaugcaggccggcaagcggagccugagaccgcagcccaccgagcucaaguauuccuggaagacguggggcaaggccaagaugcuuagcaccgagucccacaaccagaccuuccuaaucgaugggcccgagaccgcggagugcccuaacacgaaccgggccuggaacagccuggaaguggaggacuacggcuuugggguguuuaccaccaacaucuggcucaagcuccgcgagaagcaggacgucuuuugcgacuccaagcugaugagugcggccaucaaggacaaccgggccgugcaugcggacaugggauauuggaucgaguccgcccucaacgagaccuggaagauggagaaggccagcuucauugaagugaaguccugcuacuggccuaagucgcacacccugugguccaacggcguccuggaguccgaaaugaucauccccaagaacuucgccgggccugugucccagcacaacuaucgcccuggcuaccacacgcagaccgccgggcccuggcaccuaggaaaguuggagauggacuucgaccugugcgaggggaccaccguggucguaacggaggacugugguaacaggggccccagccuccgcaccaccacugcgagcgggaagcugaucacggaguggugcugccgcucuuguacccugcccccguugcgcuaccggggggaggaugggugcugguacggcauggagauucgcccccugaaggaaaaggaggagaaucuggucaacagccucgucaccgccgggcacggccagaucgauaacuucucccugggcgugcuggggauggcuuuauuccuggaggagaugcugaggacccgcaucggcacgaagcacgccaucuugcugguggcagcuagcuucgucacccugauuaccgguaacauguccuuccgggaccucggcagagugauggugauggucggggccaccaugacggaugacaucggcaugggcgugaccuaccuagcauuacucgccgcguucaaagugcgccccacuuucgccgccgggcugcugcuccgcaagcugacgagcaaggaguugaugauggcaacgaucggcaucgccuuacugucacagagcaccauccccgagaccauccuagaguugacggacgcgcuggcucuggggaugaugguccucaagaucgugaggaacauggagaaguaccagcuggcggugacgaucauggccaucuccugugucccgaacgcgguaauccugcagaacgcguggaagguuagcuguaccaucuuggcagcagucucagugagcccccuguugcucacauccucgcagcagaaggccgauuggauacccuuggcucugacuaucaagggccucaacccaacggccauuuuccugaccacccugucccggaccagcaagaagcgcuccuggccccucaacgaggccgucauggccgugggcauggugagcauccuggccuccagccugcucaagaacgauauccccaugaccgggccccuggucgcgggcgggcugcugaccgugugcuaugugcuuaccggccggagcgccgaucuggagcucgaacgcgcagcugaugucaagugggaggaccaggccgagaucagugggaguucccccauccuaaguaucaccaucuccgaggacggcucuauguccaucaagaacgaagaagaggagcagacguuaaccauccucauccggaccggcuuacuggugaucuccgggguguuucccgucuccauccccaucaccgcagccgcaugguaucucugggaggugaagaagcagcgugccggcguucugugggacgucccaagcccgccgcccguggagaaagccgagcuggaggacggggcguaccggaucaagcagcguggcauacucgguuacucccagaucggcgccgggguuuauaaggaggggaccuuucacacaauguggcacgucacacggggcgccguuuuaaugcaucgcgggaagcggaucgagcccagcugggccgacgugaagaaggaccugaucucguauggcgggggcuggaagcucgaaggggaguggaaggagggggaggagguccaggugcuagcccuggagcccggcaagaacccgcgcgcggugcaaaccaaaccagguaucuuuaaaaccaacacgggaaccaucggggccgucagucucgacuucucccccggcaccagcggcucccccaucgucgaccggaaggggaaagugguaggccuguauggaaacggcgucguuacccgcagcggcgcuuacguauccgcaauugcucagacggagaaauccauugaggauaaccccgaaauugaagacgacauuuuccgaaagaaacgucucaccaucauggaccuccaccccggggccggcaagaccaagcgguaccugccggccaucguacgcgaggccaucaagcggggauugcgcacccugaucuuagcccccacgcgcguggucgcggccgagauggaggaggccuugcgaggccuccccauccgcuaccagacccccgccaucaagaccgagcacaccgggagagagaucguugaccucaugugccacgccacguucacaaugcggcugcugagccccgugcggguuccgaacuauaaccucaucaucauggacgaagcgcacuucaccgaccccgccucuaucgcggcccgcggcuacaucaguacucggguggagaugggcgaggcagcggggaucuuuaugacagccacgccgcccggcucccgcgauccguucccccagagcaacgcccccaucauggacgaggagagggagauccccgagcgcucauggaacagcggccacgagugggugaccgacuucaaggggaagacgguaugguuugugccuuccaucaaggccgggaacgacaucgcggccugccuacggaagaacggcaagaaggugauccagcugucacgcaagacguucgacuccgaguacgucaagacccgggccaacgacugggacuuugugguaaccaccgauauaucagagaugggcgccaacuucaaagccgagcgcguuaucgacccacggcggugcaugaagcccgugauccucacggacggggaggaacgggucauccuggcuggccccaugccggucacccacuccagcgccgcccagcgccggggccgcaucggccgcaacccaaagaaugagaacgaccaguacaucuacaugggggagccucuagaaaaugacgaagacugcgcccacuggaaggaggcuaagaugcuccuggacaauaucaacacccccgaaggcauuauaccuucuauguucgagcccgaacgggagaagguggaugcgauugauggugaguacagacugcgcggggaggcccggaagacguucguggacuuaaugcgccgaggcgaccuccccgucuggcucgcauacaagguggccgccgaggggaucaauuaugcggaccggaaguggugcuucgacggcaucaagaacaaccagauccucgaggagaacauggagguggagaucuggacgaaggagggggagaggaagaaacugaagccccgguggcuugacgcccgcaucuacagcgacccccucgcccuuaaggaauucaaggaauucgccgcgggacggaagucauuaacccucaacuuaaucaccgagaugggccgccugccaaccuucaugacgcagaaggcacggaacgcccuugacaaccuggcaguacugcacaccgcagaggccggcgggcgcgcguacaaccacgcccucagcgagcugcccgagacccuugagacacuccugcugcucacguuacuggccaccgugaccggcggcaucuuccuauuccugauguccgggaaggggauaggcaagaugacccugggaaugugcuguaucaucaccgccagcauccuccugugguaugcgcagauccagccgcacuggauagccgcuuccauuauccuggaguucuuccucauuguccugcugauccccgaacccgagaagcagcgaaccccccaggacaaccaguuaaccuacguggugaucgccauucugaccgucguagccgcgacaauggccaacgagaugggcuuccuggagaagacgaagaaggaucucggguuaggcuccauuacaacccaagaguccgaauccaauaucuuagacauagaccuccgcccagccagcgccuggacgcuguacgccguagcgacgaccuucgucaccccuaugcugcggcacuccaucgagaauagcuccgugaacgugagccucaccgccaucgccaaccaggccacaguccuaaugggccuggggaagggcuggccccucagcaaaauggacaucgggguacccuugcuggccauugguuguuacucacaggucaacccaaucacccucacagcggcccugcugcuccuggucgcucacuaugccaucaucggacccggccugcaggcaaaggccaccagagaggcacagaagcgagcggccgcgggcaucaugaagaaucccacgguggacgggaucacggucaucgaccucgagcccaucccguaugaccccaaguucgagaagcagcugggccaggucaugcugcucauccugugcgugacccagguccugaugaugcgcacgacuugggcccucugcgaggcccugacccuggccaccgggcccaucucgacccucugggaaggcaaucccgggcgguucuggaacacgaccaucgccgucagcauggcgaacaucuuccgcgguucguacuuggcuggcgccgggcuacuguucagcaucaugaagaauaccacaaacacgcgccggggcaccgggaauaucggcgagaccuuaggugagaaguggaaauccagacugaacgccuugggcaaaagcgaauuucagaucuacaagaaguccgguauccaggaaguugacagaacccuggccaaggaggggaucaagcgcggugagacggaucaucaugcgguaagccggggguccgccaagcugcgcugguucguggaacgaaacauggugaccccggagggcaagguagucgaucucggcugcgggcguggcggguggucguacuauugcgggggacucaaggacgugcgggaggugaagggccugaccaagggcgggcccggccaugaggagcccauccccauguccaccuacggguggaaccucgugcgccugcagagcgguauagacguguucuuuacgccgcccgagaaaugcgacacccuccugugugacaucggggagucgucccccaauccaaccaucgaggcugguaggacgcugcgcgugcugaaccucgucgagaauuggcugaauaacaacacccaguucugcauuaaggugcucaacccguacaugcccagcgugaucgagaagauggagacgcuccagaggaaguacggaggugcccugguccgcaacccccugucccgcaauagcacccacgaaauguacuggguauccaaugcgacggggaacauagugagcuccgucaacaugaucagccgcauguuaaucaacagauucacuaugaagcauaaaaaggccacguacgagccggacguggaccucgguaguggcacccgcaacauuggcaucgagucggagauccccaaccuugacaucaucggcaagcgaaucgaaaagaucaagcaggaacaugagaccucauggcacuacgaccaggaccaccccuacaagaccugggccuaucacggcagcuacgaaacgaagcagacgggguccgccagcuccauggugaacggcgugguccgccuacucacaaagcccugggacguggucccaauggugacccagauggcgaugacggacaccacccccuucgggcaacaacgcguguucaaggaaaaggucgacacgcggacgcaggagccaaaggagggcacaaagaagcucaugaagaucaccgcggaguggcuguggaaggaacucggaaagaagaagacgccaagaauguguacgagggaggaguuuacccgcaaagugcggagcaaugccgcccugggggccaucuucaccgacgaaaacaaguggaaaagugcacgcgaggcggucgaggacggcagguucugggagcuggucgaccgcgaacggaaccuacaucuggagggcaagugugaaaccugcguguauaacaugaugggcaagcgcgagaagaagcugggggaguucggcaaggccaagggcagccgggccaucugguacauguggcucggggcacgcuuucuggaguucgaggcgcugggauuccucaacgaggaccauugguucagucgggggaacagccugucuggcgucgagggggagggucugcaccgccucggcuacauccugagggacgugggaaagaaggagggcggggccauguaugccgacgacacagcaggcugggacacacgcaucacccuggaggaccuuaagaacgaagagauggugaccaaccacaugaagggggaacacaaaaagcuggccgaggcgaucuuuaagcuuacauaccagaacaaggucgugcgggugcagcguccgacgccccggggcaccgucauggacauaauaagccgccgggaccaacgcggcagcggccagguaggcacuuacggucucaacacuuucaccaacauggaggcccaacugauccgacagauggagggcgagggcaucuuuaagucaauucaacaccuaacggccaccgaggagaucgccguucagaacuggcucgcccgggucgggcgcgagcggcuaagccgcauggcgauuuccggcgacgacuguguggugaagcccauagacgaucgguucgccucggcccugacggcccucaacgacauggggaaaguccgcaaggacauccagcagugggagcccucccguggcuggaacgacuggacacaggugccauucugcagucaccacuuccacgagcuagugaugaaggacggucgcguucugguggugcccugucgaaaccaggacgagcucaucggccgcgcccgaaucucgcagggcgcgggguggagccugaaggagacagccuguuuggguaaguccuacgcccagauguggacccuaauguacuuccaccgccgggacuugcgccuggccgccaacgcgaucugcagcgccguacccucccauugggugcccaccagccggacgaccugguccauacacgccaagcacgaguggaugaccaccgaggacaugcuugccguguggaaucgcgucuggauccaggagaacccguggauggaggacaagacgccgguugaaucgugggaggagguuccauaccuugggaagcgcgaggaccaauggugcggcucccugaucgggcucaccagccgggcgaccugggccaagaacauccagaccgcgaucaaccaggucagaagccugaucggaaacgaggaguacacggacuacaugcccagcaugaagcgauuccgcaaggaggaagaggaggccggcguacugugguga

SEQ ID NO: 24998 - RNA, 9876 nt, Artificial Sequence
  derived and/or modified CDS sequence (opt11) from DENV-2__GQ868515__SS-prME
accgcgggagugauagucauguuaauucccaccgugauggcauuccaucugaccaccagaaacggggaaccucacaugaucgucggccggcaggaaaaggggaagucccugcuguuuaagaccgaagacgguguuaacaugugcacccucauggcgaucgauuugggggaacugugcgaagacaccaucaccuacaagugcccccuccugcgccaaaacgagcccgaggacauagacugcuggugcaacagcaccagcaccuggauuaccuacgggaccuguuccaccaccggcgagcaucgccgcgagaagcggucagucgcccuggugccccaugucgggaugggacucgagacccgcacagaaaccuggaugagcagcgagggggccuggaagcacgugcaacggaucgagaccuggauacuccgccauccgggcuuuacaaucauggccgcgauccuggcguacacuaucgggaccacccauuuccagcgggcccucauuuuuauccugcugacggcaguggccccaucuaugaccaugcgcugcauaggcaucucgaaucgggacuuugucgagggcgucagcgggggcuccuggguggacaucguccuugagcacggguccugcgugaccaccauggcgaagaacaaacccacccuggacuucgaauugauuaagaccgaggcgaagcaacccgccacccuccgcaaauacugcaucgaggcuaagcugacuaacacgacgacugaaucccggugcccgacgcagggagagcccucccugaacgaagaacaggacaagcgguucauuugcaagcacagcaugguggaccggggcugggggaacggcugcgggcuguucggcaagggcgguauugucacgugcgcuauguucacgugcaagaagaacauggagggcaagguggugcagcccgagaaccucgaguacaccaucgucaucacgccccacuccggcgaggaacacgcggucggcaaugacacugggaagcauggcaaagagaucaaaaucaccccgcagagcuccaucaccgaggccgaacugacgggguacggaaccgugacgauggaguguagcccccguacuggccucgacuucaacgagaugguguuguuacaaauggaggacaaggccuggcucguacaccgacaaugguuccuggaccugccccucccuuggcugccgggcgcagacacccagggcuccaacuggauccagaaggagacucuuguaacguucaaaaauccccacgccaaaaagcaggaugucgugguccugggaagccaggagggugcgaugcauaccgcccucaccggggccacagagauacagaugagcuccggcaacuuacuguucacuggucaucugaaaugccgccugcgaauggacaaacugcagcugaaggggaugagcuacucgaugugcaccggcaaguucaagaucgugaaggagaucgccgaaacccagcaugggaccaucgugauacgcgugcgguacgagggcgacgguucucccuguaagauccccuucgagaucacggauuccgagaagcgccacguucuugggcgcuuaaucaccgugaacccgauagugacagaaaaagauucccccguuaacaucgaggccgaaccacccuucggcgacuccuacaucaucaucggaguggagccaggccagcugaaguuaaauugguucaagaaggggagcuccaucggucaaauguuugaaacgacgaugcggggcgcgaagcgcauggcuauucucggggacacggccugggacuuuggcagccucgggggcguguucaccuccaucgggaaggcccugcaccagguguucggcgccauuuacggcgcugccuucagcggggucucuuggacuaugaagauccucaucggcguaaucaucacguggauagggaugaacucaagaucuaccagccuguccgucucgcuuguauuggucggcguggugauacucuaccugggagcaaugguccaggccgacuccggcuguguggugagcuggaagaacaaggagcuuaagugcggcagcggcaucuucauuacagacaacguccauaccuggacggagcaguacaaauuccagcccgagucccccagcaagcucgcuuccgccauccagaaggcccacgaagagggcaucugcgggauccgcucgguaacgcggcuggagaaccugauguggaagcaaaucacccccgaacucaaccacauccuguccgagaaugagguaaaacugacgaucaugacgggggacaucaaggggauuaugcaggccggcaagcgcagccuccggccgcagcccacugagcugaaguauuccuggaagacguggggcaaggccaagaugcugagcaccgagucucacaaccaaacguuccucaucgacgggcccgagaccgcggagugcccgaacaccaaucgcgccuggaauaguuuggaggucgaagacuacgguuucggaguguucacgacgaacaucuggcugaaguugcgcgagaagcaggacguguuuugugauuccaagcucauguccgccgccauaaaggacaauagggccguccacgcagacaugggauacuggaucgaguccgcccugaacgacaccuggaagauggagaaggccagcuucauagagguuaaauccugccacuggcccaagagucacacccucugguccaacgggguacuggagucugagaugaucauccccaagaacuucgcaggaccagucagccagcacaacuaucggccgggcuaccacacccagaccgcgggacccuggcaccugggcaagcucgagauggacuucgaccugugcgaggggacaaccgugguugucaccgaggacuguggcaaccgcggcccuagucuucggaccacaacagccagcggaaagcuaaucaccgaguggugcugcagaucuugcacccugccgccgcuucgguacaggggcgaagacgggugcugguacgggauggagauccggccucucaaggagaaggaggagaacuuggugaacagccuggucacggcggggcacgggcagaucgauaacuucucuuugggcgugcuggggauggcccuguucuuggaggaaauguuacgcacgaggaucggcaccaagcacgccauccugcucguggcggccucauucgugacccuuaucacugguaauaugucauuccgcgaccugggccgcgugauggugauggugggggcaaccaugaccgaugacaucggcaugggugucacguacuuagcccuguuagcagcguucaaagugcggcccacguuugcggccggacuccuccugcgcaagcucaccagcaaggaguuaaugauggccacaauuggcaucgcccuucucucccagagcaccauccccgagucaauccuagagcugaccgacgcccucgcgcuagggaugauggugcugaagauaguccgaaacauggagaaguaucaguuggccgugaccaucauggccauaagcugcguuccgaacgcagucaucuugcagaacgcguggaaaguguccugcacgauccuggccgcagugagcguaagccccuugcugcuuaccagcagccagcagaaggccgacuggauaccccucgcacugaccaucaagggucugaaccccaccgccaucuucuugaccacacugagccgcacgaguaagaagcgaagcuggccguuaaacgaagccgugauggccguuggcaugguuaguauccuggccucauccuuacugaaaaacgauaucccuaugacugggccgcucguggcaggcgggcugcugacaguaugcuacguacucaccggccgauccgcagaccuagagcuggagcgggcggccgacguaaagugggaggaccaggcagagaucucggggagcagccccauacugaguauuacuaucagcgaggacggcuccaugucgaucaagaaugaggaggaggaacagacccuuacuauccuaauccgcaccggcuugcuggucauuagcggugucuucccggugagcaucccgaucacggcggcggccugguaccugugggaggucaagaagcagagagccggcguacucugggacgugcccagucccccgcccgucgagaaggccgagcuggaggacggggcguacagaauaaagcagcggggcauucugggguacagccagauaggcgccggcguguacaaggaggggaccuuccauacuauguggcacgugacacgcggcgcgguccucaugcaccgggggaagcgcaucgagcccuccugggccgacguaaagaaagaccugaucagcuauggcgggggcuggaagcuggagggugaguggaaggagggcgaggaagugcagguccucgcacuggagcccgggaagaacccccgagcggugcagaccaagcccgggaucuucaaaacaaacaccggcaccauaggggccgugucccuggauuucagcccgggcacuuccggcagccccaucgucgaucgcaaagggaagguaguuggccucuauggcaacggcgucgugacgcggagcggcgcuuaugucagcgcaaucgcacaaaccgaaaaguccaucgaggacaaccccgagaucgaagacgacauuuuccgcaaaaagcgucugaccauaauggaccugcaccccggagccggaaagaccaagcgcuaccucccugccaucguccgggaggccaucaagcgcgggcuucgcacgcugauacucgcaccgacgaggguugucgcggccgagauggaagaggcccuccgcggccugccuauccgguaucagaccccagcaaucaagacugagcacacgggucgcgagaucguugaccugaugugccaugccaccuucacaaugagacuccugucucccgugcgcgugccaaauuacaaccugaucauuauggacgaggcacacuucaccgacccggcgagcauugccgcacggggcuacaucucgacucgcguagagaugggcgaggccgcugggaucuucaugacagccaccccgcccggcagccgggauccguuuccccagucaaacgcacccaucauggacgaggagcgggaaauccccgagcggagcuggaacuccgggcaugaguggguaaccgacuucaagggcaagacggugugguucgucccgucuaucaaggccgguaacgacaucgcggccugucucaggaaaaauggcaagaaggugauucagcugagcaggaagaccuucgacagcgaguacgucaagacucgcgccaaugauugggacuuuguaguaaccaccgacaucuccgaaaugggcgcgaacuucaaggcugagcgugugaucgacccccgccggugcaugaaacccgucauccugacggacggcgaggagcgcgugauacucgcagggccaaugcccgugacccauagcagugcagcccagcgacgcgggcgaauuggccggaaccccaagaacgagaacgaccaauauaucuacaugggagagccccuagagaacgacgaggacugcgcccacuggaaggaggcgaagaugcugcuagacaacaucaacaccccugaaggcauuaucccaagcauguucgagcccgagcgcgagaaagucgacgccaucgacggugaguaccggcugagaggggaggcccggaaaacguucguggaccugaugcgccguggcgacuugcccguguggcuggcuuacaaggucgccgccgaggggaucaacuacgcggaccgcaaguggugcuucgauggcaucaaaaacaaccaaauccuggaggagaacauggagguggagaucuggaccaaggagggggagcggaagaagcucaagccgcgauggcuggacgcccggaucuacuccgaccccuuggcccucaaggaguucaaggaguucgcggcgggccgcaagagccugacccugaaccucauuaccgagaugggccggcugcccaccuucaugacccagaaggcacgcaacgcccuggacaacuuggcaguacugcacacagccgaggccggaggccgagccuacaaccacgcccugagugagcuccccgagacccuggagacgcugcuccuacugacccuccuggccaccgucaccggaggcaucuuccuguuccucaugucuggcaaggggaucggcaaaaugacgcugggaaugugcugcaucaucaccgcuagcauccugcucugguacgcccagauccaaccccacuggauugccgccuccaucauacuggaguucuuucugaucgugcuccugauccccgagccagaaaagcaaaggacaccccaagauaaucaacugaccuacgucgugaucgcuauccucaccguggucgcugcuacgauggccaacgagaugggcuuccuggagaagaccaagaaggaucuggggcucggcagcaucacuacucaagagucggaaagcaauauccuggacauagaucugcggccggcguccgccuggacgcuauaugccguugccaccaccuuugugacccccaugcugcgccacuccaucgagaacuccuccguaaacgugucccugaccgccaucgcgaaccaggccaccgugcucaugggccugggaaagggguggccccuuucuaaaauggacaucggggucccuuuacuggcgaucggcuguuacucccaggugaacccgaucacccugaccgcggccuuacugcugcucguggcccacuacgccaucaucgggccaggucugcaagccaaagccacgcgugaggcucagaagcgcgcugccgcgggcauuaugaagaacccgaccgucgacgggauaaccgugaucgacuuagagccuaucccguacgaccccaaauuugagaagcaacucggccaaguuaugcugcugauccugugcgucacccagguucugaugaugagaacgacaugggccuuaugcgaagccuuaacucuggccaccggcccgauauccacacugugggagggcaaccccggucgcuucuggaacaccaccaucgcuguguccauggccaacaucuuucguggcagcuaccuugccggagccgggcugcuguucagcaucaugaagaacaccacuaauacccggcgcgggaccgguaauaucggcgagacccucggcgagaaguggaagucccgguugaacgccuuagggaagucggaguuccagaucuacaagaagaguggcauccaagaggucgaccgcacuuuggcgaaagaggggaucaagcggggcgagacagaucaccacgccgucucacgcgggagcgcaaagcugcggugguucguggaacgcaacauggucacaccagaagguaaggugguggauuuagguuguggccgaggcggguggagcuacuacugcggcgggcucaaggacgucagagaggugaagggccugaccaagggcgggccagggcacgaggagcccauccccauguccacguacggauggaaccucguccggcuccagagcggcaucgaugucuucuucaccccgcccgagaagugcgacacccugcugugcgacaucggggaguccagccccaacccaaccauugaggccggaagaacgcuccgggugcugaaccugguggagaacuggcucaacaacaauacccaguuuugcaucaaaguucugaaccccuacaugcccuccgugaucgagaaaauggagacccugcagcgcaaguacggcggggcccuugugcggaacccuuuaagccggaacagcacgcacgaaauguacugggucagcaacgcgacggggaacaucguguccagcgugaacaugauaucccggaugcucauuaaccgcuucacgaugaagcacaagaaggccaccuacgagccggauguggaccuugggagcggcacucggaacauuggcaucgaauccgagauccccaacuuggacaucauaggcaaacgcauagagaaaauuaagcaggagcacgaaaccagcuggcacuacgaccaggaucaucccuacaagacaugggcguaccacggcuccuaugagacaaagcagaccggcagcgcuaguagcauggucaacggcguggugcgccugcuaacaaagcccugggacguggugccgauggucacacaaauggccaugaccgacaccacucccuucggccaacagcggguguuuaaggagaagguggacacccgcacccaagagcccaaggagggcaccaagaagcuaaugaagauuacggcggaguggcuguggaaggaauuaggaaagaagaaaacaccccggaugugcacccgcgaggaguucacccggaaaguccgcuccaacgccgcacucggggccaucuucaccgacgagaacaaguggaaguccgcacgggaggcgguggaagacgguagauucugggaguugguggaccgggagcgcaaccugcaccuggaagggaagugcgaaacgugcgucuacaauaugauggggaagcgggagaagaaguugggggaguucggcaaggccaagggcucccgugccaucugguacauguggcugggcgcccgguucuuggaguucgaggcucuuggcuuccugaacgaagaccauugguucucccgcgggaacagccucucgggcguggagggggagggacugcaccggcuuggcuacauucuccgcgacguggggaagaaggaggguggggccauguaugcagacgauaccgccggcugggacaccagaaucacccuugaggaccuaaagaacgaggaaauggucacaaaucacaugaaaggggagcacaagaaguuagccgaggcaaucuucaaguugaccuaucagaacaaggugguuagagugcagcgcccgacgccgcgcggcaccgugauggauauuaucagccggcgagaccagcgcggcuccgggcaggucggcacguacggccugaacaccuuuaccaauauggaggcgcagcuuauucggcagauggagggcgaagggauauucaagaacauacaacaccucaccgcuacggaagagaucgccguccaaaacuggcuggcccgugugggacgggagcgccucagccgaauggcgaucuccggcgacgauugcgucgugaagcccaucgacgacagauuugccagcgcccugaccgcgcuuaacgauaugggaaagguacggaaggacauucagcagugggaacccagccgcggcuggaaugacuggacccaggugccguucugcucucaccacuuccacgagcuagugaugaaggacgggcggguacuggucguaccaugccgcaaccaagacgagcuuaucggucgggcacgcaucucccagggcgcgggguggagccuuaaagagaccgcgugucuggggaaguccuacgcacaaauguggacguuaauguauuuccaccggcgcgaccucaggcuggccgccaacgcgaucugcagcgcugugcccucccacuggguccccaccagccgcaccacguggucgauccacgcgaagcacgaguggaugacuacagaagacaugcuggcgguauggaaccggguguggauccaggagaacccguggauggaggacaagacccccgucgagaguugggaggagguucccuaccucgggaagcgcgaagaccaguggugcgggagccugauuggucugaccucccgggcgaccugggccaaaaacauacagaccgccauaaaucagguucgcagccucaucggcaacgaggaguauaccgauuacaugccuuccaugaagcgcuuccggaaggaggaggaggaggccggcguccugugguga

SEQ ID NO: 24999 - RNA, 9876 nt, Artificial Sequence
  derived and/or modified CDS sequence (opt11) from DENV-2__GQ868516__SS-prME
accgcgggcgucaucgugaugcugauccccacggugauggccuuccacuugacgacacguaacggggagccacacaugaucgugggcagacaggagaagggcaagucccucuuguuuaagaccgaggauggcguuaauaugugcacccucauggccauagaccugggagagcugugugaagacacuaucaccuacaaaugcccccuauugcgccagaaugagccggaggacaucgacugcugguguaacaguacuagcaccuggauaaccuacgggaccugcucuacaaccggcgagcacagacgcgaaaagcggagcguggcccuggugccccacgucgggaugggacucgagacccgcaccgagaccuggauguccucugagggggccuggaaacacgugcagaggaucgagaccuggauccuacgccauccgggcuucaccaucauggccgcuauucuggcguacacgaucgggaccacccacuuccagcgggcacucaucuucauccuuuuaacugccguggcucccuccaugaccaugcgcugcaucggcaucagcaauagggacuucguggagggcgucucggguggcucaugggucgauaucguacucgagcacggguccugcgugaccacaauggcgaaaaacaagccuacucuagacuuugagcugaucaagaccgaggcuaagcagcccgcgacccuccggaaguacugcaucgaagccaagcugacaaacacgaccaccgagagccguugcccgacacagggcgagccuucccuuaacgaggagcaggacaagcgguuuaucugcaagcacagcaugguagaccgcggcugggguaauggcugugggcuguucggcaagggcgggaucgucacuugugcgauguucacguguaaaaaaaacauggaaggcaagguagugcaaccugagaacuuagaguacaccaucgucaucacgccccauucuggugaagagcaugcaguaggcaacgacacggggaagcacgggaaagaaaucaagaucacgccccagaguuccaucacagaggcagagcugaccggguacggaaccgugacgauggaaugcaguccccgcaccggacucgacuucaacgagaugguuuugcugcagauggaagacaaggccuggcucgugcaccggcagugguuccuggaccugccccuccccuggcuuccgggggccgacacccagggcuccaacuggauucagaaggaaacccuggugacguucaagaacccccaugccaagaaacaggaugucgugguccucggaagccaggagggcgcuaugcacaccgcccugaccggggccaccgagauccagaugagcagcggcaaucuccuguucacaggccaccucaagugcagacuucggauggauaaauugcagcugaaggggaugagcuauuccaugugcaccggcaaguucaagauugucaaggagauagccgagacccagcacgggacaaucguaauccgcguccaauacgagggugacggcucucccugcaagauccccuuugagaucacggaccuggagaagcgacauguauuagggaggcugaucaccgugaacccaauugugaccgagaaggauucgcccguaaacaucgaggccgagccucccuucggcgacagcuacaucaucaucggcguggagccgggccagcugaaacucaacugguucaagaaggggaguuccaucggccagauguucgaaaccaccaugcgcggcgcgaagcguauggcuauccugggggacaccgccugggacuucggaaguuugggaggugucuucaccucuaucgggaaggcccuccaccaggucuucggggccaucuauggcgcggcguuuucuggagugagcuggaccaugaaaauccugauaggcgucaucaucacguggauagggaugaacuccaggaguaccucccuuucugugucccugguacucgucggaguggugauccuuuaucugggggccaugguccaggccgacucaggcugcguugucuccuggaagaacaaagaauuaaagugcggcuccgggaucuucaucaccgacaacguacauacuuggacagagcaguacaaguuucagcccgagucccccuccaaacucgcgagcgcuauccagaaggcccacgaagaggguaucugcgggauccguucggugacccgauuggagaaccucauguggaagcagaucacccccgagcuuaaccacauacuuagugagaacgaagugaaauugaccaucaugacgggagauaucaaggggauaaugcaagccggcaaacggucuuuacgcccgcagcccaccgagcuuaaguacagcuggaagaccuggggcaaggccaagaugcuguccaccgagucacauaaucaaacguuccugauugaugggcccgagaccgcggagugcccuaauaccaaccgggcauggaacuccuuggaggucgaggauuacggcuucgggguguucaccacgaacaucugguugaagcugcgugagaagcaagacguguucugugacagcaagcugaugagugccgcgaucaaggauaaccgggcgguccacgcagacaugggcuacuggaucgagagcgcccucaaugacaccuggaagauggagaaagccuccuucauagagguaaagucgugccauuggcccaagucccacacccuguggagcaacggaguucuggaguccgaaaugaucauccccaagaacuucgcagggcccguuagccagcacaacuaccgcccgggauaccacacccagacagccggcccauggcaccucggcaagcuggaaauggauuucgaccuaugcgaaggcacuacaguaguggucacugaggacugcggaaaccgggguccgagccucaggaccacgaccgcgucggguaagcugaucaccgaguggugcugccggagcugcacccugcccccgcuccgcuaccguggcgaagacgggugcugguacggcauggagauccgcccacugaaggagaaagaggaaaaucuggugaacucucucgugacggccggccacggccagaucgacaacuucagccucggcguccuugggauggcgcucuuucuggaggagaugcugagaacccgcaucggcaccaaacacgccauccuccugguggcagcuuccuuugugacccugaucaccgggaacaugagcuuccgggaucuaggccgggucauggugauggugggggccacaaugacugacgauaucggcaugggcgugaccuaccuggccuuacucgcugcguuuaaagugcgcccuaccuuugcagccgguuugcuacuacggaaguuaaccaguaaggagcucaugauggccaccaucgguaucgcccuccugagccaauccaccaucccugaaucuauucuggagcucacagacgcucuggcccuggggaugauggugcuuaagaucguccguaauauggaaaaguaccaguuggccgugaccaucauggccauuucauguguaccgaaugccgucauccugcagaacgcuuggaaggugagcugcaccauucucgccgcagugagcgucucgccccugcuauugacaucaagccagcagaaggcggauuggaucccacuugcgcugacgaucaagggccugaacccaaccgccauuuuccugaccacccuaucccggacgucgaagaaacgcucauggccgcucaacgaggccguaauggcggucggcaugguuuccaucuuggcaagcucccugcucaaaaacgacauccccaugacgggcccccuggucgcgggcggguugcucacagucugcuacgugcugacaggccggagcgccgaccuggagcucgagcgcgcugccgaugugaagugggaggaccaagccgagaucuccgggagcucacccaucuugagcaucacaaucuccgaggacggcagcauguccauaaagaacgaagaggaggagcagaccuuaaccauccuuauccgcaccggccugcuggucauuuccggggucuuuccuguuucuaucccaaucacggcggccgcuugguaccucugggaggucaagaagcaacgcgccggcgugcugugggacgucccaucgccgccucccgucgagaaggccgaacuggaagauggggcguaccgaauaaagcagcgcggcaucuugggguauucccagaucggagccggcguguacaaggaagggaccuuccauacuauguggcacgugacccggggcgccguccugaugcacagagguaaaaggauagagcccuccugggccgacgugaagaaggaccugaucuccuacggcgggggcuggaaacuagagggagaguggaaggagggggaggaggugcaagugcuggcacuggaacccggcaagaacccccgcgcagugcaaaccaagcccgguaucuucaagacaaacacuggcacaaucggugccgugagucuggacuucuccccaggcaccagcggcagucccaucgucgaccgaaaaggaaagguggugggccuguauggcaacggcgucgugacccgcagcggugccuacgucagcgcgaucgcgcagacagagaaguccauagaggacaaccccgagauugaggacgauauuuuccgaaagaaacgccugaccaucauggaccuccaccccggggccggcaaaacgaaaagauaccugcccgccaucguccgugaggccaucaaacgcgggcuccgcacgcugauccucgccccgacccgcgugguugcugccgagauggaggaggccuugcggggccugccgaucagguaccagacccccgcuauaaagacagaacacacggggcgggagaucgucgaucucaugugccacgcgaccuucaccaugagacugcuuucuccggugagagucccgaacuacaaucucaucaucauggacgaggcgcacuucaccgaccccgccuccauagccgcacgcggcuacauaagcacccgagucgagaugggggaggccgcggggaucuucaugaccgccaccccgccaggcuccagagacccguucccacagagcaacgcccccaucauggacgaggagagagaaaucccagagagauccuggaacagcgggcacgagugggugacggacuucaagggcaagacggugugguuuguacccuccaucaaggccgggaaugauaucgcggccugccugcggaaaaacggcaagaaggugauccagcugagccgcaagaccuucgacagcgaguacgugaagacccgagcuaacgacugggacuuugucgugacgacggacaucucggagaugggcgccaacuucaaggcagagcgggugaucgacccgcggcgcugcaugaaacccgucauuuugaccgacggggaggaacgggucauccucgccggccccaugccggucacccacucaagcgccgcccagcgacgggggagaaucggucgaaauccaaagaacgaaaaugaccaguacauuuacaugggugagccgcuagagaacgacgaggacugcgcccacuggaaggaggccaaaaugcuccuggacaacauaaauacgccggaggggauuaucccguccauguucgaacccgagcgugaaaagguggacgcuaucgacggcgaguaccgcuugcguggggaggcacgcaagacguucguggaccucaugcggcgcggagaccugccagucuggcuagcguauaaggucgccgccgaagggauaaauuacgcggaccgcaaaugguguuucgacggcaucaaaaacaaccaaauccucgaggaaaacauggaaguggagauuuggacuaaggagggggaacgcaagaaguugaagccgcgguggcucgacgcucggaucuacagcgacccccucgcccuaaaggaguucaaggaguucgccgcaggcagaaagucccuuacccucaaccuaauuaccgagaugggacgccugcccacguucaugacgcagaaggcccggaacgcccucgacaacuuagccgucuuacauaccgcugaggcagggggccgcgcauacaaucaugcucucucagaacugcccgagacacuggagacgcuccugcugcucaccuuguuggcuaccgucaccgguggcaucuuccucuuccugauguccgggaaggggaucggcaagaugacgcuggggaugugcugcauaaucacggcgagcauauuauuaugguacgcgcagauacagccccacuggaucgcugccuccaucauccuggaauucuuccuaauuguucugcugauccccgaacccgaaaagcagcggacgccccaagacaaccagcucaccuacgucguuaucgccauccugacggugguggcagcuacgauggccaacgagaugggcuuccuagaaaaaaccaaaaaggaccuugggcuggguucuaucacuacccaggagagcgaguccaacauucuggacauugaccucaggccggcuucagccuggacucuguacgcuguggcaaccacuuucgugacccccaugcugcgucauaguauugaaaauucauccgucaacgugucacucacugcaauagccaaccaggcuacuguucugaugggccugggaaagggcuggccgcucucaaagauggacaucggggucccccuacuggcgaucggcugcuacagccaggugaacccgauaacccucacagccgcauuacugcuccuggucgcccacuacgcgaucaucggccccgguuugcaggccaaagcgacgcgugaagcccagaagcgggccgcagcaggcaucaugaaaaacccuacagucgacgggaucaccgucauagaccucgagcccaucccguacgacccgaaauucgagaaacagcugggccaggugaugcugcucauccuaugcgucacucagguacugaugaugcgaacgaccugggcccuaugcgaggcccugacauuagccaccggucccaucuccacgcucugggagggcaacccagggcguuuuuggaacaccacuauagccguuagcauggcgaauauauuccguggcuccuaccuggccggcgccgggcuccuguucagcaucaugaagaacaccacgaacacccgccgcggcaccgggaacaucggcgagacacugggcgaaaaauggaagagucgccugaacgcccucggaaagagcgaguuucagaucuacaaaaaguccgguauccaggagguugaucgcacucuagcuaaagaagggauuaagcgcggggaaacggaccaccacgccgugaguagaggauccgccaagcugcgcugguuuguggaacggaacauggucaccccggagggcaaggucguggaucuaggcugcgggcgcggcgguuggagcuauuauugcggcggguugaaggauguccgggaggugaagggccuaaccaaaggcggucccggccaugaggagccuauucccaugaguacguauggauggaacuuaguacggcugcagucgggcaucgacgucuucuuuaccccgccggagaagugcgauacccugcucugugauaucggagaaagcucccccaaucccaccaucgaggccggucguacgcugcggguucucaacuugguggaaaacuggcugaacaacaauacccaguucugcaucaagguccugaacccguacaugccuagcgugaucgagaagauggagacccuacagcggaaguacggcggggcgcugguccgcaacccucugucccguaacagcacccacgagauguacugggucuccaacgcgacagggaacauugugagcaguguaaacaugaucagccgcauguuaauuaaucgguuuacuaugaagcauaaaaaagcgaccuacgagccggacguagaccucggauccggcacuagaaauauugggaucgagagcgagauaccuaaccuagacauuaucggcaagcggaucgagaagaucaaacaggagcacgaaaccuccuggcauuacgaccaggaccaccccuacaagacgugggccuaccacggcagcuacgagaccaagcagaccgggucugccagcuccauggugaauggcgugguccgccugcugaccaagcccugggacguggugcccaugguaacgcaaauggcgaugaccgauaccacccccuucggacagcaaaggguauucaaagagaagguagauacucggacccaggagcccaaggagggcaccaagaaacugaugaagaucaccgcagagugguuauggaaagagcucggcaagaaaaagacgccccgcauguguacgcgggaggaguucacccgcaagguccggaguaacgccgcgcugggggccauauucaccgacgagaacaaguggaagucugcacgagaggcuguggaagacggccgguucugggagcuggucgauagggagcggaaucuacaucucgaggggaagugcgagacgugcgucuauaacaugaugggcaagcgcgagaagaagcugggggaguuugguaaagcgaagggcucuagagccaucugguacauguggcucggggcucguuuccuggaguuugaggcauuaggcuuccucaacgaggaccacugguucagccgugggaacucccugucgggcguggaaggggagggucugcaccgccucggcuacaucuugcgggacguggggaaaaaggaaggcggggccauguacgccgacgacaccgccggcugggacacccgcaucacccuggaggaccugaaaaacgaggaaauggucacgaaccacaugaagggggagcacaagaagcuggccgaggcgaucuuuaagcugaccuaccagaauaaggugguccgggugcaacgcccuacuccacggggcaccgugauggacaucaucuccagacgggaccagcggggcucgggucaagucggcacguacgggcuuaauaccuucaccaacauggaggcccaacugauccgccagauggagggcgagggcaucuucaagaauauucagcaccuuaccgccacggaggagaucgccgugcagaacuggcuggcacggguggggcgcgagcgucugucccgcauggcgauaagcggagacgacugcgucgugaagcccaucgaugacagguucgcaagcgcccugaccgcgcucaacgacaugggcaaggugcgcaaggacauccagcagugggagccgagccgaggcuggaacgacuggacgcaggucccguucugcucccaucacuuucacgaguuggugaugaaggaugggagaguucuugucgugccaugucggaaccaagacgaacucaucgggcgcgcccgcaucagccaaggcgcgggguggagccucaaggagaccgccugccuuggcaagagcuaugcccaaauguggacgcugauguauuuccacaggcgggaucuucgccuggcagccaacgcgaucugcagugccguaccgagucauugggucccgaccucccggacaaccuggagcauccacgcaaagcaugaguggaugaccacggaggacaugcucgccguguggaaccgcguguggauccaggaaaaccccuggauggaggacaagacccccgucgaguccugggaggaggugccuuaccuggggaagcgggaggaucaguggugcggaagccugaucggucucaccucacgcgcgaccugggccaaaaacauccagaccgccauuaaccaggugcggucccugauaggcaacgaggaguacaccgacuacaugcccaguaugaagcguuuccgcaaagaggaggaggaggccggcgucuuaugguga

SEQ ID NO: 25000 - RNA, 9876 nt, Artificial Sequence
  derived and/or modified CDS sequence (opt11) from DENV-2__GU131975__SS-prME
acagcgggagucaucgucaugcugauuccuaccgugauggccuuucacuuaaccacgcgaaacggggagccccacaugauugugggcaggcaggagaaaggcaagagccugcuuuuuaagaccgaggacggggucaacaugugcacccucauggcgaucgaucugggggagcugugcgaggacaccauuacguacaagugcccguuacugcgccagaacgagcccgaggacaucgacuguuggugcaauuccacuucuaccuggaucacauacgggaccuguuccacgaccggagagcaccgucgcgaaaagcgguccguggcacuggucccgcacguuggaaugggccucgagacccggaccgagaccuggauguccagcgagggcgccuggaagcauguacagcggauugagaccuggauccugcgccacccggguuucaccaucauggcggccauucuggcguauaccauugguaccacccacuuucagcgggcccuaauuuucaucuugcugacggccguugcgcccuccaugaccaugcgcugcaucgguaucaguaaccgggacuucgucgagggagucuccgggggcagcugggucgauaucguccucgagcacgguuccugcgugaccaccauggcaaaaaauaagcccacucuugacuucgagcugaucaagacggaggcgaagcaaccugcaacccuccgcaaguacugcaucgaagccaaacugacaaacacgacgaccgaaagcaggugcccgacccaaggugagcccucccuaaacgaggagcaggacaaacgguucaucugcaagcacuccaugguggaccgcggcugggggaacggcugcggguuauucggaaagggcgggaucguuacuugcgccauguuuaccugcaagaagaacauggagggcaaaguggugcagccggagaaccuggaauauaccaucgucaucacgccacacuccggggaggagcaugcggugggcaaugauacggggaagcacggcaaagagaucaagauaacgccgcaaagcuccaucaccgaggccgaguuaaccgguuacggcaccguuacgauggagugcagcccuagaacaggccucgacuucaacgaaaugguccuucugcaaauggaggacaaagcuuggcucgugcaucggcagugguucuuggacuugcccuuaccguggcugccuggggccgacacccaggguuccaacuggauccagaaggagacccucgugaccuuuaaaaacccacacgccaagaagcaagaugucgucguacucgggucgcaagagggcgcgaugcacaccgcccugaccggggccaccgagauccagaugucguccggcaaccuccuguucacgggccaccuaaagugucgacuuagaauggacaagcuccagcugaaagguaugagcuacagcaugugcaccggcaaauucaagauagugaaagaaaucgcggaaacgcaacaugggaccaucgugauccgcguccaguaugagggcgacgggagccccugcaagauccccuucgagauaaccgaucucgagaagcggcacguccuagggcgccugaucaccgucaacccgauuguuacggagaaggacuccccggugaacauagaggccgagccgccguuuggugacagcuacaucauuauugggguggaacccggccagcugaaacucaacugguucaagaagggguccuccaucggccagauguucgagacgacgaugcggggugcgaaaagaauggccauucugggggacaccgccugggauuucggcucccuaggcgggguguucaccagcaucggcaaggcgcuccaucagguguucggugccauauauggagcggccuucaguggugugaguuggaccaugaagauccuuaucggcgugauaaucacguggauugggaugaacucgcgcagcacauccuuaagcgugucccugguguuggucgguguggucauucuguacuugggggccaugguacaagccgauaguggcugcguaguuuccuggaagaacaaagagcucaaaugcggaucuggcauauucauuaccgacaacgugcauaccuggacggagcaguacaaguuucagcccgagucacccuccaagcuggcguccgcaauccagaaagcucacgaagaagggaucugcggaaucagaucggugacucgccuggagaaccucauguggaagcagaucacccccgaauugaaccacauccugucggagaacgagguuaaacuuaccauaaugacgggcgacauaaaggggaucaugcaggccggcaagagaucccugcggccgcagccaaccgagcuaaaauacucuuggaagaccuggggcaaggccaaaaugcucaguaccgaaagccauaaccagacguuccuuauagacggacccgagacugcggagugcccgaacaccaaccgugccuggaacucccuggaggucgaggacuacggcuucgggguauucaccacuaacaucugguugaagcugagggagaagcaggauguguucugugacuccaaguugaugucggccgccaucaaggacaaccgagccguccacgcggauaugggauacuggauugagagcgcacuaaaugacaccuggaagauggagaaagccucuuuuauagaggucaagagcugccacuggccuaagucccacacccuguggagcaauggcguguuagaaagcgagaugaucauccccaagaauuuugccggucccgugagccagcacaacuacaggccuggcuaccacacccagaccgcagggcccuggcaccucgggaagcuugagauggacuuugaccugugcgaggggacgacggucguggugaccgaggacugcggcaauagaggccccagccuaagaaccacgacugcgucugggaagcugaucacagaaugguguugccggagcuguacccugcccccucucagguaccguggggaggaugggugcugguacggcauggaaauccggccccugaaggagaaggaggagaaccuggugaacucccucguaacggcggggcauggccagaucgacaacuucagccuuggcguccuggggauggcccuauuccuugaagagaugcuuaggacccgcaucgggaccaagcacgccauucuccugguggcggccuccuucgugacuuuaaucacagggaacaugucguucagggaccucggucgagucauggugauggucggggcuaccaugaccgacgauaucggcaugggcgucacguacuuagccuuacucgcagcguucaaagugcgcccaaccuucgccgccgggcugcugcuccggaagcucaccagcaaggaacugaugauggccaccaucggcaucgcccuccuuagccaauccaccaucccggaaucgauccuggagcucacggacgcguuggcccuaggaaugauggugcucaagaucgugcgcaacauggagaaguaccagcuugcagugacuaucauggccauauccugcgugccgaacgccguaauucuucagaacgcguggaaggugagcuguaccaucuuagccgccguuuccgucagcccccugcuguugaccucuagccagcagaaggccgacuggaucccauuggcgcuaacaauaaagggccucaacccuaccgccaucuuccugaccacgcugagucggacgaguaaaaagcgcuccuggccccucaaugaggcagugauggcugucgggauggugucgaucuuggcuagcagccugcugaagaacgauauaccaaugaccgggccccugguagcgggagggcugcuuaccgucugcuacgugcuuacgggacggagcgccgaccuggaacucgagagggccgcugacgugaaaugggaggaccaggcggagaucuccgggagcuccccuauccugucgauuacaaucuccgaggauggaagcaugucaauaaagaaugaagaggaggagcagacccugacuaucuugauccgcacgggccugcuggugaucagcggaguauucccggucucaauacccaucaccgcggccgccugguaucucugggaggucaagaaacagagagcaggcgugcugugggacguacccagcccgccgcccgucgagaaggcggaacuggaggacggggcguaccggaucaagcagcgcggaauccucggguacucacagauuggcgcagggguuuacaaggagggaaccuuccacaccauguggcaugugacccggggugccgucuuaaugcaccgcgggaagcgaaucgagcccuccugggcugacgugaagaaagaucugaucuccuauggcgggggcuggaaacucgaaggcgaguggaaggagggggaggaagugcaggucuuggcacuggagcccggcaagaacccccgcgcggugcagacgaagcccgggaucuucaagacaaauacgggaaccaucggggccgugucucucgauuucucccccggcacuagcggauccccaaucguugaccggaaggggaaggucgugggccuguauggcaacggggucguaacgcgaagcggcgcuuacgugagugccauagcgcagaccgagaagagcaucgaggacaacccagagaucgaggacgacaucuuccggaagaagcgccugacaaucauggaccuucaccccggcgccgguaagacuaagcgguaccugccagccaucguccgcgaggcaaucaagcggggccuccgcacuuuaaucuuagccccgaccagggucguggcggccgaaauggaggaggcucugcggggccuucccaucagauaccagacccccgccaucaagacugagcauacggggcgggagauugucgaucucaugugccacgcaaccuucaccaugaggcugcugagcccgguucgggugccgaauuacaaucuuauaaucauggacgaggcucacuucaccgaccccgccuccaucgccgcacgcggguacaucagcacgcgugucgagaugggcgaggccgcggggaucuucaugaccgcuacgccgcccggcagucgcgacccauucccccagucaaaugcccccaucauggacgaagaacgggagauucccgagcgauccuggaacuccgggcacgaguggguaaccgacuucaaaggcaaaacggugugguucguuccgucaaucaaggcugggaaugacaucgcggcgugccugcggaagaaugggaagaaggugauacagcugagccguaagaccuucgacucagaguacgugaaaacuagggccaacgacugggacuucgucgucaccacggacaucucggagaugggcgccaacuucaaggccgaacgcgugaucgacccccggagaugcaugaagccggugauccucaccgacggggaggagcgggugaucuuagcgggcccuaugccggugacucacuccagcgcggcccagcgccgggggcgcauaggccguaaucccaagaacgagaaugaucaguacaucuacaugggggagccgcuggagaacgacgaggauugcgcccacuggaaggaagccaaaaugcuacuggauaauauuaacacccccgagggcaucaucccgucuauguucgagccugagagggagaaggucgaugcgauagauggcgaauacagacugaggggggaggcccgcaagacguuuguggaccuuaugcggcgcggggaccugcccguguggcuggcguauaagguugcagccgaggggauuaauuacgcggacaggaaguggugcuucgacggcauuaaaaacaaccagauuuuggaggagaacauggaaguggagaucuggacgaaggagggggagcgcaagaagcugaaaccgcgguggcuggacgcucgaaucuacagcgacccccuugcccugaaggaauucaaggaguucgccgccggcagaaagagccugacucucaaccugaucaccgagauggggaggcuucccacguucaugacccagaaagcgcggaacgcccuagacaaccuggccguucugcacacugcggaggcggggggacgcgccuauaaccacgcgcucucugaguuacccgaaacccuggagacacuccugcugcucacgcuguuagcgaccgugaccgggggcaucuuucucuuccugauguccggcaaagggauugggaagaugacgcuggggaugugcugcaucauuaccgcaagcauccuccugugguacgcgcaaauccagccgcacuggaucgcagcgagcaucauccuugaauucuuucucauagugcugcugauucccgagcccgagaagcagcggacgccccaggacaaccagcuaaccuacgucgugaucgcgauacucaccguggucgccgccacgauggcgaaugagaugggcuuccucgagaagacuaagaaggacuuagggcugggcucgaucacgacccaggagagcgaauccaacauacuggacaucgaccuucgcccggcaagcgccuggacucucuaugccguggcuaccaccuuugugacucccaugcugcggcacucuaucgaaaacagcagugucaacgugucguugacugccaucgccaaccaagccacuguguuaaugggcuuagggaagggcuggccccucucgaagauggacaucggugugccccugcuugcgauaggauguuacagccaggugaacccgaucacccugaccgcagcccugcuacuccugguggcgcauuaugccaucauagggccugggcugcaggcgaaggccacgcgcgaagcccagaaacgcgccgcagcggggaucaugaagaacccgacggucgacgggaucaccgugaucgaucuagagccuauccccuaugacccuaaguucgagaagcaacugggccaggugaugcugcucauccugugcguaacccaggugcuaaugaugcgcacgaccugggccuugugcgaggcccuaacguuggccacggggcccauauccacgcucugggaaggcaaccccggucgguucuggaacacuaccaucgccgugagcauggcgaacauauuucguggcucuuacuuagccggagccgggcuccuguucucgaucaugaagaacaccacaaacacccgccggggcaccgggaacaucggggagaccuugggcgagaaguggaagucccgccugaaugcacuaggcaagagcgaguuccaaauauacaagaaguccggcauucaggaagucgaccggacguuagcgaaggaggggaucaagcgcggcgagaccgaccaccacgccgugagccggggguccgccaagcuacgcugguucguugagaggaauauggucaccccggaagguaaggugguggaccucggcugugggcgcggcggguggucguacuacugcggcggccugaaggacguucgugaggugaagggauugacgaagggcggccccggccacgaggaacccaucccuaugagcacguacggcuggaaccucguccgccugcaguccggcaucgacgucuucuucacaccgccugaaaagugcgacacacuccucugcgacauuggcgagagcuccccgaacccaacuauagaggcaggccggacgcugcgcgugcuaaaccucguugagaacuggcugaauaacaauacccaguucugcaucaaaguccugaacccguacaugcccagcguuaucgaaaagauggaaacgcuacagagaaaguacggcggggcgcucgugcgcaacccucugucgcggaacucgacacacgaaauguacugggugagcaacgcgaccggcaauauagugagcuccguaaacaugaucagcaggaugcugaucaaccgguucacuaugaagcauaagaaggccaccuacgagccggacguagaccucgggucugggacccggaacaucgggaucgagagcgagauccccaaccucgacaucaucgguaaacguaucgaaaagaucaaacaagaacacgagaccuccuggcacuacgaccaagaccaccccuacaagacgugggccuaccacggcagcuacgagaccaagcagaccggguccgcgaguuccauggugaacggcgugguccgccugcucaccaagcccugggacguggugccuauggugacgcaaauggccaugaccgauaccacccccuucggccagcagcgcguauucaaagagaagguggauacccggacgcaggaaccuaaagagggcaccaagaagcucaugaagauuaccgcggaguggcuguggaaggagcucgggaagaagaagacgccgcgcauguguacccgugaggaauucacccgcaaggugagaagcaacgcggccuuaggcgcuaucuucaccgaugagaacaaguggaagagcgcucgcgaagcgguggaagauggacgguucugggagcugguggacagagagcgcagccuccacuuagaagggaagugcgagacgugcguuuacaauaugaugggcaaacgcgagaagaagcugggggaauucggcaaggccaaaggcagccgggcaauuugguauauguggcucggggcucgcuuccuggaguucgaggcgcuaggguuccucaacgaagaccauugguucucccgggggaacucgcuuuccggcguggaaggggagggccuacaucgccucggcuauauccugcgggauguugggaagaaggaagggggugcgauguacgcugacgacaccgcuggcugggacacccgcaucaccuuagaggaccucaaaaacgaggagaugguaaccaaccacaugaagggggaacacaagaagcuugccgaggccaucuucaagcucacuuaccagaauaagguggucagagugcagcgcccgacgccccgcggaacugugauggacauaaucagccgccgggaccagagaggcucugggcaggucggcacguacgggcucaacaccuucaccaacauggaggcccagcugauccgccagauggaaggcgagggcaucuuuaagaacauccagcaccuaaccgccacugaggagaucgccguacaaaacuggcuagcucgggucgggcgcgagagacugagcagaauggcgaucagcggagacgacugcgucgugaagccuauagacgacagguucgccagcgcacugaccgcccucaacgacauggggaaaguacggaaagacauccagcaaugggagcccucucggggcuggaacgacuggacccaggucccguucugcucucaccacuuccacgagcuggugaugaaggacgggcgcguucucgucguuccaugccguaaccaggacgaacucauuggcagggcacggaucagucagggcgcgggguggucucugaaggagacugccugccugggcaaguccuacgcccagauguggacgcugauguauuuccaucggagggaccugcggcuggccgcgaacgcgauuuguagcgccgugcccucccacuggguccccaccucaagaaccaccugguccauacaugccaagcacgaauggaugaccacggaggacaugcuggccguguggaaccgcguguggauccaagagaacccguggauggaagacaagaccccggucgagucuugggaggaggugccuuaccuggguaagcgggaggaccaguggugcggcucccucaucggccugaccucccgagccacuugggccaaaaacauacaaacagccaucaaccaggugcggagccugaucggcaacgaagaguacaccgauuacaugccaucuaugaaacgcuuuaggaaagaggaggaggaggcaggcguccucugguga

SEQ ID NO: 25001 - RNA, 9876 nt, Artificial Sequence
  derived and/or modified CDS sequence (opt11) from DENV-2__JN819422__SS-prME
accgcgggcguaaucgucaugcuuaucccaacugccauggcguuucaucucaccacccgcaacggggaaccccacaugaucgugggccggcaagagaagggaaagucauugcuuuucaagaccgaggacggcgugaacauguguacccucauggccaucgacuuaggcgaguugugugaagacaccaucacauacaaguguccgcuucuacgacaaaacgagcccgaggacauugacugcuggugcaacagcaccagcaccugggucaccuacggaaccuguaccacaaccggcgagcauagacgcgaaaagcggucugucgcccuggugccacacgucgguauggggcucgaaacucgaacugagaccuggaugaguuccgagggggcguggaagcauguucaacggauagaaacguggaucuugcgucacccgggcuucacaaucauggccgcuauccuggccuacaccaucgguacaacgcacuuccagaaggcguuaauauucauuuugcugacagccguggcgcccagcaugaccaugcgguguauaggcaucucgaaccgcgacuucgucgagggagucagcggaggguccuggguggacaucguccuggagcauggaagcugcguuaccacgauggccaagaauaaacccacccucgauuuugagcuuaucaagaccgaggccaagcagccugcgacccuccggaaguauugcaucgaggccaaauuaacgaauacuacuacagagucacgcugcccaacccagggggagcccagccugaaugaggagcaagacaaacgguuuauuuguaagcacuccaugguggauaggggcuggggaaacggcuguggguuauuugggaagggcgguaucgugaccugcgccauguuuacgugcaagaaaaacauggagggaaagguagugcagcccgagaaccuggaguacaccauaguuaucacaccccacagcggggaggagcaugccguuggcaaugauacggggaagcacgguaaggagauaaagauuacaccccagucgagcauaaccgaagccgagcugaccggguacgguacgguaaccauggaguguagcccccggacgggccuggauuucaacgaaaugguccugcugcaaauggaggacaaagccuggcuugugcauagacagugguuccuggaucucccccuccccuggcugccaggggccgauacucagggcaguaacuggauucaaaaggaaacgcuggucacguucaagaacccccacgcaaagaagcaggacgucguggucuuaggaucccaggaaggugccaugcacaccgcacugaccggugccacggagauccagaugucuagcggcaaucuccuguucacaggccaccuuaagugccggcugagaauggauaagcuccaguugaaagggauguccuauagcaugugcaccggcaaauucaaaaucgugaaagagaucgcggagacgcagcacgggacgauagucauccggguccaguacgagggcgauggcuccccgugcaagauuccguucgaaaucaccgacuuagagaagcgccauguuuuagggcgguuaaucacggugaacccaauagucaccgagaaagacagcccugucaacauugaggcggaacccccguucggagauaguuauaucauuaucggagucgaaccuggccagcugaagcucaauugguucaagaagggguccuccaucgggcagauguucgagacgacaaugcgcggcgcgaaacguauggcaauucuaggggacaccgccugggacuucggcagccucgggggcguauuuaccuccaucgggaaagcgcuacaucagguguuuggcgcgaucuacggagcagccuucucagggguauccuggacgaugaaaauccuaauuggcgucaucaucaccuggaucgguaugaauagucggagcaccagccuguccgugucguuagugcuugucgguguggugacuuuauaccugggggccaugguacaggcagacuccggcugcguggugagcuggaagaacaaggaacuuaaguguggcuccgggaucuucaucacggacaacguccacaccuggaccgaacaauacaaguuccagccugagucucccagcaagcuggccuccgcgauacagaaggcccacgaggaaggcauaugugggauacgcagcgucacacggcuggagaaccuaauguggaagcagaucacgcccgaauuaaaccauauccuaucugagaacgaggugaaacugacuaucaugaccggcgacauuaaggguaucaugcaggccggcaagcgcagccuucggccacaacccaccgagcugaaauacuccuggaagacuugggguaaggcgaagaugcucagcaccgagucccacaaccagaccuuucugaucgacggacccgagaccgcggagugcccgaacaccaaccgcgccuggaacagccuagaggucgaggacuacgguuucgggguguucacaaccaacaucuggcucaagcugagagagaagcaggacguguucugcgauuccaagcugaugagcgcggccaucaaagacaaccgugcgguccacgccgacaugggauacuggaucgaaucagcacugaacgacaccuggaaaauggaaaaagcgagcuucauagaggugaaguccugccacuggcccaagucacacacccuguggaguaauggcgugcucgaaagcgagaugauuauucccaagaacuucgccgggcccgucagccagcacaacuaccggccggguuaucacacgcagaccgcggggcccuggcaccucggcaagcuggagauggacuucgacuugugcgagggcaccacggucguagugacugaggacuguggcaaccgcggccccagccugagaacgaccaccgcaagcgggaagcugauuacagaguggugcugccgcuccugcacccugcccccgcuccgguaccgcggcgaggacggaugcugguacggcauggaaauucggccccugaaagagaaggaggagaaccuggugaacagccucguuacugcggggcacggccagaucgacaacuucuccuuggguguguuggguauggcacucuuccuggaggagaugcugcgaacucggaucggaacgaagcaugcuauucugcuagucgccgugagcuucguuacccugauaacggggaacaugagcuuccgcgaccucggcagggugauggugauggucggcgcgaccaugacggacgauaucggcaugggcgucaccuaccuggcucuacucgccgcguucaagguacguccgacuuucgcagccgggcuccugcugcgcaagcugaccucgaaggagcugaugauggcaaccauaggcaucgcgcucuugucgcagagcacaauccccgagaccauucuggagcucacggacgcucuggcucuggggaugaugguccucaaaaucguacgcaacauggagaaguaccaguuagcggugacgauuauggccaucucuugcgucccgaacgccgucauccugcaaaacgcuuggaaagugucuuguacaauccucgccgccgucuccgugagcccacugcuucucaccucaagccagcagaaagcugacuggauccccuuagcuuuaaccaucaagggcuugaaccccacggcgaucuuccuuaccacacugucccggaccagcaagaagagauccuggccguugaaugaagcaaucauggccgucggcauggugucuaucuuagccuccagccugcucaagaacgauauccccaugacggggccccugguggcgggcgggcugcucacuguuugcuacgugcugaccggccgcucggccgaccuggagcuagagagagccgccgacgugaaaugggaggaccaggccgagauuagcggcagcucccccaucuuauccauuacaaucucugaggacgguaguaugaguaucaagaacgaggaggaggagcagacccugaccauccucauccguaccggccuccuggucaucagcgggguguucccggugucuauacccaucaccgcggccgccugguaccuaugggaagucaagaagcaaagggccggggugcugugggaugugccgaguccaccgccagucgaaaaggcggagcuggaggacggggcguaucgcauuaaacagcggggcauccucggguacucccagaucggcgccggcguauacaaagaggggaccuuucacacgauguggcacgugacacgaggcgcgguccugaugcaccgggggaagaggaucgagcccucaugggccgacgugaaaaaggaucugaucuccuauggcggggguuggaaguuggaaggcgaguggaaggagggggaggagguccagguccuugccuuagagcccggcaagaacccccgggcgguccagacaaaacccgggaucuucaagaccaacacgggcaccauaggggccguuucauuggauuucucccccggcaccucuggcucccccauagucgacaggaaagggaaagugguuggcuuauaugguaacgggguggucacccggagcggcgccuacguguccgccaucgcccaaacggaaaagagcaucgaagacaaccccgagaucgaggacgacauauuccgcaagaagaggcugaccauuauggaucuacacccaggggccggaaagaccaagcgcuaccugccagccaucguccgggaagccaucaagcgugggcugcguacccugauccucgccccgacgcgagugguggccgcagagauggaggaggcccugcgcggacugcccauccgguaccaaacccccgccaucaagacgcagcauaccgguagggagaucgucgaccucaugugccaugccacguucacgaugagauugcucagcccaguucgugugcccaauuacaaccucaucauuauggacgaagcgcauuucaccgacccagccuccauugccgccagaggguacaucucgacacgcguagagaugggcgaggcugcggguaucuucaugaccgccacgccacccggcucccgcgacccguucccccagucaaacgccccgaucauggaugaggagcgcgagaucccugagagguccuggaacucugggcacgagugggugaccgacuucaaaggcaagaccgugugguucgugccgucuauaaaagcugggaacgacauagcagccugucugcgcaaaaacggcaagaaggugauccagcugagcagaaagaccuucgacucagaguaugugaagacacgcgcaaacgauugggacuucgucguuaccaccgauaucagcgaaaugggagccaacuucaaggccgagagggugauugacccccgccggugcaugaagcccguaauccucacggacggggaagaacgcgugauauuggcggggcccaugccuguaacccauuccagcgccgcgcagcggcgcgggcggaucggccggaaucccaaaaaugagaacgaccaauacauuuacaugggugagcccuuggagaacgacgaggacugcgcccacuggaaagaggccaaaaugcuccucgacaacauuaauacccccgagggcaucaucccguccauguucgagccugagcgcgagaaagucgacgccaucgauggcgaguaccggcugcgcggagaggcccggaagacauucguggaccugaugcgcagaggcgaccugccaguguggcuggcguacaaagucgccgccgaaggaauaaacuacgcagaucgcaaguggugcuucgauggcaucaaaaacaaccagaucuuagaagagaacauagaggucgagaucuggaccaaggagggcgagaggaagaaacuuaagccccgcugguuggaugcccggaucuacuccgacccccucgccuugaaggaguucaaagaguuugcggcgggccgcaagucccugaccuuaaaucugauaacagaaauggggcggcuuccuacauucaugacgcaaaaggccagaaacgcccucgacaacuuggccguucugcauacggcagaggccggaggccgggccuacaaccacgcgcucagcgagcuccccgagacgcuggagacccuccuacugcucacuuuacuggcuaccgucaccggaggcaucuuccuuuuccugauguccgguaagggggugggcaagaugacucuggggaugugcugcaucaucacggccagcauccuacucugguaugcacagauccaaccccacuggauagccgcaaguaucaucuuagaguucuuccucaucguacugcugauccccgaaccagagaagcagcgcacgccccaggauaaccagcucacauacguggugaucgccaucuuaaccgugguggccgcgacaauggccaacgagauggguuuccuggagaagacgaagaaggaccucgggcugggcuccaucaccacccaggagagcgaguccaacauucuggacaucgauuugcggcccgccagcgcuuggacccuguaugcggucgccacuacuuuugucaccccaaugcugcgacacuccaucgaaaauucaucugugaacgugagccuaaccgccauagccaaucaggcgacgguucuuaugggacucgggaagggcuggccacucagcaaaauggacauaggcgugccccugcuagcgaucgguuguuauagccaggugaacccgauaacacugaccgccgcccugcuguugcuggucgcacacuacgccaucaucgggcccggacuacaagcgaaggcaacccgcgaggcgcaaaaacgggccgcggcgggcauuaugaagaaccccaccguggacggaaucaccgucaucgaccucgagcccauaccguaugaccccaaguucgaaaagcagcugggccaggucaugcugcucauacugugcguaacccaggugcugaugaugcguaccacgugggcucuaugcgaggcccugacgcuggccacagggcccauuucuacuuuaugggagggaaacccaggcagauucuggaacacgaccaucgcagucagcauggcaaacauuuuccggggaagcuaccuggcuggugccggccuccuguuuucgaucaugaaaaacaccaccaacacgcgaaggggcaccgggaacaucggcgagacccugggagagaaguggaagucccgguuaaacgcgcuaggcaagucugaguuccagguguauaagaagucgggaauccaggaaguggaccguacgcuggcgaaagaggggauaaagcggggcgaaacggaccaucacgccgucucucgcggauccgccaaacuucggugguucguggagcgcaacauggugacgccggagggcaaggucguggaccucggcugugggcggggcgguugguccuacuacugcggcgggcugaagaaugugcgagaaguaaaagggcugaccaagggcgggcccggccaugaagaaccuauccccaugagcaccuacggguggaaccucgugcgccugcaaagcggcguggacgucuucuucacuccucccgaaaagugcgauacccucuugugcgacaucggggagagcuccccgaaucccaccaucgaggccgggagaacccuccguguucucaaucucguggagaacuggcucaacaacaauacccaauucuguaucaagguccugaacccguacaugccuuccgugaucgagaaaauggaagcccuccagcgcaaguacggcggggcguuagugaggaacccacugagucgcaacagcacacaugagauguacugggucucgaacgccacggguaacauagugagcucggugaacaugauaagccggaugcugaucaaucgcuucaccaugaagcacaagaaggcgacguacgagccugacgucgauuuggggucaggcacgcggaacaucgggauugaaagcgagaucccaaaccuggauaucaucggcaagcgaaucgagaagaucaagcaggagcacgagacaagcuggcacuacgaccaggaucaccccuacaagaccugggcuuaccacggcucauacgagaccaagcagacagggucggcuagcucgauggugaacggcguuguccggcuguugaccaaacccugggaugugguuccgaugguuacccaaauggcuaugaccgacacaacgcccuucggucagcagcgcguguucaaggagaagguggacacccgcacgcaggagccuaaggaaggcacgaagaagcuaaugaagaucaccgccgaauggcuguggaaggaacuaggcaagaaaaagacgccgcggaugugcacucgugaggaguucacucgcaagguccgcagcaacgccgcccugggggccauuuucaccgacgagaacaaauggaagucggcgcgagaggccguggaggaugggcgauucugggaacugguggaccgagagagaaaccuccaccuggaagggaaaugcgagaccugcgucuacaacaugaugggcaagcgggagaagaagcugggggaguucgggaaggccaagggcagccgugccaucugguauauguggcuaggggcccgguuucuggaguucgaggcacugggcuucuuaaacgaggaccauugguucucgagggggaacagccugaguggcguugagggggaaggucugcaucgccucggcuacauccugcgggacgucgggaaaaaggagggcggggccauguacgcagacgauaccgccggcugggauacgcggaucaccuuagaggaccucaagaacgaggaaaugguuacuaaccacaugaagggggagcacaagaaacuugcugaggcuaucuuuaaacugaccuaccaaaacaaggugguccgcguucagagaccgacgccccgcgguaccgugauggacauuaucagucggcgugaccagcgggguagcgggcaggucgguacuuacggacucaacaccuuuacgaacauggaggcccagcucauccgccagauggagggcgaaggaaucuuuaaguccauacaacacuuaaccgccacagaagagaucgcggugcaaaacugguuggcacgcguuggucgagagagguugagccguauggccaucucgggcgacgacugcguggugaagccgaucgacgacagauuugccucagcccuaaccgcccucaacgacauggggaagguccggaaagacauccagcaaugggaacccucccgcgguuggaacgacuggacgcaagugccauucuguagccaccacuuccacgagcugguuaugaaggauggccgggugcuuguuguccccugccguaaccaggaugagcucaucggccgggcgcgcauuucacaaggagccggauggucgcugaaagaaaccgccugccuugguaaaagcuacgcgcagauguggacccucauguacuuccaccgccgugaccuucgacuggccgcuaacgccaucugcagcgccgugccgccccacugggucccgaccucccggacuacguggucaauucacgccaagcaugaguggaugacaaccgaggacaugcucgcgguguggaaccggguauggauccaggaaaaccccuggauggaagacaagacgcccguagagaguugggaggagguacccuauuuggggaaaagagaggaccaauggugcggcagcuuaaucgggcucacuucccgggccaccugggccaagaauauccagaccgccaucaaccaggugcgcagccugaucggcaacgaggaguacaccgacuacaugccgaguaugaagcgguuccgcagggaggaggaggaggcuggagucuugugguag

SEQ ID NO: 25002 - RNA, 9876 nt, Artificial Sequence
  derived and/or modified CDS sequence (opt11) from DENV-2__GU131955__SS-prME
accgcaggcgugaucgugaugcuaaucccaaccgugauggcuuuccaccucaccacucggaacggggagccccacaugaucgugggccggcaggagaaggggaaguccuuacuguuuaagaccgaggacggagucaacaugugcacccucauggcuaucgaccugggggaacugugcgaggacacgaucaccuacaagugcccccuccugcgccagaacgagccugaggacaucgacugcuggugcaacuccacuagcacuugggugaccuacggaaccugcuccaccaccggcgagcacaggcgcgagaaacggagcguggcccuggucccacacgucggaaugggccucgagacgcgaaccgagacguggaugagcagcgagggggcauggaagcacguucagcggaucgagaccuggauacugcgccaucccggguuuacuaucauggccgcuauccuggcguacacuaucgggaccacccacuuccagcgggcccucauauucauccugcugacugcgguugccccuagcaugaccaugcgcugcauuggcaucagcaaccgggacuucguggagggcguguccgggggcagcuggguggacaucgugcucgaacacggguccugcgugacaacgauggcgaagaacaagcccacccucgacuucgagcugaucaagaccgaggccaagcagcccgccacacuccgcaaguacugcauugaggcuaagcugaccaacaccaccaccgagagucgcuguccgacccagggcgagcccucccugaacgaggagcaggacaagcgcuucauuuguaagcacagcauggucgaccgggguuggggcaacggcugcggcuuguucggcaagggcgguaucgugacgugcgcuauguuuacuugcaaaaagaauauggagggcaaagugguccagccugagaaccuggaauacaccauagugaucacgccccauuccggggaggaacacgccgugggcaacgauacagggaagcacggcaaagagaucaagaucaccccgcaguccuccaucacugaggccgaacucaccggcuacggcacugucacgauggagugcagcccucgaacaggccucgacuucaacgagaugguguugcugcagauggaggacaaagcguggcucguacaucgccagugguucuuagaccuaccgcuccccugguugccgggugcggacacgcagggcuccaacuggauccagaaggagacccuggucacguucaagaacccccacgccaagaagcaggacguggucguguuggggagccaagagggggcgaugcacaccgccuuaacgggugccaccgagauccagaugagcuccggcaaccucuuguucacgggacaccugaagugccgucugcggauggacaaacuccagcugaagggcaugagcuacaguauguguaccggcaaguucaagauugugaaggagaucgccgagacccagcacgggaccaucgucauccgcgugcaguacgagggcgacgguagccccugcaagaucccuuucgaaauaaccgaccuagagaagaggcacguacucgggcgccugauuaccguuaacccuauugugaccgagaaggacucccccgugaacaucgaagccgagccgcccuucggcgacagcuacaucaucaucggggucgagccgggucagcuaaaacucaacugguucaagaagggguccagcaucggccagauguucgagacaacgaugcgcggcgcaaagcggauggcgauuuuaggggacaccgccugggacuucggcucccuugggggcguguuuaccagcaucgggaaggcccuccaccaaguguucggcgccauauacggcgcggccuucuccggggucagcuggaccaugaagauacugaucggcgugauuaucacguggaucgggaugaacucccgcagcaccucucugagcgugucccugguccucguaggcguggucaccuuauaccucggggccauggugcaggccgacagcggcugcguggucuccuggaagaauaaggaguuaaagugcggaagcgggaucuucaucaccgacaacgugcacacguggaccgagcaguacaaguuccagcccgaaagccccuccaagcuggcaagcgccauccagaaggcucacgaggagggcaucugcgggauccgguccgucaccagacuggagaaccucauguggaagcaaaucacccccgagcugaaccauauauuaucugagaacgaggucaagcucacgauuaugaccggagacauaaaggggaucaugcaggccggcaagcggucccugcgcccacagcccaccgaacugaaguauucauggaagaccuggggcaaggccaaaaugcucuccacggagagccacaaccagacguuccugaucgaugggcccgagaccgcggagugcccgaacaccaaccgggccuggaacuccuuagagguagaggacuacggguucgggguguucacgacuaacaucuggcucaagcugcgcgagaagcaggacgucuucugcgacagcaagcugauguccgccgcuaucaaagacaauagagcugugcaugcggacaugggcuacuggauugagagcgcccucaacgauaccuggaagauggagaaagccuccuucaucgaggucaagagcugccacuggcccaagucccacacacuguggagcaacggcgugcuggaguccgaaaugauuauccccaagaacuucgccgggcccguaagccagcacaacuaccgcccgggcuaccauacucaaacggccgggccuuggcaucucggcaagcuggagauggacuuugaucugugugaaggaaccacuguugucgugaccgaggacugcggcaaccggggccccagccuccgcacgaccaccgcgucggggaagcuuaucaccgaauggugcugccggagcuguacgcugccgccgcuacgauaccggggggaagacgggugcugguacgggauggagauccgcccccugaaggagaaggaggagaaccuugugaacucccucgucaccgcaggacacggccagaucgacaacuuuagccugggugugcuggggauggcccucuuccuggaggagaugcugcggacccgcaucgggacaaagcacgccaucuugcugguggcagccaguuucguuacgcugaucaccgguaacauguccuuccgggaccucggucgcgugauggugauggucggcgcaaccaugaccgacgacaucggcaugggagugacuuaucuggcucugcucgccgcuuuuaaggugaggcccaccuucgccgccgggcugcugcuccggaagcugaccuccaaggagcugaugauggcaaccauuggcaucgcgcuccugagccaguccacgaucccggagaccauccuggagcucaccgacgcgcuggcacuagggaugaugguccucaagaucguccgcaacauggagaaguaccagcuggccgugaccaucauggccaucagcugcguccccaacgcggugaucuuacaaaacgcauggaaggugaguugcacgaucuuagccgccgucagcguuagcccccugcuucucaccagcucccagcagaaagccgacuggauuccccuggcgcugaccauuaaaggccucaacccgaccgccauuuuccugacgacccugagccggacuagcaaaaagcgcagcuggccgcucaacgaggccgucauggcaguuggcaugguguccaucuuagccagcagccugcucaagaaugauauccccaugaccgggccccuuguugcgggcggguuacucacuguguguuacgugcugacuggccgguccgccgaccuggagcucgagcgcgccgccgacgucaagugggaggaccaggccgagaucagcggguccagccccauacuguccauuacaauuagcgaggacggcuccaugucaaucaagaacgaggaggaggagcagaccuugacgauccucauccggacgggacugcucgugaucuccgggguguucccggucagcauccccauuacagcggccgccugguaccucugggaagugaagaagcagcgcgccggggugcugugggacguccccagcccgccgcccguggagaaagccgaacuggaggacggcgcguaccggaucaagcagcgcggcauccucggguacagucagaucggcgccggcguguacaaggaggggaccuuucacaccauguggcacguaacgcggggcgcagugcugaugcacagggggaagcggaucgagcccucgugggccgacgucaagaaggaccugaucaguuacggcgggggcuggaagcuugagggcgaguggaaggagggggaggagguccaggugcuggcccuggagcccggcaagaauccccgcgccgugcagaccaagcccggcaucuuuaaaaccaacaccggcacgauuggggcugucagucucgacuuuuccccagggaccuccggcagccccaucguggaccguaaggggaagguagucggccuguacgggaacggcguugugacgcgcuccggcgccuacgucagcgccaucgcucagaccgagaaaucaauagaggacaauccagaaaucgaggacgacaucuuccggaagaagcgccugacgaucauggaccuccaccccggggcugguaaaaccaagcgguaccugccagccaucgugagggaagccauuaagagagggcugaggacccugauccucgccccgacacgcguggucgcggccgagauggaggaggcccugcgggggcugcccauccgguaccaaacgcccgcuauaaagaccgagcacacgggcagggagaucguggaccucaugugccacgccaccuucacgaugcgccugcugucccccgugcgggucccgaacuacaaccucauaaucauggacgaggcacacuucaccgaccccgcgagcaucgccgcacgcggcuacauuuccacccggguggagaugggcgaggccgcggggaucuucaugacugccacgccgccgggaagccgcgacccguucccgcagaguaacgcccccauaauggacgaggagagggagaucccagagcgcagcuggaacuccgggcacgagugggugaccgacuuuaaggggaagaccgucugguucgugccgagcauuaaggccggcaacgauauugcggcuugcuugcgaaagaauggcaagaaagugauccagcuuucccgaaagacguuugacagcgaguacgucaagacccgggcaaacgacugggacuucguggugacuaccgacaucuccgagaugggcgcaaauuucaaggccgagcgcgucaucgacccccggcgcugcaugaagccugucauucucaccgacggggaggagcgggugauucuggcgggcccaaugccggucacgcacagcuccgccgcccagcgucgggggcgcaucggucggaaucccaagaacgagaacgaccaguacaucuacaugggggagccucucgagaacgaugaggacugcgcccacuggaaggaggccaagauguuacuagacaacaucaacaccccagagggcaucaucccgagcauguucgagccugagcgugaaaagguggacgcaauugacggagaguaccgccuucgcggggaggcccgcaagaccuucguggacuuaaugcggaggggcgaccugcccguauggcuggcauacaagguggcugccgaagggaucaacuaugcagaccggaaguggugcuucgacgguaucaagaacaaccagauccucgaggagaacauggagguggagauauggacgaaggagggggaacgcaagaagcugaagccgagauggcuggacgcccgaauauacuccgacccccuugcccuuaaggaguuuaaagaguucgccgcgggucgcaagagccugacgcucaaccugaucacggagaugggacgccugcccaccuucaugacccagaaggcccggaacgcccucgacaaucuggcuguccugcacacggcagaggccgggggccgcgccuacaaccacgcccuuuccgagcugccggagacacuggagacccuccugcuacucacacugcuggccacggugacggggggcauuuuccucuuucugaugagcggcaagggcauagguaagaugacccugggaaugugcugcaucaucaccgccuccauccuucugugguacgcgcagauccaaccacacuggaucgccgccucaaucauccuggaguucuuucucaucguucuccugauccccgaacccgagaagcaacggaccccgcaagacaaccaacucacguacguggugaucgcuauacugaccgucguggccgcgaccauggccaacgagauggguuucuuagagaagaccaagaaggaccucggucugggcucaaucacgacccaggagagugagagcaauauacuggacaucgaccuccgcccggccucagccuggacccuguacgccguggcgaccacguucgucacgccaaugcugcggcauuccaucgagaacuccagcgugaacgugucccucaccgccaucgcaaaccaggcgaccguccugaugggccuggggaagggcuggccccucagcaagauggacauaggugugccccugcuggcaaucggauguuauagucaggucaacccgaucacgcucaccgccgcucugcugcuccuggucgcccacuacgccaucaucggucccggacugcaggcgaaagccacccgcgaggcacagaagcgggccgccgcgggcaucaugaaaaacccgacaguggacggaauaacggugaucgaucucgagcccauaccguacgaccccaaguucgagaagcagcugggucaggucaugcugcucauccugugcgugacccaggugcugaugaugcgcaccaccugggcccucugcgaggcccuuacgcuggccacagggcccaucagcacccucugggagggcaaccccgggcgguucuggaacacaacgaucgccgucucuauggcgaauaucuucagaggaagcuaccuggccggcgccggacuccuauucuccaucaugaagaauaccacuaacacccgccggggcacggggaauauaggcgaaacccugggugaaaaguggaagucccgccugaacgcgcucgggaaguccgaguuucagaucuauaaaaaguccggcauucaggagguagaucggacccuggcgaaagagggaauaaaacgcggcgagaccgaccaccacgcggugaguagagggagcgcuaagcugcgcugguucgucgagcggaacaugguuacgccggagggcaagguggucgaccucggcugcgggcgcggcgggugguccuacuauugcggcgggcugaaggacgugcgggaggugaagggcuuaaccaagggggggccaggccacgaggagcccaucccuaugagcaccuauggguggaaccucguccgacuccagucagguaucgauguguucuucaccccgcccgaaaaaugcgacacgcugcucugcgacaucggcgagucaucacccaacccuaccaucgaggccggccggacccugcgcgugcugaaccucguggagaauuggcugaacaauaauacccaguucuguaucaaggugcugaacccguauaugcccuccgugaucgagaagauggagacccuccagcggaaguauggcggggcccucguccgcaacccccugagccggaacuccacgcacgagauguacugggugagcaacgcgaccggcaacauagugaguucaguaaacaugaucucccgcaugcugaucaaccgguucacgaugaagcacaagaaagccacuuacgaaccagacguggaccucggaagcggcacgaggaacaucgggaucgaguccgagaucccaaaccuggacaucaucggcaagcggaucgagaagauaaagcaggagcacgagacaucauggcacuacgaccaggaccacccguacaagaccugggcuuaccacggcuccuacgagaccaagcaaacggguagugcauccagcauggugaacggcguagugcgcuuacucaccaagcccugggacgugguucccauggugacccagauggccaugaccgacacgacccccuucgggcagcaacgcguguucaaagaaaagguagacacucguacccaggagcccaaagagggcacaaagaagcugaugaagaucaccgcggaguggcuguggaaggagcucgggaagaagaagacgccacggaugugcacccgggaggaguucacgcguaaagugcggaguaacgccgcccugggugccaucuucaccgacgagaacaaguggaagagugcgcgcgaggcaguggaggacggccgguucugggagcuggucgaccgugagcggaaccuccaccuggaggggaaaugcgagaccugcguguauaacaugaugggcaaacgcgaaaagaagcugggcgaguucggcaaggccaaggggagccgggccaucugguacauguggcucggggcccgcuuccuggaguucgaagcgcugggcuucuugaacgaggaccauugguucagccgggggaacagccuguccggcguggagggggagggcuugcaccgccuaggcuacauccugcgggacgucggcaagaaagagggcggggccauguaugccgacgacaccgccggcugggacacacgcaucacccuggaggaccucaaaaacgaggagauggugacuaaccauaugaagggggagcacaagaaguuagccgaagcaaucuuuaagcugaccuaccaaaacaaagucgugcgggugcagcgcccgacgccacgggggaccguaauggacaucaucagccgccgggaccagcgcggcuccggacaggugggcaccuacggccucaacaccuucacgaacauggaggcccagcugauucgccagauggagggcgagggcaucuucaagucuauacagcaccugaccgccacggaggagaucgccgugcagaacuggcucgcccggguggggcgcgagcggcugucccgcauggcgaucagcggcgacgacugcgugguuaagcccauugacgacagguucgcauccgcucugacugcccucaacgacauggggaagguccgcaaggauauccagcagugggagccuagccgcggauggaacgacuggacgcaagugccguucugcucccaccacuuccacgagcuggugaugaaggacggacgcguccugguugugcccugccggaaucaggacgaacucauuggccgggcucggaucagccagggcgccgggugguccuuaaaagagacugcuugccugggcaagagcuacgcccagauguggacccucauguacuuucaccgccgggaccugcgccuggccgccaacgcgauauguuccgccguccccagccacuggguccccaccucccggaccacauggagcauccacgccaaacacgaguggaugaccaccgaggacaugcucgcaguguggaaccgcgucuggauccaggagaacccguggauggaggacaaaacacccguagaguccugggaggaggugcccuaccuggggaagcgugaagaccaguggugcgguagccugauaggguugacuucucgcgcgacaugggccaagaacauccaaacagccaucaaucaggucaggucacugaucgguaaugaggaguacaccgacuacaugccgucaaugaaacgcuuucgcaaggaggaggaagaggccggcgugcugugguag

SEQ ID NO: 25003 - RNA, 9876 nt, Artificial Sequence
  derived and/or modified CDS sequence (opt11) from DENV-2__KJ189311__SS-prME
accgcuggcgugaucgucaugcugaucccgacagugauggcguuccauuugaccacucguaacggcgagccgcauaugaucgugggcagacaggagaaagguaagucgcugcuguuuaagaccgaagacggcgucaacaugugcacccucauggcgauagaccugggagagcugugcgaagacacaaucaccuacaaaugcccccuccuucgccagaacgagcccgaggacaucgacuguuggugcaacucaaccagcaccuggaucacauacgggaccugcuccacuaccggugagcaccggcgggagaagcggagcguagcccuggugccccacgucgggaugggucucgagacucgcaccgagaccuggauguccagcgaaggugccuggaagcacgugcagcggaucgagaccuggauccugcgccacccgggcuucaccaucauggcagccauccucgcguacaccaucgguaccacccacuuccaacgcgcgcucaucuucauucuacuaacugccguagcacccuccaugaccaugcgcugcaucggcaucagcaaccgggacuucgucgaaggcguguccgggggcucuuggguggacaucguccucgaacacggguccugcgugaccaccauggcgaagaacaagcccacguuagacuucgagcugauuaagaccgaggccaagcagcccgccacccuccgaaaguacugcauagaggcgaagcugaccaacacgaccacugagagccgaugcccaacacagggugagcccagccugaacgaggaacaggauaagcgcuucaucugcaagcacagcaugguggaccgggggugggggaauggcugcgggcuguucggaaaagggggaaucguuacgugcgccauguucacguguaagaagaacauggagggcaagguggugcagcccgagaaccuggaauacaccaucgucauaacgccacauuccggggaagagcaugcggugggcaacgacacggggaagcauggcaaagagaucaagauaacgccgcagagcuccaucaccgaggccgagcuuacuggguacgguaccgugacgauggaaugcagcccucgcaccggccucgacuucaacgagaugguccuacugcaaauggaggacaaggccuggcucguacaucggcagugguuccuggaccugccccugcccuggcugccgggugccgacacgcagggcuccaacuggauucagaaggagacgcuggucacguucaaaaacccccacgccaagaagcaggaugucgugguccucggaagccaggagggugcgaugcacaccgcccugaccggagcuaccgagauacagauguccagcggcaaccuccuguucacgggccaccugaagugccgucugcggauggacaagcuccaguuaaaagggaugagcuacuccaugugcaccggcaaguucaagauugugaaggagaucgccgagacucagcacgggaccaucgugauccgcguccaguacgagggagacggaagcccaugcaagauaccguucgagaucacggaccuugagaagaggcacguccucgggcgcuugaucaccgugaacccgaucgucaccgaaaaggauucccccguuaacaucgaggccgagccgcccuucggcgacagcuauauaauaaucgggguggagccgggucagcugaagcucaauugguucaagaagggauccagcaucggucagauguucgagaccacaaugcgcggcgcgaagcgcauggccauccugggggacaccgccugggacuucggcucuuuagguggggucuuuaccagcaucggcaaggcucuccaccagguguucggggccaucuacggcgcggccuucucaggggugagcuggaccaugaagauccugaucggcguuaucaucacguggaucgggaugaacucccggagcaccucccugagcgugagucugguguuggucgggguggugauccuauaucugggggccaugguccaggccgacagcggcugcgucguguccuggaaaaacaaggagcucaaaugcggcagcgguaucuucaucaccgacaauguccacacuuggacggagcaguacaaguuucagcccgagagccccucuaagcuggcgagcgccauccaaaaggcccacgaggagggcaucugcgggauccggucggugaccagacuggagaaccucauguggaagcagaucacucccgagcugaaccacauacugagcgaaaacgaggugaagcucaccaucaugacgggcgauauaaaaggaaucaugcaggcaggcaagcggucccugcgcccucagcccaccgagcugaaguacaguuggaaaaccuggggaaaggccaaaaugcucuccaccgagucgcacaaccagacguuccugauugacgggccggagaccgcggaguguccgaacaccaaccgugcuuggaacucccuggaggucgaggacuacggcuucggggucuucaccacgaacauuuggcuuaagcugcgugagaagcaagauguguucugcgauucaaagcugaugucugccgccaucaaggacaaccgggcgguccacgcggauaugggcuacuggaucgagagcgcccucaaugacaccuggaagauggagaaggccuccuucaucgaggucaagagcugccacuggcccaagucucacacccuguggagcaacggcguacuggaguccgagaugaucauccccaagaacuucgccgggcccgugagucagcacaauuaccgcccgggcuaccacacucaaaccgccgggcccuggcaccucggcaagcuggagauggacuucgaccugugcgaggggacgaccguaguggucaccgaggacugcggcaacaggggccccagccuccgcaccacgaccgcguccgggaagcugaucacggaguggugcugccgaucaugcacccugcccccgcuccgguaucggggcgaggacggaugcugguacggcauggagauccgccccuuaaaggagaaggaggaaaacuuggugaauucccuggugacggccggucacggccagaucgacaacuucagccuggggguucucgggauggcccuguuccuugaggagaugcugagaacgcgcaucggaacaaagcacgccauccuccuggucgcggcaucauucgugacccugaucacggggaacaugagcuuccgggaccucggaagagugauggugauggugggggccaccaugaccgacgacaucgggaugggagucaccuaccuggcccuguuggccgcguuuaaggugagacccacguucgccgccgggcugcuacuccggaagcugacauccaaagagcucaugauggccaccaucggaaucgcccuccugagccagucaacaaucccagagagcaucuuggagcugacggacgcgcuggcccugggcaugaugguccucaagaucguccgcaacauggagaaguaccagcuggcagugaccaucauggccauauccugcgucccgaacgccgucauccugcagaacgcguggaaagugagcugcacuauccuggccgcagugucggucucaccucugcuacuaacguccagccagcagaaggccgacuggaucccccuggcguugacgaucaagggccucaaucccaccgccauuuuccugacaacacugucccggacgaguaagaaacgcucauggccacucaacgaggccgugauggcaguuggcauggugagcauccuggcaagcuccuugcucaagaacgacauccccaugacaggacccuuaguggcgggcgggcugcucaccgucugcuaugugcugaccggccggagcgccgaccuugagcucgagcgugccgccgacgugaaaugggaggaucaggccgagaucuccgggagcaguccuauacugaguaucacaaucuccgaagauggaaguauguccaucaagaacgaggaggaagaacagacccugaccauccucauucggaccggccuguuagucaucagcgguguguucccggugaguauccccaucacagcggcggccugguaccuuugggaggucaagaaacaacgcgccggcgugcugugggacguccccagcccgccccccguggagaaggccgaacuggaggauggggcuuaccggaucaaacagcgcggcaucuuaggguacucccagaucggcgccggcguauacaaggagggaaccuuccauacgauguggcaugugacccggggcgccguccugaugcaccgcgggaagcggauagagcccagcugggccgacgugaaaaaagaccugaucuccuacggugguggauggaagcucgagggcgaguggaaggaaggggaagaagugcagguccuugcccuggagccuggcaagaacccccgcgcgguacaaaccaagcccgguauauucaagacgaacaccggcacgaucggugcggugagccucgacuucuccccgggcacuagcgggucccccaucgucgaccggaaggguaagguuguggggcuguacggaaauggcgucguuacgaggagcggcgccuauguaagcgccaucgcgcagaccgagaaguccauugaagacaaccuggagauagaggacgacaucuuccggaagaagcgacucacaaucauggacuugcacccgggggccggcaagaccaagcgguacuugcccgcgaucguacgcgaggccaucaagcgggggcugcgcacgcucauacuggccccgacccgcgugguggcggccgagauggaggaggcccuucggggccuccccauccgcuaccagaccccugccaucaagaccgaacacacgggccgggagaucgucgaccugaugugccacgccaccuucaccaugcgccugcucagccccgugagagugcccaacuacaaccugauaauuauggacgaagcgcacuuuaccgacccggccuccauagcagcgcgcgguuacaucagcacaagagucgagaugggcgaggccgccgggaucuucaugacggcgacgccucccgguagccgcgaccccuucccgcagaguaacgcccccaucauggacgaggagcgggagauccccgaacgcuccuggaacagcggacacgagugggugaccgacuucaagggcaagacggugugguucguccccuccaucaaggcugggaacgauaucgcggccugccuccggaagaacgguaagaaggugauccaguugagccgcaagaccuuugacagcgaguaugugaagacucgggccaacgacugggauuucgugguuaccacggacaucagcgagaugggcgccaacuucaaagccgagcgcguuaucgauccgcggagauguaugaagccagucauucuuaccgacggggaggaacgggugauucuggcgggccccaugcccgucacucauuccagcgccgcccagcgacgcgggcggaucggccgcaacccgaagaacgagaacgaccaguacaucuacaugggagagcccuuagagaacgacgaggacugcgcccacuggaaagaggcuaagaugcugcuggauaacaucaacacucccgagggaaucauccccuccauguuugagcccgaacgggagaaggucgacgcgaucgacggagaguaccggcuccgcggggaagcccgaaaaacguucgucgacuuaaugcggagaggcgaccugcccguguggcucgccuacaaggucgcugccgaggggaucaacuacgcagacagaaagugguguuucgacggcaucaagaacaaccagaucuuggaggaaaauauggagguggagaucuggacuaaggagggggagcgcaaaaaacugaaaccccgguggcucgacgcacgcaucuacagcgacccgcuggcccugaaggaguucaaggaauucgccgcgggccggaagucccucacccucaaccugaucaccgagaugggcaggcuccccacguucaugacccagaaggcccggaacgcccuggauaaccuggccgugcuccacaccgccgaggcgggaggucgggccuacaaucacgcgcugagcgagcugcccgaaacccucgaaacgcuccugcuccugacccugcucgccaccgucaccgggggaauauuccuguuccugauguccggcaaggguauaggaaagaugacgcuaggaaugugcugcaucaucaccgccagcauccugcugugguaugcgcagauccagccccacuggaucgccgccagcaucauccucgaauucuuccugauagugcugcuuaucccggagcccgagaagcagcgaacgccccaggacaaccagcugaccuacgucgugauugccauccuuaccguggucgcggcgacgauggcaaacgaaaugggcuuccuggagaagaccaagaaggaccugggacugggcuccauaaccacccaggagagcgaguccaauauccucgacaucgaccugcgccccgcgagcgcguggacucuguaugccguggcgaccaccuucgugacaccgaugcuccggcacuccaucgagaauagcucggucaaugugagccugacggccaucgcaaaucaagccacagugcugaugggccucgggaaaggcuggccccuguccaagauggacaucggggucccccugcuggcgauuggcuguuacagccaagugaaccccaucacccuaacugcugccuugcuccuguugguugcccauuacgccaucauagggccuggccuccaggcgaaggccacgcgcgaggcccaaaagcgggccgcagcgggaaucaugaagaaccccaccgucgaugggaucaccgugaucgaccuggaacccauccccuacgauccgaaguucgagaagcaacugggccaggugaugcuccugauccugugcgucacccaggugcucaugaugcgcacgaccugggcauuaugcgaagcguugacccucgcgaccgggcccaucuccacgcuuugggagggcaaccccggucguuuuuggaacacuacgauugccgugagcauggcgaacaucuuccgcggcucuuaccuggccggugcggggcuccuguucagcaucaugaaaaacaccaccaacacccgccggggcaccgggaacaucggcgagaccuugggcgaaaaguggaagucgcgccucaacgccuugggcaagagcgaguuccagauauacaagaaguccggcauccaggaggucgaccgcacguuagcuaaagaggggaucaagcgcggcgagaccgaccaccacgccgugagccgcgggucggccaaguuacggugguucguggagcggaauauggucacccccgagggcaaggugguggaccucggcugugggcgcggcggauggagcuacuacugcggcgggcugaaggauguuagggaggugaagggcuugaccaagggcgggccgggccacgaagagccuauccccaugagcacguacggguggaaccuggugcgacugcagucaggcaucgacgucuucuuuacgccccccgagaagugcgauacccuucugugcgacaucggggagucgucacccaaccccacuauagaagcuggccggacgcugcgggugcucaaccucguggagaacuggcugaacaacaacacacaguucugcaucaagguccuaaauccauacaugccgagcgucaucgagaagauggaaaccuuacagcggaaguacgggggggcacugguaaggaacccccugucccggaacucuacacacgagauguacugggucucgaacgcgaccgguaacaucguaagcuccgugaauaugaucagccgcaugcucaucaaccgguucacgaugaaacacaagaaagccaccuacgagcccgacgucgacuugggguccggcacccgcaacaucgggaucgagagcgagaucccgaaccuggacaucaucggcaagcggauugagaagaucaagcaagagcacgagacauccuggcacuacgaccaggaccacccguacaagacgugggccuaccacggaucauacgagaccaagcaaaccggguccgcaagcuccaugguaaacggggugguccgccuccucaccaagccaugggacguuguacccauggucacucagauggccaugaccgacaccaccccguuugggcagcagcgcguauucaaggagaagguggacacgcggacccaggagccuaaggagggcaccaagaaguugaugaagaucaccgcggaguggcucuggaaggaguuaggcaagaagaagacgcccaggaugugcacgcgggaggaguucaccagaaaggugcgaagcaacgcagcccugggggccauauucaccgacgagaacaaguggaagagugcccgcgaggcuguggaggacgggcgauucugggagcucguggaucgggagcggucgcugcacuuggaaggaaagugugagacgugugucuacaacaugaugggcaagcgcgagaagaagcucggugaguucggcaaggccaaaggaagccgggccaucugguacauguggcugggcgcccguuuccuggaguucgaagcacucggcuuccugaacgaggaccacugguucucacgggguaacagcuuguccggcguggagggggaaggccuccaucgccugggguacauucugcgggacguugggaaaaaggaaggcggggccauguacgccgacgacacagccggcugggacacccgcaucaccuuggaggaccugaaaaacgaggagauggucacgaaccacaugaagggggagcauaagaaguuggccgaggcuaucuuuaaacuaacuuaccagaacaaggugguccggguccagcgccccaccccccggggaaccgugauggauaucaucagccgccgcgaccagcgcggcuccggucagguaggaacguacgggcugaacaccuucaccaacauggaggcucagcugauacgccagauggaaggggaagggauauuuaagaacauccagcacuuaaccgccacggaggagauugccgugcagaacuggcuggcccggguugggcgcgagcggcugagccgcauggcgaucuccggggacgacugugucgugaagcccaucgacgaccgguucgccagcgcccucaccgcccuuaacgacauggguaaaguacgcaaagacauccagcaaugggagcccucccggggcuggaacgacuggacccagguccccuucugcagccaccacuuccacgagcugguuaugaaggacgggaggguauuagucgugcccugccggaaccaagacgaauugaucggccgcgcccggaucagccagggcgcagguuggagccugaaggagacggccugccucgguaaguccuacgcccagauguggacguugauguacuuccaccgccgggaccugcgcuuggcggcaaacgcgauaugcagcgccgugcccucccacuggguccccaccagccggaccaccuggaguauacacgccaaacacgaguggaugaccaccgaggauaugcuagccguguggaaccgaguguggauccaagaaaaucccuggauggaggacaaaaccccggucgagagcugggaggaggugcccuaccuggggaaacgggaagaucaguggugcggcucucucaucgggcucaccucccgcgcaaccugggcaaagaacauccagacggccaucaaccagguacggagcuugaucgguaacgaggaguacaccgacuacaugcccuccaugaagcgcuuccgcaaggaggaggaggaggcaggcguccucugguga

SEQ ID NO: 25004 - RNA, 9876 nt, Artificial Sequence
  derived and/or modified CDS sequence (opt11) from DENV-2__KJ189370__SS-prME
acugcgggcgugauagucaugcugaucccaaccgcaauggcguuucacuuaaccacccggaauggggaaccccacaugauagugucccgucaggaaaaaggcaaaucccugcuguucaaaaccgaggacggggugaauaugugcacccucauggccaucgaccugggcgaacugugcgaggacaccauuacuuacaaaugcccccuacugcgccagaaugaacccgaggauaucgacuguuggugcaacagcaccuccaccugggucacauaugggaccugcacgaccaccggcgagcaccggcgggagaagcggagcguggccuuagugccgcacgucggcauggggcucgagacccgcaccgagacuuggaugucuagcgagggcgccuggaagcacgugcagcggaucgagacguggauccugcgccacccuggguucaccauaauggccgcuauccuggcuuacacaaucggcaccacgcacuuccaacgggcccucaucuucauacuccucacggccguugcccccuccaugaccaugcgcugcauugggaucagcaaucgggacuucgucgaaggggugucuggagggaguuggguggacaucguacucgagcacgggucgugcguuaccacgauggccaagaacaagcccaccuuggacuucgagcugauuaagaccgaggccaaacaaccugccacccugcgcaaauacugcaucgaggccaagcugacgaacaccaccaccgagagcagaugcccgacccagggggagccaucguuaaacgaggaacaggacaagcguuucaucugcaagcacagcaugguggaccggggcuggggcaacgggugcggccucuucgggaagggcgguaucguaaccugcgcgauguucacgugcaagaagaacauggagggaaagguggugcagccggagaaccuggaguacaccauagucaucacgccccauagcggggaggagcacgccgucgggaacgacaccggcaagcacggaaaggagaucaagaucaccccacagagcuccaucaccgaggccgagcugaccggcuacgggacggugaccauggagugcagcccccguaccggccuggacuuuaacgagaugguccugcuucagauggaggacaaagccuggcucguccaccggcaaugguuccuggaccugccucucccguggcugccgggcgccgacacccagggguccaacuggauccaaaaggagacgcuggugaccuuuaaaaacccucacgcgaagaagcaggauguagugguccucggcagccaggagggggcgaugcauacagcacugaccggggccacggagauccagaugagcuccgggaaccuccuguucacaggccaccugaaaugccgccugcggauggacaaauuacaacugaagggcaugucauacucgaugugcaccggaaaguucaagaucgugaaggaaaucgccgagacacagcacggcacgaucgugauccgcguccaguacgaaggagacggcuccccgugcaagauccccuucgagauuaccgaccuugaaaagagacacguccucggccgccugaucacugugaacccaaucgucaccgagaaagacucccccgucaacauugaggcggagccgcccuucggugauagcuauaucauaaucggcguugaaccggggcagcugaaauugaacugguucaagaaggguuccagcaucgggcagauguucgaaacaacgaugcgcggcgcaaagcggauggcgauucugggcgacaccgcgugggacuucggguccuuaggaggggucuucacauccaucggcaaggcccuccaccagguauucggggcgaucuacggcgccgccuuuuccggaguaagcuggacuaugaagauccugaucggugucauuaucaccuggaucggcaugaacucgcgcagcaccucccugucgguaagucugguguuggucggaguagugacccuguaccugggcgccaugguucaggcggacucugggugcguggugucauggaaaaauaaggagcuaaaaugcgguagcggcaucuucaucaccgacaauguccacaccuggaccgagcaguacaaguuccagccugagagccccuccaagcuggccagcgccauccagaaggcccacgaggaagggaucugcggcaucagaagcguuacccgccucgagaaucuaauguggaagcagaucacgcccgagcugaaccacauccugagcgagaacgaggugaagcucaccaucaugaccggcgacaucaaggggaucaugcaggccgggaaacggucccucaggccacagcccacggagcugaaguauagcuggaagacguggggcaaggcgaagaugcucuccacggagagccacaaccagaccuuccugaucgauggccccgagacagccgaaugcccgaacaccaaccgggccuggaacucccuggaagucgaggacuacggguucggcguguucaccaccaacaucuggcuuaagcuaaaggagaagcaggacguauucugugacagcaaacuaaugagugcugcaaucaaggacaaccgcgcgguucaugccgauauggguuacuggauagagagcgcacucaacgacaccuggaagauggagaaagcauccuuuauagaggucaagagcugccacuggcccaagagccauacucuguggagcaacggcgugcuggagucugagaugaucauccccaagaacuucgccggccccgugagccagcacaacuaccggccgggguaccacacgcagacggcuggccccuggcacuugggcaaacucgaaauggacuucgaccugugcgagggaacgacaguuguggucacugaggacugugggaaccggggccccagccugcggaccaccaccgccuccggcaaguuaaucacggaguggugcugccgcucgugcacccugcccccgcuccgguaccgcggggaggacggguguugguacgggauggagauccggccccuuaaggaaaaggaagaaaaccuggucaauucccucguuaccgccggccacgggcagauugacaacuuuucccugggcguccugggcauggcucucuuccuggaggagaugcugaggacccggaucgggacuaagcacgcaauccuccuuguggccguguccuuugucacgcugaucaccggcaauaugagcuuccgcgauuuagggcgggugaugguaauggucggagcuacuaugacugaugacaucgggaugggcguaaccuaccucgcccuucucgccgccuuuaaggugcgacccacguucgccgccggccugcugcuccggaagcuaacguccaaggaguuaaugauggccacgaucgggauugccuuacugagccaauccaccauacccgagaccauccuggagcuuaccgaugcuuuggcccuaggcaugaugguccucaaaguggugcggaacauggagaaguaccagcuggccgucaccaucauggccaucagcugcgugccuaaugcagugauccugcagaacgcauggaaggucucaugcaccauccucgcggcagugucaguuucuccccuacuauuaaccucuucccagcagaaggccgacuggaucccccuggcgcugacuaucaaagggcucaaccccacagccauauuccugaccaccuuaagccgcacgucaaagaaacggagcuggccacucaaugaggccauuauggccgugggcaugguguccauacuagcuagcagucuuuugaagaaugacauccccaugacuggccccuuaguagcgggcgggcugcucaccguaugcuaugugcugacagggagauccgccgaccuggaguuagaacgggccgcagacguuaagugggaagaccaggccgagaucagcggguccagccccauccuguccauaaccauaucagaggacgggucaauguccaucaagaacgaggaggaggaacaaacgcugacaauccuuauucguaccggccugcucgugaucucaggcgucuucccggucagcauccccaucaccgcagcggccugguaccucugggaggugaagaaacagcgggccggugugcugugggacgucccuagcccgccgccgguugagaaggcagaguuggaggacggcgccuaccgcauaaagcagcgugggauccucggcuacagccagauuggggcuggcgucuacaaagagggcaccuuccacaccauguggcacgucacacgcggggccgugcugaugcaucggggcaagagaaucgagcccucaugggcggacgugaagaaggaccuuaucucguacggcggaggguggaaguuagagggcgaauggaaagagggagaggagguucaggugcuggcucuggagccggggaagaacccccgggcgguccaaaccaaacccggcaucuucaagaccaacacggggacuauaggugcggucucacucgacuucagucccgggacuuccggaucgcccaucguggaccggaagggaaagguggucgggcuuuauggcaacggggugguaacccgauccggcgcuuacgucagcgccauugcgcagacggaaaaguccaucgaggacaaccccgaaaucgaggacgacaucuuccgcaagaagcggcugaccaucauggaccuccaucccggggccgggaagaccaagcgcuaucugcccgcgaucgugcgugaggcaaucaaacgggggcuccgcacccuaauauuggccccgacgcgcguggucgcggccgagauggaggaggcccugcgcgggcugcccauucgguaccagacccccgccauaaaagccgaauacaccggccgcgagaucguggaccucaugugccacgcuacauucacgaugcggcuucuguccccugugcggguaccuaacuacaaccucaucaucauggaugaggcucacuucaccgacccugccagcaucgcagcccggggguauauuagcacccgcguagagaugggggaggcugcaggcaucuuuaugacggcgacgccgccugggagucgggacccguucccacagagcaacgccccaauuauggaugaggagcgcgagauccccgagagaagcuggaacuccggccacgagugggucaccgacuucaaggggaagaccgucugguucgugccgagcaucaaagcggguaacgacaucgccgccugcuugcgcaagaacggcaagaaggugauccagcuguccaggaagaccuucgacagcgaguacgugaagacgcgcgccaacgacugggacuucgucgugaccaccgacaucuccgagaugggugcgaacuucaaagcagagcggguaaucgacccccgcagaugcaugaagcccgugauccucaccgacggagaggagcgcgucauccuggccggccccaugccggucacccacagcagugccgcccagcggcgcggacgcaucgggcgcaaucccaaaaacgagaaugaccaauacaucuacaugggcgagccucuagaaaacgacgaggacugcgcccacuggaaagaggccaagaugcuccuggacaacaucaacacacccgaggggaucauccccagcauguucgagcccgagcgcgagaagguggacgcuaucgacggcgaauacaggcugcguggcgaggccagaaagaccuucguggaccucaugcgccgcggggacuugccuguuuggcucgcguacaagguagccgcggagggcauuaacuaugccgaucgcaaguggugcuucgacgggaucaagaacaaucagaucuuagaggaaaacauggaggucgaaaucuggaccaaggagggcgagcggaagaagcuaaaaccccgcuggcuggacgccaggauuuacuccgacccgcucgcccugaaggaguucaaagaguucgccgccggccgcaagagcuuaacgcugaaccugaucaccgagaugggucgcuuacccaccuuuaugacccagaaagcccgcaacgcccucgacaaccuagcagugcugcacacggcggaggccggagggcgggccuacaaccacgcacucucugagcugcccgaaacacuggagacccuccuguugcuaaccuuacuggcgacagugacaggcgggaucuuccucuuucugaugagcggcaagggcaucgggaagaugacccuggguaugugcugcauaaucaccgcguccauccuccugugguacgcccagauucagccgcacuggauugcagccucgauuauccuugaguucuuucucaucguacuacugaucccugagcccgaaaagcaacgcacaccccaggacaaucagcucacauacguggugaucgcuaucuuaaccguaguagcagcaaccauggccaacgagaugggauuccuugagaagacgaaaaaggaccucggccuggggucaaucaccacccaggaauccgagagcaacauccuggacaucgaccuccggccggccuccgccuggacucuauacgcaguggccaccacuuuccugacgccgaugcuccgccacagcaucgaaaauuccuccguaaacgugucccugaccgcuaucgccaaccaggccaccgugcugaugggccugggcaaaggguggcccuugagcaagauggacaucggcgucccccugcucgcgauugggugcuauucccaggugaacccgaucacgcugacggcugcccuccuccugcugguggcacauuacgcaaucauaggccccggguuacaggcaaaagccacccgggaggcccagaaacgugccgcggccggcauuaugaagaacccuacagucgacggcaucacagugauagaccuggaccccaucccguacgaccccaaguuugagaagcagcuggggcagguuaugcucuuaauuuuaugcgucacacaggugcucaugaugcggacuaccugggcccugugcgaggcccucacccucgcgaccggccccaucagcacccugugggagggcaacccgggcagguuuuggaacaccacgauugcgguguccauggccaacaucuucagagggaguuaccucgccggagcaggccucuuguuuuccaucaugaagaacaccaccucuacccgccgcgggacgggcaacaucggggagacccuuggcgaaaaguggaaaagccggcucaacgcgcugggcaaaucugaguuccagaucuacaagaaguccgggauccaggaggucgaucgcacccuugccaaagagggcaucaagcgcggugagaccgaccaccacgcagucagccgaggcuccgcuaagcuccggugguucguggagaggaauauggucacgccggaggggaaggugguagaccugggaugcgggcgcgggggcuggagcuauuacugcgggggucugaagaacgucagggaggucaagggucucacgaaggguggucccggacaugaggagcccauccccaugagcaccuaugguuggaaccuggugcggcugcagucaggggucgacguuuucuucaccccgcccgagaagugcgacacgcuccugugcgacaucggcgagucuuccccuaaccccaccauugaggccgggcgcacccugcgggugcucaacuuggucgagaauuggcugaauaacaacacccaguucugcaucaagguccuaaacccguauaugcccagcgugaucgaaaagauggaggcacugcagcggaaguacgguggugcccugguccgcaacccccugucccggaacagcacgcacgagauguacuggguauccaacgccacggggaacaucguaucguccgucaacaugaucagccgcaugcuuauaaauagauucacaaugaagcauaagaaggccacguacgagccggauguggaccugggcuccgggacgcggaacaucggcaucgagucggaggugcccaaccuggacauaaucgggaagcgcaucgaaaagauuaagcaggagcacgagacuuccuggcacuacgaccaagaccaccccuauaaaaccugggccuaucacggcagcuacgagaccaagcagaccggguccgcgagcuccauggucaaugggguggugcggcuccugacgaagccuugggacgucguuccgaugguuacccaaauggcgaugaccgacaccacgcccuucggccagcagcgcgucuucaaggagaaaguagacacucgcacccaggaaccuaaagaggggacgaagaagcugaugaagauaacggcggagugguuauggaaggagcugggaaagaagaaaacgccccguaugugcacccgagaggaguucacucgcaagguacgcuccaacgcggccuugggcgcgaucuuuacggacgagaacaaguggaaguccgcccgggaggccgucgaggaugggcgcuucugggaacucgucgauagagagcgcaaccuacaucuagagggcaagugcgagaccugugucuacaacaugauggggaagagagaaaagaagcucggcgaguucgggaaggcaaagggcagccgcgcgaucugguacauguggcugggcgcucgguuccucgaguuugaagcccuaggcuuccugaacgaggaucauugguucagccgcggcaauucgcugagcgggguagagggggaggggcuccauaggcugggcuacauccugcgcgaggugggcaagaaagaaggcggggccauguacgccgaugacaccgcggggugggacacccggaucacgcucgaggaccugaagaacgaagagauggucaccaaccacaugaagggcgagcauaagaagcuggcagaggccaucuucaagcucacuuaccagaauaagguugugcguguccagcggccgacgccucgggggacggugauggacaucaucucccgccgcgaccagcggggcagcggccaagucgggaccuacggccugaacaccuucaccaauauggaggcccagcugaucagacagauggagggggagggcauuuucaaguccauccagcaucuaacggccaccgaagaaauagcgguccagaacuggcuggugcgugugggccgagagcgccugagccggauggccaucucaggggacgacugcgucguaaaaccaaucgacgaucgcuuugccagcgcccucaccgcacuuaacgauaugggcaaggugcggaaggacauccagcagugggaacccucccgcggguggaaugacuggacacaggucccguucuguagccaccacuuccacgagcuggugaugaaggacggccgggugcucgucgugcccugccgcaaccaggaugagcugaucgggcgagcgaggaucucccaaggagcuggauggucucugaaagagacggccugccuggggaaguccuacgcccagauguggaccuugauguacuuccaucggcgggaucugcgucucgccgcuaacgcuaucugcucugccgugcccucccacuggguccccacuucccgcaccaccuggagcauccaugccaagcacgaguggaugacuaccgaagacaugcuggcaguguggaaccggguguggauccaagagaacccguggauggaagacaaaacccccgucgagaguugggaagaggugcccuaccugggcaaacgcgaggaccaguggugcgggagccugaucggccugaccucccgggccacgugggcuaagaacauccagacagcgaucaaccagguccgcagcuuaaucgggaacgaagaguauaccgauuacaugcccuccaugaagcgguuucgccgagaggaggaggaagccggcgucuuaugguga

SEQ ID NO: 25005 - RNA, 9876 nt, Artificial Sequence
  derived and/or modified CDS sequence (opt11) from DENV-2__EU482620__SS-prME
accgcaggcgucauagugaugcucauaccaacggcaauggcauuccaccucaccacacggaacggugaaccccauaugaucgucggccggcaggaaaaagggaaaagucuauuguuuaaaaccgaagauggcguaaacaugugcacacuuauggcgauagaccuaggcgaauuaugcgaagauacaauaacguacaaaugcccgcuccuacgccagaacgaaccagaagauaucgacugcuggugcaacagcacuucaacguggguaacauaugggaccuguacgacuacaggcgaacaucggcgugaaaagagaucggucgcccuagucccgcauguaggcauggggcuugaaacacgaaccgagaccuggauguccucggaaggagcguggaaacacguucagaggauugagacuuggauacuuagacauccuggcuucacaaucauggcugccaucuuagcauacacuaucgggacgacgcacuuccaaagagcccugaucuucauccuguuaacagcaguggcccccaguaugaccaugaggugcauaggaauuuccaaucgagauuucgucgaaggcgucagcggcgggucauggguagacaucguacuggaacacgggucguguguaacaaccauggccaagaacaaaccgacccucgacuucgaauugaucaaaacagaggccaaacaaccagcaacccugcgaaaguacugcauagaagccaaacucacaaacaccacaacggagucacggugcccuacgcaaggagagccuagucuaaacgaggagcaggacaaacgcuuuauaugcaaacacagcauggucgaucgcggguggggcaacggguguggccucuucggaaaagggggcauagugacaugcgcgauguuuacuugcaagaaaaacauggaaggaaaaguaguccaacccgaaaaucucgaauacacaauagugauaaccccucauaguggcgaggaacaugccgucgggaacgacaccggcaagcacggaaaagagauaaaaaucacaccccaauccucgauaacggaggccgagcuaaccggauacggcacagugaccauggagugcuccccaagaaccggguuagacuuuaacgagaugguccucuugcaaauggaggacaaagcauggcuaguccacaggcagugguuccuggaccuuccacuacccuggcuuccaggagccgacacccaggguucaaacuggauccaaaaagagacccugguaacguuuaagaauccccacgccaaaaagcaggacguaguaguacugggcagccaagaaggugccaugcacacagcauugaccggggcuaccgaaauacagauguccucaggcaaucuauuauucacgggccaucuuaagugucgacuccgcauggacaaacuacagcuuaaaggaaugucauacucaaugugcacgggcaaauuuaaaaucguaaaggaaaucgccgaaacacaacaugggacgauaguuauccggguccaguacgaaggcgauggaaguccaugcaaaauaccguuugagaucacagaccuggaaaaacgacacgucuuagggcgucuaauaacaguuaacccaauagugacggaaaaggacaguccagucaacaucgaggccgagccacccuucggagacagcuacaucauaauaggcguagagcccggacagcuaaagcuaaacugguucaaaaaggggagcagcaucggccaaauguucgaaacgaccaugcggggagcgaaaagaauggcgauccucggggacaccgcaugggauuucggaucgcucggaggaguguuuaccagcaucggaaaagcgcuacaucaaguauucggagccauauacggagcagcguucucaggggugagcuggacgaugaagauacucauagguguaauaaucacauggauaggaaugaacagccgcucaacaagccucucggucucgcuuguccuagucggcgucgucacacucuaccuuggagcggucguacaggccgacucgggaugcgucgugucauggaagaacaaagaacucaagugcggcuccggcauauucauaacagacaacgugcauacauggacggaacaguacaaauuucagcccgaaaguccuagcaaacucgcaucugcuauccagaaagcucacgaggaaggcauaugcgggauacgguccguaacgcgacuagagaacuuaauguggaagcagaucacgccagagcuaaaucacauucuauccgaaaaugaaguaaagcucaccaucaugacgggagauauuaaaggcaucaugcaagcuggaaaacgcucccuuaggccgcaaccaacagaacugaaauacucuuggaaaaccuggggaaaggcaaaaaugcucucuacagagagucacaaccagaccuucuuaaucgacggcccugagacggccgagugcccaaacaccaacagggcuuggaacucucucgaaguagaggacuauggguucggcgucuucacgacaaauaucuggcucaaguugcgagaaaagcaagacguauuuugcgacagcaagcucaugagcgcggcaaucaaagauaacagagccgugcacgccgauaugggauauuggaucgagagcgcacugaacgauacauggaagauggaaaaggcgagcuucauugagguaaagagcugucacuggccaaaaagucacacacuauggagcaauggaguccuagagucugaaaugauaauuccgaaaaauuucgcggggcccguaagccaacacaacuacaggcccggcuaccacacacaaacggcgggaccuuggcaccuagggaagcuagaaauggauuucgacuuuugcgaaggaacaaccguagucgugaccgaggacugcgggaaucgcggcccaucccuacgaacgaccacagccagcggaaaacuaauuacggagugguguugccgaagcugcacacucccaccgcuaagauaccgcggagaagacgggugcugguacggaauggaaaucagaccccugaaagaaaaagaagaaaaccuggugaacagccucgugacggcagggcauggacagauugacaacuucagucuuggaguacuaggaauggcguuguucuuagaagagaugcuucggacaagaaucgggacaaaacacgcgauccuucucguagcgguaucguucgucacacuaaucaccgguaacaugucguuccgggaucucggaagagugauggucaugguuggcgcgacaaugaccgacgacaucggcaugggcgucacguaccuagccuugcuugccgcguucaaaguaagacccaccuucgcugcaggccuucugcugagaaaacuuacaucuaaggagcuaaugauggcuacaaucgggauugcacuccucucccaaagcacaauuccagaaacgauacuagaacuuacggacgcacucgcgcuaggaaugaugguccucaagauaguuaggaacauggagaaauaucagcuugccgugacaaucauggccauuuccugugugccgaacgcagucauacugcaaaacgcauggaaagucaguuguacaauauuggccgccgucagcguaagcccccuccugcuuacauccagccagcagaaggcugauuggauaccacuugcccuaacgauuaaaggacucaauccaacagcgaucuucuuaaccacucucagccgaacaagcaaaaagcgaaguuggccguuaaaugaggcuaucauggccguggguauggucaguauccucgcaucauccuuacucaagaacgacaucccgaugacugggccacugguggcaggagggcugcuaacagugugcuacguccugaccgggcggagcgcggaccucgaauuagagcgagcggcugacguaaagugggaggaucaagcagaaaucagcgggaguagcccaauacugucgauaaccaucagcgaggauggcucaaugaguaucaaaaaugaagaagaggaacaaacccugacgaucuuaaucaggacuggacuccuggucauaagcggcgucuucccgguaucaauaccgauaaccgcggcagcaugguaccuaugggaagucaaaaagcaaagggcuggagugcucugggacguacccagucccccgccgguggagaaagccgaacuggaagauggagccuaccgaauuaaacaacgagguauacuaggauauagucaaaucggggcaggggucuacaaggaaggaacguuccacacaauguggcacguaacaagaggggcggugcucaugcacagggggaaaaggauugaaccgucgugggccgacgugaagaaagaucuaauuucauaugggggcggguggaaacuagaaggggaauggaaagaaggagaagaaguacaagugcuggcacucgagccggguaaaaacccacgggccguucagacgaagccaggcauauucaagaccaacacgggaacgauaggugcagucucacuggauuuuucacccggaacauccggauccccgaucgucgaccgaaaggggaagguaguggggcucuacgggaacgguguggugacccgcuccggcgcuuauguaagcgcgauagcccaaaccgagaaguccaucgaggauaaccccgagauugaggaugacaucuuuagaaagaagcggcucacuaucauggaccuccauccaggagcagggaaaaccaaaagauaccuaccagcgauaguacgagaggcuauaaaacgugggcuacgcaccuugauccuggccccaacacgagucguagcagccgaaauggaagaggcacuacgugggcuaccaauucgcuaucagacaccggcuaucaaaacggagcacacaggccgugaaauugucgaccuaaugugccacgccacauuuacaaugagacuguuaucccccguccgaguccccaacuauaaccuuauaauaauggacgaggcgcauuucacggaccccgcaucgauagcugcccgaggcuacaucuccacgcguguugaaaugggcgaggcugccggcauauucaugacagcaacaccgcccgguucucgcgacccguuuccacagucuaaugcuccaaucauggacgaggaacgagaaauaccagaacggaguuggaacucggggcaugaguggguaacggacuucaaaggaaaaacuguuugguucgugcccagcauaaaagccgggaacgauauugccgcaugucuacgaaagaacgguaagaaaguaauccagcugagccggaaaacguucgacagugaauaugucaaaacaagagcaaacgacugggacuuuguagucacaaccgauauuucggagaugggggcaaacuucaaggcagaacgagucauagacccgcgaagaugcaugaaaccgguaauucuaacagauggcgaagaacgagucauccucgcagggcccaugccaguaacacauaguagugcggcccagcggcgcggccgcaucggccgaaacccgaaaaacgagaaugaccaauacaucuacaugggagagccccucgaaaacgacgaagauugcgcacauuggaaagaagcaaaaauguuauuggacaacauaaacacaccagagggaauaauaccguccauguucgagccggaacgcgagaaagucgaugcaauagacggagaauaccggcuccggggcgaagcuaggaaaacauucguggaccucaugcggagaggagaucugccaguguggcucgccuacaaagucgcugcggagggaauaaacuacaccgaccgcaaguggugcuuugacggaauaaagaacaaccagauacuggaggagaacauggaagucgagauauggacgaaagagggugagaggaaaaagcugaaaccaagaugguuggacgcgcgaaucuacagcgacccgcucgcccuuaaagaauuuaaagaguuugcagcaggccgaaagagccugacccucaaccuaauaacagaaauggggcgccuaccaacauuuaugacccaaaaggcacggaacgcacuugacaaccuggccguccuccauacagccgaggcugguggccgcgccuauaaucaugcgcuaucggaacugccagagacauuagagacccuacuacuccucacguuauuagcuacaguaacgggcggaauauuccucuuccucaugucaggaaaagggauaggcaagaugacccuggguaugugcuguauuauaacggcaagcaucuuacuaugguaugcccaaauacagccacauuggauagccgcgagcaucauccuggaguucuuccuaauaguacugcuaauaccggagcccgaaaaacaacggaccccgcaggacaaccaacuaacuuacguggucaucgcgauacucacaguuguugcugcgacaauggccaaugaaaugggauuucuggagaaaacaaagaaagaucugggacuuggauccauaaccacgcaagaaagcgagagcaacauucuagacaucgacuuacgaccagcuucggccuggacguuauacgcuguagcaacgaccuucgucacacccaugcuacgccauucgaucgaaaauucguccgugaacgucuccuugaccgcgaucgcgaaccaagcaacugugcucauggggcucgguaaagguuggccucucuccaagauggauaucggggucccgcuccucgcgaucggcugcuacagucaagugaaccccaucacccuuacggcagcccucuuacuucuggucgcgcacuaugcaaucauuggccccgggcuacaagcgaaagcaaccagggaagcccaaaagcgagcagcggcaggcauuaugaaaaacccaacggucgauggcauaacggucaucgacuuagaaccaaucccuuaugacccgaaauucgagaaacaacuggggcaaguaaugcugcuaauccugugugucacccaaguccuaaugaugaggaccacgugggcgcugugcgaggcccucacccuagccacggggcccauaagcacucuuugggaagggaauccagggcgguucuggaacaccacgauagcggucuccauggcaaacaucuuucgugggagcuaccuggcaggggcuggcuugcucuuuucaauuaugaaaaacacaacgagcacgaggagagggacuggaaacaucggagaaacgcugggggagaaguggaaaagccgccuaaacgcccuuggaaaaagcgaguuccagauuuacaagaagaguggaauacaagaaguggauaggacccuugcgaaggagggaauaaagcgcggagagaccgaucaccacgcaguaucucgaggaucggcaaagcuaagaugguuugucgaaaggaacaugguaacccccgaaggcaagguggucgaucucggaugcggaaggggaggauggaguuacuacugcggagggcucaagaacgugcgcgaagugaaaggauuaacaaaaggcgggccggggcacgaagaacccaucccaauguccacguauggauggaaccucgugcgccuacagagcggaguggauguauuuuucaccccaccagagaaaugugacacgcugcugugugacauuggcgaaucgaguccaaauccgaccauugaagccggccgcacacucagggugcuaaaccucgucgaaaacuggcucaacaacaacacgcaauucugcauuaaggugcugaacccauacaugcccucagucaucgagaagauggaggcacuccaaagacaauacgguggcgcacuugugcgaaacccccuaagccguaacagcacccacgaaauguacuggguaaguaacgccaccggcaacauaguauccaguguaaacaugaucaguagaaugcucauaaaccgauucacaaugaagcacaagaaagcaaccuacgagccagacguagaccucggcaguggaacgcgaaacauagggaucgaaucagaaauccccaaccucgacaucauuggaaaaagaaucgagaaaauaaagcaagaacacgaaauaagcuggcacuacgaccaggaccauccauacaagacgugggccuaccacgguucauaugaaacuaaacaaacgggaagcgcgaguucaaugguaaaugguguaguacgcuuacucaccaaacccugggacguagugcccaugguaacccaaauggccaugacagacacaacccccuucgggcagcagcgcgucuuuaaggagaagguagauacccggacccaggagccaaaagaaggaacuaagaaacuaaugaaaaucaccgccgaguggcuguggaaagaacugggcaagaagaaaacaccgaggaugugcacaagggaagaguucacccggaaagucagaagcaaugcggcacucggcgccaucuucacagacgagaauaaguggaaaagcgcucgggaggccgucgaagacggucgcuucugggagcuaguggacagagagagaaaccuccaccuggagggcaaaugcgaaacaugcguauacaacaugaugggcaaacgcgagaagaaacuuggggaguuuggcaaagccaaaggcucgagagcgauaugguacauguggcugggcgccagauucuuagaguucgaagccuuaggguuccuaaacgaagaucauugguucagccggggaaauucccuuuccgggguggagggggaaggacuccacaggcugggauauauacucagagacgucggcaaaaaggaaggaggggcaauguacgcugacgauacagcaggaugggacacuaggaucacguuagaggauuugaaaaaugaagagaugguuacuaaccauaugaaaggcgaacacaagaaacuggcugaagcaauuuucaaacuaacguaccagaauaagguaguuagagugcagaggccgacaccaagagggaccgucauggacaucauaagucgacgcgaccagagaggaagcggccagguagggacauacggacucaacacguucaccaacauggaagcacaacugauucggcaaauggagggcgaaggcaucuuuaaauccauacagcacuugacggccacagaggagaucgcuguacagaacuggcuagcacgugugggucgcgaacgccuaagccggauggcaauaucaggagaugacugcguugucaagccuauagacgaccgcuucgccagcgcccugacugcacuaaaugacaugggcaaaguaagaaaagacauccaacaaugggagccaucacgcggguggaacgacuggacgcaaguaccuuucugcucucaccauuuccacgagcuagucaugaaagacggcagagugcuaguggugccauguaggaaccaagacgaauugauaggccgggcacgaaucucccaaggggccggauggagccucaaagaaacugccugucucgggaaauccuaugcacagauguggacacuaauguacuuccaucgucgcgaccuccgccuggcagcaaacgcaaucugcucagcaguccccagucacugggucccaacgucacggaccacauggucgauccacgccaaacacgaguggaugacuacggaggauaugcuagcggucuggaaccggguuuggauacaggaaaacccguggauggaggauaagacaccgguagagagcugggaagaggugccauaccucggaaaacgagaagaccaauggugcggaucgcuaauaggccucacaucccgagcaaccugggcgaagaacauacagaccgccaucaaucagguacguucauuaaucggaaacgaggaguauacggacuacaugccgagcaugaaaagguuccggcgagaggaggaagaagcagggguguuaugguaa

SEQ ID NO: 25006 - RNA, 9876 nt, Artificial Sequence
  derived and/or modified CDS sequence (opt11) from DENV-2__FJ373300__SS-prME
accgcgggcgugaucgucaugcugaucccgaccgccauggcguuccaccucaccacacgcaacggggagccccacaugaucguggggaggcaggagaaagggaaaucccugcuguucaagaccgaggacggcgugaacaugugcacccugauggccaucgaccugggggagcugugcgaggacaccaucaccuauaagugcccccuccugcggcagaacgagcccgaggacaucgacugcuggugcaacagcaccagcaccugggucaccuacgggacuugcaccacuacaggcgagcaccggcgcgagaagagauccguggccuuggugccgcacgucgggaugggccucgagacccgcaccgaaaccuggaugagcagcgagggggccuggaagcacgugcagcggaucgagaccuggauccugcgccacccugguuucaccaucauggccgcgaucuuggccuacaccaucgggaccacgcacuuccagcgggcccuuaucuucauccugcugaccgccguggcgcccagcaugaccaugcgcugcaucggcaucagcaaccgggacuucgucgaaggcguaagcgggggcagcuggguggacaucguccucgagcacgggagcugcgugaccacgauggccaagaacaagccaacccuggacuucgagcugaucaagaccgaggcuaagcaacccgccacccuccgcaaguacugcaucgaggccaagcugacgaacaccaccaccgagucucggugcccgacgcagggcgaacccagccuuaacgaggagcaggacaaacguuucaucugcaagcacuccaugguggaccgaggcugggggaacggcugcgggcuguucggaaagggcggcaucgugaccugcgcgauguucacgugcaagaagaacauggagggcaaggucgugcagcccgaaaaccucgaguacacuauagucaucacgccccauagcggugaggagcacgccgugggcaaugacaccgggaagcacggcaaggaaauaaagaucaccccgcaguccagcaucacggaggccgagcugaccggguacggcacggugaccauggagugcagccccaggaccggccucgacuucaacgagaugguccuucuacagauggaggauaaggccuggcucgugcaccggcagugguuccuggaccugcccuuacccuggcugccgggggccgacacccagggcaguaacuggauccagaaggaaacgcuggugacauucaagaacccccacgcgaagaagcaggacgucgucguacucgggucccaggagggcgccaugcauaccgcccugaccggggccaccgagauccagaugucgagcggcaaccuccuguucacaggccaccugaagugcagacugcggauggauaagcuccagcugaaggggaugagcuacagcaugugcaccggaaaguucaagaucgugaaggagauagccgaaacccagcacggaacgaucgugaucagaguccaguacgaaggcgacggcuccccgugcaagauacccuucgagaucaccgaccucgagaaacggcacguucucgggcgucugaucacuguuaacccgaucgucaccgagaaggacucgcccgugaauauugaggcggagccgcccuucggcgauuccuacaucaucaucgggguggaaccgggucaacugaagcucaacugguucaagaaggggagcuccaucggccagauguucgagacgaccaugcgcggcgccaagcggauggcaauccugggagacaccgcuugggacuucggcucacucgggggcguguucaccuccauagggaaggcacuccaccagguguucggcgcgaucuacggcgcggccuucagcgggguguccuggacgaugaagauccugaucggcgucaucaucaccuggaucgggaugaauagccgcuccaccucucuguccgugagcuuggugcuaguaggcguagugacacuguaccugggggccguagugcaggccgacuccggcugcguggucagcuggaagaauaaggagcucaagugcggcuccgggauauucaucacggacaacgugcacaccuggaccgagcaguacaaguuccagcccgaaucucccagcaaauuggcgucagccauccagaaggcccacgaagaggggaucugcggcauccguucggugacgcgccuggagaaccugauguggaagcagaucacuccggagcugaaucacauccuguccgagaacgaggucaaacucacgaucaugacgggcgauauuaagggcaccaugcaggccggcaagcggagccugcgcccgcagcccacagagcugaaguacuccuggaagaccuggggcaaggcgaagaugcucaguacagaaucgcacaaccagaccuuccuaaucgacgggcccgagacggccgagugcccgaacaccaaccgggccuggaacucacuggagguggaggacuacggcuucgggguguucaccaccaacauauggcucaagcuucgcgaaaagcaggacgucuucugcgacaguaagcugaugagcgccgccauaaaggacaaucgggcggugcacgccgacaugggcuacuggaucgaguccgcccucaacgacaccuggaagauggagaaggccagcuuuaucgaggugaaguccugccacuggcccaagucgcauacgcucugguccaauggaguccuggagagcgagaugaucauccccaagaacuucgccgggcccgugucccagcacaacuacaggccgggcuaccacacccagaccgcggggcccuggcaccucggcaagcuggagauggacuucgacuuuugcgaggggaccaccguggucguuaccgaggacugcggcaaccgggguccaucucugcgcaccaccacugccagcggaaagcucaucaccgaguggugcugccguuccugcacccugcccccgcugcgcuaucggggagaggacggguguugguacggcauggagauccgcccccucaaggagaaggaggagaaccucgugaacagccuggugaccgccgggcacgggcagauugacaacuucucacucggcgugcuggggauggcccuguuccucgaggagaugcugcggacgcgcaucggaaccaagcacgccauccuucucgucgccgucucguucgugacccugaucaccgggaacauguccuucagagacuuaggccgcgugauggucauggugggggccacgaugaccgacgauaucggcaugggcgugaccuaccucgcccugcuggccgcguucaagguccgccccaccuucgccgccgggcuccuguugcggaagcucacgagcaaggagcugaugauggccaccaucggcaucgcccugcucucccaaagcaccauccccgagaccauccuggagcugacggaugcgcucgcccuggggaugauggugcugaagaucgugcgcaacauggagaaguaccagcucgccgucaccaucauggccaucaguugcgugccgaacgccguuauccugcagaacgcuuggaaggucagcugcaccguacucgccgccgucagcgucagcccccuccugcuuaccucaagccagcagaaggccgacuggaucccucucgcgcugacuaucaaggggcugaaccccaccgccauauuccucaccaccuuaucccggacuagcaagaagcgcuccuggccgcugaacgaggccaucauggccguggguauggucucgauccucgccucgucucugcugaagaaugauauacccaugaccgggccgcuagucgcgggcgggcuccugaccgugugcuacgucuuaaccggcaggucggccgaucuggagcucgagcgcgccgccgacgugaaaugggaggaccaggccgagaucuccgggucgucccccauccucagcaucaccaucucugaggacggcagcauguccaucaagaacgaagaggaggagcagacccugacaauccugauccgcaccggccugcuggugaucucagggguuuuccccguguccauccccauaaccgcggccgcaugguaccuaugggagguuaaaaagcagcgcgccggcguccucugggacgugcccagcccaccgccaguagagaaggccgagcuggaggacggggcauaccggaucaagcagaggggcauccuggguuacucccagaucggcgccggcgucuacaaggaggggacguuccacaccauguggcacgugacgcggggcgccgugcucaugcaucgcgggaagagaaucgagcccagcugggcugacgucaagaaggaccugaucuccuacggcggaggcuggaagcuugagggcgaguggaaagagggggaagagguccaggugcucgcgcuggagcccgguaagaacccccgcgcgguccaaaccaagcccgggauauuuaagacgaacaccggcaccaucggggccgugagccuggacuucucccccggcacaagcggcucccccaucguggaccggaaggguaaggucguaggccucuacgguaacggcguggucacgcgcagcggcgccuacguguccgcuauagcgcagaccgagaaguccauugaggacaauccggagaucgaagacgauaucuuccggaagaaaagacuaacuaucauggaccuucaccccggggccggcaagaccaagcgguaccuccccgccaucgugcgcgaggccaucaagagggggcugcgcacgcucauccuggccccgacccgcgucguggccgccgagauggaggaggcccuccggggccuccccauccgcuaccagacccccgccaucaagaccgagcacacggggcgggagaucguugaccugaugugccacgccaccuucaccaugcgccuccugagcccaguccgggugccgaacuacaaccugaucaucauggaugaggcgcacuuuaccgaccccgccuccaucgccgcccggggcuacaucucgacgcggguggagaugggcgaggccgcugggaucuucaugaccgccacuccaccuggcucccgcgaccccuucccccagagcaaugccccgaucauggacgaggaaagggagauccccgaacgcucguggaacagcgggcacgagugggucaccgacuucaagggcaagacggugugguucgugccgaguaucaaggccgggaacgacaucgcggccugccuccggaagaauggcaagaaggucauccaacugagccgcaagaccuucgacuccgaguacgugaagacccgggccaacgacugggacuucguggucaccacggacaucagcgagaugggcgccaacuuuaaggccgagcgcgugaucgaccccagaagaugcaugaaacccgugauccugaccgacggggaagagcggguuauccucgcgggccccaugccggugacccacuccagcgccgcccaacgccgggggcgcaucggccgcaaccccaagaacgagaacgaccaguacaucuacaugggggagccccuugaaaacgacgaggacugcgcccacuggaaggaggcaaagaugcuacucgauaacaucaacacccccgagggaaucaucccguccauguucgagcccgagcgggagaagguggacgcgauagacggcgaguaccgccuacggggggaggcccgcaagaccuuuguagaccuaaugcgacgcggcgacuugcccguguggcuggcuuacaaaguagccgccgaagggaucaacuacgcggaccggaaauggugcuucgacggcaucaagaacaaccaaauccucgaggagaacauggagguagagaucuggaccaaggagggggagcguaagaagcucaagccgcgguggcuggacgcacgcauuuacagcgacccccuggcccucaaggaguucaaggaauucgccgcgggccggaagucccugacccugaaccucauuacagaaaugggccgccugcccacguucaugacucagaaggcccggaacgcucuggacaacuuggccgugcugcacaccgccgaggccgggggccgcgccuacaaccacgcccuuagcgagcuccccgagacccuggagacgcuccuccugcuaacccuccuggccaccguaaccgggggcaucuuccuguuucucauguccggcaaggggaucggcaagaugacccuggggaugugcugcauaaucacggcgucaauccugcucugguacgcacagauccagccgcacuggauagccgccuccaucauccuggaauucuuccugauugugcugcugaucccggagcccgagaagcagcguacgccccaagacaaccaguuaaccuacguggucaucgccauccucaccgugguggccgcgacgauggccaacgaaaugggcuuccuggagaagaccaagaaggaccuggggcuaggcagcauuaccacccaggagucggaauccaacauccuggacaucgaucuacgaccggccagcgccuggacgcucuaugccguggcgaccaccuucgugacgccaaugcugcggcacuccaucgaaaacagcuccguuaacgucagccugacggccauagccaaccaggccaccgugcucaugggucuggggaaggguuggccccuguccaagauggacaucggcgugccccuccuggcgaucggcugcuacagccaggucaacccgaucacccugaccgccgcccuccugcugcuuguggcucacuacgccaucaucggcccaggccugcaggcgaaggccacucgcgaggcccagaagcgggccgcagcgggcauuaugaagaaccccacaguggacgggaucaccgucaucgaccuggagcccaucccguacgaccccaaguucgagaagcagcucggccaagugaugcugcugauccugugcgugacucagguccugaugaugcgcacgaccugggcucucugugaggcccucacccuggccaccgggccaaucucgacgcugugggagggcaaccccgggagauuuuggaacaccacgaucgccgugagcauggcgaacaucuuccgcggcuccuaccucgcaggcgcagggcugcuguucagcaucaugaagaauaccacgucgacccgccggggcaccgggaacauaggugagacucucggcgagaaguggaaaucccgccugaacgcccucggaaaauccgaauuucagaucuauaagaagucaggcauccaggagguggaccggacgcucgcgaaagaggggaucaagcgcggcgagacagaccaccaugccgucagucgggggagcgccaaacuuagaugguucguggagcggaauauggugaccccggagggcaaggucguggaccuaggcugcgggcgcggcgggugguccuacuauugcggcgggcucaagaacgugcgggaggugaagggccugaccaagggcgggcccggccacgaggagcccauucccaugucuacguacggguggaaucuggugcgacuccagagcggcguggacguauucuucaccccgcccgagaagugcgacacccugcugugcgacaucggcgagagcagccccaaccccaccaucgaagccggacggacgcuccgugugcuuaaccugguagagaauuggcucaauaacaacacgcaguuuugcaucaagguccuuaacccguacaugcccuccgugaucgaaaagauggaggcccugcagcgacaguacggcggggcgcuggugaggaacccccugagccggaacuccacccacgagauguacugggucagcaaugccaccgguaacaucguguccucagugaacaugaucucccgcauguuaauaaaccgguucaccaugaagcacaagaaggccacguacgaaccggaugucgaucuggggagcggcacgcgcaacaucgggauagaguccgagaucccgaaccucgacaucaucggcaagcggaucgaaaagaucaagcaggagcacgagauaagcuggcacuacgaccaggaccaucccuacaagaccugggccuaccauggauccuacgagaccaagcagacggguagcgcguccagcauggucaacggaguggucagacugcugacgaagcccugggacgucguuccgauggucacccagauggcgaugacagacacgacgcccuucgggcagcagcgcguguucaaggagaagguggauacccggacgcaggagcccaaggagggcacgaagaaacucaugaagaucaccgccgaguggcuguggaaggagcugggcaagaagaagacgccccggaugugcacucgggaagaguucacgaaaaaaguacgcuccaacgccgcccucggggcuaucuucaccgacgaaaacaaguggaaauccgcaagagaggccguggaggacggucgcuucugggagcugguggaccgggagcgcaaucugcaccucgaggggaaaugcgagaccugcgucuacaacaugaugggcaagcgcgagaagaagcugggggaguucggcaaggccaagggcuccagggcuaucugguacauguggcuaggugcgagauucuuggaguucgaggcccugggcuuccugaacgaggaccacugguucagccgcgggaacagccucuccgggguugagggugaaggcuuacaccgguugggguacauccuccgcgacgucgggaaaaaggagggcggggccauguacgcggaugacaccgccggcugggacacgcggaucacccuggaggaccugaagaaugaagagauggugacgaaccacaugaagggggagcacaagaagcuugcggaggccauuuucaagcugaccuaccagaauaaggucguccgcgugcagcggccgacgccgcgcggcaccguuauggacaucaucucccggcgcgaccagcggggcuccggacaagucggcaccuacgggcugaacacguuuacgaauauggaagcccaacucauccgccagauggagggcgagggcaucuucaagagcauccagcaccucaccgccacugaggagaucgccgugcagaacuggcuggcgagggugggccgagagagacucucccggauggccaucagcggcgacgacugcgucgugaagcccaucgacgaccgcuucgccuccgcguugacggcccuuaaugacauggggaaggugcggaaggauauucagcagugggagcccagccgcggcuggaacgacuggacgcagguaccguuuugcucccaccacuuucacgagcucguaaugaaggacgggcggguguuagucgugcccugccgaaaccaggacgagcuuaucggccgggcgcgcaucagccagggcgccggguggucccucaaggagaccgccugccugggcaagaguuacgcccagauguggacccugauguauuuccaccggcgcgaccuccgacuggccgcgaacgcuaucugcuccgccgucccgucucacuggguccccaccucccgcacgacauggagcauccacgcaaagcacgaauggaugacaaccgaggacaugcuggcgguguggaaccggguguggauccaggagaacccguggauggaggacaagacccccguagaguccugggaggaggugcccuaucucggaaaacgcgaagaccaguggugcggcagccugaucggguuaacgagccgggccaccugggccaagaacauccagaccgccaucaaccaggugcgcucgcucaucggcaacgaggaauauaccgacuacaugcccagcaugaagcgauuucgccgcgaggaggaggaggccggcgucuugugguga

SEQ ID NO: 25007 - RNA, 9876 nt, Artificial Sequence
  derived and/or modified CDS sequence (opt11) from DENV-2__EU596495__SS-prME
accgcgggcgucauagucaugcugaucccgaccgccauggcauuccaccucaccacccgcaacggggagccccacaugaucgugggccggcaggagaaggggaagucccugcuguucaagacugaggacggcgugaacauguguacccucauggccaucgaccugggggagcugugcgaggacaccaucaccuauaagugcccccuacugcgucagaacgagcccgaggacaucgacugcuggugcaacuccaccagcaccugggucacauacgggaccugcaccacgacgggcgagcaccggcgggagaagcgguccguggcccugguaccccacgucgggaugggccucgagacccgcaccgagacuuggaugagcagcgaaggcgccuggaagcacgugcagcggaucgagaccuggauuuuacgccacccgggguucaccauaauggcggcgauccuggcauacaccaucgggaccacgcacuuucagcgggcccucaucuucauccugcugaccgccguggcgccgagcaugaccaugcgaugcauugggauuagcaaccgggauuuugucgaaggcgugagcgggggcagcuggguggacaucguccucgagcacgggagcugcgugacuacgauggcaaagaacaaacccaccuuggacuucgagcugaucaagaccgaggccaagcaacccgccacccuccgcaaguacugcaucgaggcuaagcugacgaauaccacaaccgaaucccggugcccgacgcagggcgagcccagccugaacgaggagcaagacaagcgauucaucugcaagcacuccaugguggaccggggcugggggaacggcugcggccuguucggcaaaggcggcaucgugaccugcgcuauguucacgugcaagaagaacauggagggcaagguggugcaacccgaaaaccuggaauacaccauagucaucacgccccacucgggggaggagcacgccgugggcaacgacaccgggaagcacgguaaagagaucaagaucaccccacagaguagcaucaccgaggccgagcugacaggguacggcacagugaccauggaguguagcccccggaccggcuuggacuucaaugagaugguccugcugcagauggaggacaaagccuggcuggugcaucggcagugguuccuggaucugccccucccuuggcugccgggggcugacacccaaggcagcaacuggauccagaaggagacgcuggugacuuucaagaacccccacgcgaagaagcaggaugucgugguccucgggucgcaggagggcgcgaugcacaccgcacugacaggggcaacggagauccagaugagcagcggcaaccuccucuucaccggccaccugaagugccggcuccggauggacaagcuccagcugaaggggauguccuauuccaugugcacagggaaguucaagaucgugaaggagaucgccgagacgcagcacggaacgaucgugauccgcguccaguacgagggcgacggcucccccuguaagaucccguucgagaucaccgaccuggaaaaacggcacguccucgggcgcuuaaucacugugaaccccaucguuaccggcaaagacagcccugugaacauugaagcggagccgccauucggugacuccuacaucauaauaggcguugagccggggcagcugaagcucaacugguucaaaaagggcagcuccaucggccagauguucgagacgaccaugcggggggccaagcggauggcaauccugggcgacaccgccugggacuucgggucauugggcggggucuucaccuccaucggcaaggcccuccaccagguauuuggcgcgaucuacggugcagccuucuccggcgugucauggaccaugaaaauccugaucggggucaucaucaccuggauaggaaugaauucccgcucaacgucacucucagugagccugguucuugucgggguggugacucuguaccugggcgccgucguucaggcugauuccggcugcguggucucauggaagaacaaggaguuaaagugcgggucuggcaucuucauuacggacaacgugcacaccuggaccgagcaguauaaguuucagcccgaaagcccaagcaagcuggcuuccgcgauccagaaggcccacgaggagggaaucugcggcauccgcagcgugacccgccuggagaaccucauguggaaacagaucacacccgagcugaaucacauccuguccgagaacgaggucaagcucaccaucaugacgggggacaucaaaggcaucaugcaggccggcaagcguucccugcgcccgcaacccaccgaguuaaaguacuccuggaagacuugggggaaggcgaagaugcucagcaccgagucacacaaccagaccuuccugaucgacgggcccgagaccgccgagugcccgaacacgaaccgagcuuggaacagccuggagguggaggacuacggguucggcguguucaccaccaauaucuggcucaaacugcgcgagaagcaggacgucuuuugcgauuccaagcugaugucggccgcuaucaaggacaaccgagcggugcaugccgacaugggcuacuggaucgaaucggcccucaacgauacguggaaaauggagaaggccucguucauagaagugaaguccugccauuggccgaagagccacacccugugguccaaugggguccuggagagcgagaugaucauccccaagaacuucgccgggcccgugucccagcacaauuaccgcccgggguaccacacgcagaccgcaggcccguggcaucucgggaagcuggagauggacuucgacuuuugcgagggcaccaccguggucgugacggaggacugcggcaauagagggccaucacuacgcaccacgacugccagcggaaagcucauuacggaguggugcugccggucuugcacccugccgccgcuucgauaccgcggggaagacgggugcugguaugggauggagauccgcccauugaaggagaaggaggagaaccugguaaacagccuggucaccgccggucauggccagauagacaacuucucccucggggugcuggggauggcccuguuccucgaggagaugcugcgaacccgcauugggacgaagcacgcgauccugcucguggccgucucguucgugacccugaucaccggcaacaugagcuuccgggaccuugggcgcgugauggucauggugggugccaccaugacugacgacauugggaugggggugaccuaccucgcucucuuagcagcguucaaaguccgccccaccuucgcagcgggccucuugcugcggaaguuaaccagcaaggagcugaugauggccaccaucgggaucgccuugcucucccaaucgaccauccccgagacgauccuggagcugaccgacgcgcucgcccuuggcaugaugguguuaaagauagugcgcaacauggaaaaguaccaacucgccguuacgaucauggccaucaguugcgugccgaacgccgugauucugcaaaaugcguggaaggucagcugcaccauccuggccgccguuagcgucaguccccuucugcugaccagcucccagcagaaggccgacuggaucccccucgcgcucaccaucaagggccuuaaccccacggccaucuuccucaccacucugucccggaccagcaaaaagcgcuccuggccgcugaacgaggccaucauggccguggggaugguaagcauacucgccagcagccugcugaagaacgauaucccuaugacaggcccccucguagccggagggcugcugaccgugugcuauguccucaccgggcggagcgccgaccucgagcuggagcgcgccgcagacguaaaaugggaggaccaagcugagauauccggaagcuccccaauucucagcaucaccaucagugaggacgggucgaugagcaucaagaacgaggaggaagagcaaacgcugaccauacucauccggacggggcuccuggucaucucaggcguguucccggucuccauccccaucaccgcggcugccugguaccugugggaggucaagaagcagcgggccggggugcucugggacgucccuagcccgccgcccguggagaaggccgagcuugaggacggcgcguaccggaucaaacagcgugguaucuuaggcuacagccagauaggcgcagggguguacaaggaaggcaccuuccacacgauguggcacgucacccgcggggcggugcucaugcaucggggcaaacguaucgaacccagcugggccgacguuaagaaggaccugauuuccuacgguggaggcuggaaacuagagggagaguggaaggaaggcgaggaaguccaggugcucgcccuggagccagggaaaaauccccgcgcggugcagacaaagccaggcaucuucaagaccaacacggggaccaucggcgccgucagucuugacuucucccccggcacgagcgggucacccauaguggaccggaagggcaagguggucgggcucuacggcaacggcguagucacccgcagcggugccuauguaucugccaucgcgcagacggagaaguccaucgaggacaaucccgagaucgaggacgauaucuuccggaagaagcgccugaccaucauggaccugcaccccggcgccgggaagaccaagagguaucuccccgccaucgugcgcgaggccaucaagcggggucugcggacccugauccuggccccgacgcgcguaguugcggccgagauggaggaggccuugcgggggcugccgauccgcuaccagacccccgcaaucaagaccgagcacacgggacgugagaucguggaucugaugugccacgccacguucaccaugcgccuccucucacccgugcggguaccgaacuacaaccugaucaucauggacgaggcgcacuucaccgaccccgccuccaucgcggcccgcggcuauaucagcacccgggucgaaaugggggaggccgcgggcaucuucaugacugccacgccgcccgggucccgcgacccguucccacagagcaacgcgcccaucauggacgaggagcgggagauccccgagcgcuccuggaacagcggccaugagugggugaccgacuucaagggcaagaccguuugguucgugccguccaucaaggcaggcaacgacaucgcggccugucuccggaagaauggcaagaaggucauccaguuaucacgcaagacauucgacucugaguacgucaagacccgggccaaugacugggacuuuguggugaccacagacaucucugagaugggggccaacuucaaggccgagcgugucaucgacccacgccgcugcaugaagcccgugaucuuaacggacggcgaggaacgggugauccuagcggggccgaugcccgucacccauuccagcgcugcccagcgccgggggcgcauaggucgcaaccccaagaacgagaacgaccaguauaucuacaugggcgagcccuuagagaaugacgaagacugcgcacauuggaaggaggccaagaugcuguuggacaacaucaacacccccgagggcaucaucccguccauguucgagcccgagcgggagaagguagacgcgaucgacggggaauaccgccugcggggcgaggcccgcaagaccuucgucgaccugaugagacgcggggaccuccccguauggcuugcauacaagguggccgccgagggcaucaauuacgcggacagaaaguggugcuucgacgggaucaagaacaaucaaauacuggaggagaacauggagguggagaucuggacgaaggagggcgagcgcaagaagcucaaaccgcgguggcuggacgcccgcaucuacucugauccccuggcucucaaggaguucaaggaguuugccgcgggucggaagucccugacccugaaccugaucacagagauggggcgauuacccaccuucaugacgcaaaaggcucggaacgcccuggacaaucucgccguacuucacaccgcggaggcggguggccgggcauacaaccacgcccuaagcgagcuccccgagacccuggagacccuucugcuguuaacgcuccuggccaccguuaccggcggcaucuuccuguuccucauguccgggaagggaaucgggaagaugaccuuaggcaugugcugcaucauuacugccagcauccugcucugguacgcgcagauccagccgcacuggaucgccgccuccauuauccuggaguucuuccugaucguccucuuaauccccgagcccgaaaagcagcggacgccccaggacaaccagcugacuuacguggucaucgccauacucaccgucguagccgcgaccauggccaacgagaugggguuucuggagaagacaaagaaggacuugggccucggcagcauaaccacgcaggaguccgagucuaauauccuggacaucgaucugcgcccggcuucugccuggacucuauacgccguggcgacgaccuuugucacccccaugcugcggcacucuaucgagaacagcuccgugaacgugagccugacugccaucgccaaccaggccacgguccucauggggcugggcaagggguggccccugagcaagauggacauuggcgugccccugcuggcgaucgggugcuacucacaaguaaacccgaucacacugacggccgcgcuucuacuccucgucgcccacuaugccaucaucggccccggccugcaggcgaaggccacacgcgaggcccagaaacgggccgccgcggggauaaugaagaaccccacgguugacggcauaaccgugaucgaccuggagcccaucccguacgacccgaaguucgagaagcagcuugggcaagucaugcugcuuauacucugcguaacccaggugcugaugaugcgcaccacgugggcccucugugaggcccucacccuggccacaggccccauauccacccugugggaggggaaucccggccgguucuggaacacgaccaucgccgucagcauggcgaacaucuuccgcggcuccuaccuggccggggccggccuacuguucagcaucaugaagaacaccaccuccacucgccgggguaccggcaacauaggugaaacccucggggagaaguggaagucccgccugaacgcucuggguaagucagaauuccagaucuauaagaaguccgggauccaggaaguggaccggacccucgcgaaggagggcaucaagcgcggggagacggaccaccaugccgucucacgggggagcgccaagcugcgcugguucgucgagcggaacauggugaccccggagggcaagguuguugaccuugggugugggcgcgggggcuggagcuacuauugugggggccucaagaacgugcgggaggugaagggccugaccaagggcgggcccggucacgaggagccgauccccaugucgaccuacggcuggaaccuggugcgcuugcagagugggguggacguauucuucacgccgcccgagaagugugacacccugcuaugugacaucggcgaguccagccccaaccccaccaucgaagccggccgaacccuccgcguccucaaccugguggaaaacuggcucaacaauaacacccaguucugcaucaagguguugaaccccuacaugcccucagucaucgagaagauggaggcccugcagcggcaguacgggggcgcacucgugcgcaacccccugagccggaacuccacgcacgaaauguacuggguuagcaacgccaccgggaacaucgucuccagugugaacaugaucagccgcaugcugaucaaccguuucaccaugaagcacaagaaggccaccuacgagccggacgucgaccugggcagcgggacgcgcaauaucggcaucgaguccgaaauacccaaucucgacauaaucggcaagcggaucgagaaaaucaagcaggagcacgagauaagcuggcacuaugaucaggaccaccccuacaagaccugggcauaccacgggucuuacgagacaaagcagaccggcucggcguccagcauggucaacggggugguucggcugcugacgaagcccugggacguuguaccgauggugacccagauggccaugaccgacaccacgccauucggccagcagcgcgucuucaaggaaaagguggauacccggacccaggagcccaaagagggcacaaagaaacucaugaagauuacggccgaguggcuauggaaggagcuggggaagaagaagacgccccguaugugcacccgggaggaguucacgaagaaggugcgcuccaacgccgcccucggagccaucuucaccgacgagaauaaauggaagucagcgcgcgaggcggucgaggacgggcgcuucugggaguugguggaccgggaacgcaacuuacaccucgagggcaagugcgaaacgugcguguauaacaugauggggaaacgggagaagaagcugggagaguucggcaaagcgaaagggucucgcgcuauaugguauauguggcugggcgcgcgguucuuagaguucgaggcacugggcuuccugaacgaagaucacugguucagccgcggcaacagccucuccggggucgagggcgagggccugcaccgacugggcuacauucuccgcgacgucggcaagaaagagggcggggccauguacgccgacgacaccgcgggaugggacacucggaucacguuggaggaucugaagaaugaggagaugguaaccaaccacaugaagggcgagcacaaaaaacuagcggaggcaaucuucaagcucaccuaccagaacaagguggucaggguacagcggccgacuccccgcggcacgguaauggacaucauuucccggcgcgaucaacggggguccggccagguagggaccuacggccugaacaccuuuacgaacauggaggcccagcucauccgccagauggagggcgaggggauauucaagagcauccagcaccugacagccaccgaggaaaucgccgugcagaacuggcuggcacgcguaggccgggagcgacucucccggauggccaucagcggcgacgacugcguggugaagccuaucgacgaucgcuucgccuccgcccugacagcccugaacgacaugggcaaggugcggaaggacauccagcagugggaacccagccgcggguggaacgacuggacccaagugccguucugcucucaucauuuccacgagcucgucaugaaggacggccgggugcuggucgucccgugccgcaaucaggaugagcuaaucggccgggccaggauaagccagggggcgggcuggucccucaaggagacggccugucucggcaagagcuacgcacagauguggacccugauguauuuccaucggagagaccuccgacuggccgcgaacgcgaucugcuccgccgugcccucacauugggugccaaccucacgcaccaccuggucgauccacgccaaacacgaguggaugacgaccgaggacauguuagcagucuggaaucggguuuggauccaggagaacccuuggauggaggacaagacccccguggagucgugggaggaggucccuuaccuaggcaagcgcgaagaccaguggugcgggucccugaucggccuuaccagccgggccacgugggccaagaacauucagaccgcaaucaaccaggugcgcagccucaucggcaaugaagaguacaccgacuacaugcccagcaugaagcgguuccgacgcgaggaggaggaggcaggggugcugugguga

SEQ ID NO: 25008 - RNA, 9876 nt, Artificial Sequence
  derived and/or modified CDS sequence (opt11) from DENV-2__EU596497__SS-prME
accgccggcgugaucgucaugcugauacccaccgccauggcuuuccaccucaccacccgcaacggggagccccauaugauagugggccggcaggagaagggcaagucccugcuguucaagaccgaggauggcgugaacauguguacccuaauggccauugaccugggggagcugugcgaggacaccauaaccuacaagugcccacucuuacgccagaaugaacccgaagauauugacugcugguguaacuccaccagcaccugggucaccuacgggacaugcaccaccacgggggagcaccgccgcgagaagcgcuccguagcucugguuccccacgucgggaugggccuagagacccgcaccgagaccuggaugagcagcgagggggccuggaaacauguccagcggaucgagacguggauccugcgccacccgggcuucaccaucauggcagcgauccucgccuauaccaucgggacgacgcauuuccagcgggcccucauuuucauacuccugaccgcgguugcgcccagcaugaccaugagaugcauaggcauaagcaaccgggauuucgucgaaggcgugagugggggcucgugggucgacaucguccucgaacaugggagcugcgugaccacgauggcuaagaacaaacccacccuggauuuugagcugaucaagaccgaggccaaacagcccgccacccuccgcaaguacuguauagaagcaaagcugacgaacacuaucacugagucccggugcccgacccagggcgagcccagucugaacgaggagcaggauaagagguuuaucugcaagcacuccaugguggaccggggcuggggaaacggaugcgggcucuucgguaagggcgggaucgucacgugcgcgauguucacgugcaagaaaaauauggaaggcaaaguugugcagcccgagaaucuggaauacaccaucgucauaacgccucacagcggggaggagcacgcugugggcaacgacacugggaagcacggcaaggagauaaagaucaccccgcaguccagcaucacugaggccgaacugaccggguacggaacagugacgauggagugcucuccccggacuggacucgauuucaacgagaugguccugcugcagauggaggacaaggccuggcucgugcaccggcagugguuccuggaucugccgcucccauggcugccgggggccgacacccaagggagcaauuggauccagaaagagacccuggugacguucaagaauccucacgcgaagaagcaggaugucguggugcucgggagccaggagggggccaugcacacugcacugacgggggcuacggaaauccagaugagcagcggcaacuugcuguucacgggccacuuaaagugccgccugcggauggacaaguuacagcugaagggaauguccuauagcaugugcaccggcaaguuuaaaauugugaaagagaucgccgagacccagcacgguaccaucgugauccgcguccaauacgaaggcgacggcucccccugcaagauccccuucgagaucacggaccuggagaagaggcacgugcucggccgccugaucaccgugaauccuaucgucaccgagaaggacagcccuguuaacaucgaggcggagccuccauucggcgauuccuacaucaucaucggggucgagccgggacagcuaaagcucaacugguucaagaaggggagcuccauuggccagauguucgagaccacgaugcgcggcgcuaaacggauggcgauccugggggacacagcgugggacuuugggagccucgggggcgucuuuaccucaaucgggaaggcucugcaccagguguuuggcgcgaucuacggcgccgccuucagcggagugucuuggaccaugaagauccugaucggugucaucaucacuuggaucgguaugaauagucgguccacgucccugucugugagcuuggugcucgucggcguugugacccuguaucugggggccgucgugcaggcagacuccggcugcguuguuagcuggaagaacaaagagcucaaguguggcuccggaaucuucauuacagacaacguccacacguggaccgaacaguauaaauuccagcccgagagccccagcaagcuggccucugcgauccagaaggcccacgaggagggcauuugcgggauccgcucggucacgcgccucgagaaccuuauguggaagcagauuacccccgagcugaaccacauuuuguccgagaaugagguaaagcucacgaucaugaccggggacaucaaggggauuaugcaggcgggcaagcguaguuugcgcccgcagcccacagaguugaaguacuccuggaagaccugggggaaggcgaagaugcuaagcacggagucccacaaccaaaccuuccugaucgacggucccgaaacggcagagugcccgaacaccaaucgggccuggaacucccuggaggucgaggauuacggauucggcguguuuacgaccaauaucuggcuaaagcuuagagagaaacaggacgucuucugcgacuccaagcugaugagcgccgccaucaaagacaaccgggcggugcacgccgacaugggcuauuggaucgaguccgcccucaacgauaccuggaagauggagaaggccagcuuuauagaggugaaguccugucacuggcccaagagcuacacccuguggagcaauggcguacuggagucugagaugaucauccccaagaacuuugcagggcccguaucucagcacaacuaccgcccgggcuaccauacccagacggcggggcccuggcaccucggcaaguuagagauggauuucgauuucugcgaggggacaaccgucguugucaccgaggacugcggcaacagaggcccgagccugcgcacgaccacggccagcgggaagcucaucaccgaguggugcugccgguccugcacgcugcccccgcugcgcuaccggggcgaagacggaugcugguauggcauggagauccgcccccucaaggagaaagaggagaaccuggugaacucccuggucaccgcggggcacggccagaucgauaacuucagucucgguguguuagggauggcucuuuuccucgaagagauguugcggacccgcaucggaaccaaacacgcgauccugcuaguggccgucucauucgucacacugauaacaggcaacauguccuuucgggaccuggggaggguuauggucauggugggggccaccaugacggacgacaucggcaugggagugacguaccucgcgcuccucgccgccuucaaggucaggccaaccuucgcugcggggcuucugcugcggaagcucacuaguaaggaguuaaugauggcgaccaucgguaucgcgcugcucucccaaagcacuauacccgagacuauccuggaacugacagaugcccucgcacuggggaugauggugcugaagaucguucggaacauggagaaguaccagcucgccgugaccauaauggccaucuccugcgugccaaacgcagugauacugcagaacgcguggaaaguaagcugcacaauccucgccgccguguccgucagcccgcuacugcugaccuccagccagcagaaggcugacuggaucccccucgcccuuacgaucaagggccuaaacccaaccgcuaucuuccucacgacccuaucccggaccagcaagaagcgcuccuggccgcucaacgaggccaucauggccguggguauggugucaauccucgccuccagccugcugaaaaacgacauccccaugaccgggccacucgucgcgggcggauugcugacggugugcuacgugcucacaggcagaagcgccgaccuggagcuggaacgcgcugccgacgugaagugggaggaccaggccgagauuucggggagcagcccuauucucagcaucacuaucuccgaggacggaagcauguccaucaagaacgaggaggaggagcaaacccugacgauccugauccggaccggucucuuggugaucagcgggguguucccugucuccauccccauaaccgcggccgccugguaccugugggaggugaagaagcaaagagccggcgugcuuugggauguccccucaccaccgccaguugagaaagccgaguuggaggauggggcauaccggauuaagcagcgcggcauccugggguacucgcagaucggcgcuggaguguacaaagaagggacuuuccacaccauguggcaugugacucggggcgcagugcucaugcaccgggggaagcggauagagcccagcugggccgacgugaaaaaggaccugaucuccuacggggggggcuggaagcuggaaggcgaguggaaggaaggggaggagguccagguguuagcccuggagcccggcaagaacccccgcgcggugcagacuaaaccuggaauuuuuaagaccaacaccggcacgaucggggcagucagcuuggacuucucgcccggcaccagcggcucccccaucguggaccggaagggcaaagugguaggccuguacgggaacggcguggugaccaggagcggcgcguacgucuccgccauugcacagaccgagaaaucgaucgaggacaacccugagaucgaggaugacauuuuccgaaaaaagcgccugacgaucauggaccugcaccccggggccgggaagacuaagcgguaccuccccgccauugugcgcgaggccauuaagcgggggcuucggacacugauccuggccccgacccgcguggucgcugccgagauggaagaagcacuccgcggccugcccauacgcuaccaaacgcccgccauuaagaccgaacacacagggcgggagaucguggaccugaugugccaugcaaccuucacgaugagauuacugagccccguacgggucccgaacuacaaccugauaauaauggacgaagcgcacuucaccgacccugccucaaucgcggcccgcggcuacaucaguacgcggguugaaaugggcgaggccgcugggaucuucaugaccgccacaccgcccgggucccgagacccuuucccgcagagcaacgcccccaucauggacgaagagagggagauacccgagcguuccuggaauaguggacaugaguggguuaccgacuucaaaggcaagaccgucugguucgugccgaguaucaaggcugguaacgacauagcggccugccuccggaagaacgguaagaaggugauccaacugucacgcaagaccuucgauagugaguacguuaagacgcgggccaacgacugggacuucgucgugaccaccgacaucagugagaugggcgccaacuucaaggccgagcgcgucauagacccccggcgcugcaugaagcccgugauccugacggacggggaggagcgcgugauccucgcggguccgaugccggucacccacagcagcgccgcccagcgccgggggaggaucggccgcaacccuaaaaacgagaacgaccaguacauauacaugggggagccccuggagaacgacgaggacugcgcgcauuggaaggaggccaagaugcugcucgacaacaucaacacgccagagggcaucauccccuccauguuugagccagagcgggagaagguugacgcgaucgacggagaguaccgccugcgcggcgaggccaggaagaccuucguagaccuuaugcggcgcggcgaucuccccguauggcuggccuacaagguggccgcagaggggauuaauuaugcggaccggaaauggugcuucgacgggaucaaaaacaaccagauacuggaagagaacauggaaguggagaucuggaccaaggagggggaacguaagaagcuuaagccgcggugguuagacgcucgcaucuacagcgacccacuggcccucaaggaguucaaggaguucgccgcgggcagaaagucccucacgcugaaucucaucaccgagaugggcagacugccuaccuucaugacccaaaaagcccgaaacgccuuggauaaccuggccguccugcauacugcugaggccgggggccgcgccuacaaccacgccuugagcgagcuccccgaaacacuggaaacccuucucuuguugacccuacuggccacggugaccgggggcaucuuccuguuccucaugaguggcaaggggaucggcaagaugacgcuagggaugugcugcaucaucaccgccagcauccuucucugguacgcgcagauccagccacauuggauagcagccuccaucauccuggaguuuuuucugaucguccuccugaucccugagccggaaaagcagcggacgccgcaggacaaccagcugaccuauguagugaucgccauccuuaccgucguggccgcgaccauggccaaugagaugggcuuccuggagaagaccaagaaggaccucgggcucgggaguauuaccacccaggagagcgaguccaacauccuggacaucgaccugcgaccggccagcgcguggacucuuuacgcuguggcgaccacguucgucaccccgaugcugcggcacuccauagaaaacagcuccguuaacgugagucugaccgccauagcgaaucaagccaccguccucaugggccuggggaagggcuggccccuguccaagauggauaucggggucccccuccuggcgauuggcuguuacagccaggugaauccaauaacgcugaccgccgcccuccugcugcucgucgcccauuacgcaaucauuggcccgggccugcaggcgaaggcaacccgcgaagcacagaaaagagccgccgcgggaaucaugaagaauccaaccguggaugggaucacggugaucgauuuagagccaauccccuacgaucccaaguucgagaagcagcucggccaggucaugcugcugauccucugcgugacccaggugcucaugaugcgcaccaccugggcguugugcgaggcccucacccuggccaccgggcccaucucgacccugugggagggcaaccccggucgauucuggaauacgacgaucgcggucucgauggcuaacaucuuccgcggcuccuaccuagccggcgccggucugcuuuucagcaucaugaagaacaccaccuccacucgccgggguacggggaacaucggcgagacacugggcgagaaguggaaaagccgccugaacgccuuagggaagucugaguuccaaaucuacaagaaguccggcauucaggaaguggaccggacccuugcgaaggaggggaucaagcgcggcgagaccgaccaccacgccgugucccgggggagcgccaagcugcgcugguuugucgagcgcaacauggugacgccggagggcaaagugguggaccugggcugcgggcgcggcgguugguccuauuauuguggggggcucaagaacguucgggaagugaagggcuuaaccaaaggcggccccggccaugaagagcccaucccuaugagcaccuacggguggaaccuggucaggcuccagagcggaguggauguguucuuuaccccgcccgagaagugcgacacguuacugugcgacaucggcgaguccagccccaacccaaccaucgaagcaggccgaacccuccgcguccugaacuuggucgagaacuggcuaaacaacaacacucaguucugcauuaaggugcugaacccauacaugcccuccguuaucgagaaaauggaggcccugcagagacaguauggcggggcgcucguacgcaacccacugagccggaacaguacccacgagauguauuggguaagcaacgccacuggcaauaucguauccagcguaaacaugaucucccgcaugcugaucaacagguucaccaugaagcauaagaaggccacauacgagccggacguggacuuagggucaggcaccagaaauauagggauagaguccgagauccccaacuuagacaucaucggcaagcggaucgagaagaucaagcaggagcacgagauuagcuggcauuacgaccaagaccaccccuacaagacgugggccuaccacggcucguacgagaccaagcagacugguucagccuccucaauggucaacggcguggugcgccugcugaccaagcccugggacguagugccgauggugacgcaaauggcaaugaccgauaccacccccuucgggcagcagcgcgucuucaaggagaaaguggacacgcggacccaggagcccaaggagggcacaaagaagcugaugaaaaucaccgccgaguggcuauggaaggagcugggcaagaagaagacuccccgcaugugcacccgggaggaguucaccaagaaggugcgcuccaacgcagcucucggggccaucuuuaccgacgagaauaaguggaaguccgccagagaagccgucgaagacggccgauucugggagcugguggaccgggagcgcaaucugcacuuagaggggaagugugagacgugcguguacaacaugaugggaaaacgggagaagaagcugggggaguucggaaaggcgaaggguaguagggccaucugguacauguggcugggggcacgcuuccuugaguucgaggccuugggcuuucugaacgaagaccacugguucagccgcgguaacagccuaucaggugucgagggggaaggacugcaccggcugggguauaucuugcgcgacguggguaagaaggaaggcggggccauguacgccgaugacaccgccggcugggacacccgaaucacccuggaagacuuaaagaacgaggagauggucacgaaccacaugaagggggagcauaagaagcucgcagaggccauuuucaagcugaccuaccagaacaaagucgugcgcguucaacggccgacgccccgcggcaccgugauggauauuaucagccguagagaccagcggggauccggccagguuggcacguacggauugaacaccuucaccaacauggaggcucaguuaauccgccagauggagggcgaagguaucuucaaaagcauacagcaccucaccgccacggaagagaucgccguccaaaauugguuggcgcgcguggggcgggagcgccuaucgaggauggccauaagcggcgacgauugcgucgucaaacccaucgacgaucgcuuugccuccgcccugaccgcccugaaugacauggggaaggugcgcaaggacauccagcagugggagcccagccgcggcuggaacgacuggacccaggugccguucugcagucaucacuuccacgagcucgucaugaaggacgggagggugcugguugugcccugccgcaaucaagaugagcugaucggccgcgcgcgcaucagccagggcgccggguggucccucaaggagaccgcgugccuggggaagagcuacgcccaaauguggacgcugauguacuuccacaggcgcgaccuccgccuggccgcgaacgccaucugcuccgccguuccgagccacugggugcccaccucccgcaccaccuggagcauccacgccaagcacgaguggaugacaacggaggacaugcuggcggucuggaaucggguguggauccaggagaauccguggauggaggacaagacaccugucgagucaugggaggagguccccuaccuaggcaagcgcgaggaucaguggugcggcagccugaucgggcuuaccagccgggcaaccugggccaaaaacauccagacggccaucaaccaggugaggagccuaaucggcaacgaggaguauaccgacuacaugccuagcaugaagcgauuucgccgcgaggaggaggaagcggggguguugugguga

SEQ ID NO: 25009 - RNA, 9876 nt, Artificial Sequence
  derived and/or modified CDS sequence (opt11) from DENV-2__EU569695__SS-prME
accgcggggguaaucgucaugcugauccccacagccauggcauuccaucucaccacgaggaacggcgaaccccauaugaucguugggagacaagaaaaaggaaagucccuucuguuuaagacagaggacggagugaacaugugcacccucauggcuaucgaccucggggaauuaugcgaggauaccaucaccuacaaguguccccuccuacgccagaacgagccugaggacauugauugcuggugcaauagcaccagcaccugggugacguacggaaccugcacaacaaccggggagcacaggcgcgagaagcgguccguggcucuggugccccacgucgggaugggccucgagacccgcaccgagacuuggaugagcagcgagggggcuuggaaacacgugcagagaaucgagaccuggauccugcgucacccgggcuuuaccaucauggccgcuaucuuggcauacaccauagggaccacgcacuuccagcgggcucucaucuuuauccuacucacggccguagcgccuuccaugaccaugcgcugcauaggcaucucaaaccgggacuucgucgagggcgugagcggaggaagcuggguggacaucguccucgagcacgggagcugcgugacgacgauggccaagaauaagcccacccuugacuucgaacugaucaaaaccgaggccaaacagcccgccacccuccgaaaauacugcaucgaggcuaaacugaccaacaccaccacugaaucccggugcccgacgcaaggcgaacccagccugaacgaggagcaggacaagcgcuucaucugcaagcacuccaugguggaccgcggcugggggaacggcugcggccuuuucgggaaaggcggcaucgugaccugcgcgauguucacgugcaagaagaauauggaaggcaagguggugcagcccgagaaccuggaguacaccaucgucaucacgccccauagcggggaagagcacgcgguuggcaacgacaccgggaagcacggcaaagaaaucaagaucacaccgcaguccucgaucacggaagccgaacugacuggguauggcacggugaccauggagugcucgccccggaccggcuuggacuucaaugaaaugguccuccugcaaauggaagacaaggcauggcuggugcacaggcagugguuccuggaccugccccuccccugguugccaggggcugauacacagggaucuaacuggauccagaaggagacgcuggucaccuucaagaacccgcaugcaaagaagcaagacgucguggugcucggaucccaggagggcgccaugcacacugcauuaacuggcgccacggagauccagaugagcagcggcaaccuccuuuucaccggccaccugaagugccgccugcggauggacaaguugcagcugaaggggauguccuacagcaugugcaccggcaaguuuaaaaucgugaaggaaaucgccgagacccagcaugguacgauugugauccgcgugcaauacgagggagacggcucccccugcaagauccccuucgagaucaccgaccuggagaaacggcacguuuuggggcgccugauuacgguuaacccgaucguuacggagaaggauagccccgugaacaucgaggcggaaccgcccuucggcgacucauacaucaucaucgggguggagccgggccagcugaaacuaaacugguucaagaaggguagcuccauaggccaaauguucgagacgaccaugcgcggcgcuaagcggauggcaauccugggagacaccgccugggacuucggcagcuuaggaggugucuucaccucgauugggaaggcccuccaucaggucuucggcgcaaucuacggggcagcguucagcggcgugucuuggacgaugaagauccucaucggcgucaucaucacguggaucgggaugaacagccgcuccacuucgcuuucuguaagccuagugcucgucggggugguaacccuguaccugggugccgucgugcaggcggacuccggcugcgugguaucauggaagaacaaggaacuuaagugcggcuccgguaucuuuaucacggacaacguucauaccuggaccgagcaguacaaauuucaacccgagagcccuagcaagcuggcguccgcaauucaaaaggcccacgaggagggcaucugugggauccggagcguuacgcgacuggagaaccucauguggaagcaaaucacgcccgaacugaaccacauucuguccgagaaugaggucaagcucaccaucaugaccggcgauaucaaggggaucaugcaggcgggcaagcgcagccuccgcccgcagcccaccgaacugaaguacucuuggaagacguggggcaaggcgaagauguugucaacugagucccacaaccagaccuuccugaucgacgggcccgagacagccgagugcccgaacacgaacagggccuggaauagccuagagguugaggacuacggauucgggguguuuacgaccaacaucuggcucaagcugcgcgaaaagcaggacgucuucugcgacuccaaacugauguccgccgccaucaaggacaaccgagcggugcacgccgacaugggauacuggauugaauccgcucucaacgacaccuggaaaauggaaaaggccuccuucaucgaagugaaguccugccacuggcccaagagccacacccugugguccaacgggguccuggagagcgagaugaucauccccaagaacuucgcgggacccgugucccaacacaacuaccgcccggguuaccacacucagaccgcgggacccuggcaccucggaaagcuggagauggacuucgauuucugcgaggggaccacaguggucgucaccgaagacugcggcaaucggggcccgagccugcgcacaacaaccgccagcggcaagcucauuacugaguggugcugccgguccugcacccugccuccguuacgcuaucggggcgaggacgggugcugguacggcauggagauccgcccacucaaggagaaggaggagaaccucgugaacucgcuggucaccgccgggcacggccagauugacaacuucucccucggggugcuggggauggcucuguuucucgaggagaugcugcggacacgcauuggcaccaagcacgcuauccugcucguggcggucucguucgugacccugaucaccgggaacaugucauuccgggaccugggccgcgugauggucauggugggggccacgaugacggaugacaucggcaugggcgugaccuaccucgcgcugcuggccgcguuuaagguccgccccaccuucgccgccgggcuccugcugcggaaacucaccaguaaggagcucaugauggccacgauuggaaucgcacuuuugucccagagcacgauucccgagaccauccuggaacugaccgacgcucucgcacuggggaugauggugcugaagaucgugcguaauauggagaaguaucagcucgccgugacgaucauggccauuucaugcguucccaacgccgugauccugcagaaugcguggaaggugagcugcaccauccuggccgccguguccgucagcccccuccugcugacauccagucagcagaaggccgauuggaucccacucgcgcuaaccauuaagggccugaauccgacugccaucuuccuaaccacccugucccgaacgucuaagaagcgcucuuggcccuugaacgaagccaucauggccgugggaaugguguccauccuugccuccucacuucugaagaacgauauuccgaugacggggccccucgucgccggcggauugcugacgguaugcuacgugcucacuggcaggucugcggaccuggagcuggagcgcgccgccgacgucaagugggaggaccaagccgagauauccggcagcagccccauccuuucaaucaccauaucagaggauggcucaauguccaucaagaacgaggaggaagaacagacgcugaccauccugauccggaccggccuccuggugaucuccgggguguucccgguguccauucccauaaccgcggccgcuugguaccugugggaggugaaaaagcagcgugccggcguacucugggacguccccaguccgccgcccguggagaaggcagagcuggaggauggagcguacaggaucaagcaaagggggauccugggguacucccagauaggcgcgggcguguacaaagaggguacuuuccauacaauguggcacgucacccggggugccguacucaugcaccgcgggaagcgcaucgagcccagcugggccgacgugaagaaggaccucaucuccuauggcggaggcuggaagcuggagggcgaguggaaggagggggaggaggugcaggugcuagcguuagagccaggaaaaaauccaagagcggugcaaacaaaacccggcaucuucaaaaccaacacgggcacaaucggagccgucagccuggauuuuucccccggcaccagcggcucccccaucguggaccggaaggggaaagugguuggccucuacgggaacggagugguaacccgcaguggcgccuauguuuccgccauugcucagacugagaaguccaucgaggacaaucccgagaucgaggacgacaucuuccgcaagaagcgccugaccaucauggaccugcacccgggggccggcaaaaccaagcgguaucuucccgcuaucgugcgugaggcaaucaagcgcggucugaggacccuaauccuggccccaacccgcguggucgcggccgaaauggaggaagcccuccggggccugccaauccgcuaccagacacccgccaucaagaccgagcacaccgggcgggaaauuguggacuugaugugccacgccacuuuuaccaugcgacuccugagccccgugcggguuccgaacuacaaccugaucaucauggacgaggcgcacuucaccgacccugccuccauagccgcccgcggcuacaucucaacccggguagagaugggcgaagcugcgggaaucuucaugacggccacgccgcccggcucccgagacccauucccccagucuaacgcccccauuauggacgaggagcgcgagauccccgaacgcucuuggaacagugggcacgaaugggugaccgacuucaagggcaaaacagucugguucgugccgucuaucaaggccggcaacgacauagcugccugccuccgcaagaacggcaagaaggugauccagcugucccgcaaaacguucgacuccgaguauguuaagacccgggcgaacgacugggacuucgugguaaccaccgacauaucggaaaugggugccaacuucaaggccgaacggguaaucgaccccaggcgcugcaugaagcccgucauccugacggacggggaggagcgggugauccucgcgggccccaugccagucacacacuccagcgccgcccaacggcgggggcggauaggcagaaaccccaagaacgagaacgaccaauacaucuacaugggggagccccuggaaaacgacgaggacugcgcccacuggaaggaggccaagauguugcuggacaacauuaauacucccgaggguaucaucccaucgauguuugaacccgagcgggagaagguggacgcgaucgacggcgaguaucgccuucgcggggaggcgcgcaagaccuucgucgaccuaaugcggcgcggcgacuuacccgucuggcuggccuauaagguggccgccgaagggaucaacuacgccgaccggaaguggugcuucgacgggauuaagaacaaccagauacuggaggagaacauggagguugagaucuggacaaaggagggggagcgcaagaaacucaaaccaagguggcuggacgcccgcaucuacagcgacccccuggcccucaaggaguucaaagaguucgccgcgggccggaaaucccuuacccugaaccucaucaccgagaugggccgccugcccaccuucaugacucagaaggcacggaacgcccuagacaaccucgccguccugcacaccgccgaagcaggcggcagagccuacaaccacgccuuaagugagcuccccgaaacccucgagacgcuacuccuucucacgcugcuggccaccgugaccgguggcauauuccuguuccucauguccggcaaaggcaucggcaagaugacccuggggaugugcuguaucauaaccgccucaauacugcucugguacgcgcaaauccagccucauuggauugccgcauccaucauccuggaauucuucuugauaguccuguuaauccccgagcccgagaagcagcggaccccucaagauaaccagcugaccuacguggugaucgccaucuuaaccguuguagccgcgaccauggccaacgagaugggcuuccuggagaagacaaagaaggacuuggggcucggcagcauaaccacccaggagagcgaguccaacauccuggacaucgaccugcguccggccagcgccuggacgcucuacgccguggcgacgacauucgucacccccaugcugcggcacuccaucgagaacagcuccgugaacguuucacugacugcaguagcgaaccaggccacgguguuaaugggccuggggaaaggcuggccccuguccaagauggacauaggggugccccuccucgcgaucggcugcuacucucaggucaacccgauuacacugaccgccgcccuccugcugcuaguugcucacuacgccaucaucggcccuggcuugcaggcaaaggccacacgggaagcccagaagcgggcggccgcgggcaucaugaagaacccgacgguggacgggaucaccgugauugaucuggagcccauccccuacgaccccaaguucgagaagcaacuaggacagguaaugcugcugauacucugcguaacgcagguccuaaugaugcgaacuacgugggcucugugcgaggcccuaacccuggccaccggcccuaucuccacauuaugggagggcaauccaggccgguuuuggaacacaaccaucgccgugagcauggcgaacauuuuccgcggguccuaucucgcaggugcugggcuguuauuuagcaucaugaagaacaccaccuccacgcgcagagguaccggaaacaucggcgaaacgcucggcgagaaguggaagucucgccugaacgcgcuggggaaguccgaauuccagauauacaagaaguccggaauucaggaaguagaccggacccucgccaaggaagggauuaagagaggcgagacggaccaucacgccgucucccgggggagcgccaagcuccgcugguucguggaacguaacauggucaccccugaggggaaggucguagaccugggcugcgggcgcggcggcugguccuauuacugcggcgggcucaagaacguucgggaggucaagggccugaccaagggcgggccaggccacgaggagcccauccccaugagcaccuacggguggaaccuggucagacuccagucaggcgucgacguuuucuucacgccgccugagaagugcgacacccuucugugcgacaucggggagucaagccccaaccccacgauugaggccggucggacucuccgcgugcugaacuugguggaaaacuggcucaauaauaacacucaguucuguaucaaaguccuaaacccuuauaugcccucaguuaucgagaagauggaagcacugcagcggcaguauggcggggcccucgugcgcaauccccugagccggaacuccacacacgagauguacugggucagcaacgccaccggcaacauugugucuagcgugaacaugaucucacggaugcugaucaaccguuucaccaugaaacauaagaaggccaccuacgagccggacguagaccuggggagcggcacacgcaacaucgggaucgaauccgagauucccaaccucgacaucaucggcaagcggaucgaaaagaucaagcaggagcacgagaucagcuggcauuacgaccaagaccacccauacaagaccugggccuaccacggcuccuaugagaccaagcaaaccgguucugccuccagcauggugaacggagugguccgccuguugacgaagcccugggacguggugccgaugguaacccagauggcgaugaccgacaccacgcccuucgggcagcagcgcguguucaaggaaaaaguagacacacgaacccaggagcccaaggagggcaccaaaaagcucaugaagaucacggccgaguggcuauggaaggaacugggcaagaagaagacgccucgcaugugcacccgggaagaguucacuaagaagguccgcuccaacgccgcccucggggcuaucuucacagacgaaaacaaguggaaguccgcacgggaagcaguugaggacggccgcuucugggagcuggucgaccgggagcgcaaucugcaccucgaaggcaagugcgagaccugcgucuacaacaugaugggcaagcgggagaagaagcuaggugaguucgggaaggccaagggcucgcgagccaucugguacauguggcugggggcccgguuccuugaguucgaggcacugggguuccugaacgaggaccacugguucucccgugggaacaguuuguccggcguggaaggggaggggcuacaccggcucggcuacauccuccgcgacgucggcaaaaaggaggguggggccauguacgcagacgacaccgcgggcugggacacccggauaacucuggaggacuugaagaacgaggagaugguuaccaaccacaugaagggugaacacaagaagcucgccgaggcuaucuuuaagcugacuuaccaaaacaaggugguccgcgugcagcgacccacgccccgcggcacaguuauggacauuaucagccggcgcgaucagcgcggcuccgggcaggucggcaccuacggucugaacacauucacgaacauggaggcccagcucauccgccagauggagggcgaaggcauauucaagucgauccaacaccuaaccgccaccgaggagauugccgugcagaauuggcuggcgcgcguggggcgggagcgccucucucggauggccaucucuggcgaugacugugucgugaagcccaucgaugaucgcuucgccuccgcccugaccgcccucaacgacauggguaaggugcgcaaagauauccaacagugggagcccucucgcggcuggaaugacuggacacaggugccguucugcucacaccacuuccacgagcucgugaugaaagacgggcgagugcuggucgucccaugccgcaaccaagacgagcugauugggcgggcgcgaaucagccagggcgccggguggucacucaaagagacggccugccuggguaaaucuuacgcccaaauguggacccugauguacuuccauaggcgcgaccuccggcuggccgcgaacgccaucugcucugcggugcccagccacuggguccccaccucccgcaccaccuggagcauccacgccaagcacgaguggaugaccaccgaggacaugcuagcgguauggaaccggguguggauccaggaaaacccguggauggaggacaagacgcccgucgaguccugggaggaggugccauaccucggaaagcgcgaggaccagugguguggcagccugauuggccugaccagccgggccaccugggcuaagaacauccagaccgccauuaaccaggugcgcucccuuaucggcaaugaggaguacaccgacuacaugccaucgaugaagcgguuucgccgcgaggaggaggaggccggcguccugugguga

SEQ ID NO: 25010 - RNA, 9876 nt, Artificial Sequence
  derived and/or modified CDS sequence (opt11) from DENV-2__EU482623__SS-prME
accgcugggguuaucgucaugcugaucccaaccgccauggcguuccacuugaccacccgcaauggggaaccgcacaugauugugggucggcaggagaagggaaagucccugcuguucaagaccgaggacggcguuaacauguguacccugauggccauugacuugggggagcugugcgaggacacuaucaccuacaagugcccccuccugcgacaaaaugagcccgaagauaucgacugcuggugcaacagcacgucuacuugggucaccuacgggacuugcaccaccacgggcgagcaucggcgcgagaagcguuccguggcucuggugccccacgucggcaugggccucgagacccgcaccgagaccuggaugagcagugagggggccuggaagcacguucagagaaucgagacuuggauccugcgccauccgggcuucaccauaauggccgcaauccuggccuacaccaucgggaccacucacuuucagcgggcccucaucuucauacugcugaccgcgguggcgcccagcaugacaaugcgguguaucggcaucuccaaccgggacuuugucgagggagugagcgggggcuccuggguggacauuguccucgagcacgggagcugugugaccacgauggccaaaaacaaaccgacccucgacuucgagcugauuaagacggaagccaagcagcccgcuaccuugcgcaaguacugcaucgaagccaaguugacaaauaccaccaccgaaucccgaugcccgacccagggagagccaagucugaacgaggaacaggacaagagauuuauuuguaaacacuccaugguggaccggggaugggggaacggcugcggccuguucgggaagggagggaucgugacgugcgcgauguucacgugcaaaaagaacauggagggaaagguggugcaacccgagaaucuggaguauacgauugucaucacgccccacaguggcgaggagcacgccgucggcaacgauacggggaagcacggcaaggagaucaagaucacaccgcaguccagcauuacugaggccgagcugacuggcuauggcacggugaccauggaauguagcccccggacgggccucgacuucaacgagaugguccugcugcagauggaggacaaggccugguuagugcaccgucagugguuucuggaccugccccuccccuggcugccgggcgcagacacccaggagagcaauuggauccagaaggagacgcuggugaccuuuaagaacccccacgcgaagaaacaggacgucgugguccucggcagucaggagggggccaugcacacggcccugaccggcgccaccgaaauacagaugaguagcggcaaccuccuguucaccggccaccugaaaugccgccugaggauggacaagcuccagcugaaggguaugucguauuccaugugcacugggaaauucaagaucguaaaagagaucgccgagacgcagcacggcacgaucgugauccgcguccaguacgagggggacggcucucccugcaagaucccguucgagauuaccgaccuggagaaacgacacguguuaggcaggcuuaucacggugaacccgauugugaccgaaaaggacagucccgugaacaucgaggccgagccgccguucggggacuccuacaucaucauuggcguagagccugggcagcugaagcucaacugguucaagaagggcucauccaucgggcaaauguucgaaacaaccaugcgcggcgcuaaacgcauggccauccugggcgauaccgccugggacuucgggagccugggcggaguguucaccucaaucggcaaggcauuacaucagguauucggcgcgaucuauggcgcggcauucuccggaguuaguuggaccaugaagauacugaucgggguaaucaucaccuggaucggcaugaacagcaggucuacaagccuguccgugucacuggugcucguaggcguggugacccuguauuuaggugccgucgugcaggcugacuccgggugcguggucagcuggaagaauaaggaguuaaagugcggcuccggcaucuuuauaacggacaacgugcauaccuggaccgagcaguauaaguuccagcccgagagccccucuaagcuggccuccgcuauucagaaagcccaugaggaggggaucugcggcauuagaagugugacccgccuggagaaucugauguggaagcaaaucacgcccgagcucaaccacauccuguccgaaaacgaggucaagcucaccaucaugaccggugacaucaagggcaucaugcaggcggggaagcggucgcuccgcccgcagcccaccgagcugaaguacuccuggaaaaccuggggcaaggcuaagaugcucagcaccgagucccacaaccagacauuccugaucgacggccccgagacggcugagugcccaaacacgaacagagcauggaacucucuggagguggaggacuacggcuuuggcguguucaccaccaacaucuggcucaagcugcgagagaagcaggaugucuucugcgacuccaaguuaaugagcgccgccauuaaggacaaccgggcggugcacgccgacaugggguacuggauagaguccgccuugaacgacaccuggaagauggaaaaggccagcuuuaucgaaguuaaguccugccacuggccgaaaagccacacgcugugguccaacggcguccuggagagcgaaaugaucauccccaagaacuuugccggccccguaucccagcacaacuaucgcccggguuaccacacgcagacagcggguccguggcaccugggaaagcuggagauggacuucgacuucugcgagggcaccaccguugucgugacggaggacugcgguaacagaggcccgucccuucgcaccaccaccgcaagcggcaaacucaucacggaguggugcugucgguccugcacccuccccccgcugcgcuaccguggggaggacggcugcugguacgggauggagauacgcccccucaaggagaaagaggaaaaucuggugaacagccugguaaccgccggccacgggcagaucgauaacuucucucucggcguacucggcauggcauuacuccuggaagagaugcugcggacgcgcaucggcacgaagcaugcgauccuucugguggcugugucuuucguuacacugaucaccggcaacauguccuuccgggaccucgggcgagugauggucauggugggcgccaccaugacggacgauauagguaugggcgugaccuaccuggcccuguuggccgcguuuaaggugcgacccaccuucgccgcgggccuucuguugcggaagcugacauccaaggagcuaaugauggccacaauugggaucgcccuccugagucagagcaccauccccgagaccauccuggaacucaccgacgcucuggcccuaggcaugaugguccucaagauagugcgcaacauggagaaguaccagcuggccgugacgaucauggcuaucuccuguguuccgaacgccgugaucuugcagaacgcauggaagguaagcugcaccauucucgccgccgugucugucagcccccugcuucucaccuccagccaacagaaggccgacuggaucccccuggcgcugacgaucaaggggcucaaccccacugccaucuuccugaccaccuuaucuagaaccucaaagaagaggucuuggccgcucaacgaggccauaauggcggucggcauggugaguauacuggccuccucgcuguuaaagaaugacauccccaugacgggucccuuggucgccggcgggcugcucacuguaugcuacguucugaccgggcgcagcgccgacuuagagcucgagcgagcugccgacgucaagugggaggaucaggccgagaucagugguagcaguccuaucuuaagcauaaccaucagcgaagacgggagcauguccaucaagaaugaggaggaggagcaaacgcugacuauccucauucggaccggccugcuggugaucagcggcguguuuccaguuucgauccccaucaccgcggccgcuugguaucucugggaggugaagaagcagcgcgcugggguguuaugggacguccccagcccaccacccguggagaaggcggaacuggaggacggcgcauaccggaucaagcagcgcgggauucucggcuacucccagaucggugcagguguguacaaggaggggaccuuccacacgauguggcacguaacccguggggcagugcugaugcacaggggcaaacggaucgagcccagcugggccgacguaaagaaggaccugauuucguacggcggcggguggaagcucgagggcgaauggaaagagggagaggagguucagguguuggcccuggagccggggaaaaauccccgggccgugcaaaccaagccaggaaucuucaagacgaacucuggcacgaucggcgcagucucccucgacuucagcccagggaccuccggcagccccaucguggaccggaaggggaagguggucgggcucuacggcaacggaguggugacccgauccggcgcguacgucagcgccauagcgcagaccgagaaguccauugaggacaacccugagaucgaagaugacaucuuccggaaaaagcgccugaccauaauggauuuacaccccggcgccgggaagaccaagcgguaccugcccgccaucguucgcgaagccaucaagcggggccugcgcacguuaauccucgcaccgacccgcguggucgcggcagagauggaggaggcccugagaggauuacccauccgauaccaaacucccgccauuaagaccgagcacaccggucgugagauaguggaucucaugugccacgcaaccuucacgaugcgccugcuguccccgguccggguccccaacuauaaucucaucaucauggacgaagcgcauuucaccgaucccgccaguaucgccgcccgcggauacaucuccacaagaguggagaugggggaggccgccggaauuuucaugaccgccacuccgcccgggucaagagacccguucccucagucgaacgcucccaucauggacgaagagagagagauaccagagagaagcuggaacuccggccacgagugggugaccgacuucaaggggaaaacagugugguucgucccgagcauuaaggccgggaacgacaucgccgcaugccugaggaaaaaugggaagaaggugauacaacugagccgcaagacguucgacagcgaguacguuaagacgcgugcgaucgauugggacuucgugguaacuacggacaucucugagaugggcgccaacuucaaggccgagcgcgucaucgacccgcggcgcuguaugaaacccgugauccucacagacggggaggagcgggugauccuugcggggcccaugccggucacgcacagcucggcggcgcagcgccgaggccgaaucggacgcaaccccaaaaaugagaaugaucaauacauuuacaugggcgagccucuggagaacgaugaggauugcgcacacuggaaggaagccaagaugcucuuagauaacaucaacacgcccgagggaauuaucccgaguauguucgagcccgagcgggagaagguggacgcuaucgacggagaguaccgccuccggggugaggcccgcaagaccuucguggaucucaugaggcgcggugacuuacccgucuggcuggccuauaagguggccgccgagggcaucaacuaugccgaccggaaguggugcuuugacggcaucaagaacaaccagauccucgaggagaacauggagguggagaucuggaccaaggagggcgagcgcaaaaaguugaaaccgcgguggcuggacgcccgcaucuacuccgacccucucgcucugaaggaguucaaggaguucgccgccggacgcaagagccugacgcucaaccucaucaccgaaaugggcaggcuccccaccuuuaugacacagaaagcccggaacgcccuggacaacuuagcgguucugcacaccgccgaagcgggcgggcgcgccuacaaucacgcccucuccgaacuacccgagacccuagaaaccuuacuucugcuaacccuuuuagccacggugaccggcgggaucuucuuguuccugaugagcggaaaggguauuggcaagaugacccucggcauguguugcaucauaacggccuccauccuccugugguacgcgcagauccaaccgcauuggaucgcugcaagcaucauucuggaguucuuccucaucguccuccugauccccgagcccgagaagcagcggacgccccaggacaaccaacucacauauguggugaucgcuauccugacggucguggcugcgacgauggcaaacgagaugggguucuuggagaaaaccaagaaggaucucggccuggggagcauaacgacccaggagucagagucaaacauccuggacaucgaccuccgcccggcgucggcauggacccucuacgccguggcgaccacguucgucacccccaugcugaggcacagcaucgagaacucgucggugaacgugucccucaccgccaucgccaaccaagcaaccgucuugaugggccugggcaaagguuggccgcucagcaagauggauauuggcgugccccugcuggcgauugggugcuacucccagguaaacccuaucacgcucaccgccgcccuccuguugcuggucgcccauuacgccaucaucggccccgggcugcaggcaaaagccacccgcgaggcccaaaagcgggccgccgcgggcauaaugaagaaccccacgguggacgguaucacggugauagaccucgaacccaucccguacgaucccaaguucgagaagcagcuugggcaagucaugcugcucauacugugcguaacccagguacucaugaugcgcaccacuugggcccucugcgaggcccugacgcuggcuaccggccccauaagcacccucugggaggggaaccccggccgguucuggaacacuaccauugccgucuccauggcgaacauauuucgcggcagcuaccuggccggggccggacuccuuuucuccaucaugaagaacaccaccagcacccgccgggggaccggcaacauuggagaaacccugggggaaaaauggaagagucgccugaacgccuugggcaagagcgaguuccagaucuacaaaaaguccgggauccaggagguggauagaaccuuggcgaaggagggcaucaagcgcggggagacagaccaccacgccguuagccguggcuccgccaagcuccgcugguucgucgagcggaacauggugacgccagaggggaagguggucgaccuaggcugcgggcgcgggggcuggaguuacuacugcgggggccugaaaaaugugcgggaggugaaaggacucacuaagggcggccccgggcacgaggagcccauccccaugagcaccuacggcuggaaccuaguccgacugcaguccggaguggacguauucuucaccccgccggaaaagugcgacacgcugcucugcgacaucggagagagcuccccgaaccccacuaucgaggcagggcggaccuugcgcgucuuaaaccucguggagaacuggcuaaacaacaacacccaguucugcaucaagguacugaacccguacaugcccucugucaucgagaagauggaggcccuccagcggcaguacggcggcgcauuaguacgcaacccucugagucggaacagcacccaugagauguacuggguguccaacgcgacggggaacaucgucucauccgugaacaugaucagccgcaugcuuaucaacagguucaccaugaaacauaagaaggccaccuacgaaccggacguagaccuaggcuccgggacucgcaacaucggcauagagagcgagauccccaaccuggacaucaucgggaaacggaucgagaagauaaagcaggagcacgagaucuccuggcacuacgaccaggaucaccccuacaagacgugggccuaccacggcagcuacgagaccaagcaaaccggcuccgccagcagcaugguaaacggcguggugagacuacucaccaagcccugggaugucguuccgauggugacgcagauggcgaugaccgacaccaccccauucggccaacaacgcguuuucaaggagaagguggacacucggacccaagagccgaaggaagggaccaagaagcugaugaaaaucaccgcugaauggcuuuggaaggagcucgggaagaaaaagacgccacgcaugugcacccgggaggaguucaccaagaaaguacgcagcaacgccgcccugggcgcaaucuucaccgacgaaaacaaauggaaauccgcgcgggaggcggucgaggacggccguuucugggagcucguagaccgggagcguaaucuccaccuggagggcaagugcgagacgugcguguacaacaugauggggaagcgggagaagaaacugggcgaguucgggaaggcgaagggaaguagggccaucugguacauguggcucggggcgcgguuucuggaguucgaggcccuaggguuccucaacgaggaccacugguucagccguggcaacucacugucgggggucgagggcgaggggcugcaucggcucggcuacauccugcgcgacgugggcaagaaagaaggcggcgccauguaugccgacgacaccgccggaugggacacccggauaacguuggaggaccuuaagaacgaggagauggucacgaaccacaugaaaggcgagcacaaaaaacuggcggaggccauuuucaaguuaaccuaccagaacaagguggugcgcgugcagcggccgacgccccgugggaccgugauggacauaaucuccaggcgggaccagcggggcucuggccagguggggacguacggccucaauaccuucacaaacauggaggcccagcugauucggcagauggagggggagggcaucuucaaguccauccagcaccugaccgccacggaggaaaucgccguccagaacuggcuugcucgcgugggccgggagcgccugucccgcauggccaucuccggggacgacugcguagucaaacccauugacgaccgcuucgccagcgcccugacugcucucaacgacaugggcaagguccgcaaggacauucagcagugggagcccucccgcggguggaaugacuggacccaaguaccguucugcucgcaccacuuccacgaguuggugaugaaagacggccggguucuggugguccccugucgcaaccaggacgaacucaucggaagggcgcgcaucagccaaggcgccggcuggucccugaaggagaccgccugccuggggaaguccuacgcgcagauguggacccucauguacuuccaccggcgcgaccugcggcucgcugcgaaugccaucugcagcgccguccccucccauuggguacccacuucgcgcaccaccugguccauccaugccaagcacgaguggaugaccacggaggauauguuggccgucuggaaccgcguguggauccaggaaaacccuuggauggaggacaagacgcccgucgagagcugggaggagguccccuaccugggcaagcgcgaggaccaguggugcgggagccugaucggccucaccucccgggcgaccugggccaaaaacauucagaccgccaucaaccaggugcgcagccugauaggaaacgaggaguauaccgacuacaugcccuccaugaaacgguuccgccgcgaggaggaggaggcgggcguccugugguga

SEQ ID NO: 25011 - RNA, 9876 nt, Artificial Sequence
  derived and/or modified CDS sequence (opt11) from DENV-2__EU569698__SS-prME
acugcgggcguuaucgucaugcugauccccaccgccauggcguuccaucucaccacccgcaauggggagccacacaugaucgugggccggcaggagaaaggaaaaucccuacucuucaaaaccgaggacggcgugaacaugugcacccucauggccaucgaccugggggagcucugcgaggacacgaucaccuacaaaugcccccuccugcgccaaaacgagcccgaagacaucgacugcuggugcaacucaaccucgacuugggucaccuacgggaccuguaccacgacgggugaacaccgccgcgagaagcgauccguggcguuaguaccccacgucgggaugggccucgagacccgcacggagaccuggauguccucggagggggccuggaagcacgugcagcggaucgagacguggauccugcgccacccgggcuucaccaucauggccgcgauccuggcguacacuaucggaaccacgcacuuucagcgggcccucaucuucauccugcugaccgccguggcgcccagcaugaccaugcgcugcaucggcaucuccaaccgggacuucgucgagggagucuccgggggcucuuggguugacauuguccucgagcacgggagcugcgugacuacgauggccaagaacaagcccacccuggacuucgagcugaucaagaccgaagcuaagcagccggccacccuccgcaaguacugcaucgaagccaagcugacgaacaccaccacugagucccggugcccgacgcagggcgagccuagccugaaugaggagcaggacaagcgcuucaucugcaagcacuccaugguggaccggggcuggggaaacggcugcggacuguucggcaagggagggaucgugaccugcgcgauguucacgugcaaaaagaacauggaaggcaagguggugcagccagagaacuuagaauacaccaucgugaucacgccccacagcggggaggagcacgccgugggcaacgacaccgggaagcauggaaaggagaucaagaucaccccgcaguccagcauuaccgaggcggagcugaccggguacggcaccgugaccauggagugcagcccccggacuggccucgacuucaacgagaugguccuguuacagauggaggacaaagccuggcucguccaccggcagugguuccuggaccugccgcucccguggcugccgggagccgauacacagggaagcaauuggauccagaaggagacucuggugaccuucaagaauccccacgcgaagaaacaagacgucguuguccucgggucucaggaaggcgccaugcauaccgcccuuaccggcgccacggagauccagaugagcaguggcaaccuccuguucaccggucaccugaagugccgccugcggauggacaaacuccagcugaaggggaugagcuacuccaugugcaccgggaaguuuaagaucgugaaggaaaucgcugagacgcagcacgggaccaucgucauccgaguccaguacgagggcgacggcucccccugcaaaaucccauucgaaaucaccgaccuggagaagcggcacguccucgggcgccugauaacugugaacccgaucgucaccgaaaaggacagccccgugaacauugaggcggagccgccauuuggcgacucuuauaucaucauugguguggaaccgggccagcugaagcucaacugguuuaagaaagggagcuccaucggacaaauguucgaaacgaccaugcggggcgccaagcggauggcuauccugggagauacggccugggacuucggcagccuugggggcgucuucaccuccaucgggaaggcccuccaccaggucuucggcgcgaucuacggcgccgcguucagcggcguguccuggacgaugaaaauccugaucggcgucaucaucaccuggaucgggaugaauagccgcuccacgagccuguccguaagccuggugcuugucggcguggugacccuuuacuuaggggccgucgugcaggcggacuccggcugcguggucucauggaagaacaaggagcuaaagugcggcagugggaucuucauuacggacaacgugcauacguggaccgagcaguacaaauuccagccugagucucccaguaaacuggccuccgcgauccagaaggcccacgaagagggcaucugcgggauccggucgguaacccgccuggaaaaccucauguggaagcagauuacucccgaauuaaaccacaucuuguccgagaacgagguaaaacucaccaucaugaccggcgacaucaaagggaucaugcaggccggcaagcggagccuucgcccgcagccgaccgaacugaaguacucuuggaaaacguggggcaaagcgaagaugcuaagcaccgagucccacaaccagacguuccugaucgaugggcccgagacagcggagugcccgaacacgaaccgagccuggaacucccuggagguggaggacuacggcuuugggguuuucaccaccaacaucuggcucaagcugcgcgagaaacaggacgucuucugcgauucgaagcugaugagcgccgcgaucaaggauaaccgcgcugugcacgccgacaugggcuacuggaucgagucugccuugaacgauaccuggaagauggagaaggccagcuucaucgaggugaaguccugccacuggcccaagagccauacccugugguccaacggcguccuggagagcgagaugaucauccccaagaacuucgccgggcccgugucccagcacaacuaccgcccgggcuaccacacgcaaacagcaggacccuggcaucugggcaagcuggaaauggacuucgacuuuugcgaggggaccacuguggucguaacugaggauugcggcaaccggggccccagccugaggaccacaaccgccagcggaaagcugaucacggaauggugcugccgguccugcacccugcccccgcugcgcuaccggggcgaggacggguguugguacggcauggagaucagaccccucaaggagaaggaggagaaucuggugaacucucuggugaccgccgggcacggccagauagacaacuucagucucggggugcuggggauggcccuguuucucgaggagaugcugcggacccgcaucgggacgaagcacgcgauccuacucguggcugucagcuucguaacccugaucaccgggaacaugagcuuccgggaccugggccgcgugauggucauggugggugcgaccaugacggacgacaucgguaugggugugaccuaccucgcccugcuagccgcguucaagguccgcccaaccuucgccgccgggcuccugcugcguaaguugaccagcaaggagcugaugauggccacgauaggcaucgcucuccucucccagucgaccaucccugagaccauccuggaguuaaccgaugcacucgcccuggggaugauggugcugaagauagugagaaacauggagaaguaccaacucgcggucacgaucauggcgauauccugcgucccgaacgccgugauccuacaaaacgcguggaaggucagcugcaccauccuggcggccguguccgucagcccccuccugcugaccuccagccagcagaaggccgauuggaucccccuugcgcugaccaucaagggccugaaccccacugcaaucuuccucaccacccugucccggaccagcaagaagcgcuccuggccgcugaacgaagccaucauggccgugggcauggugaguauccucgccaguagccugcuuaagaacgacauccccaugacugggccccucguugcgggcggauugcugaccgugugcuacgugcucacaggccguagcgccgacuuggaacuggagcgcgccgcggaugucaaaugggaggaccaggccgagaucuccggcucaucccccauccucagcaucaccaucagugaggauggcuccauguccaucaagaacgaggaggaggaacagacgcugacgauccuuauacguaccgggcuccuugugaucucgggugucuucccggucuccauccccauuacugcggccgcuugguaccugugggagguaaagaagcagcgcgcaggcguacucugggacguccccagcccgccgcccguagagaaggccgagcuggaagacggggcguaucggaucaagcagcgcggcauccugggguacucccagaucggcgccggcguauacaaggaggggacuuuucacacaauguggcacgucacacggggcgccgugcucaugcaucgcgggaagcgaaucgagcccagcugggccgacgugaagaaggaccugaucuccuacggcgggggcuggaaacuggagggcgaauggaaagagggggaggagguacagguguuagcccuugagcccggcaagaacccccgcgcggugcagaccaagcccgggaucuucaaaaccaauacaggcaccauaggagcggucagccuggacuuuuccccuggaacuagcggcuccccgaucguggaccggaaaggcaaggugguggggcucuacggcaaugguguggugacacgcagcggcgccuacgucuccgcaaucgcgcagacagagaaguccaucgaggacaaucccgagauagaagaugacaucuuccggaagaagcgccugaccaucauggaccugcaccccggggccggcaaaaccaagcgcuaucuaccggccaucgugcgcgaagcgaucaagcgggggcuacgcacgcugaucuuagccccgacgcguguggucgcggccgagauggaggaggcucuccguggacugcccauccgcuaccagacacccgccauaaagaccgagcauaccggaagagagaucguggaucugaugugccacgcaacguucaccaugcgccuccugagccccgugcgugucccgaacuacaaucugauuaucauggacgaggcgcacuucaccgauccagcguccaucgcugcccgcggcuacauaagcacccggguugagaugggcgaggccgcggggauuuucaugacggccacgccuccgggcucccgcgacagcuucccgcaguccaacgcccccaucauggacgaggaacgugaaauccccgagcgcagcuggaacuccgggcaugagugggugaccgacuucaaggguaaaaccgucugguucgugcccagcauuaaagccgguaacgacaucgcggccugccugcggaagaacgguaagaaggugauccaguugucccgcaagacguucgacagcgaguacgucaagacucgagccaacgacugggauuucguggugaccaccgacaucuccgaaaugggcgccaacuuuaaggccgaacgcgugaucgacccgcggcgcugcaugaagcccgugauccugacggacggggaggagcgcgugauccucgcggggcccaugcccgucacccacagcuccgccgcccagcgccgagggcgcaucgggcgcaacccgaaaaacgagaacgaccaguacaucuauaugggggagccucuggagaaugacgaagacugcgcgcacuggaaggaggcaaagaugcugcucgacaacaucaacaccccugagggaaucauacccagcauguuugagcccgagcgggagaagguugacgcgauagacggcgaguaccgucugcgcggugaggcccgcaagaccuucguagaccucaugcgucgcggcgaccugcccgucugguuggccuacaaaguggccgcggaaggcauuaauuacgcggaccggaaguggugcuucgacggcaucaagaacaaccagauccuggaggaaaacauggagguggagaucuggacuaaggagggggagcgaaagaaacucaagccccgguggcuggacgcccgcaucuacuccgacccgcuggccuugaaggaguucaaggaguuugccgcgggccguaagagccugacccugaaccuaaucaccgagaugggccgccugccgaccuucaugacccagaaggcgcggaacgcccuggacaaccucgccguccuacacaccgccgaagccgguggccgcgccuacaaccacgcccugagugagcuccccgaaacacuggagacccugcuccugcugacgcuacuggccaccgugaccgggggcaucuuccuguuccucaugagcggaaaagggaucggcaagaugacacuggggauguguugcauuauuaccgccagcauccuccugugguacgcgcagauacagccccacuggaucgccgcuagcaucauccuggaguuuuuccugauugugcuucugaucccggagcccgagaagcagaggacaccccaggacaaccagcugaccuacguggugaucgccauccuaacaguuguggccgcgaccauggcgaacgagaugggcuuccuggagaaaaccaagaaagaccuggggcucgggagcaucaccacacaggaguccgaaagcaacaucuuggacaucgaucugcgccccgccuccgccuggaccuuauacgcgguggcgacgaccuucgucacgccgaugcugcggcacagcauugagaacuccagcgugaacgugucccugacagccaucgccaaccaggccacgguccucaugggccuggggaagggguggccccugagcaagauggacaucggggugcccuugcuggcgaucggcugcuacucccaggugaaccccaucacccugaccgccgcccuuuugcugcucgucgcucauuacgccauuaucgggccgggccugcaggccaaggcgacgcgcgaggcccaaaagcgggccgccgcugguaucaugaagaacccgacuguggacgggaucaccgugaucgaccuggagcccauccccuacgacccgaaguucgagaagcaauuaggccaggucaugcugcucauccucugcguaacccagguccugaugaugcggacgacgugggcacugugugaggcccuaacccuggcgaccgggccgaucaguacucugugggaggguaaccccggccgguucuggaacacgaccaucgccgucuccauggcgaacaucuucaggggcuccuaccucgccggcgccgggcugcuguucucgaucaugaagaauaccacgagcacccgccggggcacagggaacaucggcgagacccucggcgagaaguggaagucccgccugaaugcccugggcaagagcgaguuccaaaucuacaaaaagucaggcauccaggagguggaccggaccuuggcgaaggagggaaucaagcgcggcgagacugaccaucacgccgugagccgggggucugccaagcugcgcugguucguagagcggaacauggucacccccgagggaaaggucgucgaccuggggugcgggcgcggcggauggagcuacuauugcggugggcuuaaaaacgugcgggaggucaaaggcuuaacaaagggcgggccggggcaugaggagcccauccccaugagcacauacggguggaaccugguccggcuccagagcgggguggauguuuucuucacgccgccggagaagugcgacacccugcugugcgacaucggagagagcucccccaaccccaccaucgaggccggccggaccuuacgcguucugaaccugguggagaacugguugaacaauaacacccaguucugcaucaaagugcugaaccccuauaugccgagcguaaucgagaagauggaagcccugcagagacaguacggcggcgcgcucgugcgcaacccucugucccggaacagcacgcacgagauguacugggugaguaacgccacgggcaacaucguaagcuccgugaauaugaucagccgcauguugaucaaccgguucacuaugaagcacaagaaggccacuuacgagcccgacguagaccugggguccggaacgcgcaauauagggauagagagcgagaucccgaaccucgacaucaucgggaagcggaucgagaaaaucaagcaggagcacgaaaucagcuggcauuacgaccaagaccacccguacaaaaccugggcauaucacggaagcuacgaaaccaagcagacggggagugccagcuccauggucaauggcgugguacgccugcugacgaagcccugggacgucguaccaauggugacccagauggcgaugaccgacaccacaccguuugggcagcagcgcgucuucaaggaaaagguagacacacggacccaagagccuaaggaagguaccaagaagcucaugaagaucacggccgaguggcuguggaaggagcugggcaagaagaagacgcccagaauguguacccgggaggaguucaccaagaaagugcgcagcaacgcggcccucggggccaucuucacggacgagaacaaguggaaauccgcucgggaggccgucgaggacggccgcuucugggaguuaguggaccgggagcgcaaccugcaccucgaggggaagugugagaccuguguguacaacaugaugggcaagcgggagaagaagcugggggaguucggcaaggccaagggcagccgcgcaaucugguacauguggcugggggcgcgguuccucgaguucgaggcccugggcuuccugaacgaggaucacugguucagccgcgggaacucucucagcggcgucgagggggagggcuuacaccggcugggcuacauccugcgggauguggggaagaaggagggcggggccauguacgccgacgacaccgccggcugggacacccgcaucacguuagaggaccugaagaacgaggagauggucaccaaucacaugaagggggagcacaagaagcuggcggaggccaucuucaagcugaccuaccagaauaaagugguccggguccagcggcccaccccucgcggcacagugauggacaucauaucccgacgcgaccagcguggcagcgggcaggucggcacauaugggcugaacaccuucaccaacauggaagcccaacuuauaaggcaaauggagggcgagggcaucuucaaguccauacagcaucugaccgcuaccgaggagaucgccguccagaauuggcuggcgcgcguggggcgugagagauugagccggauggccaucuccggcgacgacugcgugguaaagccaaucgacgaccgcuucgcaagcgcucugacugccuuaaacgacauggggaagguacggaaggacauccaacagugggaacccagucgcggcuggaacgacuggacccaggugcccuucugcucgcaccacuuccacgagcucgucaugaaggacgggcggguucugguggucccgugcagaaaccaggacgagcugaucgggcgcgcgcgcaucucccagggcgccgguuggagccucaaggaaacggccugucugggcaaguccuaugcgcagauguggacgcugauguacuuccaccggcgcgaucuccggcuggccgcgaacgccaucugcagugcggugccuagccacugggugcccaccagccggaccaccugguccauccacgcaaaacacgaguggaugacgacggaggacaugcucgcggucuggaaccgaguguggauccaggagaauccuuggauggaggacaagaccccgguggagagcugggaggagguccccuaccuggggaagagagaagaccaguggugcggcagccugaucgggcugaccucucgggccacgugggccaagaacauucaaaccgccaucaaccaggugcgcucgcugaucggcaacgaggaguacaccgacuacaugccaucaaugaagcgguuccgccgugaggaggaggaagcaggcguacugugguga

SEQ ID NO: 25012 - RNA, 9876 nt, Artificial Sequence
  derived and/or modified CDS sequence (opt11) from DENV-2__EU569699__SS-prME
acagcgggggugaucgugaugcugauccccaccgccauggcauuccaucucaccacccgcaacggggaaccacacaugauuguaggccgucaggaaaaggggaagucccugcuguuuaagaccgaggacggcgugaacauguguacccuuauggccaucgaccuaggggagcugugcgaggacaccauuaccuauaagugcccccucuugcgccagaaugagccggaggacaucgacugcugguguaacucgaccagcacgugggucaccuacgggaccugcaccacgacgggcgagcaccggcgcgagaagcggucgguggcccuggugccccacgucgggaugggcuuagagacucgcacagagaccuggaugagcuccgagggggccuggaagcacguacagcggaucgagacguggauccugcgccaccccggcuucaccaucauggccgcgaucuuagcguauaccaucgggacuacacauuuccagagggccuuaaucuucauccuguuaaccgccguggcgccaagcaugaccaugagaugcaucggcauauccaaccgggacuucguagagggcguaagcggaggguccuggguagacaucgugcucgagcacgguagcugcgugaccacuauggccaagaacaagcccacccuggacuucgagcuuaucaagaccgaggccaagcaaccugccacccuucgcaaguacugcauugaggccaagcugacgaacaccacuaccgaaucucggugcccgacgcagggcgagccuagccugaacgaggagcaggauaagagauucaucugcaagcauuccaugguggaucggggcugggguaacggcugcgggcuguucggaaagggcgggaucgugaccugcgcgaaguucacguguaagaaaaauauggaggguaagguaguacagcccgaaaaucuagaauacaccaucguaauaacaccccacagcggggaggaacacgcggugggcaacgauaccgggaagcacgggaaggaaaucaagaucaccccgcagagcagcaucacagaagccgagcugaccggguauggcacggugacgauggaaugcagcccccgaaccggccucgacuucaaugagaugguauuguugcagauggaggacaaggcauggcucgugcaccggcagugguuccuggacuugccccucccguggcugccgggggccgacacgcaggggagcaacuggauccagaaggagacgcucguuaccuucaaaaacccccacgcgaagaagcaagacgucgugguccucgggagccaggaaggcgccaugcacaccgcgcugacgggggcaaccgaaauccaaaugucgagcggcaaccuccucuuuaccggucaucugaagugucgauuacguauggacaagcuccagcucaaggggaugucuuacagcauguguaccgguaaguucaagaucgugaaggagauugcagagacccaacacgggacgauugugauucgcguccaguaugaaggagacggcucccccugcaagauccccuucgagauuaccgaccuggagaagcgacauguccucgggcgucugaucaccgucaaccccaucgucaccgagaaggacagccccgugaacauugaggcggagccgcccuucggcgacuccuacaucaucaucgggguggaaccaggccagcugaaacuuaacugguucaagaaaggcagcuccaucggacagauguucgagacgaccaugcgcggagccaaacggauggcuauccugggggacacagcgugggauuucggcagccucggggguguuuuuaccuccaucgggaaagcccuccaccaaguguuuggggcaaucuacggcgccgcuuucaguggcguguccuggacaaugaagauccugaucggcgugaucaucacguggauagggaugaacagccgcucaacgagccugagugugagccuggugcucgucggcguagugacccuguaccugggagccaugguccaggccgacuccggcuguguggucagcuggaagaacaaagagcucaagugcggcucugggaucuucaucacugauaacguccacacauggaccgagcaguacaaguuccagccggagagccccucuaagcuggcauccgcuauccagaaagcccacgaggaggggauuugcgggauacggagcgugacuaggcucgagaaccucauguggaagcagaucacgccggagcugaaucacauccuuuccgaaaaugaggugaaauugacuaucaugaccggcgacauucgggggaucaugcaggccggcaaacgcagccugcguccgcagcccaccgagcugaaguacuccuggaagacuugggggaaggcuaaaauguuaagcacagagucccacaaccagaccuuccugaucgacggucccgagaccgccgagugcccgaacacuaaccgcgccuggaacagccuggaaguugaggacuauggcuucgguguauucaccaccaacaucuggcucaaacuucgagacaagcaggauguuuucugcgacaguaagcugaugagcgccgcuaucaaggauaaucgcgcuguccacgccgacaugggcuacuggauagaauccgcccucaacgacacguggaagauggagaaggcaucauucaucgaggugaaguccugccacuggccaaaaagccacacccuuugguccaacggcguccuggagagcgagaugaucauacccaagaacuucgcuggcccagucagccagcacaauuaccgacccgguuaucacacgcagaccgcggggcccuggcauuuaggcaagcuggagauggacuuugaccuuugcgaggggacgaccgugguagucacggaagacugcggcaaccgcggccccagccuccgaacaaccaccgcaucggggaagcugaucacugaguggugcugccgcuccuguacccugccuccacuccgguaccgcggcgaggacgggugcugguacggcauggagaucaggccccucaaggagaaggaggagaaccuagugaacagcuugguuaccgccggccacggacagaucgacaacuucagccugggcguccuagguauggcccuccugcucgaggagaugcuccggacucggaucggcacgaaacacgcgauccugcuggucgccgugagcuucguuaccuuaauuaccgggaacauguccuuccgcgaucucggccgcgugauggucaugguaggcgcgacgaugacggacgauaucgggaugggcguaaccuaucuugcccuacuggccgcuuucaaggucaggcccaccuuugccgccggauuacuccugcgcaagcugaccuccaaggagcucaugauggcuacgaucggcaucgcccuacugucccagagcaccauccccgagaccauccuggagcucacagacgcacuagcccucgggaugaugguccuuaaaauagugcggaacauggagaaguaucaacuggccguaacugugauggccaucaguugcgugccaaacgccgugauucuccaaaacgcguggaaggugagcuguaccauccuggccgccgucuccgucaguccccuacucuuaacaagcucacaacaaaaagccgacuggaucccccuggcgcucaccaucaagggucuuaaccccacggcgaucuuucugaccacccucucacgcaccagcaagaagcggucauggccgcugaacgaggccaucauggccgugggcaugguaaguauccuggccuccucacuccuuaagaacgacauucccaugacagguccccucguggcgggcggucugcugaccgugugcuacguguugaccggccgaucggcugacuuggagcucgaacgagccgccgaugucaagugggaggaccaggccgagaucagugggaguucccccauccuaucgaucaccauauccgaggaugguagcaugucaaucaaaaacgaagaggaggagcagacacucaccauucugauccgcaccggccuguuaguaaucagcggggucuucccggucaguauccccaucaccgcugccgcaugguaccugugggagguaaagaagcaacgggcaggagugcugugggacgugcccagucccccaccgguggagaaggccgagcucgaggacggggcguacagaaucaagcaacggggcauccugggguacucccagauaggugccggaguguacaaggaagggaccuuccacacgauguggcacgucacucgaggcgccgugcugaugcacagggggaagcgcauagagcccuccugggcggacgucaaaaaggaccuaauuucguacggugggggcuggaagcuggaaggggaguggaaggagggcgaggagguccagguguuagcacucgagccugggaagaacccccgagcggugcagacuaagcccgggauuuucaagaccaacacuggcaccaucggggcggucagccuggacuucuccccgggcacuucaggcucccccaucguggaccgcaaggggaaggugguuggccuuuacggaaacggcguggugacccgcaguggcgccuacgucuccgccaucgcgcagacggagaaguccauagaggauaaccccgagaucgaggacgacaucuuccguaagaaacggcucacuaucauggacuuacacccuggggccggcaaaaccaaacgauaccugccugccaucgugcgggaggcgaucaagcgugggcuucgcacgcucauccuggccccaacgcgcguggucgcggcagagauggaggaggcccugcgcggccuaccuauccgguaccagaccacugccaucaaaaccgagcacacggggcgcgagaucgucgaccuuaugugucacgcgaccuucacuaugcggcugcugagcccuguucgagucccaaauuauaaccugaucaucauggacgaggcccacuucaccgacccggcguccauagccgcccggggcuacauuuccacgcgcguagagaugggcgaggccgcugggaucuucaugaccgccaccccgcccggaucccgggaucccuucccucagagcaacgcucccaucauggaugaggaacgagagauucccgagagaucguggaacucgggucacgaaugggugacagacuucaaaggcaagacggucugguucgugccauccaucaaagccgggaacgacaucgcggcgugcuuacgcaagaauggcaagaaggugauccagcucucgcggaagaccuucgacucugaguauguuaaaacccgcgccaacgacugggacuucguggugacaacugauaucucagagaugggagccaacuuuaaggccgagcguguaauugacccuagaaggugcaugaaacccguaauacuuaccgacggagaggagcgcgugauacuggcgggccccaugcccgucacccacucaagcgccgcccaacggcgcgggcgaaucgggcggaacccuaagaacgaaaaugaccaauacaucuacaugggagagccccucgagaacgacgaggacugcgcccauuggaaagaggccaaaaugcuacuggauaacaucaauacucccgaaggcauaauccccuccauguucgagcccgagcgcgagaagguugacgcgauugacggcgaguacagauugcguggugaggccagaaaaaccuucguggaccugaugcgucgcggggaccucccaguguggcucgccuacaaaguggcggccgagggaaucaacuacgcggaucguaagugguguuucgacggcaucaaaaacaaucagauccuggaggaaaauauggaaguggagaucuggaccaaagagggcgagcggaagaagcuaaagccucgguggcucgaugcccgaaucuauagcgauccucuggccuuaaaggaguucaaggaguucgcagcgggccgcaaauccuugacucugaaccuaaucacggagauggggcggcucccuacguuuaugacccagaaagcccgcaacgcccuugacaaccuggcggucuuacacacggccgaggccggaggccgggccuauaaccacgcccuaagcgaacugccggaaacccucgagacguuacugcuccugacccuacucgcaaccguuaccggagggaucuuccuguucuuaaugagcggcaagggcaucgggaagaugacccucggaaugugcugcaucauuaccgcguccauccugcucugguacgcgcagauccagccccacuggaucgcugccagcaucauccucgaauuuuuccugaucguccugcucaucccggagcccgagaagcagcgcacaccccaggacaaccagcugacuuaugugguuaucgccauacugaccgucguggcggcgacgauggccaacgagaugggauuuuuggagaagaccaagaaagacuugggccugggcagcaucaccacccaagaaucugaguccaauauuuuagacauagaccugcggcccgcuagcgccuggacgcuguaugccguggcuaccaccuuuguaaccccgaugcuccgccauucuauugaaaauuccaguguuaacguuagccuuacagccaucgccaaccaggcuaccgugcugaugggccucgggaagggcuggccccuguccaagauggacaucggugugccccugcucgcgauaggcugcuacagccaggugaaccccaucacccugaccgccgcccugcugcuguuagucgcgcacuacgccauaaucgggccggggcuccaggcgaaggcgacucgggaggcacagaagcgcgcagcugcgggcaucaugaagaacccuaccgucgacgguaucaccgugaucgacuuagagccaaucccuuacgaucccaaauucgagaagcaguuaggccagguaaugcuccucauucucugcgugacacaggugcugaugaugcggacaaccugggcgcugugcgaggcccuaacccucgcaacuggccccaucuccacccugugggagggcaaccccgggcgcuucuggaacaccacgauugccguuagcauggcgaacaucuuccgcggcuccuaccuggccggcgccgggcuccuauucagcauuaugaagaacaccacgaacacucggcggggcaccgggaacaucggcgagaccuugggagagaaguggaagucucggcucaaugcgcuggguaagagcgaguuccaaauauauaagaaguccggcauccaagaaguugaucgaacccuggcgaaggagggaauaaagagaggcgagaccgaccaccacgccgucagucgcggguccgccaaacuucggugguucgucgagcgcaacauggugacgccggagggaaaggugguagaccuuggcugcgggcgaggcgguugguccuacuacugcggcgggcuuaagaauguucgagaggugaagggacucaccaagggagggccgggccacgaggagcccauccccaugucgacguauggguggaaucuggucagacuacagagcggcguggacguguucuucacaccgcccgagaagugcgauacccuccugugcgacauuggcgagagcucccccaaccccaccaucgaggccggccgaacucugcgggugcucaaccugguggagaauuggcucaauaauaacacgcaguuuugcauaaaggugcucaaccccuauaugcccucggucaucgagaagauggaggcccugcaacgcaaauacggcggagcguuaguacggaacccccugucccgcaauuccacacacgagauguacuggguauccaacgcaaccggcaacauugucucgucagugaacaugauaagccggauguuaaucaaccguuucacuaugaagcacaagaaggcaacguaugagcccgacguggaccugggcuccggcacccgaaacaucgggaucgaaagcgagauccccaauuuagacaucauagggaagcgcaucgagaagaucaagcaagaacacgagaccuccuggcacuacgaccaggaccacccauauaagaccugggcguaccacggcagcuacgagacgaagcagaccggauccgccagcucaauggucaacggcguggugcgccuccugacaaaaccgugggacgucgugcccauggugacucagauggcgaugacggacaccaccccguucgggcagcagcggguauucaaggaaaaggucgacacaagaacgcaggaaccaaaagaggguaccaaaaagcugaugaagaucaccgcggaguggcuguggaaggagcuuggcaagaagaagacgccucgaaugugcacgcgcgaggaguuuacccggaaagugcgcucgaacgcugcucuuggggcgaucuuuacggaugagaauaaguggaaguccgcgcgggaggccguugaggacggcagauucugggaacucguggacagggaacguaaucuucaccuggaggggaagugcgagaccugcguuuacaacaugauggguaaacgggagaagaaauugggggaguuuggaaaggccaagggaucacgggccaucugguacauguggcugggggcgcgguuccuggaguucgaggcccucggauuccugaacgaggaccacugguucagccgcgggaauagccucuccggugucgagggggagggcuuacaccggcugggcuacauccugcgcgacguugggaagaaggaaggcggggccauguaugccgacgacacggccggcugggacacccggauuacuuuagaggaccuuaagaacgaggagaugguaacaaaucacaugaagggggagcacaagaagcuggcugaggccaucuucaagcuaacguaccagaacaaaguggugcgggugcagcgaccgacuccccgcggcaccgucauggacaucaucucccggcgcgaucaacgcggaucugggcaaguagggaccuacgggcugaacacguuuacgaacauggaagcccagcuuauccggcagauggagggcgagggcauuuuuaagucaauccagcaccugaccgccauugaagagaucgcaguccaaaauuggcuggcgcgcguggggcgggagcgcuuaucgcggauggccauauccggcgacgauugcguaaucaaaccuaucgacgacagauucgcauccgcccucaccgcuuugaacgacauggguaagguccgcaaggauauccagcagugggaaccgaguagaggcuggaacgacuggacacaggugcccuucugcucucaccacuuccacgagcugguuaugaaggacgggcggguccugguggugccgugccgcaaucaggacgaguuaauuggcagggcacgcauaucccagggcgccggguggagccugaaggagaccgccugccucggcaaguccuacgcccagauguggacccugauguacuuccaucggcgagaccugcggcucgcggcgaaugccaucugcagcgcagucccuucccacugggugcccaccagccguacuacaugguccauccaugcaaagcacgaauggaugaccaccgaggacauguuagcgguguggaaccggguauggauccaggagaaccccuggauggaggauaagacaccgguggagagcugggaagagguucccuaucuugggaagcgcgaggaccaguggugcggcucccucaucgggcugaccagcagggccacuugggccaagaacauacagaccgccauuaaucagguccgcagccugauuggaaacgaagaguacaccgacuauaugcccaguaugaagagguuccggcgugaagaggaggaggccggcgugcucugguga

SEQ ID NO: 25013 - RNA, 9876 nt, Artificial Sequence
  derived and/or modified CDS sequence (opt11) from DENV-2__KF955366__SS-prME
accgcgggcgucaucgugaugcugauccccacugccauggccuuccaccuuaccacccgcaauggggagccgcacaugaucgugggccggcaggagaaggggaagucccugcuguucaagaccgaagacggcgugaacaugugcacccucauggccauagaccugggggagcuuugcgaagacaccaucaccuacaagugccccuuacugcgccagaacgagcccgaggacaucgacugcuggugcaacagcacuagcaccugggugacguaugggacaugcacaaccaccggcgagcaccggcgcgagaagcggucgguugcucuaguuccccacgucgggaugggccucgaaacccguaccgagaccuggaugagcuccgagggggccuggaagcaugugcaacggaucgagacuuggauucuccgccacccuggcuucaccaucauggccgcgauccuggccuacaccaucgggaccacgcauuuccagcgggcccucaucuucauccuguuaaccgccguggcgcccagcaugaccaugcgcugcaucgggaucuccaaccgggauuucgucgagggcgugagcgggggcuccuggguggacaucguccucgagcacggaagcugcgugaccacgauggccaagaacaagcccacacuggacuucgaguugaucaagaccgaagccaagcaacccgccacccuccgcaaguacugcaucgaggcgaaacuuacuaacaccacaaccgagucccggugcccgacgcagggcgagccaagccugaacgaggagcaggacaagcgcuucaucugcaagcacuccaugguggaccgaggcuggggaaacggcugcgggcuguucggcaaagggggcaucguuaccugcgcuauguucacaugcaagaagaauauggaaggcaaggucgugcagcccgagaaucuugaauacaccaucgucaucacaccccacagcggggaggagcacgccgugggcaacgacaccgggaagcacggcaaggagaucaagaucacaccgcaauccaguaucaccgaggccgagcugaccggguacggcacggugaccauggagugcagcccacggacaggccucgacuucaacgaaauggugcugcuccagauggaggacaaggccuggcucguccacagacagugguuccuggaccugccccuccccuggcugccuggggcggacacccagggaagcaacuggauucagaaggagacucuggugacguucaagaacccacacgcgaagaagcaggacgucgugguccuugggucacaggagggcgcuaugcacaccgcccugaccggggccacggagauccagaugagcagcggcaaucuccuguuuaccggccaccugaagugcagacuccggauggacaagcuccagcucaaggggauguccuacagcaugugcacuggcaaguucaagauagucaaggaaauugccgagacccagcauggaacgaucgugaucaggguccaguacgagggggauggcucccccuguaaaauccccuucgagauaaccgaccuggagaagaggcacguguuagggcggcugaucacagugaacccgaucgucacagagaaggacagcccggugaacaucgaggcugagccucccuucggagacucauacaucaucauagggguggagccaggccagcugaagcuaaacugguucaagaaggggagcagcaucggacagauguucgaaacuaccaugcguggggccaagcggauggcuauccugggggacaccgccugggacuucggaagccucgggggcgucuuuaccucgaucggaaaagcacuccaucagguguucggcgcaaucuacggcgccgccuucagcgggguuuccuggacgaugaaaauccugaucggcgucaucauaaccuggauugggaugaauagucgcuccaccagccuguccgucucgcuggugcucgucggugugguaacccucuaccugggggccgucgugcaagcggacuccgggugugugguuagcuggaaaaacaaggagcucaagugcggcuccgggaucuucauaacggacaacguucacaccuggaccgaacaguacaaguuccaacccgagagcccgagcaaguuagccuccgccauucagaaggcccacgaggagggaaucugcgggauacgcagcgugacccgccuggagaaccucauguggaaacagaucacacccgagcugaaccacauccucuccgagaacgaggucaagcucaccaucaugacgggcgacaucaaggggaucaugcaggcgggcaaacggagccugcgcccgcagcccacagaacugaaguacuccuggaaaacguggggcaaggcgaagaugcucucuaccgaaagccacaaccagaccuucuuaauagacgggccugaaaccgccgagugcccgaauacgaaccgggccuggaacucacucgagguggaagacuacggcuucgggguguucaccaccaacaucuggcuuaaacugcgcgagaagcaggacguuuucugcgauuccaaacucaugagcgcagccaucaaagacaaccgggcgguacacgcggauaugggcuacuggaucgaaucagcccugaacgacacauggaagauggagaaagccagcuucaucgaagugaaguccugccacuggcccaagagccacacccugugguccaacggagucuuggagagcgagaugaucauccccaagaacuucgccgggcccgugucccagcacaauuaccgcccgggcuaccacacgcagaccgcugggcccuggcaccucggcaagcuagagauggacuucgacuucugcgaggggacgaccguggucgugacggaggacugcggcaaccguggccccucccugcgaaccaccaccgccucugggaagcucaucacggaguggugcugccgguccugcacccugccuccgcugcgcuaccggggugaggacgggugcugguacggcauggagauacgcccccucaaggagaaagaggagaaccuggugaacagccugguuaccgccgggcaugggcagaucgacaacuucucccucggcgugcucgggauggcucuguuccuugaggagaugcugcggacccgcaucggaacgaaacacgcgauacugcucguggccgucagcuucgugacccugaucacagggaacauguccuuccgugaccugggccgcgugauggucauggugggugccaccaugacggacgacaucgguaugggcgugacguaccuugcccugcuggccgcguucaagguccgucccaccuuugccgccggccuccuguuacgcaaguuaaccucgaaggagcucaugauggccacgaucggaaucgcccuguugucccagucgaccauccccgagaccauccuggagcugaccgaugcgcucgcccuggggaugauggugcugaaaaucgugcgcaauauggagaaguaccagcucgccgucaccaucauggcgauuuccugcgugccgaacgccgugauccuacagaacgcguggaaggucucaugcacuauccuggccgccgucagcgucagcccccuccugcucacguccagccagcagaaggccgacuggaucccccucgcucugaccaucaagggccucaaccccacggccauuuuccucaccacacuuuccaggaccagcaagaagcggaguuggccgcugaacgaggccaucauggccgugggcauggugagcauucucgccuccagcuugcugaagaacgauauccccaugaccggcccccucgucgcgggcgggcugcugaccgugugcuacgugcucaccggccggagcgccgacuuagagcuggagcgugcggccgaugucaaaugggaggaccaggccgagauaucagggucaucccccauccucagcaucaccauuuccgaggacggcagcaugucaauaaagaacgaggaggaggagcagacgcugaccauccugauccggacaggccuccugguuaucagcgggguguucccugucuccauucccaucaccgcggccgccugguaccugugggaggugaagaagcagcgggccggcguucuuugggacguccccucaccgccgcccguggagaaggccgaacuagaggacggagcguaccggaucaagcagcgcggcauccucggguacucccagaucggagccggcguguacaaggagggcacguuccauacgauguggcaugucacccggggcgccguguuaaugcacagagggaagagaauugagcccagcugggccgacgugaagaaggacuuaaucuccuacggcggaggauggaagcuggaaggcgaguggaaggagggggaggagguccaaguguuagcccuggagcccggcaagaauccacgcgcggugcagacaaagcccgggaucuuuaaaaccaauacgggcaccaucggggcggucagccuagacuucagucccggcaccuccggcucccccaucguggauaggaaagggaagguggucggccucuacgggaacggcguggugacccgcagcggugccuacgucucugccauagcgcagacggagaaguccaucgaggacaaccccgagaucgaggacgauauuuuccggaagaagcgccugaccaucauggaccugcaccccggggccggaaagaccaagcgguaucuccccgccaucgugcgcgaggcuaucaagcgggggcugcgcacgcucauccuggccccgacgcgcguggucgcggccgagauggaggaggccuuacggggccugcccauacguuaccagacgcccgccauuaagaccgagcauaccgggcgggagaucguggaccugaugugccacgccacguuuaccaugcgccuccugagccccguacgcgucccgaacuacaaccucaucaucauggaugaggcacacuucaccgaccccgccuccaucgccgcccgcggguacaucagcacacggguggagaugggcgaggccgcggggauuuucaugacggcaaccucccccggcagccgcgacccguuuccgcaaaguaacgcccccaucauggacgaggagcgggagauccccgagcgcagcuggaacuccggccacgagugggugaccgacuuuaaaggcaagaccgucugguuugugccgagcauaaaggccgggaaugacaucgcagccugcuugcgcaagaacggcaagaaggugauccagcugucccgcaagaccuucgacuccgaguacgucaagacucgggccaaugacugggacuucguugugacaacugacaucuccgagaugggcgccaacuucaaggccgagcgcguaaucgacccgcggcgcuguaugaagcccguaauccugacggacggcgaggagcggguuauccuggcggggccuaugcccgucacccacagcuccgcagcccagcgccggggacgcaucggucgcaacccgaaaaacgagaacgaccaguacaucuacaugggagagcccuuggagaacgacgaggacugcgcucacuggaaagaggcgaagaugcugcucgacaacauuaauacgcccgaaggcaucauccccagcauguucgaaccggagcgggaaaagguggaugcgaucgauggcgaguaucgucugcguggggaggccagaaagaccuucguggacuuaaugcggcgcggcgaccucccugucuggcuggccuacaagguggcugcugaggggaucaacuacgcggaucggaaguggugcuucgacggcaucaagaacaaccagauucuggaggagaacauggagguggagaucuggacgaaggagggggagaggaaaaagcucaagcccagguggcuggaugcccgaaucuacuccgacccgcuggcccucaaggaguucaaagaguucgccgcgggccggaagucgcugacccugaaccuuaucaccgaaaugggccgcuugcccaccuucaugacgcagaaggccaggaacgcgcuggauaaucucgccguauugcacacggcagaggcagggggccgcgcauacaaccacgcuuuguccgagcuccccgagaccuuagagacccugcugcugcucacgcuccuggccaccguuaccggaggcaucuuccuguuccucaugucaggcaaggguaucggcaagaugacccuagggauguguugcaucauaaccgccagcauucugcugugguacgcgcagauccagccccacuggaucgcugccagcaucauccuagaguucuuccugaucgugcuccugaucccggagcccgagaagcaaagaacaccccaggacaaccagcugaccuauguggugauugccauacucacaguaguggccgcgacaauggccaacgagaugggcuuccuggaaaagacgaagaaggaccuggggcucggcagcaucaccacccaagagucugaaagcaauauccuggacaucgaccugcgccccgccuccgccuggacucucuaugccguagcgacaaccuucgucacuccgaugcugcgccacucuauugaaaauucuagcgucaacgugucccugacggccaucgcgaaccaggccaccguccucaugggccucgggaaggguuggccccugagcaagauggacaucggggugccccuccuggcgaucgguuguuacagccaggugaaccccaucacucugaccgccgcccuccugcuucucgucgcccacuacgccaucaucgggccgggccugcaggcgaaggcuacccgcgaggcgcagaagcgggccgccgcagggaucaugaagaaccccaccguggacgggaucaccgugauugaucuggagcccauucccuacgaccccaaguucgaaaaacagcucgggcaggucaugcugcugauccucugcgugacccagguccugaugaugcgcaccacgugggcccugugugaggcccucacccucgccaccgggccaaucagcacccugugggagggcaauccugggcgguucuggaauacgacuaucgccgucucuauggcgaacaucuuccgcggcagcuaccuggccggcgccggguuacuguucuccaucaugaagaacacuacuagcacgcgccgggguaccgggaacaucggcgagacacucggcgagaaguggaagucccgccugaacgcccuggggaaaagcgaauuucaaaucuacaagaagucaggcauccaggagguggaccggacccucgcgaaggaagggauaaagcgcggcgagaccgaccaucacgccguaagccgggggagugcuaaguugcgcugguuugucgaacggaacaugguaacacccgaaggcaagguggucgaccuggguugugggcgcggcggguggagcuacuacugcggcgggcucaaaaacguccgggaggugaagggauugaccaaaggcggcccgggccacgaagaacccauccccaugagcaccuacggguggaaccuugugcgccuccaguccggcguggacguauucuucacgcccccggagaagugcgacacacugcugugcgacauaggggagagcucccccaaucccaccaucgaggccggccgcacccuccgcguucugaaccugguggagaacuggcucaacaacaacacccaguucuguaucaagguuuugaaccccuacaugcccagcgucaucgagaagauggaggcccugcagaggcaguacggcggggcgcucgugcgcaacccacuuucucggaauagcacgcaugagauguacuggguguccaacgcuaccggcaauaucgucagcuccgugaacaugauaagcagaaugcucaucaaucgguucacaaugaagcauaagaaggccacuuacgagccagacguggaccugggguccggcacacgcaacaucgggaucgaaagcgagauuccgaauuuggacauaauuggcaagcgaaucgagaagauaaagcaggagcacgagaucuccuggcauuacgaccaggaccaccccuacaagaccugggcuuaccaugggagcuacgaaacaaagcaaaccggguccgccagcuccauggucaacggcguggugcgccugcugacgaagcccugggacgucgugcccauggugacccaaauggcgaugaccgacaccacgccguucggucagcagcgcgucuucaaggagaaaguggauacccggacccaggaacccaaggagggaaccaagaagcucaugaagaucacggccgaguggcuguggaaagagcugggcaagaagaagacgccccggaugugcacccgggaggaguuuaccaagaaggugcggagcaacgccgcccucggcgccauauucacggacgagaacaaguggaaauccgcgcgugaggccguugaggacggacgcuucugggaacugguggaccgggagagaaaccugcaccucgaggggaagugcgaaaccuguguauauaacaugaugggcaaacgugagaagaagcugggggaguucggcaaggccaaggguagccgcgccaucugguacauguggcugggcgcgcgguuccucgaguucgaggcucugggcuuccucaaugaggaccacugguucagucgcgggaacucccucagcggcguggaaggugagggcuuacaccggcugggcuacauccuccgggacgucgggaagaaggaggguggugccauguacgcagacgacacugccggcugggacacacggauuacgcuggaggacuugaagaaugaggagauggucacaaaucauaugaagggggagcacaagaaguuggcggaggcaaucuucaaacuuacauaucagaacaaaguggugcgcguccagcggccuaccccgcggggcacgguaauggacaucauuucccggcgcgaucagcggggcagcgggcaggucggcacuuacgggcugaacaccuuuaccaauauggaggcacagcucauccgccaaauggagggcgaagggaucuucaaguccauucaacaucugacggccacugaggagauugcuguccagaacuggcucgcucgcgugggacgggaacgccuaagccggauggcaauauccggcgacgacugcguggucaagccaaucgacgaccgcuucgcaucggcccugaccgcccugaaugacauggggaaggugcggaaggacauccagcagugggagcccaguagaggcuggaacgacuggacccaggugcccuuuugcagucaccacuuccacgagcucguuaugaaggacgggcgggugcuggugguuccgugucgcaaccaggacgagcugauaggccgggcacgcaucucucagggggccggauggagccucaaggagacagccugccuagggaaguccuacgcccagauguggacccugauguacuuccaccggagagaucuccggcuggccgcaaacgccaucugcucagcagugccaagucacugggugcccaccagccgcaccaccugguccauccacgccaagcacgaguggaugacgacagaggacaugcuggcgguuuggaaccgcguguggauccaggagaaccccuggauggaggacaagaccccgguggagagcugggaggagguccccuaccucgggaagcgcgaggaccaguggugcggcagccuaaucgggcugacauccagggccacgugggcuaagaacauccagaccgccauuaaccaggugcgcagccucaucggcaaugaggaguacaccgacuacaugccgucuaugaagcgguuccgccgcgaggaggaggaggccggagugcugugguga

SEQ ID NO: 25014 - RNA, 9876 nt, Artificial Sequence
  derived and/or modified CDS sequence (opt11) from DENV-2__EU569700__SS-prME
accgcaggcgugauuguaaugcuaaucccgacggcgauggcauuccaucugaccacccgcaauggagagccgcacaugaucgugggccggcaggaaaaggggaagucccugcuguucaagaccgaggacgggguuaauauguguaccuuaauggcgaucgaccugggcgagcugugcgaggacaccaucaccuacaagugcccgcuacuccgccagaaugaaccugaggacaucgacugcuggugcaacagcaccuccaccuggguaaccuacgggacuugcacuaccacuggugagcaccgcagagagaagcgcuccguggccuuaguuccccacgucgguaugggauuggagacccgcaccgagaccuggaugagcucagagggugccuggaagcacgugcagcggauagagacauggauucugagacauccgggcuucacuauaauggccgcgauccuggcguacaccaucgggaccacgcacuuccagcgggcccucaucuucauccugcugaccgccguggcgcccagcaugacgaugagauguauuggaauaucaaaccgggacuucgucgagggcguuagcggagguagcuggguggacaucgucuuggagcacgguagcugcgugaccaccauggcuaagaauaagcccacccuggacuuugaacugaucaagaccgaggcuaagcaaccugcgacucuacguaaguacuguaucgaggcaaaacuuacuaacaccaccacugaaucccguugcccgacgcaaggagagcccucucucaacgaggaacaggauaaaagguucaucugcaaacauuccaugguagaccggggcugggggaauggcugcgggcuguucggcaaaggcggcaucgugaccugugcgauguucacgugcaagaagaacauggaaggcaagguuguucagccagagaaucuggaguacacgaucgucaucacgccacauaguggagaggagcacgcuguggguaacgacacugggaagcacggcaaggaaaucaagaucaccccgcaauccucgauaaccgaggccgagcugaccggguacgggaccguuacaauggagugcagcccgcggaccggauuggacuucaacgagaugguucuacugcagauggaggacaaggccuggcuaguucaccgucagugguuccuggauuugccccucccaugguuacccggggccgacacccagggcaguaauuggauucagaaagagacgcugguaacauucaagaauccccacgcgaagaagcaagacgucguggucuuggggucccaagaaggggccaugcacacggcccugacaggcgccaccgagauccagaugucaucaggcaaccuccuguucaccggccaccugaagugccgccuccggauggauaaacuucaacugaaggggaugucuuacuccaugugcaccggcaaguucaaaaucgugaaagagaucgcagagacccagcacggaacgauugugauccgcguacaauacgagggugacgguuccccauguaagaucccguucgaaaucacggaccuggaaaagcggcaugugcucggacgacugaucaccgugaacccgaucguuacagaaaaagacucgcccguaaauauagaggcggagccacccuuuggcgacuccuacaucauaaucgggguggagccgggccagcuuaagcucaacugguucaaaaaggggagcuccaucgggcagauguucgagacgacaaugaggggcgccaagagaauggccauccugggggacacggccugggacuucggaucguuagggggcguguucacgagcauugguaaggcauuacaccagguauucggggcgauuuauggcgcugccuucucggggguguccuggaccaugaagauacugauaggcguaaucauaacauggauugggaugaacucacgcaguaccagccuaagcgugucccugguucuggucggcguagucacacuguaccugggagccguugugcaggcggauagcggcugcguagucucauggaagaacaaggaacugaagugcggcuccgggaucuucauaacagacaacgugcacacuuggaccgaacaguauaaguuucagcccgagagccccagcaagcuggcuuccgcgauccagaaagcgcacgaggagggcaucugcgguauccggagcguuaccagacuugagaaucuaauguggaagcagaucacgcccgagcugaaccacauccuuagugagaaugagguuaagcucaccaucaugaccggcgacaucaaggggaucaugcaggcagguaagcggagccugcgcccgcaacccaccgagcugaaauacagcuggaagacguggggcaaggcgaaaaugcugagcaccgagagccacaaccaaaccuucuugaucgacggacccgagacugccgaguguccgaacacgaaccgggcauggaacucacucgagguggaggacuauggcuucgggguauuuaccaccaauaucugguuaaagcugcgcgaaaagcaggacguauuuugcgacuccaaguugaugagugccgcuauuaaggacaaccgggcggugcacgccgacaugggcuacuggaucgaaagugcacucaacgacacguggaagauggagaaagccagcuuuaucgaggugaaguccugccacuggcccaaaucccacacccuguggucaaauggcguccuggagucugaaaugaucauacccaagaacuucgccgggccggugucacaacacaauuaucgcccgggcuaccacacgcagacagcaggaccauggcaucucggcaagcuggagauggauuucgacuucugcgaggguacgacgguggucgugacggaagacugcggcaaccguggucccagccugcgcaccaccacggcgagcgggaagcucaucacggaauggugcugcagaucaugcacccugccgccccugcgcuaccgaggggaggacggguguugguauggcauggagaucaggccccucaaagagaaggaggagaaccuggugaacagucucgucacggccgggcacggucagaucgacaauuucucccucggaguacuugggauggcccuguuccuagaggagaugcuucgaacccgcaucggaacgaagcaugcgaucuuacugguagccgucagcuucgugacccuaaucaccggaaacauguccuuccgggacuuaggccgcgugaugguuauggugggcgcaaccaugacagaugauauuggcaugggggugacauaccucgcgcugcuagcagcguucaagguacgucccaccuucgcagccggccuccugcuucggaagcucaccagcaaggagcugaugauggcuacuaucgggaucgccuugcucucacagagcacaauuccggagaccauccuggagcugacggaugccuuggcccuggggaugaugguucucaaaaucguaagaaacauggagaaauaccaacucgccgucacgaucauggcgaucuccugcguuccgaaugccgucauccugcagaaugcguggaaggucagcugcacuauucuugcagccgugagcgucagcccccuucuguuaaccuccagccagcagaaggcggauuggaucccccucgcgcugaccaucaaggggcugaaccccaccgcuauauuccucacgacccugucacggaccaguaagaagcgauccuggccgcugaaugaggcaaucauggccguaggcaugguuagcauccucgccucuagccugcuuaaaaacgacauccccaugacggggccccuaguggcaggcgggcuucuuacuguuugcuacguccucaccggacggagcgcggaccuggagcucgagcgcgcggccgacgucaagugggaggaccaagccgagauuuccgguagcucucccauccucagcaucacgaucucugaggacggcaguaugucaaucaagaacgaagaggaagaacagacgcuuaccauacugauccggacaggucuccuggugaucagcggggucuucccggucuccauccccauaaccgccgccgcgugguaccugugggagguuaagaagcagcgggccggcgugcucugggacgugccuagcccgccgcccguggagaaagcagagcuggaggauggggcauaccggauuaaacagcgcggcauccugggauacucgcagaucggcgccgggguuuauaaggaagggacuuuccacacgauguggcacgucacccgaggcgccgugcuuaugcaccgcgggaagcggaucgagccgagcugggccgacgugaagaaggaccuuaucucguauggcgggggcuggaaauuagagggcgaguggaaggagggggaggagguacaggugcucgcccuggagcccggcaaaaacccccgcgcgguacagaccaaaccgggcaucuuuaaaaccaauacuggcaccaucggugcggugucgcuggacuucucccccggcaccagcgguaguccuaucgucgaccgcaagggcaagguggucggcuuauacgggaacggcgucgugacccgcagcggcgcuuacguguccgcaaucgcccagacagagaaauccaucgaggauaacccagagauagaggacgacauauuucggaaaaagcgccugaccauuauggaccuucauccuggggccggcaaaaccaagagauaccuaccggcaaucgugcgcgaggccaucaaacggggccugcgcacccucauccuggccccgacgcgcgugguugcggccgagauggaagaggcccuccgagggcugcccauccgcuaccagacccccgccauuaagacggaacacaccggacgggaaaucguggaccugaugugucaugcuacauucaccaugcgccuccugucgccugugcggguaccgaacuauaaccugauaauaauggacgaggcgcacuucaccgacccggccucuaucgccgcccgaggcuacaucagcacccggguggagaugggcgaggccgcagguaucuuuaugacggccacaccacccggcucccgcgauccauucccccagagcaaugccccgauuauggacgaggagcgggagauccccgaacgcuccuggaacucuggccacgaaugggugaccgacuucaagggaaagaccgucugguucgugccgucuaucaaggccggaaacgacaucgcggcuuguuuacguaagaauggcaagaaggucauccagcuuagucgcaagacguuugauuccgaguacgugaaaacucgggccaaugacugggacuuugucguaaccaccgauaucagcgagaugggugccaauuuuaaggccgagcgcgucauagauccccggcgcugcaugaagcccgugauccugacggacggggaggagcgggugauccucgcgggccccaugccggucacgcauuccagcgccgcacagagacgggggcgcauaggacgcaacccaaagaacgagaacgaccaauacauuuacaugggggagccacuagaaaacgacgaagacugcgcacacuggaaggaggcuaagaugcugcucgacaacauuaacaccccggagggcaucaucccgaguauguucgagccagagcgggagaagguugacgcgaucgacggcgaauacaggcuucgcggggaggcacgcaagaccuuuguggaccugaugcgucgcggcgaccucccagucuggcuagcguauaagguggccgcagaagggauuaacuaugcagaccgcaagugguguuucgacgguaucaagaacaaccagauccuggaggaaaauauggaaguggagauauggacgaaagaaggggaacguaagaagcucaaaccgcgaugguuggaugcucgcauauacagugacccccuggcccuuaaggaguucaaggaguuugccgccggccggaagucccugacccugaaccucauaacggagaugggccgccugccaaccuuuaugacgcagaaagcacggaacgcacuggauaaccuugccguccugcacaccgccgaggccggaggccgagcguacaaccaugcgcugucagaacuucccgaaacucuggaaacucuucuccugcuaacgcuccuugcaaccgugaccgggggcauauuccuguuuuuaauguccggaaaggggaucgguaaaaugacacugggaaugugcugcaucaucaccgccagcauacuacuaugguaugcgcagauacaaccacacuggauugccgcuuccaucaucuuggaguuuuuccugaucgugcuccugauaccugagcccgagaagcagaggacaccacaggacaaccaacuuaccuacguuguuaucgccauccucaccguuguggccgcgaccauggccaacgagaugggcuuccucgagaagacgaagaaggaucuggggcucggaaguaucaccacccaggagagcgaguccaauauucuggacaucgacuugcgccccgccucggccuggacucucuacgcgguggccaccacuuucgucacccccaugcuaagacauuccaucgagaacucguccgucaacgugucgcugacugccaucgccaaccaggccacggugcucaugggccuggggaaaggauggccccuaucaaagauggacaucggggugccccuacuugcuaucggcugcuacagccagguuaacccgauuacgcugaccgccgcucucuugcucuuaguugcccacuacgccauuauaggaccuggccuucaggcgaaggccacacgggaagcgcagaagagggcggccgcgggcaucaugaagaacccuacgguggacgggauaaccguuaucgaccuggaacccaucccguaugacccuaaguuugagaaacaacuggggcaggucaugcugcuuauccucugcgugacccagguccucaugaugcgcacuacaugggcccugugcgaggcccucacccuggcaaccggaccaauuuccacgcucugggaaggcaaucccggucgguuuuggaacacgaccaucgcggucucgauggcaaauauuuuuagagguuccuaccuugccggcgccggccuguuguuuagcaucaugaagaacaccacauccacgcgcaggggcaccgggaacaucggcgaaacccucggagagaaguggaagucccgccugaacgccuuagggaaguccgaguuccagaucuacaagaaguccggcauccaagaggucgaucgcacccucgccaaggaggggaucaaacgcggcgagacggaucaccaugcuguuuccagagggagcgccaagcuacgcugguucgucgagcguaacaugguuaccccggaggggaaggucguggaccugggaugcggucgcggagggugguccuacuauugcggcggguugaaaaauguccgggagguaaaggggcugaccaagggcggaccuggccacgaggagcccauccccaugaguacguacggcuggaauuugguccggcuccaaagcgggguagaugucuucuucacgcccccggagaagugcgauacacuucugugugacaucggggaguccagcccaaaccccaccaucgaggccggcagaacacuccgagucuuaaaccucgucgagaacugguuaaacaacaacacgcaguucugcaucaaggugcugaacccauauaugcccuccgucaucgagaagauggaggccuuacagcggcaauauggcggggcguugguacgcaacccccugagccgaaacagcacgcacgaaauguacugggugucaaacgccaccggaaacauugucucaucugugaacaugaucucccgcauguuaauaaaucgguucaccaugaagcacaagaaggccaccuacgagccggacguggacuuaggcucggguacgcgcaacaucggcaucgaauccgagauccccaaccucgauaucauuggcaagcgcauagagaagaucaagcaagagcacgagaucagcuggcacuacgaucaggaccacccguacaagaccugggccuaccacggcucguacgagaccaaacagaccgggagcgccucguccaugguaaauggcguuguuaggcuccugacgaaacccugggacgucgugccgauggugacccagauggcgaugacugacaccacgcccuucgggcagcagcgcgucuucaaggagaagguagauacgcgaacacaggaacccaaagagggcacaaagaagcuaaugaaaauaacggccgaauggcucuggaaggagcucggaaagaaaaagacuccgcgcauguguacucgggaggaguucacgaagaaggugcgauccaaugccgcccucggggccauuuucacugacgagaacaaguggaaauccgcgcgagaagccgucgaggacggccgcuucugggagcucguggaucgcgagcgcaaccugcaucucgagggcaagugcgagaccugcguauacaacaugaugggaaagagagagaaaaagcugggugaguucggcaaggccaagggcagccgcgcuauuugguauauguggcuuggggcgcgcuuccucgaguucgaagcccucggauuccugaacgaagaccauugguuuagccgggggaacagccuguccggcguagaaggugagggccugcaccggcuggguuacauacuacgcgacguagggaagaaggagggcggagccauguaugcugacgauacggccggcugggacacccgcauuacauuggaggaccugaagaaugaggagaugguuaccaaucacaugaagggggagcauaagaagcuagcggaagcgauuuuuaagcugaccuaccagaacaaagugguucguguccagcggccaacgccccgcggcaccguaauggacauaaucagccgccgcgaccagcgaggcuccggacaggugggcaccuacggguuaaacacguucaccaauauggaagcccagcuuaucagacagauggagggggagggcauuuucaaaagcauccagcaccugacggcuacggaggagauagcuguccagaacuggcuggcgcgcguggggcgggaacgcuuaucccggauggcaauuucaggugacgacugcgugguuaaacccauagacgaccgcuucgccuccgcccugacagcgcucaacgauauggggaaggugagaaaggacauccagcaaugggaaccgagccguggcuggaacgacuggacucaggugccauucuguucgcaccacuuccacgagcuugugaugaaagacgggcggguucuagucguccccugccgcaaucaggacgagcucauaggucgugcgcgcaucagccaaggcgccggguggagcuuaaaggaaacggccugccucggcaagaguuacgcccaaauguggacucugauguauuuccaccgacgugaccuccggcuggcagcaaacgcuauuugcucagccguucccagccacugggugcccaccuccaggacgacauggagcauacacgccaagcacgaguggaugacgaccgaggauauguuagcggucuggaacaggguuuggauccaggagaauccguggauggaggauaaaacgccaguggaguccugggaagagguccccuaccucggaaagcgcgaagaccaguggugcggcagucugaucggucugacgagccgcgccacgugggccaagaacauucagaccgcaauaaaccaagugcgcucccuuaucggcaacgaggaguacacagacuacaugcccuccaugaaacgcuucaggcgcgaggaggaggaggcaggcgugcugugguga

SEQ ID NO: 25015 - RNA, 9876 nt, Artificial Sequence
  derived and/or modified CDS sequence (opt11) from DENV-2__KF955369__SS-prME
accgccggagugaucgugaugcugauccccaccgccauggcguuccaccucaccacgaggaacggggagccccauaugaucgugggcaggcaggaaaaggggaagucucugcuguucaaaaccgaggacggcgugaacauguguacccucauggccaucgaccugggggagcugugcgaggauaccaucacuuacaaaugcccccuccugcgccagaacgagcccgaggacaucgauugcuggugcaacagcaccagcaccugggugaccuacgggaccugcaccaccacgggcgagcaccgucgcgagaagcgguccguggcgcuggugccccacguggggaugggccuagagacccggacagagacguggaugucaagcgaaggcgccuggaagcacguacagaggaucgagaccuggauccugcgccacccgggcuucaccaucauggccgcuauacuggccuacaccaucgggaccacgcacuuucaaagggcccucaucuucauccuccugaccaccguggcccccagcaugaccaugcgcugcaucggcauuagcaaccgggacuucgucgagggcgucucaggcgguagcuggguggacaucguccucgagcacgggucuugcgugacuacuauggcgaagaacaagcccacccuggacuucgagcugaucaagaccgaagccaagcaacccgccacguugcgcaaguacugcaucgaggccaagcugaccaauaccaccacggagucccggugcccgacccagggcgagcccagccucaacgaggagcaggacaagcgcuucaucugcaagcacuccaugguggaccggggcugggggaauggcugcgguuuauuuggcaagggcggcaucgugacgugcgcgauguucacaugcaaaaagaacauggagggcaagguggugcagcccgagaaccuugaguacacgaucgucauuacaccccacagcggggaggagcacgcgguggguaacgacaccgggaagcacggcaaggagaucaagaucaccccgcaguccagcaucaccgaggccgaacugacgggguacgguacugugaccauggaguguucaccuagaacaggccucgacuucaaugagaugguccugcugcagauggaggacaaggcauggcucguccacagacagugguuccuggaccugccccuccccuggcugccuggggccgauacgcagggaagcaauuggauccagaaggagacucuugugacauucaagaacccccacgccaagaagcaggaugucgugguccucgggucucaagagggcgcgaugcacacagcauugacuggggccacugagauucagaugucaucuggaaaccuccuguucaccggccaccugaaaugccgccugcggauggacaaguuacagcugaaagggauguccuacagcaugugcaccggcaaauucaagaucgugaaggagaucgccgagacucagcauggcaccauugucauucgcguccaguacgagggcgacggcucccccugcaagauucccuucgagaucaccgaucuggagaaacggcacguucucgggcgccucaucaccgugaacccgaucgucacggagaaggacagucccgugaacaucgaggccgagccgcccuuuggcgacuccuacaucaucauugggguggagccaggccaacuaaagcucaacugguucaagaaggggagcuccaucggccagauguuugagaccacuaugcgcggcgcuaagcggauggccauccuaggcgacaccgccugggacuucggcagccucggaggcgucuucaccuccaucgggaaggcccuccaccagguauucggggccaucuacggugcugccuucagcgggguuuccuggaccaugaagauacugaucggugucaucaucacguggauuggcaugaacagccgcuccacaagccugagugugagucugguacucgucggcguagugaccuuauaccuaggggccgucgugcaggcagacuccgggugcguggucagcuggaagaacaaggagcucaaaugcggcagcgggaucuucaucaccgacaacgugcacaccuggaccgagcaauacaaguuccagcccgagagccccucuaagcuggcguccgccauccagaaggcccaugaggaggguaucugugggaucaggagcgucacgcgccuggagaaccucauguggaagcagauaacccccgagcugaaccacaucuuauccgaaaacgaagucaaacucaccaucaugaccggcgauaucaaggggaucaugcaggccggcaagcggagccugcgcccgcagcccacggagcugaaguacuccuggaagaccuggggcaaggccaagaugcugagcaccgagucccauaaccagaccuuccugaucgacgggccggagacggcugagugcccgaacaccaacagggccuggaacagccuggagguggaggacuauggguucgggguguucaccaccaacaucuggcucaagcugagagaaaagcaggacgucuuuugcgacagcaagcugaugagcgccgccauaaaggacaacagagccgugcaugcugacaugggcuacuggaucgaguccgcgcugaacgauaccuggaagauggagaaagccagcuucauugaggugaaguccugucacuggcccaagucacauacgcugugguccaacggcguacuggaaagcgaaaugaucauccccaagaacuuugccgggcccgugucccagcacaauuaucgccccggcuaucacacccagaccgccgggcccuggcaccucggcaaauuagaaauggauuucgacuucugcgagggcacaacgguggucgugaccgaggacugcggcaaccggggcccuagccugcgcaccaccacggcgagcgggaagcucaucaccgaguggugcugccgguccugcacccugcccccgcuacgcuacagaggcgaggacggcugcugguauggcauggagauccgcccccucaaggagaaggaggaaaaccuggucaacucccugguuaccgccgggcacgggcagauagacaacuucucccucggcgugcuggggauggccuuguuccucgaggagaugcuacggacccgcaucggcaccaagcacgcaauccuucucguggcggucuccuucgugacccugauuaccggaaacauguccuuccgggacuuaggccgcgugauggucauggugggggccaccaugaccgacgacauagguaugggggugaccuaucucgcccuacuggcagccuucaaggugcgucccaccuucgcagccgggcuguuacuacggaaacucacgagcaaggagcugaugauggccacgaucgggaucgcuuuacucucccaguccaccauccccgaaacaauucuggagcugacggaugcccucgcgcucgggaugauggugcugaagaucgugcgcaacauggagaaauaucagcucgccgucaccaucauggccaucucgugcguaccaaacgcaguaauccugcagaacgccuggaaggucagcugcaccauccuggcagcaguguccgucagcccccuccuacugacuuccagccaacaaaaggcggacuggauaccgcucgcccugacuaucaaggggcugaaccccaccgcgaucuuccuaaccacccugucccggacgaguaagaagcgcucuuggccgcugaacgaggccaucauggccgucgguaugguuagcauccucgccuccagccugcugaagaaugacauccccaugacaggaccccucguggccggcgggcugcugaccgugugcuacgugcucaccggucggagcgcggaccucgaauuggagcgcgccgccgacgucaagugggaggaucaggcugaaaucagcgggucgucccccauccuaucaaucacgaucucagaggacggcagcauguccauaaagaacgaggaggaagaacagacccuaaccauccugauccggaccggccuccuggugaucagcgggguguucccggucuccauccccaucaccgccgcggccugguaccugugggaggugaaaaagcaacgcgcgggcguccugugggacguccccagcccgccgcccguggagaaggccgagcuggaagacggggcguaccgcauaaaacagcgcggcauccugggcuacucccagaucggcgcgggcguguacaaggaggggacguuccacaccauguggcaugucaccagaggcgcagugcucaugcaccgcggcaagcggaucgagcccagcugggccgacguuaagaaggaccugaucagcuacggugggggcuggaagcuggaaggugaauggaaggagggcgaggagguacagguguuagcccuggagcccggcaagaacccccgcgccgugcagaccaagcccgggauuuucaagacaaacacgggcaccaucggggcggucagccuggacuuuucccccgggaccagcggcucccccaucguggaccgcaaggggaaggugguuggcuuguacgggaacggagugguuacgcgcagcggagcuuacgucuccgcuaucgcgcagaccgagaaguccaucgaggacaacccugagauugaggacgacaucuuucggaaaaagcgccugaccaucauggaccugcaccccggagcgggcaagaccaagcgguacuugccugcaaucgugcgagaggccauaaagagaggacugcgcacauugauucuggcuccgacucgcguagucgccgcggagauggaggaggcgcuccggggccuacccauccgcuaccagacccccgccaucaagaccgagcacacggggcgggagaucguggaccugaugugccacgccaccuuuaccaugcgccuccugagccccguccgugucccgaacuacaaccuuaucaucauggacgaggcccacuucaccgaccccgcguccauagccgcccgcggauacaucagcacgcgggucgagaugggcgaggccgccgggaucuucaugacagcaacgccacccggcucccgcgacccuuucccccagagcaacgcccccaucauggacgaggagcgggagauccccgaacgcuccuggaacagcgggcacgaaugggugacagacuucaagggcaagacagucugguucgugccguccaucaaggccgggaacgauauugccgcaugccuccggaagaacggcaagaaagugauccagcuuagccgaaaaaccuuugauuccgaguacgugaagacccgggcuaacgacugggacuucguugugaccacugacaucuccgagaugggcgccaacuucaaggccgagcgcgucaucgacccccggcgcugcaugaagcccgugauccugacugacggggaggagcgggugauacucgcgggacccaugccggucacacauuccagcgcggcccagcgccggggucgcaucggccgcaaccccaagaacgagaacgaccaguacaucuacaugggggagccccuagagaacgacgaggacugcgcucacuggaaggaggccaagaugcugcuggacaacauuaacacccccgaggggaucaucccguccauguucgagcccgagcgggagaaggucgacgccaucgacggcgaauaucgucugagaggggaagcccgcaagacguucguggaccucaugaggcgcggcgaccugcccgucugguuagccuauaaggucgccgccgaggggaucaacuaugccgaccggaaauggugcuucgauggaaucaagaacaaccagauccuggaagagaacauggagguagagaucuggaccaaggagggggagcgcaagaagcucaagccgcgguggcuggacgcucgcaucuacagcgacccccucgcccucaaggaguuuaaggaguucgccgcgggccggaagucguugacccucaaccucauuaccgaaaugggccgcuuacccacguucaugacccagaaggcgcggaacgcccuggauaacuuggcugucuuacacaccgccgaggcagggggccgcgcguacaaccacgccuuaagcgaguugcccgagacccuggagacgcugcuccugcugacccuccuggccaccguuaccgggggaaucuuccuauuccucaugagcggaaaggggaucggcaagaugacccuggggaugugcugcauuaucaccgccagcauccugcucugguacgcccagauccagccgcacuggaucgcggcuuccaucauccuggaguucuuucugaucguucuccuuauacccgagcccgagaagcagcggacgccccaggacaaccagcugacuuaugugguuaucgccauccucaccguuguggccgccacgauggcgaacgagaugggcuuccuggagaagaccaagaaagaucugggccucggcagcaucaccacucaggagagcgaguccaacauucuggacaucgaccugcgcccggccagcgcauggacgcuguacgccguugcaaccaccuucgucacccccaugcuucggcauagcaucgagaacagcuccgugaacgugucccugacggcuaucgccaaccaagccaccguccucaugggcuuggggaagggcuggcccuuauccaagauggacaucgggguuccccuccuggcgaucggcugcuauagccaggugaaccccaucacccugaccgcggcccugcuguuacucguggcgcacuacgccaucaucgggccgggccuacaagccaaggcgacgcgcgaggcccagaaacgggccgcugcagggaucaugaagaaccccaccguggacgggaucaccgugaucgaccucgagcccauuccuuacgaccccaaguucgagaagcagcucggccaggucaugcugcucauccucugcgugacccaagugcugaugaugcgcacgaccugggcccugugcgaggcgcucacccuggccaccggaccgaucuccacgcugugggagggcaaccccggccgguucuggaacaccaccaucgcugucucuauggcgaacaucuuucgcggcuccuacuuagcgggugccggguugcuguucagcaucaugaagaacaccacguccacccggcggggcacggggaauauaggcgaaacacucggcgagaaguggaaaucucggcugaacgcccuggguaaguccgaguuccagauuuacaagaagucaggcauucaagagguggaccggacccuggccaaggaggggaucaagcgcggcgagaccgaccaccacgcugugucccgggggagcgccaagcuccgcugguuuguugagcggaacauggugacuccggaggguaaagugguagaccugggcugcggacgcggcgggugguccuacuauuguggugggcucaaaaacguccgggaggugaagggcuuaacuaagggcgggcccggccacgaagaacccauucccaugucgacuuacggguggaaccugguccgacuccagagcggcguggacguauucuuuacaccacccgagaagugcgacacccuccuaugcgacaucggagaguccagccccaaccccacaaucgaggccggccggacacuccgcguacucaaccugguggagaacuggcucaacaacaacacgcaguucuguaucaagguucugaauccguacaugcccuccgucauugagaaaauggaggcccugcaacggcaguacggcggcgcauuggugcgcaacccccugucgcggaacucaacccacgaaauguacugggugagcaacgcgaccggcaacauugucucgagcgugaacaugauuuccaggaugcugaucaaccgguucaccaugaagcacaagaaagccaccuacgagccggacguggaccuggggaguggcacccgcaacauugggaucgaguccgagauucccaacuuggacaucaucggcaagcggaucgagaagaucaagcaagaacaugagaucagcuggcacuacgaccaggaucaccccuacaagaccugggcguaucacgguuccuacgaaaccaagcagacugguagcgccuccagcauggucaacggcgugguucgacugcugaccaagcccugggacguagugccgaugguaacccagauggccaugaccgauacgacccccuucgggcaacagcgcguguucaaggagaagguggacacccggacccaggagcccaaagagggcacgaaaaagcucaugaagauuaccgcggaguggcuguggaaggaacugggcaaaaagaagacaccccgaaugugcacccgggaggaguucacgaaaaaggugcgcuccaacgcugcccugggggccaucuucaccgacgagaacaaauggaaauccgcccgggaggcagucgaggacggccgcuucugggaacugguggaucgggagcgcaaccugcaccucgaggggaaaugcgagacgugcguguacaacaugaugggcaagcgggaaaagaagcugggagaguucggcaaggccaaggggucccgcgccauuugguauauguggcucggggcccgguuccucgaguucgaggcgcugggcuuccugaacgaggaccacugguucagccgcgggaacagcuuaucaggugucgagggggagggacuccaccgucugggcuacauccuccgagauguggggaagaaggagggcggggcgauguacgcagacgacaccgccggcugggauacgcggaucacgcuggaagaccuuaagaacgaggagaugguaaccaaccacaugaaaggcgagcacaagaagcucgccgaggcgaucuucaagcucaccuaccagaacaagguggugcgcguccaacgcccgacgccccgcggcacagugauggauaucaucucucggcgugaccagcggggaagugggcaggucggcaccuacgggcuaaacacuuucacuaacauggaggcucaguuaauccgccagauggagggcgagggcaucuucaagagcauccagcaccugacagccacugaagaaaucgccguccaaaacuggcuugcccguguggggcgggagcgccucagccggauggcuauaagcggcgacgacugcgucgucaagccuaucgacgaucgcuuugcauccgcccucaccgcgcugaacgacauggggaaggugcggaaggacauccagcaaugggagccgagccgcggcuggaacgacuggacccaagugccguucugcucccaccacuuccaugagcucgucaugaaggacggccggguccugguuguucccugccgcaaccaggacgagcugauuggccgggcccgcaucucgcagggcgcggguuggucccucaaagagaccgccugccugggcaagucguacgcccagauguggacccugauguacuuccacagacgcgaccuccggcuggcagccaacgcgaucugcuccgcagugcccucgcacugggugccgacaucccgcacgacguggagcauccacgccaagcaugaguggaugaccacugaggacaugcuggccguuuggaaucggguguggauccaggagaacccguggauggaagacaagacccccguggaguccugggaagagguccccuaccucgggaaacgcgaggaccaguggugcggcucgcuaauuggucugacgagccgcgcgacgugggccaagaacauccagaccgcaaucaaccaggugcgaucgcucaucggcaacgaggaguauacggacuacaugcccagcaugaagagguuccgccgcgaagaggaggaggccggcgugcugugguga

SEQ ID NO: 25016 - RNA, 9876 nt, Artificial Sequence
  derived and/or modified CDS sequence (opt11) from DENV-2__EU569702__SS-prME
accgccggcgucaucgucaugcugauccccaccgccauggcauuccaccucaccacccggaacggggagccccacaugaucgugggucggcaggagaaggggaagucccugcuguuuaaaaccgaggacggcgugaacaugugcacucuuauggccaucgaccugggggagcugugcgaggacacgaucaccuacaagugcccccucuugcgccagaaugagcccgaggauaucgacugcuggugcaacucuaccucaaccugggucacguacgggacaugcaccacaacgggcgagcaccggcgcgagaagcgguccguggcccuggugccucacgucgggaugggccucgagacaagaacagagaccuggaugagcuccgagggggcuuggaaacacgugcagcgaaucgagaccuggauccugcgucaccccggcuuuaccaucauggcugcgauacuggccuacaccaucgggaccacgcacuuucagcgggcccuaaucuucauccugcugaccgccguggcgcccaguaugacgaugcgcugcaucggcaucuccaacagagacuucgucgagggagugagcggcggauccuggguggacaucguccuagagcacgggagcugcgugacuacgauggccaagaacaagcccacccuggacuucgagcugauaaagaccgaggcuaagcagcccgccacccucagaaaguacugcaucgaggccaagcugacgaacaccaccaccgagucccggugcccgacgcagggcgagcccagccugaacgaggaacaggacaagcgcuucaucugcaagcacuccaugguggacaggggcugggggaacggcugcgggcuguucggcaagggcgggaucguaaccugcgcgauguucacguguaagaagaacauggagggcaagguagugcaacccgagaaccucgaguacaccaucgucaucacgccccacagcggggaggaacacgcagugggcaaugacaccgggaagcacggaaaggagaucaagaucacuccgcaguccagcaucaccgaggcagagcugaccggguacggaacggugacaauggagugcagcccccguaccggccucgacuucaacgagaugguucuacugcagauggaggacaaggccuggcucguccaucggcagugguucuuggaccugcccuuacccuggcugccgggggccgacacccagggcagcaacuggauccagaaggagacgcuggugacauucaagaacccucacgcgaagaagcaggaugucgugguccucgggucccaggagggagccaugcauacggcacugaccggugccacggagauucaaaugagcucgggcaaccuccuguuuaccggccaucucaagugccgccugcggauggacaaguuacaguugaaagggauguccuacagcaugugcaccggcaaguucaagauaguuaaggagauugccgagacccagcaugggacgaucgugauccggguacaguacgagggcgacggcagccccugcaagauccccuucgagaucaccgaccuagaaaagcggcacgugcucgggcgccucaucacagugaacccgaucgucaccgaaaaggacagccccgugaacaucgaggcagagccacccuuuggcgacuccuacauuaucaucggcguggagccgggccaguugaagcugaauugguucaaaaaggggagcaguaucggacagauguucgagacgaccaugagaggcgcaaagcggauggccauccugggggacaccgccugggauuucggcaguuuggguggugucuucacguccauagggaaggcccuacaccagguguucggcgccaucuacggcgccgccuucucugggguguccuggacgaugaagauccuaaucggcgucaucaucaccuggaucgggaugaacagcagaucaaccagccugagcgugagccuggugcucgucggcguggugacccuguaccugggggccgucgugcaggcggacuccggcugcguggucagcuggaagaacaaggagcucaaguguggcucagggaucuucaucacggacaacguucauaccuggaccgagcaguacaaguuccagcccgagagccccuccaagcuggccuccgccauucagaaggcgcacgaggagggcaucugcgggauccggagcgugacccgccuggagaaccucauguggaagcagaucacgcccgagcugaaccacauccuguccgaaaacgaggucaagcucacuaucaugacuggcgacaucaaggggaucaugcaggccggcaaacggucgcugcgcccgcagcccaccgagcugaaguacuccuggaagacgugggguaaggccaagaugcucagcaccgagucccacaaccagacauuccugauagauggucccgagaccgccgagugcccgaauacgaaccgggccuggaacagccuggagguugaggacuacggcuucgggguauucaccacgaacaucuggcucaagcugcgcgagaagcaagacgucuucugcgauuccaagcugaugagcgccgccaucaaagacaaccgggcggugcacgccgacaugggcuacuggauagagucagcacucaacgacaccuggaagauggagcgcgcgagcuucaucgaagugaagagcugccacuggcccaagagccauacccugugguccaacggcguccuggagagcgagaugaucauccccaagaacuucgccgggccugugucccagcacaacuaccggccgggcuaccacacgcaaaccgcggggcccuggcaccugggcaagcuggagauggacuucgacuucugcgaggggacgaccgugguggugaccgaggacugcggcaaccgcggccccagccugcguaccaccaccgccagcgguaagcucaucacggaguggugcugccgcuccugcaccuuacccccccugcgguaccgcggcgaagacggguguugguacggcauggagauccggccccucaaggaaaaggaggagaaucuggugaacucccuggucaccgccgggcacggccagaucgauaauuuuucccucggcgugcuggggauggcccuguuucucgaggagaugcugcgcacccggaucggcacgaagcaugcgauccugcucguugccgucagcuuugugacccugaucaccgggaacaugagcuuccgcgaccugggucgcguuauggucauggugggggccacgaugacggacgacaucggcaugggcgugacguaccucgcccugcuggccgcguucaagguccggcccaccuucgccgccgggcuccuucugcgcaaguuaaccucgaaggagcucaugauggccacgaucggcaucgcccugcucucacagagcaccauccccgagaccauccuggagcugaccgacgcgcucgccuuggggaugaugguacugaagauaguacggaacauggagaaguaccagcucgcagucacgaucauggccaucuccugcgugccuaacgccguaauacugcagaacgcguggaaggucagcugcacaauccuggccgccguauccgucaguccccuccugcugacuuccagccaacaaaaggcugauuggauaccccucgcgcugacgaucaagggccugaaccccacggccaucuuucucaccacccugucccgcaccagcaagaagcgguccuggccgcugaacgaagccaucauggccgugggcaugguaagcauccucgccucgagccugcugaagaacgauaucccgaugacggggccccucgucgcgggcggguuacuuaccgugugcuacgugcucacuggccgcagcgccgaccuggagcuggagcgggccgccgacgucaagugggaggaucaggccgagauauccggcagcucccccauccucagcaucaccaucuccgaagacggcagcauguccaucaagaacgaggaggaggagcagacgcugaccauccucauccgaaccggccuccuggugaucagcgggguguucccgguguccauccccaucaccgcggccgcuugguaccugugggaggucaagaagcagcgggccgguguucucugggacguccccagcccgccgcccguggagaaggccgagcuggaggacggggcguaccgcaucaagcaacggggcauccuggguuacucccaaaucggcgccggcgucuacaaggaggggacauuccauacgauguggcacgugacacgcggcgccgugcucaugcaccgggggaagcgcaucgagcccagcugggccgacgugaagaaggaccugauauccuacggcgggggcuggaaguuagaaggcgaguggaaggagggggaggaaguccagguguuagcgcuggagcccggcaagaacccccgggcggugcagaccaagcccgggaucuucaagaccaacacgggcaccaucggcgccgucagccuggacuucucccccgggaccaguggcucucccaucguggaccgcaaggggaaggucgucggucucuacgggaacggcgugguuacccggucuggcgccuacgucuccgccaucgcgcagacggagaagucgaucgaggacaaccccgagaucgaggacgacauuuuccgcaagaagagacugaccaucauggaccugcaccccggggccggcaagacgaagcgcuaccuccccgccauagugagagaggccauaaaacgcgggcuccgcacccugauccucgccccaacgcgaguggucgcugccgagauggaggaggcccuccgaggccuucccaucagauaccagaccccugccaucaagaccgagcacaccgggcgcgagaucguggaccugaugugccacgccacguucaccaugcgucuccugagccccguacgcgugccgaacuacaaccucaucaucauggacgaggcgcacuucacagaccccgccuccaucgccgcccggggauacaucagcacccgcguggagaugggggaagccgccgggaucuucaugacggccacgccgcccgguucccgggacccguucccccagagcaacgcccccauuauggaugaggagcgcgagauccccgagcgguccuggaacagcgggcacgagugggugacugacuucaagggcaagaccgucugguucgugccuucuaucaaggccggcaaugacaucgcggccugcuuacgcaagaacggcaagaaggugauccagcugagccggaagacguucgacuccgaguacguuaagacgcgcgccaacgacugggauuucguggugaccacugacaucagcgagaugggcgcgaauuucaaggccgaacgggucaucgacccccgcaggugcaugaagcccgucauccugacggacuccgaggagcgcgugauccucgcgggucccaugcccgucacccacagcuccgccgcccagcggcgcggccgcaucggucgaaacccgaagaacgagaacgaccaguacaucuacaugggggagccccuggagaacgacgaggacugcgcccauuggaaggaagccaagaugcugcucgacaacaucaacacgcccgaggggaucaucccgagcauguucgagcccgagcgcgagaagguugacgcgaucgacggugaauaccgguugaggggcgaggcccggaaaaccuucguggaccucaugcggcgcggcgacuuaccggucuggcuggccuacaagguagccgccgagggcauuaacuacgcggaccgcaaguggugcuuugacgggaucaaaaacaaccagauccuggaggaaaauauggagguugagaucuggacgaaggagggagagaggaagaaauuaaagccgcgcuggcuggacgcccgcauuuacuccgacccccuggcccucaaggaguucaaggaguucgccgcggggcgcaagucccugacccugaaccucaucacugaaaugggcaggcugcccaccuucaugacgcagaaggcccgcaacgcccuggacaaccucgccgugcuacacaccgccgaggcgggcgggcgggccuauaaccacgcccuguccgagcuccccgagacccuggagacccugcuccugcugacgcuccuugccaccgugaccggcgggaucuuccuguuccucaugagcgggaagggcaucgggaagaugacccugggcauguguuguaucauuaccgccuccauccuccucugguacgcgcaaauccagccacacuggaucgccgcuagcaucauccuggaguucuuccugaucguccuccugauccccgagccugagaagcagcgcacaccccaggacaaccaacuuaccuacgugguaaucgccauccugacggucguggccgcgaccauggccaacgagaugggguuccuggagaagacgaagaaggaccugggccucgggagcaucaccacgcaggagucagagagcaacauccuugacaucgaccugaggccggccuccgccuggaccuuguacgccguggcgacgacguucgucacccccauguugcgccacuccaucgaaaacuccagcgugaacguguccuuaaccgcuaucgccaaccaggccacgguccucaugggccugggcaagggauggccccugucgaagauggacaucggcgugccccugcuggcgaucggguguuacucccaggugaauccgaucacccugaccgccgcccuccucuugcucguggcccacuaugcgaucaucggccccggucugcaagcgaaggcgacccgggaggcccagaagcgagccgccgcgggcauaaugaagaaccccacgguggacggcaucacugugauugaccuggagcccauuccguacgaccccaaauucgagaagcagcuugggcaggucauguugcucauccuaugcgugacccaggugcugaugaugcggaccacgugggccuuaugugaggcccucacccuugccacuggccccaucagcacccugugggaagggaaccccggccgcuucuggaacacgaccaucgccgucaguauggcgaacaucuuccguggguccuaccucgccggcgccggucugcuguucuccauuaugaagaacaccaccagcaccagacgcgggaccggcaacaucggcgagacucucggggagaaguggaaaucccggcugaaugcucugggcaagagcgaguuccagaucuacaaaaagucagggauacaggaaguggaccgcacccucgcgaaggagggcaucaagcgcggggagacggaucaccacgccgugagccgcggcucggccaagcugagaugguucgucgaacgcaacauggucacgccggaggggaagguggucgaccugggcugcggucgggggggcuggagcuacuacugcgguggccucaagaacguuagagaggugaaggggcugaccaagggcggccccgggcacgaggagcccauucccaugagcaccuacggauggaaccugguccggcuccaguccggggucgacgucuucuucacgccgcccgagaagugcgacacccugcugugcgacaucggcgagucuucccccaaccccaccaucgaggccgggcgcacccuccggguccucaaccugguggagaacuggcugaacaacaacacccaguucugcaucaaagugcugaacccguacaugcccagcgucaucgagaagauggaggcccugcagcgccaguacggcggcgcgcucgugcggaacccccuuucccgcaacagcacacacgagauguauuggguguccaacgccaccggaaacauugucagcuccgugaacaugaucagccgcaugcugaucaaccgcuucaccaugaagcacaagaaggccaccuaugagccggauguggaucugggcagcgggacgcggaauaucggcauugagagcgagauccccaaccuugacaucaucgggaagcgcaucgaaaagauuaagcaggagcacgagaucucuuggcacuacgaccaggaccaccccuacaagacaugggccuaucauggcagcuacgagacaaagcagaccggauccgccagcuccauggucaacggagucguuagacugcugacgaagcccugggauguggugccgauggucacccagauggcgaugacggacaccacaccuuucggccagcagagagucuuuaaagagaaaguggacacccgcacccaggagcccaaggaagggacuaagaagcuaaugaagaucacggcggaguggcuguggaaggaacugggcaagaagaagacgccccggauguguacacgcgaggaguuuaccaaaaagguacggagcaacgccgcccucggggccaucuucacggacgagaacaaguggaaguccgcgcgcgaggcggucgaggacgggcgguucugggagcuuguggaccgcgagcggaaccugcaccucgagggcaagugcgagaccugcguguacaacaugauggggaagcgggagaaaaagcuaggggaguucgggaaggccaagggaagucgggcaaucugguacaugugguugggcgcgcgauuccucgaguuugaagcccugggguuccugaacgaggaccauugguucagccggggcaacucccucagcggggucgagggcgaggggcugcacagacuuggcuauauccuccgcgacgugggcaagaaggagggcggcgcgauguacgcagacgacaccgccgguugggacaccagaaucacgcuggaggaccugaagaacgaggagauggucacaaaccauaugaagggcgagcacaaaaaacucgcggaggccaucuuuaagcugaccuaccagaacaagguuguacgggugcagcgcccgacgccccggggcacggugauggacaucaucucccgccgggaccagcguggcagcgggcagguggggaccuacggccuaaacaccuucaccaacauggaagcccaacugaucaggcagauggagggggaaggcaucuucaaaagcauccagcaccugacggccacugaggagauugcaguacagaacugguuagcucgggugggccgcgagcggcucucgcgcauggccaucuccggggacgacugcguggucaagccuaucgacgaccgguucgccagcgcucugaccgcucugaaugauaugggcaagguccgcaaagacauccagcagugggagcccucgcggggguggaacgacuggacccaggugccguuuugcagccaccacuuccacgagcucguaaugaaggacgggcgcguguuaguggucccaugccggaaccaggacgagcugaucgggcgcgcgcggaucucccagggcgcuggcuggagccucaaggagacggccugccuggggaaguccuacgcccagauguggacccugauguacuuccaccgcagggaucuccgccuggccgcgaacgccaucugcagcgccgugccuucccacuggguucccaccagccggaccaccugguccauccacgccaagcacgaguggaugacaacugaggacauguuagcggucuggaaucgcguuuggauccaggagaacccauggauggaggacaagaccccggucgagagcugggaggagguccccuaccucggcaagcgggaggaccaauggugcgggagcuuaaucggcuugaccagucgcgcuacgugggccaagaacauccagaccgcgauaaaucaagugcggagccucaucgggaacgaagaguacaccgacuauaugccauccaugaagcgcuuccgccgggaggaggaggaagccggggucuugugguga

SEQ ID NO: 25017 - RNA, 9876 nt, Artificial Sequence
  derived and/or modified CDS sequence (opt11) from DENV-2__EU482624__SS-prME
accgcggggguuauaguuauguugaucccgacagcuauggcauuccacuuaacaacacgcaauggggaaccccacaugaucgucggacgccaagaaaaaggaaaauccuuacuauuuaaaaccgaagauggagucaacaugugcacccuaauggcgaucgaccuaggagaauuaugcgaggacacaaucaccuauaaaugcccacugcugcgucaaaaugagcccgaggacauugauuguuggugcaacagcacgucaacgugggucaccuauggaaccuguaccaccaccggagaacaccgcagggaaaaacgaaguguggcauuagugccucacguagggauggguuuggagacacggacagaaaccuggaugucauccgaaggagcauggaaacacguacaacgcaucgagacguggauccuacggcacccgggauucacaaucauggcugcgauacuagccaacaccaucggaacaacccacuuccagcgcgcacuaauauuuaucuuacuaacggcggucgcccccucaaugacaaugcggugcauagguaucagcaacagagauuuuguggaaggagucucagggggcuccuggguagacaucgugcucgaacacggcaguugcguaacuacuauggccaaaaauaaaccgaccuuggacuucgaacuaauaaaaacagaagcgaaacagcccgcaacacuccgcaaauacugcauugaagcgaaacuuacaaacacgacaaccgaaagccgguguccuacccaaggagagcccagcuuaaacgaagaacaagacaaaagauucaucugcaaacacucaaugguagaccgagggugggggaacggcugcggccuuuucggcaaaggagguaucgucacuugcgcgauguuuacgugcaagaaaaacauggaggggaaagucguacagccagagaaccuggaauauaccaucgugauaacaccacauuccggcgaggagcacgcuguggggaacgacacgggaaaacacgguaaagagaucaagauaacaccacagagcaguaucacggaagcggaacugacgggauacgguacaguaacgauggaaugcagcccccgcaccggacuggacuucaacgagaugguccuccugcagauggaggacaaagccuggcugguccaccgucaaugguuccuagaccugcccuuaccuuggcuccccggugcggacauccaaggcucgaauuggauccagaaagaaacccuggugacauucaaaaacccacaugcgaagaaacaagacgucgugguacuagggucccaagagggcgcaaugcauacagcgcuaacgggagcaaccgagauacaaaugagcucgggcaaucuccucuuuacaggucaccuaaaaugccggcugaggauggacaaacugcaauugaagggcaugucguacuccaugugcacagggaaauuuaagaucguaaaggaaaucgcggaaacccaacacggaacaauaguaauaagaguacaguacgagggcgacgggucaccgugcaaaauuccguucgagauuacggaccuagagaagcgacacguacuaggccgacugaucacgguaaaucccaucguuacagaaaaagacucccccgucaacaucgaagcugagccuccauucggggacagcuacaucauaauaggcgucgaaccgggccaacuaaagcugaauugguucaagaaagggaguucgauaggccaaauguucgaaacuaccaugaggggcgcgaagcggauggccauacuuggggacacggcgugggacuucggaagccuaggaggggucuucacuucaaucgguaaggcacuacaccaaguuuuuggcgccauauauggagccgccuucagcggggucagcuggaccaugaaaauccucauuggagucaucaucacauggaucggcaugaacagucggagcacaagccuaucggugagccucguacucguaggggucgucacccucuauuugggggccguagugcaagcagacagcggauguguaguaucguggaagaacaaagaacugaaguguggguccggaauauucauuaccgacaacgugcacacauggacggagcaguacaaauuucaaccugagucaccauccaagcucgccagugcuauccaaaaggcccacgaggagggcauaugcggaauccgaucaguaaccaggcuggaaaaccuuauguggaagcagauaacccccgagcucaaccacauacucucagagaacgaggucaaacuaaccauaaugaccggggacaucaagggcauaaugcaagcaggcaagagaagccugaggccccaaccgacggagcucaaauacucguggaaaaccugggggaaagccaaaauguuaagcaccgaaagccacaaccaaacauuccucaucgauggcccagaaacggcggaauguccgaauacuaaccgagcauggaacucccuagagguugaggacuacggguucggaguguucaccacaaauauauggcuuaaguugcgggagaaacaagacgucuucugcgacagcaaacucaugagugcggcgauaaaagacaaccgggcaguacacgccgauaugggcuacuggauagaaucggcccucaacgauaccuggaaaauggaaaaagcaucauucauagaagugaaauccugccacuggcccaaaucccacacacuguggagcaaugguguacucgaaucagagaugaucauacccaaaaacuucgcaggcccaguaucacaacauaacuaccgcccuggauaccacacacagacugccggcccauggcaucucggaaaacuggaaauggacuucgauuucugcgaggguaccacagugguggugacugaggacugugguaaucguggcccuagcuugcgaaccacaaccgcaaguggaaaacuaauuacagagugguguugcagguccugcaccuuacccccacucagguaucgcggggaagauggauguugguacggcauggagaucaggccgcuaaaagaaaaggaagaaaaccuagucaauagccucguuacugcaggucacggucaaaucgacaacuucucucuagggguacucggaauggcacuuuuccuggaggaaaugcuacgaacgaggaucggcaccaaacaugcgauccugcuaguggcaguuagcuuuguaacgcucauaacggggaacaugucguuccgggacuugggaagagucauggucauggugggcgccaccaugacugacgacauaggaaugggaguaacguaccucgcacuguuagccgcguucaagguacggcccaccuucgcagccgggcuccuacugcgaaaacuaacaucaaaagaauugaugauggcgaccauuggaauagccuugcugagucaaagcacaauucccgagaccauacuagagcuuacggacgcgcucgcacuagguaugaugguacuuaaaaucguacgaaauauggagaaauaccagcucgcaguaacaauaauggccauaagcugugucccaaacgcggucauacuacaaaacgccuggaaggugagcugcacgauauuagcggcggucagcguuucgccucugcuucucacauccucacaacagaaagcagauuggauuccucucgcgcuuacaaucaagggacucaacccaaccgcgauauuccuaacuacacugucgcguaccucgaagaagagaagcuggccacuaaacgaagcuauaauggcugucggaaugguaucaauacucgcgaguagucuucuaaagaacgacauccccaugacagggccuuugguagcgggcggucugcuaacgguauguuacguccucacaggccgaagugcagaucuugaauuagaacgcgcagccgacguaaaaugggaggaucaagccgaaaucucaggcagcucacccauacucucuauaacuauuuccgaagacgggucaaugagcaucaaaaaugaagaagaagaacagacccuaacgauccugauuagaacgggccuguugguaaucagcggcgucuucccugucaguauaccaauaaccgcggcugccugguaccucugggaagugaagaagcagagagcaggaguccucugggaugucccuagcccacccccgguugagaaagccgaacuggaagacggcgccuaucggauuaaacagcggggaauacuuggcuacagccaaaucggagcuggaguauacaaagagggcacauuccacacaauguggcacguuacaaggggagccguauuaaugcauagaggaaagcgcaucgaacccuccugggcagacgucaagaaagaccuaauauccuauggcggcggcuggaaacucgaaggagaauggaaagagggugaagaaguacagguacuugcgcucgagccgggcaaaaaucccagagcgguccagaccaaacccgggauauucaagacuaacacuggaaccauuggggcgguaagccucgauuucucgcccgggacaucagggagcccgauugucgaccgaaaggguaagguugucggacucuauggcaacggaguggucacccguagcggagcuuaugucucugccaucgcgcagacagaaaagagcaucgaagauaacccggagauugaagacgauauauuccguaagaagcggcugacaauaauggaccuccacccaggagcgggcaagacaaaacgcuaucucccagcuauaguccgugaagccaucaaacgaggguuaagaacucuuauacucgcccccacacggguagucgcggcggaaauggaggaagcauuacgaggacuacccauacgauaccaaacaccagcgauaaaaaccgagcacacggguagagaaaucguagaucucaugugccacgcgacguuuaccaugcgucuacugucgccaguacgggucccuaacuacaaccugauaauaauggaugaagcacacuucaccgacccagcguccauagcagcacggggcuacauaucaacccgaguagagaugggagaagccgccggaauauucaugacugcaacaccacccgggucccgagauccauucccacaaucaaacgcaccaaucauggacgaagagagagaaaucccagagcguucauggaauagcggacacgaaugggucacugacuucaagggcaagaccgucugguucgucccuucgauuaaggccgguaacgauauagcagccugccuacgcaaaaacggcaagaaagucauacaacuuagccggaagacauuugacagcgaauauguaaaaacgagggcuaaugacugggauuucguggucacgacggauauuagcgaaaugggagcgaacuucaaagccgaaagaguaaucgauccccgacgaugcaugaagcccgugauccuaacugacggcgaagaacgggugauacucgcgggaccgaugcccguaacccauuccagcgcggcacagcgacggggccggauuggccgaaaccccaaaaaugaaaacgaccaguacauuuacaugggcgagccacucgagaacgacgaggauugugcacauuggaaagaggcaaaaaugcugcucgauaacauaaacacaccagaagguauaauacccagcauguucgaaccugagcgugaaaaaguggacgccauagauggcgaguaucgguuaaggggcgaagccagaaagacuuucguagaccuaaugcgacgcggagaucuacccguuugguuggccuacaagguagcggccgagggaauaaacuacgccgacagaaaauggugcuucgaugguaucaaaaauaaccaaauccuagaggagaacauggagguugaaauauggaccaaagaaggcgaaaggaagaagcucaaaccacgcuggcuagacgcgagaauauacagcgacccacuagcucucaaggaguucaaagaguucgcagcuggacgaaagucucugacacugaacuuaauaacggagaugggacggcuccccaccuucaugacacagaaagccagaaacgcacuugacaaccucgccgugcugcacaccgccgaagccggagggagggcauacaaccaugcacucagugaacugccagaaacccuagagacacuucuccuccucacacuguuagcgaccgucaccggaggcauauuccuauuccuaaugucaggcaaggguauagggaagaugacgcugggaauguguugcauuauaaccgcaaguauacuacuaugguacgcacagauacagccccacuggauagcggccaguaucauccuagaguucuuccucaucguccuccuuauuccagaaccggagaaacagcgcacgccacaagacaaccagcuaaccuacguaguuauagcaauacucaccguaguggcagcaacaauggccaacgagauggguuuucucgagaaaacgaagaaggaucugggacucggguccauaaccacccaagaaagcgaguccaacauacuagacauagaccuacggcccgcaucggcguggacacuauacgcgguggcuaccacauucguaacaccuaugcucaggcacagcaucgaaaauuccucgguuaaugucucgcucaccgcaauagcaaaccaagcgacagucuugaugggccugggaaaaggauggccucuaaguaagauggacauaggagucccacuacucgcuauaggcuguuacucacaagugaacccaauaacacuaacagcagcacuccuccuacucguagcgcacuacgccaucaucgguccagguuugcaggcaaaggccacccgcgaagcccagaaaagagcggcggcaggaauaaugaagaauccaaccguggacggaauuacaguuaucgaccucgaacccauaccauacgacccaaaguucgagaaacaacugggacaagucaugcucuuaauccuaugcgucacgcaaguacucaugaugcgcacaaccugggcacucugcgaggcccugacucuggccaccgguccgaucaguacauugugggaaggaaaccccggacgauucuggaacaccaccaucgccguuucaauggcaaauauauuccgaggaagcuaucuugcaggcgcgggucucuuguucucaauaaugaagaauaccacuucaacccgacgaggcacaggaaauauaggagaaacgcuaggagaaaaguggaaaagucgucugaaugcucuaggcaaaagugaguuccagauauacaagaaaaguggcauacaggaagucgaucgaacguuggccaaggaagguaucaagcgcggggaaaccgaucaccacgcggucucgcgaggaucggcuaaacugcgcugguuuguggaacgaaacauggugacgcccgagggaaaaguagucgaccugggcugcggucgagggggauggucauacuacugcggaggccucaaaaacguuagggagguaaagggacuaacaaaaggcggcccggggcacgaagaaccgauaccaaugucgacauacggguggaaucucgugcgccuucagucuggcgucgauguauucuuuacaccaccagagaaaugcgauacgcuguuaugcgauauuggugaaucaagucccaauccgacgauagaggcagggcggacuuuaagagugcucaaucuagucgaaaacuggcugaacaacaacacacaauucuguauaaaggugcugaacccguauaugcccuccgucaucgagaagauggaagcgcuacaacgccaauacggaggggcccuuguccguaacccgcuaucccguaacagcacacaugaaauguacugggucaguaacgcaacaggaaacaucguuuccucugugaacaugaucucgcgaaugcuaaucaaucgauucaccaugaaacacaagaaggcgacauaugaaccggacguggaucucggcuccgggaccagaaacauuggcauugaaagcgaaauucccaaccuggacauaauaggcaaaaggauugagaaaauaaagcaggagcacgaaaucagcuggcauuacgaucaggaccacccguacaagacaugggcuuaucacggaagcuaugaaacuaagcaaacaggaucugccagcagcauggucaauggggucguacggcuguuaacuaagcccugggaugugguaccaaugguuacgcaaauggcaaugacagauacaacgccauucggacagcagcgagucuucaaggagaaaguagacacuaggacucaagaaccgaaagaaggcacgaagaaauugaugaagauaacggcugaauggcuauggaaagaacuggggaaaaagaagacaccgcgaaugugcaccagagaagaguuuaccaagaaaguccgcagcaacgccgcgcucggcgccauuuucacugaugaaaacaaguggaaguccgcaagggaagccgucgaggacggccgcuucugggagcucguggacagagaacgcaaccuccaccucgaaggaaaaugcgagacuugcguauauaacaugauggguaaacgagagaagaagcucggggaauuuggcaaagcaaaaggaagccgggcaaucugguauauguggcugggugccagguuccuggaauuugaagcacugggguuccuaaacgaggaccacugguucaguaggggaaauucauuaucgggagucgaaggagagggucuccauagauuaggguacauccugcgcgaugucgggaagaaagaaggaggagccauguacgccgacgacacggccggaugggacacgcggauuacccuggaggaccuaaagaaugaggagauggugaccaaccacaugaaaggagaacacaaaaaguuggcugaagcaauauuuaagcucaccuaccaaaacaaggucguucggguacagcgcccgaccccacgcgggacagucauggacauuauaagccguagagaucaacgcgggucaggccaaguuggaacauacggccucaauaccuucacuaacauggaagcacagcucaucaggcagauggagggagaaggaauauucaagagcauacaacaucucacugcaacagaggagauagccgugcagaacuggcucgcgagagucggaagagaacgccuaagcagaauggccauaucaggcgaugacugcguggucaaaccaauagacgaccgguucgcauccgcacuaacugccuuaaacgauaugggcaaagugcguaaagacauccaacaaugggaacccagcagaggguggaaugacuggacacaagucccguucugcucacaccauuuccaugaauuagucaugaaagacggccgugugcuaguaguaccaugcaggaaccaagaugaacuaauaggacgagcccgaaucagccaaggagcaggauggaguuugaaagaaacggcgugccuuggaaagucauacgcccaaauguggacucuaauguacuuccaccgacgcgaccuacggcuggcugcuaacgccauaugcagcgcggugccgucacauuggguaccaacuagccguaccacguggucgauccacgccaagcacgaguggaugaccacugaagacaugcuugcgguauggaacagggucuggauacaagagaaccccuggauggaagacaaaacaccuguggagagcugggaggagguuccauaccuuggaaaaagagaagaccaauggugugguagucucauaggacugacgagcagggcuaccugggccaagaacauccaaaccgcaauuaaucaagugcgcagcuugaucggaaacgaagaauacaccgacuacaugccaucaaugaagagauuucgaagagaagaagaggaagcaggcguccuaugguaa

SEQ ID NO: 25018 - RNA, 9876 nt, Artificial Sequence
  derived and/or modified CDS sequence (opt11) from DENV-2__EU596500__SS-prME
accgcgggcgugauuguuaugcugaucccuaccgcaauggcguuccacuugacuaccagaaacggggagccccacaugauugugggccggcaggagaaggggaagucccugcuguucaagaccgaggacggcguaaacaugugcacacuaauggccaucgaccugggggaacugugcgaggacaccaucacauacaagugcccccuccugagacagaacgagccugaggacaucgacugcuggugcaacagcaccagcaccuggguuacguacgggaccugcaccaccacgggcgagcaccggcgcgagaagcgguccguggccuugguaccccacgucgggaugggccucgagacucgcaccgagaccuggaugucuagcgagggggccuggaagcacgugcagcggaucgagacuuggauccuucgccacccgggguucacuaucauggccgcgauucuagccuacaccaucgggaccacgcacuuucagcgggccuuaaucuucauucuguuaacugccguggcgccaagcaugaccaugcgcuguauaggcaucagcaaccgggacuucgucgaaggcguuagcggcggcuccuggguggacaucguccuugagcacgggagcugcgugaccacgauggccaaaaacaagcccacccuggacuucgaguuaauaaagaccgaggccaagcagccagccacucucaggaaguacugcaucgaggccaagcugacgaacacgaccacggagucccggugcccgacgcagggcgagcccagccugaacgaggagcaggacaagcgcuucaucugcaaacacucaaugguggaccggggcugggggaacggcugcggauuauucggcaagggcggcauagugaccugcgcgauguucacgugcaagaagaacauggagggcaagguagugcagccugagaacuuggaauauaccaucgucaucacgccccacucuggggaggagcacgcugugggcaaugacaccgggaagcacggcaaggagauuaagaucacuccgcaguccagcaucaccgaggccgagcugaccggguacggcacggugaccauggagugcagcccccggacaggcuuagacuucaacgagaugguccuguuacaaauggaggacaaggccuggcucgugcaccggcagugguuccuggaccugccacuccccuggcugccaggcgcugauacccagggcucaaacuggauccagaaggagacgcuggugaccuucaagaacccccaugcgaaaaagcaggacguggugguccucggaucccaagagggcgccaugcauacagccuugacgggggccacggagauucagaugagcagcggcaaccuccuauucaccggccaccugaaaugccgccugaggauggacaaauugcaacugaaggggauguccuacucaauguguaccggcaaguuuaagaucgugaaggagaucgcagagacccagcacgggacgaucgugauacgaguacaguacgagggcgacggcagccccugcaagauccccuucgaaaucaccgaccuggaaaaacggcaugugcucggucgccugauaaccgugaacccgaucgugaccgagaaggacagccccgugaacaucgaggcggagccgcccuucggggacuccuacaucauaaucgggguugagccuggccagcugaagcucaacugguucaaaaaggggagcuccaucggccagauguucgagacgaccaugcgcggcgccaagcgaauggccauccuaggggacaccgcaugggauuucggcucacuuggcggggucuucaccuccaucgggaaggcccuccaccagguguucggggcgauuuacggcgccgcguucagcgggguguccuggacgaugaagauccuaaucggcgucaucaucacauggaucgggaugaacagccgcuccacaucucuguccgugagccucgugcuugucggcgucgugacccuguaccugggggccguugugcaggccgacuccggcugcguggucagcuggaaaaacaaagagcucaagugcggauccgggaucuuuaucacagacaacgugcacaccuggaccgagcaguauaaauuccagcccgagagccccagcaagcuagccuccgccauccagaaggcccaugaggagggcaucugcgggauucggagcgugacccgccuggagaaccuaauguggaagcagaucacccccgagcugaaccauauccuguccgagaacgaggucaagcucaccauuaugaccggcgauaucaaggggaucaugcaggccggaaagcggagccugcgcccgcagcccaccgagcugaaguacagcuggaagacauggggcaaggccaaaaugcucagcaccgagucgcacaaucagaccuuccuaaucgacggacccgagaccgcggagugcccgaacacuaaccgggcuuggaauagccucgagguggaggacuacggauuugggguguucacuaccaacaucuggcuaaagcugcgcgagaaacaggacguuuucugcgacuccaagcugaugagcgccgccaucaaggacaaccgggcgguacacgcugauaugggcuacuggaucgaguccgcccucaacgauaccuggaagauggaaaaggccagcuucaucgaggucaaguccugccacuggcccaaaagccacacgcugugguccaacgguguccuggagucagagaugguaauccccaagaacuucgccgggcccgugucccagcacaacuaccgcccgggcuaccacacccagaccgccggccccuggcaccucggcaagcuggagauggacuucgacuucugcgaggggacaaccgucguggugacagaggacugcggcaaccggggcccaagccugcguaccacaaccgccucggggaagcucaucacggaguggugcugcagauccugcacacuacccccgcugcgcuaccggggcgaggacgggugcugguacggcauggaaauccgcccccucaaagagaaggaggagaaccuggucaacucgcuugugaccgccgggcauggacagaucgacaacuucucccucggcgugcuggguauggcccuguuccucgaggagaugcugcggacccgcaucggcacgaagcacgcgaucuuacuaguagccguguccuuuguaacccugaucacggggaauauguccuuccgugaccucggccgggucauggugauggucggggccacuaugacggacgauaucggcaugggcgugaccuaucuggccuuacuggccgcguucaagguucgcccgacguuugccgccggguuacugcuacgaaagcucaccucgaaggagcugaugauggcgacgaucggcauagcgcugcucucccagagcacuauccccgaaaccauccuggagcugaccgaugcgcucgcauugggaaugaugguguuaaaaaucguccgcaacauggagaaguaccaauuagccguuacgauuauggccaucuccugcgugccgaacgcagugauccuccagaacgcuuggaaggucucuugcaccauccuggccgccgucuccgugagccccuugcugcugaccuccagccagcagaaggcggacuggaucccccucgcgcucaccaucaagggccugaacccaacagccauuuuccucaccacccuguccaggaccucgaagaagagaucuuggccgcugaacgaggccaucauggcuguaggcauggucagcaucuuagccuccucacugcugaagaacgacauacccaugacggggccccucguggcgggcgggcugcugaccgucugcuacgugcucacgggccggagcgccgaucuggagcuggagagagccgcugacguaaagugggaggaccaggccgagaucuccggaagcucccccauccugucaaucaccauaucagaagacggcagcaugaguaucaagaacgaggaggaggagcagacgcugaccauccucauccgaaccgggcuccuggugaucagcggcgucuuuccgguguccauccccauuacugcggcugccugguaucugugggaggugaagaagcagcgcgcuggcguccucugggacguacccagcccaccgcccgucgaaaaggccgagcuggaggacggggcguaccgaaucaaacagcgcgggauucugggguacucacaaaucggcgccggcguguauaaggaagggaccuuucacacaauguggcaugugacccgcggcgcugugcucaugcaucgcgggaagcggaucgagcccucgugggcggacgucaagaaggaccugauaucauacggcggaggcuggaagcuggaaggcgaguggaaggagggggaggaaguccaagugcucgcccuugagccgggaaagaacccccgagcgguccaaaccaagccaggcaucuucaagaccaacacgggcaccaucggggccgugagccuugacuucucccccggcaccagcggcucccccaucguggaccggaaggggaaggucgugggacuguacgggaacggcguggucacccgcagcggggccuauguguccgcaaucgcgcagacggaaaaauccauagaggacaauccagagauugaggacgacaucuuccggaagaaacgccugaccaucauggaccugcaccccggagccggcaagaccaagcgguaccuccccgccaucgugcgcgaagccaucaagagaggacugcgcacacugauucuggccccgacgcgcgucguggcggccgagauggaggaggcccuccggggccugcccauacgcuaucagacccccgccauuaagaccgagcacacugggcgggagaucguggaccucaugugccacgccacguucaccaugcgccuccuaagccccguacggguuccaaacuauaaccuuaucaucauggacgaggcgcacuuuaccgaccccgccuccauugccgcccgcggcuacaucagcacccggguagagaugggcgaggccgcgggaauuuucaugacggcuacgccgcccggcucucgcgaccccuucccccagucgaacgcccccaucauggacgaagagagagaaauccccgagcgcuccuggaacagcggccacgagugggucaccgacuucaaggggaaaaccgugugguucgugccaucuaucaaggccgggaacgauaucgcggcuugccugcggaagaacggcaagaagguaauccagcuuagccgcaagacauucgacuccgaguacgugaagacccgggccaacgacugggacuucguggucacgacggacauuagcgagaugggcgcuaacuucaaggccgagagggugaucgacccccggagaugcaugaagcccgugauccugacggacggggaggagcgggucauccucgcaggcccgaugccggugacacacuccagcgccgcccagcgccgggggcgcaucggccgcaaccccaagaaugagaaugaccaguacaucuacaugggcgagccccuggaaaacgacgaagauugcgcccacuggaaggaggcuaagaugcugcucgauaacaucaacacccccgagggcaucauaccaaguauguucgagccggagcgggagaaaguggacgcgaucgacggcgaauaccgccugcgcggugaggcccgcaagacuuucgucgaccugaugcggcgcggcgaccucccuguguggcucgccuauaagguggccgccgaggggaucaacuaugcggaccggaaauggugcuucgacggcauaaagaacaaucagauccuggaggagaacauggagguagagaucuggacgaaagagggggagcgcaagaagcucaagccgcgauggcuggacgcgcggauuuacuccgacccccuggcccucaaggaguucaaggaguucgccgcgggccggaagucgcugacccugaaccucaucacggagaugggccgccuucccaccuucaugacgcagaaagcucgaaacgcccuggacaaccuugccgugcugcacacugccgaggccggcggccgcgccuauaaccacgcccucagcgagcuccccgagacccuggagacuuugcuccugcucacgcuacuggccaccguaaccgggggcaucuuccuguucuuaaugagcggcaagagcauagggaagaugacgcugggcauguguugcaucaucacggccuccauccugcucuggcacgcgcagauucagccgcacuggauagccgccagcaucauacuggaguuuuuccugaucgugcucuugauccccgagcccgagaagcagcggacgccgcaagauaaccagcugaccuauguggucaucgccauccucaccgucguggccgcgacaauggccaacgagauggguuuccuagagaagacgaagaaggaccugggccucgggagcauuaccacacaagaguccgaaagcaacauacuggacaucgauuuacgcccggccuccgccuggacucucuaugccguugcgacaaccuucgugacacccaugcugcggcauaguaucgagaacuccucagugaaugucucccugaccgcuaucgccaaccaggccacagugcucaugggccuuggaaagggguggccccugagcaagauggacauugguguuccccucuuugcgaucggguguuacuaccaggucaaucccaucacccuaaccgccgcgcugcuccugcuaguagcccacaacgccaucaucggccaggggcuccaggcgaaggcgaccagggaggcccagaagcgggccgccgcggggaucaugaaaaaucccacgguggacggcaucaccguuauugaccucgagcccauuccuuaugacccaaaguucgagaagcaacuaggccaggugaugcuccugauccugugcguaacccaggugcucaugaugcgcaccacgugggcccugugcgaggcccugacccucgccaccggccccauuaguacccugugggaggggaaccccggccgguuuuggaacacgacgaucgcagucagcauggcgaauaucuuccgcggauccuaccuggccggcgccggccuccuguucagcaucaugaagaacacaaccuccacgagaaggggcacgggcaacauaggggaaacccuuggagagaaguggaagucccgccucaacgcgcugggcaaguccgaguuccagaucuauaagaaguccgggauccaggagguggaccguacucuugcgaaggagggcaucaagcgcggggagacagaccaccacgccgucucccggggcagcgccaagcucaggugguucgucgagcggaacauggugacgccggaagggaaggucguagaccugggcugcggccgcggaggcuggucguacuauugcggggggcugaagaacguaagagaggucaaggggcucaccaagggcggcccugggcacgaggagcccaucccgaugucuaccuacggcuggaaucuggugcgccugcagagcgggguggacgucuucuucacgcccccggagaagugcgacacccuccugugcgauaucggcgaguccucacccaaucccaccaucgaggccgggcggacccugcgcgugcucaaucugguggagaacuggcugaacaauaacacccaguucugcaucaaggugcucaacccuuacaugccuuccguaaucgagaagauggaggcucugcagcggcaguauggcggcgcgcucguccgcaacccccucagcaggaacucgacgcacgagauguacugggugucuaacgcuaccgggaacaucgugucaagcgugaacaugaucucucgcaugcugaucaaccgguuuacuaugaagcacaagaaagccaccuaugagcccgacgucgaucuugguuccgggacgcgcaacaucggcaucgagaaugagaucccgaaccuggacaucaucgggaaacggaucgagaaaaucaagcaggagcaugaaaucuccuggcacuacgaccaggaccaccccuauaagaccugggccuaccacggcagcuacgaaaccaagcagaccggcuccgccagcuccauggugaacggugugguccgccucuuaacgaagcccugggauguggugccaauggucacccaaauggccaugaccgacaccacgccguucggccaacaacgcguguucaaagaaaaggucgacacccggacacaagagccaaaggaggggaccaagaaguugaugaagauuacggccgaguggcucuggaaggagcugggcaagaagaagaccccccgcauguguacccgggaggaguucacccgcaagguccggucgaacgccgcccucggcgccaucuuuacggacgagaacaaguggaaguccgcccgugaggccguggaggauggacgguucugggagcucguggaucgagagcgaaacuugcaccuugaaggaaagugcgaaacaugcgucuacaacaugaugggaaagcgcgagaagaaguugggcgaguucggaaaggccaagggcagccgagccaucugguacauguggcugggggcgagauuccuggaauucgaagccuugggguuucuaaacgaggaccacugguucucccggggcaacucucugucagggguggagggcgaggggcuccacagauugggcuacauccugcgggacgucggaaagaaggagggcggcgcuauguacgccgaugacaccgccgggugggacacccgcaucacgcucgaggacuuaaagaacgaggagauggugaccaaccacaugaagggcgagcacaagaagcuggcggaggccaucuucaagcugaccuaccagaacaagguugugcgggugcagcgccccacgccgcgggggacggugauggacaucaucucccgccgugaccagcgcggcagcggccaggucggaaccuacggccuuaacaccuucaccaacauggaggcucaacugaucagacagauggagggggaaggcaucuucaaguccauccagcaccucacggccaccgaggagaucgccgugcaaaacuggcuugcgcguguuggccgcgagcgccugagccgcauggcgaucuccggcgacgacugcgucgugaagcccaucgacgaccgguucgccucagcacucaccgcccuuaaugacaugggcaaggugcgcaaggacauucagcagugggaacccucccggggguggaacgacuggacccagguccccuucugcucccaccacuuccacgagcuugugaugaaggacggccgcgugcucgucguaccgugccggaaccaggacgagcugauaggacgcgcccggaucagccagggagcaggauggagccugaaggagacggccugccuggggaaguccuaugcccagauguggacgcugauguacuuccaccgcagagaucuucgccucgccgcgaacgcaauuugcagcgcaguaccuucccacugggucccaacgagccgaacaacgugguccauacacgccaagcacgaauggaugacaacggaggacaugcuggcgguguggaaccguguuuggauccaggaaaaccccuggauggaagacaagaccccaguagagagcugggaggaggugcccuacuuggguaagcgggaggaccaguggugcggcucccucaucgggcuaaccucgcgggccacgugggccaagaacauccaaaccgccaucaaccagguccggagccugaucgggaacgaagaguauaccgauuacaugcccuccaugaagcgcuuccgccgggaggaggaggaggccggcguucucugguga

SEQ ID NO: 25019 - RNA, 9876 nt, Artificial Sequence
  derived and/or modified CDS sequence (opt11) from DENV-2__EU482626__SS-prME
acugcgggcgucaucgucaugcugauccccacugcaauggcguuccaccuuaccacgcguaacggggaaccucacaugauagucggccggcaggaaaaagggaaaucccugcuguuuaagacugaagacggcgugaacauguguacccucauggccauagaucugggggagcugugcgaggauacaaucacauauaagugcccccuccugcgccagaacgaacccgaagacaucgauugcuggugcaacagcacuagcaccugggucaccuacgggacuugcaccaccacgggcgagcaccgucgagagaagcgguccguagcccuggucccccacgucggcaugggccuugaaacccgcacugagaccuggaugucuagcgagggggccuggaagcacguacagaggaucgaaaccuggauccugcgccacccagguuucaccauaauggccgcgauccuggccuauacuauuggcaccacgcacuuccagcgagcccuaaucuuuauccugcugaccgccguggcgccuagcaugaccaugagauguaucggcaucucaaaccgggacuucgucgaagguguaagugggggcucuugggucgacaucguccuggagcaugguagcugcgugaccacgauggccaagaacaaaccuacauuagacuuugagcucaucaagacagaagcaaaacaacccgccacucuacgcaaguacugcaucgaggccaagcugacgaacaccaccaccgaaagccggugcccgacccagggcgagccaagccugaaugaggagcaggacaagcgcuucauaugcaagcacuccaugguggaucgaggcugggggaacggcugugggcuguucggcaaaggagggauagugaccugcgcgauguuuacuuguaagaagaacauggagggcaagguagugcagcccgagaaccuggaauacacuaucgugaucacgccccacagcggggaggaacacgccguggguaaugacacaggaaaacacggaaaggagaucaagaucaccccgcaguccuccauuaccgaggcggaacugaccggauaugguacggugacaauggaaugcagcccaagaaccggcuuggacuuuaaugagauggucuuacugcagauggaggacaaagccuggcucgugcaucggcagugguuccuggaccugccccucccguggcugcccggggccgacauccagggcagcaauuggauucagaaggagacccuagugacauucaagaacccacacgccaagaagcaggacguaguggugcuagggucccaggagggagccaugcacaccgcccugaccggggcaacagagauucaaaugucguccggcaacuuacucuucacaggccauuuaaagugcaggcugcggauggacaagcuccaguugaaggggauguccuacucaaugugcaccggcaaauuuaaaaucgucaaggagaucgcagagacccaacacgggaccaucguuauccgcguccaguacgaaggcgauggaucucccuguaagauccccuucgagaucacagaccuggagaaacggcaugugcuggggcgacugauuaccgugaacccgaucgucaccgagaaggacagccccguaaacauagaagcagagccucccuucggagauucuuacauuaucauuggugucgagccgggucaguuaaaacucaauugguucaagaaagggagcuccauugggcagauguucgaaacuaccaugaggggcgcgaagcggauggccauccucggggacaccgccugggacuucggcagccucggaggcgucuucaccuccauaggcaaggcccuucaccagguguucggcgcgaucuacggagcggcauuuagcggggugucauggacuaugaaaauucugaucggcgucaucaucacguggaucggaaugaacagucgcuccaccucgcugucuguuagccugguguuaguuggcguggugacccuguacuugggggccgucguccaggcugacucuggcuguguagugagcuggaaaaacaaggaguuaaaaugcggauccgggaucuucauuaccgacaacguacacacguggaccgaacaguacaaguuccagccggaaucccccucgaaauuagccagugccauacagaaagcccacgaggagggaaucugcgggaucagguccgugacaaggcuggaaaauuuaauguggaagcagaucaccccugagcuaaaucacauccuauccgagaacgaggugaaauugacgaucaugacuggggacauaaaggggaucaugcaggccggcaagcgaucacugagaccgcagccgacccaacuuaaauacucguggaagacgugggguaaggcgaagaugcucagcacugagucccauaaccaaaccuuucugaucgacgggcccgagaccgcggaguguccuaacacaaacagggccuggaauagccuagaggucgaggacuauggcuucggggucuucacgacaaacauauggcucaagcugcgcgaaaagcaggacgucuucugcgacuccaagcugaugagugccgccauuaaagacaaucgggcugugcacgccgacaugggcuacuggauugaguccgcccuaaacgacaccuggaagauggaaaaagccagcuuuaucgaagugaaguccugccacuggcccaagagccacacucuauggaguaacggcguccuggagagugagaugaucauacccaagaacuucgccgggccggugagccaacauaacuaccgcccgggcuaccacacccagacagccgggccauggcaccucgggaagcuggagauggauuuugauuucugcgaggggacgaccguagucgugaccgaagacugcggcaaucgggguccuagccuucgcacgacuaccgccuccgggaaacuaaucacagaguggugcugccggucgugcacgcugcccccgcuccgcuaccggggugaggauggcugcugguauggcauggagauucgccccuuaaaggagaaggaagaaaaucuggugaauagccugguaaccgcugggcaugggcagaucgacaacuucucucucggcguacucgggauggcccuguucuuagaggaaauguugcggaccaggauuggcaccaagcacgcaauucuguuaguggccguuuccuucgugacgcugauaaccgggaacauguccuuccgggaccugggccgcguuauggucaugguuggggcgaccaugaccgacgacauaggcaugggggugacguaucucgcacuguuagccgcguucaaggugcgcccaaccuucgccgccggccuccugcugcgaaaguuaaccagcaaggagcugaugauggcaacuaucggcaucgcacuguuaagucagagcaccauccccgagaccauccucgagcugaccgacgcgcucgcccuggggaugauggugcuaaagaucguccgcaauauggaaaaguaccaacuagccgucaccaucauggccaucaguugcgugcccaaugcagugauacuccagaacgcuuggaaggucagcugcacaauccuggccgccgugagugucagcccccuucugcugacauccagucaacagaaagcggauuggauccccuuggcacugaccauaaaaggccuuaaucccaccgccaucuuccucacgacucuuucccgcaccagcaagaagcgcuccuggccgcugaaugaagcgauuauggcaguuggaaugguauccauccucgccucgagccuccucaaaaacgacaucccuaugaccgggccauuagucgcgggcggguuauuaacugugugcuacgucuuaaccggccggagcgccgaccuagagcuggagcgcgccgccgacgucaaaugggaggaccaggcagagaucucggggucuagccccauccucagcaucaccaucagcgaagacggcagcaugaguaucaagaaugaagaggaagaacaaacccucacgauccugauccggaccggccucuuagugaucagcgggguguucccagucuccauccccaucaccgcggccgcgugguaccugugggagguuaagaagcagagagcaggcgugcucugggacguccccagcccgccuccaguggagaaggccgagcuugaggauggcgcguaccggaucaagcagcguggcauccugggcuauucccagaucggcgccgguguguacaaggaggguaccuuccacacaauguggcacgucacuagaggggcagugcucaugcacaggggcaagcggaucgagccaucaugggccgaugugaagaaagaccugaucaguuauggcgggggcuggaaacuggagggcgaauggaaggagggggaggagguccagguccucgcccuggagccaggcaagaacccccgcgcugugcagaccaaacccgggaucuucaagaccaacaccggaacgaucggggccgugagccuggacuucucaccggguaccagcggcucuccgaucguggaccgcaaagggaaggugguaggccucuacgggaacggcguggugacccgaagcggcgccuacguuucggcaaucgcgcagacggagaagucaaucgaggacaacccggagaucgaggacgacaucuucaggaagaagcgccuuacgauaauggaccugcaccccggcgccgggaagaccaaacgguaccuccccgcaauugugcgcgaggccaucaagagggggcugcgcacucugauacuggcucccacccgcguggucgcggcugaaauggaagaggcccuccggggacuccccauccguuaccagacccccgccauuaagacugagcauaccggacgcgagauuguggaccucaugugucaugcuaccuucacgaugcgccuccugagccccguccgggucccgaacuacaacuuaaucauaauggacgaggcacacuucacggaccccgccuccaucgcugcccgagguuauaucagcacucguguugaaaugggggaagccgcggggaucuucaugacggcuacgccgccuggguccagggacccguucccccaaagcaacgcacccaucauggaugaggagcgggagauuccggagcgauccuggaauagcggucacgagugggugaccgacuucaaaggcaagaccgugugguucgucccauccauaaaggccgggaacgacaucgcggccugucuacggaagaauggcaagaaggugauccagcugucucgaaaaaccuucgauuccgaguacguaaagacgcgggccaacgacugggacuucguagugaccaccgacaucagcgagaugggagccaacuuuaaggccgagcgugucaucgauccccggcgcugcaugaagccggugauccugacugacggggaggagcgggugauacuagcaggacccaugccggucacucacucuagcgccgcacagagacgggggcgcaucgguaggaaucccaagaacgaaaacgaccaguacaucuacaugggggaaccgcuggagaaugaugaggacugugcucacuggaaggaagccaagauguuacucgacaacaucaacacucccgagggcaucaucccgaguauguuugagccagagcgcgagaagguugacgcaaucgacggagaguaccgauuacgcggggaagcccgcaaaaccuucguggaucugaugcggaggggcgaccuacccgucuggcuggccuacaaaguggccgccgaggggaucaacuacgccgaucgcaaguggugcuucgacgguaucaagaacaaccagauccuggaggagaauauggagguggagaucuggaccaaggaaggagaacgcaagaagcuaaagccgcgguggcuugacgcccgaauuuacagcgacccauuggcgcucaaggaguucaaggaauuugccgcggggaggaaaucguugacucugaaccucaucaccgagauggggcgccugccgaccuucaugacgcagaaagcccguaaugcccuggacaaucuugccguccugcacacggccgaggccggcgggcgcgccuacaaccacgcacugagcgagcucccagagacauuagagacacuacuccugcugacacugcuggccacggugacugguggaaucuuccuuuucuuaauguccgguaaagggaucggcaagaugacccuggggauguguugcaucaucaccgcaagcauccuguuaugguaugcccaaauccagccacauuggaucgccgccuccaucaucuuggaguuuuuccuuaucgugcuccugauccccgaacccgagaagcagcgcacgccccaagauaaccagcugacguaugucgugaucgcgauccucacaguuguagccgcgaccauggccaacgagaugggauuccuggagaaaaccaagaaggaccugggucuaggcaguaucacgacacaagagagcgaguccaacauucuggacaucgaucugcgcccagcguccgccuggacccuuuacgccguggcgaccacauucgucacacccauguugcggcacaguaucgagaacagcagugugaacgugagccucacggcuaucgcuaaccaagccaccgugcuuaugggccugggaaagggauggccacugagcaaaauggacauuggcgugccccuccuggccaucggcugcuacagucaggugaacccgaucacgcugaccgccgcccuccuucugcuggucgcccacuaugccauuauaggacccgguuuacaggcgaaggccacccgcgaggcccagaaaagagcagccgcgggcauuaugaaaaauccuaccguggacgggaucacuguuaucgaucuggagccuaucccguacgaccccaaauucgagaagcaguuaggccaggugaugcugcugauccuaugcgugacccaagugcuuaugaugcgcaccaccugggcacugugcgaggcccucacgcuggcuaccggacccaucuccacccugugggagggcaaccccgggcgcuucuggaacacgacgaucgccguuagcauggcgaacaucuuccgcggauccuacuuagccggcgcagggcuccucuucagcaucaugaagaacacgacuucaaccagacgggguacgggcaacauaggcgagacccugggggagaaauggaagucucgccugaacgcccuggggaaguccgaguuccagaucuacaagaaguccggaauccaagagguggaucggacccucgcaaaggaagggaucaagcgcggcgagaccgaccaccacgcggucucccgggggagcgccaagcuacgcugguucgucgagagaaauauggugacaccggagggcaagguggucgaccuggguugcgggcgcgggggcuggucguacuacugcgguggcuuaaagaacgugcgggagguaaagggucugacaaagggcggccccgggcaugaggagcccauucccaugagcaccuacgguuggaacuugguuagauuacagucaggagucgacguguucuucacaccgcccgagaaaugcgacacgcuacugugcgacaucggggagucaucgccgaaucccacaaucgaggccggccguacccuccgcguucugaaccugguggaaaacuggcucaacaauaacacccaguucuguaucaagguucugaaccccuacaugcccucggucauagagaagauggaggcuuugcaacggcaguauggcggggcgcucgugcgcaauccucugucccggaacuccacccacgaaauguacugggugucaaacgccaccgggaacaucguaucaagcgugaacaugaucuccaggauguuaaucaaccgauucaccaugaaacacaagaaggccaccuaugagccugauguugaccuuggaucuggcacucgcaacaucgguauugaguccgagauccccaaccucgacaucaucggcaaaagaaucgagaagaucaagcaagagcacgagauuagcuggcacuacgaccaggaccacccuuacaagacgugggccuaucaugguuccuaugagaccaaacagacugggagcgcuuccagcauggucaauggcguggugcgucuccuaacaaagcccugggacguugucccgauggugacccagauggcgaugaccgauacuacgcccuucggccaacagcgcguauuuaaggagaaaguagacacacgaacacaggaaccgaaagagggcaccaaaaagcucaugaagauaaccgccgaauggcucuggaaggagcugggcaagaagaagacgcccaggauguguacccgggaagaguucaccaagaaggugcgcuccaacgccgcacucggugcuaucuuuaccgacgagaacaaguggaaguccgcucgggaggcugucgaagacggccgcuuuugggagcugguugaccgugagcgaaaccugcauuuagagggaaagugcgagacgugcguguacaacaugaugggcaagagagagaaaaagcugggggaguucggcaaagcuaagggcucccgggccaucugguacaugugguugggggcgcgguuccuugaguucgaggcgcugggcuuccugaacgaggaucauugguucaguaggggaaacucucucucaggggucgagggggaaggccuucaccgccugggcuacauucuccgcgacguuggcaagaaggagggcggggccauguacgcugacgauacugcuggcugggacacccggauuacccuggaggaccuuaagaaugaggaaauggucacgaaccacaugaagggggagcacaagaaacucgcugaagccauauuuaagcugaccuaccagaacaaggucgugcgcguucagcggccgacaccccgcgguacuguuauggauauuaucagccggagggaucagcggggcuccggacaaguaggcacuuaugggcugaauaccuucaccaacauggaggcccagcuaaucaggcaaauggaaggcgagggcauuuuuaagaguauccagcaccucaccgcuacggaggaaaucgccguccaaaacuggcuggcgagaguggggcgggaacggcucucgcggauggcgauuucuggcgaugacugcguggugaagcccauagacgacagguucgcguccgcccugacugcccugaacgauaugggaaaggugcguaaggacauccagcagugggagcccucacguggguggaaugacuggacacaggugccguucugcucccaccauuuccaugagcucgucaugaaggacgggcgggugcuaguuguuccuugccggaaccaagacgagcugaucggccgggcgcgcaucagccagggcgccggguggucacuaaaggagacggccugucugggaaagagcuaugcccagauguggacccugauguacuuccaccggcgcgaccuaaggcuugcagcgaaugcuaucugcagugccgugcccagccauugggugcccaccucccgcacaaccuggagcauccacgccaagcacgaguggaugacuacggaggacaugcuggcgguuuggaauagggucuggauccaggagaacccguggauggaggacaagacccccguggaguccugggaagagguccccuacuuggggaagcgcgaggaccaauggugcggcagucuaauuggucuaaccagccgggcaacgugggccaagaacauccagaccgccauaaaucaggugcgcucacucaucggcaacgaagaauacacagacuacaugcccucaaugaagcgguuucgccgcgaagaggaggaggccggggugcuaugguaa

SEQ ID NO: 25020 - RNA, 9876 nt, Artificial Sequence
  derived and/or modified CDS sequence (opt11) from DENV-2__EU482629__SS-prME
accgcgggcguuaucgugaugcugauccccacagcgauggcguuccaucucaccacgagaaauggggagccacacaugaucgucggccggcaggagaaggguaagagucugcuuuucaaaaccgaagacggcguuaacauguguacccugauggccauugaccugggggaacucugugaagacaccaucaccuacaaaugcccguugcugcgacagaacgagcccgaggacaucgacugcuggugcaauagcaccucgacgugggucaccuacgggaccugcacgacuacgggcgagcacaggcgcgaaaagcgcucggucgcuuuaguuccacacgucgggaugggcuuagaaaccagaacugagaccuggaugagcuccgagggcgcguggaagcacguccagcggaucgagaccuggauccugcggcacccuggcuuuacgaucauggccgcgauccuggccuacaccauugggacuacccacuuccaacgugcgcuuauauuuauccuucugaccgccguggccccaagcaugaccaugcgcuguauuggcauuuccaaccgugacuucguggagggugugagcgggggguccuggguggacaucguccucgagcacgguagcugcgugaccacgauggcaaagaacaagcccacacuggacuucgaguuaauuaagacagaggccaagcagcccgccaccuugagaaaguacuguaucgaggccaagcugacgaacaccacgaccgagagucgcuguccgacucaaggggagccuucguuaaacgaggagcaggacaagcguuucauaugcaaacacagcaugguggaucggggcugggggaacggcugugggcuauucggcaaagguggcaucguuacuugugcgauguucacauguaaaaagaacauggagggcaagaucguacagccggagaauuuggaguacacgaucgugauaacgccucacucuggggaggaacaugcggucggcaacgacaccgggaaacacggaaaggagauaaaaauaaccccacagucaagcauaacagaagccgagcuaacaggguacgguacugugaccauggaaugcucaccucggaccggucuugacuucaaugagauggugcugcuccagauggaggauaaggccuggcucguccaccggcagugguuucuggacuugccucugccuuggcugccgggcgccgacacgcaggggagcaauuggauccagaaagagacgcuggucaccuucaagaacccccacgcgaaaaaacaggacguggucgugcucgggucccaggagggugccaugcacaccgcccugaccggggcuacggagauccaaaugagcagcggcaaccuccuguuuacuggccaucuuaaaugucgccugcggauggacaagcuccaauuaaaagggaugucguacagcaugugcaccggcaaguuuaagaucgucaaggagaucgcugagacccagcauggcacaaucguuauucgcguacaguaugagggcgauggcucccccugcaaaauccccuucgaaaucacugaccuggagaaaaggcacguccucgggcgcuugauaaccgugaacccaaucgugacagagaaggacagccccgucaacauagaagcggagccgcccuucggcgauuccuauauaauaaucgggguggagccgggacagcugaaacucaacugguuuaaaaaggguucuuccaucgggcagauguuugagacaaccaugcgcggcgcgaagagaauggccauccucggggauacugccugggacuucggcagucucgggggaguguucaccucaauagguaaggcgcuccaccaggucuucggcgcgauauacggggccgcauucagcgggguuuccuggacgaugaaaauccugaucggcguuaucauuaccuggaucggaaugaacagccgcuccaccucucuauccgucagccuugugcuagugggcguggugacccuguaccugggggccauggugcaagcagacuccggcugugucguuagcuggaagaacaaggaacucaaauguggaagugggaucuuuaucacggauaacguucauaccuggaccgagcaguacaaguuucagcccgagucuccaagcaagcuggccuccgccauccaaaaagcccaugaggaaggcauuugcgggauacggagcgucacgcguuuagagaacuugauguggaagcagaucacgcccgagcugaaccacauccuguccgaaaacgaagugaagcucacgaucaugaccggagacauccgggggaucaugcaggccggcaagcgcagucugcgaccacagcccaccgagcuuaaguauucauggaaaacguggggcaaggcgaaaaugcucagcaccgagucacacaaccagacguuucugaucgacgggcccgagaccgcugagugcccaaacacgaaucgcgccuggaacucacuggaaguagaggauuauggauuuggggucuucaccaccaacaucuggcugaaacugcgggagaagcaagacguguucugcgacuccaagcucaugagcgccgcaaucaaggacaaccgcgccguucaugccgacaugggcuacuggaucgaauccgcccuaaaugacaccuggaagauggagaaggcgagcuuuaucgaggucaaauccugccacuggccgaagagccacacccucugguccaacggcguuuuagagagcgagaugaucauaccaaagaacuuugccgggcccgugucccagcacaauuauaggccaggcuaucacacgcagaccgcgggacccuggcaccuagggaaacuggagauggauuucgaccugugcgaagggaccacugucguagugacggaggacuguggaaaccgcggccccagcuugcgaaccaccacagcaaguggcaagcuaaucacggagugguguugccgcuccugcacccuaccuccuuugcguuaccgaggcgaggacgggugcugguacggaauggagauucggccccugaaggaaaaagaagagaaucuggucaacagccucgugaccgccggacacggccagauugauaauuucucucugggcguccuggggauggcccuguuccuggaggaaaugcuucgcacccggaucgguacgaaacaugcaauacuccuggucgccgugaguuucgugacauugaucaccggaaacauguccuuuaaggaccuuggcagggucaugguuaugaugggggccaccaugacugacgacauuggaaugggcguuaccuaccuugcccugcucgcggcguucaagguccggccgacguuugccgcuggucugcuacuuagaaagcugacgagcaaggagcucaugauggcgacaaucggcaucgcccuccugucacagagcacuauccccgaaaccauccuugagcucacggacgcgcuggcgcuaggcaugaugguguuaaaaaucgugcguaacauggaaaaguaccagcuggcugucacgauaauggccaucaguugugucccaaaugccgugauuuuacagaacgcguggaaggucagcuguacuaucuuggcggccguauccgugagcccgcugcuguugacguccagucaacagaaggcggacuggaucccccucgcucugacuaucaaaggacugaacccuacggcuaucuucuugacaacacugucccgcaccagcaagaaacgcuccuggccacuuaaugaagcgaucauggcggucggcauggugagcauccuggccagcagccugcucaagaacgacauucccaugacggggccccugguugcgggaggcuuacucaccgugugcuacguguuaaccgggcggagcgccgacuuggagcucgagcgcgccgccgaugucaagugggaggaccaggccgagaucucuggaagcucgcccauacuuagcaucaccaucagugaggacggcucgauguccaucaaaaaugaggaagaggagcaaacacugacuauccucauaaggaccggccugcuggucaucagcgggguguuuccuguaaguauccccaucaccgcggccgccugguaccucugggaagugaagaagcagcgcgcgggcgugcugugggacgucccaagcccuccucccguggagaaggcugaauuagaagauggggcguaccggauaaagcagcguggcauccuaggguacucacagaucggcgccggaguauacaaggaggggaccuuccauacgauguggcacguaacccggggggcugugcugaugcacagagggaagcggaucgagcccagcugggcugaugugaagaaagaccuaaucuccuacggggguggcuggaagcuggaaggagaguggaaggaaggggaggagguucaggugcuugcccuggaacccggcaaaaauccccgagccguacagacgaagccggggaucuucaagaccaacacgggcacaaucggggcaguuagccucgacuuuucccccgggaccagcggcucgccgauaguugaccggaaggggaaaguggugggacucuaugggaacggcgugguuacccgaagcggcgcauaugucucggccaucgcgcagacggagaaauccaucgaggauaacccggagaucgaagacgacaucuuccggaagaaacgccucaccaucauggaccuccaccccggagcaggaaagaccaaaagauaucugcccgccauugugcgcgaggcgauuaagagggggcuacgcacccugauccuggccccgacgcggguugucgcggcugagauggaagaggcacugcggggucugccgauccgcuaccagacaaccgccaucaagaccgagcacaccggccgcgagaucguggaccuaaugugccacgccaccuucacuaugcgucugcugucccccguucgaguccccaacuacaacuugaucaucauggacgaggcacacuucaccgacccggcaucaauagccgcccgcggcuacaucuccacgagaguggagaugggggaagccgcgggcaucuucaugacggcgacgccgcccggcucucgcgacccguucccacagucaaacgccccaaucauggacgaagagcgggagauccccgagcgcucauggaacucagggcacgaaugggugaccgacuucaagggcaagacggucugguuuguacccuccaucaaggccgguaacgacauagcggcuugucugcggaagaaugggaagaaagugauccagcuaucgagaaaaaccuucgacuccgaguaugucaagacgcgagccaacgacugggauuucguggugaccacggauauuagcgagaugggcgccaacuuuaaggccgagcgagucauugacccgcgacgaugcaugaaaccagugaucuugaccgauggugaggagcgggugauccuggcggggcccaugcccgugacccauuccagcgcggcgcagcggcgugggcggaucggacguaacccgaagaacgagaaugaucaguacaucuauaugggugaaccccuagaaaaugacgaggacugcgcccacuggaaggaggccaagaugcuguuggacaacaucaacacccccgagggcauuaucccguccauguucgagccggagagggagaaggucgacgcgaucgauggugaguaccgccugcgcggggaggcucggaagacguucguggaucuaaugagaaggggcgaccugcccgucuggcuggccuacaagguggccgcggaggggaucaacuaugcggaccgcaagugguguuucgacggcaucaaaaauaaccaaauccuugaggaaaacauggagguggagaucuggacuaaggagggggagcggaagaagcugaagccgcguuggcuggaugcgcgcauauacagugauccgcucgcccugaaggaguucaaggaguuugccgcggggcggaagucccugacccucaaccugauaaccgagaugggccggcugcccacuuucaugacgcaaaaggcccggaacgcuuuagauaacuuagccguguugcacacugccgaggcagggggccgagccuacaaccacgcucucucggagcugccggaaacccuugagacccuccuacugcucacucugcuggccaccguaaccgggggcaucuuccucuuccugauguccggcaaggguaucggcaagaugacccuggggaugugcuguaucaucacggccagcauccuccuaugguacgcacagauucagccucacuggaucgccgccuccaucauucuggaauuuuuccugauaguccuguuaaucccggaacccgaaaagcaacgcacgccccaagauaaccagcuuacauacgucgugaucgccauccugacugucguggccgcgacuauggcuaacgaaaugggcuuccucgagaaaaccaaaaaggaccucgggcuaggaucgaucaccacccaggagagcgagaguaauauccuggauaucgaccuccgcccggccagcgccuggacacuguacgcaguggcgacgacauucaucacaccgaugcugcggcacuccauagaaaauagcuccgucaacgucucucuuacggccauugcuaaucaagccaccgugcuuaugggccugggcaaggguuggccccucagcaagauggacaucggggucccccuacuggcgaucggcugcuacucacaggugaaccccaucacccuaaccgccgcccugcugcuccuuguagcccacuacgcgaucaucgggccagggcugcaggccaaggccacucgcgaggcccagaagcgcgcggcggcggggauaaugaagaaucccaccgucgacgggaucaccgucaucgaccuagaaccuaucccauacgacccaaaguuugagaagcagcugggccagguuaugcugcucauccugugcguuacccaggugcugaugaugcgcacgaccugggcgcugugcgaggcccucacccuagccacgggcccaaucagcacguuaugggaaggcaaccccggccgguucuggaacaccaccaucgccgugagcauggcgaacauuuuccgcgguucuuacuuagccggcgccgggcuccuuuucucaaucaugaagaauaccacaaacacccgccggggcaccgggaacaucggcgaaacccuaggcgaaaaguggaagucccgccugaacgcccucgggaagagcgaguuccagaucuauaagaaaaguggcauccaagagguagaccggacguuggccaaggaggggauuaagaggggcgagaccgaccaccacgccguaaguagaggguccgccaagcugcgcugguucguugagagaaauauggucacgccugaggggaaggugguggaccucggcugcggucgcggcgguuggagcuacuacugcggcgggcuuaagaacguacgggaggugaagggccuuaccaaggguggaccgggccacgaagagccuauccccaugaguacguacggguggaaucucgugagacugcagagcgggguagacguguucuuuacgccgccggagaagugcgacacucuucucugugauaucggugagagcucacccaaccccaccaucgaagcuggccgaacguuacgcgugcugaaccucgucgagaacuggcugaacaacaacacgcaguucugcaucaaggugcucaacccuuacaugccuucagugaucgaaaagauggaggcccuccagcggaaguacggcggcgcgcugguccgcaacccacucucccggaacagcacacaugaaauguacuggguguccaacgccacagggaauauagugagcuccgucaacaugaucucgcggaugcugaucaacagauucacgaugaagcauaagaaggcaacguacgagccagacguagaccucgguucggguacucgaaacaucgguaucgagucggagauacccaaccuggacauaauuggcaagcggauagaaaagaucaagcaggagcaugagaccuccuggcacuaugaccaagaucaccccuauaagacuugggccuaucacggcagcuacgagacgaaacaaacuggcucggccucguccauggugaacggcgucguacgcuuacugacgaagcccugggacgucgugcccaugguaacucagauggcaaugacggauaccacgccguucgggcaacagcgcguguucaaagaaaaggucgacacucggacucaggagccaaaggagggaacaaagaaguuaaugaagaucaccgccgagugguuguggaaagaacucggaaaaaagaagacgcccaggauguguacgcgagaggaguucacccgcaaagugcggagcaacgcugcccuaggugccaucuucacagacgagaacaaauggaaguccgcacgggaagccguagaggacggucgauucugggagcuggucgaccgggagaggaaccuccaccucgagggcaagugugaaaccugcguuuacaacaugaugggcaagcgcgaaaaaaaacugggggaauucggaaaggcaaagggcagccgggcaaucugguacauguggcucggggcgcgcuuccuggaguuugaggccuuggguuucuugaaugaagaccacugguucucacgggguaacucccugagcgggguggagggggagggucugcacaggcugggcuacauccugcgggacgucggaaaaaaggaggguggcgcgauguaugcggacgauacggccggcugggacacucgcauaacccuugaggaccucaagaacgaagagauggugaccaaccacaugaagggggagcacaagaagcuugcugaggcaaucuucaagcugacguaccagaacaaagugguccgggugcagcgccccaccccgcggggcaccgucauggacaucauaucccgccgggaucagcgcggcagcggccaggucggcaccuaugggcugaauacauucacgaauauggaagcccagcugauccgccagauggagggagagggaaucuuuaaguccauccagcauuugacugcaacggaagagaucgccgugcagaauugguuggcccggguggggagagagaggcuuagccgcauggccaucuccggcgacgacugcguugugaaacccaucgaugaucgauucgcaagcgcccugacggccuuaaacgacauggggaagauccgcaaggacauccagcaaugggagcccucccggggcuggaacgacuggacccaggugccguuuuguagccaccauuuccacgagcugguuaugaaggaugggagaguguuaguagugcccuguagaaaccaagacgaacucaucggcagggcgcgcaucucccagggcgcgggauggagccucaaggagaccgccugccucggaaaauccuacgcucaaauguggacccucauguauuuccaucgccgggaccuucgcuuggcugcgaacgcgauuugcagcgccguucccagccauuggguccccaccucgcggacgaccugguccauccacgcaaagcaugaguggaugaccaccgaagacaugcuugcgguguggaaccggguauggauccaggagaaccccuggauggaggauaagacgccggucgagagcugggaggaagugccguaccugggcaagcgggaggaccaguggugcggcucccuuauagggcucaccucucgcgcgacuugggccaagaacauacagaccgccaucaaccaaguacgcagccucauuggcaacgaagaauacacugacuacaugcccucgaugaagcgauuccgccgugaagaagaggaggcgggcguucugugguga

SEQ ID NO: 25021 - RNA, 9876 nt, Artificial Sequence
  derived and/or modified CDS sequence (opt11) from DENV-2__FJ390390__SS-prME
accgcgggagugaucgucauguugauucccaccgccauggcuuuucaccucaccacccgcaacggggagccccacaugaucgucggccggcaagaaaaagggaaauccuugcucuucaagaccgaggauggcgucaacaugugcacccucauggcaaucgaccugggggagcugugcgaggauaccaucaccuacaaaugcccccuccugcgccagaacgaacccgaggacaucgacugcuggugcaacagcacuagcacuugggucaccuacgggacaugcacgacgacgggggagcaucgucgcgaaaagcgguccguggcccuggucccccacguaggaaugggcuuagagacccguacggagaccuggaugagcucugagggagccuggaaacacgugcagcggauugagaccuggauacugcgccacccuggauuuacgaucauggccgccauucuggccuacacgaucgggacuacccacuuccagcgggcccucaucuucauccuacugaccgccguggcgcccagcaugacgaugagaugcauaggcaucagcaaccgggacuucguggagggcgucagcgggggauccuggguggacaucguccucgagcacgggucaugcgugaccacgauggccaaaaacaagccuacccuggacuucgagcuuauaaagacggaggcaaaacaaccagccacccuccgcaaguacugcaucgaggccaaacugacuaacaccaccacugagucccgguguccgacgcagggcgagcccagccuaaacgaggagcaggacaaacgcuuuauuugcaagcacuccaugguggaccggggcugggguaacggcuguggucuguucggcaagggcgguauugugacuugcgcgaaguucacuuguaagaagaacauggaggggaagguggugcaacccgagaaccuggaguacacaaucgucaucacuccccacagcggggaagagcacgccgugggcaacgacaccgggaagcacggaaaggagaucaagaucacuccgcaguccagcauaacagaggccgagcucaccggguacggcacggugaccauggaguguagcccccgcaccggcuuagacuucaacgagaugguacugcugcaaauggaggacaaagcguggcucgugcacaggcagugguuccuggaccugccccucccuuggcuuccgggggcagacacccagggcagcaauuggauacagaaggagacgcugguaacuuucaagaacccccacgccaagaagcaggauguugugguacucgggagucaggagggggccaugcacacugcccugaccggggcuacggagauccagaugagcagcgguaaccuccuguucacuggacaccugaaaugccgccugcggauggacaaacuccagcuuaaagggaugucauacaguaugugcaccgguaaauucaaaaucgugaaggaaaucgccgagacccagcacgggacuaucgugauucggguccaauacgagggagauggcuccccuugcaaaauacccuuugaaaucaccgacuuagaaaagcggcacgugcucggcaggcugaucacuguuaacccgaucguaaccgagaaggacucacccguaaacaucgaggcggagccaccuuuuggcgacuccuacaucaucaucgggguggagccgggccagcugaaguuaaacugguuuaagaagggaagcuccaucggccagauguucgagacuaccaugcgcggcgccaagcggauggccauacuuggggacaccgcgugggacuucggaucccucgggggcguauuuacguccaucgguaaggcccuacaccagguguucggcgcgauauacggugccgccuuuucaggugucaguuggacuaugaagauccugaucggugucaucaucacguggaucgggaugaacagccgcuccaccagcuugagcgugagccuggugcuugucgguguggugacccuguaccugggggcaaugguccaggcggauucgggcuguguggugucguggaagaacaaggagcucaaguguggcuccgggauuuucaucaccgacaacguccacacguggaccgaacaguacaaguuccagcccgagagcccaagcaagcuggcuagcgccauccaaaaggcccacgaagagggcauuugcgggauccggagcguuacccgccuggagaaucucauguggaagcagaucacgcccgagcugaaucacaucuuguccgaaaacgaggucaagcucacuauaaugaccggcgacauccgggggaucaugcaggcgggcaagcgcagccugcggccucaaccuacugaguugaaauacucguggaagacguggggcaaggcuaagaugcucucaaccgagucccacaaccagacguucuugaucgacggccccgaaaccgccgagugcccgaacacgaaccgcgccuggaacucccuggagguagaggacuacggcuucgggguuuuuacuaccaacauuuggcucaaguugcgggauaaacaagacguguucugcgacagcaagcugaugagcgcagccaucaaggacaaccgcgcgguccacgccgauaugggcuacuggaucgaguccgccuugaacgacaccuggaagauggagaaggccagcuucauugaggucaagagcugccauuggcccaagagucacacccuauggucuaauggugugcuggaaagugagaugaucauccccaagaacuucgcugggccugucucgcagcacaauuaccggccgggcuaccacacgcagaccgcggggcccuggcacuuaggcaagcucgagauggacuucgaccugugcgaaggcaccaccgugguggucacggaggacugcggaaauagagggccuagccuccgaaccaccaccgccagcgggaagcuaaucacggagugguguugccggucguguacccuucccccgcugcgguaccgcggcgaggacgguugcugguauggaauggagauaaggcccuugaaggaaaaggaggagaaucuggugaacagccucgugaccgcggggcacggccagaucgacaacuucucccugggcgucuuggggauggcccuccuguuagaggaaaugcuccgcaccaggauugguacgaaacacgcgauccugcuaguggccguuagcuucgucacccucaucaccgggaacaugaguuuccgcgaccugggcagggugauggugauggucggggccaccaugacggacgacaucggcaugggagugacuuaccucgcucuccuugccgcguucaaggugcggcccacauucgcugcaggacugcuacuccgaaaacugaccagcaaagagcucaugauggccacgauuggcaucgcccuccuuucccagagcaccauucccgaaaccauccucgagcuuaccgacgcgcuggcccucgggaugaugguucugaagaucguccggaacauggagaaguaucagcuggccgugacggucauggccauauccugcgugcccaacgccgugauccuccagaacgcguggaaggucagcugcaccauccuggcagccguguccguaucgcccuuauuacugaccuccucucagcaaaaggccgacuggaucccccuggcgcucacgaucaagggucugaauccaacggcgauauuccugaccacucucucccgcaccagcaagaaacgguccuggccgcuuaacgaggccauuauggccgugggcauggugagcauacuugccuccagccuccugaagaacgacauccccaugacggggcccuuagucgcaggcgggcuccugacaguaugcuacgugcugaccggacgcagugccgaucucgagcuggagcgagccgccgacgugaaaugggaggaccaggccgaaauauccgggucgucgccgauccuaucaaucacuauuagugaggacggcagcauguccaucaagaacgaggaggaagagcagacgcucaccauccugauccgcaccgggcugcucguuauuucugggguguuuccgguauccauccccaucaccgcggccgcaugguaccugugggaagucaagaaacagcgggccggaguacugugggaugucccaucaccgccacccguggagaaagcggagcucgaggacggggcguaucgcaucaagcagcggggcauccugggguacucacagauaggcgccggcgucuacaaggaaggcaccuuccacacgauguggcacgucacccgcggcgccgugcugaugcaccgcgggaagcgcauugagcccagcugggccgacgugaagaaggaccuaaucaguuacggcgggggcuggaaauuagagggcgaguggaaagagggcgaggagguccagguguuggcccucgaacccgggaaaaacccccgggccgugcagaccaagcccggaaucuucaagaccaacacggggaccaucggggccguaagcuuagacuucucccccggcaccuccggcagucccaucguugaccgcaaggggaaggugguaggccuguacggcaacggcgucgucaccaggagcggcgccuaugucuccgccaucgcgcagacggaaaagucuauugaggacaacccggagaucgaagacgauaucuuucgcaagaagcggcucacaaucauggaccugcacccgggggccgguaagaccaagagauaccugcccgccaucgugcgggaggccaucaagcgcgggcugcgcacccucauccuggccccgacgcggguagucgcggccgagauggaggaagcccugcgaggccuaccuauaagguaccagaccacugcgaucaagaccgagcauacggggcgggagauuguugaccuuaugugccacgcgacguucacuaugcggcuguugagccccgugcgcguuccaaacuacaaccugaucaucauggaugaggcucauuucaccgacccggcguccaucgccgcacggggcuacaucucuaccaggguugagaugggggaggccgcaggcaucuucaugacugccacgccgccgggcucccgggauccauucccgcagaguaacgcccccauuauggacgaagagcgggagauccccgagcgguccuggaacagcgggcacgagugggugacagacuuuaaggggaagacggucugguuugugccauccaucaaggccggaaacgacauugcggcuugcuuacgcaaaaacgguaaaaaggugauacagcucagccggaagaccuucgacuccgaguacgucaagacccgcgccaacgauugggacuucgucgugaccacggacaucagcgagaugggcgccaacuucaaggccgagcgggucaucgacccgcgacgguguaugaagccaguaauacugaccgacggggaagagcgcguaauccucgcgggccccaugccaguaacccauuccagugcggcccagcggcgcgggcgcaucggccgcaacccgaagaacgagaacgaccaguacauuuacaugggggagccccucgaaaacgacgaggacugugcgcacuggaaggaagccaaaaugcuccuggacaacaucaacacccccgagggcauuaucccuuccauguuugaaccggagcgcgagaaaguggacgcgaucgacggcgaauaccggcuccgcggggaggcccggaagacguucguggaccugaugcgccguggcgauuugcccgucuggcuagccuacaagguagccgccgaggggaucaauuacgcggaucgcaaguggugcuucgauggcaucaagaacaaccagauccuggaggagaacauggagguggagaucuggaccaaggagggggagcggaagaaacugaaaccccgguggcucgaugcccggaucuacagcgauccgcuugcccugaaggaguucaaggaguucgccgcgggccgcaagucccucacccugaaccuaaucaccgagaugggccgacuccccacguucaugacgcaaaaggccaggaacgcccuggacaacuuagcuguccuccacaccgccgaggccggcggccgggccuauaaccacgcucuuuccgaguuaccagagaccuuggagacgcuccugcuccugaccuugcuagccacggugaccggcggcaucuuucuuuuucucauguccggcaaggggaucggcaagaugacccucgggaugugcugcaucaucacggccagcauccugcugugguacgcgcagauccagccucacuggauugccgcauccaucauuuuagaguucuuuuugauuguccugcucaucccggagccggagaagcagaggacgccccaagacaaccagcugacuuauguggugaucgccauccugacgguuguugccgcgacuauggcgaacgagaugggcuuccuugaaaagaccaagaaggaucucgggcuuggcagcaucaccacgcaggagucugaguccaacauccuggacaucgaccugcgccccgccagcgccuggacgcucuacgccguggcgacgaccuucgucaccccgauguuaaggcacuccaucgagaauaguucugucaacgugucccuuacggcaauagccaaucaggccacaguacuaaugggcuuggggaagggcuggccacugucuaagauggacaucggcgugccccugcucgcuaucggcuguuacagccaagugaaccccaucacacuaaccgccgccuuacuccuguuggucgcccacuaugccaucaucgggccgggccuccaggcgaaggccacgagagaggcccagaagcgugccgccgcgggcaucaugaagaaccccaccguggacgguauaaccgugaucgaccuggagcccauccccuacgaccccaaguuugagaaacaguugggccaggucauguuacugauauugugugugacccaggugcucaugaugcggacuaccugggcccugugcgaggccuuaacccucgccaccgggcccaucuccacgcugugggagggaaaccccgggcguuuuuggaacacaaccaucgcggucaguauggcgaacaucuuucgaggcuccuaccuggcaggcgccggacuccuguuuucuaucaugaagaacaccacgaacacccggcgcggcacggggaacaucggcgagacccuuggcgagaaguggaagucccggcucaacgcccugggcaagucagaguuucagaucuauaaaaaauccggcauucaggagguggaccgcacgcuggccaaagaggggauaaagcggggcgagacagaccaccacgcagugagccgaggguccgcgaaacuccggugguucgucgagcgaaacauggugacccccgaggggaagguagucgacuugggcugcgggcgaggcggauggucauacuacuguggcgggcugaagaacguccgagaggugaagggccuaacgaagggcgggccaggccacgaggagcccaucccgauguccacauauggguggaaccugguacggcugcaguccggaguggauguguucuucacuccacccgagaagugcgacacccuccucugcgacauaggggaaagcucccccaaucccacaauugaggccggccgcacccugcgggugcucaacuuggucgaaaauuggcugaacaacaacacgcaauucugcauaaagguccucaaucccuacaugcccagcgucaucgaaaagauggaggcucugcagcgcaaguacggcggggcguuggugcggaacccccugucccgcaacagcacacacgagauguacuggguuuccaacgccaccgguaacaucgugagcuccgugaacaugaucagcagaaugcucaucaaccgcuucaccaugaagcacaagaaagccacguaugaaccggacguggacuuagggucugguacccgcaacaucgguaucgaaagcgagauaccgaaccuggacaucaucgguaaacgcaucgagaagaucaagcaggaacacgaaacuuccuggcacuacgaccaggaccaccccuacaagacuugggccuaccacggcagcuacgagacaaaacagaccgggucagccagcuccauggugaacggcguggugcgacuucugaccaagcccugggacgucgugcccaugguuacccagauggcgaugacagauaccaccccguucggccagcagcggguguucaaagagaagguggacacgagaacccaggagccaaaggagggcacuaagaagcugaugaaaaucaccgccgaguggcucuggaaggagcuaggcaagaagaagacgccccggaugugcacgcgcgaagaguucacacgcaaggugcgcucgaacgccgcacugggggccauauucacugacgagaauaaguggaaguccgcccgggaggccgucgaggacggccgcuucugggagcucguagaucgggagcgcaaccugcacuuagagggaaaaugcgagaccuguguauacaauaugaugggcaaacgggagaagaagcucggggaguucggcaaggccaagggcagccgcgcgauaugguacauguggcugggagcacgguuucuggaguucgaggccuuaggguuucugaacgaggaccacugguucuccagaggaaacagccucagcggcgucgagggugagggcuuacaucggcugggcuauauccugcgcgaugucgggaagaaagagggcggggcaauguacgccgacgacacggccggcugggacacccggaucacccuagaggaucugaagaacgaggagauggucaccaaccacaugaaaggggagcacaagaagcuggcggaggcgaucuucaagcucacuuaccagaacaaggugguaaggguccaaagacccacuccgcgaggcaccguaauggacaucaucucccgucgcgaccagcggggaagcgggcaggucggcaccuacgggcugaacacguucacuaacauggaggcucagcugaucagacagauggagggagagggcauuuucaaguccauccagcaccucaccgccaccgaggagaucgccguccaaaacuggcuggcgcgaguagggcgggagcgccugucucggauggcuaucuccggugacgacuguguugucaagcccaucgaugaccguuucgccagcgcccucacggcccugaaugacauggggaaggugcggaaggacauccagcagugggagcccucccgcggcuggaaugacuggacccagguucccuuuugcucacaccacuuccacgagcuggucaugaaggacggaagagugcuuguuguccccugucguaaccaggacgagcugaucggccgcgcgcgaaucucgcagggcgccggguggucccugaaggagaccgccugucuggggaagaguuacgcacagauguggacgcugauguauuuccaucggcgggaccugcggcucgccgcgaacgccaucugcuccgccgugccuucgcacuggguucccacuagccgcacgaccugguccauucacgccaagcacgaguggaugacgaccgaggacaugcuggccguguggaaccggguguggauccaggagaacccauggauggaggacaagacgccaguagaguccugggaggaagugcccuaccuggggaagcgcgaggaccaguggugcggcucccuuauagggcugacuaguagagccacuugggcgaagaacauccagacagccaucaaccagguaagaagccugauagggaacgaggaguacacggacuacaugccauccaugaaaagguuccggagggaggaggaggaagccggcgugcucugguaa

SEQ ID NO: 25022 - RNA, 9876 nt, Artificial Sequence
  derived and/or modified CDS sequence (opt11) from DENV-2__FJ390391__SS-prME
accgcgggggugaucgucauguuaauccccacggccauggcguuccaccucaccacgcgcaacggggaaccgcacaugauagugggccggcaggagaaggguaagucccugcuguucaagaccgaggacggcgugaacaugugcacccugauggccaucgaccuaggagagcuuugcgaggauaccaucaccuauaagugcccgcuucugcgccagaacgagcccgaggacaucgacugcuggugcaacagcaccagcacuugggucaccuaugggaccugcaccaccacgggagaacaccggagggagaagcgguccguggcccuggugccucacgucggaaugggccucgagacccgcaccgagaccuggaugagcucugagggggccuggaagcacgugcagcgcaucgagaccuggauccugcgccacccggguuucaccaucauggccgcaauccuggccuauaccaucgggaccacgcacuuucagcgggcccucaucuucauccugcuaaccgccguggcgcccucaaugaccaugcgcugcaucggcaucagcaaccgggacuucgucgagggagugagcgggggcuccuggguggacaucguccuggagcacggcagcugcgugacgacgauggcuaagaacaagcccacccuggauuucgagcugaucaaaaccgaggcuaagcagcccgccacccuccguaaguacugcauagaggccaagcugacaaacaccaccaccgaaucucggugcccgacgcagggcgagccuagcuuaaacgaggagcaggacaagcgcuucaucugcaagcacuccaugguggaccggggaugggggaauggcugcgggcuguucggcaagggaggcaucgugaccugcgcgauguucacgugcaagaagaacauggaagguaaggugguacagcccgagaauuuagaguacaccaucgucaucacgccccacagcggggaggagcacgccgugggcaaugacaccgggaagcacggcaaggagaucaagaucaccccucaguccagcaucaccgaggccgagcugacaggguacggcacggugaccauggagugcucgccccggacgggacuugacuucaacgagaugguccugcugcagauggaggacaaggcuuggcucgugcaccgccagugguuccuggaccugccccucccguggcuuccgggggccgacacccagggcagcaacuggauccagaaggagacucuggugaccuucaaaaauccacacgcgaaaaagcaggacgucgugguccucgggucccaggagggagccaugcacaccgcccugaccggggccacggagauacagaugagcucgggcaaccuccuguucaccggccaccugaaaugccgucugcggauggauaagcuccaauuaaaggggauguccuacagcaugugcacuggcaaguucaagaucguuaaggagaucgccgagacccagcacgggacgaucgugauccgcgugcaguaugagggcgacggcucccccugcaaaauccccuucgagauuaccgaccuggagaagcggcacgugcucggucgcuuaauuaccgucaacccgaucgucacggaaaaggacagccccguaaacauugaggcggagcccccguucggggacuccuacauuaucaucgggguggagccgggccagcugaaacucaauugguucaaaaaggguagcucgaucggccaaauguucgaaacgaccaugcgcggagccaagaggauggccauccugggggacaccgccugggacuuuggaagucucgggggugucuucaccuccauugguaaggcccuccaccagguguuuggcgcaaucuacggcgccgccuucuccgggguuuccuggacgaugaagaucuugaucggcguaauuaucaccuggaucgggaugaacagccgcuccaccagccuguccgucagccuggugcucgucggaguuguuaccuuauaccuaggggccguggugcaggcggauuccggaugcgugguaagcuggaagaacaaggaguuaaagugcggcagcgggaucuucauuacggauaacgugcacaccuggaccgagcaguacaaguuccaacccgagucgccuagcaaguuggccuccgccauccagaaggcucacgaggagggcaucugugggauucggagcguaacccgccuggagaauuuaauguggaaacaaaucacgcccgagcugaaccacauacuguccgagaacgaggucaagcugaccaucaugacaggcgacaucaaggggaucaugcaggccggcaagcggagccugcgcccacagcccaccgaacugaaguacucuuggaagacguggggcaaggcgaaaaugcucagcaccgagucccacaaccagaccuuccugaucgacgggccggaaaccgccgagugcccgaacacgaacagggccuggaacagccuggagguggaggacuacggguucgggguguucacuaccaacaucuggcucaagcugcgggagaagcaggacgucuuuugcgacuccaagcucaugagcgccgccaucaaggacaaccgggccgugcacgccgacaugggcuacuggauagaguccgcccucaacgacaccuggaagauggagaaggcgagcuucaucgaggugaaguccugccacuggcccaagagccacacccuuuggaguaacggcguccuggagagcgagaugauuauacccaagaauuucgccgggcccguaucccagcacaacuaccgcccgggcuaucacacgcagaccgcggggcccuggcacuuaggcaagcuggagauggacuucgacuucugcgaggggaccaccgugguagugacggaggacugcggcaaccggggccccucccugcgcaccaccaccgccuccgguaaacucaucacggaauggugcugccgguccugcacccugcccccgcugcgguaccggggcgaagauggguguugguacggcauggagauccgcccccucaaagagaaggaggagaaucuggugaacagccugguaaccgcagggcacggacagaucgacaacuucucccucggggugcuugggauggcccuguuccucgaggaaaugcugcggacccgcauaggcacuaagcacgcgauccugcuuguggccgucagcuucgugacucugaucaccgguaacauguccuuccgggaccugggccgagugaugguaauggugggugccaccaugaccgacgacaucggcaugggcgugacguaccucgcccuccuggccgcguucaagguccgccccaccuuugccgccgggcuccugcugagaaagcucaccagcaaggagcugaugauggccacgaucggcaucgcacugcucucccagagcacuauucccgagacuaucuuugaacugaccgacgcgcuggcccucgggaugauggugcugaaaaucgugcgcaacauggagaaguaccaguuagcugucacuaucauggccaucuccugcgugccgaacgccgugauccuccagaaugccuggaaggucagcugcaccauccuagccgccgugagugucagcccccugcucuugaccuccucccagcaaaaggccgacuggaucccccuggcccucaccauuaaagggcugaaccccacggccaucuuccugaccacccuuuccaggacgagcaagaagcgcuccuggccgcugaacgaggccaucauggccgugggcaugguaucgaucuuggccuccagccuccugaaaaacgacauccccaugacugggccccuggucgcaggcgggcuccugaccgugugcuacgugcugaccggccggagcgcagaccucgagcuggagcgcgccgccgacgucaagugggaggaccaggccgagauauccggcagcucccccauauuaagcauuaccaucuccgaggacggcagcauguccaucaagaacgaggaggaggaacagacgcucaccauccugauucggacuggucugcucgugaucagcgggguauucccggucuccauucccaucaccgcggcggcuugguaccugugggaggugaagaagcagcgcgcgggugugcugugggaugugcccagcccgccgccaguggagaaggccgagcucgaagacggggcguaccggaucaagcagcgcggcauccugggguacucacagaucggcgccggcguguacaaggaggggacauuccacacgauguggcacgucacgcggggcgcugugcugaugcaccgcgggaagcgcaucgagcccagcugggccgacgugaaaaaggaccucauuuccuacggcgggggcuggaagcuagagggcgaguggaaagagggggaggaaguccaggugcuggcccucgagcccggcaagaacccccgcgcggugcagaccaagcccgggaucuucaagaccaacacagguacgaucggggccgucagccuggacuucucuccgggcacuucaggcucccccaucguugaccggaagggcaaggucgucggcuuauacgguaacggcguggugacgcgcagcggugcguacgucuccgccaucgcccagacggagaagucaaucgaggacaacccggagaucgaggacgacaucuuccggaagaagcgccucaccaucauggaccugcaccccggggccggcaagaccaagcgcuaccugcccgccauagugcgcgaggccaucaaacgggggcuccgcacuuugauacuggccccgacgcgcguggucgcggccgagauggaggaggcacugcggggccuucccauccgcuaucagacccccgccauaaagaccgagcacacagggcgcgagaucguggaucugaugugccacgccacguucacgaugcgccuucucagccccgugcgggugccgaacuacaaccugaucaucauggacgaagcgcacuucaccgaccccgcauccaucgccgcgcgcggauacaucagcacccggguggagaugggggaggccgcugguaucuucaugacggccacgccccccggcagccgcgacccguucccgcagagcaacgcccccaucauggacgaagagcgggagauccccgagcgcagcuggaacagcgggcacgagugggugaccgacuucaagggcaagaccgucugguucgugccguccaucaaggccgggaacgacaucgcggccugccuacggaagaacggcaagaaggugauccagcugucacgcaaaaccuucgacuccgaguacgucaagaccagggccaaugacugggacuucgucgugaccaccgacaucagugagaugggggcgaacuucaaggccgagcgcgucaucgacccccggcgcugcaugaaacccgugauucugacggauggggaggagcgcgugauccuggcgggccccaugccggucacccacucaagcgccgcgcagcgccgggggcguaucggccgcaaucccaaaaacgagaacgaccaguacaucuauaugggggaaccccucgagaacgacgaggacugcgcacacuggaaggaggcuaagaugcuauuagacaacaucaacacccccgagggcaucaucccgucuauguucgagcccgaacgggagaaaguggacgcgaucgacggcgaauaccgccuccgcggggaagcccgcaagaccuucguggaucugaugcggcgcggcgaccucccggucuggcucgccuacaaggucgccgcagaggggaucaacuacgcggaccggaaguggugcuucgacggcaucaagaacaaucagaucuuggaggagaacauggagguggaaauauggacgaaggagggggagagaaagaaacugaagccccgguggcucgacgcgcgcauuuacagcgacccccuggcccugaaggaguucaaggaguucgcagcgggccggaaaucccucacccugaaccugauaaccgaaaugggccgccucccgacauuuaugacgcaaaaggcacggaacgcccuggacaacuuagcaguccuccacaccgccgaggccgggggccgcgccuacaaccacgcccugagcgagcugcccgagacccucgagaccuugcugcugcugacgcugcucgccaccgugaccgggggcaucuuucuguuccugauguccgguaaggggauaggcaagaugacccuagggauguguugcaucaucaccgccagcauccugcugugguaugcgcagauucagccgcacuggaucgccgccaguaucauucucgaguucuuccugaucguccugcuaaucccagagcccgagaagcagcggacgccccaggauaaccaguuaaccuacgugguaaucgccauucugacugucguggccgcgaccauggccaacgaaaugggcuuccucgagaagacgaagaaggaccuggggcugggcagcaucaccacccaggagagcgagucgaacauccuggacaucgaccugcgcccggcuuccgccuggacccuguacgccgucgcgacgacguucgucacccccaugcuccggcacucgaucgagaauagcuccgugaacgugagccugaccgccaucgccaaccaagccacgguccugaugggccucgggaagggguggccucuguccaagauggacauaggggugccacugcucgcgaucggcugcuacagccaggugaacccuaucacucugaccgccgcccugcuccugcucgucgcucacuacgccaucaucgggcccggccuccaggcgaaggccacacgcgaggcccagaagcgggccgccgcgggcaucaugaagaaucccacgguggacgggaucaccgugaucgaccuggagccuaucccguacgacccuaaguucgagaagcaacugggucaggucaugcugcugauccucugcgugacccaggugcucaugaugcgcaccacgugggcccugugugaggcccucacccucgccaccgggcccaucuccacccugugggagggcaacccagggcgguucuggaacacuaccaucgcugucagcauggccaacaucuuucgcggcuccuaccuggccggcgccgggcuccuguucuccaucaugaagaacacuaccuccacgcggcggggcaccgggaacaucggcgagacccugggcgagaaguggaaaucccgccucaacgcccuggggaaguccgaguuucagauuuacaaaaaguccggcauccaggagguggaccggacccuggcgaaggaggggauaaagcgcggcgagacggaccaccacgccgugucccggggaucagccaagcuccgcugguucguugagcggaacauggugaccccggagggcaagguggucgaccuuggcugcgggcgcggcgggugguccuacuacuguggcgggcuaaaaaacgugcgagaggugaagggccucaccaagggggggccaggccacgaggagcccauucccaugagcaccuacggguggaaccugguccgccugcagagcgguguggacguuuuuuuuacgccgcccgagaagugcgacacccuccugugugacaucggggaguccagccccaaccccaccauagaggccggucggacccugagggugcucaaccugguggagaacuggcugaacaacaacacccaguucugcauaaagguucucaacccguauaugcccuccgucaucgagaaaauggaggcccugcagcggcaguacggaggggcgcugguucggaacccccucagcagaaacuccacgcacgagauguacuggguaagcaacgccaccggcaacaucguguccagcgucaacaugaucucccgcaugcuuaucaaccgguucacgaugaagcacaagaaagccacauacgagccagacguggaccuugggagcggcacgcggaacaucgggaucgagaaugagauccccaauuuagacaucaucggcaagcguaucgagaagaucaagcaggagcacgagaucucauggcacuaugaucaggaccaucccuacaagacgugggccuaccacggcagcuacgagaccaagcagacuggguccgccagcuccauggucaaugguguagugcgccuccugacgaaacccugggaugucgugcccauggugacgcaaauggcgaugaccgauaccacgccuuucgggcagcagcgcgucuucaaggagaagguggacacccgaacccaagagcccaaggagggcaccaagaaacugaugaagaucacagccgaauggcucuggaaggagcugggcaagaagaaaaccccccgcaugugcacccgggaggaguuuacgaaaaagguccgcagcaacgccgcccugggggcgaucuucaccgacgagaacaaguggaaguccgcuagagaggccgucgaggacggccgcuucugggagcucguggaccgggagaggaaccuccaccuagaagguaagugcgagaccugcguguacaacaugauggguaaacgggagaagaaacucggcgaguucggaaaagcuaagggcagccgcgccaucugguauauguggcugggggcgcgguuccuggaguucgaggccuuaggguuccugaacgaggaccacugguucucccgcgggaacucacugagcgguguagagggugagggcuugcaccggcugggcuacauccugcgcgacguggggaagaaggagggcggggccauguacgccgacgacaccgccggcugggacacccggaucacgcucgaggaccugaagaaugaggaaauggucaccaaccacaugaagggagagcacaagaagcuggcggaggccaucuucaagcucaccuaccagaacaagguggugcguguccagcggccaacgccccgcgguacggugauggacaucauuuccaggcgcgaccagcguggcagcgggcagguuggcaccuacggguugaacaccuucaccaacauggaggcccaacugauccgccagauggagggcgagggcaucuucaaguccauccagcaccucacggccaccgaggagaucgccguccagaacuggcuggcgcgcguggggcgggaacgccugagccggauggccauuuccggcgacgacugcgugguaaagccuaucgacgaccgcuucgcuuccgcccucaccgcccugaacgacauggggaaggugcggaaggacauccagcaaugggagccaucccgcgguuggaacgacuggacccaggugccguuuugcagccaccacuuccacgagcuggucaugaaggacgggcgggugcucgucgugcccugccgcaaccaggacgagcugauuggcagggcgcgcaucucccagggcgccggguggagccugaaggaaacggccugccucggcaaguccuacgcccagauguggacacugauguacuuccaccggcgcgaccugcggcucgccgcgaacgccaucugcagcgccgugcccucccacugggugcccaccagccgcaccaccugguccauccacgccaagcacgaguggaugacgaccgaggacaugcuugcugucuggaaccggguguggauccaggagaacccguggauggaggacaaaacccccguggagagcugggaggagguccccuaccuggggaagcgcgaggaccaauggugcggcucucucaucggucugaccagccgggccacaugggccaagaacauucaaaccgccaucaaucaagugcgcagccugaucggcaacgaggaguacaccgacuacaugcccagcaugaagcgguuccgacgcgaggaggaggaggccggagugcucugguga

SEQ ID NO: 25023 - RNA, 9876 nt, Artificial Sequence
  derived and/or modified CDS sequence (opt11) from DENV-2__FJ882593__SS-prME
acggccggagucaucgucaugcugauccccacggccauggcauuccaucucacuacccgcaacggagaaccacacaugaucgucggucggcaggagaaggggaagagucugcuauuuaagaccgaggacgguguaaacaugugcacucugauggccaucgauuugggggaacugugcgaggauaccaucacauacaagugcccucuccugcgccagaacgagcccgaggacaucgacuguuggugcaacagcaccucgacuugggucaccuacgggaccugcacaaccacgggcgagcaccggagagagaagcgcuccguggccuugguaccccacgucgggaugggccucgagaccagaacagaaacauggaugagcagcgagggggccuggaagcacgugcagcggaucgagaccuggauucuucgccacccaggcuucaccaucauggccgcgauccuggccuacaccauagggacaacccacuuccagcgcgcuuuaaucuucauccugcuaaccgccguggcgccgucuaugacgaugcggugcauuggaaucaguaaccgggauuucguugaaggagugagcgggggguccuggguggacauaguccucgaacacgggagcugcgugaccacgauggccaagaacaagcccacccuggacuucgagcugaucaaaaccgaggccaagcagcccgccacccuccgcaaguacugcaucgaggcgaagcugacgaacaccacaaccgagucccgcugcccgacgcagggcgagccgagccugaacgaagagcaagauaagcgcuucaucuguaaacacuccaugguagaccgggggugggguaacggcugcggccuguucgggaagggcgggaucgugacaugcgcgauguucacaugcaagaagaacauggaaggcaagguggugcagccggagaaucuggaguacaccaucgucaucacgccccacagcggggaggaacacgccguggguaacgacaccgguaagcacggaaaggagaucaagaucaccccgcaguccagcaucacagaggccgagcugacaggcuacggcacggugaccauggaaugcagcccccggaccggccucgacuucaaugagaugguccugcugcagauggaggacaaggccuggcucgugcaucgucagugguuccuggaucugccacucccuuggcuaccgggugccgacacacaggaguccaacuggauccaaaaggagacgcugguaaccuucaaaaacccucacgcgaagaaacaggacguugugguucuagggucccaggagggggccaugcacaccgcccugaccggcgccacggaaauccaaaugagcucggggaaccuccucuucaccggccaccugaagugccgcuugagaauggacaaguugcagcugaaaggcauguccuacagcaugugcacugggaaguucaagaucguuaaggagaucgccgagacccagcacggcacaaucgugauacgcguccaguacgagggggacggcagucccugcaagaucccauucgagaucaccgaccuggagaagcggcacgugcucggaagacugaucacugugaacccaaucgucaccgaaaaggacucccccgugaacaucgaggcggagcccccauucggggacuccuacaucaucaucggcguggagccggggcagcugaagcucaacugguuuaagaagggcaguuccaucgggcagauguucgagacgaccaugagaggcgccaagaggauggccauccugggagauacggccugggacuucgggagccugggcggggucuucaccucgaucggcaaggcacuccaccagguauucggugcgaucuacggcgccgccuucagcggcgugagcuggacgaugaagauccuaaucggugucaucaucacguggaucggaaugaacagccgcuccaccucacugucagugagccugguccucgucgggguggucaccuuauacuuaggcgccguggugcaagcggacuccgguugcguggucucguggaagaacaaagagcucaaaugcgguuccggcaucuucauaacggauaacgugcacaccuggaccgagcaguacaaauuucaacccgagagccccucgaaguuggcgucugccauacagaaggcccacgaggaggggaucugcggcauccguagcguuaccagacuggagaaccucauguggaagcagaucacacccgagcugaaccauaucuugucagagaacgaaguaaagcucacgaucaugacuggggacaucaagggcauaaugcaggcugggaagcggucgcugcgcccgcagcccaccgagcugaaauacuccuggaagacguggggcaaggcgaaaaugcucagcaccgagucccacaaccaaacuuuccugaucgacgggccggagaccgcggagugcccgaacaccaaccgcgcuuggaacucgcuggaaguggaagacuacggguucggcguguucaccaccaacaucuggcucaagcugcgcgagaaacaggacgucuucugcgacuccaagcugaugagcgccgccauaaaggauaaccgggccgugcacgccgacaugggauacuggaucgaguccgcucucaacgacaccuggaagauggagaaggccucauuuaucgaaguuaagucgugccauuggccgaagagccacacccugugguccaacggcguccuggagucugagaugauaaucccaaagaacuucgccggcccggugucccagcacaacuaccgcccgggcuaccacacccagaccgcgggaccuuggcaucucgguaagcuggagauggacuucgacuucugcgagggcaccaccgucgucgugaccgaggauugcgggaaccggggcccaagccugcgcaccacgacugcuagcggcaaacucaucacggaguggugcugccgaucuugcacccugccaccgcugcgcuaccgcggagaggauggcugcugguacggcauggagauacggccccucaaggaaaaggaggagaaucuggugaacucacuagucaccgccggccaugggcagaucgauaacuucucacucggcgugcuuggcauggcccuguucuuggaggagaugcugcggacccgaaucgggacgaagcacgcuauucugcucguggccgucucguuugugacucugaucaccggcaacaugagcuuccgggaccugggccgcgugauggugauggugggcgccaccaugacggacgacauagggaugggcgugaccuaccucgcccugcuggccgcguucaagguccggcccaccuucgcagcuggcuugcugcucaggaagcucaccagcaaggaguugaugauggccacaaucgggaucgcacugcucucccagagcacaauccccgagaccauccuggagcugaccgaugcgcuugccuuaggcaugauggugcugaagaucgugagaaauauggagaaauaccagcucgcugucacgaucauggccauaucaugugugccgaacgcagugauccuacagaacgcuuggaaggucagcuguacuauccucgccgccguguccgucagccccuuacuccugacgucaagccagcaaaaggcugacuggaucccucucgcucugacaaucaaagggcugaaccccacggccauauuccuuaccacccugagucggaccuccaagaagcguuccuggcccuuaaacgaagcuauaauggccgugggcaugguguccauacucgccuccucauuacugaagaaugauauccccaugacuggaccgcucguagccggcggucugcuuacggucugcuacgugcucacuggacggucagccgacuuagagcuggagcgcgcugccgacgucaagugggaagaucaggcagagaucuccgggucgagucccauucucagcaucacgaucagugaggacgggagcauguccauuaagaacgaggaggaggagcagacgcugaccauccugauccgaaccggccucuuagugaucuccggcguguucccggucuccaucccuaucaccgcugcugccugguaccugugggaggugaaaaagcagcgcgccggagugcucugggauguccccagcccgccgcccguggagaaggcugagcuggaagacggcgcuuaccggaucaagcagcgcggaauccugggcuacucccagauaggggccggcguguauaaggagggcacuuuccacacgauguggcacgucacccgaggcgcgguccuuaugcaucgggguaagcggaucgagcccagcugggcggacgugaagaaggaccugaucuccuacggaggcggauggaagcuugagggagaguggaaggagggcgaagagguucaggugcucgcccucgagcccgggaaaaacccccgcgcgguucagaccaagcccggcaucuucaaaaccaacacggggaccaucggcgccgucagccuggacuucagccccgggaccagcggcuccccuaucguggaccggaaggggaagguugucggguuguacggcaaugggguggugacccgcagcggcgccuacgucuccgccauagcgcagaccgagaaauccauugaggacaaccccgaaaucgaggacgacaucuuucggaagaagcgccucaccaucauggaccugcauccaggcgcggggaagacaaagcgguaccuccccgcuaucguacgugaggccaucaagcggggccugcgcacacucauccuugcaccgacgcgcguggucgcggccgaaauggaggaggcccuccggggucugcccauucgcuaccagacccccgccaucaagacagagcacacaggcagggagaucguggaccugaugugccaugcaacguuuacaaugcgcuugcugagccccguccggguccccaauuacaaccugaucaucauggacgaggcgcacuucacggaccccgcauccaucgccgcccgcggcuacaucaguacccggguggaaaugggcgaggccgcgggcauuuucaugacggccacgccgcccgggucccgugacccguucccccaauccaacgcccccauaauggacgaggagcgggagauccccgagcgaaguuggaacucgggccacgaauggguaaccgacuuuaaggggaagaccgucugguucgugccguccaucaaggccggcaacgacaucgcugccugccuccggaagaacgggaaaaaggugauccaguugucacgcaagaccuuugacuccgaguaugucaagacccgggccaacgacugggacuucgugguaaccacagacaucagcgaaaugggagccaacuucaaggcggagcgcgugaucgacccucgccgcugcaugaagcccguuaucuuaacggauggagaggagcgggugauucucgcggggcccaugccaguuacucacuccucggccgcccagcgccggggccgcaucgggcgcaaccccaagaacgaaaacgaccaguacaucuacaugggcgaaccgcuggagaacgacgaggacugcgcccauuggaaggaggcaaagaugcuacucgauaauaucaauacgccggagggaaucauaccaucgauguucgagcccgaacgggagaagguggaugcgaucgauggcgaauaccgccugcggggcgaggcccgcaaaaccuucguggaccugaugcggcguggggacuuaccugucugguuagccuacaagguggccgccgagggaauuaacuacgcagaccggaaguggugcuuugacggaaucaagaauaaucagauccucgaggaaaacauggaaguggagaucuggacgaaggagggcgagcgcaagaagcugaagccgcggugguuagacgccagaauauacagcgacccccuggcccugaaggaauuuaaggaguucgccgcgggucggaagagccugacccugaaccucaucacagagaugggccgauugcccaccuuuaugacgcaaaaggcccggaacgcccuggacaaccucgccguccuacacacugccgaggcgggcgggcgcgcguacaaccacgcccugagcgaacuacccgagacguuggagacccuucuccugcugacucuccuggccacggugaccggcggcauuuuucucuuccucauguccggaaagggcaucgguaagaugacccuggguauguguugcaucaucacugccagcaucuuacucugguaugcgcagauacagccacauuggaucgccgccuccaucauccuggaguucuuccugauaguccuccugauccccgagcccgagaaacagaggacgccccaagauaaccaguuaaccuacgucgucauugccaucuuaaccgucguggccgcuaccauggccaacgagaugggguuccuggagaagaccaagaaggaucucggucucgggucuauaacgacccaggagucagaauccaacauccuugacaucgaccugcgcccugcaagcgcuuggacccucuacgccguggcgacgacguucgugacccccaugcuacggcacuccaucgaaaacagcuccgugaacgugagccugaccgccauugccaaccaagccacgguucucauggggcugggcaagggguggccccugucuaagauggacaucggcgugccccuccuugccaucgguugcuacagccaagugaacccgaucacccuuaccgcggcccuccuguugcucguggcccacuacgccaucaucggucccggcuugcaagcgaaggcuacccgcgaggcccagaagagagcggcagcggguaucaugaagaacccgacgguggauggcauuacugugaucgaucuggagcccauuccauacgaccccaaguucgagaagcagcucggacaggucaugcugcucauccucuguguaacucaagugcugaugaugcgcacaacuugggcucugugcgaggcgcucacccuggccaccgggccaauauccacccugugggaaggaaaccccggccgguucuggaacacgacuaucgcagucagcauggcuaacaucuuccgcgggucauaccucgccggcgcaggucugcuguucucuaucaugaagaacaccaccuccacgcguagggggaccggcaacaucggggagacuuuaggcgagaaauggaagucccgucugaacgcucugggcaaguccgaguuucagauuuauaagaaguccgggauucaggagguggaccggacucuggcuaaggagggcauuaagcgcggggaaacggaccaccacgccguuucccguggcagcgccaaacugcggugguucgucgaacggaacauggugaccccggaagggaagguaguggaccuggggugcggccgcgggggaugguccuacuacugcgggggacucaagaacgugcgggaggugaaggggcugacuaaaggcggucccgggcaugaggagcccaucccaaugucgaccuacggcuggaaccuagucagacuccagucuggggucgauguguucuucacgccgcccgagaagugcgacaccuuacugugcgacaucggcgaguccagccccaaccccacaaucgaggccgggcggaccuugcgcgucuuaaaucugguggaaaacuggcucaacaacaauacccaguucugcaucaaggugcugaacccguacaugcccuccgucaucgagaagauggaggcccugcaacggcaguaugggggcgcgcuugugcgcaaucccuugagccguaacuccacgcaugaaauguauuggguuagcaacgccaccgggaacaucgucuccagcgugaacaugauuucccgaaugcuaaucaaucgguuuaccaugaaacacaagaaggccaccuacgagccggacguggaccugggaagcgggacccgcaacaucggcauagagucugagauccccaaccuagacauaauagguaagcggauugaaaagauuaagcaggagcacgagauaucuuggcacuacgaucaggaccacccauacaagaccugggccuaucacggcuccuacgagaccaagcagaccggaucagccucgucuauggucaacggagugguucgacuucugacuaagcccugggacgucgugcccauggugacccagauggcgaugacugacaccacgcccuucggacagcagcgcguuuuuaaggaaaagguggacacccggacccaggagccaaaggaggggacgaaaaaacucaugaagauuaccgcagaguggcuguggaaggagcuggggaagaagaagacuccccggaugugcacccgggaggaguucaccaagaaggugcgcuccaacgcggcccucggcgccauauucacggaugagaacaaguggaaguccgcgcgggaggccguagaggacgggcgcuucugggagcugguagaucgggaacgcaaccugcacuuagaagguaagugcgagaccuguguguacaauaugaugggcaagcgagagaaaaagcucggggaguuugggaaggccaagggaucccgcgccauuugguacauguggcugggcgcgcgguuccucgaguuugaggccuugggguuccugaacgaggaccacugguucucgcgcgguaacagccucuccggggucgagggcgaggggcugcaccggcuaggcuacauccugcgcgauguuggcaagaaggagggcggggccauguacgccgacgacacggcgggcugggacacgcgaauuacgcuagaagaccugaagaacgaggagauggucaccaaucacaugaagggggagcacaagaaauuggcggaggccauauucaaguuaaccuaccagaauaagguugugcgcguccagcggccgacgccacgcgggacggugauggacaucaucagccggcgggaucagcggggauccgggcagguugggaccuacggccugaacaccuucaccaacauggaggcccaacucauccgccagauggaaggggagggcaucuucaagagcauccagcaccugacggccaccgaggagaucgcuguccaaaacuggcuggcgcgcgugggccgggaacgucuuucccggauggcgaucagcggagaugacugcgucgucaagcccaucgacgaccgcuucgcaagugcucugacugccuuaaacgacaugggaaaagugcggaaggauauccaacagugggagccaucacgcggguggaacgauuggacacaggugccguuuuguucccaccauuuccacgaauuggucaugaaagacggccgggugcuagugguccccugccgcaaucaggaugagcugaucgggagagcgcgcauaagccagggcgcgggcuggucccucaaggagacggcaugccugggcaaaagcuacgcgcagauguggacuuuaauguacuuccaccgucgcgaucuccggcuggcggcgaacgccaucugcagcgccgugcccagccacugggucccaaccuccaggacaaccuggagcauccacgcaaagcacgaguggaugacgaccgaggacaugcuggcagucuggaaccggguguggauacaagagaacccguggauggaggacaagacccccgucgagucaugggaggagguccccuaccucggcaagcgcgaagaucagugguguggcagccucaucggccugacuucgcgggccacuugggccaaaaacauccagacggcaaucaaccaggugcgcucacucauugggaacgaggaauacacagacuacaugcccucuaugaagcgguuucgacgcgaagaggaggaggcggguguguuaugguga

SEQ ID NO: 25024 - RNA, 9876 nt, Artificial Sequence
  derived and/or modified CDS sequence (opt11) from DENV-2__FJ182014__SS-prME
acggcgggcgugauagucaugcugauccccaccgccauggcguuucaccuuaccacccgcaacggcgagccgcacaugaucgugggccggcaggagaagggcaagucccugcuauucaagaccgaggacggagugaacaugugcaccuuaauggccaucgaccuuggggagcugugcgaggacacuaucaccuacaagugucccuuccuccgccagaaugagcccgaggacaucgacuguuggugcaacucuaccagcaccugggucacguacgggacuugcacuacgacgggcgagcaccggcgcgagaagcgguccguggcccuugugccccacguggggaugggccuggagacgaggaccgagaccuggaugagcagcgagggggcauggaagcacgugcagcggaucgagacauggauacuccgccacccaggcuucaccaucauggccgccauccuggcguacaccaucggaacuacgcacuuccagcgggcccugauauuuauccuccugaccgccguggcgcccaguaugacuaugcgcugcaucggcaucagcaaccgggauuucgucgagggcgugucggggggcaguuggguggacaucguccuggagcacgggagcugcgugaccacgauggcuaagaacaagcccacccucgacuucgagcugauaaagaccgaggcgaagcagccggccacuuugcgcaaguacugcaucgaggccaagcuuacgaacaccaccacggagagccggugcccgacgcaaggugagcccagccugaaugaagagcaggacaagcgcuucauuugcaagcauucgaugguggaccggggcuggggcaauggcugcgggcuguucgguaagggcgggaucgugaccugcgcgauguuuacgugcaagaagaacauggagggcaagguggugcagcccgagaaccucgaguacaccaucgucaucacgccgcacagcggggaggagcacgccgugggcaacgacaccgggaaacacggcaaggaaaucaagaucaccccgcaguccagcaucaccgaggccgagcugacuggcuacggcacggugaccauggagugcagcccccggaccggucuggacuuuaacgagauggucuugcugcagauggaggacaaggccuggcuagugcaccggcagugguuccucgaccugccccuccccuggcucccgggggccgacacccagggcagcaauuggauccagaaggaaacgcuggugaccuuuaaaaauccccacgcgaagaagcaggacgucgugguccuggggagccaggagggcgccaugcacaccgcccuaacaggggccacggaaauccagaugagcagcggcaacuuauuauucaccggccaccucaagugccgcuugcggauggacaaguuacaacucaagggaauguccuacagcaugugcaccggcaaguucaaaaucgugaaggaaauagccgagacccagcaugggacgaucgugauccgcguccaguacgagggcgacggcucucccugcaagauccccuucgagauuaccgaccuggagaagcggcacgugcuggggcgccucauuaccguaaaccccaucgucaccgagaaggacagcccagugaacaucgaggcugagccgcccuucggcgauuccuacaucauaauagggguggagccugggcaacugaaacugaacugguucaagaaggggagcuccaucgggcagauguucgaaacgacaaugcgcggagccaagcggauggccauccucggggacaccgcgugggacuuuggcagccucgggggcgucuucaccuccaucgggaaggcccuucaccagguguucggcgcgaucuacggcgcugccuucagcgggguauccuggacgaugaagauucucaucggcgugauuaucaccuggaucgggaugaacagccgcuccacaucucuguccgugagucuggugcuggucggcguggugacccucuaccugggggccguugugcaggcggacuccggcugcguggucagcuggaagaacaaagagcugaagugcggcucugggauauucaucaccgacaacgugcacacuuggaccgagcaguacaaguuccaacccgagagccccagcaagcucgccuccgccauccagaaagcccacgaggagggcaucugcgggauacgcagcgugacccgccuggagaaccugauguggaagcagauuacgccggaacucaaccacauccuguccgagaacgaggucaagcugaccauuaugacaggcgacaucaaagggaucaugcaggccgguaagcggagccuccgcccacagcccaccgagcugaaauacuccuggaagacguggggcaaggcgaaaaugcuaagcaccgaaucccacaaccagaccuuccucaucgacgggcccgagaccgcagagugcccgaacacaaaccgggccuggaacucgcuggagguggaggacuacggcuuuggaguguucacuacaaacauauggcugaaguugcgcgagaagcaggacgucuucugcgacaguaaguugaugagcgccgccaucaaggacaaucgggccgugcacgccgacaugggcuacuggaucgaguccgcccuaaacgacaccuggaagauggagaaggcgagcuucauagaggugaaguccugccacuggcccaagagccacacccuuuggagcaacggcguccuggagagugagaugaucauccccaagaacuucgccgggcccguuucccagcacaacuaccgcccgggcuaucacacgcagaccgcgggucccuggcaccugggcaagcucgagauggacuucgacuucugcgaggggaccacuguggucgugacggaggacugcggcaaccggggccccagucugcgcaccaccacugcgagcggcaagcugaucacggaauggugcugccgguccugcacccugccaccccugcgcuaccggggcgaggauggaugcugguacggcauggagauccgcccccugaaggagaaggaggagaaccuggugaacagccuggucaccgccgggcacggccagaucgacaauuucagccugggcgugcucgggauggcucuguuucuggaagagaugcuccggacccgcaucggcacgaagcacgcgauccugcugguggccgucucuuucgugacccuaaucacugggaauaugucuuuccgggacuuaggccgcgugaugguaauggucggggccaccaugacagacgacaucggcaugggcgugacauacuuagcccuccuggcugcguuuaagguccgccccaccuucgccgccgggcugcucuuacggaagcugacgagcaaggagcucaugauggccacgaucggcaucgcccugcugucccaaagcaccauccccgagaccauccuagagcugaccgacgcucucgcccucgggaugauggugcugaagaucgugcgcaacauggaaaaguaccagcuagccgucacgaucauggcaaucuccugcgugcccaacgccgugauucuccagaaugcuuggaaggucagcugcacuauccuggccgccgugucagucaguccccugcuccugaccuccagccagcagaaggccgacuggauccccuuagcguuaaccaucaagggccugaacccgacggccaucuuccugaccacccucucgcggacaagcaagaagcgcuccuggccgcucaacgaggccaucauggccgugggcauggugagcauccuggccuccagccuacuuaaaaacgacauccccaugacaggcccccugguagcgggcggguugcugacagugugcuacguucugacuggccggagcgccgaucucgagcuggagcgggccgccgacgucaagugggaggaccaggccgagaucuccgggucaucucccauccugagcaucaucaucuccgaggacggcagcauguccaucaagaacgaggaggaggaacagacccucacaauccugauacggaccggccugcucgugauaucaggcguguucccggucuccauccccaucaccgcggccgccugguaccugugggaggugaagaaacagcgcgccggcgugcucugggacguccccuccccgccgcccguggagaaagccgagcuagaggacggggcguaucggauuaagcagcgcggcauccuggguuacucccagaucggcgccggcguguacaaggaggggaccuuccacaccauguggcacgucacucggggcgccgugcuaaugcaccgcgguaagaggauugaaccaagcugggccgacguuaagaaggacuugaucuccuauggcgggggcuggaagcuggagggagaguggaaggagggggaagagguccagguuuuagcccucgagcccgguaagaacccuagagccguucagaccaagcccgggaucuucaaaaccaauaccggcacuauuggggccgucagccuggacuucucccccgguacgaguggcucccccaucguagaucguaaagggaagguggucggccuguacgggaacggcguggugacccgcagcggggccuacgucucagccaucgcgcagaccgagaagucaaucgaggauaaccccgagaucgaggacgacaucuuccggaagaagagacucacgauuauggaccugcaccccggggccggcaagaccaagcgcuaccuacccgcuaucguucgugaggccauuaagcgggggcuccgcacccugauccuggccccgacccgcguagucgcagccgaaauggaggaagcgcuaaggggccuccccauccgcuaccaaacgccggccaucaagaccgagcacaccgggcgggagaucguggaccugaugugccacgccaccuucacgaugcgcuuacucagccccgugcgggucccgaacuacaaucugaucaucauggacgaggcucacuucaccgaccccgccuccauugccgcacgcggguacaucucuacccgggucgagaugggcgaggccgcggggaucuucaugaccgccacgccgcccggcucccgcgacccguucccccagagcaaugcccccaucauggacgaggaacgggagauccccgagcgcuccuggaacuccgggcacgagugggugacggacuucaaggguaagaccgucugguucgugccguccaucaaggccgggaacgacauugcggccugccugcggaagaacgggaagaaagugauucagcucagcaggaagaccuuugacucagaguacgucaagaccagggccaacgauugggacuucguagugaccacggacauuagcgagaugggagccaacuucaaggccgaacgcgucaucgauccccggcgcugcaugaagcccgugauccugacugauggagaggagcgggugauacuggcgggccccaugccggucacccacuccagcgcggcccagaggcgggggcgcaucggccggaacccgaagaacgaaaacgaccaguauaucuacaugggugagccccucgagaacgacgaggacugcgcccacuggaaggaggccaagaugcugcuggacaauaucaacacccccgagggcaucauuccguccauguucgagcccgagcgggagaagguggacgcgaucgacggcgaguaccgccuccgcggggaggcgcgcaaaaccuucguggaccugaugcgacgcggcgaccugcccgucuggcucgccuacaagguggccgcugagggcaucaacuacgcggaccggaaguggugcuucgacggcaucaagaacaaccagauccuggaagaaaacauggagguggagauuuggacgaaagagggggagcgcaagaagcugaagccgcggugguuggacgccagaaucuacagcgauccccuggcccugaaggaguucaaggaauuugccgcgggccggaagucccucacgcucaaccuaaucaccgagaugggccgccugcccaccuucaugacccagaaggcccggaacgcccuggacaaccuagcgguccuucacaccgccgaggcugggggccgcgccuacaaccacgccuuaagcgagcugcccgagacccucgagacacugcugcugcugacccugcucgccacggugacgggagggaucuuccuguuccugauguccggcaaggggaucgguaagaugacccucgggaugugcugcaucaucacggccagcauccugcugugguacgcgcagauccagccgcacuggaucgccgcuuccaucaucuuagaguucuuucugaucguccuucucaucccggaaccagagaagcagcggacgccccaggacaaccagcugacguacguggugaucgccaucuugaccgucguggccgcgaccauggccaacgagauggguuucuuagagaagaccaagaaggaccuggggcugggcagcaucacgacacaagaaagcgaguccaacauccucgauaucgaccugcgcccggccagcgccuggaccuuauaugccguggcgaccacguuugucacgcccaugcuccgccacuccauagagaacagcuccgugaacguaagccugaccgccaucgccaaccaggccaccguccugaugggccucgggaagggcuggccucuguccaaaauggacaucgggguuccccuccucgcgaucggcugcuacucacaggugaauccaauuaccuuaaccgccgcccugcuccugcugguggcccacuacgccaucaucgggccgggccuccaagcgaaagccaccagggaggcccagaagcgggccgccgcgggcaucaugaagaaucccaccguggacgggaucaccgugaucgacuuagagcccaucccauacgaccccaaauuugagaagcaacuuggccaggucaugcuccuaauccugugugugacccaggugcucaugaugcgcaccaccugggcccugugcgaggcccugacgcucgcuacugggcccauuaguacccugugggagggaaaccccggacgguucuggaacaccacaaucgccgucagcauggcgaacaucuuccgcggcaguuaccuggccggcgccgggcuccuguucagcauuaugaagaacaccacaucaacucgccggggcaccgggaacaucggcgagacccugggcgagaaguggaaguccaggcuaaacgcccuggggaaguccgaguuccagaucuacaagaaguccggaauccaggagguggaccggacccuggcgaaggaggggauaaagcgcggugagaccgaccaccacgccgugucccgggggagcgccaagcuccguugguucgucgagagaaacauggugacaccggagggcaagguggucgaccugggcugcgggcguggcgggugguccuauuacugcggagggcugaagaacguucgggaggugaagggccucaccaagggcgggcccggacacgaggagcccauucccaugagcacauacggguggaaccucguacgccugcagucaggcguugacgucuucuucaccccgccagagaaaugcgacacgcuccugugugacauuggggaguccagccccaaccccaccaucgaggccggacgaacccugcgcguccucaaccugguggagaacuggcugaacaacaacacccaauucugcaucaaggugcuuaacccguacaugcccucugucaucgaaaaaauggaggcccugcagcggcaguacggcggugcgcugguuagaaacccccucagccggaacuccacccacgagauguacuggguaagcaacgccacgggcaacauagucucaagcgugaacaugaucucccgcaugcugaucaaccgguucaccaugaagcacaagaaggcuaccuacgagccggacguggaccuggggucaggcacccgcaacaucgggaucgaguccgagaucccuaaccuagacaucaucggcaagcggaucgagaagaucaagcaagagcacgagauuagcuggcacuacgaccaggaucaccccuacaaaaccugggccuaccacggcuccuacgagaccaagcagaccgggagcgccuccuccauggucaacggcgugguacgccuccugaccaagcccugggacguugugccgauggugacgcagauggcaaugaccgacaccacccccuuugggcagcagcgcgucuucaaggagaagguggacacgcguacacaggagcccaaggaggguaccaagaagcugaugaagaucaccgcugaguggcuuuggaaggagcugggcaagaagaagacuccccguaugugcacccgggaagaguuuacaaagaaggugcgcuccaaugccgcccugggugcuaucuucaccgaugagaacaaguggaaguccgcgcgggaggccgucgaagacggccgcuuuugggagcucguggaccgugaacgcaaccugcacuuggaggggaagugcgagacgugcguguauaacaugaugggcaagcgggagaagaaguugggggaguucggaaaggccaagggcucccgcgcaaucugguacauguggcugggggcgcgcuuccuggaguucgaggcccucggcuuccugaacgaggaucacugguucagccgcgggaacagccuguccggcgucgagggggaggggcuccacaggcugggcuacauccugcgugacguggggaagaaggagggcggggccauguacgcggacgacaccgccggcugggauacccggaucacccucgaagaucugaagaacgaagaaauggucacgaaccauaugaagggcgagcacaagaagcuggcggaggccaucuucaagcucaccuaccagaacaagguggugcgcguccagcgcccaacgccacgcggcacgguuauggacauaauaagccggcgcgaccagcgggguuccgggcaggucggcacuuacggucugaauaccuucaccaacauggaggcccaguuaauccgccagauggagggcgagggaauuuucaagagcauccagcaccucaccgccacggaggagaucgccguccagaacuggcuggcccgcguggggcgggagcgcuuaucccggauggccauaagcggcgacgacugugucgucaagcccauugacgaccgcuucgccuccgcucucaccgcccugaacgacauggggaaggugcguaaagacauucagcagugggagcccagucgcggcuggaacgacuggacccaggugccguucugcucccaccacuuccacgagcuggucaugaaggacgggcgaguucucgugguccccugccgaaaccaggacgaacugaucggccgggcgcgcaucagccagggcgccggguggucucugaaggagaccgccugccuaggcaagagcuacgcccagauguggacccugauguacuuccaccggcgcgaccugcggcuugccgcgaacgccaucugcuccgccguacccagccacugggugccgaccagucgcacuaccuggagcauccacgcuaagcacgaguggaugaccacggaggacaugcuggcggucuggaaccggguguggauucaggagaacccguggauggaggacaagacgcccguggagaguugggaggaggucccguaccugggaaagcgcgaggaccaguggugcggcucacucaucggauugacaagccgggccaccugggccaagaacauccagacggccaucaaccaggucagaucccugaucggcaacgaagaguacaccgauuauaugcccagcaugaagcguuuucgccgcgaggaggaggaggccggcgugcucugguaa

SEQ ID NO: 25025 - RNA, 9876 nt, Artificial Sequence
  derived and/or modified CDS sequence (opt11) from DENV-2__FJ547090__SS-prME
accgccggcgugaucguaaugcucauccccaccgcaauggcauuccaccuuaccacaagaaacggggagccacacaugaucgugggacgccaggagaaggggaagucccuguuauucaagaccgaggacggcgugaauaugugcacucucauggccauugaucugggggagcuaugcgaggacacgaucaccuacaagugcccccuccugcgucagaacgagcccgaggacauugacugcuggugcaacagcaccagcacgugggucaccuacgggacaugcacuaccacgggcgaacaccggcgcgaaaagcgcuccguggcccuggugccccacgucggaaugggucucgaaacccgcacugagacuuggaugagcagcgaaggugcauggaagcacgugcagcggaucgagaccuggauccugagacaccccggcuucaccaucauggcugcuauacuggccuacacgaucgggaccacgcauuuucagcgggcccuuaucuucauccuauugaccgccguugccccaagcaugaccaugcgcuguauuggcaucucaaaccgggauuucguggagggggugagcggaggcagcuggguggacaucguccucgaacacgggucgugcgugaccacuauggcgaagaacaaacccacccuugacuuugagcugaucaagaccgaggccaagcagcccgccacccuccgaaaguacugcauagaagccaagcuaaccaauaccaccaccgagagccguugcccaacgcagggcgagcccagccugaacgaggaacaagacaagcgcuucauaugcaagcacuccaugguggaucggggcuggggaaacggcugcgguuuauuuggcaaggguggcaucgucacgugcgcgauguucaccugcaagaagaauauggagggcaaggugguacagcccgaaaaccucgaauacaccaucgucauuacgccccauagcggggaggagcacgccgugggcaacgacaccgggaagcacggcaaggagaucaagaucaccccgcaguccaguaucacagaagccgaacugaccggguaugguacggugacgauggaguguagcccccggaccggccucgacuucaacgagaugguccugcuacagauggaggacaaggccugguuggugcaccggcagugguuccucgaccugccccucccauggcugccgggugcugacacccaaggcagcaacuggauccaaaaagagacgcuggugaccuucaagaacccacacgcgaagaagcaggacgucgugguacucgggucccaggagggcgccaugcauaccgccuugaccggggccacggagauacagaugagcagcggcaaccucuuguucacaggccaucuaaagugccggcuccguauggacaagcuccagcucaaggggauguccuacagcaugugcaccggcaaguucaagaucguaaaggagaucgccgagacccagcaugggacgaucgugauccgcguccaguacgagggggauggcagucccugcaagauccccuuugagaucaccgaccuggagaagcggcacgugcucgggcgccugaucaccgugaauccgaucgucaccgaaaaggauagcccggugaauaucgaggcugagcccccuuuuggggacuccuacaucaucaucggcguggagccgggccagcuuaaguuaaauugguuuaaaaaggggagcucuaucggucaaauguucgagacgacuaugcgcggugccaagcggauggcaauccugggggauaccgccugggauuucggaagccucggggggguguuuaccaguaucgggaaggcacuccaccagguguucggcgccauuuacggcgcagcauucucugggguauccuggacgaugaagauccugauuggcgucauaauaaccuggaucgggaugaacagccgguccaccagccuguccgugucacuggugcucgucggcguggugacucuguacuugggcgcugucgugcaagcggacuccggcuguguagugagcuggaagaauaaggaacucaaguguggcuccgggaucuucaucacggacaacgugcauacauggaccgaacaguauaaguuucaacccgaaucuccaagcaagcuggcgucagcaauucagaaggcucacgaggagggcauuugcgggauacggucggugaccagguuagaaaaucuaauguggaagcagaucacgcccgagcugaaccacauccuuuccgagaaugaggucaagcuaacaaucaugaccggcgacaucaaggggaucaugcaggccggcaagcggucgcuucgcccgcaacccaccgagcuaaaguacucauggaagacauggggcaaagcuaagauguugagcaccgagucccacaaccaaacauuccugaucgaugggcccgagaccgccgagugccccaacaccaaccgggcguggaacagccuggagguggaggacuacggguucgggguguucaccacaaacaucuggcucaagcugcgcgaaaagcaggacgucuucugcgacaguaagcugaugagcgccaccauuaaggacaaccgugccgugcacgcggacaugggguacuggauagaguccgcccucaacgauaccuggaagauggagaaagccagcuucaucgaggucaaauccugucacuggcccaagagccacacgcugugguccaacggcguacuggagagcgaaaugaucauccccaaaaacuuugcugggcccgugucacagcacaacuaccgcuuaggcuaucacacacagaccgccgggccguggcacuuaggcaagcuggagauggacuucgacuucugcgaggggaccacgguggucgugacugaagacugcggcaaucgggggcccagccuccgcacaaccacggcgagcgggaagcugaucaccgaaugguguugucgguccugcaccuugccaccacugcgcuaccggggugaagacggcugcugguacgggauggagauccgcccccugaaggagaaagaggagaaccuagugaacagccuagucaccgcagggcauggccaaauugacaauuuuuccuuaggcgugcuggggauggcccuuuuccuggaggagauguugcggacacgcaucggcaccaagcacgcuauccuccugguagcggucagcuuugugacccugaucaccggaaacauguccuucagggaccucggccgagugauggucauggugggagcuacaaugaccgaugauauugggaugggcgugaccuauuuggcacugcuugccgccuucaagguuaggcccacguucgcggcagggcugcuguuacggaaacugacgagcaaggagcugaugauggcuacgaucggcaucgcgcuccugucccagagcacgauacccgagaccauccuggaacugacggacgcccuagcgcuggggaugauggugcucaagaucguucgcaacauggagaaguaccagcuggcugucaccaucauggcgaucucaugcgugcccaaugcgguuauccugcagaacgccuggaaagucagcugcaccauccucgcggccguuagcgucagcccguuacugcucaccuccagccaacagaaagccgauuggaucccccuggcccugacaaucaaaggccucaaccccaccgcgauauuccuuaccacccucucccggacgagcaagaagcgcuccuggccacucaacgaggccaucauggccgugggcauggugagcaucuuagcauccagccuguugaagaaugacauccccaugaccgguccccuggucgccggcggguugcucacagugugcuauguccugaccggacggagcgcugacuuagagcucgagagggccgcugaugucaagugggaggaccaggccgagaucuccgggucgagucccauccugucgaucacgaucuccgaggacggaucuaugucaaucaaaaacgaagaggaggagcaaacccugaccauccucauacggaccggccugcuggugaucagcggcguguuccccgucagcauccccauaacggccgcagcuugguaccucugggaggugaagaagcagcgcgccggggugcugugggacgucccuucuccgccgcccguggagaaggccgagcuagaggacggggcauaccggauaaagcaacgcggcauacucggguacucucaaaucggagcgggcguguauaaggaggggacauuccauaccauguggcacgucacccggggcgccgugcugaugcaucgcgguaagcggaucgagcccagcugggccgacgugaagaaggaccugauaagcuacggcgggggcuggaagcucgagggcgaguggaaagagggugaggagguccaggugcuggcccucgagccugguaaaaauccacgcgccgugcagacuaagcccgggaucuucaagacgaauaccggcaccaucggggcggucucccucgauuucucccccgggaccagcgguucgccgaucguggaccggaaggggaaaguagucggccuguacgggaacggcguggugacgcguagcggggccuacgucuccgccaucgcgcagaccgagaagucuaucgaagacaacccggagaucgaggacgauauuuuucggaagaagcgcuuaaccaucauggaucuccacccuggggcggggaagaccaagcgguaucugcccgcuaucgugcgcgaagccauaaagcggggccuacgcacgcugauccucgcccccacccgcguggucgccgcugagauggaagaggcccugcguggccucccgauccgcuaccagacccccgccauaaagaccgagcacacggggcgggagaucguggaccucaugugccaugccaccuucaccaugcgccugcuuagcccugugcgggucccaaacuacaaccucauuaucauggacgaagcccacuucaccgauccggcuucuaucgcggccagaggcuacauaagcacgagaguggagaugggggaggccgccgggauauucaugaccgcgacgccccccgggucccgcgaccccuucccgcaaagcaacgcccccauuauggacgaggagagagagauccccgagcgcagcuggaacagcgggcacgagugggugacugacuucaagggcaagacagucugguucgugccgaguaucaaggccgggaacgacaucgccgcgugccuccggaagaauggcaagaaggugauccaguuaagucgcaagaccuuugacuccgaguacgucaagacccgggccaaugacugggacuuuguggugaccacugacaucagcgaaaugggcgccaacuucaaagccgagaggguaauagacccacggcgcugcaugaaacccgugauacucaccgauggggaggagcgcgugauccuggcuggacccaugcccguuacccacagcuccgcggcccaacgacgggggcgcaucggccgcaacccaaagaacgagaaugaccaguacaucuauaugggcgagccccuggaaaacgacgaggauugcgcacacuggaaggaggccaagaugcuccuggauaacauuaauacccccgaggguauaaucccuucgauguucgagccggagcgcgaaaagguggacgccaucgacggcgaguaccgccugcgcggggaggcacgcaagacguucguugaccucaugaggcguggcgaccuacccgucuggcuggccuacaagguugccgccgaggggaucaacuacgcggaccguaaguggugcuucgacggcauuaagaacaaccagauacucgaggagaacauggagguggagaucuggacuaaagagggggagcgcaaaaaacugaaaccccgguggcuggacgcucgcaucuacagcgacccgcuggcccuuaaagaguucaaggaguucgcugccggccguaagucacugacccucaacuuaaucacugagaugggaagacugccgacuuucaugacucagaaggcgaggaacgcccucgacaaucuagcgguccugcacaccgcugaggccggcggucgcgcguacaaccacgcucucucugagcuuccagagacccuagaaacguugcugcugcucacgcugcuggcgaccgugacagggggcauauuccucuuccugauguccggcaaggguauuggcaagaugacgcuggggauguguugcaucauaacugccagcauccugcugugguaugcccaaauccaaccccauuggauugcugccaguauuauauuggaguucuuucucaucguccugcugauuccugagcccgagaagcagcggacgccccaggacaaccagcuuacauacguggugaucgccauccugaccguuguagccgccacgauggcgaacgagaugggcuuccuggagaaaaccaagaaggaucucgggcugggcucuauaacaacccaggagucagaguccaacauccuggacaucgaccuccgcccugccagcgcguggacgcuauacgcuguggccaccacauucgucacccccauguuacggcacuccaucgagaacagcuccgugaaugugagccucacggcgaucgccaaccaggccaccguccugaugggccugggaaaaggguggccccucuccaaaauggacaucggggugccccugcuggccaucggcuguuacagccaggugaacccgaucacucucacggcugcccuucugcuguuagucgcucacuacgcaaucauaggcccgggucugcaggccaaggcaacgcgggaggcccaaaaacgggccgccgcaggcaucaugaagaacccaaccguggacgggaucacugugaucgaucucgaaccuauucccuacgacccgaaguuugagaagcagcugggccaggucaugcugcucauccugugcgugacccaagugcugaugaugcgcacgaccugggcgcucugcgaggcgcugacccuagccaccgggcccaucuccacacucugggagggcaacccagggcguuucuggaauaccacgauagccgucagcauggccaacaucuucagaggcuccuaccuggcgggagccggguugcucuucaguaucaugaagaacacaacguccacuaggcggggcaccgggaacaucggcgaaacccugggcgagaaguggaaaagccgccugaaugcccucggcaagucugaguuccagauuuacaagaaguccggcauccaggagguggaccggacgcuggccaaggaggggauaaagcgcggcgagaccgaucaccacgcugugucccgggguagcgccaagcugcgcugguucgucgagcggaacaugguuacucccgaagguaaggugguugaccucggaugcgggcgcggaggguggucauacuacuguggcgggcuuaagaacgugcgggaggucaagggccugacuaaaggcgggccuggccacgaggagccgauucccaugagcacguacggguggaaccucguccgcuugcagagcggcguggacguguuuuucacgccuccggaaaagugcgacacccugcugugugacaucggggagaguucgcccaaccccacaaucgaggcuggccggacucugcgcguccugaaccucguggagaauugguugaacaacaacacgcaguucugcauuaagguacugaauccguacaugccauccgugauagagaagauggaggcacuccagcggcaguaugguggagcccuggugcgcaacccccucucucggaacuccacccacgaaauguacuggguaagcaacgcgaccggcaacaucgucuccucugugaacaugaucucccgcauguugauaaaccgguucacgaugaagcacaaaaaggccacguacgagccugacguggaucucgggucgggcacccgcaacaucgggaucgaguccgagauccccaaccuggauaucaucggcaagcggaucgagaagaucaaacaggagcaugagaucagcuggcacuaugaccaggaccaccccuacaagacaugggccuaucacggcuccuacgagaccaagcagacggguucggccuccagcaugguuaacgggguggugcgccuacucaccaagcccugggacgucgugcccauggugacgcagauggccaugaccgacacgacaccguuugggcagcagcgcguuuucaaggagaaaguagauacucggacacaagagcccaaggagggcacgaagaagcugaugaagauaacggcggaguggcuguggaaggagcucggcaagaagaaaacgccccgcaugugcacccgggaagaguucacgaagaaggugcgcucgaaugccgcccugggggccaucuucaccgacgagaacaaguggaaguccgcccgggaggccgucgaggacggccgcuucugggagcugguggaccgggagcguaauuuacaucucgaaggcaagugcgagacgugcgucuacaacaugauggggaagcgggaaaagaaacugggagaguucggcaaggcuaagggcuccagggccaucugguacauguggcucggggcccgguuccuugaguuugaggcgcugggcuuucucaacgaagaccauugguucagccgcgggaacagcuuauccgguguugagggggaaggacugcaccgacucggcuauauccugcgcgacguugggaagaaggagggcggagccauguacgccgacgacaccgcugguugggauacacggaucacccuggaggaccucaaaaacgaagagaugguaaccaaccacaugaagggggagcacaagaagcuggcggaggcaauauucaaacuuaccuaccagaacaagguggugcggguccaacggcccacgccacgcggcaccgugauggacaucaucagccggcgcgaccagcgaggcuccgggcaggucggcacauacggacugaacaccuucaccaauauggaggcgcaacugauccgccaaauggagggcgagggcaucuuuaagagcauacagcaccugaccgcaaccgaggagaucgcaguccagaacuggcucgcccgcguggggcgggaacgcuugucccggauggcgauaagcggcgacgacugugucgucaagcccaucgacgaccgcuuugccuccgcccugaccgcuuugaaugacauggggaaggugcggaaggacauccagcagugggagcccagccgcggcuggaacgacuggacacaggugccguucuguucccaccacuuccacgagcuggucaugaaggacgggcggguacuuguggucccaugccggaaccaggacgaguuaauuggccgggcuaggauuagccagggggcgggguggagcuugaaggagacggccugccuggggaaaagcuacgcacagauguggacucucauguacuuccaccggcgcgaccugcggcuggccgcuaacgcgaucuguucugccguacccagccacuggguccccaccucccgcaccacguggagcauccacgccaagcacgaauggaugaccacagaggacaugcucgccgucuggaaccggguguggauccaagagaacccuuggauggaggacaagaccccggucgagucgugggaggaagucccguaccuggggaagcgcgaggaccaguggugugggagccugaucgggcucacgagccgugcgaccugggccaagaauauccagacugccaucaaucagguucgcucccugaucggcaacgaggaauacacagacuacaugccaagcaugaagcgguucaggagggaagaggaggaggccgguguccuuugguga

SEQ ID NO: 25026 - RNA, 9876 nt, Artificial Sequence
  derived and/or modified CDS sequence (opt11) from DENV-2__EU482630__SS-prME
accgcuggggugaucgugaugcucaucccaaccgcuauggcguuccaccucacuacccgcaacggggagccacacaugauagugggacggcaggagaaagggaagucccuacuguucaagaccgaggacggagugaacaugugcacccucauggccaucgaccuaggggagcugugcgaggacaccaucaccuacaagugucccuuccuacggcagaacgagcccgaggacaucgacuguuggugcaacaguaccagcaccugggucaccuacgggaccugcaccacuacgggagagcaccggcgcgagaagcggagcguggcccuggugccacacgucgggaugggacuagagaccagaacugagacguggaugucgagcgagggggccuggaagcaugugcagcggaucgagacauggaucuuacgccacccggguuucaccaucauggcagcaauccuggccuacaccaucggaaccacgcauuuccagcgggcccugaucuuuauucuccugaccgcgguugcccccagcaugacaaugcgcugcaucggaaucucaaacagagacuucgucgagggcgugagcgggggcagcuggguggacaucguccuugagcacgguagcugugugacgacgauggcuaaaaauaagccgaccuuggacuucgaacuuaucaagaccgaggcgaagcagcccgccacccugcgcaaauacuguauagaggcuaagcucacgaacacgacuacagagaguaggugcccgacccagggcgagccgagucugaacgaggagcaggacaagcgcuucaucugcaagcacuccaugguggaucggggcugggggaacggcugcgggcucuucggcaaggguggcaucgugaccugcgcgauguucaccugcaaaaagaacauggagggaaagguagugcagccagagaacuuggaguauacgaucgucauaacgccccacagcggggaagaacacgccgugggcaacgacaccgggaagcauggcaaggaaaucaagauaaccccgcaguccagcaucaccgaggccgagcucacuggguacggcacggugacuauggagugcagcccccguacaggcuuagacuucaacgaaauggucuuacugcagauggaggauaaggcuuggcuggugcaucgccagugguuccucgaccugccucugcccuggcuaccgggggcagauacccagggaucaaacuggauacagaaggagacgcuggugaccuucaagaacccccacgcgaagaagcaagacgucguggucuuagggucccaggagggcgcgaugcacacugcauuaacgggggccacggaaauccagaugucaagcggcaaccuacuauucaccggccaucucaaaugccgcuuacguauggacaaacugcagcucaaggguaugucauauagcaugugcacaggcaaguucaagauagugaaggagaucgccgagacccagcacggaacaaucguuauccggguccaguacgagggugacgguagccccuguaagauccccuuugagauuaccgaccuggagaagagacaugugcugggacgccucaucacggucaaccccaucgucaccgagaaggacagccccguuaacaucgaggcggaaccgcccuucggggacuccuacaucaucauuggcguagagccgggucaguuaaagcuaaacugguuuaagaaagggagcaguaucgggcaaauguuugagacgaccaugcgcggcgccaaacguauggccaucuuaggggacaccgccugggacuucggcagccuagguggaguauuuacgucgaucggaaaggcccugcaucagguguucggagccaucuacggcgcugccuucagcggugugucguggacgaugaaaauacucauuggcguuaucaucacauggaucgggaugaacucgcgcuccaccagccuguccgugagucugguucucgucggcguagugacccucuaccuaggggccgucguccaggccgacucuggcugcguggucucguggaagaacaaggagcugaagugcggcuccgggauauucaucaccgauaacguccacacuuggaccgagcaauacaaguuccagcccgaaagccccaguaagcucgccucugccauccaaaaggcacacgaggaggggaucugcgguauccguagcgucacccgccuggagaaccugauguggaaacaaaucacuccggagcucaaucauauccuguccgaaaacgagguuaagcuuaccaucaugaccggcgauaucaaggggaucaugcaggccggcaagcgaagucucaggccgcagcccacagaauugaaguacuccuggaagacguggggcaaggcgaagaugcugagcacagagucccauaaucaaaccuuccucaucgacgggccagaaaccgcggaguguccuaacaccaaccgggccuggaauucauuggagguggaggacuauggguuugggguuuucaccaccaacaucuggcugaaacuacgcgagaaacaagacguauucugcgacucaaaguuaaugagcgccgccaucaaagacaaccgagcgguacacgcggacaugggcuacuggaucgaauccgcccugaacgacaccuggaagauggagaaggccaguuucauagaggugaaguccugucacuggcccaaaagccacacgcucugguccaacggcguccuggaaagcgagaugauuauccccaagaacuucgcggggcccgugucccaacacaacuaccgcccgggcuaccacacgcagacggccgggcccuggcaccuggguaaacucgaaauggacuucgacuucugcgaagguacuaccgugguggucacagaggacugcgggaaccggggcccaagucugcgcaccaccacagcaaguggaaagcugaucacggagugguguugucgguccugcacccugccgccccugcgcuacaggggcgaggacgggugcugguacgguauggagauaagaccccuaaaggagaaagaggagaaccucguaaacucgcugguuaccgccgggcacggacagaucgacaacuucucccugggcgugcuugggauggccuuauuccuggaggagauguugcggacacgcaucggcacgaaacacgcgauccuucuaguggccguaagcuuuguuacguuaaucaccggaaacaugucguuccgggaucugggccgcgugaugguuauggugggggccaccaugacggacgacaucggcaugggcgucacguaccuggcccuccuagccgcguuuaagguccgacccaccuucgcugccgggcuccuacugaggaaguugacgagcaaggagcucaugauggccacgaucggaaucgcccugcugucccagucuacgauccccgagaccauccucgaacugaccgacgcgcuggcccucgguaugaugguacucaagaucgugcggaacauggagaaguaccagcuggccgucacgaucauggcgaucuccugcgugccuaacgcagugauucuccagaacgcuuggaaggucagcugcaccauacuugccgccgucuccgucagcccccugcuccucacauccagccagcagaaagcagacuggauaccccuggcgcugaccaucaagggccugaaccccacggccaucuuccucaccacccucucgcggacgaguaagaagcgcuccuggccccugaacgaggcgauaauggccgugggcauggugagcauccuggccuccucacuccuuaagaacgacauccccaugacggguccccucgucgcgggugggcugcugacuguuugcuaugugcugaccggucggucggccgaccuagagcuagagcgggcggcugaugucaagugggaggaucaggccgagaucagugggucauccccaaucuugucuaucacgaucuccgaggacggcagcauguccaucaagaacgaggaggaggagcagacgcucaccauccuaauucggaccggccuacuggugauuucagggguuuucccagucuccauccccaucaccgcggccgccugguaccugugggaggugaagaaacagcgcgcuggcguucuuugggacguccccuccccuccgcccgucgagaaggccgaacucgaggauggggcguaucgcauaaaacagagaggcauuuugggauauucccaaauuggcgccgggguguauaaggaagggaccuuccauacgauguggcaugucacccggggcgccgugcugaugcaccguggcaaacggauagaacccagcugggcggacgugaagaaggaucucaucucguauggcgggggcuggaaauuggagggcgaauggaaagagggugaggagguccaggugcuggcccuggagcccgggaagaacccccgcgcgguccaaacaaagccugggaucuucaagaccaacacgggcacaauuggggcggucagcuuggacuucucccccgggacuagcggcuccccaaucguggaccggaaggggaaggugguaggccuguaugggaauggcguggugacccgcagcggcgcguaugucuccgccauugcgcaaacggaaaaguccauugaggacaaccccgagaucgaagaugacauauuccggaagaaacgccucaccaucauggaccugcacccgggggccggcaaaacuaagcgguaccuccccgcgauugugcgagaggcgaucaagcgggggcuccgcacacugauacuggccccgacgcggguugucgccgccgagauggaggaagcccugcggggccuucccauacgcuaucagaccccugccaucaagacugaacacaccgggcgggagaucguggaccugaugugucacgcuacguucacgaugcgccuacucagucccguaagagucccgaacuacaaccugaucauaauggacgaagcgcauuucaccgacccagccuccaucgcggcacgcggcuacauuagcacccggguagagaugggcgaggcggcggggaucuucaugacugccacgccgcccggcucccgugacccguucccccagagcaacgcccccaucauggacgaagaacgggaaauccccgagcgguccuggaacagcgggcacgagugggugaccgacuucaaggggaagaccguuugguucguuccgagcaucaaggccgggaacgacaucgcggccugccugcgaaaaaacggcaaaaaggugauccagcucucccggaaaacuuuugacuccgaguacgucaagacgcgggcuaacgacugggacuucguggucaccaccgacaucucggaaaugggcgccaauuucaaggccgagcgggucauagacccccggaggugcaugaagccagugauccugacugacggggaagagcgggugauucuugcaggccccaugccugucacccacuccagcgccgcccaacggagaggacgcaucggccgcaacccgaagaacgagaacgaccaguacauuuacaugggggagccgcucgagaacgacgaggauugcgcgcacuggaaagaggcaaagaugcugcuggauaacaucaacaccccggaggguauuauaccguccauguucgagccugagcgggagaaaguggacgccaucgauggcgaguaucgacuccgcggggaagcgcgcaagacauucguggaccuuaugaggcguggcgaccuacccguguggcucgcguauaagguggcugcggaagggaucaauuaugccgacagaaaguggugcuucgacggcaucaagaacaaccagauccuggaagagaacauggagguagagaucuggacaaaggagggggagcgcaagaagcugaagccacgguggcuggacgcccgcaucuacagcgacccucuggcccugaaagaguucaaggaguuugccgcgggccgaaagucccucaccuugaaucugaucaccgagaugggccgccuccccaccuucaugacacagaaggcacggaacgcccuggacaaccuggccguccuccacaccgccgaggccggcggcagggccuacaaccacgcacuuagugagcugccggaaacccucgaaacccugcuguugcugacgcugcucgccacgguaaccggaggcaucuuccuguucuugaugucuggcaaggggaucggaaagaugacccucgggaugugcugcaucaucacagccagcauccuccugugguaugcgcagauccaaccgcauuggauagccgccucaauaauccucgaguuuuuccugaucguccuccucauccccgagcccgagaaacagcggaccccccaggacaaccagcugacuuacguggugauugccauacucaccguaguggccgcgaccauggcaaacgaaaugggcuuccucgagaagacgaagaaggaccuggggcugggcaguauaaccacccaagagagcgagucgaacauccucgacaucgaucugcguccugccucggcguggaccuuguaugccguagcaacgacuuucguuacgccaaugcuccggcauuccaucgagaauaguucagugaacguaagccugacagccauugcuaaccaggccacaguacugaugggccucgggaagggcuggccguuauccaaaauggauaucggaguuccccugcuggcgaucgggugcuacagccagguaaacccgauaacccugaccgcagcccuccucuuacuggucgcgcacuacgccaucauagggccgggccuccaggcgaaagccacacgcgaggcccagaaacgggccgccgcggguaucaugaagaaucccacgguggauggaaucacagucaucgaucuggaacccaucccguacgaucccaaguucgagaagcagcugggucaagucauguuacugauucugugcgugacccagguguuaaugaugcguaccacgugggcccugugcgaagcccuaacacucgccaccgggccaauuuccacccugugggagggcaaccccgggagguucuggaacacgaccauagcagucagcauggcuaauaucuucagaggcuccuacuuggcaggcgccggucuacuguuuagcauuaugaagaacaccaccuccacgcgccguggcaccgguaacaucggcgagacacuuggcgagaaguggaagucacgccucaacgccuuggggaaguccgaguuccagauauacaagaaguccggcauucaggaaguggaucggacgcuagcgaaggaggguaucaagcgcggcgagaccgaccaccacgccguuucccggggaucggccaaauuacguugguucgucgagagaaacaugguuaccccggagggaaagguggucgaccuggggugcgggcgcggcgggugguccuacuacuguggcgggcugaagaacguucgcgaagugaaaggccugaccaagggcggccccggccaugaagagcccauucccaugagcacguacggguggaaccugguccgccuucagagcggcguggacguguucuucacgccgccugagaaaugcgacacccuccugugcgacauaggugaauccucgcccaaccccaccaucgaggcaggcaggacgcugcgcguccucaaucugguggagaacuggcuuaacaacaacacccaguuuugcaucaaaguucucaauccguacaugcccuccguuaucgagaaaauggaggcccuacagcggcaauacggcggcgcacuagugcgcaacccccucucccgaaauucuacccacgagauguacugggugagcaacgcuaccgggaacaucgucuccagcgugaacaugaucagccgcaugcugauuaaccguuuuacgaugaagcauaagaaggccaccuacgagcccgacguggaccuggggagcgguacccgcaacauugguaucgaguccgagauccccaaccuggauaucaucggcaaacggauugagaagaucaaacaggaacacgagaucaguuggcacuacgaccaggaccaccccuacaagaccugggccuaccauggcuccuacgagaccaagcagacagguuccgccagcagcauggucaacgggguggugcgucucuuaacgaagccgugggacgucgugccgaugguaacccaaauggcgaugacugauacgacgcccuucgggcagcagcgcgucuucaaggaaaagguggacacgcgcacacaagagcccaaagagggcaccaagaaacucaugaagaucacggcugaguggcucuggaaggaguuagguaagaagaagacgccccgcaugugcacacgggaggaauuuacgaagaagguuaggucaaaugcagcccugggggccauuuuuacggacgagaacaaguggaaaagugcgagagaggcugucgaggacggcagguucugggagcucguagaccgggagcgaaaccuccaccuggaggggaagugcgaaacaugcguguacaacaugaugggcaagcgggaaaagaaacucggugaauucggcaaggccaaggggucccgcgccaucugguauauguggcuaggggcucgguuccuugaguucgaggcccucggcuuccugaacgaggaccauugguuuagccgcgggaauuccuuguccggugucgagggggaggggcuccaucgucugggauauauccugcgcgacguugggaagaaggagggcggggccauguacgccgacgacacagccggcugggacacccggauuacgcucgaagaccugaagaacgaggagauggugaccaaccacaugaagggggagcacaagaaacuggcggaagcaauuuuuaagcucaccuaccagaacaagguuguaagaguccagagaccgacgccccgcgggaccgugauggacaucaucagccgccgggaccagcggggcuccgggcagguaggcacguacgggcugaauaccuucaccaacauggaggcgcaacugauacgccagauggagggcgaggguaucuuuaagaguauacagcaccucacggccacggaagagaucgccguccagaacuggcuggcacgcgucgggcgggagcgccugucccggauggcgaucuccggcgacgacugcgugguuaagccuaucgacgaccgauucgccuccgcccucaccgcacuaaaugacauggggaaggugagaaaggacauccagcagugggaacccagccgcggcuggaacgacuggacccaggugccguucugcucccaccacuuccaugagcugguuaugaaagacggacgggugcucgugguccccugccgcaaccaggaugaguuaaucggccgggcgcguaucucccagggggccggauggagucugaaggaaacugccugucuaggcaagucuuacgcccagauguggacccuaauguacuuccaccggagggaccuacgccucgccgcgaacgcgaucugcucagcugugcccagccacugggugccaaccucccgaacuaccuggagcauucacgcaaagcacgaguggaugacaaccgaagauaugcuugcggucuggaaccguguguggauccaagagaacccguggauggaggacaagaccccaguggaauccugggaggaggucccuuaucugggcaaacgggaggaccaguggugcggcucgcucauaggucugaccagccgggccaccugggccaagaacauccagaccgcaauuaaccaggugcgaucucugaucgggaacgaggaauauaccgauuacaugccaagcaugaagcgguuucgccgugaagaagaggaggccggcgucuugugguga

SEQ ID NO: 25027 - RNA, 9876 nt, Artificial Sequence
  derived and/or modified CDS sequence (opt11) from DENV-2__FJ882594__SS-prME
accgcgggggugauugucaugcugauccccacagcgauggcguuccaccucacgacccgcaacggggagccgcacaugaucguugggagacaggagaaggggaagucccugcuguucaagaccgaagacggcguaaacaugugcacguuaauggccaucgaucugggggaacugugcgaggacaccauuaccuacaagugcccuuuacugcgccagaacgaacccgaggacaucgacugcuggugcaacagcacuagcaccugggucaccuacgggaccugcaccaccacgggcgagcacagacgcgagaagcgguccguagcucucgugccccacgucgggaugggccuagagacccgcaccgagaccuggaugagcucugagggggccuggaagcacguucagcggauugagacguggaucuugcgccauccgggcuuuaccaucauggccgcgauucuggcauacaccaucggaaccacgcacuuucaaagggcucucaucuucaucuuacuaaccgccguggcgccgagcaugacaaugcgcuguauuggaaucucaaaccgagacuucgucgagggcgugagcgggggcucuuggguggacauaguacucgagcacggcucgugcgugacuacgauggcuaagaacaaacccacucuggauuucgagcugauuaagaccgaggccaagcagcccgcaacccugcgcaaauacugcaucgaggccaagcugacgaacaccaccaccgagucccggugcccgacgcagggcgagccgagccugaacgaagaacaggacaagcgcuuuaucugcaagcacucgaugguggaccgaggcugggggaauggcugcggcuuauucggcaaggggggaauagugaccugcgcuauguucacgugcaagaagaauauggaaggcaagguaguucagcccgagaaccuggaauacacaauagucaucacgccccauucgggggaggagcacgcggugggcaaugacaccggcaagcacggcaaggaaaucaagaucaccccccagucuagcaucaccgaggccgagcugaccggcuacgguacagugaccauggagugcagcccacgcaccggccuugacuucaacgagaugguccugcugcagauggaggacaaagccuggcucgugcaccggcagugguuccuggacuuaccccuccccuggcugccuggggccgacacccagggcagcaauuggauacagaaggagacgcuggugaccuucaaaaacccgcaugcgaagaagcaggacgucguggugcuugggucccaagagggcgccaugcacaccgccuuaaccggugcgacggagauccagaugagcagugguaacuugcuauucacaggccacuugaaguguaggcugcgaauggacaagcuccaacugaagggcaugucauacagcaugugcacgggcaaguucaaaaucgugaaggagaucgccgaaacccagcacggaacgauuguaauccgggugcaguacgagggcgacggcucccccuguaagauccccuucgagauuaccgaucuggagaagcggcacgugcucgggcgccugaucaccgugaacccgaucgucacggagaaggauagccccgugaacauugaggcggagccgccguucggcgacuccuacaucauaaucgguguggagccuggucaguuaaaguugaacugguucaagaaggggagcuccauugggcagauguucgagacuaccaugagaggcgccaagcggauggcuauccugggggacaccgcgugggacuucgggagccuugggggcgucuuuaccuccaucgggaaggcucuccaccagguauucggcgcgaucuacggcgccgccuucagcggugucuccuggacgaugaagaucuuaaucggagucaucaucacguggaucgggaugaacagccgcuccaccagcuuauccguuagccuagugcuggugggcguggugaccuuguaucuuggugccaugguccaggcggacuccggcugcguggugagcuggaaaaacaaggagcucaagugcggcagugggaucuucaucacggacaauguccacacuuggaccgagcaguacaaguuucagcccgagucgcccuccaaguuagccuccgcgauccaaaaagcucaugaggagggcaucugcgggauccggucugugacccgccuggaaaaucuuauguggaaacaaaucacgcccgaacugaaccacauccuguccgagaacgaggugaagcucaccaucaugaccggagacauucgagggaucaugcaagccgggaagcgcagccugcggccgcagccaaccgagcugaaguacucauggaagacguggggcaaggcaaagaugcucagcaccgagucccacaaccagacguuccugaucgacgggcccgaaaccgcugagugcccgaacacgaacagggcuuggaacucguuagaagucgaggacuacggauucgggguguucaccacgaacaucuggcuuaaauuacgggagaagcaggauguguuuugcgauuccaagcugaugagugccgccaucaaagacaacagagcuguccacgccgacaugggcuauuggaucgagucagcccucaaugacacauggaagauggagaaagccucauucaucgaaguaaagagcugccacuggcccaaaagccacacccugugguccaacggcguguuagagagcgagaugauaauccccaagaacuucgccgggcccgucucccagcacaauuaucggccgggcuaccacacucagaccgcagggcccuggcaccucgggaaguuggagauggacuuugaccugugcgaggguaccaccgucguggucacggaggacugcggcaaucgcggcccaagccuccggaccaccacggccagcggaaaguuaauuacggaguggugcugccgcuccugcacccucccaccucuccgguaccguggcgaagacggaugcugguauggcauggagauccggccacuuaaagagaaagaggagaaucuggugaacagcuuagucaccgccgggcacggccaaaucgacaacuucuccuugggaguccuggggauggcccuauuccuggaggaaaugcugcguacgcggaucggcacgaagcacgcgauccuccugguggccgucagcuucgucacccugaucaccgggaacauguccuuccgggaccucggccgcgugauggugauggucggcgcaaccaugacggacgacaucggcaugggcgucacguaccuggcccugcucgccgcguuuaaggugcggccaaccuuugcugccgggcugcuccuccgcaaguuaaccagcaaggagcugaugauggccacgaucgguaucgcucuccuuucucagagcaccauaccagagaacauacuggagcucaccgacgcgcuggcacuggggaugaugguccucaagaucgugcggaauauggagaaguaccaacuggccguaacaaucauggccaucucaugcgucccgaacgccgugaucuuacagaaugcguggaagguaagcugcacgauccucgccgccgucuccguaucgccucugcugcucaccagcagccagcagaaggccgacuggaucccccuggcgcugaccaucaagggccucaaccccaccgcuaucuuccugacgacucuguccagaaccucaaagaagagguccuggccgcucaacgaagcuaucauggccgucggaauggugucgaucuuagccaguagccugcugaagaacgauauccccaugaccgggccgcucgucgcgggcgggcugcucaccgucugcuacgugcugaccggccgcuccgccgaccuagaacucgagcgggcagccgacgugaaaugggaggaccaggccgagaucagugggagcucucccauccugagcaucaccaucuccgaggauggcagcaugagcauaaagaacgaggaggaggagcagacccugacgaucuugauccgcaccggccuacucguuaucagcggcguguucccggucuccauccccaucaccgcagccgccugguaccucugggaggucaagaagcaacgggccggcguccugugggacgugcccucaccaccgccagucgagaaggccgaguuagaagacggcgcguaccgcauuaagcagcgcgguauccucggguacucccagaucggcgccggcguguacaaggaggggacguuccacaccauguggcacgugacccgcggugccguccugaugcaccgggggaagcguaucgagccuagcugggccgaugugaagaaggaccugaucuccuacggagggggcuggaaacucgagggcgaguggaaggaaggggaggaggugcagguccuggcccuggagcccggcaagaacccccgcgcggugcagaccaagcccgggaucuucaaaaccaacaccggaacgauuggagccgugucccucgacuucucucccggcaccagcggcucccccauagucgaccgcaagggaaagguggugggccuguacggcaauggcguagugacccggagcggcgccuacguguccgccaucgcgcagaccgagaaguccaucgaggacaacccugagaucgaggaugauauuuuccggaagaagcggcuuaccauaauggaccuccaccccggggccggcaagaccaagcgcuacuugcccgccaucguccgggaggccaucaagcgcgggcugcgcacacugauccucgccccgacccgggugguggcugcugaaauggaggaggcccugcguggccugcccauccgguaccagacgacagccauuaagaccgagcacacuggacgcgagauagucgaucucaugugccacgcaacguucaccaugcggcuguugagccccgugcgcguaccaaacuauaacuuaaucauaauggacgaggcccauuucacagacccugccaguaucgcggcucggggcuauaucagcacccgcgucgagaugggcgaggcggcggggauuuucaugacggcaacgccgccuggcucccgggaccccuucccccaaaguaacgccccgaucauggacgaagagagagaaauaccagagcggucguggaacuccgggcaugagugggugacagauuucaaaggcaagaccgugugguuuguuccaaguaucaaagcggggaacgacaucgcggccugccugaggaagaauggaaagaaggugauccagcugagccguaagacguucgacuccgaauacguuaagacccgagccaacgacugggacuucguugugaccaccgauaucagcgaaaugggcgccaacuucaaagccgagagagugaucgacccgcgccgguguaugaagcccgucauacuaacggacggggaggagagagucauccuggcgggccccaugcccgugacccacuccagcgccgcccagcggcgagggcgcaucggccggaacccaaagaaugagaaugaccaguauaucuacaugggggaaccccuggaaaacgacgaagacugcgcccauuggaaggaggccaagaugcuccuggauaacaucaacacccccgaaggcaucauccccaguauguucgaaccggagcgcgagaagguugacgcgaucgacggcgaauaccggcugcggggggaggccaggaagaccuucguggacuuaaugcggcggggcgaccugcccgugugguuggccuacaaggucgccgcugaggguaucaacuacgcggaucgcaaguggugcuucgacggcaucaagaacaaccagauccucgaggagaacauggaggucgagauauggacgaaggagggggaacggaagaagcugaagccccgcuggcuagacgcuaggaucuauagugacccgcuagcucugaaggaguucaaggaauuugccgcgggccgcaagucccugacucucaaucugaucaccgagaugggccgccugcccacguucaugacgcagaaagcccgcaaugcccuggacaaccuggcggugcuucacacugccgaggccgggggccgggccuacaaccacgcacucagcgaacugcccgagacucuagaaacccuccugcuguugacgcuguuagccacaguaacuggaggcaucuuucucuuccugauguccggcaaagggaucggcaagaugacgcuggggaugugcuguauuauuacugccagcauacuccugugguaugcgcaaauccagccacacuggaucgccgccuccaucauccuggaguucuuccucauagugcugcugaucccggagcccgagaaacagcguacgccccaggacaaucagcucacauacgucgucauagccauucugaccgucgucgccgcuacgauggccaacgaaaugggcuuccuggagaagacgaagaaggaccucggacuggguagcaucaccacccaagagagcgagagcaacauccuggacaucgaccuccggccagccagcgccuggaccuuauacgccguggcuacgaccuucgugacgccgaugcuucgccacuccauugagaacagcucagucaacgugagccucaccgccaucgccaaccaggccacgguucugaugggccuggguaagggcuggccccucucaaagauggauaucgggguuccccugcuggcgaucggcugcuacagccaggugaaccccaucacucucaccgccgcccugcuucugcugguggcccauuacgcuauaaucgggccggggcugcaggccaaggccacccgggaggcccagaaaagagccgccgcugggaucaugaaaaaccccacgguggacgggaucacgguuaucgaucucgaacccauccccuacgacccgaaauucgaaaagcagcugggacaggugaugcuucucauccugugcgucacccagguacugaugaugaggaccacaugggcguuaugcgaggcccugacacuggcaaccgggccaaucucaacccucugggagggcaaucccgggcguuucuggaauacgaccauagcggugagcauggcgaacaucuuccgcggcucuuaccuggcgggagccggguugcuuuuuagcaucaugaagaacaccaccaauacgcggcgcggaacggggaacaucggcgagacccugggcgagaaguggaagucgcgccugaacgcccucggcaaaagcgaguuccagaucuacaagaaguccggcauccaggagguugaccguacguuagcgaaagagggcauaaagaggggcgagacggaccaccacgccgugucgagggguuccgccaaguuacggugguucguugagcguaacauggucacccccgagggaaaggugguggaccugggcugugggcggggcggguggagcuacuauugcggcgggcugaagaacguccgcgagguuaagggccugaccaagggggggccgggccacgaggagcccaucccuauguccacauacggguggaaccucguacgguugcagagcggcgucgacguguucuuuacgccccccgagaaaugcgauacccugcucugcgacaucggggagucaucccccaacccgaccaucgaggcaggucgcacccugagggugcugaaucucgucgagaacuggcugaacaacaacacccaauucugcaucaagguguugaaccccuacaugccuagcgucaucgagaagauggaagccuugcagcgcaaguauggcggggcuuugguacggaauccucugucccgcaacaguacgcacgaaauguacuggguguccaaugcaaccggcaauaucgugagcucggucaacaugauaagccgaaugcuuauuaaccgcuucacuaugaaacacaagaaggccaccuaugagcccgacgucgacuugggguccgguacgagaaauaucgggaucgagagcgagaucccuaaccuugacaucaucggcaagcgcaucgagaaaaucaagcaggagcacgaggcguccuggcacuacgaccaagaccacccauacaagaccugggccuaccacgguagcuacgagacuaagcagaccgggucugcgaguuccaugguuaacggcgucgugcgccuucucacgaagccuugggacguggucccgauggugacgcagauggcaaugaccgacaccacgcccuucgggcaacaacggguguucaaggagaaggucgacacucgcacccaggagccuaaggagggcaccaagaagcugaugaagaucaccgccgaauggcuauggaaggagcucggcaagaagaaaacgcccagaaugugcacgcgcgaagaguuuaccaagaaggugcgcagcaaugccgcccugggggcuaucuucacggacgagaacaaguggaaaucugcucgcgaggccguggaggacggccguuucugggagcuugucgaccgcgagcgaaacuugcaucuggaggguaaaugcgaaacuugcguguacaacaugaugggcaaaagagaaaaaaagcugggggaauucggccgggccaagggcucucgggcgauuugguacauguggcucggcgccagauuucuggaguucgaggccuuggguuuccucaacgaagaccauugguucucgcgcggcaacaguuugagcggcgucgagggggaggggcugcaccgacugggcuacauacugcgcgacguagguaagaaagagggcggggccauguacgcagacgacacagcgggcugggacacccgaaucacccuggaagacuugaagaacgaggagauggugaccaaccacaugaagggggagcacaagaagcuugccgaggcaaucuucaagcugacguaucagaacaaggucgugcgcgugcagagacccacuccgagaggcacugucauggacaucaucagcaggcgcgaccaacgcggcagcggccagguuggcaccuacgggcuaaauaccuucacgaacauggaggcgcagcugauccgacaaauggagggugaggggaucuucaaguccauucagcaccugacggccaccgaggagaucgccgugcagaacuggcucgcccgcgucgggcgggaaagacugagccggauggccauuuccggcgacgauugcguggucaagcccaucgacgaccgcuucgcuagcgcccugaccgcgcucaacgauauggggaaggucaggaaggacauccagcaaugggaacccucacgcggcuggaacgacuggacgcaggugccauucugcagccaccacuuccacgaacuggugaugaaggauggccggguuuugguggugccgugccgcaaucaagacgaacugaucggccgggcccgcaucagccagggcgccggguggagccugaaggagacggccugccugggcaaguccuaugcgcagauguggaccuuaauguacuuccaccgacgcgaccugcggcuugcggccaaugccaucuguucagccguccccucucacugggugcccacuucucgcaccacaugguccauccacgcgaagcacgaauggaugacgaccgaggacauguuagccguguggaaccggguauggauacaggagaaccccuggauggaagacaaaacgccgguggagagcugggaggaggugcccuaccuggggaagagagaggaccaauggugcggcucucuuaucggccugaccucaagagccacgugggcuaaaaacauucagacggccaucaaccaagugaggagccuaauaggcaacgaggaguauaccgauuacaugccauccaugaagcgcuuccggcgcgaggaggaagaagcgggcguucugugguga

SEQ ID NO: 25028 - RNA, 9876 nt, Artificial Sequence
  derived and/or modified CDS sequence (opt11) from DENV-2__FJ205885__SS-prME
accgccggcgucauuguuaugcugauccccaccgccauggccuuccaccucaccacccgcaacggggagccccacaugaucgugggccggcaggagaaggggaagucccugcuguucaaaacagaggacggcgugaacaugugcacccucauggccaucgaccugggcgagcucugcgaagauaccauaacguacaagugcccgcuccugcgccaaaacgagcccgaggacaucgacugcuggugcaauagcaccagcacuugggugaccuacgggacgugcaccaccacgggcgaacacagaagggagaaacggaguguggcccugguaccccacgucgguaugggcuuggagacccgcaccgagaccuggaugagcagcgagggugccuggaaacaugugcagcggaucgagacguggauccugagacacccgggcuuuaccauaauggcagcgauccuggccuacaccaucgggaccacgcacuuccagcgggcucuaaucuucaucuuacugaccgccguggcgccaagcaugaccaugcgaugcaucggcaucagcaaccgggacuucgucgagggcgugagcggaggcagcuggguggacaucguccucgaacacgggucgugcgugaccacgauggcuaagaacaagccuacccuggacuucgagcugaucaaaaccgaggcaaagcagcccgccacacuacgaaaguauuguaucgaagccaagcucacgaacaccaccacugagagucggugcccuacgcagggcgagcccagccugaacgaggagcaggacaagcgcuucauuugcaagcacuccaugguggaccgaggauggggcaacggcugugggcuauuuggcaagggcggcaucgugaccugcgcaauguucacgugcaagaagaacauggaggggaaaguagugcagcccgaaaaccuggaguacacaaucguuaucacgccccacucgggggaggagcacgccgugggcaaugauaccgggaagcauggcaaggaaaucaagaucaccccucaguccuccaucaccgaagcagagcuuaccgguuacgguacggugaccauggagugcagcccccggaccggccucgacuucaacgaaaugguuuugcugcagauggaggacaaagccuggcucgugcaucggcagugguuccuggacuuaccgcuucccuggcugccgggugccgacacccaaggcagcaacuggauucagaaggagacgcucgugaccuucaaaaacccccacgcgaagaaacaggacgucgucguccucgggucccaggagggugccaugcacacagcccugaccggggcgacggaaauccagaugagcagcggcaacuugcuauucaccggccaucucaagugccgcuuacgaauggacaaacuccaacugaaagggaugucuuauagcaugugcacgggcaaguucaagaucguaaaggagaucgccgaaacccagcaugggacgaucgugauccgcgugcaauacgagggugacggcagccccugcaagauccccuuugagauuaccgaccuggaaaagcggcacgugcucgggagacugaucaccgugaacccgauugucaccgagaaggacagccccgugaacaucgaggcggagccgcccuucggcgacuccuauaucaucaucgggguagagccgggccagcugaagcucaacugguucaaaaaggggagcaguaucggccagauguucgagacgaccaugcgcggcgccaaacggauggccauucugggcgacaccgcaugggacuuuggcagccucggggguguucucaccuccaucgggaaggcccugcaccagguuuucggcgcgauauacggcgcagccuucagcgggguguccuggacaaugaagauccuaaucggagucauaauuaccuggaucgggaugaacagccgcuccaccagccuuagugugagucucgugcuggucggagucgugaccuuauaccucggggccguagugcaggcggacuccggcugcguaguauccuggaagaauaaagagcugaaguguggcagugggaucuuuauuacggauaacgugcauacguggaccgagcaguacaaguuccagcccgagagccccaguaagcuggccucugccauccagaaggcccacgaggagggcaucugcggaauccggagcgugaccaggcuggagaaccucauguggaagcagauuacgccggaacuuaaccacauccucuccgaaaacgaggucaagcugaccaucaugaccggcgacaucaaggggaucaugcaggccggcaagcgcagccugcgcccgcagccgacagagcucaaguacuccuggaagacguggggcaaagcgaagaugcugaguaccgaaucccacaaccagaccuuccugaucgacgggcccgagaccgcagaaugcccgaacacgaaccgcgcguggaacagccucgagguggaggacuacggcuuugggguguucacgacaaacaucuggcugaaacugcgcgagaaacaggacgucuucugugacucuaagcucaugagugccgccaucaaagacaaccgggcggugcacgccgacaugggcuacuggauugaguccgcccugaacgacaccuggaagauggagaaggcguccuucaucgagguuaaguccugucacuggcccaagagucacacccugugguccaauggcguccucgagagcgagaugauuaucccuaaaaauuucgccgggcccgugucccaacacaauuaucgcccgggcuaucacacccagaccgcggggcccuggcacuuaggcaaauuagagauggauuuugacuucugcgagggcaccaccguggugguaacggaggacugcggaaaccggggucccagccuucgcaccaccacggccagcggaaagcugaucaccgaauggugcugccgcuccugcacccugccaccacuccgcuaccggggcgaggacgggugcugguacggcauggaaauccgccccuuaaaggagaaggaggagaaccuggugaacagccucguaaccgcugggcacggccagaucgauaacuucucccuuggcguucuggggauggcccucuuccuggaggagaugcugcggacccgcaucggcacgaagcaugcgauccuccugguggccgucucguucgugacccugaucaccgggaacaugucguuccgggaucucggcagagugauggucauggugggggccaccaugaccgacgacaucggcaugggcguaaccuaccuggccuuacucgccgcguucaaaguccgcccuaccuucgccgccgggcuacugcuccggaaacugaccucuaaggaguugaugauggccacgaucggcaucgcacucuugucccagagcacgauccccgagaccauccuggagcugacggacgcgcuggcccuggggaugaugguacucaagaucgugcgcaacauggagaaguaccagcuagccgucacaaucauggccaucuccugcgugccaaacgcugugauccugcagaacgcguggaaagucagcugcaccauccucgcggccguaucagucucaccccugcugcucaccucaagccaacagaaagccgacuggaucccccucgcgcugacgaucaagggucucaaccccaccgcaaucuuccugaccacccugucucggaccagcaagaagcgcuccuggccacucaacgaggccaucauggccgugggcaugguuagcauccuggccucgagccugcucaagaacgacaucccaaugacggggccccuggucgcgggcgggcugcucaccguauguuacguauuaaccggccggagcgccgaccuggagcucgaacgcgcagccgacguaaagugggaggaccaggcugagaucuccgggagcucccccauccugagcaucacgaucuccgaggacggcagcaugucgaucaagaaugaggaggaagagcagacgcugaccauccucauccggacuggccugcuggugaucagcgggguguuuccgguaagcauucccauuaccgcggccgccugguacuugugggaagugaaaaagcagcgcgccggggugcuaugggauguccccagcccgccgcccguugagaaggccgagcuggaggacggggcguaucggaucaagcagcgcggcauccucggguacucccaaaucggagcaggcguguacaaggaagggaccuuccacacgauguggcaugucacccggggcgccguucugaugcaccguggcaagcggauugagcccagcugggccgacgugaaaaaggaccugaucuccuacggcggcgguuggaagcucgaaggcgaguggaaggagggggaggaggugcaggugcuagcgcuggagcccggcaagaacccccgagcgguccagacuaagcccggcauuuucaagaccaacacuggcacaaucggcgccguuagccucgacuucucccccggcacgagcggcucucccaucguggaucggaaggggaagguggucggccuguaugggaauggcgucguaacccgcucaggcgccuacgucuccgccauugcgcagacggagaaguccaucgaggacaauccagagauagaggacgacauuuuccgcaagaaacgccugacgaucauggaccuccacccgggugccggcaagaccaagcgguaccugcccgccauagugcgcgaggcaauuaagcgggggcugcgcacccugauccucgccccgacucgcguggucgcggccgagauggaggaagcacugcggggccugcccauccgcuaccaaacccccgccaucaagaccgagcacaccgggcgggaaauuguggaccuaaugugccacgccacguucacaaugcgcuuacugagccccgugcgggucccgaauuacaaccucauaaucauggacgaagcgcacuucaccgacccggcuucaaucgccgcccgcggcuacaucaguacucgcgucgagaugggcgaagcagcugggaucuucaugacggccacgccacccggaucccgggacccguucccacaguccaacgcucccaucauggacgaggagcgggaaauccccgagcgcuccuggaacagcgggcacgagugggugaccgacuucaagggcaagaccgucugguucgugccguccaucaaggcagggaacgacaucgcggccugccugcggaagaacggcaaaaaggugauccagcugagcagaaagacguucgacuccgaguaugucaaaacucgggccaaugacugggacuucguggugacaaccgacauaagcgagaugggcgccaacuucaaggccgagcggguaauagacccccggcgcuguaugaagcccgugauccucacggacggggaggagcgggugauccuggccgggcccaugccggucacccacuccagugcagcccagaggcgggggcgcauaggcaggaaccccaagaaugagaacgaccaguacaucuacaugggggagccccuggagaacgacgaggacugcgcccacuggaaggaggccaagaugcuccuggacaauaucaacacccccgagggcaucaucccguccauguucgagccugagcgggagaaaguggacgcgaucgacggcgaauaccgccugcgcggggaggcgagaaagaccuuugucgaccugaugcggaggggagaucugcccgucuggcuggccuacaagguagccgccgaggggaucaacuauacggaccggaaguggugcuucgacggcaucaaaaacaaccagaucuuggaagagaacauggaggucgagaucuggaccaaggaaggggagcggaagaagcugaagccacguugguuggacgcgcgcaucuacucagacccgcuugcccuuaaggaauuuaaggaguucgccgccggccggaagucccucacucucaaccugaucacugagaugggucgccugcccacguucaugacccagaaggcacggaacgcccucgauaaccuggccgugcugcacaccgcggaggcggggggccgcgcguauaaccacgcccugagcgagcugcccgagacccuugagacucuccuucuguugaccuugcuggccaccgugaccgggggcauauuccucuuccugauguccgggaaggggaucggcaaaaugacccuugggaugugcugcaucaucacggccagcauccuccugugguacgcccagauccagccacacuggaucgcggcauccaucauccuggaguuuuuccucaucgugcugcugauccccgagcccgagaaacagcggacgccgcaggauaaccagcugaccuacguggucaucgccauccugaccgucguggccgccacgauggcgaacgagaugggcuuccuggaaaagacuaagaaagaccuggggcucggcaguaucacaacucaggagagcgagaguaacauccuggacaucgaccuccgcccggccucggccuggacgcuguacgccguggccaccaccuucguuaccccaaugcugcggcacuccaucgagaacagcuccgugaacgugagccucacggcuaucgccaaucaggccaccguccugaugggcuuggggaagggguggccgcucucuaagauggacaucggggucccccuguuagccaucggcugcuauagccaggugaacccgaucacccuaacagcggcgcugcuguugcuugucgcccacuacgcgaucaucgggcccggccugcaagcuaaagcgacgcgcgaggcccagaagcgggccgcggccggcaucaugaagaauccgaccguggaugggaucaccguuaucgaccucgagcccaucccauacgaccccaaguucgagaagcaacugggccaggucaugcugcuuauacugugcgugacucaggugcugaugaugcggacgaccugggcgcucugugaggcccugacccuggcuaccgggcccaucucaacgcucugggaggggaaccccggacgguucuggaauaccaccaucgccguuagcauggccaacaucuuccgcggaucuuacuuggcgggcgccggccuccuguucagcaucaugaagaacaccacauccacccgccggggcaccgguaacaucggcgagacccugggcgagaaauggaagucccgccugaaugcacucggaaagagcgaguuccagaucuauaagaaguccggcauccaggaagucgaucggacacuugccaaggaggggaucaagcgcggggaaaccgaccaccacgcggugucccgggggagcgccaagcugcgaugguucgucgagcggaacauggugaccccggagggaaagguggucgaccuaggcugugggcgcggagguugguccuacuacugcggcggccugaagaacgugcgggagguaaagggccugaccaagggcggacccggccacgaggagccaaucccgaugucaacguacggguggaaucucgugagguuacagagcggcguggacguguucuuuaccccgcccgagaagugcgacacccugcucugcgacauuggggagagcagccccaaccccaccaucgaggccggccggacccugcggguccugaaucucguggaaaauuggcuaaacaacaacacgcaguucugcaucaaggugcugaaccccuacaugcccuccgucauugagaagauggaggcccuccagcggcaguacggcggagcacuggugcgcaacccccucagcagaaacuccacgcacgagauguacugggugagcaacgcgaccggcaauaucgucuccagugugaacaugauaucccguaugcuuaucaaccgguucaccaugaagcacaaaaaggccacguaugagccggauguggaccuagggagcggcacgcggaacauugggaucgagucagagauccccaaccuggacaucauuggcaagcggaucgagaagaucaagcaggagcacgagaucucguggcacuacgaccaagaccaccccuacaagaccugggccuaccacggguccuacgagaccaagcagacggggagcgcuaguucaauggugaacggcguggugcgccuguuaaccaagcccugggacgucgugccgauggugacgcagauggccaugacagacacgacccccuucgggcagcagcgcgucuuuaaggagaaggucgacacccggacccaggagcccaaggaggggacgaagaagcugaugaagaucaccgcggaguggcuguggaaggagcucggcaaaaagaagacgccgcgcaugugcacacgggaggaguucacgcgcaaggugcgguccaacgccgcacuuggggcuaucuucaccgacgagaacaaguggaaguccgcucgcgaggcggucgaggacggccgauucugggaacucguggaccgcgagcggaaccugcaucuggaggggaagugcgagacuuguguguacaauaugaugggcaagcgcgagaagaagcugggagaguuuggcaaagccaagggcaguagagccaucugguacauguggcucggggcccgcuuccuggaauucgaggcccugggcuuccucaacgaggaccacugguucagccgggggaauagccuuuccggcgucgagggagagggacugcacaggcucggcuacauacugcgggacgucgggaagaaggagggcggggcaauguacgccgacgacaccgccggcugggacacgaggauaacucuggaggaccuuaagaacgaggagauggucaccaaccacaugaagggggagcacaagaagcuagccgaggcgaucuuuaaguugaccuaccagaacaagguggugcggguccaaagacccaccccccgaggcacggugauggacaucaucucgcgccgggaucagcgcggcuccgggcaggugggcacguacgggcucaacaccuucacgaauauggaagcccaacuuauucgccagauggagggggagggcauauucaagagcauccagcaccugaccgccacagaggagaucgcuguccaaaacuggcucgcccggguggggcgcgagagacugucccggauggcgaucucaggcgacgacugcguugucaaacccaucgaugaccgguucgccuccgcacugacugccuuaaacgacauggggaaggugcggaaggacauccagcagugggagccuagccggggcuggaacgacuggacacaggugccuuucugcagucaccacuuccaugagcuggucaugaaggacgggcgcguacugguugugcccugccguaaccaggaugagcucaucgggcgcgcccggaucagccagggcgcgggguggucccugaaggagaccgcgugccuggggaaguccuacgcgcagauguggacacucauguacuuucaccgccgcgaccuacgccuggccgccaacgcgauaugcagugccgugcccucacauugggugcccacaucccgcaccacguggagcauccacgccaagcacgaguggaugaccaccgaggacaugcucgcugucuggaaccgcguguggauccaggagaaccccuggauggaggacaaaaccccaguggaguccugggaggagguccccuaccuggguaagcgugaggaccaguggugcggcagccugaucgggcucacgagccgcgcgaccugggcuaagaacauccagaccgcgaucaaccaaguaaggucccugaucggcaacgaggaauacaccgacuauaugcccagcaugaagcgcuucagacgggaggaagaagaggccggcguucugugguga

SEQ ID NO: 25029 - RNA, 9876 nt, Artificial Sequence
  derived and/or modified CDS sequence (opt11) from DENV-2__FJ744743__SS-prME
accgcgggcguuaucgucaugcugaucccaaccgccauggcguuucaccugaccacucgcaacggugaaccucacaugauagugggccggcaggaaaaggggaagucccugcuguuuaagaccgaggacggcgucaacaugugcacccucauggcgaucgacuugggggagcugugcgaggacaccauaacauacaaguguccacuccucaggcagaacgagcccgaggacauugacugcuggugcaacuccacgagcaccugggucaccuacggcaccugcaccaccacgggagagcaccggcgcgagaaacgguccguggcccuggugccacacguugggaugggucucgagacucgcacagagacauggaugagcucagagggugccuggaaacacguucagcggauagagacguggauacugcgccaucccggcuucaccaucauggccgcgauucuugccuacaccaucgggacuacgcauuuccagcgggcacucaucuuuauccugcugaccgcuguugcgccuaguaugacgaugcguugcaucggaaucuccaaccgggauuucgucgagggggugagcgggggcagcuggguggacauaguccucgagcauggaucaugcgugaccacuauggcaaagaacaagcccacucuggacuucgagcugauaaagaccgaggccaagcagcccgcgacacuccgcaaguacuguauagaggcuaagcugacuaacaccacgaccgagucucguugcccgacacaaggagagcccagccuaaacgaggagcaggacaagcgcuucauuuguaagcacuccaugguggaccgcggcugggggaauggcugcgggcuguucggcaagggcggcaucgugaccugcgcaauguucacgugcaagaagaacauggagggcaaaguggugcagccagaaaaccuagaguacaccaucgugauuacgccgcacucuggagaggagcacgccgugggcaacgacaccgggaagcauggcaaggagaucaagauuacuccgcagagcagcauuaccgaggccgagcugacuggguacggcacggugaccauggagugcagcccgagaaccggccucgacuucaacgagaugguccuguugcagauggaggacaaggcauggcucgugcaccgccagugguuccuggaccuuccucucccuuggcugccaggggcagacacccagggcagcaacuggauucaaaaagagacguuagugaccuucaagaacccacacgcgaagaagcaggacguaguagugcucggcucccaggagggcgccaugcacaccgcgcugaccggggcaacggagauacagaugucgagcggcaaccuccuguucaccgggcaccucaagugucgccugaggauggacaagcuccaguuaaaggggaugucauacagcauguguaccgguaaguucaagauugugaaagagauagccgagacccagcacgggacgauagugauccgaguccaguaugagggcgacgguucccccuguaaaauccccuucgagaucaccgaucuggagaagcggcacguucuggggcgcuuaaucacgguaaaccccaucguaaccggcaaagauagcccggugaacaucgaggcagagccgcccuucggggacagcuacaucaucaucggcguugaacccggucaacugaaacucaacugguucaagaaaggaagcuccaucggccagauguuugagacuaccaugcggggagccaagagaauggcuauccugggcgacacagcuugggauuucgggagucugggagggguauucaccaguauaggcaaggcccuccaccagguguuuggcgcgaucuacggggcagcauucucuggcguguccuggacaaugaagauacugaucggggucauuaucaccuggaucggcaugaauagcagaaguaccagccuguccgucucucuggugcucgucggaguggugacccucuaccugggcgccguggugcaggcggacucuggcuguguggucagcuggaagaauaaggaguuaaagugcgggucaggcaucuucaucacggauaauguacacaccuggaccgagcaguauaaguuccagcccgaaagccccagcaaguuggccagugcuauucagaaggcacacgaagaaggaaucugcggcauccggagcgugacccgccuagagaaccucauguggaagcaaaucacgcccgagcugaaccauauacuguccgagaacgaggucaagcucacaaucaugacuggggauaucaagggcaucaugcaagccgguaaacggucgcuauggccgcagccaacggagcugaaguacucuuggaaaacguggggaaaggcgaaaaugcuguccaccgaaucccacaaccagaccuucuugauagacgguccugagaccgccgagugcccgaacaccaacagggccuggaacagccuggaggucgaggacuauggguucggcgucuucaccacaaacaucuggcucaaacugcgggagaagcaggacguguucugcgacucgaagcucaugagcgccgccaucaaggauaaccgggcggugcaugccgauaugggcuacuggaucgagagcgcccucaacgacaccuggaagauggagaaggccucuuuuaucgaggugaaauccugucacuggccgaagagccacacacugugguccaacggggucuuagaaagcgagaugauaauccccaaaaacuucgccggcccaguuucccagcacaacuaccgaccgggguaucacacgcagaccgcugggcccuggcaccuagguaagcuggagauggacuucgacuucugcgaaggcaccacaguuguagugacagaggacugcggcaaccgcggacccagccugcggaccaccaccgccagcggaaagcugauuacggaauggugcugucgcagcuguacccugccuccgcugcgguaucgcggggaggaugguuguugguacgggauggagauccggccccucaaggaaaaggaggagaaucugguuaacucacucgucaccgcuggccauggacaaaucgauaacuucuccuuaggggugcugggcauggcucuguuccuagaagagaugcugcgcacccguaucgguacgaaacacgcgauccugcucguggccguaucguucguaacccugaucaccggaaauauguccuuccgggaucuggggcggguaauggucauggugggcgccaccaugacugacgacaucggaaugggggugacauaccucgcccuguuggccgcguuuaagguccgcccgaccuucgccgccggcuugcuccugcgcaagcucacuagcaaggagcuuaugauggccacgauaggcauugcccuucuuucccagaguacuauaccugagaccauccuugagcuuaccgacgcccucgcccucggcaugauggugcucaaaaucgugaggaacauggagaaguaccaacucgccgucacgauaauggccaucuccugcgugccgaaugcugugauccugcagaacgcguggaagguaucuugcaccauccuggcggcaguauccgugagcccccuccugcugaccuccagccagcagaaggccgacuggauaccccucgcacuaacgaucaagggccugaaccccacggccaucuucuugaccacacugucacgcaccagcaaaaagcgguccuggccgcugaacgaggcuaucauggcgguggggauggucagcauacucgccuccagccugcugaaaaacgacauuccuaugacgggcccccucguagccggcggacugcugaccguuugcuaugugcucacggggcgcuccgccgaccuggaguuagaacgggcugccgacgugaaaugggaagaccaggcagaaaucuccgggucaucccccauccucagcaucacuauuuccgaagacggcagcauguccaucaagaacgaggaggaggaacaaacucugaccaucuugauccgcacaggacuccuggugaucagcggcguguucccugucuccaucccuauaaccgcggcugccugguaccugugggaggucaagaagcagagggcaggggugcucugggacguccccagcccccccccuguggaaaaggccgagcuagaggacggugcguaucgcaucaagcagcgagggaucuuaggcuacucgcagaucggcgccgggguguacaaggagggcacauuccacacaauguggcacguaacccgcggggccguucugaugcaccggggcaagcgcaucgagcccucaugggccgaugugaagaaggauuuaaucucguacggcggagguuggaagcuggaaggggaauggaaggagggcgaggagguccagguauuagcacuagagcccgggaagaauccccgggcgguucagaccaaaccggggaucuucaaaaccaauacggggacgauaggcgccgucagccuggauuucucccccggcaccagugggucccccaucguggaccgcaaaggcaaggugguuggguuguacggcaacggcgucgugaccaggucaggagccuacgucuccgcaaucgcucagacggagaaguccaucgaggacaaccccgaaaucgaagaugauaucuuccggaagaagcggcugaccaucauggaccugcaccccggugccggaaagaccaagcgauaccucccggcaaucguacgcgaggccaucaagcgaggccugcgcaccuugauccuggcaccgacgcggguggucgcggcugagauggaggaggcucuucgcgggcugcccauccgguaucaaaccccugccaucaagaccgaacacacuggucgcgagaucguggacuugaugugucacgcaacguucacaaugcgccuccuuucaccggugcgcgucccgaacuacaaccugaucaucauggacgaggcacacuucaccgaccccgcauccaucgccgcccggggcuacaucucuacccggguggagaugggagaggccgcgggcaucuucaugacugccacgccccccggcucccgggauccguucccccagagcaacgcucccaucauggacgaggagcgcgagauccccgagcgguccuggaacagcggccacgagugggucaccgacuucaaggggaagaccgucugguuugugccguccaucaaagccggaaacgacaucgcggccugucuacgcaaaaacggcaagaaaguaauccaacugagccgaaaaacguuugauuccgaguacgucaagacccgagccaaugacugggauuucgucguuaccacagacaucagcgagaugggggcaaacuucaaagccgagagggucaucgacccgcgccggugcaugaagcccguuauccugacagacggcgaggagcgcgugauccucgcggggcccaugccggucacccacucguccgccgcccagcguagaggccgcaucggucgaaaccccaagaacgagaacgaccaguacauuuacaugggcgaaccccuggagaacgaugaagacugcgcucacuggaaggaagcgaagaugcugcucgacaacaucaacacccccgagggcauaaucccgucaauguucgagcccgagcgcgagaaggucgaugcgaucgauggggaguauaggcugcgcggcgaagccaggaagaccuucguagaccugaugcgccgcggagaccucccaguuugguuagccuacaagguggccgccgaggguaucaauuaugcagaccgcaaguggugcuuugacgggauaaagaauaaccagauccuggaggagaacauggagguggagauuuggacgaaggagggcgagcggaagaagcucaagccgcgcuggcuggacgcccggaucuauagcgaccccuuagcgcucaaagaguucaaggaauucgccgcuggccgcaagucccugacacuaaaccucauuaccgagauggggcggcugcccaccuucaugacccagaaggcccgcaacgcacuggacaacuuagccguccugcacacggccgaggcgggcgggcgggccuacaaccacgcccuaagcgagcuccccgagaccuuggagacccuucuccugcugaccuuguuagcgaccgucacugguggcaucuuucuguucuugauguccggcaagggcaucgggaaaaugacccugggaauguguugcaucauaaccgccagcauccugcugugguacgcgcagauucagccacacuggauagcugcguccaucauucuggaguucuuccugaucguccugcugauccccgagcccgagaagcaacggacgccacaggacaaccagcuuaccuaugugguaaucgccauccuaaccgucgucgcggcgaccauggccaacgagauggguuuccuggagaagacuaagaaagaucugggccucggcuccguuaccacgcaggagucggaauccaacauccuugacaucgaccugcgaccggcgagcgccuggacccuguacgccgucgcaaccacuuucgucacccccaugcugcgucacuccaucgagaacagcucugugaacgucucucuaaccgccaucgccaaccaagccacggugcucaugggccugggcaagggcuggccguuauccaaaauggauaucggcgugccccucuuggcgaucgggugcuacagccaagucaacccaaucacucucaccgcaacccucuuacgguuuguggcgcaguacgcuaucaucgguccaggccugcaggccaaggcgacgcgcgaggcucaaaagcgcgccgcugccgggaucaugaagaaucccaccgucgacggcauaacggugaucgaccucgaaccuaucccguaugaucccaaguucgagaagcagcucggucaggucaugcuucucauccugugcgucacccaggucuuaaugaugcguacuaccugggcgcucugcgaggcgcugaccuuagccaccgggcccaucucuacacucugggaggguaacccaggccgguuuuggaacaccacaaucgccgugagcauggcaaacauuuuucgcggcuccuaccucgcgggagccggccuccucuucuccaucaugaagaacaccacguccacccgccggggcacaggaaacauaggagaaacccuuggggaaaaauggaagucccgccugaacgcccuaggcaagucggaguuccagaucuacaaaaaguccgggauacaagagguggaucggacgcuggccaaggaaggcaucaagcgcggggagaccgaucaccacgcggucucccggggcucagccaagcugcgcugguuuguggagcggaacauggugaccccggaagggaaagucguggaccucggcugcggccgcgggggguggaguuauuacugcggggggcugaagaacguucgggaggugaagggccugaccaagggugggcccgggcacgaggagcccaucccaaugagcacguacggcuggaaccuuguucgccugcagagcgggguggacguguucuucacacccccagaaaagugcgacacccuccuuugugacaucggcgaaucgagccccaacccuaccauugaggcaggucggacauuacgcguguuaaaccucguggagaacuggcugaacaacaacacacaguucugcaucaaaguccugaauccauacaugcccucagucaucgagaagauggaggcuuuacagcggcaguacgggggagcccuggugcgcaauccccuuucacggaacuccacgcacgagauguacuggguuagcaacgcgaccggcaacaucgugucaagcgucaauaugaucucuagaaugcucauaaaccguuucacgaugaagcauaagaaggccacguacgagccagacguugaucugggcucgggaacccgcaacaucggcaucgagucugagauccccaacuuagacauuaucggcaagaggauugagaagauaaagcaggagcacgagaucagcuggcacuacgaccaagaccaccccuacaagacaugggccuaccacggguccuaugaaacuaagcagacgggcagcgccagcagcauggugaacggcgugguacgcuuacucacaaagcccugggacgucguaccgauggugacucagauggccaugaccgacacuaccccuuuuggacagcagcgagucuuuaaggaaaaaguggacacgcguacccaggaacccaaggagggaacuaagaagcucaugaagaucaccgcagaguggcuguggaaggaacuugggaagaaaaagacgccccgcauguguacccgggaagaguucacuaagaagguccgcaguaacgccgcccugggcgccauauucaccgaugagaauaaauggaaaagugcccgggaggcgguagaggacgggcgcuuuugggagcugguugaccgugagcgcaaccuccaccuggagggcaaaugcgaaacaugcguuuacaacaugaugggcaagcgugagaagaaauugggcgaguucggcaaggccaagggaucuagggccauuugguacaugugguuaggcgcccgguuccuagaguuugaagcgcugggauuucucaacgaggaucacugguucucgcgcggcaacucccugagcggugucgaaggcgagggccugcaucggcucggcuauauccugcgagacguuggcaagaaggagggcggugccauguacgcggacgacacagccgggugggacacgcgcauaacccuggaggaccucaagaacgaggaaauggugacaaaccacaugaaaggcgagcauaagaaacuggccgaggcuaucuuuaaacugaccuaccagaacaaaguagugcgaguccagaggccgacuccccgcgguacuguaauggacaucauaagccggcgcgaccagcgggguucuggacaggucgggaccuacggccuaaacaccuuuacgaauauggaggcccagcugauccgccagauggagggcgaggggaucuuuaagagcauccaacacuugaccgccauugaggagaucgccgugcaaaacuggcuugccagagugggccgggagcgacugucccggauggcgaucucuggggacgacugcgucguaaagcccaucgacgaccgguucgccucagcccugaccgcccucaaugacaugggcaaggugcggaaagauauacagcagugggagcccagccgcggguggaacgauuggacccaaguccccuucugcucccaccacuuccacgagcugguuaugaaggauggccggguccuggucgugcccuguagaaaccaggacgaacucauuggccgggcgcgcaucagccagggcgcaggcugguccuuaaaggaaaccgccugccugggcaagucauacgcucagauguggacucucauguacuuccacaggagagaccugcgacuggcugccaaugcuauauguagugccguacccucgcacugggucccaaccucccgcaccaccuggaguauccacgcaaagcacgaguggaugaccaccgaagacaugcucgccguguggaaccggguguggauccaggagaauccguggauggaggacaagaccccagucgagaguugggaggaaguuccguaccuuggcaaacgcgaggaccaguggugcgggucacugaucggacuaaccagccgagcuacgugggcaaaaaacauccagacggccaucaaccaggugaggucccugaucggcaacgaggaguauaccgacuauaugcccagcaugaagcgauuccgccgggaggaggaggaagcaggugucuuaugguaa

SEQ ID NO: 25030 - RNA, 9876 nt, Artificial Sequence
  derived and/or modified CDS sequence (opt11) from DENV-2__JN819424__SS-prME
accgccggcgugauuguaauguugaucccuaccgcgauggcguuucaccucaccacgcgcaacggggagccccacaugaucgugggccggcaagagaaggggaaaucccugcuguucaagaccgaggacggcgugaacauguguaccuugauggccaucgacuuaggggagcugugcgaggacaccaucaccuauaagugcccgcuccugcgccagaacgaacccgaggacaucgacugcuggugcaacaguaccagcacaugggucaccuacgggaccuguaccaccacgggcgagcaccggagagagaagaggagcguagcccuggugccccacguagggaugggccuggagacccgcaccgagaccuggaugucgagcgagggagccuggaagcacgugcagcggauagaaacguggauacugcgacaucccggcuucaccauaauggcugcgauccuagccuauaccaucgggaccacgcacuuccagagagcacucauauucauucugcugaccgccguggcgcccagcaugaccaugcgaugcaucggcauuuccaaccgggacuucgucgagggcgugagcgggggcuccuggguggacaucguacucgagcaugggagcugugugaccacgauggcuaagaacaagcccaccuuagacuucgaacugauaaaaaccgaggccaagcagccagccacccuccgcaaguauugcaucgaagccaaacugacgaacaccacuaccgagucucgcugcccaacacagggugagcccagccuaaaugaggagcaagacaagcgcuuuaucugcaagcacucgaugguggacaggggaugggggaacggcugcgggcuguucgggaaggggggaauaguaaccugcgcgauguuuacgugcaagaagaacauggaggguaaggucgugcagccggagaaucuggaguacacgaucgucaucacgccccacucgggagaggagcaugcuguuggcaacgacaccgggaagcacgguaaagagaucaagaucacgccgcagaguuccauuacggaggccgagcugaccggcuauggcacggugacuauggagugcagcccccggacgggucucgacuucaacgaaaugguacugcuucagauggaggacaaagccugguuagugcaccggcagugguuuuuagaccugccccucccguggcugcccggggccgacacccagggcagcaacuggauccaaaaggagacccuggucaccuucaagaacccccaugcgaagaaacaggaugucgugguccucgggucccaagagggcgcuaugcacaccgcccugacaggggcgacggagauccagaugucaucgggcaaccuguuauuuaccggucaccugaagugccgccugcggauggacaagcuccagcugaaggggaugucguacagcaugugcacagguaaguucaagaucgugaaagaaaucgccgagacucagcacgggacgaucguaauucgcguccaauacgagggcgacggcucccccugcaagaucccguucgagaucaccgaccuggagaagaggcaugugcucgggcgccugaucacggugaacccgauaguuaccgagaaggacagccccgugaauauagaggcggagccacccuucggcgacuccuacaucaucaucgggguggagccgggccagcugaagcucaacugguucaagaagggcucauccaucggccagauguucgagacgaccaugcgcggcgccaagcggauggcaauccuuggggauacagcaugggauuucggcagcuugggcggggucuucaccucuaucggcaaggccuuacaccaaguguucggggcgaucuacggcgcggcguucuccgggguguccuggacgaugaagauccugaucggugucaucaucaccuggauugggaugaacucccgcuccacgagccugucagugagcuugguccucgucggcguggucaccuuauaccugggggccgucgugcaagcggacuccggcugcguggucagcuggaagaacaaagagcucaaaugcggcucagggauuuucauaacagacaaugugcauaccuggaccgagcaguacaaguuccagccagagagucccucgaagcuggccagcgccauucaaaaggcccacgaagagggcaucugugggauccggagcguaacccgccuagagaaccucauguggaagcagaucacgccagagcuuaaccauauucuguccgagaacgagguaaagcucaccaucaugacgggcgacauaaagggaaucaugcaagcgggcaagcgcagccugcgcccgcagcccacugaguugaaauauaguuggaagacguggggcaaggccaaaaugcugucgacagaaagucacaaccaaaccuuucugaucgacgggccagagacagccgagugcccgaauacgaacagagccuggaacagccuggaggucgaggacuacggcuucggagucuuuaccaccaacaucuggcucaaacucagagagaagcaggaugucuuuugugauuccaaacugaugucagccuccucgaucgacaaccgggcagugcaugcugauaugggcuacuggauggaaagugcccccagcgacuccugcaagauggagaaggccagcuucaucgaggauaaguccuguuacuggccgaauagccagcaucuuuggaguaacggcgucuuggagucagaaaugaucuuucccaagaacuucgcaggcccggucagccagcauaucuaccgccccggguaccacacccagaccgccgggccgugcaaucuaggcaagcucgagauggacuucgacuucugcgagggcaccaccguggugguaaccgaggacugcggcaaccggggccccucacucaggaccacgaccgcgagcgggaagcugaucacugaguggugcugccgguccugcacccucccgccucuacgcuaucggggcgaagacggcugcugguacggcauggagauccggccccugaaagaaaaagaggagaacuuggugaauagccuggugacggccggccacggccagaucgacaacuucucccuggggguacucgggauggcacuguuccuggaagagaugcucagaacucgcaucgggaccaagcaugccauccugcuggucgcaguguccuucgucacccuaauuaccgggaacaugucauuucgggaccugggccgugugauggugauggucggggccacaaugacugaugacaucggcaugggcgugaccuaccuggccuugcuggccgccuucaaggugcggcccacuuucgcagcugggcugcuccugcggaaguugaccagcaaggagcucaugauggcuaccaucgggauagcucugcugucccagagcaccauucccgagacgauccucgagcugaccgacgcccuggcgcucgggaugauggucuuaaaaaucgugcgcaacauggaaaaguaccagcuggccgugacgaucauggcgaucuccugcgucccaaacgccgugauccuccagaacgcguggaagguaagcugcaccauacuggcugccgucuccguuucgccacugcuacucacuuccucucagcaaaaggcagacuggaucccccuggcgcucacuaucaagggccuaaacccgaccgcgaucuuccuuaccacucucagccggaccagcaagaagcgcagcuggccccuaaaugaggccauuauggccgucggcauggucucaauucuugcaagcucccuccucaagaacgacauccccaugaccgggccccugguggccggcgggcuuuugaccgucugcuauguauuaacggggcgaagcgcugacuuggaacuggaacgcgccgccgaugugaagugggaggaccaggccgagaucuccgggagcuccccgauccugagcaucaccaucucugaggauggcagcauguccauuaagaacgaggaggaggagcagacgcucacgauacugauucggacgggccugcuugucaucagcggcguguucccuguguccaucccuauaaccgccgccgccugguaucuuugggaggucaagaagcagagagccggcgugcuuugggacguccccagcccgccucccgucgagaaggccgaacucgaggacggcgccuaccggaucaagcagagaggaauccuggguuauucccaaaucggagcggguguguauaaggaagggacauuccacaccauguggcacgugacccgaggcgcgguccugaugcacagggggaagagaaucgagccgucaugggcggaugugaagaaggaccucaucaguuacggcgguggcuggaaacuggagggcgaguggaaggagggggaggaagugcagguccuggcccucgagccagguaagaacccccgugccgugcagacgaagcccgguaucuuuaagacaaacaccgggaccaucggcgcggucagcuuagacuucucaccgggcaccuccggcagcccuaucguggaccggaaggggaagguaguugggcuguacgggaacggcguggugacacgcuccggcgccuacguuuccgccaucgcccaaaccgagaaguccaucgaggacaaucccgagaucgaagacgauaucuuccggaagaagaggcucaccaucauggaucuucaucccggugcuggaaagacuaaacgguacuugccagccaucgugcgcgaagccaucaaaagaggguuacgaacacugauccuggcucccacacgugugguggccgcugagauggaggaggcauuaaggggcuuacccauccgguaucagacccccgccauaaaaacggagcacaccggccgggagaucgucgaccucaugugccacgcuaccuucacgaugcgccuguugucuccggugcggguucccaacuacaaccugaucaucauggaugaagcucacuucacggacccggcguccaucgccgcgcgcggcuacaucagcacacggguagagaugggugaggccgcugggauuuuuaugaccgcgacgccacccgguagcagagaccccuucccccagaguaacgcgcccaucauggacgaggaacgggagaucccagagcgcuccuggaacagcgggcaugagugggucaccgacuucaagggcaagaccgugugguucguccccuccaucaaggccgggaacgauauugccgcgugccugcggaagaauggcaagaaggugauccaacucagccgcaagaccuucgacuccgaguacgugaagacccgggccaacgacugggacuucgucgugaccaccgauaucagcgagaugggcgccaacuucaaagccgagcgcguuauugacccgcggcgcugcaugaagcccgucauccugaccgacggggaggagcgagugauccuagccggcccgaugcccgugacccauucgucugcagcacagagacggggacgcaucggcagaaauccuaagaaugagaacgaucaguacauuuacaugggagagccccucgaaaaugacgaggacugugcccacuggaaggaggccaagaugcugcuggacaacaucaacacgcccgagggcaucaucccuucuauguucgagcccgaaagagaaaaggucgaggccauagacggcgaguaccgccuccgcggcgaggcgcgaaagaccuucguggaucuuaugcguaggggcgaccugccggugcggcucgccuacaaagucgcugcugaggggaucaacuacgccgaccgcaaguggugcuucgacggcaucaagaacucucagauccuggaagagaacauggagguggaaaucuggaccaaggagggggagcggaagaaguugaagccccgcuggcucgacgcccggauauauagcgauccccuggcccuaaaggaguucaaggaguuugccgccggccgcaagagccucacucugaaccugauuacggaaaugggccggcuccccaccuucaugacccagaaggcgcgcaacgcccuggacaauuuggccguucuccacaccgccgaggccggggguagagcguacaaccacgcccuaagcgagcugccggaaacgcucgagacccuucugcuucugacccugcucgcgaccgucacagggggcauauuccuguucuugauguccggcaaggguauugggaagaugacccucgggaugugcugcauaaucaccgccaguauccuucugugguaugcccaaauccagccccacuggaucgcggcuuccaucauacucgaguucuuucuaauugugcuguugauaccggagcccgagaagcagcgaaccccgcaagacaaccagcugacauacguaguaaucgccauccugacuguggucgccgccaccauggcgaaugaaaugggcuuccucgagaagaccaagaaggaccugggucugggcagcaucacuacgcaagaguccgaaagcaacaucuuagacaucgaccugcgucccgccucagccuggaccuuguacgccguggcuaccaccuucgugacgcccaugcucagacauagcauugagaacuccagcgucaacguaagucugaccgcgauugccaaccaggccacagugcugaugggccucgggaagggcuggccacuguccaagauggacauaggugucccgcugcucgcuaucggcugcuauucccaggugaaccccauaacccugacggcagcccugcuucuccugguagcccacuacgccaucauugggcccggccuccaggcuaaggcgacucgcgaggcucagaagcgcgccgccgccggcaucaugaagaaucccacugucgacggaauuaccgucaucgaucuggaaccuauucccuaugacccuaaguuugagaagcagcugggccaggugaugcuccuuaucuugugcgucacacagguccucaugaugaggaccaccugggcguugugcgaggcgcuuacucucgccaccggucccauuagcacccuaugggagggcaacccggggcgguuuuggaauaccaccaucgcaguguccauggccaacaucuuucgcggcagcuaucuggcgggcgccgguuuguuauucuccauuaugaagaacacgacgagcacacggagaggcaccgggaauaucggcgagacgcugggugagaaguggaagucccgucucaacgccuuaggcaagagugaguuucaaauauacaaaaagagcgguauccaggaaguggaccgcacgcuggcuaaggaagguaucaagcggggcgagaccgaccaucacgcggugucccgcgggagugcgaaguugcguugguucguggagcguaacauggucacgcccgagggcaaggugguagauuuagguugcgggcgugggggcuggucguauuacuguggugggcugaagaacguccgagagguuaagggccucacuaagggcgggcccggacacgaggagcccaucccuaugagcaccuacggguggaaccugguacggcuccaguccggcgucgacguguucuucaccccgccagagaaaugcgacacgcuccuuugcgacauaggggagagcuccccgaacccgacgaucgaggccggucgcacacugcgggugcucaacuuaguggagaauuggcugaacaacaacacccaguucuguaucaagguucuuaaucccuacaugcccuccgugaucgagaagauggaagcacugcagcgccaauacggcggugcccugguccggaauccccuguccagaaauucaacccacgagauguacuggguguccaaugccacugggaacauuguuagcagcgucaacaugaucucccgaaugcugaucaaucgcuucacuaugaagcauaagaaagcgaccuacgagcccgacguggaccugggguccggcacuaggaacauagggaucgagagugaaauuccaaaccuggacaucauuggcaagagaauagagaagaucaagcaagagcacgaaauuuccuggcacuaugaccaggaccacccuuacaagaccugggcguaccacggcagcuaugaaacgaagcagaccgggagcgccucgucgauggugaacggggucguucgacuccugaccaagccgugggacgugguucccauggugacucagauggccaugacagacacaacccccuucgggcagcagcgaguuuucaaggagaaggucgacacccgcacgcaggagcccaaggagggcaccaagaaguugaugaagauuaccgcagaguggcucuggaaggagcucggcaagaagaagaccccgcggaugugcacgcgcgaggaguuuaccaagaaggugcguuccaacgcagccuugggggccaucuucaccgacgagaacaaguggaaguccgcccgcgaagcgguggaggacggccgguuuugggagcuaguggaccgcgaaaggaaccugcaccucgaggggaagugcgagacgugcguuuacaacaugaugggcaagcgcgagaagaaacucggggaguucggcaaggccaaggguucccgagccaucugguacauguggcucggugccagguuucuggaguucgaggcacucggcuuccugaacgaggaucacugguuuagccgggggaacucccugagcggaguggagggggagggccuccaucgucuaggcuacaucuuacgcgacgucgggaagaaggagggcggggccauguaugccgacgacacggccgggugggacacccgcaucacccuggaagaccugaaaaacgaggagauggucaccaaccacaugaagggggagcacaaaaagcuggccgaggcgaucuuuaaacucacguaccagaacaagguggugcgggugcaacgccccaccccucggggcacugucauggacaucaucagucgccgcgaucagcgcggcagcggccagguggguacauacgggcugaacacguucaccaacauggaggcccagcuaauucgccagauggagggggaggggaucuucaagucgauacaacaccucaccgccaccgaagagaucgcgguucagaacuggcuggcucgagucggccgugaacggcugucgcgcauggcgaucaguggugacgacuguguggugaagcccauugacgaccgguucgccagcgcccucaccgcccuuaaugacauggggaaagucagaaaggacauccaacagugggagccgucccggggcuggaacgacuggacccaggugcccuucugcagccaccacuuucacgagcuggugaugaaggacgggcgggugcuaguggugcccugccggaaccaggaugagcugauuggucgcgcccggaucucccaaggcgcgggguggagucugaaagagaccgccugucuuggcaaauccuacgcgcaaauguggacauugauguacuuccaccggcgggaccugcgccuggccgccaacgcgaucugcucugcagugccgucccacugggugccgacgucccggacaaccuggagcauacaugcgaagcacgaguggaugacuaccgaggacauguuggccguguggaaccgcgucuggauccaagagaaccccuggauggaggacaagacgcccguugagucaugggaggaggugcccuauuugggaaagagagaagaccaguggugugguagccucaucggccuuaccucacgagcgaccugggcaaagaacauucaaaccgccauuaaccagguacggagccuaauugguaaugaggaguacacggacuacaugccaagcaugaaacgcuucagacgggaggaggaagaagcgggcgugcucugguga

SEQ ID NO: 25031 - RNA, 9876 nt, Artificial Sequence
  derived and/or modified CDS sequence (opt11) from DENV-2__FJ744741__SS-prME
accgcuggugugauugucaugcugauucccaccgccauggcguuccaccucaccacccgcaacggggagccucacaugaucgucggcaggcaagagaaagguaagucccuccuauucaaaacagaggacggggugaacaugugcacgcucauggccaucgaccuaggggagcugugcgaggacaccaucacauacaagugcccgcuccugcgacagaacgagcccgaggacaucgacuguuggugcaacagcaccagcaccugggucaccuaugggaccugcaccaccacgggcgagcacagacgcgagaagcggucaguggcccuggugccccacguggggaugggccucgagacucgcaccgaaacguggaugagcucugagggggccuggaagcauguucagagaauagagaccuggauccugcgccacccgggcuucacgaucauggccgccauucuggccuacaccauugggaccacccacuuccagcgggcccucauauucauacugcugacggccguggcucccagcaugaccaugcguugcaucggcauauccaaccgggauuucguggaaggugugagcgggggcucaugggucgacaucguccucgagcacggguccugcgugacaacgauggccaagaauaagcccacccuggauuucgagcugaucaagaccgaggccaagcagcccgccacgcuccgaaaauauugcauugaggccaagcugacgaacaccaccaccgaaucccggugccccacacagggcgagcccagccugaacgaggagcaggacaagcgcuucaucugcaagcacuccaugguggauagaggcugggggaacggcugcggguuauucggcaaggggggcaucgugacuugcgcgauguucacgugcaagaagaacauggagggcaagguagugcagccagagaaccuggaguacaccaucguaauaacgccgcauagcggggaagagcacgcagugggcaacgacaccgggaagcacggcaaggaaaucaagaucaccccgcagaguagcaucaccgaggcagagcugaccggguacggaacagugaccauggagugcagcccccggaccggccucgacuucaacgagaugguccugcuccaaauggaggacaaggccuggcuagugcacaggcagugguuucuugaccugccccuccccuggcugcccggggccgacacacagggcagcaacuggauccagaaggagacuuugguaacuuucaaaaauccccacgcuaagaaacaggacgucgugguccucggaucccaggagggcgcaaugcauaccgcccugaccggggcaacagaaauccagaugagcagcggcaaccuccuguucaccggccaccugaagugccgccugcggauggacaaauugcagcugaagggaauguccuacaguaugugcaccgguaaguucaagaucgugaaggaaauugccgagacccagcacggaacgaucgugauccgaguccaguacgagggcgacgguucccccugcaagauccccuucgagaucaccgaccuggagaagaggcacgugcucgggcgccuuauuacaguuaacccgauuguaaccgagaaggacagccccgugaacaucgaggcggagccgcccuucggcgacuccuacaucaucaucgggguggaaccgggccagcugaagcucaacugguucaagaaggggucuagcaucgggcagauguuugagacgaccaugcgcggcgccaagcggauggccaucuuaggggauaccgccugggacuucgggagccuggguggcgucuucacuuccaucggcaaggcccuacaccagguguucggagcgaucuacggcgccgccuucaguggugugucguggacgaugaagauccugaucggcgugaucaucaccuggaucgggaugaacagccgcaguaccagccuguccgugagccucgugcugguaggcguggugacccuguaccugggggccaugguccaggcggacuccggcugcguggugucauggaagaacaaggagcucaagugcggcuccgggaucuucaucacggauaacguccacaccuggaccgagcaguauaaguuccagccagagagcccaagcaagcuggccucagcuauccagaaggcccacgaggagggcauaugcggcauccggagcgugacccgccuggagaaccucauguggaagcagaucacgccggagcugaaucacauuuugucugagaacgaggugaagcucaccaucaugaccggugacauccggggcaucaugcaggccggcaagcgcagccugcggccucagcccaccgagcugaaguauaguuggaagacgugggguaaggcgaaaaugcucagcaccgagagccacaaccagaccuuucugauugacgggcccgagaccgccgagugcccgaacacgaaccgcgccuggaacucucuggaggucgaggacuacgguuucgggguuuuuaccaccaacaucuggcucaagcugcgagagaaacaggacguguucugcgacucuaagcugaugagcgcugccauuaaagauaaucgcgcgguccacgccgauaugggcuacuggaucgaguccgcccucaacgacaccuggaagauggaaaaggccagcuucaucgaggugaaauccugccacuggcccaagagccacacccuguggucgaacggcgugcucgagagcgagaugaucaucccuaagaacuucgccgggcccgucucccagcacaauuaccggccgggcuaccacacgcagaccgcgggccccuggcaccucggaaagcuagaaauggacuucgaccuaugcgaggguaccaccguggugguuacggaggacugcggcaaccgcggcccgagccucagaacuaccaccgccagcgggaagcugauaacggaauggugcugccgcuccugcacacugccgccgcucagauaccgcggugaggacgggugcugguauggcauggagauccggccccucaaagagaaggaagagaaccuggugaacagccucgugacagccgggcauggccagauugauaacuucuccuugggcguccuggggauggcacucuuccuggaggagaugcugcgcacccggauaggcacgaagcacgcuauccugcugguggccgugagcuucgucacccugaucacugguaacaugucauucagagaucucggccgugugauggugauggucggcgccaccaugacugacgacauuggcaugggcgucacuuaccuggcccugcucgccgcguucaaggugcggcccaccuucgccgccgggcuccuguugaggaagcugaccagcaaagaacugaugauggccacgaucgggaucgcccuucuaucccagagcaccaucccagagaccauccuggagcucaccgacgcccuggcccuggggaugaugguccugaagauugugcggaacauggagaaguaucaguuagccgugacaaucauggccaucuccugcgugccgaacgccgucauacuacagaacgcguggagagugagcuguacaauccucgccgccgucuccguuagcccccugcuccucaccucgagccagcagaaggcagacuggauccccuuggcgcugacgaucaagggacucaaccccacggccaucuuccugaccacccugucccggaccucgaagaagcgcagcuggccgcucaacgaggcuaucauggccgucggcauggugagcauccuggccagcucacugcuuaagaacgacauacccaugacagggccccugguggcgggaggccugcucaccgucugcuacguuuuaacaggccggagcgccgaucuggaacucgaacgcgccgccgauguaaaaugggaagaccaggccgagauuuccgggagcuccccuauacugagcaucacgaucuccgaggacggaagcauguccaucaagaacgaggaggaggagcagacgcugacuauacucaucagaaccggccuucucgucauuagcgggguguuccccgucuccauccccauaacagcggccgccugguaccucugggagguuaagaagcagcgugccggcguccugugggacgugcccagcccaccucccgucgaaaaggcugagcuggaagacggggcuuaccggaucaagcagcgcggcauccucggguacucccagauuggggccggcguuuacaaggaggggaccuuccacacuauguggcacgugacccggggcgccgugcugaugcaucgcggaaaacguaucgagcccagcugggccgacguaaagaaagaccugaucuccuauggcggggguuggaagcucgaaggugaguggaaggagggggaggaggugcagguacuggcccuggaacccggcaagaacccccgcgcggugcagaccaaacccgggauauucaagaccaacacgggcacaaucggggcugugagccucgacuucucccccggcaccaguggcucccccaucguugaccggaaggggaaagugguuggccuuuacgggaacggugucgugacccggagcggggccuaugucuccgccaucgcgcagacggagaaguccaucgaggacaacccugagaucgaggacgacaucuuucggaagaagcgccucacaaucauggaccuccacccaggcgccggcaagaccaagcgguaccugcccgccaucguacgugaggcgaucaagcgcgggcugagaacgcuaaucuuagcgccgacgcgcgugguagcggccgagauggaggaggcacugagaggccugcccauccgguaccagaccaccgccaucaagaccgaacacacugggcgggagaucgucgacuugaugugccaugccaccuucaccaugcgccugcugagcccagugcgggugcccaacuacaaccucaucaucauggacgaggcacacuucaccgacccagccuccaucgccgcgcgcggcuauaucagcacgcgagucgagaugggcgaggccgcagggauuuucaugaccgccaccccgcccggcagucgcgaucccuucccgcagagcaacgcccccaucauggacgaggaacgggagauccccgagcgguccuggaacucugggcacgagugggucaccgacuucaagggcaagacggugugguucguccccuccaucaaggccgguaaugacaucgcggcgugccuacggaagaacggcaagaaggugauucagcuaagcagaaaaaccuuugacuccgaguacgugaagaccagggccaacgacugggauuucgucgucaccacugacaucucugagaugggugccaacuuuaaggccgagcgcgugaucgacccgcggcgcugcaugaagccugucauccucaccgacggggaagagcggguaauacuugcgggccccaugcccgugacgcacagcagcgccgcgcagcgccgcgggcguaucggccgcaacccgaagaacgagaacgaccaguacauauacaugggggagccccuggagaacgacgaggacugcgcccauuggaaggaggccaagaugcuccuggacaacauuaacacgcccgagggcaucaucccuuccauguucgagccggagagagagaaggucgaugcgaucgacggcgaguaccgcuugcgcggggaggcccggaagacguucguggaccuuaugcgucgcggugacuuacccguguggcuggccuacaaggucgccgccgaagggaucaacuacgcggaucggaaguggugcuucgacggcaucaagaacaaccaaaucuuggaggaaaacauggagguggagauuuggaccaaggagggggaacgaaagaagcugaagccacggugguuagacgcucggaucuacagcgacccgcucgcccugaaggaguucaaggaguucgccgcggggcggaagucccuuacccucaaccucaucacggagaugggccgccugcccacguucaugacccaaaaggcacggaaugcccucgacaaccuggccgugcugcauaccgccgaggccgggggccgcgccuacaaccacgcucuaagcgagcuucccgaaacauuggaaacgcuucugcuucucacacugcuggccaccguuaccgggggcauuuuccucuuucugauguccggcaaggggaucggaaagaugacccuggggauguguuguaucaucacggccagcauccucuuaugguacgcgcagauccagccccauuggaucgccgccuccaucauccuggaguucuuucucaucgugcugcucaucccggaacccgaaaagcaaaggacuccccaagacaaccagcucaccuacgucgugaucgccauccugacuguggucgccgcgacgauggcaaacgaaaugggcuuccucgaaaagaccaagaaggaccucgggcugggcagcaucacgacgcaggagucagaguccaacauccuggauaucgaucuccgccccgccagcgccuggacgcucuaugccguggcgaccaccuucgugacaccgaugcuccgacacuccaucgagaacagcuccgucaacgugucgcuuacugccaucgccaaucaggccacaguucugaugggccuggggaagggcuggccccucuccaagauggacauaggggucccccugcuggcaaucggcuguuacagccaggugaaccccaucacacucaccgccgcccuacuucucuugguggcccacuacgccaucaucgggccggggcugcaggcuaaggccacccgcgaggcucagaagcgugccgccgcgggcaucaugaagaacccuaccgucgacgguaucaccgugaucgaccuggaaccaaucccguacgacccgaaguucgagaaacagcugggacagguaauguuacucauccugugcgugacccaggugcugaugaugcgcacgacgugggcacucugugaggcccugacacuugcaaccgggcccauuuccacgcugugggagggcaacccggggcguuucuggaacacuaccaucgccgugagcauggcuaacaucuuccgggguuccuaucuggcuggagccggccuccuguucucgaucaugaagaacaccacgaacacccggcggggcacugggaacaucggcgagacgcugggcgagaaguggaagucaaggcugaacgccuugggcaagagcgaguuccagaucuacaagaaguccggcauccaggaggucgaccggacgcuggcgaaggaagggaucaagcgcggcgaaaccgaccaccacgccguaagcagaggguccgccaagcuucgcugguucguggaacggaauauggucacccccgagggcaaggugguugaccugggcugcgggcgcggcggguggagcuacuacugcggagggcugaagaacguccgcgaggugaagggccugaccaagggcgggccgggccacgaagagccuauucccauguccacauacgguuggaacuuaguacgccugcagaguggugucgacguguucuuuacgccucccgaaaagugcgacacccugcucugcgacauuggggaaagcucccccaaucccaccaucgaggccggccgaacccugcgggugcugaaccugguagagaacugguuaaacaauaacacgcaguucugcaucaaggugcugaaccccuauaugcccagcgugauagagaagauggaggccuuacagcggaaguacggcggggcacugguccgcaacccccuaucccggaacuccacacacgaaauguacugggugagcaaugccaccggaaauauugugagcuccgucaacaugaucagccgcauguuaaucaaccgauucaccaugaagcacaagaaagccacguacgagcccgacguggaccucggcuccggcacccguaauaucgggauugagagcgagauccccaaucuggacaucaucggcaagcgcaucgagaagauaaagcaggagcacgaaaccuccuggcacuacgaccaggaccaccccuacaagacgugggccuaccacggcagcuaugagacgaagcagaccggguccgccagcucaaugguuaacggcgucgugcggcucuuaacgaagcccugggaugugguccccauggugacccaaauggcgaugacggacaccaccccuuucgggcaacagcgcguguucaaggaaaaggucgacacccggacacaggagcccaaggaaggcaccaagaaacugaugaagaucaccgccgaauggcuguggaaggagcugggcaagaagaagacgccccgcaugugcacgcgggaggaguuuacccgcaaggugcggagcaacgcagcccuaggggccaucuucacagacgagaacaaguggaagucggcccgcgaggcugucgaagacggucgguuuugggagcugguugaccgcgagcggaaucuacaccuggaggggaagugcgagaccugcguguacaacaugaugggcaaacgcgaaaagaagcugggggaguucggcaaggccaagggcagccgcgcgaucugguacauguggcucggggcgcgcuuccuagaguucgaggccuuagguuuccucaacgaggaucacugguucucccgggggaauagccuuagcggcguggagggggaggggcugcaucggcucggcuacauccuucgggacgucgggaagaaggaggguggggccauguacgccgacgacacggcaggcugggacacccgcaucacgcuggaggaccuaaagaacgaggagaugguuaccaaccacaugaagggggagcacaagaaacuggcggaggccauuuucaagcugacguaccagaacaagguugugcgggugcagcgcccgaccccccggggcaccgucauggauaucauuagucgccgcgaccaaaggggcagcgggcagguaggcacauacgggcuuaacacuuuuaccaacauggaggcccagcugauccggcaaauggagggcgagggcauuuucaaguccauccaacaccugaccgccaccgaggagaucgccgugcagaauuggcuggcgcggguugggcgcgagcggcugucucgcauggccaucucuggugacgacugcguggugaagcccaucgacgaccgguuugccagcgccuuaacggcgcugaacgacaugggcaagguccgaaaggacauccagcaaugggagcccucacggggcuggaacgauuggacucagguccccuucugcagccaccacuuccacgaacuggugaugaaggacgggcgcguccugguggugccgugccggaaucaggacgaacucaucggccgcgcgcggauuagccagggcgcgggguggagccugaaggagacagccugccugggcaaguccuaugcccagauguggacacucauguacuuccaccgccgggaccugcggcuggccgcgaacgcgaucugcagcgccguccccucacacugggugcccaccucucggacgaccugguccauucacgccaagcaugaguggaugaccaccgaggacaugcucgcgguauggaaccgcguuuggauccaggagaaccccuggauggaagacaagacgccggucgagagcugggaggaggugcccuaccuggggaagcgggaggaccaguggugcgggucgcugaucgggcucaccucccgcgccaccugggccaagaacauucagacagccaucaaccagguccgcucgcugaucggcaacgaagaguacacggacuacaugcccuccaugaagcgguuccgccgggaggaggaggaggccggcguucugugguag

SEQ ID NO: 25032 - RNA, 9876 nt, Artificial Sequence
  derived and/or modified CDS sequence (opt11) from DENV-2__FJ744703__SS-prME
accgcgggugugauugucaugcuuauccccaccgccauggcguuccaucucaccacccgcaacggggagccccauaugaucgugggccgucaagagaaggggaagucccugcuguucaagaccgaggacggcguaaacaugugcacccucauggccaucgaccugggcgagcugugugaggacaccauuaccuauaagugcccccuccuacggcagaacgaacccgaggacaucgacugcuggugcaacaguaccucaaccugggucacuuacggaacuugcacuaccacaggggagcaccggcgcgagaagcggagcguggcccugguuccccauguggguaugggccuggagacccgcaccgaaacguggaugucuagugaaggugccuggaagcacgugcagcggaucgagacguggauccuuagacaccccgguuuuaccaucauggccgcgauccuggccuacaccaucgggaccacgcacuuccagcgggcccucauauucauacuauuaacugccguggcccccagcaugaccaugcgcugcaucgguaucagcaaccgggacuucgucgagggcguaagcgggggcagcuggguggacauuguucucgagcacggcagcugcgugaccacuauggcaaagaacaagcccacccuggacuucgagcuaaucaagacugaggccaaacagcccgccacccuccgcaaguacugcaucgaggccaagcugacgaacaccaccaccgagagcagguguccgacgcagggcgaacccagccuuaacgaggagcaggacaagcgcuuuaucuguaagcacucuaugguggaccggggcugggggaacggcugugggcuguucggcaaaggcggaaucgugacaugcgcgauguucacgugcaagaaaaacauggagggcaaggugguacagcccgaaaaccuggaguacacaaucgucauuacgccccacagcggagaggagcaugccguugguaacgauacugggaagcacggcaaggagaucaagauaacgccgcaaagcucuauaacugaggcggagcugaccggguacggcacggugacaauggagugcagcccccgcaccggacucgauuuuaacgagauggugcugcugcaaauggaagacaaagcuuggcucgugcaucggcagugguuucuggaccugccccucccguggcugccaggggccgacacacagggcagcaacuggauccagaaggagacucuggugacuuucaagaacccccacgcaaagaagcaagacguuguuguccucggaucccaggagggcgccaugcacaccgcccugaccggggccacggagauacagaugagcagcggcaaccuccuguucaccggccacuuaaaaugccgccugagaacugacaagcuccagcugaaggggauguccuacuccaugugcaccgguaaguucaagaucgugaaagagauugccgagacgcagcacggcacaauugugauccgcguacaguacgagggcgacgguuccccaugcaagauccccuucgagaucaccgaccuggagaagcgccaugugcucggacgccugaucacggugaacccgauuguuacggaaaaggacagcccagugaacauugaggcagagccgcccuucggugacuccuauaucaucaucgggguugaaccaggacagcugaaacucaauugguucaagaaggggagcuccaucggccagauguucgagaccacaaugcgcggcgcgaagcggauggcuaucuugggggacaccgccugggauuucgggagccucgggggcgucuucacgucaaucgggaaggcacuccaccagguuuucggcgcgaucuauggagccgcauucagcgggguguccuggaccaugaagauccuuaucggcgucaucaucacguggaucggaaugaacucgcgcuccaccagccuguccguuagccuggugcucgucggcguggugacgcuguaccugggcgccgucgugcaggcugacuccggcuguguaguuagcuggaagaacaaggagcuaaaaugcggguccgggaucuucaucaccgauaacgugcauacuuggacggaacaauauaaguuucaacccgagagcccauccaagcuggcauccgccauccagaaggcccacgaggagggcauaugcgggauucggagcgugacacgcuuagaaaaccucauguggaagcagauaacccccgagcugaaccauauaccguccgagaaugaggucaaguugaccaucaugaccggcgacaucaaggggaucaugcaggccggcaagcggagccuaagaccccagccgacagagcuaaaguacuccuggaaaaccugggguaaggcgaagaugcugucuacugagucccacaaccagaccuuccucaucgacgggccagagacugccgagugccccaauaccaauagggccuggaacucgcuggaaguagaggacuauggcuuugggguguucaccaccaacaucuggcugaagcuccgcgagaaacaggacguguucugugacuccaagcugaugagcgccgcaaucaaggacaaccgugcggugcacgcggacaugggcuacuggaucgaguccgcucugaacgauaccuggaagauggagaaagccagcuucaucgaagugaaguccugccacuggcccaagucgcauacgcucuggagcaacggcguccucgagagcgagaugaucauccccaagaacuuugccgggccgguaucgcagcacaacuaccgcccaggguaccacacccagaccgcggggcccuggcaccuagguaagcucgagauggacuucgacuucugcgagggcaccacaguugucgugaccgaggacugcggcaaccggggccccagucugcgcaccaccaccgcuagcgggaaguuaauaaccgaguggugcugcagauccugcacccucccgccccugcgcuaucgcggcgaggaugggugcugguaugggauggagauccgcccacugaaggagaaggaggaaaaucucgucaacucccuugucaccgccgggcacggccagauugacaacuucucccugggcgugcucgggauggcguuguuccuggaggagaugcuccggacgcgcauagggacgaagcacgcgauccugcugguggccgucagcuucgugacccucaucaccgggaacauguccuuccgggaccuuggccgggugauggucauggugggggccacgaugacggacgacaucggcaugggugugacguacuuggccuuacuagcggcguucaaaguucgcccaaccuuugcggccgggcugcuccugcggaaguuaacgagcaaggagcuaaugauggccaccauagguauugcccugcugucccagagcaccauccccgagaccauccucgagcucacggaugcacucgcccucgggaugauggugcucaagaucgugcgcaacauggagaaguaccaauuagccgucaccaucauggcuaucuccugcguacccaacgccgugauccuccagaacgcguggaaggugagcugcacuauccuggccgcaguguccgucagcccccugcuccuuaccuccagucagcagaaggcggacuggauuccccuggcgcuuacgauaaagggccugaacccgaccgcaauuuucuugacaacacucuccaggacgaguaagaagcgcuccuggccccugaacgaggccaucauggccgugggcauggugagcauucuugccuccucacuccugaagaaugacaucccaaugacgggcccccugguagcgggugggcuccuuaccgugugcuacgugcugaccggccggagcgccgaccuggagcuggagcgggccgccgacgucaagugggaggaccaggccgagaucuccgggagcuccccgauccugagcaucacgaucuccgaggacggcagcauguccaucaaaaacgaggaggaggaacagacccucaccauccuuauucggacaggucugcuugucaucucugguguguucccagucucgauccccaucacggcggccgccugguaccugugggaagugaagaagcaaagagccggcguacugugggacgugcccagcccgccgcccguggagaaggccgagcucgaggacggggcguauaggaucaagcaacgcggaauccugggguacucccagauuggcgcgggaguuuacaaggaggggacguuccacaccauguggcaugucaccagaggggccgugcuuaugcaccgggguaagcggauugagccuagcugggcagaugucaagaaggaccugaucuccuacggcgguggcuggaagcuagagggcgaauggaaagaaggagaggagguucaggugcuggcccucgagcccggaaaaaauccccgcgcggugcagaccaagcccggaaucuucaagacgaauaccgggaccaucggggccgucagccuggacuucuccccaggcaccucuggcaguccgaucguggaucggaaggguaagguugucggccuguacgggaacggcguugucacgcgaucaggcgccuauguguccgcuaucgcgcagacggagaaguccauagaggauaaccccgaaaucgaagaugacaucuuccggaagaaacgacuuacgaucauggaccugcaccccggggccggcaagaccaagagauaccuuccggccauugugcgcgaggccaucaagcgggggcuacggacacugauccuagcccccaccaggguggucgcggccgagauggaggaggcccugaggggccuucccauccgcuaucagacucccgccaucaaaaccgagcacacgggucgggagauuguggacuugaugugccacgccaccuuuaccaugcgccuguugagcccggugcgggucccuaacuauaaccuuauuaucauggaugaggcgcauuucacggaccccgccucuaucgccgcccgcggcuacauaagcacgcgcguagaaaugggcgaggccgccgggaucuucaugaccgccacaccgcccgguucccgcgacccauucccacaaucgaaugcccccaucauggacgaagagagagagauccccgagcgcuccuggaacucagggcacgagugggugacugacuucaagggcaagacagucugguuugucccuucuauaaaagccggcaacgacauugccgccugucuacggaagaacggcaagaaggugauccagcucagccgcaagaccuucgacuccgaguacgucaagacgcgggccaacgacugggacuucguggugaccacggacaucucugaaaugggcgccaacuuuaaggccgagcgcguaauugauccccggcgcugcaugaaacccgucauccugaccgacggcgaggaacgggugauccuugcggguccgaugcccgucacgcacuccuccgccgcccagcggcgggggcguauugggcgaaaccccaagaacgagaacgaccaauacaucuacaugggggagccucuagaaaacgacgaagacugcgcucauuggaaagaggccaaaaugcugcucgauaacaucaacaccccggaggguaucauacccuccauguucgagcccgagcgggaaaaaguggaugcaaucgauggggaguaccgccuccgcggggaagcacgcaaaacauucguggaccugaugcggcguggcgaccugcccgucuggcucgccuauaagguggccgcugaagggaucaacuacgccgaccggaaguggugcuucgacggcaucaagaacaaucaaauucuggaagagaacauggagguugagauauggaccaaggagggggagcgcaagaagcucaagccccgguggcucgacgcccgaaucuacagcgacccgcuggcauugaaggaguucaaggaguuugccgcgggccggaagucccucacauugaaccugauuaccgagaugggccgccuccccacguucaugacccagaaggcacgcaacgcccuggacaaccuugccguccuccacacagccgaggccgguggccgcgccuacaaccacgcacugagcgaauuaccggagacguuagagacgcuucuacuccugacccugcucgcuaccgugaccggggguaucuuccuguuucugauguccggcaaggggaucggcaaaaugacccucgggaugugcugcaucauuacggccuccauccugcugugguacgcccagauucagccccacuggaucgcugccaguaucauccucgaguucuuccugauaguccugcucauccccgagcccgagaagcagcggaccccccaggacaaccaacugaccuacguggugaucgccauccugacggucguggcggcgacaauggccaacgaaaugggcuuucucgaaaaaaccaagaaagaccuaggccugggcagcauaaccacccaggagagcgagucaaacauccucgacauugaccugcguccggccagcgccuggacgcuguacgccguggcgacaaccuuugucacccccaugcuccgccacuccaucgagaacagcucugugaacgugagccugacggcaauagcaaaucaggcaaccguccugaugggccucgggaagggcuggccucuuuccaagauggacaucggggugccgcugcucgcgaucggcuguuacagucaggucaaccccaucaccuuaaccgccgcccugcuccuguuggucgcccauuacgcuaucaucgggcccggcuuacaggccaaagcaacgcgggaggcccagaagcgugccgccgcggguaucaugaagaaccccaccguggacggcaucaccgugaucgaucuggagccuauccccuacgacccgaaguucgagaagcaguugggacaagucaugcuccugauccugugcguuacccaggucuuaaugaugcgcacgacuugggcacugugcgaggcccugaccuuagccaccgggcccaucuccacgcugugggagggcaauccgggccgguucuggaacacaaccaucgccgucagcauggcgaacauauuccgcggcuccuaccuggcgggagcagggcuccuuuuuagcaucaugaagaauaccacgucuaccaggcggggcacagggaacaucggagaaaccuuaggcgaaaaguggaagucgcgccucaacgcccuggggaagagugaguuucaaaucuauaagaaguccggcauccaggagguagaccggacccuggcgaaggaggggaucaagcgcggcgaaacggaccaccacgccgugucccgggggucugccaagcuacgcugguucguagagcggaacauggugacacccgagggcaagguagucgacuugggcugugggcgcggcggguggagcuacuacugcggagggcugaagaacgugcgggaggugaaggggcuuacaaagggagggccaggacacgaggaaccaauuccaaugaguacguacggauggaaccuggucaggcugcagagcggaguggacguguucuuuacgccccccgagaagugcgacacucuccugugcgauaucggggaguccagccccaauccuaccaucgaggccggccggacguuacgcguccucaaucucguggagaacuggcugaacaacaacacgcaguucugcaucaaaguccucaacccuuacaugcccucggucauugagaagauggaggcccugcagcgacaguacggcggggcccuugugcggaacccccucagccggaacucgacacacgagauguacugggugaguaacgcgacgggcaacaucgucuccagcgugaacaugaucucccgcauguugaucaacagguucaccaugaagcacaagaaagcaacguacgagccagacguggauuuagggagcggaacccguaacauaggcauagaguccgaaauccccaacuuggacaucaucggcaagcggauagaaaagaucaagcaagaacacgagaucuccuggcacuacgaccaggaccaccccuacaagaccugggccuaucacgguuccuacgaaaccaagcaaacgggaagcgcuuccagcauggucaauggggucguaaggcucuugaccaagccgugggacgucgugccgauggucacccagauggcgaugaccgauacgacccccuuugggcagcagcgcgucuucaaagagaagguggauacccggacccaggagcccaaggagggcacgaagaaacugaugaaaaucaccgccgaguggcuuuggaaagagcuggguaagaagaaaacgccucgcaugugcacccgggaagaguucacgaagaaggugcguuccaacgcugccuugggagccaucuucacagacgagaacaaauggaagucggcgcgcgaggcugucgaggauggccgcuucugggagcucguggaccgagagcgaaaccugcaccuugaggggaagugcgagaccugcguguacaacaugaugggcaagcgggagaaaaagcucggggaguucgggcgcgccaaaggcucccgggccaucugguacauguggcucggagcgcgcuuccuggaguucgaggcccuagguuuucugaacgaagaucacugguucagccgggggaacucguugucaggcgucgagggggagggccuccaccgccucggcuacaucuugcgcgauguagggaagaaggagggcggcgcaauguaugccgacgacacggccggaugggauacucgcaucacgcucgaggaucugaagaacgaggagauggugaccaaccacaugaagggagagcacaagaagcuggccgaggccauuuuuaagcucaccuaccagaauaaggugguacggguccagcgccccacucccagagggaccguuauggauaucauaagccgccgggaccagcggggcagugggcaggucggcacuuacgggcucaauacguucacgaacauggaggcccagcugauacgccagauggaaggugaaggcauuuucaaaucuauccaacaccuaaccgccaccgaagagaucgcuguacagaacuggcuggcgcggguggggcgcgagcggcugucccggauggccaucagcggcgacgacuguguggucaagcccauugacgaccgguucgccuccgcccucaccgcccugaacgauauggggaaagugcgcaaagacauccagcagugggagcccagccgcggcuggaacgauuggacccaggugccauucugcucccaucacuuucacgagcugguaaugaaggaugggcgggugcucguggugccuuguaggaaccaagacgagcugaucggccgcgcgcggauuagccagggcgcgggcuggucccuuaaagaaaccgccugccucggaaagagcuacgcccaaauguggacgcugauguacuuccauagacgggaucugcgccucgccgcgaacgccaucugcuccgccgugcccagccauugggugccgaccagccggaccacguggagcauccacgccaaacacgaguggaugacuaccgaagacaugcuggcaguuuggaaccgcguguggauccaagagaaccccuggauggaggacaaaaccccuguggaguccugggaggaggucccauaucuggggaagcgggaggaucaguggugcgguagccuaaucgggcugacgagccgcgcaaccugggccaagaauauccagaccgccaucaaccagguccggucccuaaucggcaacgaggaguacaccgacuacaugccgagcaugaagcgcuuccgacgcgaggaagaagaggcaggcgugcugugguag

SEQ ID NO: 25033 - RNA, 9876 nt, Artificial Sequence
  derived and/or modified CDS sequence (opt11) from DENV-2__FJ850067__SS-prME
accgcgggggugauagucaugcugauccccaccgccauggcguuccaccucacuacccggaacggagaaccccacaugaucgugggucgccaggaaaaggggaaaucccuucuguucaagaccgaagacggagucaauaugugcacccucauggccaucgaucuaggggagcucugcgaggauacuaucaccuacaagugcccgcuccugcgucagaacgaacccgaggacaucgacuguuggugcaacucaaccagcaccugggucacguaugggaccuguaccaccacaggcgagcacagacgcgagaagcgguccguggcccugguuccucacgucggaaugggccuagagacccgcaccgaaaccuggauguccucugagggggcguggaagcacguccagcgcauagaaaccuggauucugcgccacccaggcuucaccaucauggcugcuauccuggcuuacacaaucgggaccacccauuuccagcgggcguugaucuucauauugcugacggcgguggcgcccagcaugacgaugcgcugcauuggcaucucuaaccgggacuuuguagagggcgugaguggcggauccuggguggauaucgucuuagagcacgggagcugcgugacuacuauggcuaagaacaagccuacccuagauuucgagcugaucaaaaccgaggccaaacaaccggcgacgcuccgcaaguauugcaucgaggcuaagcugacgaacaccaccacagagucucguugcccuacacagggugaaccaagccuaaacgaggagcaagacaagcgcuucaucugcaagcacuccaugguggaucggggcugggggaacggguguggucuguucgggaaagggggaaucguuacaugcgcgauguuuaccugcaagaagaacauggagggcaagguggugcagcccgagaacuuggaguacaccaucgucaucacaccccacuccggggaggaacaugccgugggcaacgacaccgggaaacauggcaaggaaaucaagauuaccccgcagucuagcaucacggaagcggagcugacgggauacggcacggugaccauggagugcagcccccgcacgggcuuagacuucaacgagaugguccuacugcaaauggaggacaaagccuggcugguacaucggcagugguucuuggacuugcccuuacccuggcugccgggcgcggacacccagggcucaaauuggauccaaaaggagacgcuggugaccuucaaaaacccacacgcgaagaaacaagauguaguuguucucggaucccaggagggcgccaugcacaccgcccugacuggggccacggagauccagaugagcucuggcaaucuacuguucacgggccaucuuaagugccgccugagaauggauaagcuccaacugaaaggaauguccuacagcaugugcacaggcaaguucaagaucguuaaggagaucgcggagacccagcacgggacuaucgugaucagaguccaguacgaaggcgacggcucgccuugcaagauacccuucgagaucaccgacuuggagaagcggcacgugcucgggcgcuuaauaaccgugaaccccaucgucacagagaaggauagcccugugaauaucgaggcggaaccgcccuucggcgacuccuacauaauaaucggaguugagccagggcagcugaagcucaauugguuuaagaaggggucuuccauuggccaaauguucgaaacuaccaugcgcggugcuaagcggauggcuauucugggggacaccgccugggacuucgguagcuuagggggugucuucacguccauagggaaagcgcuccaccaaguguucggcgcaauauauggggccgccuucaguggggucuccuggacgaugaagaucuuaaucggugucauaauaaccuggaucggaaugaacagccgcuccacaagucuguccgugucucuggugcucguuggcguggugacccuguacuuaggugccaugguccaggccgacuccggcugcgugguuucuuggaagaauaaagaacucaaaugcggguccggaaucuuuaucacggauaacguacacaccuggacugagcaguacaaguuucagcccgagucucccucaaagcuagccuccgccauccaaaaggcccacgaggaagggauaugcgggauccggucagugacgagauuggagaaccucauguggaagcaaauuacccccgagcugaaucauauacuuuccgaaaacgaagugaagcucacgaucaugacgggagacauuagggggaucaugcaagccggcaaacggagcuuacgcccccagccgaccgaacugaaguauuccuggaagacguggggcaaagcgaaaaugcuaucaaccgagucccacaaccagaccuuuuuaauugacggccccgaaaccgcagaguguccgaacaccaaccgagcauggaacucucuggaagucgaggacuauggcuucggagucuucaccaccaacaucuggcucaagcuccgugagaagcaggacgucuucugcgacuccaaacugaugagcgccgccauaaaggauaaccgcgcgguccaugcugacaugggguacuggaucgaauccgcgcuuaaugacaccuggaagauggaaaaggccucuuucauugaggugaaguccugucacuggcccaagagccauacacuaugguccaacgggguucuggagagcgagaugauuauuccgaaaaacuucgcagggccgguaucacagcacaauuaccgcccgggcuaccauacgcaaaccgcggggcccuggcaccucggcaaacuggagauggacuucgaccugugcgaggggacaaccgugguagucacggaggacugcgguaaccgcggucccuccuuacggaccaccaccgccagcgggaagcugauaacagaguggugcugccgcucaugcaccuuacccccgcuccgguaucgcggggaggacgggugcugguacgggauggagauccguccccucaaggagaaggaagaaaaccuagugaacagccucguaaccgcgggccacgggcagaucgacaacuucuccuugggcguccucggcauggccuuauuccuggaagagaugcugcgcacucgaauagguaccaagcacgcuauccuccucguggccgugagcuucgucacacugauaaccggcaauauguccuucagggaccucgggcggguaauggucauggucggggcaaccaugacggacgacauugggaugggcgugaccuaccucgcccugcuggcugccuucaagguacggcccacuuucgcagccggucugcuuuugcguaagcugaccagcaaagaguuaaugauggcgacgaucggcauagcucucuuaucccagagcaccaucccugagaccauauuggaguuaacagacgcacuagcacuaggcaugauggugcucaagaucgugcgcaacauggaaaaguaccagcuugccguuacuaucauggccauuuccuguguuccgaaugccguuauccugcagaacgcuuggaagguguccuguaccaucuuagcggccgucuccguaucgccacuucucuugacaucuagccagcaaaaagccgacuggaucccacuagcccugacuaucaagggucucaaccccacggcuaucuuucuuacaacccucucccgcaccagcaagaagcguuccuggccucugaaugaggcaaucauggccgucggcauggugucaauccuggccaguagucugcucaaaaacgacauccccaugacggggccucuaguggcaggcgggcuacucaccgucugcuacgugcucaccgggcgcagcgcagaucuugaacuagagcgggcugccgacguaaagugggaagaccaagcagagaucuccgggagcucccccaucuuaagcaucaccaucuccgaagauggcagcauguccaucaaaaacgaagaggaggaacaaacgcugacuauccucaucaggaccggccugcuuguuaucagcgggguguucccgguguccauucccaucaccgcggcggcaugguaccucugggaggucaaaaagcagcgggccggcguguugugggacguucccagcccuccgcccgucgagaaggcugaacuggaagacggggcguacaggaucaagcagcggggcauacucggguacucucagauuggcgcuggcguauauaaagaagggaccuuccacacuauguggcacgugacgcgcggcgccguccuaaugcaccgagggaagcgcauagagcccagcugggcugacguaaagaaggaucuuaucuccuacggaggugguuggaagcucgagggcgaguggaaggagggggaggaggugcagguccuugcccucgagccaggaaagaauccucgggcggugcagacgaagcccgggauauucaagacaaacacggggaccauaggggcagugagccucgacuucucgcccgguaccagcggcucgcccaucgucgaccgcaagggaaaagugguaggccuguacgguaacggcgucgugacccggagcggcgccuauguuuccgcgauagcacagacggaaaaguccaucgaggacaacccugagaucgaggaugacaucuuccgcaagaagcggcugaccaucauggaccuucaucccggggccggcaaaaccaagcgcuaccugcccgccauaguccgugaagccaucaagcgcgggcugcgcaccuugauccucgcccccacgcgggugguugcggccgaaauggaggaagcccugagaggucugcccauccgguaccagaccaccgcuaucaaaaccgagcauacgggaagggagaucgucgaccucaugugccacgcgaccuucaccaugcggcugcugagccccguucgcguacccaacuauaaccucaucaucauggaugaagcgcacuucaccgacccggcuuccauagccgcccguggauauauuagcacucgcguugagaugggcgaggccgcuggaaucuuuaugaccgccacgccucccggcucccgggaucccuucccgcagagcaacgcaccaaucauggacgaggagcgcgagauaccagagcggagcuggaacagcgggcacgaaugggugaccgauuucaagggcaagaccgugugguucguccccuccauuaaggccgggaacgacauagcggccugccugaggaagaacggcaagaaagugauccagcugagccggaagacauucgacucagaguacguaaaaacucgcgccaacgacugggacuucguaguuacaacggauaucucagaaaugggggccaauuuuaaagccgagcgugugaucgauccgcgccggugcaugaagccagucauccucacugacggggaggagcgcguuauccuggcgggccccaugcccgugacccacucuagcgccgcucagcgacgagggcgcaucggacggaacccgaagaacgagaaugaccaguacaucuacaugggagagccccucgagaacgacgaggacugcgcacacuggaaagaagccaaaaugcucuuggacaacauaaauacuccagaaggcaucaucccuagcauguucgagccggagcgggagaaggucgacgcgaucgacggggaguaccggcugagaggggaggcccggaagacguucguggacuuaaugcgccggggagaucuucccguguggcuggccuacaagguggccgcggaggguaucaacuacgcggaccgcaagugguguuuugacggcauuaagaauaaucagauccucgaggaaaacauggagguugagauuuggacgaaagagggggaacggaaaaagcuaaagccucguugguuagacgcgcggaucuacagcgacccgcucgcccugaaggaguucaaggaguucgcggcggggaggaagucccugacccuaaaccucaucacugagaugggccggcugcccaccuucaugacccaaaaggcccgcaacgcgcucgauaaccuggcggugcuacacacggcagaggccgguggucgggccuacaaccacgcccucucugaacugcccgaaacccuggagacacuccugcugcugacucugcuggccaccgucaccggggguaucuuccuuuuccugauguccggcaaagguauugguaagaugacacuggggaugugcuguaucaucacggcuagcauccuccugugguacgcgcaaauucagccccauuggaucgccgccuccauaaucuuggaguucuuccucauugugcugcugauccccgagccggagaagcagcggacgccccaggacaaccaacugacguacgucgucaucgcgauccuuaccguagucgccgcuacuauggccaacgagaugggauuccuagagaagaccaaaaaggaccucgguuugggaucaaucacaacccaggaguccgaguccaacauacuggacaucgaccuccgaccugcaagcgccuggacgcuguacgccguggcuacgacgcuagugacgccgaugcucagacacuccaucgagaacagcuccgugaaugugagccugacggcuaucgcuaaccaggcaacagugcuuauggggcucgggaagggguggccccuuaguaaaauggacaucggugucccccuguuagcgaucggcugcuacucacagguuaaccccauaaccuuaaccgccgcccuacuccugcugguggcccacuacgccauuaucgggccaggcuuacaggccaaggccacccgggaggcccagaagcgcgcagccgcgggcaucaugaaaaaccccaccgucgacgggaucaccgucaucgaccuggagccgauccccuacgauccgaaauucgagaaacagcugggccaggugauguuacugauucuuugcgucacgcagguauugaugaugcggacgacuugggcccuuugugaagcauuaacccucgcaaccggaccgaucucuacgcugugggagggcaaccccggucgcuucuggaacacuaccaucgccgugaguauggcuaacaucuucaggggcuccuaccuugccggcgccgggcuuuuauuuagcaucaugaaaaacaccacgaacaccagacgcggcaccgggaccaucggagagacgcugggggagaaguggaagucccggcuuaaugcauuagguaaaagcgaguuccagauauacaaaaaguccgggauccaggaggucgaccggacucuggcgaaggaggggaucaagagaggcgagaccgaucaccaugccgucagccguggauccgcuaagcucagaugguuuguggagcgcaacauggucacccccgaaggcaagguagucgaccugggcugcgggcgugguggguggagcuacuacuguggcgggcucaaaaacguuagggaggugaagggucucacaaagggcggcccgggccaugaggaacccauucccauguccaccuauggguggaaccuggugcgacugcaguccggcguggaugucuucuucacaccacccgagaagugcgagacccucuugugcgacauaggcgagagcucccccaauccaaccauagaggccggucgcaccuugcggguucucaaccucguagaaaauuggcugaacaacaacacccaguucugcauuaagguauugaaccccuauaugcccucgguuaucgagaaaauggaagcccugcagcgcaaauacggaggggcgcugguacggaauccccugucccgcaacagcacacaugagauguacuggguaagcaacgcaacuggcaacauagucucuuccgucaacaugauaagccgcaugcucaucaacagguucacuaugaagcauaagaaggcuacuuacgagcccgacguggaccugggauccggcacgcggaacauagggaucgaaagcgagaucccgaaccuggacaucaucggcaagcggauagagaaaauaaagcaggaacaugagacuucguggcacuacgaccaggaccacccuuacaaaaccugggcuuaccauggcagcuaugaaaccaaacagaccggauccgcgaguucuauggugaauggcguggugcgcuuauuaaccaaaccaugggacgugguccccauggugacucagauggcgaugaccgacaccacaccguucgggcaacagcggguguucaaagagaaggucgacacucgcacgcaggagcccaaggagggcacgaagaaacuaaugaagaucaccgcagaguggcuguggaaggagcugggcaagaagaagacgccccggaugugcacacgcgaggaguucacucggaaagugcgcucuaacgccgcccuuggggccaucuucaccgacgagaacaaguggaagagugcgcgggaggccguagaggacggcagguucugggaacucgucgaccgagagcgcaaucugcaccuggaggggaagugcgagacgugcguguacaacaugaugggcaagcgugagaaaaagcucggggaguucggcaaggccaagggcagccgcgcuaucugguacauguggcugggagcgcgguucuuggaguucgaggcccucggauuccugaacgaggaccacugguuuucccgugggaacagcuugagcggcguagagggggagggacuccaccgguugggcuauauccugcgugacgucgggaagaaggagggcggugccauguacgccgacgauaccgcgggcugggacacccggaucacccuugaggaccugaagaacgaggagaugguuacgaaccacaugaaaggggaacacaagaaacuggcggaggcaauuuucaagcugacuuaccagaacaaggucgugcgcgugcagcggcccacaccccgcgggaccgugauggacaucaucucccgaagagaucagcgcggcagcgggcaagucggcacguacgggcugaacaccuucacaaacauggaggcccaauugauuagacagauggagggcgagggaauuuucaagucaauacaacaccugaccgccacggaggagauugccgugcagaacuggcuggcccgaguugggcgggagcgccucagccgaauggccauaucgggugacgacugcgucguaaagccgaucgacgaccgcuucgccagcgccuugaccgcccucaacgacaugggaaagauccggaaagauauccagcagugggagcccucccggggcuggaacgacuggacccagguccccuucugcagucaccacuuucacgagcugguuaugaaagacggccgggugcugguugugcccugccgcaaucaggacgaacugaucggccgggcgaggaucucucagggcgccggguggaguuuaaaggagaccgccugcuuagguaaguccuacgcccagauguggacccugauguacuuccaccggagagaucuccgauuggccgccaacgcgaucugcucggcugugccaucccauuggguuccuacgagcagaacuaccugguccauacacgccaagcacgaguggaugaccacggaggacauguuagcgguauggaaccggguguggauccaagaaaaucccuggauggaggacaagaccccggucgagagcugggaggaggugcccuaccuggguaagcgcgaggaucagugguguggcagccucaucggauuaacuucucgggccaccugggccaagaacauccaaacggccauuaaccaggugcgcagcuugaucggcaaugaggaguacaccgacuacaugcccuccaugaagagauuccggcgcgaggaggaggaagccggcgucuugugguga

SEQ ID NO: 25034 - RNA, 9876 nt, Artificial Sequence
  derived and/or modified CDS sequence (opt11) from DENV-2__FJ850060__SS-prME
acagccggcgucaucgucaugcugauccccaccgccauggcguuccacuugaccacacgcaacggggagccccacaugaucgucgggcggcaggagaaggggaagucgcugcuguucaagaccgaggacggugugaacaugugcacccuaauggccauagaccugggggagcuuugcgaagacaccaucaccuacaagugcccccuccugcgccagaacgagcccgaggacauagacugcugguguaacagcaccagcaccugggucaccuacggaaccugcaccaccacgggcgagcaccggcgcgagaagcgguccguggcacugguaccccacgucggaaugggccucgagacccgcaccgagaccuggaugagcuccgaaggcgccuggaagcacgugcagcggaucgagaccuggauccugcgccacccggguuuuacaaucauggccgcgauauuagcuuacaccaucgggaccacgcacuuccagcgcgcccucaucuucauccugcuaaccgccguggcgcccagcaugacaaugcgcugcaucggcaucuccaaccgggacuucguugagggcguaagcgggggcuccuggguggacauaguucucgagcacgggagcugcgugaccacgauggccaagaacaagcccaccuuggacuucgagcugaucaagaccgaggccaagcagccggccacccuccgcaaguauugcauagaggccaaguuaacgaacaccaccaccgagucccggugccccacgcagggcgagcccagucugaacgaggagcaggacaagcgcuucaucugcaagcacuccaugguggaccgaggcugggggaacggcugcggguuauucggcaagggcggcaucgugaccugcgcgauguucacguguaagaagaauauggagggcaaggugguucagcccgagaaccuggaguacaccaucgucaucacuccccacagcggggaggaacacgccgugggcaacgauaccgggaagcacggcaaggagaucaagaucacgccgcaguccagcaucaccgaggccgagcugaccgguuacggcacggugaccauggagugcagccccaggaccggccucgauuucaacgagaugguccugcugcagauggaggacaaggccuggcucgugcacaggcaaugguuccuggaccugccccuccccuggcugccgggggccgacacccagggcagcaacuggauccagaaggagacgcuggugaccuucaagaacccccacgcgaagaagcaggacgucgugguccucggcucccaggagggcgccaugcacaccgcccugacuggggcuacggagauccagauguccagcggcaaccuccuguucaccggccaccugaaaugccgccugcggauggacaagcuccagcugaaggggaugagcuacagcaugugcaccggcaaauucaagaucgugaaggagaucgccgagacccagcaugggacgaucgugauccgcguccaguacgaaggcgacggcucccccugcaagauacccuucgagaucaccgaccuggagaagcggcaugugcucgggcgccugaucaccgugaacccgaucgucaccgagaaggacagccccgugaacaucgaggcggagccgcccuucggcgacuccuacaucaucaucgggguggagccgggccagcugaagcucaacugguucaagaaggggagcuccauaggccagauguucgaaacgaccaugcgcggcgccaagaggauggccaucuuaggggacaccgccugggacuucggcagccucgggggcgucuucaccuccaucgggaaggcccuccaccagguguuuggggcgaucuacggcgccgccuucagcggcguguccuggacgaugaagauccugaucggcgucaucaucaccuggaucgggaugaacagccgcuccaccagccugucagugagccuggugcucgucggcguggucacccuguaccuaggggccaugguccaggcggacuccggcugcguggugagcuggaagaacaaggagcucaagugcggcuccgggaucuucaucacggacaauguccacaccuggaccgagcaguacaaguuccagcccgagagccccagcaagcuggccuccgccauccagaaggcccacgaggagggcaucugcgggauccggagcgugacccgccuggagaacuuaauguggaagcagauuacgcccgagcugaaccacauccuguccgagaacgaggugaagcucaccaucaugaccggcgacaucaagggcaucaugcaggcggguaagcggagccugcgcccgcagcccaccgagcuaaaguacuccuggaagacguggggcaaggcgaagaugcucagcaccgaaucccauaaccagaccuuccuaaucgacgggcccgagaccgccgagugcccuaacacaaaccgggccuggaacagccuggaggucgaggacuauggcuucgggguguucaccaccaacaucuggcugaagcugcgcgagaagcaggacguguucugcgacuccaagcuaaugagcgccgccaucaaggacaaccgggcgguccacgccgacaugggcuacuggaucgaguccgcccucaacgauaccuggaagauggagaaggccucauucaucgaggugaaguccugccacuggcccaagagccacacccugugguccaacggcguacuugagagcgagaugaucauccccaagaacuuugccgggcccgucucccaacacaacuaccgcccgggcuaccacacgcagaccgcggggcccuggcacuugggcaaacuggagauggacuucgaccucugcgaggggaccaccgugguggucacggaggacugcggcaaccggggccccagccuccgaaccacuaccgccagcgggaagcugauuacggaguggugcugccguuccugcacccugcccccgcuccgcuaccggggcgaagacgggugcugguacggcauggagauccgcccccugaaggagaaggaggaaaacuuggugaacagccuagugacggcagggcacggccagaucgauaacuucucccugggcguacuagggauggcgcucuuccuggaggagaugcuccggacccgcaucgguacgaagcacgcgaucuugcuaguugccguaagcuucgucacccugauuaccgggaacaugucguuccgggaucucggccgcgugauggugauggucggggccaccaugacggacgacaucggcaugggugugaccuacuuagcccuguuagccgcguucaagauacgccccaccuucgccgcagggcugcugcuccggaagcugaccagcaaggagcugaugauggccacgauaggcaucgcccuccugucccagagcaccauccccgagaccauccuggagcucacugacgcccuugcacuggggaugauggugcucaagaucguccgcaacauggagaaguaccagcuggcugucacgaucauggccaucuccugugugccgaacgccgucaucuugcagaacgcuuggaaggucagcugcgcuaucuuagcggccguguccgucagcccgcugcugcucaccuccagccagcagaaagcagacuggaucccccuggcccugacaaucaagggccucaaccccaccgccaucuuccugaccacccugucccggaccagcaagaagcgcuccuggccgcuuaacgaggcagucauggccgucgggauggugagcauccuggcgucgagccuguuaaagaacgacauccccaugaccgggccccugguugccggcggacugcucacggucugcuacgugcugaccggccggagcgccgaccuggaacuggagcgcgccgccgacgugaagugggaggaccaggcggagaucuccgggucaagcccgauccugagcaucaccaucuccgaggacggcagcauguccaucaagaacgaggaggaggagcagacccugacgauccucauccggaccggccugcuggucaucagcgguguguucccgguguccauccccaucaccgccgccgcaugguaccucugggaggucaagaagcagcgcgccggcgugcucugggacgugcccucuccgccgcccgucgagaaggcggaacuggaggacggggccuaccggauaaagcagcgcggcauccucgguuacucccagaucggcgccggaguguacaaggaggggaccuuccacaccauguggcacgugacgcggggcgccguccuuaugcaccgcgggaagcggaucgagcccagcugggccgacgugaagaaggaccugaucuccuacggcggaggcuggaagcucgagggcgaguggaaggagggggaggaggugcagguccuggcguuagagcccggcaaaaacccccgcgccgugcaaaccaaacccgggaucuucaagaccaauacuggcacgaucggggccgugagccucgacuucucccccggcaccagcgggucucccaucgucgaccggaaagggaagguggugggcuuauacggcaacggcgucgugacccgcagcggcgccuacguauccgcgaucgcgcagaccgagaaguccaucgaggauaaccccgagaucgaggacgacaucuuccggaagaagcgccugacaaucauggaccuccaccccggugccggcaagaccaagcgguaccugcccgccaucguccgcgaggccaucaagcgggggcugcgcacccugauacucgcgccaacccgcgugguggccgccgagauggaggaggcccugcggggccugcccauccgcuaccagacgcccgcgaucaagaccgagcacaccgggcgggagaucguagaccucaugugccacgcgaccuuuacaaugcgccugcugagccccgugagagugccaaacuacaaccuaaucaucauggacgaggcccacuucaccgaccccgccuccaucgccgcccgcggcuacaucagcacccgggucgagaugggugaggcggccgggaucuucaugaccgccacgccucccggcucccgggacccguucccccagagcaacgcccccaucauggacgaggagcgggagaucccagagcgcuccuggaacuccgggcacgagugggugaccgacuuuaagggcaagaccgugugguuugucccguccauuaaggcggggaacgacaucgccgccugccugcggaagaacggcaagaaggucauccagcugucacgcaagaccuucgacuccgaguacgugaagacgcgggccaacgacugggacuucgucgugaccaccgacaucagcgagaugggcgcuaacuucaaggcggaaagggugaucgacccccggcguugcaugaagcccgucauccucaccgacggggaggagcgggucauccuggccggccccaugccgguaacgcacucgagcgccgcccagcgccgggggcgcaucggccgcaacccgaagaacgaaaacgaccaguacaucuacaugggggagcccuuagagaacgacgaggacugcgcccacuggaaggaagcgaaaaugcuccuggacaacaucaacacacccgagggcaucaucccguccauguucgagcccgagcgggagaaggucgacgccaucgacggcgaguaccgccugcgcggggaggcccguaagaccuucguagaccucaugcggaggggcgaccugcccguguggcuggccuacaagguggccgcggaggggaucaacuacgccgaucggaaguggugcuucgacggcauccgcaacaaccagauccucgaggaaaacauggagguggagaucuggaccaaggagggagaacggaagaagcugaaaccgcgcuggcuugacgcccgaaucuacagcgaccccuuagcccugaaggaguucaaggaguucgcggccggccgcaaaucccuaacgcucaaccugaucaccgagaugggcaagcugccaaccuucaugacccagaaggcccggaacgcacucgacaaccuggccguacugcacacggcggaggccgggggccgcgccuacaaccacgcccugucagagcugccggagacccuggagacucuccuguugcucacccugcuggccacgguaacuggggggaucuuccucuuccugauguccggcaaggggaucggcaagaugacccuggggaugugcuguaucaucacagcaagcauccuccugugguacgcccagauccagccgcauuggaucgccgccuccauuauccuggaguucuuccucaucguacugcugaucccugagcccgagaagcagcggacgccucaggacaaccagcucacguacgucgugaucgccauccugaccguggucgccgcaaccauggccaacgagaugggcuucuuagagaagaccaagaaggaccucgggcugggcagcaucacgacccaggagagcgaguccaacauccuggacauugaccuccgcccggccagcgccuggacccuguacgcgguggcgaccacauucgugacccccaugcugagacacuccaucgagaacucaagcgucaacgugagccucaccgccaucgccaaccaagcgaccguccugaugggccuggggaagggcuggccccucagcaaaauggacaucggggucccccugcuggccauaggcuguuauagccagguuaacccgaucacgcucaccgccgcccugcugcuccugguggcccacuacgcgaucaucggccccggccugcaggccaaagccacccgcgaggcccagaagcgggccgcagccgguaucaugaagaaccccaccguugacgggaucacugugaucgaccucgagcccaucccguacgaccccaaguucgagaagcagcucggccaggugaugcugcucauccugugcgucacccaggugcugaugaugcgcaccaccugggcgcuaugcgaggcccugacgcuggccaccgggcccaucuccaccuuaugggagggcaaccccgggcgguucuggaacaccacgaucgcggugaguauggccaacaucuuccgcggcuccuacuuagccggcgccgggcugcuguucucuaucaugaagaacaccaccaacacccgccggggcacggggaacaucggcgagacccugggugagaaguggaagucccgccuaaacgcgcucggcaaaagcgaguuccagaucuauaagaaguccggcauacaggaggucgacaggacccuggccaaggaggggaucaagcgcggcgagaccgaccaccacgccgugagccggggguccgccaagcugcgcugguuuguggagcggaacauggucacgccggagggcaaggugguggaccucggcugcgggcgcggcgggugguccuacuacugcggcgggcucaagaacguccgggaggugaagggcuuaaccaagggcgggcccggccacgaggagcccauacccauguccaccuacggguggaaccucgugcgccuacagagcggcgucgacguguucuucaccccgcccgagaagugcgacacgcugcucugcgacaucggggagucgucccccaaucccacaaucgaggccggccgcacccugcgcguacugaaccucgucgagaauuggcugaacaacaacacccaguucugcaucaagguguugaacccguacaugcccagcgugaucgagaagauggaggcgcuccagcggaaguacggcggggcccugguccgcaacccccugucccggaacagcacccacgagauguauuggguauccaacgccacgggcaacauagugagcuccgucaacaugaucagccgcaugcugaucaaucgguucaccaugaaacacaagaaggccaccuacgagcccgacguggaccucggguccggcacccgcaacaucgguauagagagcgagauccccaaccuggacaucaucggcaagcggauugagaagauuaagcaggagcacgagaccuccuggcacuacgaccaggaccaccccuacaagaccugggccuaccauggcagcuacgagaccaagcagaccggguccgcgagcuccaugguuaacggcgucgugcgccugcucacgaagccuugggacguggucccuauggugacccagauggccaugaccgacaccacgcccuucgggcagcagcgcguguucaaggagaaggucgacacucggacccaagagcccaaggaaggcacuaagaagcugaugaagaucacggccgaguggcuguggaaggagcucggcaagaagaagacgcccagaauguguacccgggaggaguucacccgcaaagugcggagcaacgccgcccugggggcgaucuucacggacgagaacaaguggaaguccgccagggaggccguggaggacggccgguucugggaacugguugacagagagcggaaccuccaccuggaggggaagugcgagaccugcguguacaacaugaugggcaagcgcgagaagaagcugggugaguucggcaaggccaagggcagccgggcgaucugguauauguggcucggggcccgcuuccuggaguucgaggcccugggcuuucucaacgaggaccacugguucucccgggggaacagccugagcggcguggagggggagggccugcaccgccucggcuacaucuugcgggacgucgggaagaaagagggcggagccauguacgccgacgacaccgcgggcugggacacucgcaucacccuagaggaccucaagaacgaggagauggugaccaaccacaugaagggggagcacaagaagcuggccgaagcuaucuuuaagcugaccuaccagaacaaggucgugcgggugcaacgcccgacgccccggggcacggucauggacaucaucucccgccgggaccaacgcggcagcgggcaggucggcaccuacgggcucaacaccuucacaaacauggaggcccagcugauccgccagauggagggcgagggcaucuuuaaauccauccagcaccugacggcaacugaggagaucgccgugcagaacuggcucgcccgggucgggagagagcggcugagccgcauggccauuuccggcgacgacuguguggugaagccuaucgacgaccgguucgccagcgcccugaccgcgcucaacgauauggggaagguccgcaaggacauccagcagugggagcccucccggggcuggaacgacuggacccaggugccguucugcagccaccacuuccacgagcuagucaugaaggacgggcgcguucugguggugccaugccggaaccaggacgagcucaucggccgcgcccggaucucccagggcgccggguggagccugaaggagacggccugccugggcaaguccuacgcccagauguggacccucauguacuuccaccgccgggaccugcgcuuggcggccaacgccaucugcagcgccgugccgccccacugggugccgaccagccggaccaccuggagcauccacgcgaaacacgaguggaugaccaccgaggacaugcuugccguguggaaccgcgucuggauccaggggaaccccuggauggaggacaagacccccguggaguccugggaggaggugcccuaccugggcaagcgggaggaccaguggugcgggagccugaucggccucaccucccgcgccacgugggccaagaacauccagaccgccaucaaccagguccggagccugaucggcaacgaggaguacaccgacuacaugccgagcaugaagcguuucagacgggaggaagaggaggcgggggugcuaugguga

SEQ ID NO: 25035 - RNA, 9876 nt, Artificial Sequence
  derived and/or modified CDS sequence (opt11) from DENV-2__FJ850061__SS-prME
accgcaggcgugaucauuaugcugauccccaccgccauggcguuccaccucaccacccguaauggggaaccccacaugauagucggcagacaggaaaaggggaagucccuccuguucaagaccgaagauggugugaacaugugcacccucauggccaucgaccugggggagcuuugugaggacaccaucaccuacaaaugcccccucuuacgccagaacgagccagaggacaucgacugcuggugcaacaguaccagcacgugggugacguacgggaccuguaccaccacgggcgagcaccggcgcgagaagaggucagucgcccugguuccacacguagggaugggacuagagacucgcaccgaaaccuggaugucuucagagggggcuuggaagcauguccaacggaucgaaacauggauccugagacauccgggcuucacgauuauggccgcgauacuugccuacaccaucgggaccacgcauuuccagagagcgcucaucuucauccugcucacugccguagcgcccucuaugaccaugcgcugcaucggcaucuccaaucgggacuucgucgagggcgucagcgggggcaguuggguugacaucguccuggagcaugggagcugcguaaccacgauggccaaaaacaaaccuacgcucgacuucgaacugaucaagacggaggccaagcagccagccacccugcguaaguacugcaucgaggcgaaacuaacgaacaccacaaccgagucgcgguguccgacgcagggcgagccgagccugaacgaggagcaggacaagagguucaucugcaaacacucaauggucgaccggggcugggggaacggcugcgggcuguucgggaaagguggcaucgugaccugcgcgauguucacgugcaagaagaacauggaaggcaaagucgugcagccagagaaucuggaauauacaaucgugaucacgccgcauagcggggaggagcacgcagucgggaaugacacggggaaacacggcaaggaaaucaagaucaccccgcaguccucgauaacugaggccgaacugacuggguacggcacugugacgauggagugcagccccagaaccggcuuagacuucaacgagauggugcugcugcagauggaggacaaggccuggcuuguccaccggcagugguuccuugaccugccccuccccuggcugcccggggccgacacucagggcagcaacuggauccagaaagagacacuggucacuuucaagaacccucaugcgaagaagcaagacguugucgugcucgggagccaggagggcgcuaugcacaccgcccugaccggggcaaccgaaauccaaaugaguagcggcaaccuccuguucaccgggcaccugaagugccgccugcgcauggacaagcuacaguuaaaggggauguccuacagcauguguaccggcaaguucaagaucgucaaggagauugcggagacccaacacggcaccauuguaauccgcgugcaguacgagggcgaugguuccccauguaagauccccuucgaaaucacugaccuggagaagcggcacgucuuagggcggcucaucacagugaacccgaucgugaccgagaaagacagucccgucaacaucgaggcagagccgcccuucggcgacuccuacauuaucauuggggucgagccgggccagcuaaaguugaacugguucaagaaagggagcuccaucggccagauguucgcuacgacuaugaggggugccaagcguauggccauccugggggacaccgccugggauuucgguagcuuagggggugucuuuaccuccauagggaaggcgcuccaccaaguauucggggccaucuauggcgcggccuucagcggggugaguuggacgaugaagauacugaucggcgugauuauuacuuggaucgggaugaacucacgcuccaccagccuguccgucagcuugguucucgugggcguagugacucuguaccugggggcaauggugcaggccgacagcgggugcgucgugagcuggaagaacaaggaguugaagugcggcuccgggaucuucaucacggacaacgugcacacauggaccgagcaguacaaguuccaaccugagucacccucgaagcuggccuccgccauucagaaggcccacgaggagggcaucugcggcauccggucagugacccgccuggaaaaucucauguggaagcagaucacgcccgaacugaaucacaucuuaagugaaaacgaggugaaacugacaaucaugacgggggauaucaaggggauaaugcaagcuggcaaacggucauugcgcccgcagcccaccgagcugaaguauuccuggaagacguggggcaaggcuaaaaugcucagcaccgagucccacaaucagaccuuucugaucgacgggcccgagacggccgaaugcccgaacacaaaccgggccuggaacagucuggagguggaagacuacggcuuuggagucuucaccaccaauaucuggcucaagcugcgcgagaagcaagacguguucugcgacucuaaacugaugagcgcugcgaucaaggacaaccgugccgugcacgcugacaugggcuauuggaucgagucagcucucaacgacacguggaagauggaaaaagcuagcuucaucgaggucaaaucaugccauuggccaaaaagccauacccugugguccaacggcguccuggagagcgagaugauaauccccaagaacuucgcggggccagugucccagcacaacuaccgcccgggauaccacacgcagaccgccggaccguggcaccucgguaaacucgagauggacuuugaccugugcgaggggacaaccguuguggugacagaggacugcggcaaucgaggucccagccugcguacgaccaccgccuccggaaagcuaaucacggaguggugcugucgguccugcacguuacccccguuacgcuaccggggagaggacggcuguugguacggcauggagauccguccccugaaggaaaaagaggagaaccuggucaauagucuugugaccgcugggcacggacagaucgacaacuucagccugggugugcugggaauggcauuguuucucgaggagaugcugcgaaccagaaucggcacgaagcaugccauccuccuggucgccguguccuucgucacccuuauuacggggaauaugucuuuccgggaccucggccgcguuaugguaauggugggcgcgaccaugaccgacgauauuggaaugggcgucacguaccuggcccugcuggcggccuucaaagugaggccaaccuucgcggcagggcuccuguuacggaagcugaccucgaaagagcugaugauggcuacgaucggcaucgcccuccugucccagagcacaauaccggagaccauccuagagcucacugacgcgcuggcgcuugguaugaugguccuaaaaaucguucgcaacauggagaaguaucagcuggcgguuacgaucauggccauauccugcguaccaaaugccguaauacuacagaacgccuggaaggucagcugcaccauucucgccgcuguguccgucaguccccugcugcucaccuccagccagcaaaaagcggacuggaucccguuggcucucacuauuaagggacucaacccuacggccauauuucugacuacacuguccagaaccagcaagaaacgcuccuggccucuaaacgaagccaucauggcagugggcaugguuucuauccucgcuuccagccuacucaagaacgauauucccaugacggguccguugguggcgggcgggcugcugaccgugugcuacguucugaccggccggucugccgaccuggaguuggagcgcgccgccgaugugaagugggaagaccaagcggagauaucuggaagcagcccaauccugagcaucaccaucucugaggacggcagcauguccauaaagaacgaagaggaggagcagacgcugacaauccuuauccggacuggucuccuggugaucuccggcguauucccggugaguauccccaucacagccgccgccugguaccucugggaggugaagaagcagcgagcgggcgucuuaugggacguucccucaccaccgccaguggagaaggcggagcuggaagacggggccuaccggaucaagcaacgaggcauacuuggguacucacagauuggcgccggugucuacaaggaagggaccuuucacacgauguggcacgugacccggggcgccguacugaugcaccgcgggaagcggauagagccuagcugggccgacgugaagaaggaccuuaucagcuauggcgggggcuggaaacucgaaggcgaauggaaagagggugaggaaguccagguacuagcgcuggagccuggcaagaauccccgcgcagugcagaccaagcccgggaucuucaagaccaacacgggaacuauaggggcggugagccucgacuucagccccgggaccagcggcagccccaucgucgaccggaaggggaaggucgugggccuguacgggaacggcguggugacccgaaguggcgccuacguauccgcgauugcccaaacggaaaaauccaucgaagacaaccccgaaaucgaggacgacaucuuccggaagaaacgccugacgauaauggaucuccauccgggggccggaaaaaccaagcgguaccugcccgccaucguacgcgaggccaucaagcgggggcuaaggacccuuauccuugcgccaacccgcgugguggccgccgagauggaagaggcccugcggggucugcccauacgcuaccagacgcccgccauaaagaccgaacacaccggacgggagauuguggaucucaugugucacgcgacguucaccaugcgccuguugagccccgucaggguaccuaauuacaaccucaucaucauggacgaggcacacuucacagacccugccuccauugcugcacgcggguacauaagcacccggguggaaaugggcgaggcagccgggaucuucaugacugcaacgccgcccggcucccgugacccguucccgcagagcaaugcgcccaucauggacgaggagcgggaaauaccagaaagauccuggaacagcgggcacgagugggucaccgacuucaaggguaagacagugugguucgugccauccauaaaagcugggaacgacaucgcugcuugccugcggaagaaugguaagaaagucauccagcuaucccgcaagacguucgacuccgaguacgugaagaccagagccaacgauugggacuucguggucacaaccgacauuuccgagaugggagcaaacuucaaggcugagcgagugauagacccccggcgcugcaugaagcccguuauccucacggacggggaggagcgcgugauccuggccggaccgaugccggugacccacuccagcgccgcccagcgccgggggcgcaucggccgcaaccccaaaaaugagaacgaccaguacauuuacaugggagagcccuuggaaaacgacgaggacugcgcccacuggaaggaggcgaagaugcuccucgacaacaucaacacccccgagggcauuauaccgagcauguuugagcccgagcgcgagaagguugacgcuauugacggcgaguacaggcugcgcggggaagcccgcaaaacuuuuguagaccucaugcggaggggcgacuuacccguguggcuggcguacaagguugcggcggaggggaucaacuacgcugaccguaaguggugcuucgaugguauuaagaacaaccagauccucgaggaaaacauggaagucgaaaucuggacgaaagagggggagcgcaagaaacugaaaccacgguggcuggaugcccgcauuuacagcgacccccuagcucugaaagaguucaaggaguucgcggccggucggaaaucucucacccuaaacuugauuacggaaaugggcaggcugccaacauucaugacgcagaaggccaggaacgcgcuggauaaccuggcgguguuacacaccgccgaggcaggcgggcgcgccuacaaucacgcccucucggagcugcccgagacucuggagacccuccugcugcuuacgcugcucgcgaccgugaccggagggauuuuucucuuccugaugagugggaaggggaucggcaagaugacacugggaauguguugcaucaucaccgcgaguaucuuacugugguacgcccagauccagccacacuggaucgccgccucgaucauccuggaguucuuucucaucguccuccugauccccgaacccgagaaacagcggacgccccaggacaaucagcucaccuacguggucaucgccauucuaaccguggucgcagccaccauggccaacgagaugggcuuuuuagagaagacgaagaaggacuuagggcugggcagcaucacgacccaggagucugagucgaacauuuuagacaucgaccuccgaccggcaucggccuggacccuguaugcugucgcuacgacuuuugugacacccaugcugcggcacuccaucgaaaauaguucagugaacgucagucugaccgcgaucgccaaccaggcaacggugcugaugggccucgggaagggguggccccugucgaaaauggauaucgggguuccccugcuggccaucggcuguuacagccaggucaagccgaucacguuuacagccgcccuccuguuacucguagcucacuaugcgaucaucggaccaggccugcaggccaaggcgccccgcgaggcccagaagcgagcggcggcgggcauaaugaagaaucccaccguggacgguaucaccgucauugaccuggagccgauccccuaugaccccaaguucgagaaacagcuuggccagguuaugcugcugauucuaugcgucacccagguucugaugaugcggacaacaugggcccugugugaggccuugacguuggcuaccggaccuaucuccacccugugggaaggcaacccgggaagguucuggaacaccacgauagcgguuucgauggccaacaucuuucgcggcuccuaccucgccggcgccgggcucuuauucucuauuaugaaaaacaccaccaacacacggcggggcacggggaacaucggugagaccuuaggagaaaaguggaagucccgccugaacgcucugggcaagagcgaguuccagauuuacaagaagucagguauccaagaaguggaccggacccucgcuaaggaggggaucaaacgcggcgagaccgaccaccacgccgucagccgaggguccgcgaagcugcgaugguucguggagcggaacauggugacgccagaggguaaggucguugaucuggggugcggucgcggcggguggagcuacuauugugguggccucaagaacgugcgggaggucaaaggccugaccaagggcgggcccggccaugaggaacccaucccgauguccaccuacgguuggaaccugguucgccuccagagcggcguggacguguucuucacgccacccgagaagugugauacguugcugugugacauaggagaguccagccccaacccgaccaucgaggccggcaggacccuccgugucuugaacuuaguggaaaacuggcucaauaauaacacccaauucugcaucaagguucugaaccccuauaugcccucagugaucgagaaaauggaagcgcugcagagaaaguacggcggagcgcuaguucgcaauccccugucccggaacagcacccacgagauguacugggucuccaacgccaccggcaacauuguguccucggucaacaugaucucccgcaugcugauuaacagauucacaaugaagcacaagaaggcaacguacgagcccgacgucgacuugggaucuggaaccagaaacaucgggaucgagagcgagguaccaaacuuggacaucauagggaagcggauagagaaaaucaaacaggagcacgagacguccuggcacuacgaccaagaucacccuuauaagacuugggccuaccauggcagcuaugagaccaaacagaccgguagcgcuagcuccauggugaacggcgugguacgccuucugacuaagccgugggacguggugcccauggugacccaaauggccaugaccgacaccacgcccuucgggcagcagcgcguguuuaaggaaaaggucgacacccggacacaggagcccaaggagggaaccaagaaguugaugaagaucacagccgagugguuauggaaagagcuaggcaagaagaaaaccccacggaugugcacucgggaagaguucacccggaaggugagauccaacgcagcccucggggcgauuuucacggacgagaauaaguggaaguccgcccgggaggccguggaagacggucgguucugggagcugguagaccgcgagcggaaucugcaccucgaggguaagugcgagaccugcguguauaacaugaugggaaagcgcgagaaaaaguugggugaguucggcaaagccaaggguagccgugcgaucugguacauguggcugggugccagguuucucgaguucgaggcacugggcuuccugaaugaggaccacugguucagccgggggaacucgcucucuggcguugagggcgagggucugcaccgccuggguuacauccuccgggacgucgggaagaaggaaggcggcgccauguacgccgacgacaccgcgggcugggauacacgcauaacucucgaagacuuaaagaacgaggagauggugaccaaccauaugaagggggagcauaagaaacuugcagaggcuaucuucaagcuaaccuaccagaacaaggucgugcggguccagagacccacaccccgggguacugucauggauauuauuucacgccgggaucagcgcggcagcggacagguggguaccuacggacugaacaccuucacaaacauggaggcccagcuaaucagacagauggaaggggaggguauauucaagagcauccagcaccuuacggccaccgaggagaucgcugugcagaacuggcuggcucgggucgggcgcgaacgccuaagucguauggccaucucuggagacgacugcguugugaagccaauagacgacagauucgccagcgcucugaccgcgcugaacgacaugggaaagguacgcaaggacauccaacagugggagccgucgcggggcuggaacgacuggacccaggugccguucuguucacaucacuuccacgagcucgugaugaaggacgggcgcguccuggugguccccugccggaaccaggacgagcucaucggccgcgcccggaucagccagggggcaggguggucgcucaaggagacggccugccugggcaaguccuacgcccagauguggacccuaauguauuuccaccggcgggaccuccgccuggcggccaacgccaucugcagcgcugugccgccacauuggguucccacaucccggaccacuuggagcauccacgcgaagcacgaauggaugacgaccgaggacaugcuggccguguggaacagagucuggauucaggagaacccuuggauggaggacaagaccccaguugaguccugggaggaggugcccuaucucgggaaacgggaggaucaauggugcggcagcuuaaucgggcugaccucccgggccacuugggccaaaaauauccagaccgccauaaaccaggugagaagccucaucggcaacgaggaguacacugauuauaugcccagcaugaagcgguuccgccgggaggaggaagaggcgggcgugcugugguaa

SEQ ID NO: 25036 - RNA, 9876 nt, Artificial Sequence
  derived and/or modified CDS sequence (opt11) from DENV-2__FJ744709__SS-prME
acagccggcgugaucguaaugcugauucccaccgcuauggcguuccaccugaccacccgcaacggggagccccacaugauagugggccggcaggaaaaggggaaguccuugcuguucaagaccgaggauggcguaaacauguguacccucauggcgaucgaccugggggagcugugcgaggacacaaucacauacaaguguccccuccuccgccagaacgagcccgaagacaucgacugcuggugcaacagcaccuccaccugggugaccuacgggaccugcaccaccaccggcgagcaccggcgcgagaagcgguccguggcccuggugccccacguagggaugggccucgagacccgaaccgagaccuggaugagcagcgagggggccuggaaacacgugcagcggauugagacguggauccuacgccacccuggcuucaccaucauggcggcagugcuugccuacaccauugggaccacccacuuccagaaggcccucaucuucauccugcugacugccgucgcgcccagcaugaccaugcggugcaucggcaucagcaaccgcgacuucguggagggcgugagcgggggcagcugggucgacaucgugcucgagcacggcucuugcgugaccaccauggccaagaacaagcccacccuggacuucgagcugaucaagaccgaggccaagcagcccgccacccuccggaaguacugcaucgaggccaagcugacgaacacgaccaccgagucccgcugcccgacacagggcgagcccagccugaaugaggaacaggacaagcgguucaucugcaagcacuccauggucgaccgcggcugggguaacggcugcgggcuguucgggaagggcgggaucgugaccugcgcgauguuuacgugcaagaagaacauggagggcaaaguuguccagcccgagaaucuggaguacaccaucgugauaacuccccacagcggggaggagcacgccguggggaacgacacaggaaagcacggcaaagaaaucaagaucaccccacaguccagcaucaccgaggccgagcugaccggguacggcacggucaccauggagugcagcccccgcaccggccuugacuucaacgagaugguguuacugcagauggaggacaaggccuggcucgugcaccgccagugguuucuggaccugccucuccccuggcugccgggggcagacacacagggcagcaacuggauacagaaggagacgcuggucaccuucaagaacccccacgcgaagaaacaggacgugguuguccucgggucccaggaaggcgccaugcacaccgcccugaccggggccacggaaauccagaugaguagcggcaaccuccuguucaccggccaccugaagugccggcugcguauggacaaacuccagcugaagggaauguccuacagcaugugcaccggcaaguucaagaucgugaaggagaucgcagagacccagcacgggacgaucgucauccggguacaauacgagggagacggcucgcccugcaagauccccuuugagaucaccgaccuggagaaacgccacgugcucggacgguuaaucaccgucaacccgaucgugacagagaaagacagccccgugaacaucgaggcggagccgccguucggcgacuccuacaucaucaucggggucgaaccaggccagcugaagcucaauugguucaagaaggguagcuccaucggacagauguuugagaccaccaugcgcggcgcuaagcgcauggccauccugggggacaccgccugggacuuugguucgcucggcgggguguuuaccuccaucgggaaggcccuccaccagguguucggggcgauuuacggcgcagccuucagcgggguguccuggacgaugaagauccugaucggagugauaaucacauggaucgggaugaacagcagguccaccagccugucggugagccugguccucguuggcgugguaacccuguaccugggggccgugguacaggcggacuccggcugcgucgucucguggaagaacaaggagcugaagugcggcucagggaucuucaucacggacaaugugcacaccuggaccgagcaguacaaguuccagcccgagagccccucgaaguuggccagcgccauccagaaagcccacgaggagggcauaugcgggauccgcagcgucacccgucuggagaacuugauguggaagcagaucacgcccgagcugaaccauauacugagugagaacgaggugaagcucaccaucaugacaggcgacaucaaggggaucaugcaggccggcaagcgcagccugcggccacaacccacugagcugaaguacaguuggaagacguggggcaaggcgaagaugcucagcaccgagucccauaaccagaccuuccugaucgacgggcccgagaccgccgagugcccaaacacgaacagggccuggaacucgcuggaaguggaagacuacggcuucggugucuucaccaccaacauuuggcucaagcugagagagaagcaggacguguucugcgacucuaaacugaugagcgcagcgaucaaggacaacagagcggugcacgccgacaugggcuacuggaucgaguccgcccucaacgauaccuggaaaauggaaaaggccagcuucauugagguaaaauccugccauuggccuaagucucacacccugugguccaacggcgugcuggaaagcgaaaugaucauccccaagaacuuugcuggacccgugucccagcacaauuacaggccgggcuaccacacgcagacggcgggccccuggcaccucggcaaguuagagauggacuucgacuucugcgaggggaccaccgucguggugaccgaggacuguggcaaccgcggccccagccugcggacuaccacugccucggggaagcuuauuacggaguggugcugccgcuccugcacccugcccccguugcgcuaccgcggcgaggacgggugcugguacggaauggagauccggccucucaaggagaaggaggaaaaccuggucaacagccuggugaccgccgggcacggacagauagacaauuucagucucggcgugcuggguauggcccuguuccucgaggagaugcugcgcacccggauugguacgaagcacgccauucugcucgucgccgugagcuucgugacccugaucaccgggaacauguccuuccgcgaccugggccgggucauggugauggugggggccaccaugacggacgauaucggcaugggcgucacauaccucgcccugcuggccgccuucaagguucgcccgacuuucgccgccggacuccugcugagaaagcucaccagcaaggaacugaugauggccacaaucggcauagcccuccucucccagagcacuauccccgaaacaauccuggagcugaccgacgcgcucgcccuggggaugauggugcugaagaucguccggaacauggagaaguaccagcucgcggugacgaucauggccaucaguugcgugccgaaugccgucauccugcagaacgcguggaaagugagcugcacgauuuuagccgcagucuccgucagcccccuccugcugaccuccagccaacagaaggccgacuggaucccccucgcuuuaaccaucaaaggccuaaaccccaccgccaucuuccucaccacccugucccgcacuuccaagaagcgguccuggccacugaacgaggccaucauggcugugggcauggucagcauccucgccucgagcuuacugaagaacgacauccccaugacggggccccucguggcuggcggacugcugacagugugcuacguccucaccggccgcagcgccgaccuggagcuggagcgugcugccgacgugaagugggaagaccaggccgaaaucucagggagcucccccauccucucgaucaccaucuccgaggaugggagcauguccaucaagaacgaggaggaggagcagacgcugaccauccugauccguaccggccucuuaguuaucagcgggauuuuuccggugucaauccccaucaccgcugccgccugguaccuaugggaggugaagaagcagcgggccggcguguugugggacguccccagcccgccacccguggagaaggccgagcuggaggacggggcauaccgcaucaagcagcggggcauccugggguacucccagaucggcgcgggcguguacaaggaggggaccuuccacacgauguggcacgucaccaggggcgccguacucaugcaccgggggaagcguaucgagcccagcugggccgacgugaagaaggaccugaucuccuacgggggcggcuggaagcucgagggcgaguggaaggagggggaggagguccaagugcuagcccuagagcccggcaagaauccccgggcggugcaaacaaaacccgggauauucaagacuaacacgggcaccaucggggcuguuagccuggacuucucccccggcacgagcggcucccccauagucgacaggaaggggaagguggucggccucuacgggaacggcguggugacacggagcggcgcuuacgucuccgccaucgcgcagacggaaaaguccaucgaggauaaucccgagaucgaggacgacaucuuucgcaagaagcggcugaccaucauggaccuucaccccggggccggaaagaccaagcgcuaccuccccgccaucguccgggaggccaucaaacgaggguugcggacacugauccuggccccgacgcgugucgucgcagccgagauggaagaggcccuccgcggucugcccauacgguaccagaccccagccaucaagacagagcauaccggccgcgagaucguggaccucaugugccacgcgacguucaccaugagacuccugagccccgugcgcgucccgaacuacaaccugaucauuauggacgaggcgcacuucacggaccccgccuccaucgccgcccggggcuacaucagcacacgcguugaaaugggugaggccgcggggaucuuuaugacagccacgccgccaggcucccgggacccguucccccagagcaacgccccgaucauggacgaagagcgcgagauccccgagcggaguuggaacuccggucacgagugggugaccgacuucaagggcaagaccgucugguucgucccgaguaucaaggccgggaacgauauagcggccugccugcgcaaaaauggcaagaaggugauccagcugagccggaaaacguucgacuccgaguacgucaagacccgcgccaacgacugggacuucguggugaccaccgacaucagcgagaugggcgcaaacuucaaggccgagcggguuaucgacccccgccggugcaugaagccagugauccucacggacggggaagagcgcgugaucuuggcuggccccaugccggucacacacuccucagccgcccagcgacgcgggcggaucggccguaaccccaaaaacgagaacgaccaguacaucuacaugggggagccccuggaaaacgacgaagacugugcccauuggaaggaggccaagaugcugcucgacaauaucaacacucccgaggguauaaucccguccauguucgaacccgagcgcgagaagguggacgcgaucgauggcgaguaccggcugcgcggggaggcccggaagaccuucguggaccugaugcgccgaggugaccuccccgucuggcuggccuacaaaguggccgccgaggguaucaacuacacggaccgcaaguggugcuuugacggcaucaagaacaaccagaucuuggaggagaacauggagguggagaucuggaccaaggagggggagcggaagaagcucaagccgcgcuggcuggacgcgcgcaucuacagcgauccccuggcccucaaggaauuuaaagaguucgcggccggccgcaagucccugacccugaaccucaucaccgagaugggccggcugcccaccuucaugacccagaaggcgagaaacgcccuggacaaccuagccguccugcacacugcugaggccgggggccgggcguacaaucacgcccucagcgagcuccccgagacucuggagacgcugcuccugcugacccuccuggccaccguaaccgggggcaucuuccuguuccucauguccggcaaggggaucggcaagaugacccuggggaugugcugcaucaucacggcgagcaucuugcugugguacgcccagauccagccgcacuggaucgcugcguccaucauccuugaguucuuucugaucguccuccugauccccgagcccgaaaaacagcgcacuccccaggacaaccagcugaccuacguuguuaucgccauccucaccgucguagccgccacgauggcgaacgagaugggcuucuuggagaagaccaaaaaagaccuggggcuaggcagcaucacgacccaggagagcgaguccaacauccuggauauugaccugcggccggccagcgcguggacccucuaugccguggccaccaccuucgucacccccauguugcgccacuccaucgagaacucauccgugaacgugagccugacagcaauagccaaucaggccaccguccucaugggcuuagggaagggcuggccgcuauccaagauggacaucggggugccccuccuggccaucggcugcuacagccaggugaacccgaucacccugaccgcggcccuccugcugcucguugcucacuaugccaucaucgggcccggccugcaggccaaggcgacgcgggaggcccagaaacgcgccgccgccggcaucaugaagaaccccaccguggacgggauaaccgugaucgaccuggagcccaucccguacgaccccaaguucgaaaagcaguugggccaggucaugcugcugauccucugcgugacccagguacucaugaugcggacuacgugggcgcugugcgaggcucuuacccuagccaccgggcccauuuccacgcugugggaaggcaaccccgggcgcuuuuggaacaccacuaucgccgucagcauggccaacaucuuccggggcuccuaccuagcgggcgccgggcugcuguucucuaucaugaagaacaccacgucgacccgccgcgggaccgggaacaucggcgagacccucggcgagaaguggaagucgcggcugaacgcccuggggaagucagaguuccagaucuacaagaaguccggcauccaggagguggaccgcacgcucgccaaggaggggaucaagcggggcgagaccgaccaccacgcaguuucccgcgguagcgcgaagcugcggugguucgucgagcguaacauggugaccccugaagguaagguggucgaccuggggugcgggcgaggcggaugguccuacuacugcgguggucucaagaaugugcgcgaggugaaaggccugaccaaaggcggucccggccaugaggagcccauccccaugagcacguacggguggaaccugguccggcuccagucugguguggacguguucuucaccccgcccgagaagugugacacccugcugugcgacaucggggagaguagccccaaccccaccaucgaagcaggccgaacccuccggguccugaaccugguagagaacuggcucaacaacaacacgcaguuuuguaucaaggugcugaacccguacaugcccuccgucaucgagaagauggaggcccugcagcgccaguauggcggggcccucgugcggaacccccugucccgcaacuccacccacgaaauguacugggucucaaacgcgaccggcaacaucgucuccagcgugaacaugaucucgcggaugcugaucaaucgcuucacaaugaagcacaagaaggccacguacgagccggacguugaccugggcagcggcaccaggaacaucgguaucgaguccgagauccccaauuuagacaucaucggcaagcgcaucgagaagauuaagcaagagcacgagaucagcuggcacuacgaccaggaccaccccuacaagaccugggccuaccacggcucauacgagacaaagcagacgggguccgccuccagcauggucaacggcguaguacggcugcugaccaagcccugggacguagugccgauggugacgcagauggccaugaccgacaccacccccuucggacagcaacgcgucuucaaagagaagguggacacccgcacacaggagcccaaggagggcacgaagaagcucaugaagaucaccgcggaguggcuguggaaggagcugggccggaagaaaacgccccguaugugcacccgggaggaguucacgcgcaaagugcggucgaacgccgcacucggggccauuuucaccgacgagaacaaguggaaauccgcccgcgaggccgucgaggacggccguuucugggagcugguggaccgcgagagaaaccuccaucucgaagggaagugcgagaccugcguguacaacaugaugggcaagcgcgagaagaagcugggggaauucggcaaggccaaggggucccgggccauuugguacauguggcugggggcccgcuuccucgaguucgaagcgcugggcuuccugaaugaagaccacugguucagccgggagaacagccucuccggggucgagggcgagggccugcaucgccugggcuacauccuccgggacgugggcaagaaggagggcggugccauguacgcggacgacaccgccgggugggacacgcgcauuacccuggaggaccugaagaacgaggagauggucacgaaccacaugaagggcgagcacaagaagcucgccgaggcgaucuucaagcugaccuaccagaacaaggugguucggguucagcgcccgacgccccgagggaccgugauggacaucauuagccgccgggaccagcgcggcuccggacagguggggacuuacggccugaacacuuucacgaacauggaggcccagcucaucagacagauggagggggagggcaucuucaagaguauccagcaccugaccgccacugaggagaucgccguacagaacugguuggcccggguggggcgcgagaggcucucccggauggcgauuagcggggacgacugcguggugaagccuaucgacgaucgguuugccuccgcccugacagcccugaacgauaugggcaaagugcgaaaggacauucagcagugggagcccagccggggguggaacgacuggacccaggugccuuucuguucgcaccacuuccacgaguuggucaugaaggacggccgcgugcugguggucccgugccggaaccaagacgagcugaucgggcgcgcccggaucagccagggcgcggguuggagccucaaggagaccgccugccugggcaagagcuacgcccaaauguggacccugauguacuuccaucgccgggaucuccgccuggccgccaaugcgaucuguuccgcagugcccagccacugggugcccaccagccggaccacguggagcauccacgccaagcacgaguggaugacaaccgaggacaugcuggccgucuggaaccgcguguggauacaggagaacccguggauggaggacaagaccccaguggaguccugggaggagguccccuaccucggcaaacgggaggaccaguggugcgggagccuuaucggccugacgagccgcgcgaccugggccaagaacauccagacagccaucaaccaggugcggucccucaucgggaacgaggaguacaccgacuacaugcccagcaugaaacgcuuccgccgugaggaggaggaggcuggcgugcugugguga

SEQ ID NO: 25037 - RNA, 9876 nt, Artificial Sequence
  derived and/or modified CDS sequence (opt11) from DENV-2__FJ744708__SS-prME
accgcgggcgugaucguaaugcugauucccaccgccauggcguuccaccucaccacccgcaauggcgaaccccacaugauuguggggcggcaggagaaagggaagucucugcuguucaaaacggaggauggggugaauaugugcacccucauggccaucgacuugggggagcugugcgaggacaccaucaccuacaaaugcccccucuuaaggcaaaacgagcccgaggauaucgacugcuggugcaacuccaccagcaccuggguaaccuacgggacuugcaccaccacgggcgagcaccggcgcgagaagcgaaguguggccuuggugccgcacguugggauggguuuagagaccaggacugagaccuggaugagcagugaaggggccuggaagcacguucagcggaucgaaacguggauauuacgccacccaggcuuuaccaucauggccgcgauucuugccuacaccaucgggacuacgcacuuccaacgagcacuuaucuuuaucuugcugaccgccguugcgcccagcaugaccaugcgcugcaucggaaucuccaaccgugacuuugucgagggcguaagcgggggcucauggguggacauaguccucgagcacggcagcugcgugaccacaauggccaaaaauaaacccacacuggacuucgagcugaucaagaccgaagccaagcaacccgccacccuccgcaaguauuguauugaggccaaacugacgaacaccaccaccgagucccgguguccgacgcagggcgagccaagccugaacgaggagcaagauaagcgcuucaucuguaagcacuccauggucgaccggggcugggggaacgggugcgggcuguuugggaagggcggaaucgugaccugcgcgauguucacguguaagaagaacauggagggcaagguggugcaacccgagaaccuggaguacacgauagucauuaccccacacagcggggaggaacaugccguggguaacgacaccgggaaacauggcaaggagaucaagauuaccccgcaguccagcauuacagaagccgagcugacgggguauggcaccgucaccauggagugcucgccccgaaccggccuggacuucaacgagaugguccugcugcagauggaggacaaggccuggcucguccaccggcagugguuccuggaccuaccgcuccccuggcugccgggugccgacacccaggguucuaacuggauccagaaggagacucuggugacguucaagaacccccacgcgaagaagcaggacgucgugguccucgggucucaggagggcgccaugcacaccgcccugacuggggccacggagauccagaugagcagcgggaaccuccuguuuaccggucaucugaagugccgcuuacgaauggacaaacuccaguuaaaggggauguccuauaguaugugcaccgguaaauucaaaauagugaaggagaucgccgagacccaacacggaacgauaguaauucgcguacaguacgagggcgacggcagccccugcaaaaucccuuucgagauuacugaccuggagaagcggcacgugcucgggcgccugaucaccgugaauccuauugucaccgaaaaggauucucccgugaacauugaggcggagccacccuucggcgacuccuauaucaucauugguguagagccgggccagcugaagcucaacugguucaagaaagguagcuccaucggucagauguuugagacgaccaugcgcggcgccaagcggauggccauucuaggcgacaccgccugggacuucgguucgcuagggggcguauucacuuccaucggcaaggcccuacaccagguguucggcgcgaucuacggagccgccuucucuggggucuccuggacgaugaagaucuuaaucggugucaucauaaccuggaucgggaugaauagccgcuccaccucucuuuccgugucucugguccucgucggugugguuacccuguaccugggugccgucgugcaggcggacuccggcugcguugucagcuggaaaaauaaggagcucaaaugcggcuccgggaucuuuaucacggauaacgugcacaccuggaccgagcaauacaaguuccagcccgagagucccucaaaguuggccuccgccauccagaaggcacacgaggagggcaucugcgggauucggagcgugacccgccuugaaaaucucauguggaagcagaucacacccgagcugaaccacaucuuaucggagaacgaggucaaacucaccauaaugaccggugacauaaaggggauaaugcaggccggcaagcggagccuccgcccacagcccaccgaauugaaguacagcuggaagaccugggggaaagcgaaaaugcucagcaccgagucccacaaucagacuuucuuaaucgaugggcccgagacugccgagugcccgaauacgaaucgggccuggaauagccuggagguagaagacuauggauucggggucuucacuacaaacaucuggcucaaacuacgcgaaaagcaagacguguucugcgacagcaaguuaaugagcgccgccaucaaggacaaccgggcggugcacgccgacaugggcuacuggaucgaguccgcccuaaacgacaccuggaagauggagaaggccagcuucaucgaggugaaguccugccacuggccgaaaagccacacccuguggaguaacggcguacuggagagcgagaugaucauccccaagaacuucgcuggucccgucucccagcacaacuaccgcccaggcuaccacacgcagacugcggggccguggcaccucggcaaacuugagauggauuucgacuucugcgaagggaccaccguggucgugacggaggauugcggcaaucggggccccagccugcgcaccaccaccgcgagcgggaagcucaucacggaguggugcugccgguccugcacccugcccccgcugcgauaucggggcgaagacggguguugguacggcauggagauucgcccccucaaggagaaggaggagaaccuggugaacucgcugguuaccgcaggacacggccagaucgacaacuucucccucggcgugcuggggauggcccuuuuccuugaagagaugcugcgaacucgcaucggcacaaagcacgcgauccugcugguugcggucagcuucgugaccuuaaucaccgggaauauguccuuccgggaccugggccgggugaugguaaugguuggggccaccaugacugacgacaucggcaugggcgugaccuaccuagcgcugcuggccgcguucaagguacgccccaccuuugcagcggggcuccugcuccggaagcugaccagcaaagagcuuaugauggccacgaucggcauagcccuauugucccagagcaccaucccagagacuauccuggaauuaaccgaugcucucgcccuggggaugauggugcugaagauugugcgcaacauggagaaguaccagcucgccgucaccaucauggccauauccugcgugccgaacgcugugauacugcagaaugcguggaaggucagcuguaccauccuggccgccguguccgucagcccccuccuuuuaaccuccagccagcaaaaggccgauuggaucccccucgcgcugacuaucaagggcuuaaaccccacugccauuuuccugaccacauuauccaggaccucaaagaagcguuccuggccgcuuaacgaggccaucauggccgugggcauggugagcauucucgcgucgucacuucugaagaacgauauccccaugaccggcccccuagucgccggugggcugcugacggugugcuaugugcucacagggcggagcgccgaccuggagcuggagcgcgcggcggacgucaagugggaggaccaggccgagaucuccgggucaucccccauccucaguaucaccauauccgaggaugguucaaugaguauaaagaacgaagaagaggagcaaacacugaccauacuuauccggaccggccuccucgugaucuccgggguguucccggucucaaucccuauuaccgcggccgccugguaccugugggaggugaagaaacagcgcgccggcguccucugggacguuccgagcccgccgcccguggagaaagccgagcucgaggacggggcguaccggauaaagcagcgcgggauacugggguacucccaaaucggcgcuggcguguauaaggagggcacguuccauacgauguggcacgucacccggggcgcgguguugaugcaccgcggaaagcggaucgagccaagcugggcagaugugaagaaggaccugaucuccuacggcggaggguggaagcuagaaggcgaguggaaggagggggaggagguccaagugcuggcccuggagcccggcaaaaacccccgcgcaguucaaacuaagcccgggaucuuuaaaaccaacacggggacaaucggggccgugagccuugacuucucccccggcacgaguggcagcccaaucguugaucggaaggggaagguggucggccucuacgguaauggcguggugacccggagcggcgcguauguguccgccaucgcucagaccgagaaauccaucgaggacaaccccgaaauugaagacgacaucuuucguaagaaacgccugaccauaauggaucuccacccuggggccggcaagaccaaacgguaucuccccgcgauuguucgggaggcgauuaaacgagggcuccgcacccugauccucgccccgacgcgaguugucgcggccgagauggaggaggcccuccggggccugcccauccgcuaccagacccccgcgaucaaaacggagcacaccgggcgggagauuguggaccugaugugccaugccacguucaccaugcgccuccugucucccguucgggucccaaacuacaaccugaucaucauggacgaggcgcacuucaccgaucccgccuccauugccgcgcgcggcuacaucagcacccggguggagaugggggaggcugccgggaucuucaugacggccaccccgccaggcucccgcgacccguucccccagagcaaugcccccaucauggacgaggagcgggagauccccgagcgcuccuggaauagcgggcacgaaugggugaccgacuucaaggggaagaccgugugguucgugcccuccaucaaggcagguaaugauaucgccgcaugccuccggaagaacggaaagaaggugauccagcucagccgcaagacguucgauuccgaguauguuaaaacccgggccaacgauugggacuuuguggugaccaccgacauaagcgaaaugggcgccaauuucaaggcagaacgggucaucgauccccggcgaugcaugaagcccguuauccugacagacggggaggagcggguuauccucgcggggcccaugccgguuacccacuccagcgccgcccagaggcgggggaggaucggccggaaucccaagaacgagaacgaucaguauaucuauaugggagagccccuggagaacgacgaagacugcgcgcacuggaaggaggccaaaaugcugcucgacaacauaaauacccccgagggcauaauccccuccauguucgagcccgaacgggagaagguggacgcgaucgacggcgaguaccgccugcgcggggaggcacgcaagaccuucguugaccugaugcggcgcggcgaccucccagucuggcuggccuacaagguggccgcggaggggaucaacuacgcggaccggaaguggugcuuugacggcaucaagaacaaccagauucuagaggaaaacauggagguggagaucuggacuaaggagggggagcgcaagaagcugaagccccguuggcuggacgcccguaucuacagcgacccgcucgcccucaaggaauuuaaggaguuugccgccggcaggaagucguuaacccugaaccucaucaccgagaugggccggcugccuaccuucaugacgcagaaggcccgcaacgcauuggauaaccucgcaguucuacacaccgcagaggccggcggccgcgcguauaaccaugcucugagcgagcuccccgagacccuggagacccuccugcugcugacucugcuggccacagugaccgggggcaucuuccuguuccuuauguccggcaaggggaucggcaagaugacgcuggggaugugcuguaucaucaccgccagcaucuugcuaugguaugcugagauccagccccacuggauagccgccagcaucauccuggaguucuuccugauaguccuccugaucccggagcccgagaagcagcggacgccgcaagacaaccagcuuaccuacgugguaaucgccauccucaccgucguagccgcgacaauggccaaugagaugggcuuucuggaaaagaccaagaaggaccuggggcucggcagcaucacuacccaggagagcgaaaguaacaucuuggauaucgaccugcgcccggcuuccgccuggacccucuacgccguggcgacaaccuucguuacccccaugcugcgucacaguaucgagaauagcuccguuaacgugagccugaccgccauugccaaucaggcaacgguacucaugggucuugggaagggguggccccuguccaaaauggacaucggggugccccuccuagcgaucggcugcuacucucaggugaacccgauaacccugacggccgcgcucuuacuccucgucgcccacuacgccaucauugggcccggccugcaggcgaaggccacccgagaggcgcagaagcgggcagccgcgggcaucaugaaaaaucccaccguagacggcaucaccgucauugaccuggagcccaucccguacgacccuaaguuugagaagcaguuggggcagguaaugcuguugauccucugcgucacccaagugcugaugaugcgcacuaccugggcccugugugaagcccucacccuggccaccgggcccauuuccacccuuugggagggcaacccggggcgguucuggaacacgacuaucgcggugagcauggugaacaucuucuccggcagcuaccucgcaggcgccgggcugcacgugccgcuccguaagaauacacugcguacccggcgcggcacggggaacaccggcgagacccugggugagaaguggaagucccgguugaaugcucucgggaaaagcgaguuccagaucuacaagaaguccggcauccaggaggucgacagaacccuggcuaaggaggggaucaaacggggcgaaacagaccaccacgcuguaagccgcgggucggcuaagcugcggugguucgucgagcgcaacauggucacgccggagggcaaggugguggaccucggaugcggucgaggcggguggagcuacuacugcggcgggcugaagaaugucagggaggugaagggccugaccaagggcgggcccggccacgaggagcccaucccgauguccaccuacggauggaaucucguccggcugcaguccggcguagacguuuucuuuacgccgccugagaagugcgacacccugcucugugacaucggggagagcucgcccaauccgacuaucgaggccgggaggacacugcggguguuaaaccucgucgagaacuggcuuaacaauaacacccaguucuguaucaaggugcugaaccccuauaugcccagugugauugagaaaauggaggcccuccaacgacaguacggaggggcccugguccggaacccgcugucccgcaacagcacacacgagauguauuggguguccaacgcuaccggaaacauagugagcuccgucaauaugaucagccggaugcucaucaaucgcuucaccaugaagcauaagaaggcgaccuacgagcccgacguagaccucgggucuggcacacgaaacaucgggaucgaaagcgagauccccaaccuggacauuauuggcaaacgcaucgagaagauuaagcaggagcacgaaauuuccuggcacuacgaccaagaucaccccuauaagaccugggccuaccacggcucuuacgagaccaagcagaccggguccgcuagcuccauggugaacggcgucgugcgccugcucacgaagcccugggacguggucccgauggugacccagauggccaugacagacaccacacccuucggucaacagcggguguuuaaggagaaggucgacacccgcacucaggagcccaaagagggcaccaagaaguuaaugaagaucacggcggagugguuauggaaggagcuggggaagaagaaaacaccgaggaugugcaccagagaagaauuuacuaagaaagugcguagcaacgccgcccugggagcuaucuucacggacgagaacaaauggaaguccgcccgcgaggcuguggaggacggacgguuuugggagcuugucgaccgggagcgaaaccuccaccucgaggggaagugugagaccuguguguacaacaugauggguaagagagaaaagaagcugggggaguucggcaaggcgaaggguagccgcgccaucugguacaugugguugggggccagguucuuggaguucgaggcacuagguuuccugaacgaggaccacugguucuccagggggaacuccuuaagcggcguggagggggagggccugcaccgccucggcuauauccuucgggacguggggaagaaggagggcggggccauguacgccgacgacacugccggcugggacacaagaauuacauuagaggaccucaaaaacgaggagauggugacuaaccacaugaagggcgaacacaagaagcuggcugaggcgaucuucaaacugacuuaccagaacaaggucgugcgggugcagcggccaacgccccgcggaacggucauggacaucaucucccgcagggaucagcgcggcagcgggcaggucgguaccuacggauugaacacauucaccaauauggaggcccaacugauccgccaaauggagggugaggggaucuucaaguccauccaacaccugacggccacugaagagaucgccgugcagaacuggcucgcacgggucggucgcgagcgucugagccgcauggcgaucuccggcgaugacugcgucgugaagcccaucgacgaccgauucgcuuccgcccugaccgcauugaaugacaugggcaagguucguaaagacauccaacagugggagccguccagaggcuggaacgacuggacccagguacccuucugcucucaccacuuccacgaacuggugaugaaggacgggcgcguccugguugugccuugucgaaaccaggacgagcucaucggccgcgcccgaauuucacaaggagcgggguggagccuaaaggagacugcaugccugggcaaauccuacgcccagauguggacccucauguauuuccaucgccgggaccugagacuggcggccaacgccaucugcagcgccguccccucccacuggguaccgaccagccgcaccacaugguccauccaugccaagcacgaguggaugacgacggaggauaugcucgccguguggaaccgcguuuggauccaggaaaaccccuggauggaagacaagacacccguggagagcugggaggaagugcccuaccuggggaagcgggaagaccagugguguggcucuuugaucggccucaccagcagagcgacgugggcgaagaacauacagaccgccaucaaccagguccggucacugaucggcaaugaggaguacaccgacuacaugccguccaugaagcgcuucagacgagaggaggaggaggcuggcguucugugguga

SEQ ID NO: 25038 - RNA, 9876 nt, Artificial Sequence
  derived and/or modified CDS sequence (opt11) from DENV-2__FJ810418__SS-prME
acagcgggcgugaucguuaugcuaauccccaccgccauggcguuucaccucaccacccgcaacggugagccccacaugauugugggccggcaagaaaaagggaagucccuacucuucaaaacugaggacggagugaacaugugcacccucauggccaucgaccugggggaacugugcgaggacacgauuaccuauaagugcccccuccugaggcagaacgagcccgaggacaucgacuguuggugcaacagcaccagcacaugggucaccuacgguaccugcaccaccacgggcgagcaccggcgugaaaaacgguccguggcacucgugccgcacgucggaaugggccuggagacccgcacagagacguggaugucgucugagggggccuggaagcaugugcagcgaauugagaccuggauccugcgccacccgggcuuuacaauuauggccgcgauacuggcauacaccauugggaccacacacuuucagcgggcccucaucuucauccugcuaacagccguugcgccaagcaugacaaugagaugcaucggcauaagcaaccgggacuucgucgagggcgugucugggggcagcuggguugauaucguccucgagcaugguaguugcguuacgacgauggccaagaauaagcccacgcucgauuucgagcugaucaaaaccgaggccaagcaacccgccacccucagaaaguacugcaucgaagccaaacugacgaacaccaccaccgagagccggugccccacucagggcgaacccagcuuaaacgaggagcaggacaagcgguuuaucugcaagcacucaaugguagaccgaggcugggguaacggcuguggguuguucgggaagggcgguauaguuaccugcgcuauguucacgugcaagaagaacauggagggcaagguggugcaacccgagaaccuggaguauaccaucgucaucacuccccauaguggggaagagcacgccgugggcaacgacaccgggaaacauggcaaggaaaucaaaaucacgccgcaguccagcaucaccgaggcggagcugaccggguacggcacugugaccauggagugcagcccccggaccggccucgacuucaacgagaugguucugcugcaaauggaggacaaggccuggcucgugcaccggcagugguuccuggaccugccccuccccugguuaccuggggccgacacccagggauccaacuggauccagaaggagacgcuggugaccuucaagaacccccacgcgaagaagcaggauguugucguccucgggucccaggaaggagccaugcacaccgcguuaaccggggcgacggaaauccagaugagcucuggcaaccugcuguucaccggccaccucaagugccgccugcggauggacaagcuccagcugaaggggauguccuacucaaugugcacagggaaguucaaaaucgugaaggaaauagccgagacccagcacggcacgaucgucauccgaguacaguacgagggcgauggcagccccugcaagauccccuucgagaucaccgaccuagagaagcggcaugugcucgggcgucugaucaccgugaacccgaucgucaccgaaaaggacucacccgugaacaucgaggcggaaccgcccuucggcgacuccuacaucauuauuggcguugagcccggccagcugaaacucaacugguucaagaaggggagcuccauaggccagauguucaagacgaccaugcgcggagcaaagcggauggccauccugggggacacagccugggacuucggaagccuagggggcgucuucaccaguaucgggaaggcccuccaccaggucuucggugcuaucuauggcgccgcauucagcggggugaguuggacgaugaaaauuuugaucggagucgugaucaccuggaucgggaugaauagccgauccacuagccuauccguaagucuggugcucgugggcguggucacgcuguaccuuggggccgugguccaggcggacuccgggugcgucgugagcuggaagaauaaagagcucaagugcggauccgggaucuucauaacggacaacgugcacaccuggaccgaacaguacaaguuccagcccgagagccccagcaagcuggccagugcuauacagaaagcccacgaagaaggcauuugcgggaucagauccgugacgcgccuggagaaucucauguggaagcagaucacgccggaguugaaccacauccugagcgagaaugagguuaagcucaccaucaugacgggcgauauuaaggggauuaugcaggccggcaagcggagccugcgcccccagcccaccgagcugaaguacuccuggaaaacaugggguaaagcuaagaugcucuccaccgagucccacaaccagacauuccugaucgacgggcccgagaccgccgagugcccuaacacgaauagagcguggaacagccuggagguggaggacuacggcuucggggucuuuaccaccaacauauggcucaaguugcgcgagaaacaggacguguucugugacuccaagcugauguccgcagccaucaaagauaaccgggcggugcacgccgacaugggcuacuggaucgaguccgcguuaaaugacaccuggaagauggagaaagcuucguucaucgagguaaaauccugccacuggcccaagagccacacccugugguccaacggcgugcuggagagcgagauggucauccccaaaaacuucgcggggccggucucccagcacaacuaccggccgggcuaccacacgcagaccgcgggccccuggcacuuaggcaagcuggagauggacuucgacuucugcgaaggaacgaccgugguggucacagaggacugcggcaaccggggccccagccugcgcaccaccaccgcuagcgguaagcuaaucacggagugguguugucggucaugcacccugcccccgcugcguuaccggggcgaagacgggugcugguacggaauggagauccgcccccucaaggagaaggaggagaaccuggugaauagccuugugaccgccggacacggccagauugacaacuucucccuuggcguccuggggauggccuuauuccucgaggagaugcugcggacccgcaucggcacgaagcacgcgaucuuacucguggcaguaaguuucguuaccuugaucacggguaacauguccuucagagaccugggccgugugauggugaugguaggcgccaccaugacggacgacaucggcaugggggugaccuaccucgcccugcuugccgcguucaaggugcgucccaccuuugccgccgggcuccugcuacggaagcuaaccagcaaggagcugaugauggccacaaucggaaucgcccugcuuucccagagcacuauccccgagacaauccuggaacugacggacgcgcucgcccuggggaugaugguccugaagauugugcgcaauauggagaaauaccagcucgccgugacuaucauggccauauccugcguuccgaacgcugugauucuccagaacgcguggaaggucagcugcaccauccuagccgcgguguccgugucuccacuuuuacuuacguccagucagcagaaagccgacuggaucccccuggcgcuuaccauaaaggggcugaaccccacggccaucuuccucaccacccugucccggaccagcaaaaagcgcucguggccacugaaugaggccauaauggccgucgguauggugagcauccuugcauccucucugcugaagaacgacaucccaaugacagggccgcucguugcgggcgggcuucugaccgucugcuaugugcuaaccggcagaagcgccgaccuggaacucgaacgugccgccgacgugaaaugggaggaccaagcugagaucuccggcucuuccccuauccucucgauuaccaucuccgaggacggcagcauguccaucaagaacgaggaggaggagcagacgcugaccauacugauccggacgggcuuacuggucaucagcggggucuucccggucuccauccccaucaccgcugccgccugguaccugugggaggucaaaaagcagcgcgccggugugcuuugggacguucccagcccgccgcccgucgagaaggccgagcuggaggauggcgcuuaucggaucaagcagcgcggaauccucggguauucccagauuggcgccggcguguacaaggagggcacauuccacacuauguggcacguaacaaggggugcgguccucaugcaccgcgggaaacggaucgaacccucuugggcugacgugaagaaggaccugaucucguauggcggggguuggaagcuagagggggaguggaaggagggggaggagguucagguccuugcccuggagcccgggaagaaucccagggcugugcagacgaaacccgggaucuucaagaccaacacagguaccauuggggccgugagcuuggauuucucacccgguaccagcggcagucccauaguggaucggaaggggaagguagugggacuguacgggaacggugucgucacccguagcggcgccuauguguccgccaucgcgcaaacggaaaaauccaucgaagauaaccccgagaucgaggacgauaucuuucggaagaaacgccucacuaucauggacuuacaccccggggccggcaagaccaagcgguaccuccccgcaaucguccgcgaggccauuaagcgggggcuaaggacccugauccuugccccgacgagagucgucgcggccgagauggaggaggcccuccggggucugccuauccgcuaccagacccccgccaucaaaacagaacacacagggcgggagaucgucgauuugaugugccacgccacguucaccaugcgcuugcugucgccugugcgaguucccaacuacaaccuuaucaucauggacgaagcacacuucaccgaccccgccaguaucgccgcccgaggcuauaucagcaccagggucgagaugggcgaggccgcggggaucuuuaugaccgccacgccgccaggcuccagggacccguuuccccagucuaacgcccccauuauggacgaggagcgggagauccccgaacgcuccuggaacagcggccacgagugggugaccgacuucaaaggcaagaccgugugguucgucccauccaucaaggccgggaacgacaucgcugcuugccuccggaaaaacgggaagaaggugauacaacugucucgcaaaacguucgacagugaguacgugaaaaccagggcaaacgacugggacuucguggugaccaccgacaucagcgagaugggagcgaauuucaaggccgaacgcgugauugacccccggcgcugcaugaagccugugauccugacggauggugaggagcgggugauccucgcgggccccaugccggugacccacaguagcgcugcacagcggcgggggcgaaucgggcgcaacccaaagaacgagaacgaccaauacaucuacaugggggagccccuggagaacgaugaggacugcgcccacuggaaggaggccaagaugcugcucgacaacauaaacacccccgagggcaucauccccuccauguucgaacccgaacgggagaaggucgacgcgaucgauggcgaguaccgccugcgcggagaggcacgcaagaccuucguugaccugaugcggcggggcgaucuacccguguggcuagccuacaaggucgcggccgaggggaucaacuacgcggaccggaaguggugcuuugauggcauuaaaaauaaccagaucuuagaggagaacauggagguggaaauuuggacgaaggagggagaacgcaagaaacucaagccgcggugguuagacgcccgcaucuacagugacccccuggcccugaaagaguucaaggaguucgccgcaggccggaagaguuuaacuuugaaccucaucaccgagaugggcaggcuacccaccuucaugacgcagaaagcccggaacgcgcuggacaacuuggccguccugcauacagccgaagccggggggcgcgcguacaaucaugcccugagcgagcuccccgagacccuagagacucugcuccugcuuacgcuccuagcgaccgugaccgggggcaucuuccuguuccucaugagugguaaaggaauaggcaagaugacacugggcaugugcugcaucaucaccgccucuauccugcucugguacgcgcaaauacaaccgcauuggauugccgcuuccaucauucuggaauucuuccuaaucguguuacucauccccgagcccgagaaacagcguacgccccaggacaaccagcugaccuacgucgugaucgccauccucaccguggucgcagcaaccauggccaacgagaugggcuucuuggagaagacgaaaaaggacuuagggcucggcagcaucaccacccaggagagcgaguccaauauccuggacaucgaccugcgaccggcuagcgccuggacccuguacgccguggcgacgaccuucgugaccccuaugcugcggcacuccaucgagaacagcuccgucaacgugagccuuacggccaucgccaaucaggccacgguacucaugggccuggggaagggauggccccuguccaagauggacaucggagugccccuccuggcuaucgggugcuacagccaggugaacccuaucacccugaccgccgcccuccugcugcucguggcccacuacgccauaaucgggcccggccugcaggcgaaagccacucgcgaagcccagaagagggccgccgcggguaucaugaagaaccccacggucgaugggaucaccguuaucgaccuggagcccauuccguacgauccgaaguuugagaaacagcucggccaggugaugcuucugauacucugugucacccagguacugaugaugcgcaccacgugggcccuuugcgaggcgcucacccuggccaccgggcccaucuccacucugugggagggcaaccccgggcgguucuggaacacgaccauugccguguccauggcgaacaucuuccgcgguuccuaccucgccggcgccggucugcuguucuccaucaugaagaacaccaccuccacgcgccggggcacggggaacauaggcgagaccuuaggcgagaaauggaagucccgcuugaacgcccuggggaaguccgaauuccagaucuacaaaaaguccgguauccaagagguugaccggacccucgcgaaggaaggcauaaagcgcggcgagaccgaccaccaugcugugagccgggggagcgcaaaacugcgcugguucguggaacgcaauauggucaccccugagggcaagguaguggaccuaggcugcgggcgcggcgguugguccuacuauugcggaggccugaagaacguccgggaagugaagggucugacgaagggcgggccgggccacgaggagcccauaccuaugucgacauacggguggaaccuagugagacuccagagcggcgucgacguauucuucacgccgcccgagaagugcgacacccugcugugcgacaucggcgagucgagccccaaucccacaaucgaggccggccggaccuugcgcguguuaaaccugguagagaauuggcucaacaacaacacccaguucugcauaaagguauuaaacccauacaugcccucggugaucgagaagauggaggcguugcagcgucaguauggcggggcucucguccgcaacccgcuaagccgcaauucgacgcacgagauguacugggugagcaacgccaccgggaacaucguguccagcguaaacaugaucucccgaaugcugaucaaccgguucaccaugaagcacaagaaggccaccuacgagccggacguggaucuggggucaggcacacgcaacaucggaauagaguccgaaauccccaaccucgacaucauaggcaagcguauagagaagaucaaacaggagcaugagauaucauggcacuacgaccaagaccaccccuacaaaacaugggcauaccacggcuccuacgagacaaagcagaccgggucugccuccucuauggugaacggaguagugcgacugcugaccaaacccugggaugugguccccauggugacucagauggcgaugaccgacaccacgccauucgggcagcagcguguguucaaggaaaaggucgauacgaggacucaagagcccaaggaaggcaccaaaaaguuaaugaaaauaacggccgaguggcuguggaaagaauugggcaagaagaagaccccacgcaugugcacccggguagaguucaccaagaaaguuagauccaacgccgcccucggggcuaucuucacggacgagaauaaauggaaguccgcgcgggaggccguugaggaugggcgguuuugggaguuggucgaccgagagcggaaccugcaccuagagggaaaaugcgagaccugcgucuacaacaugaugggcaagcgggaaaagaaguuaggugaguucggcaaggcuaaggguucccgcgccauaugguacauguggcuuggagcgcgcuuccucgaguucgaggcgcugggcuuccugaacgaggaccacugguucucgcgcgggaacagcuuguccggaguugagggugagggccugcaucggcugggcuacauccuccgcgacguggggaaaaaggaggguggggccauguacgccgacgacaccgcgggcugggacacccggaucacucuggaagaucugaaaaacgaggagauggugaccaaucacaugaagggggagcacaagaagcuugccgaggcaaucuucaaacucaccuaccaaaacaaggugguccgcguccagcggccgacuccucgaggcacagugauggauaucaucagcaggcgcgaccagcgcggcaguggacagguaggaaccuacggacugaauacuuucacaaacauggaggcccagcucauacgccaaauggaaggcgagggcaucuucaagagcauccagcaccugacagcaaccgaagagaucgccguccagaacugguuggcgcgcguggggcgggagcgccucucccggauggccaucagcggcgacgacugugugguaaagcccaucgacgaccgcuuugccuccgcucucacugcccugaaugacauggggaagguccggaaggacauccagcagugggagcccagccgcggguggaacgacuggacccaggugccguucuguucccaccacuuccacgaacuggucaugaaggauggacgggugcucgugguccccugccgcaaccaagacgagcugaucggccgggcgcgcaucucacagggcgccggguggucucuuaaggaaacggcaugccugggcaagagcuacgcccagauguggacccucauguacuuccaucggcgcgaccugagacuggccgcgaacgccaucugcuccgccgugcccagccauugggugcccaccucccguaccaccuggagcauccaugccaaacacgaguggaugaccacugaagacaugcuggcggucuggaaucggguauggauccaggagaacccguggauggaggacaagacccccguugaaucuugggaggagguaccauaccuugggaaacgcgaggaccaguggugcgguucacugaucgggcugaccagccgggccacaugggcaaaaaacauucagaccgccaucaaccaggugcgcucacucauugguaacgaagaguacaccgauuacaugcccagcaugaagcgguuucgccgugaggaggaagaagccggcgugcugugguga

SEQ ID NO: 25039 - RNA, 9876 nt, Artificial Sequence
  derived and/or modified CDS sequence (opt11) from DENV-2__FJ639835__SS-prME
accgccggcguaaucgucaugcucauucccaccgccauggcguuccaccucaccacccgcaacggggagccgcacaugaucgugggccggcaggagaaggguaaguccuugcuguucaagacggaggacggcgugaauaugugcacgcucauggccaucgaucugggggagcugugugaggacacuaucaccuauaaaugcccccuccugcgccagaaugagcccgaggacaucgacugcuggugcaacagcacgagcacaugggucacuuacgggaccuguaccacgacaggggagcaccggagagagaaacgguccguggcuuuggucccacacgucgggauggggcucgagacccgcaccgagacauggaugucuagcgagggggccuggaagcacgugcagcggaucgagaccuggauacugcgccacccgggcuuuaccaucauggccgcaauccuggcguacacuaucgggaccacgcacuuccaacgggcacucaucuucauacugcugacugccguggcccccuccaugaccaugcgcugcaucggcaucucgaacagagacuucgucgagggagugagcggaggguccuggguagacaucguccucgaacaugggucuugcgugaccacaauggcaaagaacaagcccacacuggacuuugagcugaucaaaaccgaagcaaaacagcccgcaacacuccgcaaauacugcaucgaggccaagcucacgaacacgacuaccgaaucccggugcccgacgcagggcgagcccagccugaacgaggaacaggacaagcgauucaucugcaaacacuccaugguggaccggggcugggggaacgggugcgggcuguucggaaagggcgggaucguaaccugugcgauguucacauguaagaagaacauggagggcaagguagugcaacccgaaaaucuggaguacaccaucguaaucacgccccacagcggggaggagcacgcuguggggaacgacacggguaagcacggcaaggagaucaagaucaccccgcaguccagcaucaccgaagccgaauugaccggguacggcacggugaccauggagugcagcccacggaccggucucgacuuuaacgagauggucuugcugcaaauggaggacaaggccuggcuagugcaucgucagugguuucucgaccugccccuccccuggcugccgggggcugacacgcaaggcagcaacuggauacagaaagagacguuggugaccuucaagaacccccacgcaaagaagcaggacgucgugguccucgggucccaagagggagccaugcacaccgcccugaccggggccacggagauacagaugagcagcggcaaccucuuguucaccggccaccugaagugccgccugcggauggacaagcuccaguuaaagggaaugaguuacucaauguguaccggcaaauucaagaucgugaaggagauagcggaaacgcaacaugggaccaucgucauccgcguccaguacgagggcgauggguccccguguaagaucccuuucgaaaucaccgaccuggagaagcgucacgugcucgggcgccugaucacugugaauccgaucgucaccgagaaggauucccccgugaauaucgaggcggaaccgcccuucggggacagcuacaucaucaucgguguagagccgggacagcugaaauuaaacugguucaagaaggguaguucgaucggccagauguucgagacgaccaugcguggcgccaagcggauggccauccugggugacacugcaugggacuucgggagccucggcggggucuuuaccuccauaggaaaggcccuccaccaaguguuuggggcgaucuauggcgccgcguuuagcggcguguccuggacgaugaagauccuuauuggagucaucaucaccuggaucgggaugaacucgcgcuccaccagucuguccgugucucuggugcucgucggcguggugacccuguacuuaggggccgucgugcaggccgacucggggugcguugucagcuggaagaacaaggaacucaagugcgguuccgggaucuucaucacugacaacgugcacaccuggaccgagcaguauaaguuucagccagaaaguccgagcaaguuggccuccgccauccaaaaagcccacgaggaggguauaugcgggauccggagcgugacccgccuggagaaccucauguggaagcagaucacccccgaacugaaccacauccuauccgagaacgaggucaagcuaaccauuaugaccggcgacaucaaggggauuaugcaagccggcaagagaagccuaagaccgcagcccaccgagcugaaauacuccuggaagacguggggcaaggcgaagaugcucucgaccgagucccacaaccagacauuccugaucgacggcccggaaacggccgagugucccaacacgaauagagcguggaauucauuagaaguggaggacuacggcuucgguguguuuaccaccaacaucuggcucaagcugcgcgagaagcaggacgucuucugcgacuccaagcugaugagcgccgcaaucaaggauaaucgggcggugcacgccgauaugggauacuggaucgaguccgcuuuaaaugacaccuggaagauggagaaggccucguucaucgagguaaaguccugccauuggcccaagucucacacccugugguccaacggaguccuggaauccgagauggucauccccaaaaacuucgccgguccugucucgcaacacaacuaccgcccgggcuaccacacucagaccgcggggcccuggcaucucgggaagcuugagauggacuucgacuucugcgagggcaccacagucgugguaacggaggacugcggcaacaggggccccagucugcgcacuaccacugccagcgggaaacucaucacggaguggugcugccguagcugcacccugcccccgcuacgcuaccguggagaggacggguguugguacggcauggagauccgcccccucaaggagaaggaggaaaacuuggucaauagccuggugacugccggccacggccagaucgauaacuucucccucggcgugcuggggauggcccuguuccuugaggagaugcugcggacccguaucggcacgaagcacgcgauccugcucgucgccguaagcuucgugacucugaucacggggaacauguccuuccgggaucugggcagggugauggugauggugggggcuaccaugacggaugacaucggaaugggagucaccuaccucgcccuacuggcagcguucaaggugcgcccuaccuucgccgccggucugcugcugcgaaagcucacgucuaaggagcugaugauggcgacuauugguaucgcccuccucucccaaucuaccauccccgagaccaucuuagagcugaccgacgcgcucgcucuggggaugauggugcugaagaucguacgcaacauggagaaauaccagcucgccguaacgaucauggccaucuccugcgugccgaacgcugucauccugcagaacgccuggaagguuucaugcacaaucuuagccgccgucuccgugagcccccuacugcugaccuccagccagcagaaagccgacuggauccccuuagcgcuuaccauaaagggccugaaucccacagccaucuuccucaccacccugucccggaccuccaaaaagcgcuccuggccgcugaacgaggccaucauggccgugggcauggucagcauccuggccuccucccuguuaaagaacgauauccccaugacugguccccucguagcuggcggacugcuuaccguaugcuacgucuuaacuggucguagcgcggaccuggagcuggagcgcgccgccgacguaaagugggaggaucaagccgagauuucagggagcuccccuauacuuagcaucaccaucuccgaagacggcagcauguccauaaaaaacgaggaggaggagcaaacccugaccauccuuauccguaccggccuccuggugaucagcgggguuuucccgguuuccauucccauuaccgcggccgccugguaccugugggaagugaaaaagcagagggccggcguucucugggauguucccagcccgccacccguggagaaggcugagcucgaggacggugcguaccggaucaagcagcguggaauccugggguacucccagauaggcgccggcguguacaaggaagggacguuucacacuauguggcacgugacccggggcgccgugcucaugcauagggggaagcggaucgagcccagcugggcggacgucaagaaggaccuaaucucuuacggcggcggcuggaaguuagaaggcgaguggaaagaaggggaggagguccaggugcuugcccuggagccuggcaagaacccucgcgcggugcagacgaagcccggaaucuucaaaacgaacacgggcaccauuggcgcagucagccuggacuucucccccggcaccagcggcucuccuauuguggaucggaaggggaaagucgugggccucuaugguaacggcguggucacccgcagcggcgccuacgugagcgcaauagcgcagacggagaaguccaucgaggacaaccccgaaaucgaggaugacauuuuucggaagaagcgccugacuauuauggaucugcaccccggugcaggcaagacuaagagauaccuccccgccaucguccgcgaggccaucaagcggggguuacgcacccugauccuagcuccaacgagggucgucgcugccgagauggaggaggcccucagaggccugccgaucagguaccagacccccgccaucaagaccgagcacacggggcgggagaucguggaccuuaugugucacgccacguucaccaugcgacuccugucgcccguccggguaccgaacuacaaccugauuaucauggaugaggcacacuucacagacccggcauccaucgccgcccgcggcuacaucagcacccggguagagaugggcgaagccgcggggaucuucaugacggccacgccuccuggcucccgcgacccauucccccaaagcaacgcgcccaucauggacgaggagcgugaaauccccgagcgcuccuggaacagcggccacgagugggucaccgacuucaagggcaagaccgugugguucgugccgucgaucaaggccgggaacgacaucgcugcaugcuuacguaagaacgggaagaaggucauccagcugagccgcaagacguucgacuccgaguacgugaagacccgggcgaacgauugggacuucguagugaccaccgacaucagcgagaugggcgccaacuucaaagccgagcgggugaucgacccccggcgcuguaugaagccgguuauccuaaccgacggggaggaacgcguaauacucgcgggccccaugccggugacccauuccagcgcugcccagcgcagagggcgcaucggaagaaaccccaagaaugaaaaugaucaguacauuuacaugggggagccccuggagaacgacgaagauugcgcccacuggaaggaggcgaaaaugcuacucgacaauauaaacacgcccgaagggaucauuccguccauguuugaaccagaacgggagaagguggacgcgaucgacggugaguaccgccugcguggcgaggcccgaaagacauuugucgaccugaugcggcgcggcgaccuccccgucuggcuggcauacaagguagcagcugaaggaaucaacuacgcugaccggaagugguguuuugaugggaucaagaauaaccagauccuggaagagaacauggaagucgagaucuggacgaaggagggggaacgcaagaagcucaagccgcgguggcuggacgcccgcaucuacagcgaccccuuagcgcucaaggaguucaaggaguuugccgcaggacggaagucccuuacccugaaccucauuaccgagaugggacgccugccaaccuucaugacgcagaaagcucgcaacgcccucgacaaucucgccgucuugcacaccgccgaggcgggagggcgggcguacaaucacgcccuuagcgagcucccagagacccucgagacacugcuccuguuaacacuccuggccaccguaaccggcgggaucuucuuauuucucauguccggcaaaagcauugggaagaugacucuggggaugugcugcauaaucacugccuccauacugcucuggcacgcgcagauccagccgcacuggauagccgccucaauuauucuggaguucuuuuugaucgugcuccuuauuccggagcccgaaaagcaacggacgccccaggacaaccagcugaccuacguggucaucgccauuuuaacggugguggccgcgaccauggccaaugagaugggguuucuggagaaaacgaagaaggacuuggggcucgggagcaucaccacccaggaguccgagagcaacauccuggacauugaccugagaccggccuccgccuggaccuuguacgcugucgcgacgaccuucgugaccccgaugcugaggcacagcaucgagaacuccucugucaacgucucccugacugccauugccaaccaggccacgguacucaugggccugggaaagggguggcccuuaagcaagauggacaucggcgugccccuccuggcgaucgggugcuacucccaagucaauccuauaacccugacugccgcccuccuacugcuaguggcccauuacgccaucaucggcccgggacugcaagcgaaggccacucgcgaggcgcagaaacgugccgccgccggcaucaugaagaaccccacggucgacggcauaaccgucaucgaccucgaaccaaucccguacgaucccaaguuugagaaacagcucggccaggugaugcuguuaauucucugcgugacccagguuuuaaugaugcgcaccacgugggcguuaugcgaggcgcugacucucgcgaccggccccaucuccacccugugggaggggaaccccggccgauucuggaauacgacuaucgccguguccauggcgaacaucuuccgugggagcuaccucgccggugcggggcugcuguuuuccaucaugaagaacaccacaagcacucgcagggguaccggcaauaucggggagacgcucggcgagaaguggaagucuaggcuuaacgcccuggggaaaucugaguuucagauauauaagaaauccgggauccaggagguggaccgcacucucgcgaaggagggcaucaaacgcggggagacggaccaccacgccgucagccggggcuccgccaagcugcgcugguucguggagcggaacauggugaccccggaggggaagguaguggaccugggcugcggccgcgggggcuggagcuacuacugcgggggccucaagaacgugcgggaagucaaggggcugaccaaagguggcccagggcacgaagagcccauccccaugaguaccuauggcuggaacuuagugcggcugcaguccgggguggacgucuucuucacgccgccggaaaaaugcgacacccugcugugugacaucggcgaaagcucccccaaucccaccaucgaggccgggaggaccuuacgggugcugaaccugguggaaaacuggcucaacaacaacacccaguucugcaucaagguccugaacccguacaugccgagcgugaucgagaagauggaagcgcugcagagacaguacggcggcgcgcucgugcgcaacccccugucccggaacagcacgcacgaaauguacugggucuccaacgccacugggaauauagugagcuccgugaacaugaucagccgcauguugauaaaccgguuuaccaugaagcacaaaaaggcaaccuaugagccggacgucgaucucggcuccgggacgcguaacaucggcauagagaaugagauuccgaaucuugacaucaucgguaagcgaaucgagaagaucaaacaggagcacgagaucagcuggcauuacgaccaagaucaccccuacaagaccugggcguaccacggcucguaugaaaccaaacagaccggaagcgccucaagcauggugaacggugugguccgccugcugacgaagcccugggacguagucccgauggugacccagauggcgaugaccgacacgacgcccuucggccagcaacgcgucuucaaagagaaaguugacacgcggacccaagagcccaaggaggguaccaagaagcucaugaagaucacggccgaguggcucuggaaggagcuggggaagaaaaagacuccccgcaugugcacccgcgaggaguucacccggaagguccggaguaacgccgcccuuggcgccaucuucacggacgagaacaaguggaaguccgcgcgcgaggcuguggaggacggacgguucugggagcucguggaccgcgaacggaaccugcacuuagagggcaagugcgagaccugcgucuacaauaugauggguaagcgcgagaagaagcugggcgaauuugggaaggcuaagggcucccgggccaucugguacauguggcugggugcgcguuuccucgaguucgaagccuugggguuccugaacgaggaccacugguucucucggggcaacagccucuccggcguggagggcgaggggcugcaccgccugggcuauauccuacgggacgucggcaagaaggagggcggcgccauguaugcagaugacacggccggcugggacacccguaucacgcuggaagacuuaaagaacgaagagauggugaccaaccacaugaagggcgagcauaagaagcucgcggaggccaucuuuaagcuaacguaccaaaacaagguuguccgggugcagcgcccgacgccccgggggacugugauggacaucauuagccgccgggaccagcgcggauccgggcaggucgggacuuacggacugaacacauucacuaacauggaagcccaacucauccgccagauggagggggagggcaucuucaagucgauccaacaccucacugccaccgaggagauagccgugcagaacugguuggcgcgggugggucgcgagcgucucucgaggauggccaucagcggggacgauugugucgugaagcccaucgacgaccgguucgccucagcccugaccgcccugaaugacauggggaaggugcgcaaggacauacaacagugggagcccagccggggguggaacgacuggacccaggucccguucuguucccaccauuuccacgagcucgugaugaaagacggccgcgugcuggucgugcccugccggaaccaagacgaguugaucgggagagcaaggaucagucaaggcgcuggauggucccucaaggaaacggccugccugggcaagagcuaugcccagauguggacccugauguacuuccaccgccgggaccuccgccuggcagcgaaugccaucugcagcgcugugccgucccacuggguacccaccucaaggaccaccuggagcauccacgccaagcacgaguggaugacuaccgaggacaugcuggcgguguggaaccgcguguggauccaggaaaauccuuggauggaagacaagaccccaguagaguccugggaggaggugcccuaccucgguaagcgggaggaccaguggugcgggucgcucaucggccugaccucacgggccacgugggcaaagaacauccagaccgccaucaaccagguucggucgcucauugggaacgaggaguacaccgacuacaugccuagcaugaagagguuccgccgggaggaagaggaggcaggcguucugugguaa

SEQ ID NO: 25040 - RNA, 9876 nt, Artificial Sequence
  derived and/or modified CDS sequence (opt11) from DENV-2__FJ850050__SS-prME
accgccggcgugauaguaauguugauccccaccgcaauggcguuccacuuaacgacccgaaauggggagccgcacaugaucguggggcggcaggagaaagggaagucccugcuguuuaagaccgaggacggcgugaauaugugcacccucauggccaucgacuuaggggagcugugcgaggacacgaucaccuacaagugcccccuccugcgccagaacgagcccgaggacaucgacugcugguguaauucuaccagcaccugggucacguacggaaccugcaccaccacuggcgagcaccggcgcgagaagcgguccguggcacucgugccccacgucgggaugggucucgaaacgcggaccgagaccuggaugucguccgagggcgcauggaagcacgugcaaaggauagagacguggauccugcgccaccccggguucaccaucauggccgcaauucuggcauacaccaucggcaccacgcacuuucagcgggcacuuaucuucauccuuuugaccgcuguagcgcccagcaugaccaugcgcugcauuggcauauccaaccgggacuucgucgagggcgugagcgggggcuccuggguggauaucguccucgagcacgggucgugcgugaccacgauggccaagaacaagcccacccuagacuuugaguugaucaagacagaggccaagcagcccgccacccuacgcaaauacugcaucgaagccaagcucaccaacaccacaacagagucccggugcccuacgcagggcgaacccagccugaaugaggagcaggacaaacgcuucaucugcaagcauucuaugguagaccggggcugggggaacggcugcggacucuucggcaaggguggcaucgucacaugcgcgauguucaccuguaagaaaaacauggagggcaagguggugcagcccgagaaccucgaguauaccauagucaucacgccacacagcggggaggagcacgccgugggcaacgacaccgggaagcauggcaaggagaucaaaaucacaccgcagagcucuaucaccgaggccgaacugaccggguacggcacagugaccauggaaugcucaccacgcaccggccucgacuuuaaugagaugguccugcugcagauggaggacaaggccuggcucgugcauaggcagugguuccuggaccugccccuccccuggcucccuggggccgacacccaaggcagcaacuggauccagaaggagacuuuagugaccuucaagaacccccacgcgaagaaacaggacgucgugguacucgggucccaggagggcgccaugcacaccgcccucacuggcgggacggagauccagaugagcucggggaaucugcuuuucaccgggcaccucaagugccgccugcggauggacaagcuccagcugaaggggaugucuuacagcaugugcacugguaaguuuaagauugugaaagagauugccgagacccagcacgggaccaucgugauccgcguucaguacgagggcgacggcucccccugcaagaucccguucgagauaaccgaucuggagaagcggcacgugcucgggcgacugauuaccgugaacccuauugucaccgagaaggacucuccugugaacaucgaagcagagccacccuucggggacuccuacaucaucauuggcguggaaccaggccagcugaagcugaacugguuuaagaaaggcagcagcauuggccagauguucgagacgacuaugagaggggcaaagcggauggcgauacuaggcgacaccgccugggacuucgggucacuaggcgggguguucacauccaucggcaaggcccuccaccaaguguuuggagcuaucuacggggccgccuuuucaggcgugucguggacgaugaagauccugaucgggguuaucaucaccuggaucggcaugaacagccgcuccaccagucucucggugagccuggugcucgucgggguggugacgcuuuaccuuggcgcagugguucaagccgacuccggcugcguggucagcuggaagaacaaggagcuaaagugcggguccggcauuuucaucacagacaacgugcacaccuggacggaacaguacaaguuccagcccgagucuccuagcaagcuggcguccgccauccaaaaggcccacgaggaggggauuugcgggauccggagcgugacccgccuagaaaaccucauguggaaacagaucacgccagagcugaaccacauccuauccgagaacgaggucaagcucaccaucaugaccggcgacaucaagggcauaaugcaggcgggcaagcggagccugcgcccgcagcccaccgagcugaaauacuccuggaagacgugggggaaggcgaagaugcucagcaccgagagucacaaccagaccuuccugauugauggaccggagacagcggagugcccgaacacgaaccgggccuggaacagccuggagguggaggacuacgguuucggcgucuuuaccaccaacaucuggcugaagcuacgcgagaagcaggacguguucugcgacuccaaguuaaugagcgccgccauaaaguacaaccgggcagugcacgcggacaugggcuauuggaucgaguccgcccccugcgacucaugggagaugcagaaagccucauucaucgaggugaucucaugucacuggcccaagucccucacccuuuggagcaaugggguccuggaguccgaaaugaucauccccaagaacuucgccggaccggugagccaacacaacuaucgccccggauaccacacccagacggccgggcccuggcaccuugggaagcuggaaauggacuucgauuuuugcgagggaaccaccguggucgugaccgaggacugcggcaaccgugggcccagccugcgcacgaccaccgcgagcggaaagcugaucaccgaauggugcugccggagcugcacgcugccgccccugcgauaccggggagaggacgggugcugguacgggauggagauccgcccccucaaagagaaggaggaaaacuuagucaacagccuugucaccgcgggccacggccagaucgacaauuucagccucggggugcugggaauggcauuauuccucgaggaaaugcugcggacccgcaucgggacaaagcacgcuauccuacucguggccgugaguuucguaacgcugauaacgggcaacaugagcuuccgcgaccuggggcgcguuauggucaugguuggagcuaccaugaccgacgacaucggcaugggugugacguaccucgcccugcuggccgcauucaagguccgcccuaccuucgccgccgggcuccugcugcggaaguugacguccaaggagcugaugauggcaaccaucgggauagcccugcucagccaguccacgaucccggagaccauccuggagcugaccgacgcccuggcccucggcaugaugguacugaagaucgugcggaacauggagaaguaccagcucgccgucaccaucauggccaucagcugcgugcccaacgccgugauacugcagaaugccuggaaaguuucuugcacaauacuugcggcggugagcgucucgccccuccuucugaccucuagucagcagaaggccgacuggaucccccucgcgcugaccaucaagggucugaauccgacugcgaucuuccucacgacccugucacggacgaguaaaaagcggagcuggccccugaacgaggcuaucauggccguggggaugguguccauacucgcaagcagccugcugaagaaugacauuccgaugaccggaccccucgucgccgggggacuucuaacggugugcuacguccucaccgguagaucugcggaccuggaauuagagcgcgcggcggauguuaagugggaggaucaagccgagaucaguggcaguagcccuauucuauccauaaccaucagcgaggacgguuccaugagcaucaagaacgaggaggaggaacagacacugacgauccugauccguaccgggcuccuggugaucaguggcguguuucccgucagcauccccaucaccgcagcggccugguaucugugggaggugaagaaacagcgcgcgggggugcucugggacguccccuccccgccacccguggagaaggcggagcuagaggacggggccuaucgcauuaaacagcgcgggauccugggauacucccaaauaggcgcggggguguacaaggagggcaccuuccacacaauguggcacgucacgcguggagccgugcucaugcaccgaggcaagcgcaucgagcccuccugggccgacgugaaaaaggaccugauuucauacgggggcggcuggaagcuggagggggaguggaaggagggcgaggagguccaggugcuagcacuggagcccgguaaaaacccccgcgccguccagaccaagcccgguaucuuuaaaacaaacaccgggacaauaggugcggucucccuggacuucucaccgggcacaagcgguagccccaucguggaucggaaagguaagguagucggacucuacggcaacggcgucgugacccgcuccggcgccuacgucagcgccauugcacagaccgagaaaagcaucgaggacaaccccgagaucgaggacgacaucuuccguaagaagcgccugacgaucauggaccugcaccccggcgcgggcaagaccaaacgguacuuaccggccauuguucgggaggccauuaaacggggccuacgaacccucauccuggcucccacacgcguugucgccgcggaaauggaggaggcacuacgggggcugcccaucagauaucagacgcccgccauuaaaaccgagcacacaggccgggagaucguggaucugaugugccacgccaccuucacgaugcgccuccugucuccgguaagagucccgaauuauaaccugaucaucauggacgaggcccacuucaccgaccccgcgagcaucgccgcccgcggcuacaucuccacucggguggagaugggggaggccgccggcaucuucaugaccgcaacacccccugggagccgugacccauucccccagucgaaugcccccaucauggacgaggaacgggagauaccggagcgcagcuggaacucagggcacgaguggguaaccgacuucaaggggaagaccgucugguucguccccagcaucaaggccggcaacgauauagccgcgugccuaaggaagaacgguaagaagguuauccagcugucccgcaagaccuucgauagcgaguacgucaagacgcgggccaacgacugggacuucgucgugaccaccgacaucucugagaugggggccaacuucaaagccgagcgcgucaucgacccccggcgcugcaugaaaccggugauccugaccgacggagaggaacgggugauccuugcggggccgaugccugucacgcacuccuccgccgcccaacgccggggccguaucgggcgcaaccccaagaacgaaaaugaucaauacauuuauaugggcgagccgcuggagaacgacgaggauugcgcucacuggaaggaggccaagaugcugcucgacaacauuaauaccccggagggcaucaucccaagcauguucgagcccgagcgugagaaaguggacgccaucgauggggaguaucgccugcgcggggaggcaaggaagaccuucguggauuuaaugcgucgcggggaccucccgguuugguuagccuacaaaguggcugccgagggcaucaacuacgccgaccggaaguggugcuucgauggaaucaagaauaaccagauccuggaggagaacaugcaggagcagaucuggaccaaggagggggagcgcaagaagcucaagccccgguggcuggacgcgcgaaucuauucagacccucuggcacucaaggaguucaaggaguucgcugcuggccggaagucauugacgcugaaccugauaacugagauggggaggcuacccaccuucaugacccagaaggcgcggaacgcccuggacaaccucgccguacugcacacggccgaggccggcgggcgggccuacaaccacgccuugucugagcucccggagacccuagagaccuugcuacuguuaacacuccuggccacggucacuggcggcaucuuccuauucuugaugagcgggaagggcaucgggaaaaugacucugggcaugugcugcauaaucaccgccuccauucugcuuugguacgcccaaauucagccacacuggaucgcggcgagcaucauccuggaguucuuccuuaucguccuccugauccccgagcccgagaagcaacgcaccccgcaagauaaccaguuaacguacgucgugaucgcaaucuugaccguggucgcagccacaauggcgaaugagaugggguuccuggagaagaccaaaaaggaccugggucucggcagcaucacuacacaagaguccgagagcaauaucuuagacaucgaccugcgaccagccuccgccuggacccucuacgccguggccaccacguucgucacccccaugcugcgacauagcaucgaaaauuccagcgugaacgugucccugacagcgaucgccaaccaagccaccgugcucauggggcugggcaagggguggccucuaagcaagauggacauuggcgugccucuacuggccaucgggugcuacucccaagugaaucccauuacgcugacagcggcccuccuccuccucguggcccacuaugccauaaucggucccggccugcaagccaaggcgacacgcgaggcccagaagagagccgccgccggaaucaugaagaaccccaccgucgauggcaucacggugaucgaccuggagccgauccccuacgauccgaaguucgagaagcagcucggacagguuaugcuacugauccucugcgucacucaaguccugaugaugcgcaccaccugggcgcuaugcgaggcacucacgcuggccaccggccccaucuccaccuuaugggaagggaacccuggucgguucuggaacacuacgauugccguguccauggccaacaucuuccgcggcucauaucucgcgggcgccggccugcuguucuccauaaugaaaaacaccaccagcacccgccgagggacggguaacaucggcgagacccucggggagaaguggaaaucacggcugaacgcccugggcaagagcgaguuucagaucuauaagaaauccgggauccaggagguagaccggacccucgccaaggaaggcaucaagcgcggagagacugaccaccacgccgugucucgaggcuccgcuaagcugagaugguucguggagcggaacauggucacacccgagggcaagguagucgaucuggggugcggccgcggaggguggaguuacuacugcgggggccucaagaacguccgggagguaaagggccugaccaaagggggccccgggcacgaggaacccaucccgaugaguaccuacgguuggaaccugguccgccuccagagcggugucgaugucuucuucacacccccugagaaaugcgacacgcugcucugcgacaucggggagagcucccccaacccgacgauagaggccggucguacccuacgcgugcugaaucuggucgaaaacuggcuuaacaacaacacccaguucugcaucaagguacugaacccuuacaugccuagcgucaucgagaagauggaagccuuacagcggcaauacggaggggcccucgucaggaauccgcugucacggaacagcacccacgagauguacuggguguccaaugccacgggcaacaucgucagcuccgucaauaugauuagccggaugcugauuaaccgguucacuaugaagcauaagaaggccacauacgagcccgacguggacuuaggcuccgggaccaggaacaucggcaucgagagcgagauacccaaucucgauaucauaggcaaacggaucgagaagaucaagcaggagcacgagauuaguuggcacuacgaucaggaccaccccuacaagacgugggccuaccacgggaguuacgaaacgaagcagaccggcuccgcaucgaguauggugaacggagucguacgucugcugaccaagccgugggacgugguccccauggugacgcagauggcuaugaccgauaccacccccuuugggcagcagcgcguguucaaggagaagguugacacgcgcacccaggaacccaaggaaggaaccaagaagcucaugaagaucaccgcggaguggcuguggaaggagcuggggaagaagaagacgccgcgcauguguaccagagaggaguucaccaagaagguucgcagcaacgccgcccucggcgccaucuucacggaugagaauaaguggaaaagcgcccgggaggcgguggaggacgggcgcuucugggaacugguagaccgggagcgcaaccugcaucucgaaggcaagugcgagacguguguuuauaacaugauggggaagcgggagaagaagcugggcgaguucggcaaggccaaagggucacgagcaauuugguacauguggcugggugcccgguuccucgaguucgaggcguuaggguuccugaacgaggaucacugguucagccgcggcaacucccucagcgggguggagggugaagguuugcaccgguuggguuacauccuccgagacgucggcaagaaggaagggggcgccauguaugccgacgacacagcgggaugggacacccggaucacccuggaggacuugaagaacgaggaaaugguuacgaaccauaugaagggcgaacacaagaagcucgccgaagcgauuuucaagcugaccuaccagaacaaggucgugagggugcaacggcccacaccccgcggcaccgucauggacaucaucucccgucgcgaccagcggggaagcggccagguggggacauacggccugaauaccuucaccaacauggaggcccaacucauccgccagauggagggcgagggaauauucaaguccauccagcaucugaccgccacggaggaaauugcaguucagaauugguuagcccguguuggccgggagcgacugagccgaauggcgauuuccggcgaugauugugucguuaagccuauugacgaccgcuucgccagcgcccugacggcgcugaaugacaugggcaagguccggaaggacauccagcagugggagccgucccgcggguggaacgauuggacccaaguacccuucugcagccaccacuuccacgagcucgugaugaaggacggccggguccugguggugcccugccgaaaucaagacgagcugaucggccgggcuagaaucucccagggggcgggcuggagucucaaggagaccgccugccuggguaagucguaugcccagauguggacgcugauguacuuccaccggcgcgaucuucgguuggccgcgaacgccaucugcagcgcaguccccucccacugggugccgaccagccgcacaaccugguccauucacgccaagcacgaguggaugaccacggaggacauguuggccgucuggaaccgggucuggauccaagagaacccauggauggaggacaagacacccguggagucuugggaggaggugcccuaccucggcaagcgcgaggaccaguggugcgggucccugauuggacugacgucccgggccaccugggcuaaaaauauccaaacggcuaucaaucagguccgcagccucaucggcaacgaggaauauaccgauuauaugccguccaugaagcgauucagacgcgaggaggaggaggcagggguucugugguga

SEQ ID NO: 25041 - RNA, 9876 nt, Artificial Sequence
  derived and/or modified CDS sequence (opt11) from DENV-2__FJ639837__SS-prME
acggcaggcgugauugucaugcuuauucccacagcaauggccuuucaccucacuacccgcaauggggagccccacaugaucgugggccggcaggagaaggggaagagucuucuguuuaagaccgaggacggcgugaacaugugcaccuuaauggccaucgaccugggggagcugugcgaggacaccaucaccuauaaguguccccuacugcgccaaaaugagcccgaagacaucgauugcuggugcaacucuaccagcaccugggucaccuacgggaccugcaccacaacgggcgagcaccguagggagaagcguuccguggcccuggugccccacgucgggaugggucucgagacccguacggaaaccuggaugagcucugagggggccuggaagcaugugcagcggauugagaccuggauauugcgccacccgggcuucaccaucauggcggcgauccuggcguauaccaucggcaccacgcacuuccaaagagcccucaucuucauccugcugaccgccguggcacccagcaugaccaugcgguguauaggcauaucgaaccgcgacuuugucgagggcgugagcggaggcuccuggguggacaucguucucgaacacgguagcugcgugaccacgauggccaagaacaaaccuacccuggacuuugaauuaaucaagaccgaagcgaagcagcccgccacccuccgcaaguacugcaucgaggcgaaguugacgaauaccacaacagaaucccggugccccacucagggcgaacccagccugaacgaggaacaagauaagagguucauauguaagcacuccaugguggaccggggcugggguaacggcugcgggcuguuuggcaagggaggaaucguuaccugugcgauguucacgugcaagaaaaacauggagggcaaaguggugcagccggaaaacuuagaauacaccaucgucaucacgccccacucgggugaggagcacgcaguuggaaacgacaccgggaagcacggcaaggagaucaagaucacgccacagucgucaaucacggaggccgagcugaccggguacggcacugugaccauggaguguagcccucguaccggccucgacuucaacgagaugguuuugcuacagauggaggacaaggccuggcucgugcaucggcaaugguuccucgaccuaccccugcccuggcuaccgggggccgauacccagggcagcaacuggauccagaaggagacgcucgugaccuucaagaauccgcacgcgaagaagcaggacgucgugguguuggggucccaggagggagccaugcacacugcccuaaccggggccacggagauucagaugagcagcggcaaccuccuguucacgggccacuuaaagugccgucuccggauggacaagcugcagcuaaaggguauguccuacagcaugugcaccggaaaguucaagauugugaaggagaucgccgagacccagcaugggacaaucgugauccggguacaguacgagggugacggcucccccugcaagauacccuucgaaaucaccgaccuugaaaaacggcacgugcucgggcgccugauaaccguuaacccgaucgugacagagaaggacucuccaguaaacaucgaggcggagccgccguucggcgacuccuacaucauaaucgggguggagcccggccagcugaagcucaacugguucaagaaggggaguuccaucggccaaauguucgagacgaccaugcgcggagccaagcggauggcgauccugggggacaccgccugggacuuuggcagccucggcggagucuuuaccaguaucgggaaggcccuccaccaaguuuuuggcgcgaucuacggcgccgcauucagcggggugagcuggacuaugaagauccugaucgguguuauaaucaccuggauagggaugaauagccgcuccaccucgcuauccgugagcuuggugcucgucggcguggugacucuguaccugggggccgucgugcaggcggauuccgguugcguggucagcuggaagaacaaggaacucaaguguggauccgguaucuucauuacggacaacgugcacaccuggaccgagcaguacaaguuccagccagagucucccucaaagcuggcguccgcaauacaaaaggcacacgaggagggaaucugcgguauccggagcguaacccgccuggagaacuugauguggaagcagaucacgcccgaacugaaucacauccuauccgagaacgaggucaaacucacuaucaugaccggcgauaucaaggggaucaugcaggccggcaagcggagccugcgcccgcaaccuaccgagcugaaguacuccuggaagacguggggcaaggcgaagaugcuuagcaccgagucccacaaccaaaccuuccugaucgacgggccggagaccgccgagugcccgaacaccaaccgggcguggaacagccuggagguggaggacuacggcuucgggguauuuaccaccaacaucuggcuuaaacugagagagaaacaggacgucuucugcgacagcaagcucaugagcgccgccaucaaggacaaccgggccgugcacgccgauaugggcuauuggaucgaaucugccuuaaacgacaccuggaagauggagaaggcgucguucauagaggugaaguccugccacuggccaaagagccacacccugugguccaacggcguccuggagucagagauggugauccccaagaacuucgcaggacccguaucccaacacaauuaccgcccgggcuaccacacgcagaccgcggggcccuggcaccucggcaagcuggagauggauuucgacuuuugcgagggcaccaccguaguggugacggaggacuguggcaaccggggccccucauugaggacaaccaccgcaagcgggaaauugaucacggagugguguugccggucaugcacacugcccccgcugcgcuaccggggcgaggaugggugcugguacggaauggagauccgccccuuaaaggaaaaagaagagaaccuggucaacagccuggugaccgcagggcacgggcaaaucgacaacuucucccuaggcgugcuggggauggccuuauuccucgaggaaaugcugcggacccgaaucggcacgaaacaugcgauccuucucgucgccgucagcuuugugacccugauuaccgggaacauguccuuccgggaccugggccgcgucauggucaugguuggggccaccaugacggacgacauuggaaugggcgucaccuacuuggcccuguuagcugcuuuuaaaguccgcccgacauucgccgccggucuccugcuacgcaagcucaccagcaaggagcuaaugauggccacgaucggaaucgcccugcuaucccaaucgaccauccccgagaccauccuggagcugaccgaugcacucgcccuggggaugauggugcugaagauuguccgcaacauggagaaauaccaguuagccgugacgaucauggccaucuccugcgugccgaacgccgucauccugcaaaacgcguggaaggugaguuguaccauucuggcagccgucuccgugagcccguuacugcuuaccucuagucagcagaaggccgacuggaucccccucgcgcugacaauaaagggcuuaaaccccaccgccaucuuccucaccacccugucccggaccagcaaaaagcgguccuggccucugaacgaggccaucauggccgucgggauggucagcauauuagccuccucuuugcugaaaaacgacaucccgaugacaggaccucucguggccgguggucugcugacgguguguuacguucucaccggcaggagcgccgaccuggagcuggagcgcgccgccgaugugaaaugggaggaccaggccgagaucuccgggagcucccccauccuuagcaucaccauauccgaggacgguagcauguccaucaagaacgaggaagaggagcagacucugaccauauuaauccggaccggccugcuggugaucagcgggguguucccgguguccauuccuaucaccgcggccgcuugguaccugugggaggugaagaagcagcgcgccggcguccucugggaugugcccagcccgcccccagucgagaaagccgagcucgaggacggggcguaucggaucaagcagcgaggcauacugggguacucccagaucggcgccggcgucuacaaggaggguacauuccacaccauguggcacgugacacguggcgcuguccuuaugcacagggguaagcggaucgagcccagcugggccgacgucaaaaaggaccugaucuccuauggcggggguuggaagcuagagggagaguggaaagagggugaggagguccagguccuugcccuggaacccggcaagaauccgagagccguccagaccaagcccgggaucuuuaaaacaaacacgggcaccaucggcgcgguaucccuggacuucucccccggaaccagcggcagccccaucguugaccggaaggggaaagugguggggcucuacgggaacggaguggucacucgcagcggagccuaugugagugcaaucgcgcaaacggagaagucaauugaggacaaccccgagaucgaggacgauauuuuucggaagaagcgccugacaaucauggaccugcaccccggggccggcaagaccaagcgcuaccuacccgccaucguacgcgaggccaucaagcgggggcugcgcacccugauccuggcuccgacgcgcgucguagccgccgagauggaagaggcccuacggggccuucccauucgcuaccagacccccgccaucaagaccgagcacaccgggcgggagaucguggaccugaugugccacgccacguucaccaugagacuccugagcccgguccgagugccgaacuacaaccugauuaucauggaugaagcccacuucaccgaucccgccuccaucgcagcccgcggcuacaucucuacucggguggagaugggcgaggcggcggggauuuuuaugacggccacgccgccuggcucccgcgaucccuucccgcagagcaacgcucccauuauggacgaggagcgggagaucccagagcgcuccuggaacagcgggcaugaaugggucaccgauuucaagggcaagacugugugguucgugccgucgauaaaggccgggaacgacaucgcggccugccuccggaagaacgggaagaaggucauccagcugagccgcaaaacguucgacucagaguacguuaagacucgcgccaacgacugggacuuuguggucacuaccgacaucagcgagaugggcgccaacuucaaggcggagcgcgugaucgacccccggcguuguaugaagccagugauccugacggacggggaggaacgggugauccucgccggccccaugccaguaacccauuccucagcggcacaacgacgagggcgcaucggcagaaaccccaaaaacgagaacgaccaguacaucuacaugggggagccucuggaaaacgaugaggacugcgcccacuggaaggaggcaaagaugcugcucgacaacaucaacacccccgaaggcauuaucccgaguauguucgagcccgagcgggaaaagguggacgcuaucgacggcgaguaucgccugcguggggaggcccgcaagaccuucgucgaccuaaugcggcgcggcgaccucccagucuggcuugccuacaaggucgcugcagaagggaucaacuacgccgaccggaaguggugcuucgacggcaucaagaacaaccagauucuagaggaaaacauggaagucgagaucuggacgaaggagggcgagcgcaaaaagcucaagccgcgcuggcuggacgcccguauuuauagcgacccuuuggcccucaaggaguuuaaggaguucgccgcgggccgcaaaucccugacccugaaccucaucacugagaugggacgccugcccaccuucaugacgcaaaaggcccggaacgcuuuagauaaccucgccgugcugcacaccgccgaagcugguggccgcgccuauaaccacgcccugucagagcucccggagaccuuagaaacccugcuccugcugacucugcuggccaccgucaccgggggcaucuuccuauucuuaauguccggcaagagcaucgggaagaugacacugggaaugugcugcaucaucacggcuucaauccugcucuggcacgcgcagauccagccgcacuggauugccgcaagcaucauccuggaguucuuucucauagugcuccugaucccagagcccgagaagcagcggacgccccaagacaaccaacugaccuacguggucauagccauccucaccgugguagcggcgacgauggccaacgagaugggguucuuggagaagacgaagaaggaccugggguuggguagcaucaccacgcaggagagugagagcaacauucuagacauagaccugcgcccggccucagccuggacccuguacgcagucgcgacgaccuucgugacacccauguugcggcauaguaucgagaacuccagcgugaacgucucccugaccgccaucgccaaccaggcgacgguucugaugggcuugggcaagggcuggccccugucaaagauggacauaggagugccccuccuggcgaucgggugcuacucccaggucaacccgaucacccuaacagccgcccuccuccugcucguggcacauuacgccaucauagggcccgggcuccaggcgaaggccacccgcgaggcccagaagcgggcggccgcgggaaucaugaagaacccaacgguggaugguauuaccguuaucgaccuggcacccaucccauaugaccccaaguucgaaaagcaacucggccaggugaugcuucugaucuugugcgugacccaggugcugaugaugcgcaccacgugggcccugugcgaggcccugacccuggccacugggccuaucagcaccuuaugggaggggaacccuggccgguucuggaacacgaccauagcggugucgauggcaaacaucuuccgcgggagcuaccuugcgggagccggcuuacuguucuccaucaugaagaacaccacgagcacgcgccgggguacuggaaauaucggggagacccuuggcgagaaauggaaaagccgccugaacgcgcuggggaaaagcgaguuucagaucuacaagaaguccgguauccaggagguagaccggaccuuagcaaaggaagggaucaagagaggggagacggaccaccacgccgucagcagaggcucugccaaacugcgaugguucguggagcggaacauggugacuccggaggggaaggucguggaccugggcugcggccgcgggggcuggagcuacuacugcggcggccucaagaacgugcgagaggucaaggggcugaccaaagggggaccagggcacgaggagcccaucccaaugagcaccuauggguggaaucuggugagacugcagucggggguggacgucuuuuucacgccaccugagaagugcgauacccugcugugcgacaucggggaaagcuccccuaaccccacgaucgaggcggggcggacgcucagagugcugaaccugguggagaacugguuaaacaacaauacccaguucugcaucaagguucugaacccguacaugcccagcgugaucgaaaagauggaagcgcugcaacggcaguacggcggcgcacucgugcgcaacccccucucccggaacucuacacacgagauguacugggucucaaacgccaccgggaacaucgucaguuccgugaauaugaucagccgaaugcugaucaaccguuucaccaugaagcauaagaaggccaccuacgagccggacguggaccugggcuccgggacgcggaacaucggcaucgagaacgagauucccaaccucgacaucaucgggaagcggauugaaaagaucaaacaggagcacgagaucuccuggcacuacgaccaggaccacccauacaagacuugggcuuaccauggcagcuacgaaacaaagcagacugggucugcuuccagcauggugaacggggugguacgccugcugacgaagccaugggacguugucccgauggucacccaaauggccaugaccgacaccacccccuucggccagcagcgcguguucaaggaaaagguggacacccggacccaggagcccaaggaggggaccaagaagcucaugaagauaaccgccgaguggcuguggaaggaacucggaaagaagaaaacgccccgcaugugcacccgggaagaauuuacccgcaaggucagauccaacgccgcccucggcgccauauucacggacgaaaacaaguggaaguccgcccgcgaggccgucgaggaugggcgguucugggaacugguggaucgcgagcggaacuuacaucucgaggguaagugcgagaccugugucuauaacaugauggggaagcgcgagaagaagcuaggcgaguucgggaaggccaagggcucccgggcgauuugguacaugugguugggugcccgcuuccucgaguuugaagcccugggguuccucaaugaagaccacugguucagcaggggaaacagccucuccgggguugagggcgaggggcugcaccgucugggcuacauccuccgggauguugccaagaaggaaggcggcgccauguacgccgacgacaccgcuggcugggacacacggaucaccuuagaggaccuaaagaacgaggaaauggugaccaaccacaugaagggggaacacaagaagcucgccgaggcgaucuucaagcugaccuaccagaacaagguagugcgagugcaacgcccgacaccccgggguacggugauggacaucaucagccgccgcgaccaacguggguccggccaggucggcaccuacggguuaaacaccuucaccaacauggaggcccagcugauuagacagauggagggcgagggcaucuucaagagcauccagcaccuuacugcgacagaggagauagccguccaaaacuggcuggcccggguaggccgcgaacgguugucacgcauggcgaucucuggcgacgacugugucgugaagccuaucgacgaccgguucgccucagcguuaaccgcccugaaugacauggggaaaguacgcaaggacauccagcagugggagcccagucggggcuggaacgacuggacccaggucccguucugcucccaucacuuccacgagcucgugaugaaggacggucgcguguuaguagugcccugccgaaaccaggacgaacugauaggcagggcccggaucagucagggggccggcuggucgcucaaggagacggcgugccugggcaaguccuacgcacagauguggaccuugauguacuuccacaggcgugaccuacgacuggccgccaaugccaucugcuccgcagugcccagucacuggguccccaccucccggacuaccuggagcauccacgccaagcacgaauggaugacgaccgaggacaugcuggccguauggaaucgaguguggauccaggagaacccguggauggaagacaaaacccccgucgaguccugggaggaggugcccuaccucggaaaacgggaggaccaguggugugggagccugaucgggcugaccucacgcgccacgugggcuaagaacauccagaccgcgauaaaccaggugcggucccucauugggaacgaggaguacacagacuacaugcccagcaugaagcgcuuccggagggaagaggaggaggccgguguccugugguga

SEQ ID NO: 25042 - RNA, 9876 nt, Artificial Sequence
  derived and/or modified CDS sequence (opt11) from DENV-2__FJ744706__SS-prME
accgcgggcgucaucgucaugcugauccccaccgccauggcguuccaccucaccacccgcaauggggagccccacaugaucguggggcgacaggaaaaggggaaguccuugcuguucaaaaccgaggauggcgugaacaugugcacgcucauggcgauagaccugggggaguuaugcgaggacaccaucaccuacaaaugcccucugcugcgccagaacgagccugaagacaucgauugcuggugcaauagcaccagcaccugggucacguacgggacaugcaccaccacuggcgaacaucggcgcgaaaagcgguccguagcgcuggugccccacgucgggaugggccucgagacccgcacugagaccuggaugagcagcgagggagccuggaagcacgugcagcggaucgagaccuggaucuuacgucacccgggcuucaccaucauggccgcgauacucgccuauacgaucgguaccacgcacuuccagcgggcccucaucuucauccuacugaccgccguggcgccaucaaugaccaugcgcugcaucggcaucagcaaccgggacuuugucgagggcguaagcgggggcaguuggguggacaucguacuagagcacgggagcugcgugaccacgauggccaagaauaagccaacccuggacuuugaguuaaucaagaccgaggccaagcaacccgcgacccuccgcaaauacugcauugaggcuaaacugacgaauaccacuacggagucccggugcccgacgcagggugagcccucucugaaugaggagcaggacaaacgcuucaucugcaagcauuccaugguugauagaggcugggggaauggcuguggccuguucggcaagggcgguaucgugaccugcgcgauguucacgugcaaaaagaacauggaaggcaaggugguccagcccgagaacuuggaauacacgaucgucaucacgccccacagcggagaggagcacgccguuggcaacgacaccggcaagcacggcaaggagaucaagaucaccccacaguccagcaucaccgaggccgagcugaccggguacggcacgguaaccauggaguguagccccaggaccggcuuggauuucaacgaaauggucuuacugcagauggaggauaaggccuggcucguacaccggcagugguuccuggaucugccucuccccuggcugccgggggccgacacccagggcagcaacuggauccagaaggagacgcuggugaccuucaagaacccccacgcgaagaagcaagacgucgugguacucgggucccaagaaggcgccaugcacaccgcccugaccggggcuacggagauucagaugagcagcggcaaccuccuguucacugggcaccugaagugccgucugcggauggacaagcuacaacugaaggggaugucauacagcaugugcaccggcaaguucaagaucgugaaggagaucgccgagacgcagcaugggacgaucgugauccgcguccaguacgagggagacgggucucccugcaagauccccuuugagaucaccgaccuggagaagcggcacguccucgggcgccuaauaacugugaacccuaucgucaccgagaaggacagccccgugaacauugaagcugagccgcccuucggcgacuccuacauaaucaucgggguggagccgggccagcugaagcuuaacugguucaagaaggggagcuccaucggccagauguucgagacgaccaugcgcggcgcaaagcggauggccauccuuggggacaccgccugggacuucggcagccucgggggcgucuucaccuccaucgggaaggcacuucaccagguguucggcgcgauuuacggcgccgccuucagugggguguccuggacgaugaagauccugauuggggucaucaucaccuggaucgggaugaacucucgcucgacgagccuguccgugagccuggugcucgucggcgucgugaccuuauaccugggggccguagugcaggcggacaguggguguguggucagcuggaagaacaaagagcucaaguguggguccgguaucuucaucacagauaacguucacaccuggaccgagcaguacaaauuucagccugagagcccuagcaagcuugcauccgccauccagaaggcgcacgaggaaggcaucuguggaauccggucugucacucgccuagagaaucucauguggaagcagauuacccccgaacugaaccacauucuguccgagaacgaggucaagcucacgauuaugaccggugacaucaagggcaucaugcaggcaggcaagcggucacugcgcccgcagcccaccgagcugaaauacuccuggaagacgugggguaaggcgaagaugcugagcaccgggagucacaaccagaccuuucugauugacggccccgagaccgcugagugccccaauacaaaccgggccuggaacagccuggaaguagaggacuaugguuucggcguuuucaccaccaacauauggcugaagcugcgggagaagcaggacguuuuuugcgacuccaaacugaugagcgccgcuaucaaggauaaccgggcgguccacgccgacaugggcuacuggaucgaguccgcccuuaacgauaccuggaagauggagaaggcaaguuuuaucgaggugaaauccugccacuggcccaagucccacacccugugguccaauggaguccuggagagcgagaugaucauccccaagaacuuugccggccccgucucccagcacaacuaccgcccgggguaccacacacagaccgcaggccccuggcaccucgggaagcuugagauggacuucgacuucugugagggcaccaccguggucgucacggaggacugcggcaacaggggucccagccugaggaccaccaccgccagcggcaaacucaucacggaaugguguugccguuccugcacccugcccccgcuacgcuaccgcggggaggacggcugcugguaugggauggagauccgcccacucaaagagaaggaggagaaccugguuaacagccuggucaccgccggccacgggcagaucgacaacuuuucacucgggguauugggcauggcccuguuccucgaggagaugcugcggacccgcaucgggacgaaacacgcgaucuuacucguggccgucagcuuugugacccucaucacuggcaacaugucguuccgggaucuggggcgugucauggucauggugggcgccacaaugacggacgauauuggcaugggugugaccuaccucgcccuauuggccgcguucaagguccgccccacguucgcggccgggcuauuacugcggaagcucaccuccaaggagcugaugauggccacgaucgggauagcccuacugagucaaaguaccauccccgagaccauccuggagcugaccgacgcgcucgcacugggaaugauggugcugaaaaucgugcgcaacauggagaaguaccagcuggccgucacgaucauggccaucuccugcgugcccaacgccguaauccugcagaaugccuggaaggugagcugcaccauccuggccgccguguccgucagcccccugcuguuaaccuccagccagcagaaggcugauuggaucccccuagcgcugaccaucaagggccugaaccccacggccaucuuccuaaccacccugucccggaccagcaaaaagcgcucuuggccguugaaugaggcuaucauggccguuggaauggugagcauccucgcauccagccugcugaaaaacgacaucccgaugacgggcccccucguggccgggggccugcugacugugugcuauguacucaccgggcggagcgcugaccuggaguuggagcgcgccgccgacgucaaaugggaggaucaggccgagaucuccggcagcucccccauccucucuauaaccaucuccgaagacggcuccaugucgaucaaaaacgaggaggaagagcagacgcucaccauccucauacggaccggacuccuggugaucagcggcguauuccccgucucuauacccaucaccgcggccgccugguaccucugggaggugaagaagcagcgcgccgggguauuaugggacguccccaguccgccgcccguggagaaagccgagcuggaggacggcgcauacaggaucaagcagcgcgggauccugggcuacucccagaucggugccggaguguacaaggagggcaccuuccacacgauguggcacgucacgcgcggugcggugcucaugcaccggggcaagaggaucgagcccagcugggcagacgugaagaaggaccucaucuccuacggcggcggcuggaagcuugagggggaguggaaggagggcgaggagguccaggugcuggcucuagagcccgggaagaacccacgcgccgugcaaacgaaacccggcauuuucaagaccaauacggggaccauaggcgccgucagccuggacuucucccccgguaccucugggucccccauaguggaccggaagggcaaggugguaggguuauacgggaacggcguggucacccgcagcggggccuacgucuccgccaucgcccagacggagaaguccauugaagacaaccccgagaucgaggacgacaucuuccguaagaagcgccuaacgaucauggacuugcaccccggcgccgggaaaaccaagcgguaucuccccgccaucgugcgcgaggcuaucaagcggggccugcgcacccugauccuggccccgacgcgcguggucgcugcugagauggaagaggcccuccggggacuaccaauccgcuaccagacccccgccaucaagaccgaacacaccggccgggagaucguggaccugaugugccaugccacguucaccaugaggcuccugagccccguccgggucccgaacuacaaccugauaaucauggacgaggcgcacuucaccgaucccgcguccauugcagcgcgcggcuacaucagcacccggguagagaugggugaagccgcugggaucuuuaugacggccacgccgcccgggucccgcgacccguuuccccagagcaacgcccccauuauggaugaggagcgggagauccccgaacgcagcuggaacaguggccacgagugggugaccgacuuuaaggggaagaccgucugguuugugccgagcaucaaagccggcaacgacaucgcggcaugccuucggaagaacggcaagaaggugauccagcugagccguaagacguucgacagugaguacgucaaaacccgggcuaacgacugggacuucgucgugaccaccgacaucagcgagaugggggccaacuucaaggccgaaagagucaucgauccucggcgcugcaugaaaccagugauccugacggacggcgaggagcgggugauccucgcagggcccaugccggucacccacuccagcgccgcucagcgcagaggccgcaucggacgcaaccccaagaacgaaaaugaccaguauauauacaugggcgagccccuggagaaugacgaggacugcgcccacuggaaggaggccaagaugcugcucgacaacaucaacacucccgagggcaucaucccguccauguucgagcccgaacgggagaagguggacgcgauugacggggaguaucgcuuacggggggaggcccgcaagaccuuuguggaccugaugcggcgcggggacuugcccgucuggcuggcauacaagguggccgccgaaggcaucaauuacgcggaccggaaguggugcuucgacgggaucaaaaacaaccaaauccucgaggagaacauggagguugagauauggacgaaagagggagaacgaaagaagcucaagccgcgguggcuggacgcccgcaucuauucggacccccucgcccucaaggaguucaaggaguucgccgccggccggaagucccuaacccugaaccucaucaccgagaugggcagacugcccaccuucaugacgcagaaggcccggaacgcacuugacaaccuggccgucuugcauaccgccgaggcgggagggcgcgcauacaaucacgcgcugagcgagcucccugagacuuuggagacccugcuccuccugacgcuccuggccaccgugaccgggggcaucuuccuguuucucaugagcgggaaaggcaucgggaagaugacccugggcaugugcugcaucaucaccgcuagcauccuacucugguacgcgcagauccagccccacuggaucgccgccuccaucauccuggaguucuuccugaucgucuugcuaauccccgagcccgagaaacagcggacgccccaggauaaccagcugaccuacguggugaucgccauccucacaguuguggccgcgaccauggccaacgagaugggguuccuggagaagacgaagaaggaccuuggcuuaggcagcaucaccacccaggagagcgaguccaacauccuggacauugaccuucgcccggccagugccuggacacucuacgccguagcgacaaccuucgugacccccaugcugcggcacucuaucgagaacucguccguuaacgugagccuaaccgccaucgccaaccaggccacgguccucauggggcuggguaaaggguggccccuguccaaaauggauaucggcgugccccuccucgcuaucgggugcuacagccaggugaacccgaucacacugaccgccgcccuccuucuguugguagcccauuacgccaucaucggccccggccuccaagcgaaggccacccgcgaggcucagaagcgggccgccgcggggaucaugaagaaccccacggucgacggcauaaccgugaucgaccuggagcccauaccguacgaccccaaguucgagaaacaguuagggcaggucaugcugcugaucuugugcguuacccaggugcugaugaugcguaccacgugggcccugugcgaggcacuuacacuggccaccggccccaucuccacccugugggaagggaaccccggccgguucuggaacacgaccaucgccgucucuauggcgaacaucuuccgcggcaguuaccucgccggggccggucuguuguuuagcaucaugaaaaacaccaccuccacgcgccgggggacaggcaacaucggcgagacccucggggagaaguggaagucccgccugaaugccuuaggaaaguccgaguuccagaucuauaagaaguccgggauccaggagguggaccggaccuuggcgaaggagggaaucaagcggggggaaacagaccaccacgccgugucccgggggagcgccaagcugcgcugguucgucgagcggaauauggugaccccggaggggaagguggucgaccuggggugcggccgcgggggauggucuuacuacugcggcggccucaagaacgugcgggaggugaagggccugacaaagggcggccccgggcacgaggagcccauccccaugagcaccuacggcuggaaccuggucagacuucagagcgggguggacguuuuuuuuacgccgcccgaaaagugcgacacccugcugugcgacaucggcgaaagcagccccaacccgaccauugaggcaggcaggacccuccgcgugcuuaaucugguggagaacugguugaacaacaacacccaauucuguaucaagguucuuaacccguacaugcccuccgucauugagaagauggaggcccugcagcggcaguacgggggcgcgcucgugcggaacccucugagccggaacuccacgcacgagauguacugggugagcaacgcaaccgggaacaucgucuccagcgugaacaugaucagcaggaugcugaucaacagguucaccaugaagcauaaaaaagccaccuacgagccugacguugaccugggcagcggcacgcgaaacauaggcaucgaguccgagauccccaacuuagauaucaucggcaagcggaucgagaagauaaaacaggagcacgaaaucagcuggcauuacgaccaggaccaccccuacaagaccugggcuuaccacgggagcuacgagaccaagcagacuggcagcgcuuccagcaugguuaacgggguggugcggcugcugacuaagccaugggacgucgugccgauggugacccagauggcgaugaccgauaccacgcccuucggccagcagcgcgucuucaaggaaaagguggacaccaggacccaggagcccaaggaaggaacgaagaagcucaugaaaaucacggccgaauggcuguggaaggagcuggggaagaaaaagacgccccgcaugugcacccgggaggaguucaccaagaaggugcgcggcaacgcugccuuaggagcgauuuuuacggaugagaacaaguggaaauccgcgcgggaggccguugaagacggccgcuucugggaacugguggaccgagagaggaaccugcaccucgaggggaagugcgagacgugcguuuacaacaugaugggcaagcgggagaagaaacugggcgaguucgggaaggccaagggcagccgcgcgaucugguauauguggcugggggcgcgguuccuagaguucgaggcccugggcuucuugaacgaggaccacugguucucccgcggcaacagccucagcggcgucgagggcgaaggccuccaucggcugggcuacauccuccgcgacguggggaaaaaggagggcggggccauguaugccgaugacacggcgggcugggacacccgcaucacgcuggaggaccugaaaaacgaggaaauggugaccaaucauaugaagggcgagcacaaaaagcucgcggaagccaucuucaaguugacguaccagaacaaggucgugcgcguccagcggccgacgccucgcgggacggugauggacaucauaucccggcgcgaccagcggggcucuggccagguggggaccuacggacugaacacguucaccaacauggaggcucaacucauucgccagauggagggggagggaauauucaaguccauccagcaccuuacggccaccgaggagaucgccguccagaacuggcuggcucgcguggggcgggaacgguuaagccggauggccauuuccggcgacgacugcguggucaagcccaucgacgaccgcuucgccagcgcccugaccgcccuuaacgacaugggaaagguacggaaggauauccaacagugggaacccucgcgaggcuggaacgauuggacacaggugccguucugcagccaucacuuccacgagcucgucaugaaggacggcagagugcugguaguucccugccgaaaccaagacgagcuaaucgggcgggcgcggaucucccagggcgcgggguggagccucaaagagaccgccugccuuggcaaguccuacgcccagauguggacgcuaauguacuuccaccggcgugaccuucggcuggccgcgaacgcgaucugcagcgccguccccucccacugggugccaaccucccgcaccaccugguccauucacgccaagcacgaguggaugacgaccgaggauaugcuggcggucuggaaccggguguggauccaggagaacccguggauggaggacaagacgcccguugagagcugggaggagguccccuaucucgggaaacgcgaggaccaguggugcggcuccuugaucggccuaaccucacgggccacgugggccaagaacauccagaccgccauuaaccaggugcgcagccucaucgggaacgaggaguacaccgacuacaugcccuccaugaagcgguuucgccgcgaagaggaggaggccggcgugcucugguaa

SEQ ID NO: 25043 - RNA, 9876 nt, Artificial Sequence
  derived and/or modified CDS sequence (opt11) from DENV-2__FJ744707__SS-prME
acagcgggcgugaucgucaugcugaucccuacggccauggcauuccaccucaccacgcgcaacggggagccccacaugauagugggccggcaggagaagggaaagucucuccuguucaagaccgaggacggcgugaacaugugcacccucauggccaucgaccugggggagcucugcgaggacacgaucaccuacaagugcccucuccugcggcagaacgaacccgaggauaucgacugcuggugcaacagcaccucaaccuggguaaccuaugguacuuguaccacaacgggagagcaccgucgcgagaagcggagcguggcccuggugccccacgucgggaugggacucgagacccgcacugagaccuggaugagcagugagggagccuggaaacacguacagcggaucgagacauggauccugcgccacccuggauucacuaucauggccgcgauccuggccuacaccaucgggaccacgcacuuccagcgggcacucaucuuuauccugcugacugcagucgcgccgagcaugacaaugcgcugcauuggcaucagcaaucgggauuucguggaggguguuagcggcggcucguggguggacaucguucucgagcacgguagcugcgugaccacgauggcaaaaaacaaaccuacucuggacuucgagcugaucaagaccgaggccaaacaacccgccacccuacgcaaguacuguaucgaggccaagcugacaaacacaaccaccgagagccgguguccgacgcagggcgaacccagccugaacgaggagcaagacaagcgguucaucugcaagcacuccaugguugaccgugggugggggaacggaugugggcuguucggcaagggcggcaucgugacaugcgcgauguucacgugcaagaagaacauggagggcaagguuguucaacccgagaaccucgaguacacaauagucaucacgccccauagcggggaggagcacgcagugggcaacgacaccgguaaacacggcaaggagaucaagaucaccccgcagucaagcaucaccgaggccgagcuuacgggguacggaacgguuaccauggagugcagcccacggacaggacucgauuucaacgagaugguccugcugcaaauggaggacaaggccuggcucguccaccggcagugguuccuugacuugccccuccccugguugccgggcgccgauacccagggcagcaauuggauccagaaggagacccuggugaccuucaagaacccccaugcgaagaagcaggacgucgugguucucggcucccaggagggcgcaaugcacaccgcgcugacgggcgccacggagauccagaugagcagcgggaacuuauuauucacggggcaccugaagugccguuuacggauggauaagcuacagcuaaagggcauguccuauaguaugugcacagguaaguucaagaucgucaaagagaucgccgagacccaacacggcacgaucgugauucgcgugcaauacgagggcgacggcucccccuguaagauccccuuugagaucaccgaccuggagaagcgccacgugcucgggcgcuuaauuaccguuaacccgauugucaccgaaaaggacagccccgugaacauugaggccgaaccgcccuucggggauuccuacauuauaaucggcguggagccgggacaacugaagcucaacugguucaagaagggcuccuccaucggccaaauguucgagacgaccaugcgcggcgccaagcggauggccauccuaggggacaccgccugggacuucggaagucucggggguguguucacgucaaucggcaaggcccuccaccagguguucggcgcgaucuauggcgcagcuuucagcggagugaguuggacaaugaagauucugaucggcgucaucauaaccuggauuggcaugaacagucgcuccaccagccuuuccgugagccugguguuaguaggcguuguaaccuuguacuuaggagccgucguucaagcggauucggguugcguggugucauggaaaaacaaagagcucaaauguggcagcggcaucuucaucacggauaaugugcacaccuggaccgaacaauauaaguuccagccggagucccccagcaagcuggcguccgccauccagaaggcccacgaagagggcaucugcgggauaaggagcgugacccgacuggaaaaccucauguggaagcaaaucacacccgagcugaaccauauccuguccgagaacgagguaaagcucaccaucaugaccggagacauuaagggcauuaugcaggccgguaagcggagccuucgcccgcagcccaccgagcugaaguacuccuggaagacguggggcaaagccaagaugcucuccaccgagucucacaaucagacauuccugaucgacgggcccgaaaccgccgagugcccgaacaccaaccgggccuggaacagccuggagguggaggacuacggcuuugggguguucaccaccaauaucuggcucaagcuccgcgagaagcaggacgucuucugcgacagcaaauugaugucagccgccauuaaagacaaccgagcaguacacgcggacaugggguacuggaucgaguccgccuuaaacgacaccuggaaaauggagaaggcuagcuucauagaggugaaauccugccacuggccaaagagccacacccugugguccaauggcgugcuggagagcgaaaugaucauccccaaaaacuuugcggggcccgugucccaacacaacuauaggccgggcuaccacacacagacugcgggcccauggcaucucgguaagcuggaaauggacuucgacuucugcgaagggaccaccguaguuguaaccgaggacugcggaaaccggggccccagccugcgaaccaccaccgccucagggaagcucauuacggaguggugcugucggaguugcacauuacccccgcugcgcuacaggggugaagaugggugcugguacggcauggagauacgcccccucaaggagaaggaggagaaccuggugaacucacucguuaccgccgggcacggucaaaucgacaacuucucccucggcguacugggcauggccuuguucuuagaggagauguuacggacccggaucgguacgaagcaugcgauccugcucguggcugucagcuucgugacccugaucaccgggaacaugucguuccgggacuuaggucgcgugauggucauggugggggccaccaugacggacgauaucgggaugggugugaccuaccucgcucugcuggcagcguuuaagguacgccccaccuucgccgccgggcuccugcugcggaagcugaccucgaaagagcugaugauggccacaaucggcaucgcacugcucucacagagcacuauaccugagaccauucuggagcugacagaugcgcucgcccuggggaugauggugcugaagaucgugcgaaacauggaaaaguaccaacuggccgucaccauuauggccauuuccugcgugccgaacgcugugauccugcagaacgcauggaaagucagcugcaccauacuugccgccgugucugucucuccgcuccugcugaccucgagccagcagaaggcggacuggauuccucuugcgcugaccaucaaaggucugaaccccacggcgaucuucuuaaccacccugagccggaccucgaaaaagcgcuccuggccgcuaaacgaggcgaucauggccguggguauggugagcauccuugcuuccagcuuacugaagaacgacauccccaugacgggcccacuggucgccggcggguugcugaccgucuguuacguacuaaccggacggagcgccgaccuugagcuggagcgcgcggccgacgucaagugggaggaccaggcagagauaucaggaucuucccccauccucagcaucaccauuucagaagacgggagcaugucuaucaagaacgaggaggaggagcagacucugaccauucugauacggaccggguugcuugugauaagcggcguguuuccgguauccaucccaauaacggcggccgcgugguaccugugggagguuaagaaacagcgcgcaggggugcucugggaugugcccagcccgccgccaguggagaaagccgagcuggaggacggugcguaccggaucaaacagcguggcauccuaggguacagccagaucggagccgggguuuacaaagaagguaccuuucauaccauguggcauguuaccagaggcgccgugcucaugcaucgcgggaagcggaucgagcccucgugggccgacgugaagaaggaccugauuuccuaugggggggguuggaagcuggagggugaguggaaggagggugaggagguacaggugcucgcccuggagcccgguaagaacccccgugcggugcagacuaaaccgggaauauuuaagacaaacacaggcacaauuggugccgucagucuagauuuuucgcccgggaccucaggcucucccauuguugaucggaaggggaagguggugggccucuacgggaacggaguggugaccaggagcggcgcauacgucuccgccaucgcgcagacggagaaaucaaucgaagauaaccccgaaauugaggacgacaucuuccggaagaagcgccugacgaucauggaccugcauccuggagccggcaagaccaagcgguaccucccggcaauagugcgcgaggccauaaagcggggacugcgcacccugauccuggcucccacccgggugguggcggcggaaauggaggaggcguugcggggccugccuauccgcuaccagacccccgccaucaagaccgagcacaccgggcgagagaucguggaucugaugugccacgccacguucacaaugcgccuccugagcccuguucggguaccgaacuacaaucuaaucaucauggacgaagcccacuucaccgacccugcauccaucgccgcuaggggcuauaucucgacgcgcguggaaaugggcgaggccgcggggaucuuuaugaccgccacgccgcccgguagcagggacccauucccgcaauccaacgcgcccaucauggacgaagagagggagauacccgagcgcuccuggaacucaggccaugagugggugaccgacuucaagggcaagaccgucugguucgugccgucuaucaaggcugggaacgacaucgcggccugccugcggaagaacgguaagaaagugauccagcucagccgcaagacuuucgacuccgaguacgucaagaccagggccaacgacugggacuucguggugaccaccgauauaagcgagaugggcgccaacuuuaaggccgagcgcgucaucgacccccggcgaugcaugaagcccgugauccugacagacggugaagaacgcgugauccucgcagguccuaugccgguaacccacuccagcgccgcccagcgccgugggcgcauaggccgcaaccccaagaacgagaacgaccaguacaucuacaugggggagccucuggagaacgacgaggacugcgcccacuggaaggaggcgaagaugcugcucgacaacauuaacacccccgagggcaucaucccgucgauguucgaacccgagcgggagaagguggacgcgauugacggcgaguaccgccuacgaggugaagcccgcaagaccuucguggaccugaugcggcgcggcgaucuccccguuuggcuggccuacaaaguggccgcggaggguaucaacuacgcggacaggaagugguguuucgacggcauaaagaacaaccaaauccuagaggagaacauggagguggagaucuggacgaaggagggggagcgcaagaaacucaaaccgagaugguuagacgcccguauauacagugacccccuggcacucaaggaauuuaaggaguucgcagccgggcggaagucccugacccugaaucucaucaccgagaugggucggcuccccaccuucaugacgcagaaggcacggaaugcccuggacaaccuugccgucuugcacacagcagaggccggcggccgcgccuacaaccacgcccugagcgaguugcccgagacucucgaaacacugcuccuguuaacucuccuggccaccgugacagggggcaucuuuuuauuccucaugagcggcaagggcaucggcaagaugacccuugggaugugcuguaucaucaccgccagcauucugcucugguaugcgcagauacagccgcauuggauugccgccucaaucauccuggaguucuuccugaucgugcuccugauccccgagccagagaagcaacggaccccacaggacaaccaacuuaccuacguggugauagcgauccuaaccgucguggccgcgaccauggcaaacgagaugggcuuccuggagaagacgaaaaaggaccucgggcucggcagcaucacaacacaggaaagcgaguccaacauccucgauaucgaccugcgcccugcuucggcuuggaccuuguaugccguggcgacgacguucgucacccccaugcugcggcacuccaucgagaacagcuccgugaacgugucgcugacugccauugccaaccaggccacgguccuuaugggccuggggaagggcuggccgcugucaaagauggacaucggggugccccuccuagcgaucggcugcuacucucagguaaacccgaucacccugaccgccgcccugcugcugcucgucgcucauuacgccaucauagggccgggccugcaggcaaaggcuacucgcgaggcucaaaagcgggccgcagcgggcauaaugaaaaaccccacgguggaugggaucaccgugaucgaccuggaacccaucccguacgacccaaaguucgagaagcagcucggccaggucaugcugcugauccucugcgugacccaggugcugaugaugcgcaccaccugggcccuaugcgaggcccucacacuggccacagggcccaucaguacgcugugggagggaaauccugggcguuucuggaacacgacaaucgccguaagcauggcgaacauuuucagagguuccuaccuggccggcgccgggcugcuguucucgaucaugaagaauacaaccuccacgaggcgggguaccgggaacaucggcgagacccucggcgaaaaguggaagagccgcuuaaacgcccuggguaaaagcgaauuucagaucuacaagaaauccggcauccaggagguagaccguacgcuagcgaaggaagguaucaaacguggugagacggaucaccaugccgugucccgggggagcgcaaagcugcgcugguucgucgagcggaacauggugaccccggagggcaaggucgucgaccugggcugcgggcgcggcggguggaguuacuacugcggcggacucaagaaugugagggaggucaagggccugacgaagggcgggcccggccacgaggagcccaucccaaugagcacguacggguggaaucugguccgccuccagucgggcguggacguauucuuuacuccgcccgagaagugcgacacucugcuuugcgacauaggugaguccucacccaaccccaccaucgaagccggccggacccuccgcgugcugaacuuaguugagaauuggcuuaacaauaacacgcaguucuguaucaagguacucaauccguauaugccguccguaaucgagaagauggaggccuuacagcggcaauacggcggagcgcuuguccgcaaccccuugagccggaacuccacccacgagauguacugggugagcaacgcgaccggcaacauagucuccagcgucaacaugauuucccgcaugcugaucaaccgguucacgaugaagcacaagaaggcuaccuacgaaccggacguggacuuagguagcgggacgcgcaauaucggaaucgaguccgagaucccgaaccucgacauuaucggcaaacggauagaaaagaucaagcaggagcacgagauuagcuggcacuacgaccaggaccaccccuauaagaccugggccuaucacggauccuacgagaccaagcagaccgggagcgcauccagcauggucaauggcguggugaggcuguugacaaaacccugggacgucguaccgauggugacgcagauggcgaugacggacaccacgccguucgggcagcagcgugucuucaaagagaaaguagacacacggacgcaggagcccaaggaagguacuaagaaacuaaugaaaauaacggccgaguggcucuggaaagagcugggcaagaagaagacgccucgcaugugcacccgugaggaauucaccaagaaggugcgcucaaacgccgcccucggugccaucuuuacggaugagaacaaguggaagucggcgcgggaggcggucgaggacgggcgcuucugggagcugguagaccgggaacgaaaccugcacuuggaggggaagugcgagaccugcguauacaauaugaugggcaagcgggagaagaagcugggugaguucggcaaggccaagggcucgagggcuaucugguacauguggcucggggcccguuuccucgaauucgaggcacugggcuuccugaacgaggaucauugguucagcaggggaaacagccucuccggagucgagggggagggccugcaucggcugggguacauucugcgggacguagguaagaaggaaggcggggccauguacgccgacgacaccgccggcugggacaccagaaucacgcuggaggaccucaaaaacgaagaaauggucaccaaccacaugaagggggagcacaagaagcucgcggaggccaucuucaaacugaccuaucagaacaagguagugcgcguucagcggccgaccccacgcggaacgguaauggacaucaucagcagacgcgaucaaagaggcucaggccaggucggcaccuacgggcuuaauaccuuuaccaauauggaggcccagcucaucaggcagauggagggcgagggcaucuucaagagcauccagcaccugacggcgaccgaggaaaucgcggugcaaaacuggcuugcccgcguagggagggagcgucuauccagaauggccauuuccggcgacgacugcguagugaagccgaucgacgaccgcuucgccucugcccugaccgcccuaaacgacaugggcaaaguucgaaaagacauccagcaaugggagcccagccgcggcuggaaugacuggacccaagugccguucugcucucaccacuuucacgagcucgucaugaaggaugggagagugcuaguggcgccgugccgcaaucaggacgagcuaaucggccgggccagaaucagucagggugccggguggucccucaaggagacggccugccugggcaagagcuaugcccagauguggacccuaauguacuuccaccggcgggaccuccggcuggcugcgaacgccaucugcucagccgugcccagccacuggguacccacgucccgcacaacauggagcauccacgcuaagcaugaguggaugacgaccgaggauaugcuugccguguggaaccgggucuggauccaggagaauccguggauggaagauaaaacacccguugaaucgugggaggaaguaccguaccuuggaaaacgcgaggaccaguggugcgggagccugaucggccugaccucgcgggccacgugggcaaagaacauucagacggcgauuaaccagguacgauccuugaucgggaacgaggaguacaccgauuacaugccgucuaugaaacgguucaggcgagaggaggaagaggcgggcgugcugugguaa

SEQ ID NO: 25044 - RNA, 9876 nt, Artificial Sequence
  derived and/or modified CDS sequence (opt11) from DENV-2__FJ744704__SS-prME
acugcaggcgugaucgucaugcucauucccaccgccauggcguuccaucucaccacccgcaacggggagccccacaugaucgucggcaggcaggagaaagggaagucgcugcuguucaagaccgaggacggcgugaauauguguacacucauggccaucgaucugggggaguugugugaggauaccaucaccuacaaaugcccccuccugcggcagaacgagcccgaggacauugacugcuggugcaacaguaccagcaccugggugacauacgggaccugcaccaccaccggcgagcaucgucgugagaagcgaagcguugccuuggugccacauguggggaugggccuggagacccguacugagaccuggaugagcucagaaggugccuggaagcaugugcagcggaucgagacguggauacugcgccacccgggcuucaccaucauggcggcgauuuuagcuuacacaaucgggaccacgcacuuccagcgggcucuuaucuuuauacugcugaccgccguagccccaagcaugaccaugcgaugcaucgggaucuccaaccgggacuucgucgagggcgugagcgggggcuccuggguggacaucguccucgagcacggaagcugcgugaccacgauggccaagaacaagcccacucuggacuucgagcugaucaagaccgaggccaagcagcccgccacccuccgcaaguacuguauugaggcuaagcucacgaacaccaccacugagucccggugcccuacgcagggcgagcccagccugaacgaggaacaggacaagcgcuucaucugcaagcauuccauggucgacagaggcugggggaacggcugcggccuguucggcaagggcgguaucgugacuugcgcaauguucacgugcaagaagaacauggagggcaagguagugcagcccgagaaucuggaguacaccauugucaucacgccccacagcggggaggagcaugccgugggcaaugacaccgggaagcacgggaaagagaucaagauuaccccgcagaguagcaucaccgaggcagagcuaacugguuacgguacggugaccauggagugcagcccccgcaccggccucgacuucaacgaaauggucuuacugcagauggaggacaaagcguggcucgugcaccggcagugguuccucgaccugcccuugcccuggcuucccggcgccgacacccaggguucaaacuggauccagaaggagacucuggugacguucaagaacccccaugcgaagaagcaagaugucgugguccucggcucccaggagggcgccaugcacaccgcccugacaggggcaacggagauccagauguccagcggcaaucuacuguucaccggccaucugaagugucgcuuacggauggauaagcuccaacugaagggcauguccuacucuauguguaccggcaaguucaagaucguuaaagaaauagccgagacccagcacggaaccaucgugauccgcguccaauacgagggagacgggaguccauguaagauccccuucgagaucacggaccuggaaaagcggcacguacucgggcgccugaucaccgugaacccgaucgugaccgaaaaggacagccccgucaacauagaagcggagccgcccuucggcgacuccuacaucaucaucgggguggagccgggccagcugaagcugaacugguucaagaaggggagcuccaucggccagauguucgaaacuaccaugcgcggggccaaacgcauggccauccugggagauaccgccugggauuucgggagccucggaggggucuucacgucaaucgggaaggcccuacaucaggucuucggggcgaucuacggugccgccuucagcgggguguccuggacgaugaagauccugaucggcgugaucaucacauggauaggcaugaacagccgcuccaccucccuguccgugagccuggugcucguaggcguggugacccuguaccuaggggccaugguccaggccgacuccggcugcguugugagcuggaaaaacaaggagcugaagugcggaucgggcaucuuuaucacggacaacgugcacaccuggacggagcaguacaaguuccagcccgaaagccccuccaagcuggccuccgccauucaaaaggcccacgaggagggcauuugcgggauccggucagugacucgccuggagaaccucauguggaagcagauuacgcccgaacugaaccacauucuguccgagaacgaggugaaacucacaaucaugaccggugacauccggggcaucaugcaggccggcaagcgcagccugcguccgcagcccaccgagcugaaguauuccuggaagacgugggguaaggcgaaaaugcugucgacggagucucacaaccagaccuuccugauagacggaccggaaaccgccgagugccccaacaccaaccgcgccuggaauagccuggagguagaggacuacggcuucgguguguucacgacuaacaucuggcuuaagcugcgggagaagcaggacgucuucugcgacuccaaacucauguccgcggccauaaaggacaaucgcgcgguccaugccgacaugggcuacuggauugaguccgcccucaacgacaccuggaagauggaaaaggccagcuucauugaggugaagucgugccacuggcccaagagccacacccucugguccaacggcgugcuggagagcgaaaugaucauccccaagaacuucgcugggcccgucucucaacacaauuaccggcccggguaccacacgcagacagcgggaccuuggcaucucggcaaacuggagauggacuucgaccuaugugaggggaccaccgugguggucacggaggacugcgggaaccgcggacccucucuccggacuaccacggcuucuggaaagcuaauuaccgaguggugcugccgcaguugcacccucccaccgcuccgguaccgcggcgaagacgggugcugguacgguauggagauccggccucugaaggagaaagaggagaaccuggugaacagcuuaguuaccgcugggcacggccagaucgacaacuucucacuuggcguucugggcauggcacucuuccuggaggaaaugcugaggacccggaucgggacaaagcacgcuauccugcugguggcuguaucauucgugacccucaucacagggaacaugucauuucgagaccucggccgcgugaugguaauggucggggcgaccaugacggaugacaucggcaugggcgugaccuauuuggcgcuguuagccgccuucaagguccggccgaccuucgccgcugggcuacugcuccgcaagcugaccucgaaagagcuuaugauggccacgaucgggaucgcgcuacugucccaaaguaccauacccgaaaccauccuggagcucaccgaugcauuggcccuggggaugaugguccucaaaaucgugcggaacauggagaaguaccaguuagcgguaacgaucauggcgaucuccugcguaccgaacgccgugaucuugcagaacgcguggaaggugagcuguaccauccucgccgccgucuccgugagcccccugcuguuaaccucaagccagcagaaggccgacuggaucccccuggcguugaccaucaagggccucaaccccaccgcaauauuccuuaccacccugagucgcacuagcaagaagcgcuccuggccgcucaacgaggccaucauggcugugggcaugguguccauccuggcauccagccucuuaaagaacgacaucccaaugacggggccccugguggcaggagggcuccucaccgucugcuacgugcugacaggccgauccgcggacuuggaacuugagcgggccgccgacgugaagugggaggaccaggcagagaucagugggaguucccccauucugagcauuaccaucuccgaggacggcucgauguccaucaagaacgaggaagaggaacaaacucugaccauccuuauacgcaccggccuccuggucauaucagggguguucccgguguccaucccaaucacagcggccgccugguaucucugggaagucaagaagcaacgggccggcgugcugugggacgugcccagcccuccucccguggagaaggccgagcuggaggacggggcauaccgcaucaagcagaggggcauccucgguuacucccaaauaggcgccggcguauacaaagaggggacguuccacacgauguggcacgugacucgcggcgccgugcugaugcaccgggggaagcgcaucgaacccagcugggccgacgugaagaaggacuugaucucuuacggugggggcuggaaacuugagggcgaguggaaggagggggaggaggugcagguccuggcccuggagcccgggaagaauccaagagcgguccaaaccaagcccgggauguuuaagaccaacacaggcacgauuggggccgugagcuuggacuucucuccaggcaccaguggcucucccaucgucgaccgcaaggguaagguggugggguuguacgggaauggcguugucacgcggucaggcgcauacgugucggccauagcgcagacugagaagucaaucgaagacaaccccgagauugaggaugacaucuuccggaaaaagcgucugaccauaauggaccuccauccuggggcuggaaagaccaagcgcuaucugcccgccauagugcgggaggccaucaagcggggucugcgcacucugauccucgcaccgacgcgggucguagcagccgaaauggaggaggcgcugcgcgggcuucccauacgguaccagacccccgccaucaagacagagcacaccgggcgcgagaucgucgaccuaaugugccacgccaccuucaccaugagacugcugagccccguucgcgugccuaacuacaaccucauuaucauggacgaggcgcacuuuacugaccccgccuccaucgccgcccggggcuacaucagcacccgcguagagaugggcgaggccgcggggaucuucaugacggcgacaccgccgggcucccgggacccauucccccagagcaacgcacccaucauggacgaggagcgcgagaucccugagagguccuggaacucggggcaugagugggugaccgacuuuaagggcaagaccgugugguucgucccuuccaucaaggccggcaaugacaucgccgccugucugcggaaaaacggcaagaaggugauucagcucucccggaagacuuucgacuccgaauacgugaagacacgcgccaacgacugggauuucgucgugacuaccgacaucagcgagaugggcgcuaauuucaaggccgagcgggugaucgaucccagacggugcaugaagccuguuauccucacggauggggaggagcgggugauccuggcgggccccaugccggugacccauucgagcgccgcccagcgacgcgggcgcauaggccggaaucccaagaaugagaacgaccaguacauuuacaugggggaaccccuggagaacgaugaggacugcgcgcacuggaaggaggcuaagaugcuccuggacaauaucaacacccccgagggcaucaucccguccauguucgaacccgagcgugagaagguagacgcgauagacggcgaguaccggcugcgaggggaagcucgaaagacuuucguggaccuuaugcgccggggugaccugcccguguggcucgccuacaaggucgcagcagaggggaucaacuacgcggaccgcaaauggugcuuugacggcaucaagaacaaccagauccucgaagagaacauggaaguagagauuuggaccaaggagggcgaacggaaaaagcugaagccgagauggcuggaugcccggaucuacuccgacccucucgcgcugaaggaguucaaggaguucgccgcgggucgcaaaucccugacgcucaacuugaucaccgaaaugggucggcugccaaccuucaugacgcagaaggcccgcaacgcccucgacaaccuggccgugcugcacaccgcggaggccggcggccgggccuacaaccacgcccuaucagaacugcccgagacccuggagacccuacugcugcuaacucugcuggcgaccgucaccggcggaaucuuccucuuccugaugaguggcaaggggauagggaagaugacccuggggaugugcugcaucaucaccgccagcauccuccugugguacgcgcagauccaaccgcacuggaucgccgccagcaucauccuggaguucuuccucaucgugcuccugauccccgaacccgagaagcagcgaacgccccaggacaaccagcucaccuacguugucaucgcaauccugaccguggucgccgcgaccauggccaacgagaugggauuccuggagaagacaaagaaagaccucggucugggcagcauuaccacucaggaaagcgagagcaacauccuggacaucgaucuccggccugccagcgccuggacucuguacgccguugccacgaccuucgugacccccaugcugcgucauagcaucgaaaauucuucggucaacguaagccuuaccgcgaucgcaaaccaagcaacggugcuuaugggccuggggaagggauggccacucucgaagauggacauuggggucccccugcuggcgaucggcugcuauagccagguaaacccgauaacccucaccgccgcgcugcugcuccuggucgcucacuacgccaucauugggcccggccugcaagcgaaggccacccgggaggcccagaagcgcgccgcagcuggcaucaugaagaaccccacgguggacgggaucaccgucaucgaucuugagcccaucccguacgaccccaaguucgagaagcagcuuggccaggugaugcugcucauacugugcgucacccaagugcucaugaugcggaccacgugggcccucugcgaggcucuuacucuggccaccgggcccaucuccacccucugggagggcaaucccgggcgcuucuggaacacgaccaucgccguaagcauggcgaacaucuuccgcggauccuaucuggcgggcgccggguugcuguucucaauuaugaagaacaccaccaacacgcggcguggcacggggaacaucggcgaaacccugggcgagaaguggaaaagucggcugaaugcccucggcaagagcgaguuucaaaucuauaagaaguccggcauccaggaagucgaccgcacccuggcgaaggaggggaucaaacggggcgagacggaccaccacgccgugagcagagggagugccaaguugcggugguucguggagcgcaacauggucaccccagagggcaaggugguggaccucggcugcgggcggggcggguggagcuacuacugcggcgggcuuaagaacguccgcgaaguuaaaggccugacgaagggcggacccggucaugaggagcccauccccauguccaccuacggguggaaccuagugcgccugcagucuggcgucgauguauucuucacaccgcccgagaagugugacaccuuacuaugcgacauuggggagaguuccccuaacccaacuaucgaggccggccgcacccugcgggugcuaaaucucgucgagaacuggcugaacaacaacacgcaguucugcaucaaggugcugaacccguacaugcccagcgugaucgagaagauggaagcccuccaacgcaaguacgguggagcgcucguccggaacccccugucccgcaacucgacgcaugagauguauuggguguccaacgcgaccggcaacaucgugagcuccgucaacaugaucucccggaugcugauaaacagguucaccaugaagcacaagaaagccaccuacgagccugauguugaccucggcuccggcacgcggaacaucgggaucgagagcgagauaccgaaucuggacaucaucggcaaacgcaucgagaagauaaagcaggagcacgagacauccuggcacuacgaccaagaucacccguacaagaccugggccuaucacgggagcuacgagaccaaacagacgggguccgcaaguuccaugguuaaugguguagugcgccugcucaccaaacccugggacguggucccgauggugacccagauggcgaugaccgacacgacccccuucgggcagcagcggguguucaaggagaagguggacacccgaacccaggagcccaaagagggcaccaagaaguuaaugaaaaucacagccgaguggcuguggaaggaacuugggaagaagaagacgccucggaucuguacccgcgaggaguucacucggaagguucgcucuaacgccgcgcugggcgccaucuucacugacgagaacaaguggaaguccgcgcgggaggcgguggaagacgggagauuuugggagcugguugaccgggagcgcaaccuccaccuggaggggaagugcgagaccugcguguacaacaugaugggcaagcgggagaagaagcugggagaguuuggcaaggccaagggcaguagagcaaucugguacaugugguugggagcucgguucuuagaguucgaagcccugggcuuccucaacgaggaccacugguucucgcgggagaacagccugagcgggguggagggagaggggcugcaccggcucggcuauauucugagagacguaggcaagaaggagggcggagccauguaugccgacgauaccgccgggugggauacgaggaucacccuggaggaccugaagaacgaggagauggugaccaaccacaugaaaggcgagcacaagaaguuagcggaggccaucuucaaacugaccuaucagaacaaggucgugcgcgugcagcggccgacaccccgcgggacggucauggacaucauaagccggcgggaccagcgcggcagcggccagguggggaccuacggccucaacacauucacaaacauggaggcccagcugauccgucaaauggagggagagggcaucuucaaguccauccagcaccugacagccaccgaggaaaucgccgugcaaaauuggcucgcccgcguaggccgggaacgccugucgcguauggcaaucuccggggacgacugcguggugaagcccaucgacgaccgcuucgccagcgcccuuacagcccucaacgacaugggcaagguccggaaggacauccaacagugggaacccagccgcggguggaacgacuggacucaggucccguucugcucccaccacuuccacgaacuggugaugaaggauggccggguccuggugguccccugcagaaaucaggaugagcucauagggcgggcgcgcaucucccagggcgccggauggagccugaaggagaccgccugccugggaaagagcuacgcccagauguggacacuaauguacuuucaucggcgggacuugcggcucgcugccaaugccaucuguagcgccgugccgccccacugggugccgaccucacguacaacguggagcauccaugccaagcacgaguggaugaccacagaggacaugcucgcuguauggaaccggguuuggauucaagagaacccguggauggaggauaagacgcccguagaguccugggaggaagugcccuaucugggaaagagggaggaccaguggugcggcagccuuaucggucucacgucccgggcgaccugggccaagaacauccagaccgcaaucaaccagguccgcagccugauugggaaugaagaauacaccgacuacaugccuagcaugaaacgcuuccggcgcgaggaggaggaggccggggugcugugguga

SEQ ID NO: 25045 - RNA, 9876 nt, Artificial Sequence
  derived and/or modified CDS sequence (opt11) from DENV-2__FJ744745__SS-prME
accgcgggggucaucgucaugcugauccccaccgccauggccuuccaucucaccacgcgcaacggugagccccauaugauugugggccggcaggagaaggggaagagucugcuguucaaaaccgaggacggcgucaauauguguacccuuauggcuaucgaucugggggaauuaugcgaggacaccaucaccuacaagugcccccuccugagacaaaaugagcccgaggauaucgacuguuggugcaauaguaccucaacuuggguuaccuacgguaccuguaccaccacuggcgagcaccgaagagagaagcgguccguggcccuggugccccacguugggaugggacucgagacccgcaccgagaccuggaugagcagcgagggggcauggaaacacguccagcggaucgaaaccuggauacugcgccauccgggcuuuaccaucauggccgccauccucgcauacaccauagggacuacccacuuucagagagcccucaucuucauccugcugacggccguagcgcccaguaugaccaugcgguguauuggcaucuccaacagggacuuugucgagggcgugagcggcggguccugggucgacaucguccucgagcauggcagcugcguaaccacgauggccaagaacaaacccacccuggacuucgagcugaucaaaaccgaagccaagcagccggccacccuccgcaaguacugcaucgaggccaagcugacaaacacuaccacagagucucggugccccacucagggagaacccagccuaaacgaggagcaggauaagcgcuucauuugcaagcacuccaugguggaccggggcuggggaaacggauguggccuguuuggcaagggagggauagucaccugcgcuauguucacgugcaagaagaacauggaaggcaagguugugcagccggagaaccuggaauacaccaucgucaucacgccccacaguggugaagagcaugccgugggcaacgacaccgguaagcacgguaaggagaucaagaucaccccgcagaguucuauuacagaagcagaauugacgggguacggcacuguaaccauggagugcagcccccggaccggccucgacuucaacgagaugguucugcugcagauggaggauaaagccuggcucgugcaccggcagugguuccuggacuuacccuugcccuggcugccuggggcagacacccagggcagcaacuggauccagaaagagacacuuguuacguucaagaacccgcacgccaaaaagcaggacguggugguccucgggagccaggaaggcgcuaugcacaccgcccugaccggcgcuacugagauucagauguccagcggaaaccuucuguucaccgggcaucugaagugccgcuugaaaauggacaagcuccagcucaaggggaugucuuauagcaugugcaccggcaaguuuaagauugugaaggaaaucgcggagacccagcacgggacgaucgugauccggguucaguacgagggugacggcagcccuugcaagauccccuucgagaucacggaccuggaaaagcgacacgucuuggggcggcuaaucaccgugaacccaaucgugaccgagaaagacagucccgugaacaucgaggcggagccucccuucggcgacuccuacauuaucauugggguagagccgggacagcugaaguugaacugguucaagaaggguagcuccaucggccagauguuugaaacgaccaugagaggcgcgaagagaauggcaaucuugggggacaccgccugggacuucggcagccucggcggugucuucacauccaucgggaaggcccugcaccaagucuucggggcgaucuacggcgcugccuucagugggguguccuggacaaugaagauccugaucgggguuauaauuaccuggaucgggaugaacagcaggagcacaucucugucugugagccuggugcucguaggcguggugacccuguaccugggagcaaugguccaggcagacuccggcugcgugguuaguuggaaaaauaaggagcucaagugcggcucuggaaucuuuaucacggacaacguccacaccuggaccgagcaauacaaguuccagcccgagagccccuccaagcuggcuuccgccauccagaaggcccacgaggagggcaucugcgggauacggagcgugacucgguuggagaaccucauguggaaacagaucacgccggaguugaaccacauccucuccgagaacgaggucaaguuaaccaucaugaccggcgacauccgagggaucaugcaggccggcaagcguuccuuacgcccgcagccuaccgaauugaaguauuccuggaagacguggggcaaagcgaagaugcucaguacggaaucccacaaccaaaccuuccugaucgaugggcccgagaccgccgaaugcccgaacacgaaccgcgccuggaacuccuuggaggucgaggacuacggcuucggugucuucacaaccaacauuuggcucaagcuccgcgagaagcaggacguguuuugcgauucuaaacugaugagugccgccaucaaggauaaccgggccguccacgccgacauggguuacuggaucgaguccgcacucaaugacacguggaagauggagaaggcaucuuucaucgaggugaaguccugccacuggcccaagucacacacacugugguccaacggggugcuggagagcgagaugaucauccccaagaauuucgcuggaccggucagccaacacaacuaucgcccgggcuaccacacgcagaccgcggggccuuggcaccuuggcaagcuggagauggacuucgaucuuugcgaggguaccaccguggucgucacagaggauugcggcaaccggggccccucucucagaacgacuaccgccagcgggaagcucaucacugagugguguugccgguccugcacccuccccccucuccgcuaucggggcgaagacgggugcugguacgggauggaaaucagaccauuaaaagaaaaagaagagaaccuggugaacagccucguaaccgcaggccacggccagaucgacaacuucuccuuaggcguccucgggauggcccucuuucuggaggagaugcugcggacccguaucgggacgaagcacgcgauccuccucguggccgugagcuucguaacgcugaucacggggaacauguccuuccgggaucucggccgagucauggugauggucggugcgaccaugacggacgacaucggcaugggcguuaccuaucuggcgcuacucgccgcauuuaaggugcgacccaccuucgcagccgggcugcuacugcggaagcugacgagcaaggagcucaugauggccacgaucggcauagcccuccugucccagagcacaaucccugagacuauccuggagcuaaccgacgcgcuagcccugggcaugaugguccucaaaaucgugcgcaauauggaaaaauaucaacuggccgugacgauaauggccaucuccugcgucccuaacgccgugauccugcagaaugcguggaagguaucaugcacuauccuagccgccgucagcgucagcccccugcugcuaacuuccagucagcagaaggcagauuggaucccucuggcgcuaaccaucaagggacucaauccaaccgccauauuccugaccacccugucccggaccagcaaaaaacgcuccuggccuuugaaugaggccauuauggcugucggcauggugagcauccuggcauccucacugcucaagaacgacauacccaugacagggcccuuaguggcgggcgggcuucucaccgucugcuacguucuaaccgggcgguccgcggaccuggagcucgagcgcgcagccgacgugaagugggaagaccaagccgaaauaucagggucgucgcccauccugucaaucacuaucuccgaagacggcuccauguccaucaagaacgaggaggaggagcagacgcugaccauccucaucaggaccggacugcuuguuaucagcgggguguuucccguguccauaccgauuaccgcugccgccugguaccuaugggagguuaagaaacaaagggccggcguccuuugggaugugccgagccccccgcccgucgaaaaggccgagcuggaggacggggcuuaccggauaaagcaacgcggaauccucgguuauucccagaucggcgcuggcguuuauaaggaagggacauuccacacgauguggcacgugacccgaggagcuguacugaugcaccgcgggaagcggaucgagccaagcugggccgacgugaagaaagaucugaucucauacggcggggguuggaaguuggagggcgaguggaaggagggggaggaagugcagguacuggcccuggagcccggcaagaacccccgagcggugcagaccaagcccgggaucuuuaaaaccaacacaggcaccaucggggccgugagccucgacuucaguccaggcaccagcggcucucccauugucgacagaaaggggaaaguggucggccucuaugggaauggaguggugacccgcagcggagccuacguuuccgccaucgcgcagacggaaaagucuaucgaagacaaccccgagauagaggacgacauauuccggaaaaaacgccugaccaucauggaccuccacccaggagccggcaagaccaaacgguaccuucccgcaauuguccgcgaggccaucaagcguggacugcgcacucuuauacuagcuccgacacgugugguggcggcagagauggaggaggccuugaggggccugccaauuagauaucaaacccccgccaucaaaaccgagcauaccgggagggagaucgucgaccucaugugccacgcuaccuucaccaugcgccuguugaguccuguccgggugccgaacuacaacuuaaucaucauggacgaagcucacuucacugaccccgccuccaucgccgcccgcggcuacauaucuaccagaguggagaugggcgaggccgcggggauuuucaugacagccacgccgcccggcagccgggacccuuucccucagagcaacgccccuaucauggaugaggagcgugagauuccagagcgcucauggaacagugggcacgaaugggugacugacuucaaagguaagaccgucugguuugucccauccauaaaggccggcaacgacaucgcggccugccugcggaagaacggcaagaaggucauccagcugagccgcaagacguucgacuccgaguauguaaagacccgggccaacgacugggauuucguugugaccaccgacaucagcgagaugggugccaacuucaaggccgaaagggugaucgacccccggcgcuguaugaaacccgucauccucacggacggggaggagagaguaauucuggcgggccccaugccuguaacacacaguagcgccgcccagcgucgggggcgcauagggcgcaaccccaagaacgaaaaugaccaguacaucuacaugggggagccacuggagaaugacgaggacugcgcucacuggaaggaggccaagauguugcuggacaacaucaauaccccggaagggaucaucccgucaauguucgagccagagcgggagaaggucgacgcaauagacggggaguaccgauugaggggggaggccagaaagacuuucguagacuugaugcggcggggcgaccugcccgugugguuggccuauaagguugcggccgaggggaucaacuacgcagaucggaaguggugcuucgauggcauuaaaaacaaucagauccucgaggagaacauggagguggagaucuggacgaaagagggggaacgaaagaaacugaagccgcgauggcuggacgcucgaaucuacucagauccccucgcccugaaggaguucaaagaauucgcugccgggagaaagagucugacccugaaccugaucaccgagaugggccgccugcccacuuucaugacgcagaaggcgcggaaugcccuagauaaccuggcgguuuugcacacggcggaggcuggggggagggcauacaaccacgcucuaagcgagcugcccgagacccuggagacccucuugcugcuaacgcugcuagcuaccgucacaggaggaaucuucuuguuccugaugucaggcaaaggcauuggcaagaugacccuagggaugugcugcaucaucacggccagcacccuccugugguaugcacaaauacaaccgcacuggaucgccgccuccaucauccuggaguucuuccucaucgugcuguugauccccgagcccgagaagcagcggacgccccaggacaaccaacucacguacgucgugaucgcgauacugacugugguagccgccacgauggcaaaugagaugggcuuccucgagaagaccaagaaggaccucggucuggggucaauuaccacucaagaaagcgaguccaauauccuggacaucgaccuacgcccggccucagccuggacguuauacgccgucgcgacgaccuucgugaccccuaugcugcggcacuccaucgaaaacucaucuguuaacguaucucucacggccauagccaaucaggcuaccguuuugaugggcuuaggcaaggguuggcccuuauccaagauggacauuggagucccccuuuuagcgaucggcugcuauagccagguuaacccgauaacccucacagccgcgcuacuguugcugguugcucacuacgcgaucauagggcccggccugcaagcaaaggccacgagggaagcccagaagcgggccgcugcgggcaucaugaagaacccgaccgucgacgggaucaccguuaucgaucucgagccaauuccguaugaccccaaguucgagaaacaacucggccaggugaugcugcucauucugugcgucacccagguacugaugaugcgcacgaccugggcgcucugcgaggcucugacccuggccaccgggcccaucuccacuuuaugggagggcaacccagggcgguucuggaacaccaccauagcggugucaauggcgaacaucuuccgcggcuccuaccuggccggcgccgggcuccuguucagcaucaugaaaaacacgacuaacaccagacggggaacaggaaacaucggcgaaacacuuggggagaaguggaagucccgccugaacgcccucggaaagagcgaauuccagaucuacaaaaaguccggcauccaagaagucgacagaacucuggccaaggaagggauaaagaggggcgagaccgaccaccacgccgucagccguggguccgccaagcugcgcugguucguggagcggaacauggugaccccagagggaaagguggucgacuuaggcugcgggcguggcggguggucauacuacugcggcgggcugaagaacguccgcgaggugaagggccugaccaagggcgggcccggucaugaggaacccaucccaauguccacguauggguggaaccucguucggcuucagucgggcguggacgucuuuuucaccccccccgaaaaaugcgacacccugcugugcgacaucggagagagcucccccaaucccaccauugaggccggccggacacugcgcguucugaacuugguggagaacuggcugaacaacaauacgcaguucugcaucaagguucuaaacccguacaugcccucggugauugagaagauggaggcccuccagcggaaguacgguggugcgcugguacgcaacccgcugucccguaauuccacucacgagauguauuggguguccaacgcgucgggcaacaucguauccagcgugaauaugaucuccaggauguugaucaaccgguucacgaugaagcacaaaaaggccaccuacgagccggacguggaccucggcagcggcacgagaaacaucgggaucgagucggagauccccaaccuggacauaauuggcaagcgcaucgagaagaucaagcaggaacacgagaccagcuggcacuacgaccaagaccaccccuacaagaccugggccuaucacggcaguuacgaaacaaagcagaccggaagcgcuuccaguaugguaaacggugucgugcggcuguuaaccaaaccuugggauguggucccgauggugacccaaauggcgaugaccgauacgacccccuuugggcagcagcgcguguucaaggagaaggucgacacccggacucaggagcccaaggagggcacgaagaaguugaugaaaauuaccgccgaguggcuguggaaagagcuagggaaaaagaagacgccccguaugugcaccagagaggaauucacgcgcaaggugcguuccaacgccgcccugggggccauauucaccgacgaaaacaaguggaaguccgcucgcgaagccgucgaggacucccgguucugggaauuagucgaccgcgagcgcaaccuacaccuggagggcaagugcgaaacuugcguguacaacaugauggguaagagggagaagaagcucggcgaguucgggaaggcgaagggaagucgggccaucugguacauguggcucggcgcacgauuccuagaauucgaggcccugggauuucucaacgaggaccacugguucucgcgagggaacucucucagcggaguugagggcgaagggcugcaccgccucgguuacauccugcgcgacgucgguaaaaaggagggcggcgccauguacgccgacgacacggcggggugggauacccgcaucacccuggaggaccucaagaacgaagagaugguaaccaaccacaugaagggcgagcacaagaagcuggccgaagccaucuucaagcugacguaccagaacaaggucguucggguucagcgcccgacgccgcgggguaccguaauggacaucauuucccgcagggaucagcgcgguucgggacagguggggaccuacggacucaacacauucacgaacauggaagcacagcugauccgccagauggagggggaaggcaucuucaaguccauccaacaccugaccgccaccgaggagaucgcgguacagaauugguuggcgcgggucggcagggagcggcuuagccgcauggccaucuccggcgaugacuguguugugaagccaaucgacgaccgguucgccagcgcccugaccgcucugaacgacauggguaaaguccggaaggacauccaacagugggagcccagccggggcuggaacgacuggacccaggucccguucugcagccaccacuuccaugagcuggugaugaaggauggacgcguccuagugguacccugccgaaaucaggacgagcuaaucgggcgcgcucggauuucccaaggggccggcuggagccugaaggaaacggccugccucgggaagaguuaugcccaaauguggacccuuauguauuuucaccgcagagaccugcgccuggccgcgaacgccaucugcagcgccgugccgccgcacugggugccaaccucccguaccacguggaguauccacgcuaagcacgaauggaugacuacggaagacaugcucgcgguguggaaucgcgucuggauccaagagaaccccuggauggaggacaaaacuccgguggaguccugggaggagguaccuuaccugggcaagcgggaagaccaguggugcggcagccugaucggccucacgagcagggcgaccugggccaagaacauccagaccgccaucaaccaggucagaucgcuuaucgggaaugaggaguacaccgacuacaugccuaguaugaagcgcuucagaagagaagaagaggaggccggcgugcuaugguag

SEQ ID NO: 25046 - RNA, 9876 nt, Artificial Sequence
  derived and/or modified CDS sequence (opt11) from DENV-2__FJ744705__SS-prME
accgccggaguaaucguaaugcugauccccaccgccauggccuuccauuuaaccacacggaauggcgaaccacacaugaucgugggucgccaggagaaggggaagucccugcuguuuaagacggaagauggcgugaacaugugcacccucauggccaucgaccugggcgagcugugugaggacaccaucaccuauaagugcccccuccucaggcagaacgagcccgaggacaucgauuguuggugcaacucuacuagcaccuggguuacguacgguaccugcacaaccacgggggagcaccggcgcgaaaagcggucgguagcccugguaccccacgucggcaugggccucgaaacccggacggagaccuggaugagcucggagggcgcauggaagcacgugcagcggaucgagacguggauccugcgccaccccgguuuuacaaucauggccgcuauccuggccuauaccaucggaaccacucacuuccaacgggcccucauuuucauccuacuuacggccguagcgcccagcaugaccaugcggugcaucggcaucuccaaccgcgacuucgucgagggcguuagcggggguuccuggguggacaucgucuuagaacaugggucaugcgugaccacgauggccaagaacaagcccacccuggauuucgagcucaucaagaccgaggcaaagcaaccggccacccuccgcaaauacugcaucgaagccaaauuaacaaauaccacaacugagucccggugcccaacacaaggagagccaucacugaacgaggaacaggacaagcgguuuaucuguaagcacagcaugguggaucggggcuggggaaacggcugcgguuuauuuggaaagggcgggaucgugaccugugcuauguucacaugcaagaagaacauggaaggcaagguggugcagcccgaaaaccuggaguacaccaucgucauuacuccccacucgggagaagaacacgcagugggcaacgacaccgggaaacacgggaaggagaucaagaucaccccgcaguccucaaucacugaagcagagcugaccggauacggcacggugacaauggagugcucuccccgaacaggacuggacuucaacgagaugguacuguugcagauggaggacaaggcaugguuggugcaccggcagugguuccuggaccugccccuuccauggcuaccuggggccgauacccaaggcagcaauuggauacagaaagagacccuagugaccuucaaaaacccccaugcgaagaagcaggacgucgucguucucgggucccaggagggagccaugcacacagcgcugacuggcgccacggaaauucagaugagcagcggcaaucuccuguucacaggucaccuaaaaugcaggcugcggauggauaaacuccagcuaaaggggaugagcuacaguauguguaccggaaaguucaagaucgugaaggagaucgcagagacacagcacgggacuauagucauccgcguccaguacgagggggacgauagccccugcaagauccccuucgagaucacggacuuagaaaagcggcacgugcucggccgacugaucacugugaacccgaucgugaccgaaaaggauagcccggugaacauagaagcagaaccaccuuucggggacagcuacaucauaaucggcgucgagccggggcagcugaagcuaaacugguuuaagaaaggcagcuccaucggucaaauguuugaaacgaccaugcggggcgccaagcggauggccauccuuggcgauaccgccugggacuuuggaagccuuggcggcgucuuuacuuccaucggcaaggcccugcaccagguguucggggcgaucuacggcgcagccuucagcggcguauccuggacgaugaagauccugaucggggugauaaucaccuggauuggcaugaacagcagguccaccagccugagugucagccugguccuuguagggguggugacauuauaccugggagccaugguucaggcggacucuggcugcaucguaucuuggaaaaauaaagagcucaagugcggcuccggcauuuucaucacugacaauguccacacguggaccgaacaguauaaguuccagcccgagucacccagcaaacuggccuccgccauccagaaagcucacgaggaagguaucugcggcauacggagcgucacccgccuagagaaccucauguggaagcagaucacacccgagcuaaaccacauacugucggagaacgaggugaaacuuaccaucaugaccggggauauucgugggaucaugcaggccggaaagcgcuccuuacgaccgcagcccaccgaguugaaauauuccuggaagacguggggcaaggcgaagaugcucagcaccgagucccacaaucaaaccuuucuuauugacggcccagagaccgucgagugcccuaacacgaaccgggccuggaacucucuugaagucgaggacuauggauucggaguguuuaccaccaacauauggcucaagcuccgggagaagcaggauguguucugcgacuccaaacugaugagcgcugccaucaaggacaacagggccguacacgcggacaugggguacuggaucgaaagcgcucugaacgacaccuggaagauggagaaggccagcuucaucgaggugaagucaugccacuggccgaaaagccacacccuauggucuaauggagugcuggaguccgagaugaucaucccaaagaacuuugccggccccgugagccaacacaauuaccggcccggguaucacacacagacagcgggcccguggcaccuugggaaacuggagauggacuucgaccucugugaaggcacgaccguaguggucacggaggacuguggaaaccggggcccuagccuccggaccaccaccgcaagcggcaaguugaucacagaguggugcugucgcucaugcacgcugcccccgcuccguuaccguggcgaggacggguguugguaugggauggagauccggccccugaaggagaaagaggagaacuuagugaacagccuggugacggccggccaugggcagaucgacaacuucuccuuaggcguccugggaauggcccucuuccuggaggagauguuacgaacccggauugggacgaagcacgccaucuuacucgucgcggucagcuucgucaccuugaucaccggcaacauguccuuccgcgaucucggucgcgugaugguaaugguaggcgccacuaugaccgaugacauagguaugggcguaacuuaccuggcacugcuggccgccuuuaaggugcgccccaccuucgccgcgggccugcugcuccgcaagcugaccaguaaagaguuaaugauggcgaccaucgggaucgcgcuucugucccagagcacgauccccgaaacaauucuggagcucaccgacgcgcuggcgcucggcaugaugguccugaaaaucguucggaauauggagaaguaccagcuggccguaacgaucauggccaucuccugugugccgaacgcugucauccugcagaacgccuggaaggugucgugcacuauccuugcggccguaucgguaagccccuuguuacucaccuccagccagcaaaaggccgauuggauaccccuggcuuuaaccaucaaagggcuuaaccccacggcgauuuucuugacuacccucuccaggaccagcaagaagcgauccuggccgcuuaacgaggcaauuauggccguggggauggugagcauccuagcaucuagccugcuuaagaaugacauacccaugacgggcccccugguagccgggggucuccucaccgucugcuacgucuugaccgggcgcagugcggaccuggagcucgaacgugccgcugacgucaaaugggaggaucaggcagagaucagcggaucgagcccgauccugaguaucacgauuagugaagacggaucaauguccaucaagaaugaggaagaggagcagacgcugacaauacuuauccgcacaggcuugcuggucaucagcggcgucuucccggugucuauccccauaaccgccgccgcuugguaccucugggagguaaagaagcagcgggccggagugcugugggaugugcccucaccgccgcccguggagaaggcggagcuggaggauggcgccuaccgcaucaaacagcgggggauuuuaggcuacucccagaucggcgcuggcguauacaaggagggaaccuuccacacuauguggcacguaacccguggcgccguauuaaugcacaggggcaagcgcauugagcccagcugggccgaugugaagaaggaccugaucuccuaugggggcggguggaagcuagagggagaguggaaggagggcgaagaggugcaggucuuggcccuggagccuggaaagaacccgcgugccgugcagaccaaaccaggcaucuucaagaccaacacggggaccauaggugcugugagcuuagacuucucucccggcaccagcgguucccccauagucgaccguaaaggcaaggugguggggcuguacggcaacgggguuguuacucggaguggcgccuacgugagcgccaucgcucagacggagaaaagcauugaggacaacccggaaauugaggacgauaucuucagaaagaaaagacugaccaucauggacuuacacccuggugcggggaagaccaagcgauacuuaccugcaaucguaagggaggccaucaaacgcggccugagaacucuuaucuuagcccccacucgcgugguggccgcggagauggaggaggcgcugagaggacugcccauaagguaccagaccccggcaauuaagaccgagcacacuggucgcgaaaucguugaccucaugugccacgccacguucaccaugagauugcugucgccuguucgggugcccaacuacaaccucaucaucauggacgaggcccacuuuaccgaucccgccucuaucgccgcgcgcggguauaucagcaccaggguugaaaugggcgaagcagcuggcauauuuaugacugcaacgccgcccgggucgcgagacccguucccacaaucaaacgcccccaucauggacgaggagcgggagauuccugagcgguccuggaacagcgggcacgagugggucaccgacuuuaagggcaagaccgugugguucgucccguccauaaaggccggcaacgacauagcagcgugccugcgcaagaauggcaagaaggugauccagcugagccggaaaacguucgacucggaguacgugaagacccgagcaaacgacugggacuuugucgugaccaccgacauuagcgagaugggcgccaacuucaaggcggaacgagugaucgacccacgccgguguaugaaaccugucauccugaccgauggcgaggagcgugugaucuuagccgggccuaugcccgugacccacuccucggcagcccagaggaggggccguaucggccgaaaucccaagaacgaaaaugaucaguacaucuacaugggggagccccuggaaaaugacgaggacugcgcccacuggaaagaggcgaaaaugcuccuggacaacauuaacacccccgaggggauuauaccgucaauguucgagcccgaacgcgagaaggucgacgccaucgacggcgaguaucggcugcgcggggaggcgcggaagaccuuugucgauuuaaugcgcagaggggaccugcccguguggcuggccuacaaggucgccgccgaaggcaucaauuacgccgaccgcaaaugguguuuugacggaauuaagaacaaccagauccucgaggaaaauauggagguggagaucuggaccaaggagggcgagaggaagaagcuaaagccaagauggcuggacgcgcggaucuacagcgacccccucgcccuaaaagaguucaaagaguucgccgccgggaggaagucccugacccucaaccugauaaccgagauggggcggcugcccaccuucaugacgcaaaaggcgcgcaacgcacucgacaacuuggccgugcuccacaccgcggaggccggugggcgggcguacaaccacgcccucagcgagcugcccgagacacuggagacgcugcugcuacucacccugcuggcuacuguaaccggcgggaucuuccucuuucugauguccggcaaggguaucgguaagaugacccuaggcauguguugcaucauaaccgcaagcauccuucugugguacgcucaaauccagccacauuggaucgcggccagcaucauccuagaguucuuccucauugugcuucuaauccccgagcccgagaagcagcgcacuccccaagacaaccagcuuaccuaugucguuauugccauccugacgguggucgccgccaccauggcuaacgagaugggcuuccuggagaagacgaagaaagaccugggguuggggaguaucaccacccaggagucagaguccaacauccuggacaucgaccucaggccggcgucggcguggacauuauaugccguggcuacgaccuucgugacccccauguuacgccauucaauugaaaacucaagugugaacguuagccuuacggcaaucgcgaaccaggccacggugcugaugggcuuaggcaaaggguggccccuaagcaaaauggacaucggcgucccucugcucgcgaucggcugcuacagucaggugaacccgauaacgcucacggcugcccugcugcuacucguugcccacuacgccaucaucggaccuggccugcaggcuaaggcuacgcgagaggcacagaagcgugccgccgcaggcaucaugaagaaucccacgguugauggcauuacugugauagaccucgagcccaucccauacgauccgaaauucgagaaacaacuggggcaggucaugcuguugaucuuaugcgucacacaggugcucaugaugcggaccacgugggcccugugcgaagcucugacccuggcaaccggccccaucuccacccuaugggagggcaaucccggcagguucuggaacacgaccaucgccgucagcauggccaauaucuuccgcggguccuaccucgcgggcgccggccuacucuucucgaucaugaaaaacaccacgaacacgcggagggggaccggcaacaucggugaaaccuugggcgagaaguggaaaucccggcugaacgcccucggcaagagcgaguuccaaaucuacaaaaagagugggauccaggagguagaucgcaccuuggccaaagaggggauaaagagaggggagacggaccaucacgcggugagccggggguccgccaaguugcggugguucguagagcgcaacauggucacccccgagggcaagguagucgaucuaggcugcggccgcggcggguggagcuacuacugcggcgggcucaagaauguaagggaggucaaaggucugaccaagggcgggcccggccacgaggagcccauucccauguccaccuacggauggaaccucgugagacugcaaucaggggucgauguguucuucacuccgccagagaagugcgacacccugcucugcgacaucggcgagaguucaccaaaucccacuaucgaggccgggcgcacccugcgggugcugaaccucgucgagaacuggcugaacaacaacacccaguucugcaucaaagugcugaauccguacaugccguccgugaucgagaagauggaggcccuucagcgcaaauacggcggagcccucguccgaaauccuuuaagccgcaacagcacgcacgaaauguacuggguguccaacgcgaccgggaacauugugagcuccguuaauaugauaagccggaugcugauaaaucgcuucaccaugaagcacaagaaggccacuuacgagcccgacguggaucucggcuccgguacgcggaacaucggcaucgagucggagauccccaacuuggauaucaucgggaaacgcaucgagaagauaaagcaggagcaugagaccagcuggcacuacgaccaggaccaucccuacaagaccugggcuuaucauggcagcuaugagacgaaacagacgggcuccgccagcucgaugguuaacgguguaguccgccugcucaccaaacccugggacguagucccgauggugacccagauggccaugaccgacacuaccccauuugggcaacagcggguguucaaggagaagguagacacccguacgcaggaaccgaaggaggggacgaagaaacuuaugaaaauaacugccgaguggcucuggaaggagcucgguaaaaagaagacaccucggaugugcaccagagaagaguucacucggaagguacgcucgaacgccgcccugggcgccauuuucaccgacgagaauaaguggaaguccgcacgggaggccguggaggacgggcgcuucugggagcugguggaccgggagagaaaccuccaucuggagggcaagugcgaaacaugcguguacaacaugauggguaagagggagaagaagcugggcgaguucgggaaggcaaaggggagccgugccaucugguauauguggcucggcgcacgguuccuggaguucgaggcgcugggauuccucaacgaggaccacugguucucccgcggcaacucacugucagggguggagggcgagggucuucaccgacucggguacauucuucgggacgucggcaagaaagagggcggcgccauguaugccgaugacacugccggaugggacacacggaucacucuggaagacuuaaagaacgaggaaauggugaccaaucauaugaagggcgagcacaagaaacuggcagaagcgaucuuuaagcugacguaccagaacaaaguaguucgagugcagcggccaacgccucgugggaccguuauggacauaaucuccagacgugaccaacgcggcagcggucaggucgggaccuacggacucaauaccuucacgaacauggaggcccagcugauccggcaaauggagggggaaggaaucuucaagucuauacagcacuuaaccgcuaccgaggaaaucgcugugcagaacuggcuagcccgugucggacgugagcgccucucccguauggcgaucucaggugacgacugcguagugaagccgauagacgaccguuucgccagcgcccuuaccgcacucaacgacaugggcaagguucggaaagacauucagcagugggagccuucccgcggguggaacgacuggacccaggucccguucugcagccaccacuuccacgagcucguaaugaaagacggcaggguccuggugguucccugucgcaaccaagacgagcucaucggccgagcccgcaucucacagggcgcggguuggagccuaaaggagaccgccugucuggggaagaguuacgcacaaauguggacccucauguauuuccaccggcgcgacuuacggcuggcggcgaacgccaucugcagcgccgucccgccccauugggugccgaccagucgcaccacguggagcauucacgcgaagcacgaguggaugacgacagaggacauguuagccguguggaaccgagucuggauccaggagaaccccuggauggaggacaagacucccguggagagcugggaagagguacccuaucugggcaaacgggaagaccaauggugcgggagccugaucggccucacgucgcgagcgaccugggccaagaauauucaaacagcaaucaaccaaguccguucccugauagggaacgaggaguacacugacuacaugccgagcaugaagcgcuuccgucgcgaggaagaggaggcaggcguccugugguga

SEQ ID NO: 25047 - RNA, 9876 nt, Artificial Sequence
  derived and/or modified CDS sequence (opt11) from DENV-2__FJ744744__SS-prME
accgcaggggugauugucauguuaauucccaccgccauggcguuccauuugaccacccgaaacggggaaccccacaugaucgugggccggcaggaaaaagggaaaucccuucuguucaagaccgaagacggcgugaacauguguacgcucauggccauagaccucggggaacugugcgaagacaccaucacuuacaaauguccccuccugcgccaaaacgagcccgaagauaucgacugcuggugcaauucaaccagcaccuggguuacauacggaaccugcaccacaacuggcgagcaccggcgagagaaacggucuguggcccuggugccccacguggggaugggucucgagacccgcacagaaaccuggaugagcagugaaggggccuggaaacauguacagcgcaucgagaccuggauccugaggcauccgggcuucaccaucauggccgcgauccuggccuacacuaucgggacgacgcacuuccagcgggcgcucauuuuuauucugcucaccgccguggcgcccagcaugaccaugcgaugcaucggcaucaguaaccgggauuucgucgagggugugagcggcggcagcuggguggacauaguccucgagcaugggagcugcgugaccacaauggccaaaaacaagcccacccuggauuucgagcucaucaagaccgaagcgaagcagcccgcaacccuccgcaaguacuguaucgaagcaaagcugacuaacaccaccacagagucccggugccccacucaaggcgagcccagcuuaaacgaagaacaggacaagcgcuucaucuguaagcacucaauggucgaccguggcugggggaacggcugcggacuguuuggcaagggcgggaucgugacuugcgcgauguucacguguaagaagaacauggagggcaagguggugcagcccgagaaccuggaguacaccaucguuaucacuccccacagcggggaagaacacgcagugggcaacgacaccgggaagcacggaaaggagaucaagauuaccccacaguccagcauuacggaggccgagcuuacuggguacggcacggucacuauggagugcagcccccggaccggccucgacuucaacgagaugguccugcugcagauggaggacaaggccuggcucgugcaccggcagugguuccuggaccucccccuucccuggcugccgggugccgauacccaggguagcaacuggauacaaaaggagacgcuggugaccuucaagaauccccacgcgaagaagcaggacgucgucguccucggaucccaggaaggcgccaugcacaccgcccugacgggggccacagagauucagauguccagcggcaaccuacucuucaccggucacuugaagugccgccugaagauggacaaacuccaacugaaggggaugagcuacagcaugugcaccggcaaguucaagauuguaaaggagaucgccgagacccaacacgggacgaucguaauucggguccaauacgagggcgauggcucccccuguaagauccccuucgaaaucaccgaccucgagaagcgccacguacucgggcgacugauaaccgucaauccgaucgucacugaaaaagacagccccgugaacauugaggcggaaccgcccuucggagauagcuauaucauuaucgggguggagcccggccagcugaagcucaacugguucaagaaggggaguuccaucggccagauguucgaaacgaccaugcgcggcgcuaagcgcauggccauccugggggauacagcuugggacuucgguagccucggcggaguauuuaccuccaucgggaaggcccuccaccagguguucggggcgaucuacggggccgcuuucagcgggguguccuggacaaugaaaauacugaucggcgucaucaucacuuggauugggaugaacucucggucgaccagccuauccguuagccuggugcucguuggcguaguaacccuguaccugggcgccaugguccaggcggacuccggcugcguugugagcuggaaaaacaaggaguugaagugcggcucggggaucuucauuacggacaacguccacacauggaccgagcaguauaaguuccagcccgaaucucccagcaagcuggccuccgcgauucaaaaggcccacgaagaaggcauuugcgggauuaggagcgugacccggcuggagaaccucauguggaagcagaucacgccggagcuuaaccauauucuuuccgagaacgagguaaagcucaccauaaugaccggcgacauacgcgggaucaugcaggccggaaagcggagccugcgcccgcagcccaccgagcugaaguacucuuggaagacgugggggaaagccaaaaugcucagcacagagucccacaaccaaaccuuccuuaucgaugggcccgagacugccgaguguccgaauacgaaccgggcuuggaacagcuuagaggucgaggacuacggcuucggaguguucaccaccaacaucuggcuuaaacugcgggagaaacaagacguauucugcgacuccaagcugaugagcgccgccaucaaggacaaccgugcgguccacgccgacaugggauacuggaucgaguccgcccucaacgacacguggaagauggagaaggccagcuucauugaggugaaguccugucacuggcccaagagccacacccugugguccaacggcgugcuggaaagcgaaaugaucauccccaagaacuuugccgggcccgucagccagcacaacuaccguccgggguaucacacgcagacagcggggcccuggcauuugggcaagcuggagauggauuucgacuugugcgaggggaccaccgugguggucacggaggacugcggcaaccgcggcccgucacuccgcacaaccacugccucggggaaguugauuacggaguggugcugccguagcugcacacuaccucccuuacgguauagaggggaagacgggugcugguacggcauggaaauccgaccccuaaaggagaaggaggagaaucuugugaacagccucgugacugccgggcacggccagaucgacaacuucucccugggcguccuagggauggcacucuuccuggaggagaugcuacggacccgcauaggcacgaagcaugcaauccuccugguggccgugagcuucgucacccugaucacagguaacauguccuuuagggaccucggccgcgugauggugaugguuggggccaccaugacggacgacaucggcaugggcguuacguaccuggcccugcucgcugcguucaaggugcgccccaccuucgccgucggguuauugcuccggaagcuaacaagcaaggaacugaugauggccacgaucggcaucgcccucuuaucccagagcaccauccccgagaccauccuggagcucaccgacgcccuggcuuuagggaugauggugcuaaagauaguucggaauauggagaaauaccagcuggccgucacgauuauggcuaucuccugcgugcccaacgccgucaucuuacagaacgcauggaaggucuccugcaccauccuggcugucgucagugugagcccccugcuccucaccuccucccagcagaaggccgauuggaucccccuggcacugaccaucaaaggacucaaucccacggcuaucuuccuuacgacacugagcagaaccagcaagaagcgcucguggccgcucaacgaggcaaucauggccguggggauggucagcauucuagcuuccagccuccucaagaacgacaucccgaugaccggaccccugguagccgguggguuauuaacgguguguuacguccuuaccgggcggagcgcggaccuggagcucgaacgagccgccgacgugaaaugggaggaccaggccgaaaucuccgggagcuccccuauccugagcaucaccauauccgaagacggcagcaugagcaucaagaacgaagaggaggagcaaacgcuuaccauucucauacguaccgguuugcugguaaucagcggggucuuuccgguguccaucccuauuaccgccgcggcuugguacuuaugggaggugaagaagcaacgcgccggcguccugugggacgugccuagcccgccgcccguugaaaaggcggagcuggaggauggggccuaccggaucaagcagcgagggauucucggguacucccagaucggagccggcguuuacaaggaggggacuuuccacacgauguggcacguuacccggggcgcggugcuaaugcaccgcgggaagagaaucgagcccagcugggcagacgucaagaaagaucugaucuccuacggcgggggauggaagcucgagggcgaguggaaagaaggggaggagguccaagugcuggccuuggagcccggcaagaacccccgcgcaguacaaaccaagcccggaaucuucaagacuaacacgggaaccaucggcgccgugagccucgacuucuccccuggaaccucgggcucccccauaguggaucggaaggggaaggucgugggccuguacgggaacggcgucgucacccgcucuggcgcguacguguccgcgaucgcccagacggagaaguccaucgaggacaaccccgagaucgaggacgacaucuuccggaagaagaggcugaccauaauggaccuccaccccggggccggcaaaacgaaacgguaccugccagcgaucguucgcgaggcaaucaagcgggggcugcgcacgcugauacucgccccgacgagggugguugccgccgagauggaggaggcgcugcggggccugccuauccgcuaccagacucccgccaucaagaccgaacauaccgggcgggagaucguagaccugaugugucacgccacguucacaaugcgccucuugucucccguacgggugccgaacuacaaccucaucauaauggaugaggcacacuucaccgaccccgcguccauugcggcccguggcuauaucagcacccggguggagaugggcgaggcagcggggaucuucaugacggccacgccacccggcucccgcgauccguucccgcagagcaacgcgccaaucauggacgaggagcgggagaucccugagcgcuccuggaacagcggccacgagugggucacggauuucaagggcaagaccgugugguucgugcccuccaucaaggccgggaacgacaucgccgcuugccuacgaaagaacggcaagaaggucauucaacucucucgcaagacauuugacuccgaauacgugaagacucgggcgaaugacugggacuuuguagucaccaccgacaucagcgagaugggcgccaacuucaaggcugaacgagugaucgacccgcggcgcuguaugaagcccguaauccucacggauggggaggaacgggucauccuggccggccccaugccggugacccacuccucagcggcgcaacgccgggggcgcaucggacggaaccccaagaacgagaacgaucaguacaucuacaugggugagccucucgagaacgacgagaacugcgcucacuggaaggaagcgaagaugcuccuggacaacaucaauacccccgagggcaucaucccguccauguuugagcccgagcgggagaagguggacgcuaucgacggagaguacagacugcgcggggaggcccggaagaccuuugucgaucucaugcggcguggagaccugcccgucuggcuggcauacaagguggcugcugaggggauaaacuacgccgacaggaaguggugcuuugacggcaucaagaacaaccagauccucgaggagaauauggagguagaaaucuggacuaaggagggggagcgcaagaagcugaagccucgguggcuugacgcccgcaucuacagcgauccccucgcgcugaaggaguucaaggaguucgccgcuggccggaagucgcugacacuaaaccugaucaccgagaugggccgccugccaaccuucaugacgcagaaggcgcggaacgcgcucgacaaccuggccgugcugcacacagcagaggccgggggccgcgccuauaaccacgcgcucagugagcugcccgagaccuuagaaacccuucuguugcugacucugcuggccacaguaacugggggcaucuuucucuucuugauguccgggaaggggaucggcaagaugacgcugggcaugugcugcaucauaaccgcuagcauucuccucugguacgcccagauccagccgcauuggaucgccgccagcaucauccuggaguucuuucucaucgugcuccugauccccgagcccgaaaagcaacggacgccccaggacaaccagcucaccuauguagucaucgcgauuuugaccguaguggccgccaccauggccaacgagaugggcuuccuggagaagacgaagaaggaccucggguuagggagcaucaccacccaggagagcgaauccaacaucuuagacauagaucuccgcccggcgagcgccuggacccuguacgccgucgccacgacguucgugacccccaugcugcggcacagcaucgagaacucauccgugaaugucagccucacugccaucgcgaaccaggcgacgguacuuaugggccuugggaagggguggccccucagcaagauggacaucggagugccccugcuggcuaucggcuguuacagccagguuaacccgaucacacucaccgccgcucugcuguugcugguggcucacuacgcuauuaucggucccggccugcaggccaaggccacccgcgaggcgcagaagcgggccgcagccggcaucaugaagaaucccacgguagacgggauuaccgucaucgaccucgagcccauccccuacgacccuaaguucgaaaagcagcuuggccaggugaugcugcucauccucugcgugacgcaggucuuaaugaugcgcaccacgugggcacucugugaggcgcugacccuggcgaccggcccaaucuccacccugugggaagggaaucccggucgguucuggaauacgaccaucgcugugagcauggccaacauauuccgggguuccuaccuggccggcgcgggccuccuguucagcauaaugaagaacaccaccaauacccgacgaggcaccgggaacaucggcgagaccuuaggugaaaaguggaagucacgccugaacgcccucgggaagucagaguuccagauauacaagaagucuggcauacaggagguggaucggacucuggccaaggagggaaucaaacgcggcgagacggaccaccacgcugucagccggggaagugcgaaacugcgcugguucguggagcggaacauggugaccccagagggaaaggucguggaccucggcugcgggcguggcggcuggucguauuacugcggcgggcugaagaacgugcgggaggugaaaggccugacuaaaggcgggcccgggcaugaggagcccauccccauguccacauauggguggaaucucguucgccuucagucgggcguugaugucuucuucacgccuccagagaagugugacacccugcucugcgacaucggggagucaucucccaaucccaccaucgaggcgggccgcacccugcgcgugcugaacuugguggagaacuggcugaacaacaacacccaauucugcaucaaggugcugaacccguacaugcccagcgugauugagaaaauggaggcccuccagcguaaguauggcggugcacugguucgcaacccccugucccggaacagcacccacgagauguacuggguguccaacgccagcggcaacaucguguccagcguuaacaugaucucccgcaugcugauaaaucgguucaccaugaagcacaagaaggccaccuaugagccggacguagaccucgggagcggaacccguaacaucggaaucgaguccgagauacccaaccuagacauuauaggcaagagaaucgagaagaucaagcaggagcacgagaccagcuggcacuacgaccaggaucacccuuacaaaaccugggcguaccacggcuccuacgagaccaagcagaccgggagcgccucgucuauggugaacggcguaguccgccugcucacgaaacccugggacguggugccaauggucacgcagauggcuaugacggacaccacuccuuucgggcagcagcgcguguucaaggagaagguggacacccgaacucaggagcccaaggaggguaccaagaagcugaugaaaauaacggcagaguggcuguggaaagaguuggggaagaagaaaacgccccgcaugugcacacgagaggaguucaccaggaaggugcgguccaacgcagcacugggcgccaucuucacagacgagaacaaguggaaauccgcccgcgaagccguggaggacucccgguuuugggagcugguggaccgcgagcggaaccuccaccuggagggcaagugugaaaccugugucuauaauaugauggguaaacgcgagaaaaagcugggcgaguucgggaaggcaaaaggcagccgcgcuaucugguacauguggcucggcgccagauuucuggaguucgaggcgcugggguuccucaacgaggaccauugguucagccguggcaacucccuuagcgggguggagggugagggguuacaccgccugggcuauauccugcgggacgugggcaagaaggaaggaggcgcgauguacgccgaugauaccgccgggugggacacucgcaucacccuggaggaucucaaaaacgaggagauggugaccaaccacaugaagggcgagcacaagaaacuggcugaggccaucuucaagcugaccuaccagaacaagguggucagaguccagcgcccuacgccccggggcacggucauggacaucaucucccgccgggaccagcgcgggagcggccagguagggaccuaugggcucaacaccuucacuaauauggaggcgcagcugauccgccagauggaaggggagggaauuuucaagagcauccagcaccuuacggccaccgaagaaaucgccguccagaacuggcucgcccggguuggacgcgaacggcugagccguauggccaucuccggggacgacugcgucgugaagcccauugacgaccgguucgcgagcgcccugacagcacucaacgacaugggcaagguucgcaaggauauucagcagugggagccaucccggggauggaacgauuggacccaagugcccuucugcucgcaccacuuccacgagcuggugaugaaggacggccgagugcuggucgugcccugccggaaucaggacgagcucauaggucgcgcccguauaucccagggcgccggcuggagccugaaagagacggcgugccuugggaaguccuaugcccagauguggacucucauguacuuucaccgccgggaucugcgccuggcugccaacgccaucuguucagcggucccgccgcauuggguuccgacaucccggaccacuuggucgauccacgcgaagcacgaguggaugacgaccgaggacaugcuagcuguguggaaucgcgucuggauccaggaaaacccuuggauggaggacaaaacccccgucgagucaugggaggagguccccuacuugggcaagagggaggaccaauggugcgggucgcugaucggccucacaagccgcgccacgugggcgaaaaacauccagaccgccaucaaccaggugcggucccugaucgggaacgaggaguacacugacuacaugccguccaugaagcgcuuucgccgagaagaggaagaggcgggaguccugugguga

SEQ ID NO: 25048 - RNA, 9876 nt, Artificial Sequence
  derived and/or modified CDS sequence (opt11) from DENV-2__GQ868646__SS-prME
acugcgggagugaucguaaugcugauccccacagccauggcuuuccacuugaccacucgcaauggcgagccgcacaugauugugggucggcaggagaaggggaagucccuccuguucaagaccgaggacggagugaacauguguaccuugauggccaucgaccugggggagcugugcgaagacaccaucaccuacaagugcccgcuccugcgccagaacgagcccgaggauauugacugcuggugcaauaguacuagcaccugggucaccuaugggaccugcaccaccacgggcgagcaccggcgcgagaagcggucuguagcccugguuccccacgucgggaugggccucgaaacccgcacagagaccuggaugagcucagagggugccuggaaacacgugcagcggaucgagaccuggauccugcgccacccuggcuucaccaucauggcugcaauccuggccuacacuauugggaccacccacuuccagcgggcccucaucuucauccugcugaccgccguggcccccagcaugacaaugcgcugcaucggcaucuccaaccgagacuucgucgagggcgugagcggaggcuccuggguggacaucguccucgaacacgggagcugcgugaccacgauggccaagaacaagcccacccuagauuucgagcugaucaagaccgaggccaagcagcccgccacgcucagaaaguacugcaucgaagcuaaacugacgaacacuaccaccgagucccgguguccgacacagggcgagcccagccugaacgaggaacaggacaagcgcuucaucuguaagcacuccaugguggaccgggggugggggaauggcugugggcuguucggaaaaggcgggaucgugaccugcgcgaaguucacgugcaagaagaacauggaggggaagguggugcagcccgaaaaccuggaauacaccaucgucaucacgccccacagcggggaggagcacgccguggguaacgacaccgggaagcacggcaaagagaucaagaucacaccgcaguccagcaucaccgaggccgagcugaccggguacggcacggugaccauggagugcagcccccgcacgggccucgacuuuaaugaaaugguacugcugcaaauggaagacaaggccugguuagugcaccggcagugguucuuagaccugccccuccccuggcugccaggagccgacacacagggcagcaacuggauccaaaaggaaacgcuugugaccuucaagaacccccaugcgaagaagcaagacgucgugguccucggaucgcaggagggcgccaugcacaccgcccugacaggggccacggagauccagaugagcuccggcaaccuccuguucacaggccacuuaaagugccgacugcggauggacaagcuccagcugaaagggaugucuuacagcaugugcacgggcaaauucaagauagugaaggagauagccgagacucagcacggcacgaucgugauccgcguacaguacgagggcgacggcucccccuguaaaauccccuucgagauuaccgaccuggagaagcggcacguguuaggccgccugaucacggucaacccgaucgucaccgagaaggacagccccgugaacaucgaggcggagccgcccuucggcgacuccuacaucaucaucggcguggagccgggucagcugaagcucaauugguucaagaaggguagcuccauaggccagauguucgagacaacaaugcgcggcgccaagcggauggccauccugggagacacugcuugggacuucggaagccucgggggcgucuucaccagcaucgggaaggcccuccaccagguauucggugcaaucuacggugcggccuucagcgggguguccuggacuaugaagauacugaucggcguuaucaucaccuggauagguaugaacucccgcuccaccagccuguccgugagccugguguuagucggcguggugacccuguaucugggcgccaugguucaggcggacaguggcugcguggugucguggaagaacaaggaacucaagugcggcucagguauauucaucacggacaacguccacaccuggaccgagcaguacaaguuccagcccgaaucucccucuaaguuagccuccgccauccagaaagcccacgaggagggaaucugugggauacggagcguuacacgccuggagaaccucauguggaagcagaucacgcccgaacugaaccacauccuguccgagaacgaggugaagcugaccaucaugaccggcgacauuagaggaauaaugcaggccggcaagaggagccugcggccgcagcccaccgagcugaaguacucguggaaaacguggggaaaggcgaagaugcucagcaccgagucgcacaaccagaccuuccugaucgacggccccgaaaccgcagagugcccgaacacgaaccgcgccuggaacagucuggagguagaggacuacggcuucgggguguucaccaccaacauauggcucaagcugcgagacaagcaggacguguucugcgauucaaagcugaugagcgcugccaucaaggacaaccgcgcgguccacgccgacaugggcuauuggauugagagugcccucaacgacaccuggaagauggagaaagccagcuucauugaaguaaagucgugccacuggcccaagagccacacccuguggagcaacggcgugcuggagagcgagaugauuauccccaagaacuucgccgggcccgucucccagcacaacuaccggccggguuaccacacgcaaaccgcggguccguggcaccucggcaaauuggagauggacuucgaccucugugaggggacgaccgugguggucacggaggacugcggcaaccgcggucccagccucagaaccaccaccgccagcggcaagcuaauuacggaguggugcugucgcuccugcacccugcccccgcuccgguaccgcggcgaggacgggugcugguacggaauggagauccggcccuuaaaggagaaggaggaaaacuuggugaauagccucgugaccgccggccacggccagaucgacaacuucucccuaggcgucuuagggauggcacuccugcuggaggagaugcuccgcacccguauaggcacuaagcacgcgauccugcugguggccguaagcuucgucacccucaucaccgggaauauguccuucagggaccuggggcgugugaugguuauggucggugccaccaugacggacgacauaggcaugggagugacuuaccuggcccucuuagccgcguucaagguacggcccaccuucgccgccggacugcuucugcgcaagcugacgagcaaggagcuaaugauggccacgaucggaaucgcgcuacugucccagaguaccauccccgaaaccauccucgagcugaccgaugcguuggcccuggggaugaugguccugaagauugugcggaacauggagaaguaccaguuggccgugacaguaauggccaucucuugcgugccgaacgcugugauccuccagaacgcauggaaggucagcugcaccauccuggccgccguauccgucaguccacugcuguugaccuccagccaacagaaggccgacuggaucccccuggcgcucaccaucaagggccugaaccccacggccaucuuccugaccacacucucccgaaccagcaagaagcgaucauggccgcugaacgaggccaucauggccgugggcauggugagcauccuggcaaguagccuccuuaagaaugacauccccaugacgggcccccugguugcgggggggcucuuaacugugugcuacgugcugaccggacgcagcgccgaccuagagcuggagcgagcagccgaugucaagugggaggaccaggccgaaaucuccgggaguuccccuauacugagcaucaccaucuccgaggauggcagcaugucgauuaaaaacgaggaggaggagcagacgcucacgauccugauccgcaccggucugcucgugauaagcggaguguucccggucucgauacccaucaccgcggccgccugguaucugugggaggugaagaagcagcgggcuggcgugcucugggacgucccuagcccgccgcccguagagaaggccgaguuggaggacggggcauaccgaaucaagcagcggggcauucugggcuacucccagaucggcgccggcguguauaaagaggggacguuucauacgauguggcacgucacgaggggcgccguguuaaugcauagagggaagcgcaucgagcccaguugggccgacgugaagaaggaccucauaagcuacggcggaggcuggaagcuggagggcgaguggaaggagggagaggagguccagguacucgcccucgagcccgguaagaacccacgggcggugcaaaccaagcccgggaucuucaagaccaacacaggcaccaucggggccgucagcuuagacuuuuccccuggaaccagcggcucccccauaguagacagaaaggggaaggugguuggccuguacgggaacggaguggugacgcggagcggcgccuacgucagugccauagcgcagacggagaaguccaucgaggacaaccccgagaucgaggacgacauauuccggaagaagcggcucaccauaauggaucugcacccgggggccggcaagaccaagcgcuaccugccggccauugugcgggaggccaucaagcgcgggcugcguacccucauucuggccccgacgcggguggucgcggccgagauggaagaggcccugcgcggccuacccauccgguaccaaaccaccgccauuaagacggagcacacagggcgugagaucguggaccuuaugugccacgccaccuucaccaugaggcugcucucgcccgugcgcguccccaacuacaacuugaucauuauggacgaggcgcacuucaccgacccggcuuccaucgccgcccgggguuacaucagcacgcgcguggagaugggcgaggcagcggggaucuucaugacugccacgccgccuggcucccgcgaucccuucccacagagcaacgccccaaucauggacgaggagagggagauccccgagaggucguggaacagcggucacgagugggugaccgauuucaagggaaagacugucugguucguucccagcaucaaggccgggaaugauaucgcggccugucugcgcaagaacgguaagaagguaauccaacucagccgaaagaccuuugacuccgaauacgucaagacccgcgcgaacgacugggacuucguggugacaacggacauuagcgagaugggcgccaacuucaaggccgagagggucaucgacccgcgccggugcaugaagcccgucauccugaccgacggggaggagcgcgugauccuggcgggccccaugcccguaacccauuccagcgccgcccagcggcgcgggcgcaucggucggaacccgaagaacgagaacgaccaguacaucuacaugggggagccgcucgagaacgacgaggacugugcccacuggaaggaggccaaaaugcugcuggacaacaucaacacccccgaggguaucauccccaguauguucgaaccggagcgcgagaaggucgacgcgaucgacggcgaauaccggcucagaggggaagcccggaaaacguucguggaccugaugcgccgcggcgaccugcccgucuggcucgccuacaagguggccgccgaagggaucaacuacgcggaccgcaaguggugcuucgacgguaucaagaacaaccagaucuuagaggagaacauggagguggagauuuggaccaaggagggagagcggaagaaguuaaaaccucgcuggcucgacgcccggaucuacagcgacccgcuggcccugaaggaguucaaggaguucgccgcgggacgcaaaucccucacccugaaccugaucaccgagaugggccggcucccgaccuuuaugacccagaaggcccgcaacgcccuggacaacuuggccguccuccacaccgccgaggcggggggcagagccuacaaccacgcccugagcgagcugccagagaccuuggagacgcuacugcuauugacccugcucgccaccgugaccgggggcauuuuccuuuuccugauguccggcaaggggaucggcaagaugacucuggggauguguugcaucaucaccgccuccauccugcugugguacgcccaaauucagccccacuggaucgccgcuuccaucauucuagaguucuuccugaucguccucuuaauccccgagccugaaaagcagcgcacgccucaggauaaccaacugaccuacguggugaucgcgaucuuaaccgucguggccgccacgauggccaacgagaugggcuuccuugagaagaccaagaaagaccuggggcugggcagcaucaccacccaggagagugaauccaauauccucgauaucgaccuccggcccgccagcgccuggacguuauacgcagucgcgaccacauucgucaccccgaugcugcgccacucaaucgagaacagcuccgugaacguuucgcugacggcuauugccaaccaggccaccguccugaugggccucgggaagggauggccccuguccaagauggacaucgggguaccccuguuggcgaucggcugcuauagccaggugaaccccaucacccugaccgccgcccuguuacugcugguugcccacuaugccaucaucgguccaggccuucaggccaaagccacgcgggaggcccagaagcgcgccgccgcgggcaucaugaaaaacccuaccguggacgggaucaccgugaucgaccuugagccaauccccuacgacccgaaauucgagaagcagcugggccaggucauguuacugauccugugcgugacccaggugcucaugaugcggacgacaugggcgcuuugcgaggccuuaacccuggcaaccgggccaauuuccacgcugugggagggcaaucccgggagguucuggaacaccaccaucgccgucagcauggcgaacaucuuucguggcuccuaccuggccggggccgggcuccuguuuagcaucaugaagaauaccacgaacaccagacgcgguaccgggaauaucggcgagacccuaggcgagaaguggaagucccggcuuaaugcacugggcaaaucugaguuccagaucuacaaaaaguccggcauccaggagguggaccgcacgcuugcgaaggaggggaucaagcggggcgagacagaucaccacgccgugagccgcggguccgccaagcuccgaugguucgucgagaggaacauggugacccccgaggguaagguggucgaccugggcugcggccggggcggguggagcuacuacugcggcgggcugaagaacgucagggagguaaagggccucacgaagggcggcccgggccacgaggagcccauccccauguccacauacggguggaauuuggucagacugcagagcggcguggacguguucuuuacgccccccgagaaaugugacacccuccugugcgauauaggggaaagcucccccaacccgacgaucgaggccggucgcacccugcggguccucaaccugguagagaauugguuaaauaacaacacgcaauucuguauuaaggugcucaaccccuacaugccaagcgucaucgagaagauggaggcccugcagcgcaaguauggcggggcguuggugcggaacccccugucccgcaacaguacccacgagauguacugggugucuaacgccaccggcaauaucgucaguuccgugaacaugaucucccggaugcucaucaaccgcuucaccaugaagcacaaaaaggccacguacgagcccgacguggacuuaggauccgggacucggaacaucgggaucgaauccgagauaccgaaccuggacaucaucggcaagcgaaucgagaagaucaagcaggagcacgagaccuccuggcacuaugaccaggaccaccccuacaagacgugggccuaccacggcagcuaugagacgaagcagaccggguccgccagcucuauggucaacggcguggugcgccuccugacuaagcccugggacgucgugcccauggugacccagauggcuaugacggacacaaccccguucgggcaacagagagucuucaaggagaaaguggacacgcgcacgcaggaacccaaggaagguacuaagaagcugaugaagaucaccgcugaguggcucuggaaggagcugggcaaggagaagacgccccggaugugcacgcgcgaggaguucacccggaaggugcgcuccaacgccgcccugggggccauauucaccgacgagaacaaguggaaauccgcgcgagaggccgucgaggacggccguuucugggaguuaguggaccgggagcgcaacuuacaucuggaggggaagugugagacgugcguguauaauaugaugggcaagcgggaaaagaagcuuggggaguucggcaaggccaaggggucccgcgccaucugguacauguggcugggcgccagguuccuugaguucgaggcccucggcuuccugaaugaggaccauugguucucccgcgguaauagccuaagcggcgucgagggggaaggucuccaccgacugggguacauccuacgcgacguuggaaagaaggagggcggggcgauguacgccgacgacacggccgggugggacaccaggaucacccucgaggaccugaagaacgaggagauggucaccaaccauaugaagggggagcacaagaaacuggcggaagccaucuuuaaguugacguaccagaacaagguggugcgcguucagcggcccaccccgcgcggaaccgugauggacaucaucucacggcgcgaccagcgcggcagcgggcaggucgguaccuacggccugaacacguucaccaacauggaggcucagcugauccggcaaauggagggcgagggcaucuucaaguccauccagcaccucaccgccaccgaggagauagcggugcagaauuggcuggcgcgcguagggcgggagcgccugagccggauggccauauccggagacgacugcguggucaagccuaucgacgaccgcuuugcuagcgcacugacggcccugaacgacauggggaaggugcggaaagacauccagcagugggagcccucccgcggcuggaaugacuggacucaagugcccuucuguagccaccacuuucaugagcuggucaugaaggauggccgggugcucguggucccuugccgcaaucaggacgagcugaucgggagggcacgcaucucccagggcgccggauggagucugaaagagaccgccugucucggcaagaguuacgcccagauguggacucuaauguauuuccaccggcgcgaccugcggcucgcggccaacgccauaugcagcgccgugcccucccauugggugcccacaagccgcacaaccugguccauccacgccaagcacgaguggaugaccacagaggacaugcuggcgguauggaaccgcguuuggauccaggagaaccccuggauggaggacaagaccccgguagagagcugggaggagguccccuaccugggcaagcgcgaggaucaguggugcggcucccucauaggccucaccagccgggccacgugggcuaaaaacauccagaccgccaucaaucaggugcgaagccugaucggcaaugaggaguacacggacuacaugcccucaaugaagagguucaggcgcgaagaggaggaagccggcgugcuuugguga

SEQ ID NO: 25049 - RNA, 9876 nt, Artificial Sequence
  derived and/or modified CDS sequence (opt11) from DENV-2__FJ906961__SS-prME
acugcaggcgugaucguaaugcugaucccgacugccauggcguuccaucucaccacucgcaacggggagccccacaugaucgugggccggcaggagaaggggaaaucccugcuguucaagaccgaagacggcguuaauaugugcacucucauggcuaucgaccugggggaauugugugaagacaccaucaccuacaaaugcccccuccugcgccagaacgagccagaggacaucgacugcuggugcaacucuacgagcaccugggucaccuaugggaccuguacaaccacgggcgagcaccggagagagaagcggucaguggcgcuagugccccaugucgggaugggucucgagacccgcaccgagaccuggaugucuagcgagggagccuggaagcaugugcagaggaucgagaccuggauccugcggcaccccggcuuuaccauuauggcggcaauccuggcauacaccauugggaccacccacuuccagcgggcgcuaaucuucaucuugcugaccgccguagcgccuucuaugaccaugcgcugcauugguaucuccaacagggacuucguggagggcgugagcgggggcuccuggguggacauaguacucgagcacggaucaugcgugaccacgauggccaaaaauaaacccaccuuggacuucgagcugaucaagacagaggccaagcagcccgcuacccuccgaaaguacugcauagaggccaaacuaacgaauaccacaaccgagucucggugccccacucaaggcgagcccagccuaaacgaggagcaggacaagcgcuuuaucugcaaacacuccaugguggaccggggcuggggcaacgggugcggccuguucgggaagggcggcaucguuaccugcgcgauguucacgugcaagaagaacauggagggcaagguggugcagcccgaaaaccuggaauauaccaucguaaucacgccccacagcggugaggagcacgccgugggcaacgacaccgggaagcacggcaaagaaaucaagaucaccccucaguccucgauuaccgaggccgagcugaccggguacggcacgguaaccauggagugcucaccccgcaccggacucgacuucaacgagaugguccugcuccagauggaggacaaggccuggcucgugcaccggcaaugguuccuggacuuaccccuccccuggcugccuggugccgauacccagggcagcaacuggauccagaaggagacgcuggugacauucaagaacccccacgcgaagaagcaggacguuguaguucuggggucccaggagggugccaugcauaccgcccugaccggggcuacagagauucagaugagcagcggcaaccuccuguucacuggccaccugaagugccggcugcggauggacaagcuccagcugaaagggaugucguauagcaugugcaccgguaaguucaaaauuguuaaggagaucgccgaaacucagcacgggacgaucgugauccgcguccaguacgagggggacggcuccccgugcaagauacccuucgagaucaccgaccuggagaagcggcauguacucgggcgccugaucaccgugaacccgaucgucaccgagaaggauucuccgguuaauaucgaagcagaaccgcccuucggcgauagcuacauuaucauugggguggagccgggccagcuaaaacugaacugguucaagaagggguccuccaucggccaaauguucgagacgaccaugaggggagccaagagaauggccaucuuaggugacaccgccugggacuucggcucccucgggggcguauucacuaguaucgggaaggcauugcaccagguauuuggugcgaucuacggcgccgccuucucaggggugaguuggacgaugaaaaucuuaauuggcguaauaaucaccuggaucggaaugaacagccgcucuacgagccuguccgugagccuggugcucguaggcguggugacccuguaccuuggggccaugguccaagcggacuccggcugcguagugagcuggaagaacaaggagcucaaauguggcucagggaucuuuaucacggauaacguccacaccuggacagagcaguacaaguuccagcccgagucccccaguaagcuagccucagccauccagaaggcccacgaggagggaaucugcgggauacggagcguaacccggcuggagaacuugauguggaaacaaaucacgccugagcugaaucacauccuguccgagaacgaggugaagcuuaccaucaugacgggggacauucgggguaucaugcaggccggcaagcgaagccugcggccgcagcccacagagcuaaaguacuccuggaagacguggggcaaggcgaagaugcuaagcaccgagccccacaaccagaccuuucugaucgacgggccggagaccgccgagugccccaauacaaaucgcgccuggaacucccuggagguagaggauuauggguucgggguauucacgaccaauaucuggcugaagcugagggagaagcaggagguguucugcgacagcaagcugauguccgcggcaauaaaggacaaccgcgcaguccaugccgauaugggcuacuggaucgagucugcccucaacgacaccuggaaaauggagaaagccuccuucauagaggucaagagcugccacuggcccaagucccacacccuguggagcaacggcgugcuggaaagugaaaugauaauccccaagaacuuugcugggccaguuagccagcacaauuaccggcccggcuaucacacgcagaccgccgggcccuggcaucucggcaagcuggagauggacuucgaccuuugcgaagggaccaccgugguggucacugaagacugcggcaauagaggccccucccugcggaccaccaccgccagugggaagcugaucacggaguggugcugccgcagcuguacccugccaccccuccgauauaggggagaagacggcugcugguacggcauggagauaagaccccuaaaagagaaggaagagaaccuggugaauucccucgugaccgccgggcacggccagaucgacaacuucagucuaggagucuugggcauggcccucuuccuggaggagaugcuccgcacccggauaggcacaaagcacgcgaucuuauugguggcaguauccuuugucacucugaucaccggaaacauguccuuccgugaccucggccgggucauggugaugguuggggcgaccaugacggacgauaucggcaugggcgucacguacuuggcccuucucgccgccuucaagguccggcccacguucgcugccgggcugcugcuccgcaagcugaccuccaaggagcugaugauggccacgaucgggaucgcccuccugagccaauccaccauuccggagaccauccuggaguuaaccgaugcgcucgcccuugggaugaugguucugaagaucgugcggaacauggagaaauaccaacuggccguuacgaucauggcuaucagcugcguacccaacgcagugauccuccagaacgcguggaaaguaucgugcaccauacucgccgcugucuccgugagcccccugcuacucaccagcucgcaacagaaggcagacuggaucccccuggcguuaacgaucaagggccucaacccgacggccaucuucuuaaccacccugagccgcaccuccaagaagcggaguuggccccucaacgaggcgauaauggccgucggcaugguguccauccuggccucgucucugcucaagaacgacauccccaugacggggccccugguggcgggcggguugcucaccgucugcuacguguugaccggacguagcgcugaccucgagcucgagcgggcagccgacgugaagugggaagaucaggccgagaucucuggcuccagcccgauccuguccaucaccaucuccgaggacggcuccaugucgaucaaaaacgaggaggaggagcagacucugacaauacucauccgcacaggccugcugguuaucuccggagucuucccaguuagcauacccaucaccgcggcagccugguacuugugggaggucaaaaagcagcgugccggcgugcugugggacguucccucgccgccgcccgucgagaaggcggagcuugaggacggggcauaccgcauaaagcaacgggguauccucggauacucccagauuggagcaggcguuuacaaggaagggaccuuccacacuauguggcaugugacccguggcgccguccugaugcaccgagggaagcgaaucgagccuucgugggccgacgugaagaaggaccugaucagcuacggcgguggcuggaaacucgagggcgaguggaaggagggggaggaggugcagguccuagcccuggagcccggcaagaacccucgcgcggugcagacuaagcccgggaucuucaagaccaacacuggcaccaucggggccguguccuuagacuucagcccgggcacuuccggaagccccaucgucgaccgcaaggggaaagugguugggcuguacgguaacggcgucgugacccgguccggcgccuacgugagcgccaucgcgcaaaccgagaaauccaucgaggacaaccccgagaucgaggacgacauauuccgcaagaagcgucugaccaucauggaccuacaccccggggccggcaagaccaaacgcuaucugccugcuaucguucgggaagcgaucaaacgcggguuacgcacccugauccucgcuccgacacgggucguggcggcugagauggaagaggcccugcgcggucugccgauucgguaccagaccaccgccaucaagacagagcacaccgggcgagagauagucgaccucaugugucacgcuaccuucacaaugcgucuucugagccccgugcgcgucccgaacuacaaccucaucaucauggacgaggcgcacuucaccgaccccgccucgaucgccgcgcgggguuacaucucuacgcgcgucgagaugggagaggccgcggggaucuuuaugaccgcaacgccgcccggcagccgggacccguucccccaguccaacgcccccaucauggacgaggagcgagagauccccgagcgcagcuggaacuccgggcaugaaugggugaccgacuucaagggcaagacaguaugguucgugccuucgaucaaagccgggaacgacauugcggccugccugcgcaagaacggaaagaaagugauccagcugucgagaaagaccuucgacagcgaguaugugaagacgagagccaacgacugggacuucgucguuaccacggacaucagugagaugggcgcgaacuucaaggccgagcgagugaucgacccccggcggugcaugaagcccgucauccucaccgacggggaggagcgcgugauccuggcaggccccaugccagucacccauucauccgccgcucagcggcgcggucgcaucggccggaaccccaagaacgagaacgaccaguacaucuacaugggggagccccuggaaaacgacgaggacugcgcccacuggaaggaggcaaagaugcucuuggacaacaucaacaccccagagggcauaaucccgagcauguuugagcccgagcgugagaaggucgaugcgaucgacggcgaguaccggcugcgcggggaggcccggaaaacauucguggaccucaugcgccggggugaccuccccguuuggcuggccuacaaggucgccgccgagggaauuaacuacgcggaccgcaaguggugcuucgacggcaucaagaacaaccagauccuggaagagaacauggagguggagaucuggaccaaggagggagaacggaagaaacugaagccccgcuggcuggacgccagaaucuacuccgacccccuugcccugaaggaguucaaggaguucgcggcaggccgcaagagccugacccucaaccugaucaccgagaugggccggcuuccaacguucaugacccaaaaggcccgcaacgcccucgauaacuuagccguguugcauaccgccgaagccgggggaagggccuauaaccacgccuugucagagcugccagagacccuggaaacguuacugcugcucacccugcuggcuaccgucaccgguggcaucuuccucuuccugaugaguggcaaggggaucggcaagaugacccuugggaugugcugcaucauuacggccucuauccuccugugguacgcgcagauccaaccucacuggauagccgccuccauaauccuggaauucuuccugaucgugcugcugauccccgagcccgagaagcagcgcacgccccaggauaaccagcucaccuacgucgugaucgccauccugacagucgucgccgcuacuauggccaaugagauggguuuccuggagaagaccaagaaagaccucgggcugggcuccaucacgacccaagagagcgagucaaacauacuugacaucgaccuccggccagccagcgccuggacgcuguacgccguggcgaccaccuuugugacacccauguuacggcacagcaucgagaauuccucggucaaugucucccucacggccauugccaaccaggcuaccgugcuuaugggccucgguaaaggcuggccgcuaagcaagauggacaucggggucccccugcuggcgauaggcuguuauucacaggugaacccgaucacacucaccgccgcccucuuacuucugguggcccacuacgccaucauaggccccggccugcaggccaaggccacgcgggaggcccagaaacgugcggccgccgguaucaugaagaaccccaccgucgacgggauuaccgugauagaccuugagcccaucccguacgaccccaaguucgagaagcagcugggccaggugauguuacucauccugugugugacccaggugcugaugaugcgcacaaccugggcccucugcgaggccuugacccuggccacggggcccaucaguacgcucugggaagguaauccaggacgcuuuuggaacaccaccaucgccguguccauggcgaacaucuuccgcgguagcuaccuggccggcgccgggcuacuguuuuccauaaugaagaacacgacgaacacccggcgcggcaccgggaacauaggcgagacccugggcgagaaguggaaguccagacugaacgcccucgggaaguccgaguuccagauauacaagaagucgggaauccaagaggucgaccguacgcuggcgaaggaggggaucaagcggggcgaaaccgaccaucacgccgugucccgcggcagcgccaagcugcggugguuuguagagcgcaacaugguaaccccggaggggaaggugguggaccucgggugcgggcggggcgggugguccuacuacugcggaggacugaaaaacguccgcgaagugaaaggccuuaccaaaggcggcccgggccacgaagagcccaucccgaugagcaccuacggguggaaccucguuagacugcagucaggaguagacguguucuuuaccccgcccgagaagugcgauacccugcucugcgacauuggagagagcagcccgaaucccacuauagaagccggccguacccuucggguucugaaccucgucgagaauuggcugaacaauaacacacaguucugcaucaaggugcucaacccguauaugccauccgugaucgagaagauggaggcccuucagcgcaaauauggcggggcgcugguccggaacccucugucgcgcaacucuacacaugagauguauugggugucgaacgcgaccggcaacauaguguccucgguaaacaugaucucccggaugcugaucaaccgcuucaccaugaagcacaagaaggccacguacgaaccggacguggaccucgggagcgggacccggaacaucgguaucgaauccgagauccccaaccuggacaucaucggcaagcgcaucgagaaaaucaagcaggaacaugagaccagcuggcauuacgaccaggaccaccccuacaagacuugggccuaucauggaucauacgagacgaagcaaaccgggagcgcuuccagcauggugaauggcgucgugcgccuguuaaccaaacccugggacgugguccccauggugacccagauggcgaugacggacaccacccccuuugggcagcagagagucuuuaaggaaaagguugacacgcgcacgcaggagcccaaagagggcaccaagaaacugaugaaaaucacagccgaguggcuguggaaggaacucgggaaaaagaagaccccccggaugugcacgcgcgaggaguucacccgcaagguacguuccaacgccgcccugggggccaucuucaccgacgagaauaaauggaagucggcccgggaggcaguggaggacggucguuucugggaguuagucgaccgcgagcgaaaccuacaccuggaggggaagugcgagaccugcguguacaacaugaugggcaagcgggagaagaaguugggggaguucgggaaggccaagggcagccgagccaucugguacaugugguugggagcgcgguuccuggaguuugaggcacucggauuccucaacgaggaccacugguucagucgcggaaacucccucagcggcguugaaggagagggccugcaccggcucggguacauucugcgggacgucgggaagaaggagggcggggccauguacgcagacgauacggccggcugggacacacgaaucacccuggaggaccucaagaaugaggagauggugaccaaucauaugaagggggagcacaagaagcuggcggaagccaucuucaagcugacauaccagaacaaagucgugcgcgugcagcgacccacgccccggggcaccgucauggacaucaucagccggcgggaccaacgcggcuccgggcaggucggcaccuacgggcucaacacguuuaccaacauggaggcacagcugauacggcagauggagggcgaagguaucuucaagagcauacaacaccuuaccgccacagaggagaucgcugugcagaacuggcucgcgcgggucgggcgggaaagacugucccgaauggccauuucaggcgacgacugcgugguuaagccaaucgacgaucguuucgccagcgcccugacggcucucaacgacauggggaagguuagaaaggauauccagcagugggagcccagccgcggguggaaugacuggacccaggugccguucugcucccaccacuuucaugaguuagugaugaaggacgggcggguucugguugucccaugccgcaaucaggacgaacucaucggccgugcccgcauaucccaaggggccggcuggucccugaaggagaccgccugccugggcaaaagcuacgcccaaauguggacccucauguacuuccaucgacgcgaccuucggcuggcggcgaacgcgaucuguuccgcgguccccagucacugggugccuacuucccgcaccaccuggagcauccacgccaagcacgaguggaugaccacagaggacauguuagcgguguggaaccgggucuggauccaagagaauccauggauggaggacaagacgccaguggaguccugggaggaggugccauaccuggggaagcgugaggaccaauggugcggcucacugauugggcucaccucgcgggccaccugggccaagaacauccagaccgccaucaaccaaguccgcucguugauuggcaaugaagaguauacggauuacaugccgaguaugaagcgcuuccgacgcgaggaggaagaagccggcguguuaugguga

SEQ ID NO: 25050 - RNA, 9876 nt, Artificial Sequence
  derived and/or modified CDS sequence (opt11) from DENV-2__FJ906962__SS-prME
accgcgggcgugauaguaaugcuaauccccaccgccauggccuuccaucucaccacccgaaacggugagccgcacaugaucgugggccggcaggagaaggggaagucucuccucuucaagaccgaggacggcgugaauauguguacccucauggccauagaccugggggagcugugugaggacaccaucaccuacaaguguccccuucugcgccagaacgagcccgaagacaucgacugcuggugcaacagcaccagcaccuggguaaccuacgggaccugcaccaccacgggcgagcaccgacgggagaagcgguccguggcacuggugccucacgucgggaugggacuagagacccgcaccgagaccuggaugagcucagagggggccuggaagcacgugcagcggaucgagacguggauccugcgccacccgggcuucaccaucauggccgcgauccuggccuacaccauugggaccacgcacuuccagcgggcccuuaucuucauacugcugaccgccgucgcgcccagcaugaccaugcgcugcaucggcaucuccaaccgggacuuugucgagggaguuagcggcggcuccuggguggacaucguccucgagcacgggagcugcgugaccacgauggccaagaauaagcccacccuggacuucgagcugauuaaaacugaggccaagcagcccgcgaccuugaggaaguacugcaucgaggccaagcugacaaacacgaccaccgaaucccggugcccgacgcagggcgaacccagccuaaacgaggagcaggacaagcgcuuuaucugcaagcauuccaugguugaccggggaugggggaacggcugcgggcuguucggcaagggcgggaucgucaccugugcgauguucacgugcaagaagaacauggagggcaagguggugcagccugagaaccuggaguauaccaucgucaucacgccgcacagcggggaggagcacgcggugggcaacgacaccgggaagcacggcaaagagaucaagaucaccccgcaguccucuaucacggaggccgaacugaccggguacggcacugugaccauggagugcuccccccgcaccggccucgacuucaaugaaauggucuugcuacagauggaggauaaggcuuggcucguacacaggcagugguuccuggaccuaccccuccccuggcuuccgggggccgacacccagggaagcaacuggauccagaaggagacgcuugugaccuucaaaaacccccacgcgaagaagcaggacgucgugguccucggaucccaggagggcgcuaugcacaccgcccugacgggggcuacggagauccagaugagcagcggaaaccuccuguuuaccggccaccugaagugccgccugcggauggacaaacuacagcugaaggggauguccuacagcaugugcacuggcaaguucaagaucguaaaagagaucgccgagacccagcacgggacgaucgugauccgcguccaguaugagggcgauggcuccccuuguaagauccccuucgagaucacugaccuggaaaagcggcacgugcucgggcgccugaucaccgugaacccgaucgucaccgagaaggauagccccgucaacaucgaagcggagccgcccuucggcgacuccuacaucaucaucgggguggagccgggccagcugaagcucaauugguuuaaaaagggcagcuccaucggccagauguucgagacgaccaugcgcggcgccaagcggauggccauccugggugacaccgccugggacuucggcagccucgggggcguuuucaccuccaucgggaaggcccuccaccagguguucggggcgauauacggagcagccuucagcgggguguccuggacgaugaaaauccugaucggagucaucaucaccuggaucgggaugaacagccguuccaccagccuguccgugagcuuagugcucgucggaguggugacccuguaccugggggcgaugguucaggcggacuccggcugcguugugagcuggaagaacaaggagcucaagugcggcuccggcaucuucaucacggacaauguccacaccuggaccgagcaauacaaguuccagcccgagagcccuagcaagcuggccuccgccauccagaaggcccacgaagagggcaucugcgggauucggagcgugacccgucuagagaaccucauguggaagcaaaucacgcccgagcugaaccacauccuguccgagaaugaaauuaagcucaccauaaugaccggcgacauccgggggaucaugcaggccggcaagcgcagccugcggccgcagcccacugaacugaaguacuccuggaagacguggggcaaggcgaagaugcucagcacggagucccacaaccagacauuccugaucgacgggcccgaaaccgccgagugcccgaacaccaaucgcgccuggaacagccuggagguggaggacuacggcuucggggucuucaccaccaacaucuggcucaagcugcgggagaagcaggacguguucugcgacuccaagcugaugagcgccgcuauaaaggacaaccgcgcggugcacgccgacaugggcuacuggaucgaguccgcccucaacgacaccuggaagauggagaaggcgagcuucaucgaggucaaauccugucacuggcccaagagccauacccugugguccaacggcgugcuggagagcgaaaugaucauccccaagaacuucgccgggcccgugucccaacacaacuaccggccgggcuaccacacacaaaccgcagggcccuggcacuugggcaagcuggagauggauuucgaucugugcgaggggaccaccgucguggugacggaggacugcggcaaccgcggccccagccuccggaccaccacagccagcgggaagcugaucacggaguggugcugccgcuccugcacccugccuccucuccgguaccgcggcgaggaugggugcugguacggcauggagauucggccccugaaggagaaggaggagaaccuugucaacagccucgugaccgccgggcauggccagaucgauaacuucagccugggcguacuggggauggcccucuuccuggaggagaugcugcguacccggaucggcacgaagcacgcgauccuccuagucgccgugagcuucguaacccugaucaccgggaacauguccuuccgcgaccucggccgaguuaugguaauggugggugccaccaugacggacgacaucggcaugggugucacguacuuggcacugcucgcugcguucaaggugcggccuaccuucgccgcggggcuguuacuccgcaagcugaccaguaaggagcugaugauggcgacuauugggaucgcucuccuuucucagagcaccauccccgagaacauacuggagcucaccgaugcguuagcccuggguaugaugguucugaagauuguccggaacauggagaaguaccaguuggccgugaccaucauggcgaucuccugcguaccgaacgccgucauccugcaaaacgcguggaaggugagcugcacgauccucgcugccguguccgucucuccccugcugcucacauccucacagcagaaagccgacuggauccccuuagcgcucacgaucaagggccucaauccuaccgcaaucuuccugacgacccugucacgcaccucgaagaaacgguccuggccccuuaacgaggccaucauggccgugggcaugguuagcauccuggccuccagccugcucaagaacgacauccccaugaccgggccccuuguggcgggcgggcugcucacggugugcuacguccugacaggccgcagcgccgaucucgagcucgagcgggccgccgacgugaagugggaggaccaggccgagaucuccgggagcucccccauccugagcauaacaauuuccgaggacggcagcauguccaucaagaacgaggaggaagagcagacccugacgauccucauccgcaccggccugcucgugauuagcgggguguucccgguguccaucccaaucaccgcggcagccugguaccucugggaggugaagaagcaaagagccggcgucuuaugggacguaccgagcccgccgcccguggagaaggcagagcuggaggacggggcauaccgcauuaaacagcggggcauccucggguacucccagaucggggccggcgucuacaaggaggggacguuccacaccauguggcacgugacgcgcggcgcaguucugaugcaucgagggaagcgcaucgagcccagcugggccgacgucaagaaggaccugaucucauacggagggggcuggaagcucgagggcgaguggaaggagggagaggagguacaggugcuggccuuggaaccaggcaagaacccgcgggcgguccagacaaagcccgggauuuucaagaccaacaccggcacuaucggcgccgugucacucgacuucagccccggcacaagcggcuccccaaucguggacagaaaggggaaggucgucggccuguacgggaacggcguggucacccggagcggcgcauacguguccgccaucgcgcagaccgagaaauccaucgaagacaaccccgagauagaggacgacaucuuccgcaagaagcggcugacgaucauggaccuccaucccggggcaggcaagaccaagcgcuaucugcccgcaauagugcgggaggcuauuaagcgcgggcuucgcacgcugauccucgccccgacccgggucguggcggcggagauggaggaagcccugcgcggccugcccauccguuaccagacgacagccaucaagaccgagcacaccgggcgcgaaaucguggaccucaugugccacgccacauucacaaugcgccugcugagccccguccgcguucccaacuacaaccucaucaucauggacgaggcgcacuucaccgacccggccagcaucgcugcccggggcuauaucagcacccgcguugagaugggcgaggccgcggggaucuuuaugacagccacgccgcccggcucccgggaccccuucccgcaaagcaacgcccccauaauggacgaggagcgcgagauccccgaacgauccuggaacagcgggcacgagugggucaccgacuucaagggcaagaccgucugguucguucccuccauuaaggcugggaacgauaucgcggccugccugcgcaagaacgggaaaaaggucauccagcugagccggaagacguucgacuccgaauacgugaagacccgugccaacgacugggacuucguggucaccaccgauaucagcgagaugggagccaacuuuaaggccgaacgagugaucgacccuaggcggugcaugaagccaguaauccucacggacggggaggaacgggucauccuggcggggcccaugcccgugacccacuccagcgccgcccagcgacgugggcgcaucggccggaacccgaagaacgagaacgaccaguacauauacaugggggagccccuugagaacgacgaggacugcgcccacuggaaggaggccaagaugcuccuggacaauaucaacacccccgagggcaucauccccuccauguucgagccggagcgcgagaaaguagacgcgaucgacggcgaguaccggcugcgcggggaggcccguaagaccuucgucgaucucaugcgccguggcgaccugcccgugugguuagccuacaagguggccgccgaggggaucaacuacgcggaccgcaaguggugcuucgacgguauuaagaacaaccaaauccucgaggagaauauggaggucgagaucuggacgaaggagggggagcgaaagaagcugaagccucgcuggcuggacgcccggaucuauuccgacccgcucgcccugaaggaguucaaggaguucgccgcggggcguaagucccugaccuugaaccugaucaccgagaugggccggcugcccacguucaugacgcagaaggcgcgcaacgcacucgauaaccuggccgugcugcacacggcggaggccgggggccgggccuauaaccacgcccuuagcgagcugcccgagacccuggagacccuccugcugcucacccugcuggccaccgugaccgguggcaucuuccucuuccugauguccggcaaggggaucgggaagaugacgcuggggaugugcugcaucaucaccgccagcauccuucugugguacgcgcagauccagccacacuggaucgccgccuccaucauucuggaguuuuuccucaucguccugcugaucccggagcccgagaagcagcgcacuccucaggacaaccagcucacauacgucgucaucgccauccugaccgugguggccgcgaccauggccaacgagaugggcuucuuggagaagacgaagaaggaccucggucugggcagcaucaccacccaggagagcgaguccaacauucuggacaucgaucuccgucccgccagcgccuggacccuguaugccgucgcgacgacuuuugugacgccgaugcugcgccacucgauagagaauagcuccgugaacgucagccucaccgccauagcgaaucaggccacgguccugaugggccuugggaaaggcuggccccucuccaagauggacauuggggugccccugcuggcgauaggcugcuacagccaggucaacccaaucacccucaccgccgcccugcuccuccugguggcccacuacgccaucauaggaccgggucuacaggcgaaggccacccgggaggcccagaagcgcgcggccgcaggcaucaugaagaaccccacgguagaugggauuaccgucauugaccucgagcccauccccuacgacccgaaguucgagaagcagcugggccaggugaugcugcugaucuuaugcgugacccagguucugaugaugcggaccacgugggcccucugcgaagcccugacccuggccaccgggcccaucucgacucucugggagggcaaccccgggcgcuucuggaacacuacuaucgccgugagcauggcgaacaucuuccgaggcuccuaccuggccggcgcugggcuccuguucaguaucaugaagaacaccaccaacacgcggcgcggaaccgggaacauuggcgagacccugggagagaaguggaagucccggcuuaacgcccucggcaagagcgaguuccaaaucuacaagaaguccggcauccaggaaguggaccgcacacuggcgaaggaggggaucaagcggggcgagacggaucaccacgccgucagccgcggguccgccaagcugcggugguucguagagcgcaauaugguuacccccgagggcaaggucguggaccucggcugcgggcggggcggguggagcuacuacuguggcgggcugaagaacgugcgcgaagucaaaggccugaccaagggcggcccaggccacgaggagcccauccccauguccaccuacgguuggaaccuggugcggcugcagagcggcguggacgucuucuucacgcccccggagaagugcgacacccugcucugcgacaucggcgagagcucucccaaccccacaaucgaagccgggcgcacccugcgggugcugaaccucguggaaaacuggcugaauaacaacacccaguucugcaucaagguccugaaccccuacaugccgucugugaucgagaagauggaggcccuccagcgcaaguauggcggggcgcuggugcgcaaccccuuaucgcgcaacagcacgcacgagauguacugggucuccaacgccaccggcaacaucgugagcuccgugaauaugaucucgcggaugcugaucaaccgcuucaccaugaagcacaagaaggccaccuacgagcccgacgucgaucucggguccggcacgcggaacaucggaaucgagagcgagaucccgaaccucgacauuaucggcaaacgcauugagaaaauaaagcaggagcacgagacuuccuggcauuacgaccaggaccacccauauaagaccugggcguaccacggcagcuacgagaccaagcagacgggguccgccagcuccauggugaacggcgugguacgucugcucaccaagcccugggacguuguacccauggucacccagauggcgaugaccgacacgaccccguucgggcagcagcggguguucaaggagaagguggacacccgcacacaggaacccaaggagggcacgaagaagcugaugaagaucaccgccgaguggcuguggaaggagcucggcaagaaaaagacgccccggaugugcacuagagaggaguucacgcggaagguccgcagcaacgccgcccugggggcuaucuucaccgacgagaacaaguggaaguccgcgcgggaggccguggaggacggccgcuucugggagcugguggacagggagcgcaaccuccaccuggaggggaagugcgagaccugcgucuacaacaugaugggcaagagagagaagaagcuaggggaguucggcaaagccaaaggcagcagagcgaucugguacauguggcucggggcgcgcuuucuggaguucgaggcccugggcuuucucaacgaggaccacugguucucucgcgggaacagucugagcggcguggagggggagggccugcaccggcugggcuacauccugcgcgacguggggaagaaggagggcggcgccauguacgccgacgacaccgccggcugggacacgcguaucacccuggaggaccucaagaacgaagagauggucaccaaccacaugaagggggagcacaagaaguuggcggaggccaucuucaagcugaccuaucagaacaaggugguacgcguccagaggcccacgccucgcgguacagucauggacaucaucucccggcgcgaccagcgcggcucaggucaggucggcaccuacgggcucaacacauucacgaacaucgaggcccaguugauccggcagauggagggcgagggcaucuucaaauccauccagcaccuaaccgcaaccgaggagaucgccguccagaacuggcucgcgcgcgucgggcgggagcgccucucucguauggcuauuucgggagacgacugcgucgugaagccaauagacgaccgcuuugcuagcgcccugaccgccuuaaacgauauggggaaggugcggaaggacauccagcagugggagcccucccgcggcuggaacgacuggacucagguccccuucugcagccaccacuuccacgagcuggugaugaaggacgggcggguguuaguugugccgugccgcaaccaggacgagcucauaggccgggcgcgcauuucccagggcgccggguggucucugaaggagaccgccugcuuaggcaagaguuacgcucaaauguggacucucauguacuuucaccggcgcgaccugcggcuggccgcgaacgccaucugcucugccgugcccucccacuggguccccaccagucgcaccacuugguccauucacgccaagcacgaguggaugacgaccgaggauaugcucgccguguggaaccggguauggauccaggagaacccguggauggaggauaagaccccggucgagagcugggaggagguccccuaccuggggaagagagaggaccaguggugcggaagucugaucgggcucacgagccgggcgaccugggccaagaacauccagaccgccaucaaccaggugagaagucugaucggcaacgaggaauacaccgacuacaugcccuccaugaagcgcuuccggcgcgaggaggaggaggcuggcguccugugguga

SEQ ID NO: 25051 - RNA, 9876 nt, Artificial Sequence
  derived and/or modified CDS sequence (opt11) from DENV-2__FJ850053__SS-prME
acugcgggcgucaucgucaugcugauccccaccgccauggcguuccaccucaccacacgcaacggggaaccccauaugaucgucggccggcaagaaaaggggaagucccugcuguucaagaccgaagaugguguuaacaugugcacccucauggccaucgaccugggggagcugugugaagacaccauuaccuacaagugcccguuacuacgccagaacgagccugaggauaucgacugcuggugcaacagcaccucuaccugggucacguacgguaccuguaccaccacgggcgagcaccggcgcgagaagcggucggucgcccuugugccccacgucgggaugggccucgaaacccgcaccgagacauggaugagcucggagggggccuggaagcacgugcagcggaucgagaccuggauccuacgccaccccggcuucacaauaauggccgcgauccuggccuacaccaucgguacaacgcacuuucagcgggcucucauuuuuaucuugcugacagccguggccccgagcaugacgaugagguguauagguauaagcaaucgggacuucgucgagggcgugucggggggcuccuggguggacaucguccuagagcaugggucuugcgugacgacgauggccaagaacaagccuacccuggauuucgagcugauuaagaccgaggcgaagcagcccgccacccuccggaaguacugcaucgaggccaagcugacgaauaccaccaccgaaucccggugccccacacagggcgagcccucguugaacgaggagcaggacaagcguuucaucugcaagcauuccaugguggaucgggguugggggaacggcugcgggcuguucgguaagggcggcauagugaccugugcaauguucacgugcaagaagaacauggagggcaaggucguacagcccgagaacuuagaguacaccaucgucaucacaccccacagcggggaggagcacgcuguggggaacgacaccgggaagcacggcaaggagaucaagaucaccccgcagucuagcaucaccgaggcugaacugaccggguacggcacggugaccauggagugcagcccccgcaccggcuuggacuuuaacgagaugguccugcugcaaauggaggacaaggcauggcuugugcacaggcaaugguuccuggaccugccccucccguggcugccgggugcugacacccaaggcuccaacuggauccagaaggaaacgcuggugaccuucaaaaacccacacgcaaagaagcaggacgucgugguccucgggucccaggagggugccaugcacaccgcccugaccggggccacggagauccagaugagcagugggaaccucuuauucaccggccaccugaagugccgcuuacggauggacaagcuccagcugaaggguauguccuacucgauguguaccgguaaguucaagauagugaaggagaucgcagagacccagcacgguacuaucgugauccgcguccaguacgaaggcgacggcucccccugcaagauuccauucgagaucaccgaccuggagaagcggcacgugcucgggcgccugauaaccgugaauccgaucgucacagagaaggacagccccgugaauaucgaagcggagccucccuuuggagacuccuacaucaucaucggggucgagccgggacagcugaagcucaacugguucaaaaaggggagcuccaucggucagauguucgagacuaccaugcgcggcgcaaagcggauggcgauccugggggacacagccugggacuucggcagccucgggggcgucuucaccuccauagguaaggcccuccaccagguguucggcgcuaucuacggcgcagccuucagugggguuagcuggacgaugaagauauuaaucggugucaucaucacguggaucgggaugaacagccgcagcaccagucugucagugucucuggugcucgucggcgugguaacccuauaccuuggggccaugguccaggcggacuccggcugcguggugucguggaagaacaaggagcucaagugcggcuccgggaucuucaucacggauaacguacacaccuggaccgagcaguauaaguuccagcccgagagccccagcaagcuugcuuccgccauucagaaggcgcacgaagagggcaucugcgggauccggagcgugacgcgucuagagaaccucauguggaaacagaucacccccgaacugaaccacauacuguccgagaacgaggucaaacucaccauuaugaccggcgacauacgagggauaaugcaggcaggcaagcgcagccuucggccucaaccaaccgaacugaaguacaguuggaagacauggggcaaggcuaagaugcucuccaccgagccucacaaucagacauuccugaucgacgguccggagaccgccgagugccccaauacgaaucgcgccuggaauucucuggagguugaggacuacggcuucgguguguucaccacuaauauauggcucaaauuacgagagaagcaagauguguucugcgacagcaagcugauguccgcagccaucaaggauaaccgcgcgguccacgcugacauggguuacuggauugagagcgcccuaaacgacaccuggaagauggagaaggccuccuucaucgagguaaagagcugccacuggcccaaaucgcacacccuguggucgaacggcguucuggaguccgagaugaucauccccaagaacuucgccgggccugucagccaacacaauuaucgacccggauaccauacgcagaccgcgggacccuggcaccucgggaaacuggaaauggacuucgaccugugcgaggggaccacgguggucgucaccgaggacugcggcaacagaggucccucccuccggaccaccaccgccagcggaaagcugaucacggaguggugcugucgcuccugcacccugccgccacucagguaucguggagaggacggaugcugguacggcauggagauuaggccccugaaggaaaaggaagagaaccuggugaacagucuugugaccgccgggcacggccagauugacaauuucagccugggcguccucgggauggcccucuuucuggaggagaugcugcgcacgcggaucggcaccaagcacgcuauccuccugguggcuguguccuucgucacccugaucaccgguaacauguccuuucgcgaccucgggcgcgugauggucaugguuggggccaccaugacggacgacaucgguaugggcgugaccuaccuggccuuacucgcugcauucaagguucggcccacguucgccgccggucugcuacuacgcaagcugaccuccaaggagcugaugauggccacgaucggaaucgcccucuugucucagaguaccauccccgaaaccauccuggagcucaccgacgcacuagcgcugggcaugaugguacucaagaucgugcggaacauggagaaauaccaacuggccgugacgaucauggccaucaguugcguccccaacgccgugauccugcagaacgcguggaagguaucuugcaccaucuuagccgccgucagcgugagcccccugcuacucaccagcucccagcagaaagccgauuggaucccuuuagcgcugaccauaaagggccucaacccgaccgccaucuuccugaccacccugucgaggaccuccaagaaacguagcuggcccuugaaugaagccaucauggccgucgggaugguauccauccuggccucuuccuuacugaagaacgacauccccaugacggggccccugguugcgggcggcuugcucaccgucuguuacguguuaacgggacgcagcgccgaccuggaacucgagcgggccgccgacgugaagugggaggaccaggccgagaucucagggucaaguccgauccuguccaucaccaucagcgaggacggcuccaugagcaucaaaaaugaagaagaggagcagacgcuuaccauccucauccgcaccggcuuacuggucauaagcggaguguuccccgugagcauccccaucaccgcggcugcgugguaccucugggaagugaagaagcagcgggccggcgugcuaugggacgugcccuccccgccgccagucgaaaaggccgaacuggaggauggggcguaccgcaucaagcagcggggcauccucggguacucgcagaucggggccggcgucuacaaggagggaaccuuccacacgauguggcaugugaccagaggcgccguccugaugcaccgggggaaacgcaucgagccauccugggccgacgugaagaaagaccugaucagcuacggggggggcuggaagcucgagggcgaguggaaggagggggaagaggugcaggugcuagcccuggagcccggcaagaacccccgagcggugcagaccaagcccggaauuuucaaaaccaacacgggcacgaucggagccgugagcuuagacuuuucgccgggaaccucuggcagcccgauuguggaccgcaaggggaaggugguuggguuguacgggaacggugucgugacucgauccggagcauacgugucugccaucgcgcagacggagaaauccaucgaagacaacccugagaucgaggacgacauuuuccgcaaaaagagacuaaccaucauggaccuucaccccggggccgguaagaccaagagauaucugccggccauuguacgggaggccauaaagcgugggcugcgcacacugauacucgcccccacacgugugguggcugccgagauggaggaggcgcugcgcggucuccccauccgguaccagaccaccgccaucaagaccgagcacacuggccgcgagaucguggaccucaugugccacgccacuuucaccaugcggcugcuaagccccgugcgcgugccgaacuacaaccucaucaucauggacgaagcgcacuuuaccgaccccgcaucaaucgccgcccgaggauacauauccacccgagucgagaugggcgaggccgcgggcauuuucaugaccgcaacaccgcccggcagccgggacccguucccccaauccaacgccccgaucauggacgaagaacgcgagauuccagagaggucauggaacaguggacacgagugggugaccgacuucaagggcaagacggugugguucgugccgaguaucaaggccgggaaugacaucgcggccugccugcgcaagaacggcaagaaggugauccagcucucacggaagaccuucgacagcgaguacguaaagacucgcgccaacgacugggacuucgucgugacuacggacaucucagagaugggugccaacuucaaagcagagcgggugauugacccccgucggugcaugaaacccguaauccuuaccgauggcgaggagcgcgugauccuagcgggaccaaugccggugacccacagcuccgccgcccagcggcgcgggagaaucggucggaaccccaagaacgagaacgaccaguacaucuacaugggggagccacuggagaacgacgaggacugcgcgcauuggaaagaggcgaagaugcugcuggauaauaucaauacgcccgagggcauaauccccagcauguucgagcccgagcgcgaaaaggucgaugcgaucgacggcgaguaccgguugcgcggggaggcccggaagacguucgucgaucucaugcgccguggcgaucuccccgugugguuagccuacaaagucgcagcggaggggauuaacuacgcggauagaaagugguguuucgacggcaucaagaacaaccagauccucgaggagaacauggagguggaaaucuggacaaaggaaggggagcggaagaagcugaagccucgcuggcuggaugcucggaucuacuccgacccgcucgccuuaaaagaguucaaggaguuugcagcgggccgaaagagccugacccucaaucucaucaccgagaugggcagacugccuacguuuaugacacaaaaggccaggaacgcccucgauaaccuggccgugcuucacaccgccgaggccggcggccgggccuacaaccacgccuuaucagaacugcccgaaacccuugagacgcuccugcugcucacccugcuggcuaccguuaccggaggcaucuuccucuuccugaugagcggcaaggggaucggcaagaugacccuggggaugugcugcauaaucacagccucuauccuacuaugguacgcgcagauccagccgcacuggaucgccgccagcaucauccuggaauucuuccucauagugcuguugauucccgaaccugagaagcagcguacgccucaggacaaccagcucaccuacguggucaucgcgauccugaccguggucgccgcgacgauggccaacgagaugggcuuucuggagaaaaccaagaaggaucucgggcugggcuccaucaccacgcaggagucugagagcaacauccuggacaucgaccuacgacccgcauccgccuggacgcuauacgccgucgcgaccacuuucgugacccccauguuacgccauagcauugagaacuccagcgucaacgugucacuuacggcuauagcuaaccaggcuaccguccugaugggucuggggaagggcuggccccucagcaagauggacaucggcgucccgcuucuagcaaucggcugcuacucccaggugaauccgaucaccuugacggcugcccugcugcuacugguggcccacuacgccaucaucgggcccggccugcaagcuaaggccacgcgggaagcccagaagagggcugccgcgggcaucaugaagaacccaacgguggacgggauaaccgugauugaccuugaacccaucccuuacgaccccaaguucgagaaacagcugggccaggugaugcuauugauccugugcgucacccaggugcucaugaugcggacgaccugggcccucugcgaagccuugacccuggcgaccgguccgaucagcacgcucugggaggggaaccccgggcgcuucuggaacaccaccaucgccguguccauggcgaacaucuuccgcggaagcuacuuggccggcgcugggcuccuguuuucgauaaugaagaacaccacgaacacccggcgcgggacggggaacauaggggagacccugggggagaaauggaagucccggcugaaugcccuggggaaguccgaauuccagauauacaagaaguccgguauccaggaggucgacagaacgcuggccaaagaggguaucaagcggggcgaaaccgaccaucacgcggugucccgcgguucugccaagcugcggugguucguggagcgcaacaugguuaccccggaagguaaggugguggaccucggcugcgggcggggcggguggaguuacuacugcggcgggcugaagaacguccgcgaggugaagggccugacaaagggcgguccaggccacgaggagcccaucccuaugagcaccuauggguggaaccucgugcggcuacaguccggcguugacguuuucuucacuccgcccgaaaagugcgacacuuugcucugcgauaucggagagagcagccccaaccccaccaucgaggccggccgaacccugcgggugcuuaaccucgucgagaacuggcucaacaacaacacacaguucugcaucaaaguacugaacccguacaugccauccgugaucgagaagauggaagcucuccagagaaaauacggcggggcccugguaaggaacccccugucacgcaacuccacucacgagauguacugggugagcaaugccaccggcaacaucgugaguucugucaacaugaucucccggaugcuuauaaaccgcuucaccaugaagcacaagaaggccacguacgagccggacguggaucucgggagcggcacccgaaauauugggaucgaaucugagauucccaaucuggacauaauagggaagcgcaucgagaagauaaagcaagagcacgagacauccuggcacuaugaccaggaccaccccuauaagaccugggccuaccacggcucguacgaaacuaaacagaccgggucggccuccagcaugguuaacggcgucguucgccugcucacuaaaccgugggacguggucccaauggugacgcagauggcgaugacugacaccacacccuucgggcaacagcggguauucaaagaaaaggucgacacccgcacgcaggagccuaaggagggcacuaagaaauuaaugaagaucaccgcugaguggcuguggaaggagcucgggaaaaaaaagacuccccggauguguacgcgcgaggaguucacccggaaagugcgcuccaacgccgcucugggggcuaucuucaccgacgaaaacaaguggaaguccgcgcgagaggccguagaggacggccgcuucugggagcuugucgaccgagaacgcaaccuccaccuggaggggaagugcgagacaugcguauacaacaugaugggaaaacgggagaagaaacuaggggaguucggcaaggccaagggcucccgcgcaaucugguacauguggcucggggcgcgguuccuggaguucgaagcccugggcuuccucaacgaggaccauugguuuagccgcgggaacucccuguccgggguggagggggaggggcugcaucgccucggcuacauccugcgcgacgucgggaagaaggaaggcggggcgauguacgcugacgauacggcgggcugggacacgcggauuacccuggaagaccucaagaacgaggagauggugaccaaccacaugaagggggagcacaagaagcuggcggaggccaucuuuaagcugacguaccagaacaaagucgugcgcgugcagcguccgacgccgcgcggaaccgucauggauauuaucagccgacgcgaccaacgcggcuccgggcaggucggcaccuaugggcucaacacguucacuaauauggaggcccaguuaauccgacaaauggagggcgaaggcaucuucaagagcauacagcaccugacugccacugaggaaaucgccgugcagaacuggcucgcccgcgucgggcgggagcgccugucccggauggccaucuccggcgacgacugcguagugaagcccaucgacgaucgcuuugccuccgcacugaccgccuugaaugacauggggaaaguucguaaggacauccaacagugggagcccucgcgcggcuggaacgacuggacccaggugccguucugcucccaccacuuccacgaacuggucaugaaagauggacgcguccuggucgugcccugccggaaucaggacgagcucaucgggcgggcccgcaucucucagggcgccggauggucucuuaaggagaccgccugccugggcaaaagcuacgcccagauguggaccuuaauguauuuucaucgacgcgaucugcggcuagcugcgaacgccaucuguuccgcgguucccucucacugggucccaacuucccgcacgacguggaguauccacgcuaaacaugaauggaugaccaccgaggacaugcuugcgguguggaacaggguauggauacaggagaacccguggauggaggacaagacgcccguggagagcugggaagagguccccuaccuggggaaacgcgaggaccaguggugugguucacuaauugggcucaccucccgggccacaugggccaagaacauccagaccgccaucaaucaggugcgcucacucaucgguaacgaagaauauacggacuacaugcccucaaugaagcgcuuccggcgcgaggaggaggaggccggcguucugugguga

SEQ ID NO: 25052 - RNA, 9876 nt, Artificial Sequence
  derived and/or modified CDS sequence (opt11) from DENV-2__JN819420__SS-prME
accgccggcguuaucgugaugcugauucccaccgcgauggcguuccaucucaccacuaggaacggggagccccauaugaucgugggccggcaggagaaggggaagagucugcuguucaagaccgaggacggaguuaacaugugcaccuugauggccauagaucugggggagcugugcgaggacacuauuaccuacaaaugcccccuucuacgccaaaacgaacccgaggacaucgacugcuggugcaacagcaccucgaccugggucaccuacggcacuugcacaaccacgggcgagcauagacgcgaaaagcgguccguagcgcuggugccccacguagggaugggccuugagacccgcaccgaaacuuggaugagcagugaaggggccuggaaacauguucagagaaucgagaccuggauccugcgucacccgggguucaccaucauggccgcgauccuggccuacaccaucgggaccacgcacuuccaacgggcacuaauauucauccugcugaccgccguggcgcccucgaugaccaugaggugcaucggcauuuccaaccgggauuucgucgagggcgugagcggggguuccuggguggacaucguacucgagcacgggagcugcgugaccacgauggccaagaauaagcccacccuggacuucgaacugaucaagacggaggcaaagcagccugcgacucuccgaaaguacugcaucgaggccaagcuaacgaacaccaccacagagucgcgguguccgacccagggcgagcccucucugaacgaggagcaggacaagcgcuucauuugcaagcacuccaugguggacagaggcuggggaaacggcugcggguuguucggcaagggcgggauagugaccugugccauguucacuugcaagaagaacauggagggcaagguggugcaacccgagaaccuggaguacacaauaguuauuacaccccacucgggggaggaacacgccgugggcaacgacacagggaagcacggcaaggagaucaagauaaccccgcagaguagcaucacagaggcagaguugaccggguacggcacagugaccauggaaugcucacccaggaccggccucgauuucaacgagaugguccuguuacagauggaggacaaggccuggcucgugcaccggcagugguuccuggacuuaccccuucccugguuaccaggagccgacacccagggaucgaacuggauccaaaaggaaacgcugguuaccuucaagaacccucacgcgaagaagcaggaugucgugguccucgggucccaggaaggugcaaugcauacagcccuaaccggagcaacggagauccagaugagcucuggcaaccuccucuucaccggccaccugaagugccgccugagaauggacaagcuccaguuaaagggcaugucguacaguaugugcaccggcaaauucaagaucgugaaggaaauugccgagacccagcacggaacgaucgucauacgcguccaguacgaaggggacggcucccccugcaagauacccuucgaaaucaccgaccuagaaaagcggcacgugcuggggcgccuuaucacagugaaccccaucgucaccgagaaggacucuccugugaacaucgaggcggagccgcccuucggcgacuccuacaucaucaucggggucgaaccgggccaacugaaacucaacugguucaagaaaggaagcuccaucggccagauguucgaaacgacgaugcgcggcgccaagcggauggccauccugggcgacaccgccugggacuucggcagccucgggggcgucuucacuucaaucgggaaggcccuccaccagguguucggcgcgaucuacggcgccgccuucagcgggguguccuggacgaugaaaauccuaaucggcgucaucauuaccuggaucggcaugaauucucgcuccacaagcuuauccguaagccuggugcucguaggcguggugacccuguaccuaggggccgucguucaggcggacuccgggugcguggugaguuggaagaacaaggagcucaagugcggcuccgggauuuuuaucacggacaacgugcacaccuggaccgagcaauacaaauuccagccugagagcccuucgaagcuggcauccgcuauccagaaggcccacgaggagggcaucugcgggauccggucugugacccgccuggaaaaccuaauguggaagcaaauuacaccggagcuaaaccacauccuguccgagaacgaggucaagcugaccaucaugaccggggacaucaaggggaucaugcaagccggcaaacggagccugcgcccgcagccuaccgagcugaaguauuccuggaagacguggggcaaggccaagaugcugucuacugagucccacaaccaaaccuuccugaucgacgggcccgagaccgccgagugcccgaacacaaaccgcgcuuggaacagccuggaaguggaggauuacgguuuugggguguuuaccacgaacauauggcucaagcugcgcgagaagcaggacgucuucugugacuccaaacugaugagcgccgcaaucaaggacaaucgggccguacacgcggacaugggcuacuggaucgaaagugcccuuaacgacaccuggaagauggagcgggccagcuucaucgaggucaaauccugccacuggcccaagagccacacccugugguccaacggcguucuggagagcgagaugaucauccccaagaacuucgccgguccagugucccagcauaauuauaggccgggcuaccacacgcaaaccgcgggacccuggcaccucggcaaacuggagauggacuucgauuucugcgaggggacuaccguggucgugacagaggacuguggcaaccgcggcccaucucuucguacaacaaccgccagcgggaaacugaucacagaguggugcugccgauccuguacccugcccccgcuucgguaccggggcgaagacgguuguugguacggcauggagauccguccccucaaggagaaagaagagaaccuggugaacagccuggucaccgccgggcacggccagaucgacaacuucuccuuaggcgugcuggggauggcccuguuccuugaggagaugcugcguacccgcaucgguacgaagcacgcaauauugcucguggccgucagcuucgugacccugaucaccgggaacauguccuucagagaccugggacgcgugauggucauggugggcgcaaccaugaccgacgauaucggcaugggcgugaccuaccucgcucugcuugccgccuucaagguccggcccacauucgccgccgggcuccugcuacguaaacucaccagcaaggagcugaugauggccacgaucgguaucgcacugcucucccaaagcaccauccccgagaccauccuggagcugacggacgcucucgccuuagggaugauggugcugaagaucguucggaacauggagaaguaccaacuagccguuacgaucauggccaucuccugcgugccuaacgccguuauccugcagaacgcuuggaaggucucauguacgauccuggccgccgugucggucagcccccuccugcugaccuccucucaacagaaggccgacuggauuccgcucgcccugaccaucaagggccugaaccccacggcaaucuuucugaccacucugucccgcaccagcaagaagcgguccuggccgcugaacgaggccaucauggccgugggaaugguuucuauacuagccuccagccugcucaagaacgacauccccaugacggggccccucguugcgggcgggcugcugaccgugugcuacguguugacggggcgcagcgccgaccuagaguuggagcgggcugcugacguuaagugggaagaucaggccgagaucuccggguccucacccauccucagcaucacgaucuccgaagacggcagcauguccaucaagaacgaggaggaagagcagacucugacuauacugauuaggaccggccuucucgugauuagcgggguguucccggucaguauccccaucaccgcggccgccugguaccugugggaggucaagaagcagcgggccggggugcuaugggacguccccagcccgccgcccguggagaaggcagagcuagaggacggggcguaccguauuaagcagagaggcaucuuagguuacucccaaaucggcgccgguguguauaaggagggcaccuuccacacuauguggcacgucacccgaggagcgguguuaaugcaucgggggaagcgcaucgagccgagcugggcggauguuaagaaggaccugauuuccuacgggggaggcuggaaacuggagggcgaauggaaggaaggggaggagguccagguccuugcccuagaacccggaaaaaacccccgggcaguucagaccaagcccgggaucuucaaaaccaacacgggcacaaucggggccgucucccuggacuucucccccggcacaagcggcucccccauugucgaccgcaaagggaaagucgucggccucuaugggaacggcguggucacccggaguggcgcauacguguccgcgaucgcgcaaaccgagaaguccaucgaggauaaccccgaaaucgaggacgacaucuuccgcaaaaagcggcugaccaucauggaccugcaccccggggcuggcaagaccaagcgcuaucucccagccaucgugcgggaagccaucaaacgcgggcugaggacccugauucuggccccgacgcgggugguagcggccgagauggaagaggcccuacggggcuugcccauucgguaccagacccccgccauuaagaccgaacacaccgggcgcgagaucguggaccugaugugccacgccacguucaccaugcgacuccugagccccgugcgcgucccgaacuacaaccuuauaaucauggaugaggcgcacuucaccgaccccgccaguaucgccgcccggggcuacaucagcacccgcguggagaugggcgaggccgcggggaucuucaugacggcuacgccgcccggcucucgggacccguucccccagucaaacgcccccauaauggacgaggaacgagagauccccgagcggucguggaacagcggucacgaguggguuaccgauuuuaagggaaagaccgucugguucguaccgucgaucaaggcggggaacgacaucgcggccugccuccgcaaaaacggcaaaaaggugauccagcugucacggaagacuuuugacucggaguacgucaaaacucgggcgaaugauugggacuucgugguaaccaccgacaucagcgagaugggggcaaacuucaaggccgagcgggugaucgauccccgccggugcaugaagcccgugauucugacagacucggaggagagggugaucuuagcggggccuaugccggucacccauucuagcgcggcccagagacgcggacgcauuggacggaaccccaaaaacgagaacgaucaguacauuuacaugggcgagccgcuggagaacgacgaggacugcgcccacuggaaggaggccaagaugcugcucgauaacaucaacacgccagaggggaucaucccgaguauguucgaaccagagcgcgagaagguagacgccaucgacggggaguaccgacuacgcggcgaagcgcggaagacguucgucgaccucaugcgccgcggggaccucccugucuggcuggccuauaagguggcagcggagggcauaaacuacgcugaccgcaaauggugcuucgacgggaucaagaacaaccaaauccuggaggaaaacauggagguggagaucuggacgaaggaaggcgagcggaaaaagcucaagccgagguggcuugacgcacggaucuauuccgacccucuggcccucaaggaguucaaggaguuugccgcgggccgcaagaguuugacccugaaccucaucaccgagaugggacggcugcccacauucaugacgcagaaggccagaaacgccuuagacaacuuggccguucugcacaccgccgaggccggcgggcgggccuacaaccacgcguuguccgaacuccccgagacccucgaaaccuuacuacugcugacccuccuggccaccgugaccggcgggaucuuccucuuccucaugucgggcaagggcaucggaaagaugacccuuggcauguguugcaucauaacggcuucgauccugcucugguacgcgcagauucagccgcacuggaucgccgccaguaucauccuggaguucuuccugaucguacuccugaucccggagcccgaaaaacagcgcaccccccaagauaaccagcugacguacguggugauugccauucucaccguuguagcggccaccauggccaacgagaugggguuuuuagaaaagacgaaaaaggauuuaggccucgggaguaucaccacccaagaauccgagagcaacauccuggacaucgaccugcggccugcguccgcauggacacuguacgccguggcgacgaccuuuguuacacccaugcuccgccacagcaucgaaaacuccagcgucaaugugucccucaccgcuaucgccaaucaagccacagugcucaugggccugggcaaaggguggccccugucaaagauggacaucggcgugccgcuccucgcgaugggcugcuacucucaguucaaaccgauuacccugacugccgcgcuauugcugcucguagcucauuaugcuaucaucgguccggggcugcaggccaaggccacccgggaagcccagaagcgcgccgccgcuggcauuaugaagaaccccacggucgauggcauuaccgucaucgaccuggagcccaucccguacgacccuaaguucgagaagcagcucggucaggucaugcuuuugauccugugcguaacccaggugcugaugaugcggaccacgugggcgcugugcgaggcucucacacuggccaccgguccaaucaguacccuuugggagggaaacccgggccgcuucuggaacacuaccaucgccguuuccauggcgaauauauuccgcgggucauaccucgccggcgccggccugcuguuuuccauuaugaagaauaccaccucuacgaggcgcggcacaggcaacauaggggagacgcucggcgagaaguggaagucccggcugaacgccuugggcaagagcgaguuccagaucuauaagaaaucagggauccaggaggucgaccgcacacucgcgaaggagggcaucaagcgcggugagacugaccaccacgccgugagccgcggcuccgcgaaacugcggugguucguugaacggaauaugguuaccccggaggggaaggugguggaccugggcugcggccgugggggcuggagcuacuacugcgguggacucaagaacguucgcgagguuaaagggcugacgaagggcggccccgggcacgaggagcccauccccauguccaccuacggcuggaaucuggugcggcuucaguccgggguggacgucuucuucacuccucccgagaaaugcgacacccuacugugugauaucggcgagagcuccccuaauccgacaauagaggccgggcgaacucuccgggugcugaaccucgucgagaauugguugaacaacaauacccaguucugcaucaaggugcucaacccuuacaugcccagcguaaucgagaagauggaggcccuacagagacaguacgguggcgcgcucguccgcaacccccugucccgcaacagcacgcacgagauguauugggugagcaacgccaccgggaacauugugagcucagugaauaugaucucccggaugcugaucaaucgcuucaccaugaagcacaagaaagccaccuacgagccggacguggaccugggcuccgggacgcggaauaucggcauagagagcgaaaucccgaacuuagacauaaucggcaaaagaaucgagaaaauuaagcaggagcacgagaucaguuggcacuacgaccaggaccaccccuacaagaccugggccuaccauggaucguaugagaccaaacaaaccggcuccgcuuccuccaugguaaauggggucgugcgccugcugacgaagcccugggacguggugccgaugguuacccagauggcgaugaccgacacgacgcccuucggccagcagagagucuuuaaggaaaaggucgacacccgcacacaagaacccaaggaagggacgaagaagcucaugaagaucacggccgaguggcuauggaaggaacuggguaagaagaaaacgccccgcaugugcacccgcgaggaauucaccaagaaggugcggucuaacgcagcccucggagccaucuuuacggaugaaaacaaguggaaauccgcucgcgaggccguggaggacgggcguuucugggagcuggucgaccgcgagcggaaccugcaucucgagggcaagugcgagaccugcguguacaacaugauggggaagcgagagaagaagcugggcgaguucgguaaggccaagggaagccgggccaucugguacaugugguuaggggccagguuccucgaguucgaggcucugggauuccugaaugaggaccacugguucagccggggcaacucccucucugguguggaaggcgaggggcugcaucgccugggcuacauccuccgggacguugguaagaaagaaggcggcgcaauguacgccgaugacaccgccgggugggacaccaggaucacgcuggaggaccugaagaacgaggaaauggugaccaaccacaugaaaggagagcacaagaagcucgcggaggccaucuucaaacugaccuaccagaacaaggucgugcgagugcagcgccccaccccucgcgggaccgucauggacaucaucagcaggcgggaccagcgcgguucuggccagguggggaccuacggccugaacaccuucaccaauauggaggcccagcuuauacggcagauggaaggggagggcauuuucaaguccauccagcaccugacagccaccgaggagauagcagugcaaaacuggcuggcgcggguaggccgggagcggcucagccgaauggccaucuccggggaugacugcgugguaaagccgauugacgaccgguucgccagcgcccugacggccuuaaacgacaugggcaaggucaggaaggacauccagcaaugggagccaucccggggguggaacgacuggacccagguuccauucugcagccaccacuuucaugaacugguaaugaaggacggccggguccuuguggugcccugucggaaccaggacgagcugauagggcgcgcgcggaucagucaaggcgccggcuggagcuugaaggagacggccugucuggggaaguccuacgcccaaauguggacacugauguacuuucaccgccgggaccuccgccuggcugcgaacgcaaucugcagcgcuguccccucccacugggugcccacuagccggaccaccugguccauacacgccaaacaugaguggaugacgacggaggacaugcuagcgguguggaacagagucuggauccaggagaacccguggauggaggacaagacccccguggaguccugggaggagguucccuaucucggcaagcgggaggaccaguggugugguucacugaucggucugaccucccgcgccacgugggccaagaacauccaaaccgcaaucaaucaggucagaucccucaucggaaacgaggaauauaccgauuacaugccaucuaugaagcgcuuucgccgcgaggaggaggaggccggcguccugugguaa

SEQ ID NO: 25053 - RNA, 9876 nt, Artificial Sequence
  derived and/or modified CDS sequence (opt11) from DENV-2__FJ850118__SS-prME
accgccggcguuaucgucaugcugauccccaccgcuauggcguuccaccucaccacccgcaauggggagccccacaugauuguggggcgucaggagaaggggaagucccuacuauucaaaaccgaggacggggugaacaugugcacccucauggccaucgacuugggggaacucugcgaggacaccaucaccuacaaguguccccuucugcgccagaacgagcccgaggacaucgauugcuggugcaacagcaccagcaccugggucacguaugggaccuguacaaccacgggcgagcaccggcgcgagaagcgguccguugcccuggugccccacgucgggaugggccucgagacccgcaccgagaccuggaugaguuccgagggggccuggaagcacgugcagcggaucgaaacguggauccugcgccacccgggcuucaccauaauggccgcuauccuggccuacaccaucggcaccacgcauuuccagagggcgcucaucuucaucuuacugaccgccguggcgcccagcaugaccaugcgcugcaucgguaucuccaacagagauuuugucgagggcgugagcgggggcuccuggguggacaucguccuggagcaugggagcugcgugaccacgauggccaagaacaagccuacccuggacuucgagcuuaucaagaccgaggccaagcagcccgccacccuccgaaaguacugcaucgaggccaagcugacgaacaccaccaccgagagucguugcccuacacaaggcgagcccagccugaacgaggagcaggacaagcgcuucaucugcaagcacuccauggucgaccggggcuggggaaauggcugcgggcuguuuggcaagggcggcaucgugaccugcgcgauguucaccugcaagaagaacauggagggcaagguggugcaacccgagaaccuggaguauaccauagucaucacgccccacagcggagaggagcacgccgugggcaacgacacagggaagcacggcaaggagaucaagaucaccccgcaguccagcaucaccgaagcggagcugaccggguacggcacggucaccauggaguguucaccccgcacuggccucgacuuuaacgagaugguucugcugcagauggaagacaaggcauggcucgugcaccggcagugguuccuggacuuaccacuccccuggcugccgggggccgacacccagggcagcaacuggauccagaaggagacacuggugaccuucaagaacccccacgcgaagaagcaggacguugugguccucgggucacaggagggcgcgaugcacaccgcccugaccggggccacggagauccaaaugucgagcggcaacuugcuguucaccggccaucugaagugccgcuugcggauggacaagcuccagcugaaggggauguccuacagcaugugcaccggcaaguucaagaucgugaaggagaucgccgagacccagcacgggacgaucguuauccgugugcaguacgagggagacggcucccccugcaagauacccuucgagaucaccgacuuggagaaaaggcacguucuugggcggcugaucaccgugaacccgaucgucaccgagaaggacagucccgugaacaucgaggcggagccaccguucggcgacuccuacauuaucauagggguggagccgggccagcugaagcucaacugguuuaagaaggggaguagcaucggccagauguuugaaacgaccaugcgcggcgccaagcggauggccauccugggggacaccgccugggacuucggaagccucgggggggucuucaccagcauugggaaggcccuccaccaggucuucggugcgaucuacggcgccgccuuuucggggguguccuggacgaugaagaucuuaaucggcgucaucaucaccuggaucgggaugaauagccgcuccaccucauuaucugugagccuggugcucgucgguguggugacacuguaccugggggcgauggugcaggcggacuccggaugcguggugagcuggaagaacaaggaguugaagugcggcuccgggaucuucaucacggacaacguccacaccuggaccgaacaguacaaguuucagcccgagagccccucuaagcuagccuccgccauccagaaggcccacgaggagggcaucugcgggauccggagcguaacccgccuugagaaccucauguggaagcagaucacgcccgagcugaaccacauccuguccgaaaacgaggugaaacugaccaucaugaccggcgacauccgggggaucaugcaggccggcaaacgcagccugcggccucagcccaccgagcuaaaguacuccuggaagacguggggcaaggcgaagaugcucagcaccgaaucccacaaccagaccuuccuaauagacggaccugagacagcagagugcccuaacacgaacagggccuggaacagccuugaggucgaggacuacggcuucgggguguucaccaccaacauuuggcucaagcugcgggagaagcaggacguguucugugacuccaaguugaugagcgccgcuaucaaggacaaccgcgcgguccacgccgacaugggcuacuggaucgaguccgcccucaaugacaccuggaagauggagaaggccagcuucaucgaggugaaguccugucacuggcccaagagccacacccuguggagcaacggcgugcuggagucggagaugaucauccccaagaacuucgccgggcccgucucccagcacaacuaccggccggguuaucacacucagaccgcggggccguggcaccucgggaagcuggagauggacuuugaccugugugagggaaccaccguaguggucacggaggacugcggcaaucgcggccccagccuccggaccaccacagccagcgggaagcugaucacggaauggugcugccgcagcugcacucugcccccgcuccguuaccguggcgaggacgguugcugguacggcauggagaucaggccccugaaggagaaggaggaaaaccuggugaacagccuagugaccgccggguacggccagaucgacaacuucucccugggggucuuggggauggcccuuuuccuggaggagaugcugaggacccggaucggaacgaagcacgcgauccuccugguggccgugagcuucgucacgcugaucacugggaacauguccuuccgcgaucucgggcgcgugauggugauggucggggccaccaugacggacgacaucgggaugggggugaccuaccuggcccugcucgccgcguucaaaguacggcccaccuucgcggccggacugcugcucagaaagcugacgagcaaagagcugaugauggccacgaucggcaucgcccuccugucacaaagcaccauccccgagaccauacuagagcucaccgacgcgcuugcccuggggaugaugguccugaaaauagugcggaacauggagaaguaccagcuggccgugacgaucauggccaucuccugugucccgaacgccguuauuuugcaaaacgccuggaagguaucuugcaccauccucgcggccgucuccgugucuccccugcugcuuaccuccucucaacaaaaggcugacuggaucccccuugcccugaccaucaagggccucaaccccacggcuauuuuccugacgacccuaucccgcaccaguaaaaagcgguccuggccgcucaacgaggccaucauggccgucggcauggugagcauucuggccuccagccugcucaagaacgauauccccaugacaggaccccugguggcgggcgggcugcucaccgucugcuacgugcugaccggccgcagcgccgaucuagagcuugagcgcgccgccgacgugaagugggaggaccaggccgagauuucagggagcucucccauccugagcaucaccaucagcgaggacggcagcauguccaucaagaacgaggaggaggagcagacguugaccauccucauccguaccggcuugcuggucaucucggggguguucccggugucuauccccaucaccgcggcugccugguaucucugggaggucaagaaacagcgagccggcgugcugugggacguacccucuccgccgcccgucgagaaggccgaacuggaggauggggcguaccgcaucaagcaacggggcauccucggguacucccagauuggagccggcguguacaaggaggggaccuuccacacgauguggcacguaacccggggcgcagucuugaugcaccgggguaagaggaucgagcccagcugggcugacgugaagaaggacuugaucucauacggaggagguuggaaacucgaaggcgaguggaaggagggggaggaagugcagguauuggcccuggaacccggcaagaacccccgggcgguucagaccaagcccgggaucuucaagacuaacacgggcaccauuggggccguaucgcucgacuucuccccgggcacuagcggcucccccaucgucgaccgcaaggggaagguggugggcuuauacgggaauggcgucgugacccggagcggcgccuacgucuccgccauagcgcagacggagaagucgaucgaggacaaccccgagaucgaggacgacaucuuucgcaagaagcggcugaccaucauggaccuccaccccggggccggcaagaccaagcgcuacuugcccgccauaguccgggaggccauuaagcgcgggcugcgcacgcugauccucgccccgacgcgggugguggcggccgagauggaggaggcucugcgcggccugcccauacgcuaccagacccccgccaucaagaccgagcauaccggucgcgaaaucgucgaccuaaugugccaugccacauucaccaugcggcugcugagccccgugcgcgugccgaacuacaaccucaucaucauggacgaggcccacuucaccgaccccgccuccaucgccgcccggggcuacaucagcacccgcgucgagaugggcgaggccgcggggaucuucaugacggccacgccgcccggcuccagggacccguucccccagagcaacgcccccaucauggaugaggagcgcgagauccccgagcgguccuggaacagcgggcacgagugggugaccgacuucaagggcaagaccgugugguucgucccguccaucaaggccgggaaugacaucgcggccugccugcgcaagaacggcaaaaaggugauccagcugagccggaagacguucgacuccgaguacgugaagacccgcgcuaacgacugggacuucgucgugaccaccgacaucagcgagaugggagccaacuucaaagccgagcggguuaucgauccccgcaggugcaugaagcccgucauccucacagacggggaggagcgcgugauacuggcgggccccaugccggugacgcacaguagcgccgcgcagcggcgagggcgcaucggccggaaccccaagaacgagaacgaccaauacaucuacaugggggagcccuuggagaaugacgaggacugcgcccacuggaaggaggccaagaugcuccuggauaacauaaacaccccagaaggcaucauuccguccauguucgagcccgagcgcgagaaagucgacgcgaucgacggcgaguaccggcugcgcggggaggcccggaagaccuucguggaucugaugcgccggggcgaccuccccgugugguuggccuacaaggucgcugccgaggggaucaacuacgcagaccgcaaauggugcuucgacggcaucaagaacaaccaaauccucgaggagaacauggagguggagauauggacaaaggagggggagcggaagaagcugaagccgcgcuggcuugacgcacggauauacagcgacccccucgcacugaaggaauucaaggaguucgcagcgggccgcaaaucccugaccuuaaaucugaucaccgagaugggccggcugcccaccuucaugacacagaaggcccgcaacgcccucgacaaccuggcgguacugcacaccgccgaagccgggggccgggccuacaaccacgcccucucugagcugccagagacccuggagacccuccugcugcucacgcugcuggccacugucaccggggggaucuuccucuuccugaugucuggcaaggguaucggcaagaugacccuagggaugugcugcaucaucacagccagcauccucuugugguacgcgcagauccaaccccacuggaucgccgcuuccaucauccuggaguucuuccucaucgugcugcugauacccgagcccgagaagcaacgcacaccccaggacaaccagcucacuuacgucgugauugcgauccugaccgucgucgccgcgaccauggcuaaugaaaugggcuuccuggagaagacgaagaaggaccucgggcugggcagcaucaccacgcaggagagcgagaguaacauccuggacaucgaccuccggccggccagcgcguggacccuguacgcaguggcgacaaccuucgugacccccaugcugcgccacuccaucgagaauagcuccgucaacgugagccucacggcgaucgccaaccaggcuacggugcugaugggccuggggaaaggcuggccccuauccaagauggacaucggggucccuuuacuggcgaucggaugcuauagccaggugaacccgaucacccucaccgcggccuuacugcuccuggucgcccacuacgccaucaucgggcccggcuugcaagccaaggccacucgggaggcccagaaacgcgccgcugcuggcaucaugaagaacccaacgguagacgggaucaccgugaucgaccuagagcccaucccguacgaccccaaguucgagaagcagcugggccaagugaugcugcucauccugugugucacccaagugcugaugaugcggacuacgugggcccucugcgaggcuuuaacccuggccaccgggcccaucuccacucucugggagggcaacccggggcgcuucuggaacacaaccaucgccgugagcauggcgaacaucuuccgcgguaguuaccuggccggcgccgggcuccuguucuccaucaugaagaauaccaccaacacgaggcgcggcaccgggaacaucggcgagacccugggcgagaaguggaagucccggcugaacgcccucggcaagagcgaauuccagaucuacaagaaguccggcauccaggaggucgaccgcaccuuggcgaaggaggggaucaagcguggcgaaacggaccaccacgccgugagccgcggguccgccaaguugcggugguucguggagcgcaacaugguuaccccggagggcaaggugguggaucucggcugcgggcggggcggguggagcuacuacugcggggggcugaagaacguccgggaggugaagggccugacaaagggggggcccgggcacgaggagccaauccccauguccaccuauggguggaaccucgugcggcuccagagcggcgucgacguguuuuucacgccacccgagaagugcgacacgcuguugugugacaucggggagucgucccccaaccccaccaucgaggcgggccgcacccugaggguguuaaacuuggucgagaacuggcugaacaacaacacccaguuuugcaucaaggugcugaauccguacaugcccagcgugaucgagaaaauggaggcuuugcagcgcaaguauggcggugcgcugguccggaacccccugucccgcaacagcacgcacgagauguacuggguguccaacgcaaccggcaacaucguaagcuccgucaacaugaucagccggauguuaaucaaccgcuucaccaugaagcacaagaaggcaaccuacgagccggacguggaccucggguccggcaccaggaacaucgggaucgagagcgaaauccccaaucuggacauuaucggcaagaggaucgagaagaucaagcaggagcacgagaccuccuggcacuacgaucaggaccaccccuacaagaccugggccuaccacggcuccuacgagaccaagcagacgggcuccgccuccuccauggugaacggcgucgugcgccugcucaccaagcccugggacgugguuccuauggugacccagauggcgaugaccgacacgacucccuucgggcagcagcggguuuucaaggaaaaagucgacacccgcacccaagagcccaaggaggguacgaagaagcuuaugaagaucaccgccgaguggcuguggaaggagcucggcaagaagaagacgccccggaugugcacccgugaggaguucacacggaaagugcgaucuaacgccgcccugggggcuaucuucaccgaugagaacaaguggaaguccgcgcgggaggccguggaagacggccgcuucugggagcucgucgaccgggaacgcaaccuccaccuggagggaaagugcgagacauguguguacaacaugaugggcaagcgggagaagaagcugggggaguucggcaaggccaaggggagccgcgcgauaugguauauguggcuuggggcucgguuccuugaguucgaggcgcugggcuuccucaaugaggaccacugguucucccgcgggaacagccugagcggcguggagggggagggacugcaucggcuuggcuauauccugcgcgacgucgggaagaaggagggcggagcaauguacgccgacgacaccgccggcugggacacgcggauuacccuagaagaccucaagaacgaggagauggugaccaaccacaugaagggggaacacaaaaaacuggcggaggccaucuucaagcugacauaucagaauaaggucgugcgugugcagagaccgacgccccgcgggaccguaauggacaucaucucccggcgcgaccagcgggggagcgggcagguaggcaccuacggucucaacaccuucacgaacauggaagcccagcugaucaggcagauggaaggcgaggggaucuucaaguccauccagcaccugaccgcaaccgaggagauugccgugcagaacuggcucgcgagaguugggcgggagcgccuaagccggauggccaucuccggugacgacugcguggugaagcccaucgacgaccgcuucgccucagcccugaccgcccucaaugacauggggaagguccggaaggacauccagcagugggagccaucccgcggcuggaacgauuggacccaggucccguucugcagccaccacuuccacgaacuggugaugaaggacgggcggguccugguggugcccugccgcaaccaggacgagcucaucggccgggcgcgcaucucccagggcgcgggguggucccuuaaggagacggccugccugggcaaauccuacgcccagauguggacacucauguacuuccaccggcgggaucugcggcuggcagcgaacgccaucugcagugccgugccgccccacugggugccaaccucacgcacuaccuggagcauucacgccaaacacgaguggaugaccacugaggacaugcucgcgguauggaaccgggucuggauccaggagaaccccuggauggaggacaagacccccguugagaguugggaagaggugcccuaccuggguaagcgcgaggaccaguggugcggcagccugaucggucucacgucccgugccaccugggccaagaacauccagaccgccauaaaccagguccgcagccugaucggcaaugaagaguacaccgacuacaugccgagcaugaagcgcuuucggcgcgaggaggaagaagccggcguacugugguga

SEQ ID NO: 25054 - RNA, 9876 nt, Artificial Sequence
  derived and/or modified CDS sequence (opt11) from DENV-2__JN819416__SS-prME
accgcugguguaaucgugaugcugauccccacggccauggcauuccaucucaccacacgcaauggcgaaccacacaugaucgugggccggcaggaaaaggguaagucccugcuuuucaaaaccgaggacggcgugaacaugugcacucucauggccauagaccugggggagcugugcgaggacaccaucacuuauaagugcccgcuccuucgacagaacgaacccgaggauaucgauuguuggugcaacucuacaagcaccugggucacguacggaaccugcaccacuacuggagagcacaggcgcgagaagcgcagcguagcucuggucccgcacguggggaugggcuuagaaacucgcacugagacguggaugagcuccgagggagccuggaagcauguacagcggaucgagacguggauccuacgccauccgggcuucaccaucauggcugcuauacuggcauauaccaucgggacgacgcacuuccaacgggcgcucauauucauccugcugaccgccguggcccccagcaugaccaugagaugcauugguaucuccaaccgggacuucguagagggggucagcgguggcucuugggucgacaucguccucgagcacgggucuugugugacaacgauggcgaagaacaagcccacccuggacuucgaacugaucaagaccgaggccaagcagcccgccacccuccgcaaguacugcaucgaggcuaagcugacgaacaccaccaccgagagccggugcccgacgcagggcgaacccucacucaacgaggagcaagacaagcgguucaucuguaaacacuccaugguggaccggggcugggggaacggcugugggcuguucgguaagggcgguaucgugaccugcgcaauguucacgugcaagaagaacauggaggggaaggugguucagccugagaaccuggaguacacaauagugauaacgccccacucuggggaggaacaugcuguuggcaacgacacgggaaagcauggcaaagagaucaagaucaccccgcaauccuccaucaccgaggccgagcugaccggguacggcacggugaccauggaaugcagcccccggaccggacucgauuuuaacgaaaugguucugcugcagauggaggacaaggccuggcucgugcaucgccagugguuccuggaucugccccucccguggcugccgggggcagacacccaggggucaaauuggauccagaaggagacuuuagugaccuuuaaaaauccccacgcgaagaagcaggacguagugguccucgguucccaggaaggcgcgaugcacacggcccugacgggcgccacggagauccagaugagcucaggcaaccuucuguuuaccgggcaccugaagugucgccugcggauggacaagcuccagcuuaaaggaauguccuacuccaugugcacagggaaguucaagauagugaaggagauugcggaaacccagcaugggacaaucgucauccggguacaguacgaaggcgacggaucgcccuguaagauccccuucgagaucaccgaucuggagaagcggcacgugcucgggcgccugauuacgguaaacccgaucgucaccgaaaaggacagcccagugaauaucgaggcggagccgcccuucggcgauuccuauauaauuauaggaguggagccgggucagcugaaguugaacugguucaagaaggggagcuccaucggccagauguucgagaccaccaugcggggcgcuaagcggauggccauccugggggacaccgcgugggacuuugggagccucggaggggucuucaccucaaucggaaaggcccuccaccaaguguucggggccauauacggcgccgccuucagcgggguuuccuggacuaugaagaucuugaucggcgucaucauuaccuggaucgggaugaacucgcgcaguaccagcuuauccgugagcuuaguguuggugggcguugugaccuuguaccugggggcuaugguccaggcggacucgggaugcguggucagcuggaaaaauaaggagcucaagugcggcuccgggauauucaucacggacaacgugcacaccuggaccgaacaguacaaguuccagcccgagagcccaucuaaguuagcauccgccauucagaaggcccacgaggagggcaucugcgggauucggagcguaacgcgccuggaaaaucucauguggaagcagaucaccccagaguuaaaucacaucuuaagugagaaugaggugaaacuaaccaucaugaccggcgauauaaaggggauaaugcaggccggcaagcggagccugcggccucagccuaccgagcugaaguacagcuggaagacguggggaaaggcgaaaaugcucuccaccgaaagccacaaccagaccuuccuuaucgacgggcccgagaccgccgagugcccgaacacgaacagagccuggaacagccuggaagucgaggacuauggcuucggcguuuucaccaccaacaucuggcucaagcugcgcgagaagcaggauguguuuugcgacuccaaacugauguccgccgcaaucaaggacaaccgggcuguccacgcggacaugggcuauuggaucgaguccgccuuaaacgauaccuggaaaauggaaaaagcuagcuucauagaggucaagucaugccauuggccaaagucucacacccuguggaguaacggcgugcuggagagcgagaugaucauaccuaagaacuucgcgggucccgucucgcaacacaacuaccguccgggcuaccacacucagaccgcgggccccuggcaccucgggaagcuggaaauggacuucgaccuaugugaggggaccaccgugguugucacggaggacugcgggaaccggggcccaagucuccgcacaacuacagccucugggaaacugaucacggaguggugcugccgguccuguacacugccaccccucagauaccgcggggaagaugguugcugguacggcauggagauccggcccuugaaggagaaggaggagaaccugguaaacagccuagugaccgccggccauggccagaucgacaacuucuccuuaggcguccuagggauggcccucuuccuggaggagaugcugcggacucgcaucgguacgaagcacgcuauccuccugguggccgucagcuucgucacccugauaaccggcaacaugucuuuccgggaccuaggucgcgugauggugauggucggggcaacaaugacggacgacaucgguaugggcgugaccuauuuggcccuguuagcugcguucaaggugcgucccaccuucgccgccgggcugcuucuacggaagcugaccagcaaggaguugaugauggcgaccaucggcauugcccuccugucccaaucaaccaucccggagaccauucuggagcucacugacgcgcuggcacucggcaugaugguccucaagauugugcgcaacauggaaaaguaucagcuggccgugacuaucauggccaucuccugcgucccgaaugccgugauccuacaaaacgcguggaaggugucaugcaccauccucgccgccgucuccgugucaccccuguuacucaccuccucgcagcagaaagccgauuggauaccccucgcccuuacuaucaagggacugaaucccacggcuaucuuccugaccacucugucccggacuagcaagaaacgcuccuggccgcucaaugaggccaucauggccgucgguauggugagcauucuggcuucgucuuuacucaagaacgacaucccgaugacggggccucugguggcgggagggcugcucaccgucugcuacgugcucaccggccggucugcugaccuggagcucgaacgagcggccgacgugaagugggaggaccaggcagagaucuccgggucuucccccauccugagcaucaccauuuccgaggacggcagcauguccaucaagaacgaggaagaggagcagacgcugaccauacucauccggaccggacuguugguaaucucagggguguucccaguguccauccccaucaccgcggccgccugguaccuuugggaggucaaaaagcagcgcgccggggugcugugggacgugcccagcccgccgcccguggaaaaggccgaacuggaagacggggcguaucguaucaagcaacgcgguauccucggguacucccaaaucggcgcgggcguguacaaagaagggacauuccacacuauguggcacguaacccggggcgccguccugaugcaccgcgggaagcggaucgaacccagcugggccgacgugaagaaggaccugaucagcuacgggggcggcuggaaacucgaaggugaauggaaggaaggggaggaggugcaaguguuggcgcucgagcccggaaagaacccucgagccguccaaaccaagcccgggaucuucaagacuaacacgggcaccauuggggcggugagccucgacuucagccccggcaccagcggcucuccgauugucgaccggaagggaaaagugguaggccuguacgguaacggcguaguuaccagaagcggugccuauguuucggcgaucgcgcaaacggagaaauccauugaggacaaucccgagaucgaagacgacaucuuucggaagaagcgccucaccauaauggaccuccaccccggggcaggcaagaccaagcgguaccuaccagcaauaguccgggaagccaucaaacgggggcugcgcacguuaaucuuggcccccacgcgcgugguggccgcugaaauggaggaggcccugcgaggccugcccauccgauaucagacacccgccaucaagaccgagcacaccgggcgggagauuguugaccucaugugccaugccacuuucacuaugaggcuguugagccccgugcgggugccaaacuacaauuugaucaucauggacgaagcgcauuucacggacccagccuccauugcagcccgcggcuacauuaguacccgggucgagaugggcgaggccgcggggaucuucaugacggccacaccgcccggcucgagagauccauucccgcaauccaacgcccccauaauggacgaggagcgggagauucccgagagauccuggaacucggggcaugagugggugaccgauuuuaagggcaagaccgugugguucguuccgucuauaaaggccggaaacgacaucgcggcuugccugcgcaagaauggcaagaaggucauccagcugagcaggaagacguucgacucugaguacgugaagaccagagccaacgacugggacuucgucgugaccaccgacaucagcgagaugggcgcaaacuucaaggccgaacgcguaauagacccgcggcgcugcaugaaaccggucauccuuacggacggggaggagcgcgugauucuggcgggcccuaugccggugacucauaguucggccgcucagcgccguggacgcauaggucgcaacccuaagaaugagaacgaccaguauauuuacaugggggaaccccuagaaaaugacgaggacugcgcccacuggaaggaggccaagaugcuccuggauaauauaaacacccccgagggcaucaucccuucuauguuugaaccggagcgggagaaggucgacgcgaucgacggcgaguaucgccuccgcggagaggcccggaaaaccuucguggacuugaugcggagaggcgaccugcccguguggcuggccuauaaggucgccgccgagggaaucaacuacgccgaucggaaguggugcuuugacggcaucaagaacaaccaaauucucgaggagaacauggagguggagaucuggacgaaggagggggagcgcaagaagcugaagccgcgguggcuggacgcccgcaucuacagcgacccccuagcccugaaagaguucaaggaguucgccgcgggcaggaagucccuuacgcucaaccugaucaccgagauggggcggcugcccaccuucaugacgcagaaagcaaggaacgcccucgacaacuuagcaguacugcacaccgccgaagccggcgggcgcgccuacaaccacgccuuaucagagcugccggagacccuggagacccuacuucugcucacgcuccuggcgacaguaacaggcggaaucuuccucuuucucaugucggggaaaggaaucggaaagaugacccuggggaugugcugcaucaucaccgcgagcauccuccugugguacgcgcaaauccagccgcauuggaucgcagcuuccaucauccuggaguuuuuccucaucguucuccugaucccugagccggaaaaacagcggacgccacaagacaaccagcuaaccuacguagugaucgccauccuuaccgugguggccgcuaccauggccaaugaaaugggcuuucuagagaagacgaagaaagaccucgggcugggcagcauuaccacacaggaaagcgaguccaacauccuugacaucgaucuccgcccugccagcgcuuggacccuguacgccguggccacgaccuucgugacuccaauguugcggcacuccaucgagaacuccucuguuaacgugagccugaccgcgaucgccaaccaggccacaguucucaugggucucgguaagggcuggccacucuccaagauggacaucgggguccccuuacuggcuaucggcugcuacagccaggugaacccaauuaccuuaaccgccgcacugcugcuccucgucgcccacuacgccaucaucggucccggucugcaggcgaaggccacccgugaggcccaaaagcgggcggcggcuggcauuaugaagaaucccacggucgacgggaucaccgugaucgaucucgagcccauuccauacgacccuaaauucgaaaagcagcuuggccagguaaugcuguuaauucugugcgucacccaggugcugaugaugcgcaccacaugggcccucugcgaagcccugacacuggcaacuggucccaucucuacccucugggagggcaaccccgggagguucuggaacacgacgauugccgugaguauggcgaauaucuucaggggcuccuaccuggccggcgcggggcuccuguucagcaucaugaagaauaccaccaauacgcgccgggguacugggaacaucggcgaaacccuaggcgagaaauggaagucccgucugaacgcccucgguaaguccgaauuucagaucuacaagaagucuggcauccaggaggucgaccggacacuggcgaaagaggggaucaagcgcggcgagacggaccaccacgcugugagccggggaucggccaagcugcggugguucguggaacggaacauggucacaccggagggcaaggucguagaccucggaugcgggcgcggcgguugguccuacuacuguggcggacugaagaacguccgggaggucaaggggcugacgaagggcgggcccggccacgaggagcccaucccgauguccaccuacggguggaaccucguuaggcugcagagcggcgucgauguguuuuucaccccgcccgagaagugcgacacccuauugugugacauuggggagagcucccccaaucccaccaucgaggccggccggacgcugcgcgugcucaaucugguggagaacugguugaacaacaauacacaauucugcauaaaggugcugaacccguacaugcccagcgugaucgagaagauggaagcccuccagcggaaguacgggggugcucuaguccgcaaccccuuauccaggaacagcacccacgaaauguacuggguguccaaugccaccggcaacauagucagcucagucaacaugauuagccgcaugcugaucaaccgguuuacaaugaagcacaagaaggccacauacgagccggacgucgaucucggcucuggcacgcgcaacaucggaaucgaaagcgagauaccuaaccuggacaucauaggcaagcggauugagaaaaucaagcaggagcacgagaccuccuggcacuacgaccaggaucacccguauaagacgugggccuaucacgggaguuacgagacuaagcagacgggguccgcgagcucaauggucaacgggguugugcgccugcuaacgaagcccugggacguugucccgauggugacucagauggcgaugaccgacacgacccccuucgggcagcagcguguguucaaggagaaggucgacacccgaacccaggagccaaaggaagggacgaagaaguugaugaagaucaccgcggaauggcucuggaaggaacucggcaagaaaaagacgccgcgcauguguacccgggaggaguucacccggaaggugaggagcaacgcugcccugggggccaucuucaccgacgaaaacaaguggaagucagcacgcgaggcggucgaggacagccgguucugggaguuagucgacagagagcgcaacuuacacuuagagggcaagugcgaaaccugcguguacaacaugauggggaagcgcgagaaaaagcugggcgaguucggcaaagccaagggcucucgggcgaucugguacauguggcucggcgcgcgcuuccuggaguuugaggcccuagguuuccucaaugaggaccacugguucucucgggggaacagccucagugggguggagggcgaggggcugcaccgucucggcuacauccugcgugacgucggaaagaaggaggguggcgcgauguacgccgaugacaccgccgggugggacacgaggaucacgcuggaagaucucaagaacgaggaaauggugacaaaccacaugaaaggcgagcacaagaagcuggcggaagccaucuucaagcugacauaccagaacaaggucgugcgggugcaacgcccgacgccgagaggcaccgucauggacaucauuucacgacgugaccagcggggcucgggacagguagguaccuauggucucaacaccuucacgaacauggaggcccaguugauucgacaaauggagggagagggaauuuucaagagcauccaacaucugaccgcaaccgaggaaaucgccgugcagaacuggcucgcucgcguaggccgcgagcggcugucccgaauggcgaucagcggagacgauugcguggugaagcccaucgaugaccgguucgccucugcccugaccgcccucaacgacauggguaagguccgaaaagacauccagcagugggagcccucgagaggguggaacgacuggacccaggucccguucugcucccaccacuuccacgaacucguaaugaaggacggcagggucuugguggugccaugccggaaccaggacgagcucaucgggcgcgcgaggauaagucaaggagccgguuggucacugaaggaaaccgcaugccugggcaagucguaugcccagauguggacauugauguauuuccaccgccgagaccugcgccuggccgccaaugccaucugcuccgccgugccgccccacuggguaccgaccucccgcaccacgugguccauccacgcuaaacacgaguggaugacgaccgaagacaugcucgcgguguggaaucgagucuggauacaggagaacccauggauggaggacaagacgcccguggagagcugggaggaagugcccuaucugggcaagcgugaggaccaguggugcggaucccuuaucggccucacgagccgcgccacaugggccaagaacauccagaccgccaucaaucagguccgcucgcugaucggcaacgaggaguacaccgacuauaugccgucuaugaagcgcuucagacgggaggaggaggaggcuggcgugcugugguga

SEQ ID NO: 25055 - RNA, 9876 nt, Artificial Sequence
  derived and/or modified CDS sequence (opt11) from DENV-2__FJ850119__SS-prME
accgcgggcgugauugucaugcucauccccaccgcaauggcguuccaccucaccacccgcaacggagagccccacaugauagucggccggcaagagaaaggcaaaucccugcuguucaagaccgaggacgguaucaauaugugcacacucauggcgauagaccucggggagcugugcgaggacaccaucaccuacaagugcccccuacuacgccagaaugagcccgaggacauugacugcuggugcaauagcacgagcaccugggucaccuacgggaccuguaccaccacgggugagcaccggagggagaagcgguccgucgcccuggugccccacguggggaugggucucgagacccgcaccgagacauggaugagcuccgagggggccuggaagcacguccagcgcaucgagacguggauccugagacaccccggcuucaccaucauggccgcgauccuggccuacaccaucggaaccacgcauuuucagcgggccuugauauuuauccuguuaaccgccguggcucccagcaugaccaugcgcugcaucgggaucucgaaccgggacuucguugaaggcgucagcgggggcaguuggguggacaucgugcucgaacacgggagcugcguaaccacgauggccaagaacaaacccacccuugacuucgagcugaucaagaccgaggccaagcagccggccacccugcgcaaguauugcaucgaggcuaagcugacgaacaccaccaccgagucccggugcccaacgcaaggcgagcccucucugaacgaggagcaggacaagcguuucaucugcaaacacuccaugguggaccgcggcugggggaacgguugugggcuguucggcaagggcgggaucgugaccugcgcaauguucacuugcaagaagaacauggagggcaaaguaguacagcccgagaaucuagaguacacuaucgugauaacgccgcacucaggggaggagcaugccgucggcaacgacaccgggaagcacggcaaagagaucaagaucaccccgcagucgagcaucaccgaggcugagcuuaccggguaugggacggugaccauggaauguuccccccggaccggucucgacuuuaacgagauggugcugcugcagauggaggacaaggcauggcucguccaccggcagugguuucuggaccugcccuugccauggcucccuggggcugauacccaggggucgaacuggauccagaaggagacgcuggugaccuucaagaacccccacgcgaagaagcaggacguagucgugcucgggucccaggagggcgccaugcacaccgcccugaccggggcaacggagauccagaugagcucaggcaaccuucuguucaccggccaccuaaagugccgacugcggauggacaaguuacagcugaaggggauguccuacucaaugugcaccgggaaguucaagauugucaaggagaucgccgagacccagcacgggacgaucgugauccgcgugcaguacgaaggcgacggcucccccugcaagauccccuucgagaucaccgaccuggagaagcggcacguccucgggaggcuuaucaccgugaauccuaucgugaccgaaaaggacagcccggucaauauugaagcggagccgcccuucggugacuccuacaucaucaucgggguggagccgggccagcugaagcugaauugguucaagaaggggagcuccaucggucagauguuugagacgaccaugcgcggcgccaagcggauggccaucuuaggggacaccgccugggacuucggcagccucgguggcguguucacuuccaucgggaaggcacuccaccaggucuucggagcaaucuauggcgccgccuucucaggcgugagcuggacgaugaagauucugaucggcgugaucaucaccuggaucgggaugaacagccgcuccaccagccucuccguaagccugguguugguaggagucgugacccuguaccugggggccauggugcaggcggacuccggcugcguggugaguuggaagaacaaagaacucaagugcgguuccgggaucuuuaucacggacaacgugcacaccuggaccgaacaguacaaguuccaacccgaaagccccagcaagcucgccuccgccauucagaaggcccacgaggagggcauuugcggaauccggagcgucacccgccucgaaaaccucauguggaagcagauaacgccagagcugaaccacauacuauccgaaaacgaggugaagcucaccaucaugaccggcgacaucaaagguaucaugcaggcaggcaaacgcagccugcgcccgcaacccaccgaacuuaaauacuccuggaagacguggggcaaggcgaagauguugucuaccgagucccacaaccaaaccuuccugaucgacgggcccgagaccgcugagugcccgaacacuaaccgggccuggaacucacuggagguggaggacuauggcuucggggucuucacaaccaacaucugguuaaagcugcgcgagaaacaggacgucuucugugacuccaaacugaugagcgccgccauuaaggauaacagagcgguacaugccgauaugggcuacuggaucgagagcgcccucaacgacacauggaagauggagaaggccagcuuuauagagguuaaguccugccacuggcccaaaagccacacccugugguccaacggcgugcuggagagcgagaugaucauccccaaaaacuucgccgggcccgugucccagcacaacuaccgcccaggcuaccacacgcagaccgcagggcccuggcaccucggcaagcuggagauggauuuugaccugugcgaggggacuaccgucguggucacggaggacugcggcaacaggggccccagccuccgcaccaccaccgccuccgggaagcugaucacggaguggugcugucggagcugcacccugcccccgcuccgcuaucggggcgaggaugggugcugguacggcauggagauucgcccccugaaggagaaggaggagaaccuggucaacagccuugugaccgccgggcacgggcagaucgacaacuucucauugggcgugcuggggauggcccuguuccuggaggagauguugcggacucgcauaggcaccaagcacgcgauacuccuggucgccgugucuuucgugacccugaucaccgggaauauguccuuccgggaccucggccgagucaugguaauggugggggccaccaugacggacgauauuggcaugggcgucaccuaccuggcccuccuagccgcauucaaggugcgcccgacuuucgccgccggccugcugcuccgaaaacugacuagcaaggagcugaugauggccacgaucggcaucgcccuccugucccagagcaccaucccggagaccauccuggagcucaccgacgcgcuggcguuagggaugauggugcucaagaucguccgcaacauggaaaaguaccaacuggccgugacgaucauggccauauccugcgugccgaacgccgucauccuucaaaacgcguggaaaguuucgugcaccauccuugcagccguguccgucagcccucuacugcucaccucgagccagcagaaggccgacuggaucccucuggcgcugaccaucaagggucucaaccccacagccaucuuccugacuacccucucccggacaagcaaaaagcgcuccuggccgcuaaacgaagccauuauggccguaggcauggucagcauccuggccuccagccugcucaagaacgacauucccaugacgggcccucugguggcgggcgggcugcucaccgugugcuacguacugaccggccggagcgcugaccuggagcucgagcgagccgccgacgucaagugggaagaccaggccgagauuagugggucgucccccauccugagcauaaccaucuccgaggacggcucaauguccaucaagaacgaggaagaggagcaaacgcugaccauccucaucagaaccggccugcuggucauaagcggggucuucccggucucaauccccaucaccgcagccgccugguacuugugggaggugaagaagcagcgcgccgggguccugugggacguaccuagcccgccgccaguggagaaggccgagcuggaggacggggcguaucggaucaaacagcgcggcauccuaggguauucccagauuggcgcuggcguguacaaagaagggacguuccacacgauguggcacgugacccggggcgcagugcugaugcaccgcgggaagcggaucgagcccagcugggcugacgucaagaaggaccugaucagcuacggcgggggauggaagcucgaaggcgaguggaaggagggggaggagguucaggugcuggcccuggaaccaggaaagaauccccgagcgguccagaccaagccagggaucuuuaagaccaacacgggcaccaucggcgccgugucacuggacuucucccccgguacgagcggcucccccaucguugaccggaaagggaagguugugggucuguacgggaacggaguggucacccguucaggugcauauguaucugccaucgcgcaaacggagaaguccaucgaagauaacccugagauagaggacgacaucuuccggaaaaagcgccugaccaucauggaccuccaccccggggccggaaagacuaagcgguaccugccagcaaucgugcgcgaggcuaucaaacggggguuacgcacccugaucuuagccccgacgcgcgucguggcugccgagauggaggaggcacugagaggccugccaauucguuaccagaccccggcuauuaagaccgagcacacgggacgugagaucguggaccucaugugucacgccacauuuacgaugcgccugcugagccccguccgggugccgaacuacaaccucaucaucauggacgaggcgcacuucacagaccccgccuccaucgccgcccgaggcuacaucagcacccggguggagaugggcgaggccgcggggaucuucaugacggccacaccgcccggcucccgcgacccguucccccaaagcaacgcaccgauuauggacgaggagagagaaauccccgagcgcuccuggaacagcgggcacgaguggguaaccgacuucaaaggcaagaccguuugguuugugccguccauuaaagccgggaacgacaucgcagccugccugcggaagaacggcaaaaaggucauucagcuaagccguaagacguucgauucagaauacgucaagacccgggccaacgacugggacuucgugguuacgacagauauaucagaaaugggugcaaacuucaaggccgagcgcgugaucgacccccggcgcugcaugaagcccgugauccucaccgacggggaagaacggguaauccuggcgggccccaugccggugacacacuccagcgcugcccagcggcgcggccgcaucgggcgcaacccgaagaacgagaaugaccaguacaucuacaugggggagccccuggaaaacgaugaggacugcgcccacuggaaagaggcaaagauguuacuggacaacaucaacacccccgaaggcaucaucccgucuauguucgagccugagcgugagaagguggacgcaauugacggcgaguaccgccuucgcggggaggcccgcaagacuuucgucgaccucaugcggcguggcgaccugccaguuuggcuggcauacaagguggccgccgaagggaucaacuacgcggaccggaaguggugcuucgauggcaucaagaacaaccagauccucgaggagaacauggagguagagaucuggacgaaggaaggggaacgcaagaagcugaagccgcgcuggcuggacgcgcggaucuauagcgacccucucgcccugaaggaguucaaggaauucgccgcuggccggaagucccugacucucaacuuaaucacugaaaugggccgccuacccaccuucaugacgcagaaagcccggaaugcccucgacaaccuggccguacuucacacggccgaggccgggggcagggccuacaaccacgcccuuagcgagcugccugagacccuggagacccuccugcugcucacgcugcuggccaccgugaccgguggcauuuuccucuuucugaugaguggcaaagggaucggcaagaugaccuuagggaugugcugcaucaucacugccagcauccuacugugguacgcgcagauccagccgcauuggaucgccgccucaauaauccuggaauucuuccucaucguacugcuuauccccgagccagagaagcaacggacaccucaggacaaccaacugaccuacguggucauagccauccugaccgucgucgccgcaaccauggccaacgagaugggcuuccuggagaagacgaaaaaggaccucgggcucggcuccauaaccacccaggagucggaguccaacauccuggauauagaccuccgcccggccucggccuggacccuguacgccgucgcgacaaccuuugugacgcccaugcugcggcacucgaucgagaacaguaguguuaacgugagccucaccgccaucgccaaccaggccacgguguugauggggcuggggaagggcuggccguuguccaagauggacaucggcgugccccugcuggcgauuggcugcuacagccagguuaacccgaucacccuuaccgcagcccugcuacuacugguggcacacuacgccaucauuggccccggauuacaggcgaaggccacccgagaggcccagaaacgggccgccgcgggaaucaugaagaaccccacgguggacggaauuaccgucauugaccucgagcccauccccuacgacccaaaguucgaaaagcaguuaggucaggucaugcugcucauccuaugcgugacccagguccugaugaugcgcaccaccugggccuugugcgaggccuugacccuggccaccggccccaucuccacccucugggagggcaaucccgggcgguucuggaacacgaccaucgccguuagcauggcgaacaucuucagaggcagcuaccuggcaggggccgggcucuuauucagcaucaugaagaacaccaccaauacgcgccgcggcacggguaacaucggugagacccugggggagaaguggaagagccgccugaacgcccucgguaagagcgaguuccagauuuacaagaaguccggcauccaggagguggaccggacucuggcgaaggaggggaucaagcgcggugaaacggaccaucacgccgucagccggggguccgccaaacugcgcugguucguagagcggaacauggucaccccggaaggcaaggucguggaccucggcugcgggcgcggggggugguccuacuauugcggcgggcugaagaaugugcgagaggucaaggggcugacaaaaggggguccaggccacgaggagccaauacccaugucuaccuauggguggaaccucgugcgccugcaaagcggcgucgacguguucuucacgccccccgagaagugcgacacccugcucugcgacaucggggagagcuccccaaauccgacaaucgaggccggccggacccugcgcguguuaaaccucguggagaacuggcuuaauaacaacacccaguucugcaucaaggucuugaacccguacaugccaagcgugauagaaaagauggaggccuuacagcgaaaguauggcggggcgcugguacgcaacccccuguccaggaacagcacgcacgagauguauugggucagcaaugccaccggcaacaucgugagcuccgugaacaugaucagucgcauguuaaucaaccgguucaccaugaagcacaagaaggccaccuacgagccggacguagaccucggguccggcacgagaaacaucggcauagaaucggagauccccaaccuggacauaaucggcaaacggaucgagaagauaaagcaggagcacgagaccuccuggcacuacgaucaggaccaccccuacaagaccugggccuaccacggcagcuacgagaccaagcagacgggguccgccagcucuauggugaacggaguuguccgccuguugacuaagcccugggacguggugccgauggucacucagauggcgaugaccgacacuacgccauucgggcagcagcggguauucaaggagaaggucgauacccggacccaagagcccaaggagggcacgaagaagcugaugaagauaaccgccgaguggcuauggaaggagcucgguaagaagaagacuccccgcaugugcacucgggaggaguucacgcgcaagguccggagcaacgccgcccugggggccaucuucaccgacgagaacaaguggaaguccgcgcgcgaggccguggaggacggccgguucugggagcugguggauagggagcggaaccuacaccuggaggggaagugcgaaaccuguguuuauaacaugaugggaaagcgcgagaagaagcugggggaguuuggcaaggccaagggcucgcgggccaucugguauauguggcuuggggcgcgcuuccuagaguuugaggcccugggcuuucucaacgaggaccacugguucucccgugguaacagccugagcggcguggaaggggagggccugcaccgccucggcuacauccugcgggaugucgggaagaaggagggcggggccauguacgcugacgacacugcgggaugggacacgcggaucaccuuggaggaccucaagaacgaggagauggugaccaaccacaugaagggggagcauaagaagcuggcggaggccaucuucaagcugaccuaccagaacaaggucguccgggugcagcgcccgacgccucgaggcaccgugauggauaucaucuccaggcgagaccaacgcggcagcgggcaggucgguaccuaugggcuuaacaccuuuacgaacauggaggcccagcugaucaggcagauggagggcgagggaaucuucaaauccauccagcaccugaccgccagcgaagagaccgccgugcagaacuggcuagcgcgggugggucgagagcggcugucccgaauggccaucagcggggacgacugcgucgugaagcccaucgacgaccgguucgccagcgcccugaccgcccucaacgacaugggaaagguacgcaaagauauccagcagugggagcccagccggggcuggaacgacuggacacaggucccguucugcucccaccacuuccacgagcuggugaugaaggacgggcgcgugcuggucgugcccugccgcaaucaggacgaacuuaucggucgcgccaggaucucgcagggcgccggguggagucugaaggagaccgcaugccuggguaagagcuacgcccagauguggacccucauguauuuucaccgccgggaucugcgccuggccgcgaacgccaucugcuccgcugucccaccucacuggguccccaccagccguaccaccugguccauccacgccaagcacgaguggaugaccacagaggacaugcuagcaguguggaaccgcguguggauccaggagaaucccuggauggaggacaagacccccgucgagagcugggaggaagugcccuauuuaggaaagcgggaggaccaguggugcggcucccugauaggucuuacgagccgagccaccugggccaagaacauccagaccgcuaucaaccaagugcguagccuuaucggcaacgaggaguacaccgacuacaugccguccaugaagcgcuuccggcgagaggaggaggaggccggaguccugugguga

SEQ ID NO: 25056 - RNA, 9876 nt, Artificial Sequence
  derived and/or modified CDS sequence (opt11) from DENV-2__FJ850064__SS-prME
accgcgggggugaucguuaugcugauccccacagccauggccuuccaccucaccacccgcaacggggaaccgcacaugaucgugggccggcaggaaaaggggaagucccugcuuuucaagaccgaggacggcgugaacaugugcacucucauggccaucgacuugggagaacugugcgaggacaccaucaccuacaagugcccccuccugcgccagaaugagcccgaggacaucgacugcuggugcaacagcacuagcaccuggguuacguaugggaccugcaccacgacgggcgaacaccggcgcgagaagcguucuguggcgcugguuccccacguugggauggggcucgagacccgcaccgaaaccuggaugagcagugaaggagccuggaagcacguucagcgcaucgagacguggauucugcgccacccgggcuucaccaucauggccgcgauccuggccuauaccauuggcacgacgcacuuucaacgggcucuuaucuucauccugcugaccgccguggcgcccagcaugacaaugcgauguaucggcaucuccaaccgggacuucgucgagggagugagcggaggauccuggguggacaucguacuugagcacgggagcugcgugaccacgauggccaagaacaagcccaccuuggauuucgaacugauuaagaccgaggccaagcagccggccacccuccgcaaguauugcaucgaggccaagcuaaccaacaccacuaccgagucgcggugccccacgcagggcgagcccucccugaacgaggagcaggauaaaagauucaucugcaagcacuccaugguagaccggggcugggggaacggcugcgggcuguucggcaaaggagggaucguuaccugcgccauguucacguguaaaaagaauauggagggcaagguggugcagccggagaaucuggaguacaccaucgucaucaccccucacuccggggaggagcacgccguaggcaacgacaccgggaaacacgggaaggagaucaagaucacaccgcaauccagcaucaccgaagccgagcugaccggguacggcacagugacuauggaauguaguccccggaccggacuggauuucaacgagaugguccugcugcagauggaggacaaagccuggcucguucaccgccagugguuccuggacuugccccuccccuggcugccgggcgcagacacccagggcagcaacuggauccagaaggagacgcuggugaccuuuaagaacccccacgccaagaagcaggaugucgugguacuagggucccaggagggcgccaugcauaccgcccucaccggggccacagagauccagaugagcucaggcaaucucuuauucaccggccaccugaaaugccgccugcggauggauaagcuccagcugaaaggcaugaguuauagcauguguaccggcaaguuuaaaaucgugaaggagaucgccgagacucaacaugggacgauaguaauccgcguucaguaugagggagaugguuccccgugcaagauuccuuucgagaucacagaccuggagaagcgacacgugcucggaaggcugaucacggugaaccccaucguaaccgagaaggacagcccuguaaacaucgaggcggagccgcccuucggcgacaguuacauaaucaucgguguggagccgggccaacugaagcucaacugguucaagaaggggagcuccaucggccagauguucgccacgacaaugagaggggccaagcggauggccauccugggggacaccgccugggauuucgggucacucggaggggucuucacauccauugggaaagcucuccaccagguauucggugccaucuacggugccgccuuuagcgggguguccuggacgaugaagauccuuaucggugucauaauaaccuggaucgggaugaacagccgcuccaccagccucuccgugagccuggugcugguaggcguagugaccuuguacuugggggcgaugguccaagccgacuccgggugcguggugagcuggaagaacaaggagcuaaagugcggcuccgggauauucaucacggauaacguccacaccuggacggagcaauacaaguuccagcccgagagccccagcaagcuagccuccgccauccagaaggcccacgaggagggcaucugcgguauccgcagcguaacucgccuggagaaucucauguggaagcagaucacacccgaguuaaaccacauacugucugagaacgaggugaagcucacuauuaugaccggcgacaucaaggggaucaugcaggcaggcaagcguagccuucgcccgcagcccaccgagcucaaauauuccuggaagacauggggaaaggccaagaugcuuagcacagagucccacaaccagaccuuccugauagacgggcccgagacagccgaauguccgaacacgaaccgggcuuggaacagccuggaggucgaggacuacggcuucgggguguucaccaccaacaucuggcucaagcugcgcgaaaagcaggauguguucugcgacuccaagcugaugagcgcagcgauuaaggacaaccgggcuguccacgcggauaugggcuacuggauagaguccgcccucaacgacaccuggaagauggaaaaggccagcuucaucgagguaaaguccugccacuggcccaagagccacacccuguggucaaacggcgugcuggagagugagaugaucauccccaagaacuucgccggacccgucucgcagcacaacuacaggccgggcuaucacacgcagaccgccgggcccuggcaccucggcaagcuggagauggauuucgacuugugcgagggcaccaccguaguuguaacugaggauugcggcaaccggggacccagccucaggacgaccacggcgagcgggaaacuuauuacagaguggugcugucgguccugcacccucccaccgcuccgcuaccggggcgaagacgggugcugguacgguauggagauccgcccgcuuaaggagaaagaggagaacuuagugaacagccucguaacagcaggacacggccagaucgacaacuucucacugggcguguuagggauggcgcuguuccuggaggagaugcuccggacacgcaucggcacgaagcaugccauucuccuaguggccgugagcuucguuacacugaucaccgggaacaugaguuuccgcgaccucggccgcgugauggugauggucggagcgaccaugacggaugacauaggcaugggugugaccuaccuggcccuccucgccgcguucaaggugcgccccacauucgccgcaggucugcuguugcggaagcugaccucuaaggagcugaugauggccacgauugguauugcgcuccugucgcaaagcaccaucccugagaccauccuggaacucaccgacgcccuggcccuggggaugaugguccuaaagaucguacggaacauggagaaguaccagcuggcgguuacgaucauggccauaucgugcgucccgaacgcggugauucugcagaacgccuggaagguuagcuguaccauucucgccgcagucagugugagcccccuacuguugaccuccagccagcagaaggcggacuggaucccccuggcucuuaccaucaaaggccucaaccccacggccauauuccugaccacccugucccggaccagcaagaagcgcucguggccgcuuaacgaagcgaucauggccgucggcauggugagcauccuggcuaguagccugcucaagaacgacauuccuaugacggggccccugguggcuggcgggcugcucaccguuuguuacgugcugaccggccggagcgccgaccuugagcuggaacgcgccgcugacgucaagugggaggaccaggcggagaucuccggcucauccccgauccugagcaucaccaucuccgaggacggcaguauguccaucaaaaacgaggaggaggagcaaacguuaacaauccucauccggacgggccugcuggucaucagcgggguguucccgguguccaucccuaucaccgccgccgccugguaccucugggaggucaagaagcagcgcgccggcguguugugggauguaccaucuccaccgcccguagaaaaagcggagcuggaggacggagccuaucgcauuaaacagcgcggcauccucggguacucccagaucggcgccggaguuuauaaggagggcaccuuccacacgauguggcacgucacccggggcgccguacugaugcacagggggaagcgcaucgagcccagcugggccgacgugaagaaggaccugaucuccuacggcgggggcuggaagcucgagggcgaguggaaggagggggaggaggugcaggucuuagcgcuggaacccgggaagaaccccagggcagugcagaccaagcccgggaucuucaagacaaauacgggcaccaucggggccguuucucucgacuuuucucccggcaccagcggaucgcccaucgucgaccggaagggaaaggugguggggcuguacgggaauggggucgugaccagaagcggcgccuacguguccgccauagcgcagaccgagaaguccaucgaggacaaccccgagaucgaagacgacauauucagaaagaagcggcugaccauuauggaucuccacccaggggccggcaagaccaagagauaccugcccgccaucguccgcgaggccaucaagcgggggcugcguacccugauacucgcgccgacccgaguuguugcggcagagauggaggaggcccugcggggccugccaauccgcuaccagaccccagccauaaagacagagcauaccgggcgggagauugucgaucucaugugccacgccacguucaccaugaggcuacugucccccguucgggugccgaacuauaaccucauuauaauggacgaagcccacuucaccgaccccgccuccaucgcagcucgcggcuacaucagcacccgcgucgaaaugggagaggcggcugguauuuucaugacggcgacgccacccggcuccagggacccuuucccccagagcaacgccccgaucauggacgaggaacgggagauccccgagcguagcuggaacagcgggcacgagugggugacagauuucaagggaaagaccgugugguucgucccauccaucaaggcagggaacgacauagccgccugccugaggaagaacggcaagaaaguaauucagcugucgcguaagacguucgauuccgaguacguaaaaacacgcgccaacgacugggacuucgucguaaccaccgacaucagcgagaugggcgcuaacuucaaggcggagcgagugaucgacccucggcgcugcaugaagccagucauccucacggacggggaggagcguguuauccuugccgguccuaugccgguaacccacuccucagcugcccagcgccggggucgaaucggccgcaaccccaagaaugagaacgaccaguauaucuacaugggggaaccccuggagaacgacgaggauugcgcccacuggaaggaggcgaagaugcuccuagacaauaucaacacccccgagggcaucauaccgucuauguucgaacccgaacgggaaaagguagacgccauagacggcgaguaccgccuacgcggagaagccaggaagacguuuguagaccucaugcggcgcggcgaccugcccguguggcuggcauacaaggucgccgcggaaggcaucaacuaugccgaccggaaauggugcuucgaugggauaaagaacaaccaaauccucgaagagaacauggaggucgagauuuggacuaaggagggggagcgcaagaaguugaagccgcguuggcuugacgcgcgcaucuauucagacccccucgcccucaaggaguucaaggaguucgcagcaggccggaagucccugacccucaaucugauaaccgaaaugggcagacugccuacauucaugacgcagaaagcccggaaugcccucgacaaucuggccgugcugcacacggcggaagccgggggccgcgcuuacaaccacgcccucucagagcugcccgagaccuuggagacccuccuauugcucacgcugcuggccaccgucaccgguggcaucuuccucuuccugauguccggcaaggggaucggcaagaugacgcuggggaugugcugcaucaucaccgcgaguaucuuguugugguacgcgcagauccagccgcacuggaucgccgccucuauuauccuggaguucuuucuuauugugcuguuaauccccgagccagaaaagcagcggacaccgcaggacaaccagcucacguauguagugaucgccauucugacuguggucgcggcgacaauggccaacgagaugggcuuucuggagaaaacuaagaaggaucucggucuuggcuccaucaccacgcaggagucggagagcaacauuuuggacauagaccuccgccccgcaucggccuggacgcuguacgccguggccacuacuuucgugacucccaugcuacggcauuccaucgagaacagcucugucaacgugagccucacggccaucgccaaccaggcgacggugcugaugggacugggcaaagguuggccucucucuaaaauggacauaggcgucccccugcuggcuaucggcugcuacagccaggugaacccuauaacccucaccgccgcgcugcugcuacugguggcccacuaugcgaucaucgggcccggcuuacaagccaaggcuacccgggaagcccagaaaagagccgcggccggcaucaugaaaaacccuacgguagauggaaucaccgugaucgaccucgagcccaucccguacgaccccaaguuugagaaacagcugggccaggugaugcuguugauccugugcgucacccaagugcugaugaugcgcaccacaugggcucucugcgaagccuugacucuggccaccggacccaucucaacccuaugggagggcaaccccgggcgguucuggaauacgacuaucgcagugagcauggccaauaucuuucgaggcuccuaccuggccggcgccgggcuacucuucagcaucaugaagaacaccaccaacacuaggcgggggaccgggaacaucggugaaacccugggcgagaaguggaagucccgccugaacgcgcucggcaagagcgaguuccagaucuacaaaaaguccggcauccaggaggucgaccggacccuggccaaggaggggaucaagcgcggcgagacggaccaccacgccgugagccggggguccgccaagcugcgcugguucguagagcggaauaugguuaccccggagggcaaggucgucgaucucggcugcggccgcggcggguggagcuacuacugcggcgggcuuaagaauguccgcgaggugaagggccuuacuaagggcgggccgggucacgaggagcccaucccaauguccacauacggguggaaucucgugagacugcagagcggcgucgacguauucuucacgccgcccgagaaaugugacacccugcuuugugacaucggggagagcagccccaaucccaccaucgaggccggccggacgcugcgcguacugaaccucgucgagaauuggcucaauaacaacacccaguucugcaucaaggugcugaacccguauaugcccagcgugaucgagaagauggaagcgcuccagcggaaguacggcggggcccugguccgcaauccccugucacggaacagcacccacgagauguauuggguuuccaacgccacugguaauaucgugagcuccgucaacaugaucagccgcauguuaaucaacagguucacgaugaaacacaagaaggccaccuacgaaccugacguggaccucgguuccggcacgcgcaauaucgggaucgagagcgaggugcccaaucuggacaucaucggcaagcggauagaaaagaucaagcaggagcaugagaccuccuggcacuacgaccaggaccacccguauaagacgugggcuuaucacggcagcuacgagacgaagcagacggggagugccagcagcauggucaacggcgugguucgccuguugacuaagccuugggaugucgugccgauggugacgcaaauggccaugacggacaccaccccuuucgggcagcagcggguuuucaaggaaaaaguggacacccguacccaggagcccaaggagggcacgaaaaagcugaugaaaaucaccgccgaguggcucuggaaagaauuaggcaagaagaagacgccccgaaugugcacccgggaggaguucaccagaaaggugagaucgaacgccgcccugggggcgauuuucaccgacgaaaacaaguggaaaagcgcccgcgaggcagucgaggauggcagauucugggaauugguggaccgcgagaggaaccuccauuuggaagggaagugcgagaccugcguguacaauaugaugggaaaacgcgagaagaaacuuggggaguuugguaaggccaagggcagcagagcuauaugguacauguggcuaggggcccgcuuccuggaguucgaggcgcugggcuuucucaacgaagaccacugguucucacgggggaauagccugagcggcgucgagggggaggggcugcaucgccugggcuacauccugcgggacguggggaagaaggagggcggggcuauguacgcagacgacaccgcgggcugggauacgcgcaucacccuggaagaccucaagaacgaggaaaugguaaccaaccacaugaagggggagcacaagaagcuggccgaagccaucuucaaacucaccuaccaaaacaagguagugcggguccagcgcccgacgcccaggggcaccgugauggacauuauaagucgccgggaccaacgcggcagcgggcaggucggcaccuacgggcucaacaccuuuacgaacauggaggcacaguugauccgccagauggagggcgagggcauauuuaaaagcauccagcaccugaccgccacggaggagauugcaguccagaacuggcuugcccggguggggcgugagcgguuaagcagaauggcuaucuccggcgacgacugcguggucaagccaauugacgaccgcuucgccagcgcgcugaccgcacuaaacgacaugggcaagguccgcaaggacauccagcagugggagccgucccggggcuggaacgacuggacccaggugccguucugcagccaccacuuccaugaguuggucaugaaggacgggcgcguauugguggucccaugccggaaccaggacgaauugauugggcgcgcccguaucucccagggagccggguggucgcuaaaggagacggcuugccuaggcaaguccuacgcccaaauguggacucucauguacuuucaucgucgggaucucaggcuggcggccaacgccaucuguagcgccgugccgccccacugggugccaaccagucgaaccacauggagcauccacgcgaagcacgaguggaugaccaccgaggacaugcucgcgguuuggaaucgcguguggauccaagagaaucccuggauggaagauaagacccccguggaguccugggaggagguacccuaccuggggaagcgggaggaccaguggugcgguagccugaucgggcucacgagccgcgccaccugggccaagaacauucagaccgccaucaaccaggugcgaucgcugaucggcaaugaggaguauaccgacuacaugccgagcaugaagcgcuuccgccgggaagaagaggaggcuggcguguugugguaa

SEQ ID NO: 25057 - RNA, 9876 nt, Artificial Sequence
  derived and/or modified CDS sequence (opt11) from DENV-2__FJ850065__SS-prME
acagcgggggucauugucaugcuuauacccacagcaauggcauuccaccucacgacaaggaauggggaaccgcacaugaucguagggcgccaagaaaaagggaaaagucuucuauucaaaaccgaagauggggucaacaugugcacgcuaauggcaauugaccuaggagagcuuugcgaggauacgaucacauacaaguguccacuguuacgccaaaacgagcccgaggauauagacugcugguguaacagcacgagcaccugggucacuuacggaacaugcaccacgacaggcgaacaccgacgugaaaaacgaucagucgcacucguaccccacgugggaauggggcuggaaacccgcacagagacauggauguccagcgagggggcauggaaacauguccaacgaauagaaacguggaucuuacgacacccaggauucacaauaauggcagccauucucgcguauacaauaggcacgacccacuuucaacgcgcacugauauucauacuacugacggcaguugcacccucgaugacaaugcgcuguaucgguaucucaaaccgggacuuugucgaaggaguuagcggcggaaguuggguagacauaguccuggagcacggcuccugcgugacgacgauggcuaaaaacaaaccuacauuagauuuugagcucaucaagaccgaagcgaagcaaccggccacucuacguaaauacugcaccgaagcaaagcuaaccaauaccacgacggagagccggugucccacacaaggcgagccaagccuaaacgaagaacaagauaagagguucauauguaaacacagcaugguagaucgagguugggguaacggcugcggacucuucggcaaagggggaaucguaacgugcgcaauguucacauguaagaaaaacauggaaggcaaagucguccagcccgaaaaccucgaguacacgaucguuauaacaccacauuccggcgaagaacacgcaguagggaaugauaccggaaagcacgggaaggaaauaaaaaucacuccccagaguuccaucaccgaagcggagcugacaggcuacggaaccgugaccauggaaugcagcccuagaacugggcuagauuucaacgaaaugguccuccugcaaauggaagacaaggccuggcucguccaccgacaaugguuucuagaccuaccccuacccuggcugccgggagcggauacccaagggucuaacuggauccaaaaagaaacguuagucacauucaaaaacccccacgcgaagaaacaagacguagugguccuggggagccaagaaggagcgaugcacacggcccucacuggggccacugaaauccagaugagcagcggcaaccuccuauuuacaggacaccucaaaugcaggcugcgcauggacaaacuacagcuaaaaggaaugaguuacagcaugugcaccgguaaauucaaaauagucaaagaaaucgccgaaacgcagcacggcaccauaguuauacguguucaauacgaaggggacggaucgccgugcaagauuccuuucgaaauuaccgaucuagaaaagcgccauguccugggacgccugauaacgguaaaccccauaguaacugagaaggacucgcccgugaacauagaggcugagccaccauuuggagauucuuacauuaucauaggcguggaaccuggccagcuuaaacuuaacugguucaagaaaggcuccuccaucggccagauguucgaaacgacaaugcgaggggcgaaacgaauggcaauucuuggagacaccgcgugggacuucggaagccucgguggaguguuuacuuccauuggcaaagcguuacaccaaguauucggggcaaucuacggcgcggcauucagugguguuuccuggacgaugaaaauacuaauaggggucauaauuacauggaucgggaugaacucacguucuacgucccuuagcguuucucugguccuuguaggagugguaaccuuguaccugggggcaaugguccaggcagacucggguuguguaguauccuggaaaaacaaggagcuaaaaugcggaagcggcaucuuuauaacggacaacguacauaccuggacagagcaguauaaguuccaaccugaaucacccagcaaacucgccucagcgauacaaaaggcccacgaggaaggcauaugcgggauccggagcgugacuagacuugaaaaccuaauguggaaacaaaucacccccgaacucaaccauauauuauccgaaaacgagguaaaauugacuauaaugaccggggacauaaaaggaauaaugcaggcuggaaagagaucguuacgaccacagcccacagagcuuaaauauagcuggaaaacgugggguaaagcuaaaaugcucaguaccgaaagccauaaccaaacauuccuaauagauggcccagaaaccgccgaguguccgaacacaaaccgggcauggaacagucuggagguggaagacuauggauuuggagucuucacuacaaacaucuggcuaaaacuacgggaaaagcaggacguauuuugcgauucaaaacuaaugucggcagcuauuaaagacaaccgggcaguccaugccgauaugggauacuggaucgaguccgcgcucaacgacacguggaagauggaaaaagccagcuucaucgagguaaaaucgugccacuggcccaagagccacacucuauggagcaacggaguccuggagagcgaaaugaucauccccaaaaauuucgcgggcccagugagccaacacaacuaccgacccggauaccauacacagacggccgguccauggcaccuaggcaagcuagaaauggauuucgaccugugcgaaggaacaacaguagucguaacggaggacugcgggaaccgcggcccaucgcugcgaaccacuacugcgucgggaaagcucaucacggaguggugcugcaggagcugcacacucccgcccuugcgguaccguggagaagacgggugcugguauggcauggagaucaggccccucaaagagaaagaagaaaaccucgucaacagccucgugacagcugggcaugggcagaucgacaacuucagucucggaguacugggaauggcacucuucuuggaagaaaugcuaagaacccggauuggaaccaagcacgcgauacuauuaguagcuguaucauuugucacucuaauaaccggaaauaugagcuuccgagaccucggacgagugauggugaugguaggcgccaccaugacugacgauauagggaugggagugacguaccuagcacuuuuagcagccuucaaagucagaccgacuuucgcggcagggcuacuacucagaaagcucacaagcaaagaacuuaugauggcaaccauuggaaucgcacuccuuucacagaguacaauaccagaaacaauauuagaauugacagacgcacucgcguugggaaugauggucuuaaagauaguaagaaacauggagaaguaccaacuugcagucaccauuauggcgaucucauguguccccaacgcgguaauacuacaaaacgcuuggaaagugagcugcacgauacuugcggccguauccguguccccacuacucuugacuucgucacagcaaaaggcggacuggaucccccuagcauugaccaucaaaggccugaaccccacggcaaucuuuuuaacaacgcuguccaggacaagcaagaaacgcagcuggccguugaaugaagcuauuauggcgguaggaauggucucaauacuggcgucgagccuauuaaagaaugacauaccgaugacgggcccgcucguugcagggggacuacuuacgguguguuacguccuaacaggacggagugcggauuuggaacuggaacgcgccgcggacguaaagugggaagaccaagcagaaaucuccgguaguucacccauccuaucgauaaccauaagcgaggauggcucaaugucgauaaagaacgaggaagaggaacaaacccugacgauacucaucagaaccggccugcucgugaucucuggcguauucccgguuaguauccccauaacugcagcagccugguaccugugggaggugaaaaagcaacgcgcaggcguccuuugggacgugccuuccccgccgccaguggaaaaagccgaacuagaagacggggcguaucgaauuaagcagcgagggauacugggguauucacagauaggggcuggcguguacaaggaagggacuuuccacacaauguggcaugucacaagaggggcuguccucaugcaucgaggcaagcgaaucgagccgaguugggccgacguuaaaaaggaccuaaucucauauggagguggauggaaacuggaaggcgaguggaaagagggugaagaaguucaaguguuggcgcucgagcccgggaagaacccccgagccguacagacaaaacccgguauuuuuaagacgaacacggggacaauuggcgcagucucccuggacuucucgccugguacaucuggaagcccaauaguugauagaaagggcaaaguaguugggcuauacggaaacggcgucguaacaaggaguggagcauacguguccgcaauugcacagacggaaaaauccaucgaagacaacccagaaaucgaggaggacaucuuccgaaagaagagacucacaaucauggaccuccacccgggcgccggcaagacgaaacgauaccuacccgcgauaguccgcgaagccauaaaaagaggcuuacggacgcucauucuggcgccgacgcguguaguugcugcagaaauggaggaagcacuacgcggccuacccauacgcuaccaaacaccagcuauuaagacagagcacacggggcgagaaaucguggaccugaugugccacgccaccuucacgaugcgccuacuauccccgguacggguaccuaacuacaauuugauaaucauggacgaagcacacuuuacagauccugccucaauugcggcccgcggauacaucaguaccaggguagagaugggcgaggccgccggcauauucaugacugcuacgccgccuggaagccgcgacccguucccgcagagcaaugcacccauuauggacgaagaacgcgagaucccagagcguucauggaacaguggccacgaauggguuaccgacuucaaaggaaaaacagucugguucguacccagcaucaaggcgggcaacgacaucgcagcgugccugcgcaaaaacgggaagaaaguaauacaacucucaagaaaaacauucgacagcgaguacgugaagacccgggcgaacgauugggacuuugucgugacuaccgacauauccgagaugggagccaauuucaaagcggaacguguaauagacccgcgacgaugcaugaaacccgugauucuaaccgauggcgaagaaagagucauccuagccggacccaugccugugacacacagcucagcagcgcagcgccgagggagaauuggacggaacccgaaaaacgagaacgaccaguacaucuacaugggggaaccacuugaaaacgacgaagauugugcacacuggaaagaggcaaaaaugcugcuagacaauauuaacacgccagaaggaauuauuccaucgauguuugaaccggaaagagagaagguagacgcgauugacggggaguacaggcucaggggagaagcacgaaaaacuuucguagaucucaugcgaagaggcgaccuacccguuugguuggccuauaagguggcagccgaggggaucaacuacgccgaccgaaaauggugcuucgacggaaucaaaaacaaccagauacuagaggaaaacauggaaguggaaauauggacaaaggagggagagagaaagaaacucaaaccucgguggcuggacgcccggaucuacuccgacccacuagccuuaaaggaguuuaaagaguucgcagccggacgcaaaucgcuuacccucaauuugauaacagaaaugggaagacuaccgaccuucaugacucaaaaggcgcgcaacgcacuggacaaccuggcuguacugcacaccgcugaggcaggagggagagcguacaaucaugcacuaagcgaacuuccagagacacucgaaacgcugcuccuccucacauugcuagcaaccgugaccggggguaucuuccuguuccuaaugagugggaaagguaucgggaaaaugacgcuaggaaugugcugcauaauuacggcuucaauauuacugugguacgcgcagauucaaccccauuggauagcagcaucgaucauacuggaguucuuccugaucgugcuacucauacccgaaccagagaagcaacggacgccucaggacaaucagcuuaccuacgugguaaucgcgauacuaacgguugucgcugcaacaauggcuaacgaaaugggguuccuagagaaaacuaagaaagacuuaggccuaggaucaaucacaacucaggaauccgagucaaauauacuagacauagaucucaggccggcaagcgcauggacccucuacgcaguggcgacgaccuucguaacaccgaugcuucgacacuccauagagaauagcuccgucaacguuagccuaaccgcaauagccaaccaggcgacggugcuaaugggacuggggaagggauggccucuaaguaaaauggacauuggcgucccucuuuuagccauagggugcuauagccaggugaacccgaucacucuaacagcggcauuacucuuauugguggcccacuacgccauaaucggacccgggcugcaagcaaaagccacccgggaagcucagaagagagcagccgcaggcaucaugaaaaacccaaccguagaugguaucacgguaaucgaccuggagccuauaccguaugacccuaaauucgaaaagcagcucggacaggugaugcuacucauacugugcguuacccaagugcuaaugaugagaacaacuugggcucuaugcgaagcgcucacccuggcaaccggaccgauuucaacacugugggagggaaaccccggaagguuuuggaacacgacaauagccguaaguauggcgaacauauuccgcggaagcuaccuagccggcgcaggacuacucuuuagcauaaugaaaaacacaacaaacacuaggagggggacaggcaauaucggagaaacccuaggcgagaaguggaagucacggcucaacgcucuuggaaaguccgaauuucagauauacaagaagucagggauacaggaagucgaccguacauuggcgaaagaggggauaaagcggggcgagacagaucaccaugcgguaucccgcggcucugcgaagcuacgaugguucgucgaacgaaauauggugaccccagagggcaaaguggucgaccuggggugcggccgaggaggguggagcuauuauugcggaggccuuaaaaauguccgcgaaguaaaaggucucacgaaagggggaccaggccaugaagaaccgaucccgaugucaaccuacggguggaaucucguaagacuccagucgggcgucgacgucuucuucacaccaccagaaaaaugcgacacccuucucugcgacaucggcgagucaagcccaaauccaacgauugaggcaggaagaacucuuaggguguuaaaucucguagagaacugguugaacaacaauacgcaauucugcauaaaaguacuaaacccguacaugcccagcgugaucgagaaaauggaagcccugcagcgaaaacauggaggggccuugguacgcaacccgcugagucggaacagcacgcacgaaauguacuggguuagcaacgccacgggaaacaucguaaguuccgucaacaugaucagcaggaugcugauaaaccgauucacuaugaaacacaaaaaggcaacauacgaaccagacguggaucugggaagcggcaccagaaauaucggcaucgagagcgagauaccaaaccuggauauaauagggaagaggauagaaaagauaaaacaagaacaugaaacaucuuggcacuacgaucaagaucacccuuacaaaacuugggcauaccacgggucauacgagacgaaacagacagggagcgccucgaguauggucaacgggguugugagacugcuaacgaaaccgugggacgucgucccaaugguuacucagauggcgaugacagacacgacgccuuucggccaacaaagagucuuuaaagagaaagucgauacaagaacccaagaaccgaaagaagguaccaagaaacucaugaaaauaaccgccgaguggcuauggaaagaacuaggcaagaagaaaacaccacggauguguaccagagaagaguucaccagaaaaguuagaagcaacgcggcucuaggggcgauauucacagacgaaaacaaauggaaauccgcaagagaagcgguagaggauggaagguucugggagcucguagacagagagcgcaacuugcaccucgagggcaaaugcgagacaugcguauacaauaugaugggcaaaagagagaagaagcucggugaguuuggcaaggcaaaaggcagucgugcgaucugguacauguggcuaggggcgcguuucuuagaguucgaggcacugggcuuuuugaacgaagaucacugguucucgagggggaauagccuauccggaguagaaggcgagggacuccaucgccuaggcuacauacuacgugauguggguaaaaaggaagggggugccauguacgccgacgauacagcgggcugggacacuaggauaacacuagaagaucucaagaacgaagagaugguaacuaaccacaugaaaggcgaacacaagaagcuggcggaggcaaucuucaaacucacguaccaaaacaagguagugcgcguacaaagaccuacaccgaggggcacgguaauggacauaauaucacgacgcgaccaacggggcagcgggcaggucggaaccuacggacuaaauaccuucacaaauauggaagcgcagcuaaucaggcaaauggaaggagaggggaucuucaaaucgauccaacaccuaacggccacugaagagauagccguucaaaacugguuagccagagugggacgcgaacggcuaagucgcauggcgaucucaggugaugacugcgugguaaagcccauagacgaccgguucgcuucggcacugacagcccuaaacgacaugggaaaggugagaaaagauauacagcaaugggaaccgucccgaggcuggaacgacuggacccaagugccauucugcagucaucauuuccaugagcuagucaugaaggauggacgagugcuugucgucccgugucgaaaccaggaugaauugaucggccgagcacggauaucacaaggagccggauggucccuaaaggagacagccugccugggcaagucguacgcacaaauguggacccugauguacuuucaucgucgggauuuacgauuagcggcgaacgcgaucugcagugcaguuccgccgcacuggguacccaccucgcgaacaacuuggaguauccacgccaaacacgaauggaugacaacggaggacaugcucgcagucuggaacagagucuggauccaagaaaacccauggauggaggacaagacaccggucgagagcugggaggagguuccauaccuaggaaaacgggaagaucaauggugcggaagccucaucgggcucacuucgagagcaaccugggccaaaaacauccagacagcgaucaaccaaguaagaucucuaauaggcaaugaagaguacacagacuacaugccuuccaugaaacgauuccggcgugaggaagaagaggcugggguauuaugguag

SEQ ID NO: 25058 - RNA, 9876 nt, Artificial Sequence
  derived and/or modified CDS sequence (opt11) from DENV-2__FJ873808__SS-prME
accgccggcgucauaguaaugcugauccccacggccauggcguuccaccucaccacucgaaacggggagccccacaugaucgugggccggcaggaaaaggggaagucccugcuguuuaagaccgaggauggcgugaacaugugcacccucauggccauugaccugggggaacugugcgaggacaccaucacuuauaaguguccccuccugcgccagaacgagcccgaggacaucgauugcuggugcaauagcaccaguaccuggguuaccuacgggaccuguaccaccacuggcgagcaccggcgggagaagcguuccguggcccuggugccccaugucgggaugggccucgagacccgcaccgagaccuggaugagcuccgagggggccuggaagcacguacagcggauugagacauggauucuccgccaccccggcuucaccaucauggcugcgauccuagccuacaccaucggaaccacgcacuuccagcgggcccucaucuucauccugcuuaccgccguugcgcccaguaugaccaugcguugcaucggcaucuccaacagggacuucgucgagggcguaucggggggcuccuggguggacauuguccucgagcacgguagcugugugacgacaauggccaagaacaagccaacuuuagacuucgagcugaucaaaaccgaggccaagcagcccgccacacuccgaaaguacugcaucgaggccaaacugacuaacaccaccaccgagucccggugcccgacacagggcgagccgagccuuaacgaagagcaagauaaacgcuucaucugcaagcacuccaugguggaccggggcugggggaacggcugcggguuauucggaaagggagggaucgugacaugcgcgauguucaccugcaagaagaacauggagggaaaggucgugcagcccgagaaccuggaguacaccauugucaucacgccccacagcggggaggagcaugccgugggcaacgauaccgguaagcacgggaaggagaucaagaucacaccccaguccagcaucacagaagcagagcuaaccggcuauggcacggugaccauggaauguagcccccgcaccggccuagacuucaacgagauggucuugcugcagauggaggacaaggccuggcucgugcaccggcagugguuccuggaucucccccuccccuggcuuccgggggccgacacccagggcagcaacuggauccagaaggagacgcuggugacauucaagaacccccacgcgaaaaagcaggauguugugguccucgggucucaggagggcgcuaugcacacugcccuaaccggcgcgacugaaauucagaugagcagcgguaaccuccuguucaccggccaccugaagugccgccugcggauggacaagcuccagcugaaggggaugucguacagcaugugcaccggcaaguucaagaucgucaaagagaucgccgagacucagcacgguacgauugugauucgcguccaauacgagggcgacggcucccccugcaagauccccuucgagaucaccgacuuggagaaacgccacgugcucgggcgccugaucaccgugaacccgaucgucaccgaaaaagacucgcccgucaacaucgaagcggaaccgccuuuuggugacuccuacauuauaaucgguguggagccgggucaauuaaagcucaacugguucaagaaggggucuaguaucggccagauguucgagacuaccaugcgcggugcuaagaggauggccauccugggggacacugccugggauuucggcucucucgggggcgucuucaccuccaucgggaaagcucuccaccagguguucggagcuaucuacggcgcggccuuuagcgggguguccuggacuaugaagauccugaucggcgucaucaucaccuggaucggaaugaacagcagauccaccagccuguccgugucacugguccuugucggcguggugacccuguaccugggggcuaugguccaggccgacuccggcugcgucgugucuuggaagaacaaggagcucaagugcggcucagggauuuucaucacggacaauguccacaccuggacagagcaguacaaguuucagcccgagagccccagcaagcuggcauccgccauucagaaggcgcacgaggaagggaucugcgggauccggagcgugacccgccuggaaaaccucauguggaagcagaucacgcccgagcugaaccacaucuugucagagaacgaggugaagcucaccaucaugaccggagacaucaaggggaucaugcaggccggcaagcguagccugcguccacaacccaccgagcuaaaguacaguuggaagacguggggcaaagcaaagaugcucagcaccgaaucccauaaccagaccuuccugaucgacgggccugaaaccgcggaguguccgaauacgaaccgggcguggaacagcuuggaggucgaggauuacggguucgggguguucaccaccaacaucuggcuuaaacugcgcgagaagcaagacguguuuugcgauuccaaacugaugagcgccgccaucaaagacaaucgggccguccacgcagacaugggcuacuggauugaguccgcccucaaugacaccuggaagauggagaaggccagcuuuaucgagguaaaguccugucauuggcccaagagucacacccugugguccaauggcgugcuagagagcgagaugaucauucccaagaacuucgccgggcccguuucccaacauaauuaccgcccgggcuaccacacccagaccgcggggcccuggcaccucggaaagcuggagauggacuuugaccugugcgaggggacgacggugguugucacggaggacugcggcaacaggggccccagccugcguacaacuaccgcaagcgguaaguuaauaacggaauggugcugcagguccugcacccugccuccgcuccgguaccguggggaggacgggugcugguacgggauggagauucgcccgcugaaggagaaggaggagaaucuggugaacagccucgugaccgccgggcauggacaaaucgacaacuucucccuuggcguccugggaauggcccucuuccuggaggagaugcuucggacacgcaucggcacgaagcaugcgauacuccugguggcugugagcuuugucacccuuaucacaggaaauauguccuuccgggaccucggccgugugauggugauggucggggccacuaugacggacgacaucgggaugggcguaacuuaccuggcccugcucgccgcguucaagauccgcccgaccuucgccgccgggcugcuucuccggaagcugaccagcaaagagcugaugauggcaacgauuggcaucgccuuauugagccaaagcaccauccccgagaccaucuuagagcucaccgaugcgcuagcgcucggcaugauggugcugaagaucguacgcaacauggagaaauaccaacuggccguuacgaucauggccauauccugcgugccgaacgccgucauccugcagaacgcguggaagguuucaugcgcaauccucgccgccguguccgucucaccccugcugcucaccuccagcaagcagaaggcggacuggaucccguuagcccugaccaucaagggccuaaaccccacggcaauauuccugacaacauuaucccggaccagcaagaagaggaguuggccguuaaacgaggccgucauggccgucgguauggugucuauccuggccaguagccugcucaagaacgauauacccaugaccgggccccugguggcagguggucugcucaccgucugcuaugugcugaccggccggagugccgaucuggagcucgagcgcgccgccgacguaaaaugggaggaccaggcggagaucuccggaagcucccccauccugagcauaaccauuuccgaggacgguagcauguccaucaagaacgaggaagaggaacagacccugacgaucuugauccggaccggccuccuggucaucagcgggguguuccccguguccauccccaucacugccgccgccugguaccucugggagguaaagaagcagcgcgccggcgugcugugggacgugcccagcccgccgcccguugaaaaggcggagcuggaggacggggcguaccguaucaaacagcgcggcauccuuggguacucacagaucggcgccggagucuacaaggaagggaccuuccauaccauguggcacguaacucgcggcgcuguccugaugcaccgcgggaagcggaucgaacccucgugggccgacgugaaaaaggauuugaucuccuacggcgggggcuggaagcucgagggcgaguggaaggagggggaagaggugcagguccuggcgcuggaacccggcaagaacccaagagccgugcagacgaagcccgggaucuucaagacuaauacaggcacgauaggugccgugagccucgacuucucccccgggaccagcgguagccccaucguugaccggaagggaaaggugguuggccuguacgggaacggcgucgucacccguagcggugcuuaugucucagcgaucgcccagaccgagaagucuaucgaggacaaccccgaaauagaggacgacaucuuucggaagaagcgccuaaccaucauggaccuacaccccggggccggcaagaccaagcgguaccugcccgccaucgugcgcgaggccaucaagaggggccuccgcacuuuaaucuuagcgcccaccagggugguggcggccgagauggaagaggcccugcggggucugcccauccgauaccaaacuccagcuaucaagaccgaacacacgggucgcgagauagucgaccuaaugugccacgcuacuuuuacaaugcgccuacugucccccgugcgggugccgaauuacaaccucauuauaauggaugaagcccauuucaccgaccccgccuccauagccgcccgcggguauauuaguacccgggucgagaugggcgaggcggcagggaucuucaugacagccacgccacccggcucccgcgauccguucccucagagcaacgccccgaucauggaugaagagcgggaaauccccgagcgauccuggaacuccgggcacgagugggugaccgacuucaagggcaagaccgugugguuugucccgucgaucaaggcggggaacgauauugccgcgugcuugcggaagaacgguaagaaggugauccagcugucacgcaagaccuucgacuccgaguacguaaagacgcgggccaacgauugggacuucguugugaccaccgacauaagcgagaugggcgcgaacuucaaggccgagcgcgugauagacccccggcgcugcaugaagcccgucauccucaccgacggggaagagcgggugauccuggccgggcccaugccagugacccauucgagcgcagcccagcgucgggggcgcauaggccgcaaccccaagaacgagaacgaccaguacaucuacaugggggagccccuggaaaacgaugaagacugcgcccauuggaaggaggcgaagaugcuccuggacaacaucaacacucccgaggguauaaucccguccauguuugagcccgagagagagaagguggacgccaucgacggcgaguaccgauuacgcggggaggcccgcaagacguucgucgaucucaugcggcggggugaccugccaguauggcuggccuacaagguagccgcugaggggaucaacuacgccgaccggaaauggugcuucgacggaauucgcaacaaccagauacucgaggagaacauggagguugagaucuggacuaaggagggggagcggaaaaagcugaagccgcgcuggcuggacgcccggaucuacucagacccccucgccuuaaaagaguucaaggaguucgcggccggccgcaagucccuaacuuuaaaucugauaaccgagaugggcaaguuaccgaccuucaugacccagaaggcgcgaaacgcccuugacaaccuggccguacugcacacggcggaagccggggggcgcgcuuacaaccacgcccucagcgagcugcccgagacccuggaaacccuacuucugcucacucuccuggcgaccguaaccgggggcauauuccucuucuugauguccggcaaggggaucggcaagaugaccuuggggaugugcugcaucaucaccgcguccaucuuacugugguaugcccagauacagccgcacuggaucgccgcaucuaucauccuggaguuuuuccugaucgugcugcugauuccugaaccagagaagcaacgaacgccgcaggacaaucaguugacguacgucgugaucgccauccuaaccguugucgcggccaccauggccaacgagauggguuuucuggagaagaccaagaaagaccucgggcugggcaguaucacgacccaagagagcgaguccaauauacuggauaucgaccuccgcccggccuccgccuggacccuguacgcaguagcaaccacguucguuaccccaaugcugagacacuccaucgagaacagcuccgucaacgugagccucaccgcaaucgccaaucaggcgaccgugcugaugggucuggggaagggcuggccccuauccaagauggacaucggggucccgcugcuggcgaucgguugcuauagucaagugaacccaauuacguugaccgcugcguugcugcucuugguagcucacuacgccauuaucgggccuggccugcaagccaaggccacccgcgaggcccaaaagcgggccgcagccggcaucaugaagaaccccaccgucgacgggauuacggugaucgaccucgagcccauuccguacgaccccaaguuugagaagcaauuaggccaggugaugcugcucauucugugcgucacccaggugcugaugaugcgcaccaccugggcccucugcgaggcccuaacgcuggcuaccgggcccauuuccacccucugggaggguaacccggggcgguucuggaauaccacgaucgcggugagcauggccaacaucuuccgcggcucguaccuggcgggagccggguuacuguucaguaucaugaagaacaccaccaacacgaggcggggcacggggaacauuggagagacccugggcgagaaguggaagucccgccugaacgcucuaggcaagagcgaguuccaaauuuacaaaaaguccggcauccaagaggucgaucgcacucuggccaaggaaggaaucaagcgcggagagacggaccaccacgccgugagccgggguucugccaaacugcgcugguucguggaacggaacaugguaacuccagaggguaaggugguugaccuugguugcgggcgugguggguggaguuacuauugcgggggucugaagaauguccgggaggugaagggguugaccaaggguggacccggccacgaggagcccaucccgauguccacguauggguggaaccucguccggcugcagagcggagucgauguguucuucacgccgcccgagaagugugauacgcugcucugugacaucggggagucgucccccaauccgacuaucgaagccggacgcacccuaagagugcucaaccucgucgaaaacuggcugaacaacaacacacaguucugcaucaaagugcugaacccguacaugcccagcgugaucgaaaagauggaggcgcuccaaagaaaauacggcggggcccugguucgcaacccccugagucggaacaguacacacgagauguacugggugucgaacgccacgggaaacaucguuagcuccgucaacaugauaagccgcaugcugaucaaccgguucaccaugaagcauaagaaggccaccuacgagccggauguggaccucgggucgggcacgcgcaacauugggaucgagagcgaaaucccuaaccuggacaucauaggcaagcggaucgaaaagauaaaacaggagcacgagacguccuggcacuacgaccaagaccaccccuauaagacuugggccuaccauggcucuuacgagacaaagcagaccgggagugcuagcucaauggugaacggcguugugcgccugcucacgaaaccuugggacguggucccgauggugacucaaauggccaugaccgacacgacccccuucggacagcagcgcguguucaaggagaaagucgacacccggacccaggagcccaaggagggcacuaagaagcugaugaagaucacagcggaguggcuuuggaaggagcuaggcaagaagaagacaccuagaaugugcacccgggaagaguucacccgcaagguccguucgaacgccgcccugggggcuaucuucacggaugagaacaaauggaaauccgcccgcgaggccguagaggacggccgguucugggagcuggucgaccgcgagcggaaccuccaccuggaggggaagugcgagaccugcguguacaacaugauggggaaacgcgagaagaagcugggggaguucgguaaagccaagggcagucgggcgauuugguauauguggcucggggcccgcuuccuggaauucgaggcccugggcuuccucaacgaggaccacugguuuagucgcgggaacucccuuagcggcguggaaggggagggccuacaccgccucggcuacauccuccgugacguagggaaaaaggagggaggugcaauguacgccgacgacaccgcuggcugggacacccgcaucacgcuggaggacuuaaagaacgaggagaugguuacgaaccauaugaagggggagcacaagaagcuggccgaggccaucuucaaauuaacuuaccagaacaaagucgugcgggugcaacgcccgacgccccggggcacggucauggacaucaucucccgccgggaccagcgcggcagcggucaggucgguaccuaugggcucaauaccuucaccaacauggaggcccagcugauacgccagauggagggggagggcaucuucaaaucaauccagcaccugacggccaccgaagaaaucgcagugcaaaacuggcucgcccgggucgggcgcgagcgucugagccgcauggccaucuccggcgacgacugcguggugaagcccaucgacgaccgauucgccuccgcccuaaccgcgcucaacgacaugggaaagguccguaaggacauccaacaaugggaacccucccggggcuggaaugacuggacacaggugccguucugcucccaccacuuccacgagcuggugaugaaggacggucgcguccucgugguaccaugucggaaucaggaugaacucauuggaagggcgcggaucucucagggcgccggguggagccugaaggagacggccugccugggcaaaaguuacgcacagauguggacccucauguacuuccacagacgggaccugcgccuggcggcgaacgccaucugcagcgcggugccgccgcacuggguaccaacaucccgcacuaccuggucgauccacgcgaagcacgaguggaugacgaccgaggauaugcucgccguguggaaccgcgucuggauccaggggaaucccuggauggaggauaagacgcccguggaguccugggaggaagugcccuaccuaggcaaacgagaggaccaguggugcgggucgcuuauaggucugaccucccgcgccacaugggccaaaaacauccagaccgcuaucaaccaaguccggagccugauugguaacgaagaauacaccgacuacaugccgucuaugaagcgcuuccgucgcgaagaggaggaggcggggguucuaugguga

SEQ ID NO: 25059 - RNA, 9876 nt, Artificial Sequence
  derived and/or modified CDS sequence (opt11) from DENV-2__FJ850120__SS-prME
accgccggaguuaucgugauguugauuccaacggccauggcguuccaucuuacaacccgcaacggugagccccacaugaucgugggacggcaggagaaggggaagucacugcuauucaagaccgaggauggagugaacaugugcacgcucauggcuaucgaccugggggaacugugcgaagacaccaucaccuauaagugcccccuacugagacagaacgaacccgaggacaucgacugcugguguaacagcacuagcacuugggucacguacgggacuugcaccaccacgggcgagcacaggcgcgagaagagguccguagcccuggugccgcacgugggcaugggccucgaaaccaggacugagacuuggaugagcuccgagggggccuggaagcacguucagcggauugagacauggauccugcgccacccgggcuucaccaucauggccgcaauccuggccuacacaaucgggaccacgcacuuccagcgggcgcucaucuucauccuucugaccgccguggcgcccagcaugacuaugcgcugcaucggcaucagcaaccgggacuucgucgagggagugagcgggggcuccuggguggacaucguacucgaacauggaagcugcguaaccacgauggccaagaacaagccaacucuggacuucgagcucaucaagaccgaggccaagcagccggcgacccugcgcaaguacugcaucgaggcuaagcugacgaacaccaccaccgagucccggugcccaacacagggcgagccaagccugaacgaggaacaggacaagcguuucauaugcaaacacuccaugguggaccgcggcugggggaacgguugcggguuguucggcaagggcgggauugugacaugcgcgauguucacgugcaaaaagaacauggagggcaagguggugcagccagagaacuuggaauauacaaucgucaucacgccccacagcggagaggagcaugcugugggcaacgacacagguaagcacggcaaggagaucaagaucaccccgcagucuaguguuaccgaggccgagcuaaccggguacgggacggugacgauggaguguagcccuaggaccggccucgacuucaaugagaugguacuucuucagauggaggacaaggccugguuaguacaccggcagugguuccucgaucugccccuccccuggcugccuggggccgacacccagggcagcaacuggauucagaaagaaacgcuggucacuuucaagaauccccaugcgaagaaacaagacguggucgugcucgggucacaggagggcgccaugcacaccgcucugacuggugcgacggaaauucagaugagcagugggaaucuacuguucaccggccaccugaagugccgguuaagaauggacaaguugcagcugaaggggauguccuauagcaugugcaccggcaaguucaagauuguuaaggagaucgccgagacccagcacggcacgaucguuauccgcgugcaguacgagggcgauggcucccccugcaagauucccuucgagaucaccgaccuggagaagcggcacguguugggccgccuuauaacugucaaccccaucgugacggaaaaggacagccccguuaacaucgaggcggaaccgcccuucggugacuccuacaucauaaucggggucgagccgggccaacuaaagcuaaauugguucaagaaggggucgucaauuggccagauguucgaaacgaccaugcgcggcgccaagcggauggccauccuuggggacaccgccugggacuucggcagccucggcgggguuuuuaccuccaucgggaaggcacuccaccagguuuucggcgcgaucuauggcgcugcguucuccgggguguccuggacuaugaagauccucauuggaguuaucauuacguggaucgggaugaauagccgguccaccagcuugucaguaagccugguacucgugggcgucgugacccuguacuuaggcgcaauggugcaggccgacuccggcugcguggugagcuggaaaaacaaggagcucaaaugcggaucagggaucuucaucacggacaauguacacaccuggaccgagcaguacaaguuucagcccgagagccccucaaaacuggccuccgcuauacagaaggcccaugaggaaggcaucugcgggauccggaguguuacucgcuuagaaaaccucauguggaagcagaucacccccgagcugaaccacauccuguccgagaacgaggucaagcuaaccauaaugaccggcgacauccgggguaucaugcaggccggcaagcgaagccugaggccccagcccaccgagcugaaguauuccuggaaaacguggggcaaggcgaagaugcucagcaccgaaucccacaaccagaccuucuugaucgauggcccagagacugcggaaugcccgaacaccaaucgcgccuggaacagccuggagguagaggauuacggguucgggguguucaccacgaacaucuggcucaagcugcgugagaagcaagacgucuucugcgacuccaaacugaugagugccgccaucaaggacaaccgcgccgugcacgcagacaugggcuacuggaucgaauccgcccucaacgacacuuggaaaauggaaaaggccagcuucauugaagugaagaguugccacuggccgaaaagccacacccuuugguccaauggcguccuggagagcgagaugauuaucccaaagaacuucgcagggcccgugucccagcacaauuaccguccgggcuaccacacgcagaccgccgggcccuggcaucucggcaaacucgagauggauuucgaucugugcgaagggaccacgguggucguuacugaggauugcggcaaucgaggcccaagucuacguacaaccaccgcgagcggaaagcugaucacggaauggugcuguagauccugcacccugccgccgcucagauaccguggcgaggauggguguugguacggcauggagauccggccccucaaggagaaggaggagaaccucguaaauucccucgucaccgccgggcacggccagaucgauaacuuuucauugggcguacuuggaauggcacucuuccuugaggaaaugcugcggacccggauuggcacgaagcacgcgaucuugcucgucgccgugagcuucgugacccuaauuaccgggaacauguccuuucgagaccucggccgagugauggucaugguuggggccaccaugacggacgacauaggcaugggggugaccuaccuggcccuccucgccgcguucaagguccggcccacuuucgccgccggguuacugcucaggaaacuuaccagcaaggagcugaugauggcaacuaucggcaucgcccuccuaucccagagcacgaucccggagaccauccuggagcucaccgacgcgcucgcccuagggaugauggugcucaaaauaguccggaacauggaaaaguaccagcuggcggucacgaucauggcuaucuccugugugccaaacgccgugauccugcagaacgcuuggaagguaucgugcacaauccucgccgcuguguccguuagcccccugcugcucaccagcucccagcaaaaggcagacuggaucccccuggcucugaccaucaagggccucaaucccacagcgauuuuccuaaccacccuaagucgcaccagcaagaagagaagcuggccacucaacgaggccaucauggccgugggaauggugagcauucuggcaagcucgcugcucaagaacgacauccccaugaccgggccuuuagucgcuggcggucugcucaccgugugcuacgugcugaccggccgcagcgccgaucuggaguuagagcgggcugcggacgucaagugggaggaccaggccgagaucucggggagcucccccauccuuucuaucaccauuuccgaggacggcaguaugagcaucaagaacgaggaggaggagcagacucugaccauucuaaucaggacgggccugcuagugaucuccgggguuuucccgguaucaauccccaucaccgcggccgccugguaccucugggaggugaagaaacagcgggcuggcguguugugggaugucccgucaccuccgcccguggagaaggccaagcuggaggacggggcguaccggaucaagcagcggggcauucucggguacagccagaucggcgccggcguguacaaagaagggacauuccacaccauguggcacgucacgcgcggggcagugcugaugcaucgggggaagcgcaucgagcccucaugggcggacgucaagaaggaccugaucuccuacggcgguggcuggaagcucgagggcgaauggaaggagggcgaggagguccaggugcuagcccuggagcccggcaagaacccccgcgcugugcagacuaagccagggaucuucaagaccaacaccgggaccaucggagccguuagccucgacuucuccccuggcaccagcggcagucccaucguugaucgcaaagggaaggucguaggccuguacgggaacgguguggugacucggucaggcgccuacgucuccgccaucgcgcagacggagaagaacauagaggacaaccccgagaucgaagacgacaucuuccgcaagaagagacugaccaucauggaccuacaccccggggccgguaagaccaagcgcuaccugcccgccaucgugcgggaggccauuaaacgcggccugcgcacccugauccucgcuccaacucgcguggucgcagccgagauggaggaggcccugcgcggccugcccauucgguaccagacaccggcgaucaagaccgagcacaccgggcgcgagauaguggaccucaugugccacgccacguucaccaugcggcugcugucucccgugcgcgugccgaacuacaaccucauaaucauggacgaagcccacuucaccgaucccgcuagcaucgccgcaagggguuacaucuccacgcgcguugaaaugggcgaggccgcgggcauauuuaugacugccacaccgccugguucccgggauccguucccccaguccaaugcgcccauuauggaugaggagcgcgagauccccgagcggagcuggaacagugggcacgagugggugaccgacuuuaagggcaagaccgucugguuuguacccagcauaaaggcggguaacgacauugcagcuugccugcgcaagaacggcaagaaggugauccaacugucccggaagacauucgauagcgaauacgucaaaacucgcgcaaaugacugggacuuuguugugacaacagauauaucggagaugggggcuaacuucaaggccgaaaggguuaucgacccccgccggugcaugaagcccgugaucuugacggacggugaggagcgcguaauccuggcgggccccaugccggucacccacagcuccgccgcccagagaagggggcgcauaggcaggaaccccaagaaugagaacgaccaguauaucuacaugggggagccacucgagaaugacgaggacugcgcccauuggaaagaggcaaagaugcuccuggacaauaucaacacccccgaaggcauaaucccuaguauguucgagccagagcgcgagaagguggaugcgaucgauggcgaguaccgacugcguggagaggcccgcaaaaccuucguagaccucaugcgcaggggcgauuugccggucuggcuggcauauaagguagccgccgaggggaucaacuaugcugaccgcaaguggugcuucgacgggaucaaaaacaaccagauccuugaggaaaacauggagguugaaaucuggaccaaagaaggggaacguaagaagcugaagccgcgcuggcuggacgcccggaucuacucagacccccucgcccugaaagaguuuaaagaguucgcugcgggccgcaagagccugacccucaaccugauaaccgagaugggcagacugccaaccuucaugacgcagaaggcccgcaacgcguuggacaaccuggcuguccugcacaccgccgaggcugggggucgggcauacaaucacgcccucuccgagcugcccgaaacccuggagacuuugcugcugcucacucugcuggcgaccgugaccgguggcauuuuccuuuuccugaugagcggcaaagggauaggcaagaugaccuuggggaugugcugcauaaucaccgccucaauccuccugugguacgcgcagauccaaccgcacuggaucgccgcuagcaucauccuagaauuuuuccucauagucuuacugaucccugagcccgagaagcagcgcacgccccaggauaaccagcucaccuacguagugaucgcaauacugaccgucguggccgcaaccauggccaacgagaugggcuucuuggagaaaaccaagaaagaccucgggcuuggcuccaucaccacucaggagagugagagcaacauccuagacaucgaccuccgaccggccuccgccuggacucuguacgccguggccacgaccuucgucacccccaugcugcgccacuccauagaaaauucgagcgucaacgugucccucaccgccaucgccaaccaggcuacgguccucaugggacuggggaaaggcuggccuuugagcaagauggacaucggggugccacugcuggccaucggcugcuauucccaagugaaccccauuaccuuaacggcagcccugcugcucuuagucgcccacuacgccauuaucgggcccgggcugcaggccaaagcuacccgggaagcccaaaagcgcgccgccgccgggauaaugaagaacccaacgguggacgggauaaccguuaucgaucucgagccaauuccguacgaccccaaguucgagaagcaacugggccaggucaugcuguuaauccugugcgugacccagguccucaugaugcggaccacaugggccuuaugcgaagcccugaccuuagccaccggccccaucagcacccucugggagggcaacccaggccgcuucuggaauacgacaaucgcagucucuauggcgaacauauuccgcggcagcuaccuggcgggcgccgggcucuuguucucaaucaugaagaacaccaccaauacgcggcgcggcacggguagcaucggcgagaccuugggcgaaaaguggaaauccaggcugaacgcacuuggcaagagcgaguuucagaucuacaagaaguccgggauucaggaaguagacaggacccuugcgaaggaggggaucaaacggggcgagacagaccaccacgccgugagccgcggguccgccaaguugcggugguucguagagcgcaacauggugacaccggagggcaagguggucgaccuggggugcggacggggcggguggagcuacuacuguggcgggcugaagaacgugcgggaggugaagggacuaacuaaaggugggcccggccacgaagaacccaucccaauguccacauauggguggaaccucguacggcugcaaucgggcguagacguguuuuucacaccgcccgaaaagugcgacacccuccuaugcgacauuggggagucaucaccuaaccccaccaucgaagcaggccgcacccuucggguccugaacuuaguagaaaacuggcugaacaacaacacccaguucugcaucaagguucugaauccguacaugccuagcgucaucgagaagauggaggcucuccagcguaaauacggcggggcgcuggugcggaacccucucagcagaaauucaacgcaugagauguauugggucuccaacgccaccggcaacauugucagcuccgugaacaugaucagccguaugcugaucaaccgguucacgaugaagcacaagaaggcuacauacgagccggacguagaccuggggucaggcacgagaaacaucggcaucgagaacgagauucccaaccuggauauuaucgguaagcgcaucgagaaaaucaaacaggagcacgagaccagcuggcacuacgaucaggaccaccccuacaagaccugggccuaccacggcuccuacgagaccaagcagacugggagcgcuuccagcauggucaacggcgugguucgccugcucacuaagccuugggacgucgugccgauggugacgcagauggcgaugacugacacgacccccuucgggcagcaaagggucuucaaggagaagguggauacucgcacccaggagcccaaagagggcaccaagaagcugaugaagaucaccgccgaguggcuguggaaggagcucgggaagaagaagacgccacggaugugcacgcgagaggaguuuacgcggaaagugcgcuccaaugccgcccuaggggccaucuucacagacgagaacaaguggaaguccgcgcgggaggccgucgaggacucccgcuucugggagcugguggaccgggaacguaaucuccaccuggaggguaagugcgaaaccugcguguacaacaugauggggaagcgggagaagaaacugggggaguucgggaaagcaaagggcucucgcgcgaucugguauauguggcuuggcgcgcgguucuuagaguuugaggcccugggguuccucaacgaggaccauugguucucccggggaaacagccuaagcggcgucgagggcgaggguuugcaccgucucggcuacauccugcgcgacgugggcaaaaaggaaggcggugccauguaugccgacgacaccgcugggugggacacgcggaucacccuggaggaccucaagaaugaggaaauggucacuaaccauaugaagggggagcauaagaaguuggcggaggccauauucaagcuaacuuaccagaacaagguggugcgcguucagcggccgacaccccgcgguacggugauggauauuaucagccgacgcgaccagcgcggcagcggucagguggggaccuacggccucaacaccuucacgaacauggaggcccagcugaucagacagauggaaggggaagguauauucaagagcauccagcaccugaccgcuaccgaggaaaucgccguccagaacugguuggcgcgaguuggccgggagcggcugucucggauggccaucuccggggacgauugcguggucaagccaaucgacgacagguucgcgucagcccugaccgcccuaaacgacaugggcaaggugcggaaagacauucagcagugggagccgucccgcggguggaacgacuggacccaaguccccuucuguagccaccacuuccacgagcugguaaugaaggacggccgggugcuuguggucccauguagaaaucaggaugaacucaucgggcgggcccguaucucgcagggagccggcuggucgcugaaggaaaccgccugccuggguaaauccuacgcucagauguggacccugauguacuuccacaggcgcgaccugaggcuugcggcgaacgcaauuugcagcgcugugcccucgcacugggucccaaccagccguaccacgugguccauccacgccaagcacgaguggaugaccacggaggacaugcuggcggucuggaaccggguguggauccaagaaaacccauggauggaggacaagaccccuguggagucgugggaggagguccccuaucugggcaaacgcgaggaucaguggugcgggucccugaucggucuuacuagccgggcuacaugggccaaaaauauccaaaccgccaucaaccaaguacgcagccugaucgggaacgaggaauacacugacuacaugcccuccaugaagagauuccggcgcgaggaggaggaggccggcguccucugguaa

SEQ ID NO: 25060 - RNA, 9876 nt, Artificial Sequence
  derived and/or modified CDS sequence (opt11) from DENV-2__FJ850121__SS-prME
acggcuggcgucaucgucaugcuaaucccuaccgccauggccuuccaccucaccacccgcaacggggagccacacaugauagucggccggcaggagaaggggaagucccugcucuuuaaaaccgaggacggcgugaacaugugcacccucauggccaucgaucuuggcgagcugugcgaggacaccauuaccuauaagugcccccuccugcgccaaaacgagcccgaggacaucgacugcugguguaauagcacgucuacuugggucaccuacgguacgugcaccaccacgggcgagcaccggcgagagaaacgaucaguggcccugguuccccacgucgggaugggccuugagacccgcaccgagaccuggaugucauccgagggggccuggaagcacgugcagcgcaucgagacuuggauccugagacacccgggcuucaccaucauggccgcgauccuggccuauaccaucgggacaacccacuuccagcgggcccucaucuuuauccugcugaccgccguggcgcccagcaugaccaugagaugcaucgguaucuccaaucgggacuucgucgagggcgucagcgggggguccuggguagacaucguacucgagcacgggagcugcgugacaacgauggccaaaaacaagcccacccuagauuucgagcugaucaagaccgaggccaagcagcccgcuacccuccgcaaguauugcaucgaagccaagcugacgaauaccacgaccgagagccggugcccaacgcagggcgagcccucgcugaacgaggagcaggacaagcgauucaucuguaaacacuccauggucgaccggggcuggggcaacggaugcgggcuguucggcaaaggcgggaucgugacaugugcgauguucaccugcaagaaaaacauggaaggcaagauugugcagcccgaaaaccuggaguacacuaucguaauuacaccccacagcggggaggagcaugccguaggcaacgauaccgggaagcacggcaaggaaauuaagaucacaccgcaguccagcaucaccgaggccgagcugaccggguacggaaccguuacaauggaguguagcccucggaccgggcucgacuucaacgagaugguccuucugcagauggaagacaaggccuggcuugugcaccggcaaugguuccuggaccugccccuccccuggcugcccggggccgauacccagggcagcaauuggauccagaaggagacguuagugacauuuaagaacccccacgcuaagaagcaggacguggucguguuagggucccaggagggcgccaugcacacggccuuaacgggcgccacggagauacaaaugagcagcggcaaccuccuguucaccggacaccugaagugccgccugcggauggacaagcugcagcugaaggggauguccuacagcaugugcaccggcaaguucaagaucgucaaagagaucgccgagacccagcacgggacaaucguuauccgggugcaguacgaaggcgacggcucccccugcaagauacccuucgagaucacagaccuggagaagcggcacguacuagggagacucaucaccgugaacccgaucgugacggagaaggacagcccggucaacaucgaggcagagccgcccuucggcgacuccuacaucaucaucgggguggaaccgggccaacugaagcucaacugguucaagaaggggagcuccauuggccaaauguucgagacgacuaugcgcggcgccaaacggauggcaauccugggcgauaccgccugggauuucgggagccucgggggcguguucaccuccaucgguaaagcccuccaccaggucuucggcgcgaucuacggcgccgcuuucagcgggguaucauggacgaugaagauccugaucggugucaucauuacauggaucggcaugaacagccgauccacgagccuguccgucagccuggugcucgugggggucgugacacuguaccucggggccauggugcaagcggacuccggcugcgucgugucguggaagaacaaagaguugaagugcggcuccggaaucuucauaacggauaacguccacaccuggaccgagcaguacaaguuccaaccggagucgccaucgaagcucgcguccgccauccagaaggcccacgaggagggcaucugcgggauccgaagcgucaccagacuugagaaccucauguggaagcagaucacgcccgaauuaaaucacauccuguccgaaaacgaggugaaguugacaauaaugacuggcgacaucaaggggauaaugcaggcugggaagcgcagcuuacgcccgcagcccacugagcugaaguacucguggaaaacguggggcaaggcgaagaugcucagcaccgagucccacaaccaaaccuuucuaaucgauggacccgagaccgccgagugcccgaacacgaaccgggccuggaauagccuggagguggaggacuacggcuucgggguauucaccaccaacauuuggcucaaauugcgcgagaagcaggacguguucugcgacuccaagcugaugagcgccgccaucaaggacaaccgcgcgguucacgccgacaugggcuacuggaucgaguccgcccucaacgacacauggaaaauggaaaaggcuagcuuuaucgaggucaaguccugccacuggcccaagucccacacccuuuggucuaacggcguguuagagagcgagaugauaaucccaaagaauuucgccgggccggugagccagcacaacuaccgaccgggcuaccacacgcagaccgcggggcccuggcaccucggaaaguuagaaauggacuucgaucuaugcgaggggaccacagucguggugacggaggauugcggcaaccgggggcccucacuccgcaccaccaccgcaagcgguaaacugaucacggaguggugcugucguuccugcaccuugcccccgcucagguaucguggcgaggacgggugcugguacggaauggagauccgaccccugaaggagaaagaggagaaccuggucaacagccucgucaccgcaggucauggccagaucgacaacuucucccuuggugugcuggguauggcccuauuccuggaggaaaugcugcggaccagaaucgggacgaagcacgucacccucuuaguggcggugagcuucguuacccugaucacugggaauauguccuuccgggaucucggccggguuauggugauggucggggccacgaugacggacgacauuggaaugggugugaccuacuuagcacuguuggccgccuucaaagugcgccccaccuucgcggcaggccugcuucuccggaagcugacgucuaaggagcuuaugauggccaccauuggcaucgcccucuuaagucagagcaccauccccgagaccauucuggaguuaacugaugcgcucgcgcugggaaugaugguccucaagaucguacggaauauggagaaguaccaacuggcggugaccauaauggcgaucuccugcgucccgaacgcggugauccuucagaacgccuggaaagugaguugcacuauacucgccgcuguuuccguuuccccgcuguuacuuaccuccagccaacaaaaggccgacuggaucccccuggcucugacgauaaagggccuaaaccccaccgcgaucuuuuugaccaccuugucccggacgucaaagaagcgcuccuggccucucaacgaggccaucauggcugucgggauggugagcauacuggccagcagccugcucaagaacgacauucccaugaccgggccccugguggccggcgggcugcucaccgugugcuacguguugacaggccgguccgcggaccuagaguuagaacgggccgccgacgugaagugggaggaccaggccgagaucuccgggagcucccccauccugagcauaacgaucuccgaagaugguucaaugucuauuaagaacgaggaagaggagcaaaccuugaccauacugauucggacuggccuacugguuaucucggggguauuuccgguuaguauaccuauuacagcagcggcaugguaccucugggagguuaagaagcagcgcgccggcgugcugugggacgugcccucaccaccgccggucgagaaagccgagcuggaggauggggccuaccggaucaagcaacgcggaauucucggguacucccagauuggggcgggcguguauaaggaagggacguuccacaccauguggcacgugacccggggagcaguccugaugcaccggggcaagcggaucgagcccagcugggcugacguaaagaaggaccugauuuccuacggcgggggcuggaagcucgagggcgaguggaaggagggggaggagguucaggugcuggcccuggaacccgggaaaaacccacgcgccgugcagacuaaacccggcaucuucaagacgaauaccggcaccaucggagcggugagccuagauuucucccccggcacuucuggcuccccgaucguagaccggaaggggaaaguaguuggucuguacgggaacggagucgugacgcgcagcggcgccuacguguccgccauugcccagacagagaaguccaucgaggacaaccccgagaucgaggaugauauuuuccgaaaaaagcgccugaccauaauggaucuccaccccggcgcgggcaagaccaaacgguaccugcccgccaucguccgcgaggccaucaagcgggggcugcgcacguuaauccuugccccgacucgagugguggcugcggagauggaggaggccuugcggggccugcccauccgauaccagacccccgccaucaaaaccgaacacaccggccgggagaucguggaccucaugugucacgcgaccuucaccaugcgccugcuguccccggugcgggugccgaacuacaaucuuaucaucauggaugaggcucacuucaccgaccccgcguccaucgccgcacgcggcuacaucucuacgcgggucgagaugggcgaggccgccgggaucuucaugaccgcgacgccgccgggcucccgugacccguuuccccagagcaacgcaccuaucauggacgaggaacgggagauccccgaacgcuccuggaauagcggacacgaguggguaacagacuucaaaggaaagacggugugguucguaccgucaaucaaggccggaaaugacaucgccgcgugccugcggaagaacgggaaaaaggugauccagcugucacgcaaaaccuucgauagcgaguacgugaagacucgggccaacgacugggacuucgucgucaccacggacaucagcgagaugggugccaacuucaaggcggagcgcgucaucgacccgcggcgcugcaugaagcccgucauacucaccgauggggaggagcgggugauacuggccggcccuaugccagugacccacuccucugccgcccagagacgggggcgcaucggccgcaaccccaagaacgagaacgaucaguacaucuacaugggggagccccuggagaacgaugaggacugugcucacuggaaggaggccaagaugcuacuggacaacaucaacaccccagagggcaucaucccguccauguucgagcccgaacgggagaaggucgacgcuaucgauggcgaguaccgcuugcgcggugaggcgcgcaaaacguucguugaccucaugcggcgaggugaccuacccguguggcuggccuacaagguugccgccgaggggaucaacuaugccgaccggaagugguguuucgacgggaucaagaauaaccagauccucgaagagaacauggagguggagaucuggaccaaggagggggagcgcaagaagcugaagccgcgguggcucgacgcgcgcauuuacagcgauccccucgcccugaaagaauucaaggaguucgccgccggccggaagucccugacccuuaaucucaucacggagaugggccgccugccuacauucaugacccagaaggcgcggaacgcucucgacaaccuugccguucugcauaccgccgaggcgggggggcgcgcuuacaaccaugcccucagcgagcuacccgagacguuggagacucuccuucuucuaacccugcuggccaccgucaccgggggcaucuuucuuuuccugauguccggcaaggggaucggcaagaugacgcuagggaugugcugcauaaucacggccagcauacuccuuugguacgcccagauucagccgcacuggaucgcggccucgaucauucuggaguuuuuccucaucgugcugcuaauccccgaaccggaaaaacagcggaccccccaggacaaucaauuaaccuacgucgugaucgccauccugacuguggucgcugcaacgauggcuaacgagaugggcuuccuggagaagacuaagaaggaccucggccugggaagcaucaccacucaggagagcgaaagcaacauccuggauaucgaccuccgcccggccagcgccuggacccuguacgcugucgccaccaccuucguaaccccuaugcugcggcacucuauugagaacagcuccgugaacgugagccucacggccauugccaaccaggcuaccguucugaugggccugggcaaaggcuggccccucuccaagauggacaucggggucccccuucuggccaucggaugcuacagccaggucaacccgaucacccucaccgcggcccugcuguugcugguggcccauuacgccaucauuggcccgggccugcaggcuaaggccacacgcgaggcccagaagagggccgccgccggcauaaugaagaaccccacugucgacgggaucacggugaucgaccucgagccuaucccguacgacccaaaguucgagaaacagcugggccaggugaugcugcucauccugugcguaacccaggugcugaugaugcgcacgacaugggcgcucugcgaggcccugacccuagccacaggccccaucuccacgcucugggaggguaaucccgggcgguucuggaauaccacgaucgcugugagcauggccaacauauuccgcggcucguaccuggccggcgccggguugcuguucagcaucaugaaaaacaccacgaacacccgcagaggcaccgguaacaucggcgagacccuuggcgagaaauggaaaagucgccugaacgcccucggaaagagugaguuccagaucuacaagaaguccggaauacaagaggucgaucggacgcuggcaaaggaggguaucaagcgcggcgagaccgaccaccacgccgucucuagggggagugccaagcugcgcugguucguggagcggaacauggucacccccgagggcaaagugguggacuugggaugcgggcgcggcggguggucguacuacugcgguggguugaagaacgugcgagaggugaagggucuuacuaaaggcggaccuggccaugaggagccuaucccuaugagcacuuacggguggaacuuagugcgacuacaaagcggcgucgacguauucuuuacaccgcccgaaaagugcgauacccugcucugcgacaucggggagaguagccccaacccaaccaucgaggcuggccggaccuuacggguacuaaaccuuguagaaaacuggcucaacaacaauacgcaguucugcaucaaggugcugaacccuuacaugccuucugugaucgaaaagauggaggcacuacagaggaaauacggcggagcccugguccgcaacccccugucccggaacaguacccacgagauguacuggguguccaacgcgacgggcaacaucgugagcuccgucaacaugaucucgcgcaugcugaucaaccgguucaccaugaagcauaaaaaggccacguacgagccggacgucgacuuaggcuccggcacccgcaacauugggauagagagcgagauccccaaucuggacaucauugguaagcggaucgagaaaaucaagcaggagcacgaaacguccuggcacuacgaccaagaccaccccuacaagaccugggccuaucacggaagcuacgagacgaagcagacuggguccgccagcuccauggugaacggagucgugaggcuucuuacuaagcccugggacguggucccgauggugacccagauggccaugacggacaccacacccuucggucagcagagagucuuuaaagagaaggucgacacccggacccaggagccaaaggaggggacaaaaaagcugaugaagaucacagcggaguggcuguggaaggaguugggcaagaagaaaacgccccgcaugugcacccgugaggaguucacccgcaagguacggagcaacgcagcccugggcgcuaucuucaccgacgagaacaaguggaagagcgcgagggaggcgguggaggacggccgguucugggagcucguggaccgcgagcguaaccuccaccuggaagggaaaugcgagaccugcguguacaacaugaugggcaagcgcgagaagaaacugggagaauucggcaaggccaagggcagccgggccaucugguacauguggcugggggcccgcuuccuggaguucgaggcucuggguuucuugaacgaggaucacugguucucccgcgggaacucccuaucuggcguggagggugagggacugcaccgccucggcuacauccugcgggacguugggaagaaggagggcggggccauguacgccgaugacacggcuggcugggacaccagaauaacgcuggaggaccucaaaaacgaggagauggucacaaaccauaugaagggagagcauaagaaacuggccgaggcuaucuucaaacugacuuaucagaacaaggucguuagagugcagagaccgacgcccagaggaacugucauggacauuaucucccgcagggaccagcgcgggagcgggcaggucggcaccuacgggcucaacaccuucacgaacauggaggcccagcugauucgccagauggagggugaggguauauucaaguccauccagcacuuaaccgccaccgaggaaaucgcaguccaaaacuggcuagcccgggucggacgcgaacggcucagccgcauggcgauuucuggcgacgauugcguggugaagcccaucgacgaucguuucgcuagcgcccugacggcccucaacgacaugggaaaagugcgcaaggacauccagcagugggagcccucccgaggcuggaacgacuggacccaggugccauucugcagccaccacuuccaugaauuagugaugaaggacgggcgcguccugguggugcccugucgaaaccaggacgagcugauaggucgagcaagaaucucgcagggagcgggauggagccugaaggagaccgcuugucugggcaaguccuaugcccagauguggacccucauguacuuccacaggcgggaccuucgcuuggccgccaaugcgaucugcagcgccgugccgccccauugggugccgaccucccggacgaccuggucuauccaugccaaacacgaguggaugacaacggaagauaugcuggccguguggaaccgcguuuggauacaggaaaauccuuggauggaggacaagacgcccguagaguccugggaggagguccccuaucuggggaagcgggaggaccaguggugcggcagccuuaucgggcucaccucacgcgcgacgugggcgaagaacauccagaccgccaucaaccagguccggucguugaucggcaacgaagaguacacggacuacaugccgucuaugaagcgcuuucgccgagaggaggaggaagccggcgugcugugguga

SEQ ID NO: 25061 - RNA, 9876 nt, Artificial Sequence
  derived and/or modified CDS sequence (opt11) from DENV-2__GQ199897__SS-prME
acagcaggcgugauagucauguugauuccuaccgccauggcuuuccaccucacaacccgcaacggggaaccccacaugauagugggccggcaagagaagggaaaaucgcugcuguucaagaccgaggauggcgucaacaugugcacacucauggccauagaucugggggagcugugcgaagacaccaucaccuacaagugcccccuccugcggcagaacgagccggaggacauagauuguuggugcaacagcaccagcaccugggucacguacgggaccugcaccaccacaggcgagcaccggcgcgagaaacgguccguagcccuggugccacacgucgguaugggccuugagacccgcaccgagaccuggaugagcuccgagggggccuggaagcaugugcagagaaucgagacguggauccugcgccacccgggcuucacgaucauggcggcgauccuagccuacaccaucggcacgacgcacuuccagcgagcccuuaucuuuauucuguuaacagcaguggcgcccagcaugaccaugagaugcaucggcaucuccaaccgggacuucguugaggggguaagcgggggcuccuggguggacaucguccuagagcacgggagcugcgucaccacgauggccaagaauaaacccacgcuugauuucgagcuuauuaaaacggaggccaagcagcccgccacccuccguaaguacugcaucgaggccaagcugacuaacaccaccaccgaaucccggugcccaacccagggagagccgagcuugaacgaggagcaagauaagcgcuucauuuguaagcacuccaugguugaccgaggcugggggaacggcuguggccuguucggcaagggcgggauuguuaccugugcgauguucacuugcaagaagaauauggagggcaagguggugcagcccgagaaccucgaguacacgaucgucaucacgccgcauucuggagaggaacacgccgugggcaacgacaccgggaagcacggcaaggagauuaagauuaccccgcaguccagcaucaccgaggcugaacugaccggguacggcacggugaccauggaguguagcccucggacuggccucgacuucaacgagaugguccugcugcagauggaggacaaggcaugguuagugcaucgacagugguuccuggaucugcccuuacccuggcugcccggggccgacacccagggaagcaacuggauccaaaaggaaacguuggugaccuuuaagaacccccaugcgaagaaacaagacgucgugguucucgggagccaggagggcgccaugcacaccgcccugaccggggcgacggagauccagaugagcagcggcaaccuucuguucacgggacaccugaaauguaggcugcguauggacaagcugcagcugaaggggaugucguacagcaugugcaccggcaaguucaagaucgugaaggaaaucgccgagacccagcaugggacgaucgugauccgcgugcaguacgagggagacggaucccccuguaaaauucccuucgagaucaccgaccuggaaaagagacacgugcuugggagacugaucaccgugaauccgauugucacugagaaggacucacccgugaacaucgaggcggagccgcccuucggugacuccuacaucaucaucgggguggagcccggccaacugaagcucaauugguuuaagaaggguaguuccaucggccagauguucgagacgaccaugcgcggcgcuaagcggauggccauccugggagacaccgcuugggacuucggcagccucggcggcgucuuuaccucgaucgggaaggcucuccaccagguguucggagccaucuacggcgcagcguucagcggcguguccuggacuaugaagauccugauaggcgucaucaucaccuggaucgggaugaauagucgcuccaccagccugucaguaucacuagugcucguuggcguugugacccuguaccugggggccaugguccaggcggacuccggcugcguggugagcuggaagaacaaggagcuaaagugcggcuccggcaucuucaucacggacaacguccacacguggaccgagcaguacaaguuccagcccgagagcccgagcaagcuggcuuccgccauacagaaggcccaugaggagggcaucugcgggauccggucgguaacaaggcuugaaaaccucauguggaagcagaucacgccagagcuaaaccacaucuugucggagaaugaggugaagcucaccauaaugaccggcgacaucaaggggaucaugcaagccgggaaacggagccugcgcccgcagcccaccgagcugaaauacucguggaagacgugggguaaggcuaagaugcucagcaccgagucccauaaccaaacuuuccuaaucgacgggccagaaacagccgagugcccaaacacgaaucgggccuggaauagccuggaggucgaggauuacggcuucgggguguucaccacgaacauuuggcuaaagcugcgcgagaagcaggacgucuucugugacaguaaauuaaugagcgccgcaaucaaggacaaucgggcgguccacgccgacaugggcuacuggauagaguccgcccuaaacgauaccuggaagauggagaaggcgagcuucaucgaggugaaguccugccauuggcccaagucucacacccuguggucaaacggcgugcuggagagcgagaugaucaucccuaagaacuucgcugggcccgucucucaacacaacuaucgcccgggcuaccacacgcagacagcggggccauggcauuuagguaaacuagagauggacuucgaccugugcgaaggcaccaccgucguggucacggaggauugcggcaaccggggucccucgcuccgcacaaccaccgccagcgggaaauuaaucacggaaugguguugucggagcugcacccuccccccgcuaagguaccggggcgaggacggcugcugguacgguauggagauccguccccuaaaggagaaggaggagaaccuggugaauucacuugugacggcgggacacggccagaucgacaauuucagccugggcgugcuggggauggcccucuuccuggaagagaugcuacggacccgcaucggcacgaagcacgcgauuuuguuaguggcggucagcuucgugacccugaucaccgggaacaugucguuccgggaccuaggccgcgugauggugaugguuggcgccaccaugaccgacgacauaggcaugggcgugaccuacuuggcccugcucgccgccuucaagguacgucccaccuucgcggcugggcuccugcuaagaaagcugaccagcaaagagcuaaugauggccacgaucgggaucgcccuccugucccaguccaccauccccgagaccauccucgaguuaaccgacgcgcuggcccugggaaugaugguacucaagaucgugcgcaacauggagaaguaccagcucgccgugaccaucauggccaucuccugugucccgaacgccgugauacugcagaacgcguggaaggugagcugcaccauccucgccgccguauccgugagcccauuguuacuaaccuccagccagcagaaggccgauuggaucccccuggcgcuaaccaucaaaggccucaaccccacagcuaucuuccuaaccacccugucccggaccagcaagaagcgcuccuggccccucaacgaggccaucauggccguuggcaugguuucgauccuggccuccagccuguugaaaaacgacauccccaugacgggcccacugguagccggcggacugcucaccgucugcuacgugcugaccggccgcagcgccgaccuggagcucgagcgcgccgcggacgugaaaugggaagaucaggccgagauuuccgggagcuccccgauacuguccaucacaaucagugaggacggcagcauguccaucaagaacgaggaggaggaacagacauugacaauccucauucggacgggccuguuagucgugagcgggguguucccugucucuauccccauaaccgcggccgccugguaccucugggaggugaagaagcagcgagcgggcguccucugggacgucccaagcccaccgccgguggagaaggccgagcuggaggacggggcguaccggaucaagcaacgcggcauacucggcuacagucagaucggcgccggcguguacaaggagggaacuuuccacaccauguggcacgucacacggggcgccgugcugaugcaccgcgggaagagaaucgaacccaguugggccgaugugaagaaggaucugaucagcuacggggguggcuggaagcucgagggcgaauggaaggagggagaggagguccaagugcuggcccuggagcccggcaagaacccccgcgccguucagaccaaacccgggauauucaagaccaacacggggaccaucggggcagucagccucgacuucucccccggcaccagugggucccccaucguggaccggaaggggaagguggucgguuuguacgggaauggaguugugacucgcagcggcgccuaugucucugccaucgcgcagacggagaagucuaucgaggacaaccccgaaauugaggacgacaucuuucgcaagaagcgcuuaacgaucauggacuugcaccccggggccggcaagaccaaacgguaccugcccgcgaucgugcgugaggcuaucaagaggggucugcgcacucugauccucgccccgacccgcguggucgcggccgagauggaggaagcccugcggggccugcccauccguuaccaaaccccagccaucaagaccgagcacaccggacgggagaucguugaccucaugugccacgccacguucaccaugcgccugcugagcccaguccgggugccaaacuacaaccucauaaucauggacgaggcgcacuuuaccgacccggccuccauagccgcccgcggcuacaucucuacacggguggagaugggugaggcggcggguaucuucaugacugccacgccacccggcucuagagacccguucccccagagcaacgcaccuaucauggacgaggaacgugagauccccgagcgguccuggaacagcggccacgagugggugaccgacuucaaaggaaagaccgucugguucgugccuucuaucaaggccggaaacgacaucgcggccugucugaggaagaacgggaagaaggugauacagcuaagucgcaagacguucgacuccgaguaugucaagacccgggccaacgauugggacuucguggugaccacggacaucagcgaaaugggggcuaacuucaaggccgaacgcgucaucgacccccggcgcugcaugaagcccgugauacucacggacggggaagagcgggugaucuuagcgggucccaugccggucacccacuccagcgccgcgcagcgccggggacgcaucggccgcaacccuaagaacgagaacgaccaguauaucuacaugggggaacccuuggagaacgacgaggacugcgcccacuggaaagaggcgaagaugcuccuggacaacaucaauacacccgaaggcauaaucccguccauguucgagcccgaacgggagaagguagaugcgaucgacggcgaguaucgccugcgaggggaggccaggaagaccuucguggaccucaugagacgcggugaucugccaguuuggcuggccuacaaggucgcugccgaggggaucaacuacgcagaccggaaguggugcuucgacgguauuaaaaacaaccagauccucgaggagaacauggagguggagaucuggacgaaggagggggaacgcaagaaacuaaagccgcguuggcuggacgcccgcaucuacagcgauccccucgcuuuaaaagaguucaaagaguucgcagcgggccggaaaucccugacgcucaaucugaucaccgagaugggccgccucccaaccuucaugacgcagaaggcccggaaugcccuggacaaccuggccguccugcacaccgcugaggccgggggccgcgcuuacaaccacgccuuaucggaacuucccgagacccuggagacgcuacuucugcucacgcugcuggccaccgugacgggggguaucuuccuguuccugauguccgguaaagggauugggaagaugacucuggggaugugcugcaucaucacggccagcauccuacugugguacgcgcagauucagccccauuggaucgccgcaucgaucauucuggaguucuucuugaucguccugcugauccccgagcccgagaaacagcgcacgccccaggacaaccaacucaccuacguggugauagccauccuuacugucguggcagcgacaauggcaaacgagaugggcuuucuagagaagacuaagaaagaucucgggcugggcucgaucacuacccaggagagcgaauccaacauccuugacaucgaccuccgcccggccagcgccuggacccuguacgccguggcgacuaccuucgucaccccaaugcugcggcacuccaucgagaauucuuccgugaacgugucacucaccgccauagcuaaccaggcuacgguccugaugggccuggguaagggcuggccacucuccaagauggacauaggggugccccuccuggcaaucggguguuacagccaagugaacccgaucacgcuaaccgcugcccugcuacuccugguggcccacuacgccauuaucggacccggccugcaggcgaaggcaacgcgagaggcccagaagcgggccgccgcggggauuaugaaaaacccuacgguggacgggaucaccgugauagaccucgaaccaauaccguacgaccccaaguucgagaagcagcuggggcaggucauguuguuaauauugugcgugacgcaggugcucaugaugcgcaccacuugggcccucugcgaggcccugaccuuagccaccgggcccaucuccacccucugggaaggcaaccccgggcgguuuuggaacacgaccauugccgucagcauggccaacaucuucaggggcaguuaccuggcaggcgcggggcuacuauuuagcaucaugaagaacaccaccaacacgagacggggcaccgggaacauuggcgaaacccugggcgagaaauggaagucccgcuuaaacgcccucgggaagucugaguuccagauauacaagaaguccggcauacaggagguggaccggaccuuggcuaaggaggggaucaaacgcggggagacggaccaccacgccguaagccgcgggucagcuaaacuccgcugguucguagagcggaacauggugaccccggagggcaagguggucgaucucggaugcggacggggcggguggagcuauuacugcggcggccuaaaaaacgugagggaggugaagggccugacgaaaggagggccgggccacgaggagccgauccccauguccacuuacggguggaaccuggugcgucuacagucugggguggauguguucuucacgccgcccgagaagugcgacacccugcucugcgacaucggggaaagcucccccaaccccaccaucgaagccggccggacccugagaguccugaauuuaguugagaacugguuaaacaacaacacccaguucugcaucaagguacugaauccuuauaugcccagcgucaucgagaagauggaggcccuccagcggaaguaugguggggcgcuggugcgcaauccacugucccggaacucuacgcacgagauguacugggucucaaacgccaccggcaacaucgucucguccgugaacaugauaagcagaaugcugaucaaccgguucacgaugaagcacaagaaggcgaccuacgagccggacguggaccucggaaguggcacgcgcaacauuggaaucgaaagcgaaaucccgaacuuggacaucauuggcaagcggauagagaagaucaagcaggagcacgagaccuccuggcacuacgaccaggaccaccccuacaaaaccugggccuaccauggcucauacgagaccaagcagacgggguccgcuucauccauggucaacggcgucguccgccugcucaccaagccgugggaugucguuccgauggugacgcagauggcgaugaccgacacgaccccauucgggcagcagcgugucuucaaggagaagguggauacccggacccaggagccgaaggagggcacgaaaaaacugaugaagauuacagccgaguggcuguggaaggagcuaggcaagaaaaagacgccccgaaugugcacccgggaggaguucacgcgaaagguuaggaguaacgcagccuuaggggccaucuuuaccgacgagaacaaguggaaauccgcgcgggaggcagucgaagacggccgguucugggagcuaguggauagggagcggaaccuccaccuagaaggcaagugcgagacuugcguuuacaacaugaugggcaagcgcgagaagaaguuaggcgaauucggcaaggcuaagggcagucgggccaucugguacauguggcugggggcacgcuuccuagaguuugaggcccugggguuccucaaugaagaccauugguucucccgggguaacagccugucgggcgucgagggggagggccugcaccgccucggcuacauccugcgcgacgucgguaaaaaggagggcggggccauguacgccgacgauaccgccggcugggacacucgcaucaccuuggaggaccucaagaacgaggagauggucaccaaucacaugaagggggaacacaaaaaguuagcggaggcgaucuucaaacugaccuaccagaauaaaguggugcggguccagcgcccgacgccccgggggaccgugauggacaucaucucccgccgggaccagagagggagcgggcaggucggcaccuaugggcucaacaccuuuacgaacauggaggcccagcugauccgccaaauggagggcgaggggaucuucaaguccauccaacacuuaaccgccaccgaggagaucgccguccagaacuggcucgcccguguggggcgcgagcggcugucgcgaauggccaucuccggggaugacugcguggucaaaccgauugaugaccgguucgcguccgcccuuaccgcccucaacgacauggguaaggugcguaaggauauccagcagugggaacccagcaggggcuggaacgacuggacacaagugccguucugcagccaccacuuucacgagcuggucaugaaagacggccgcgugcuggucguuccuuguaggaaccaggacgagcucauuggccgcgcacggauaucccagggcgccgguuggagccugaaggagaccgcuugccuagggaaguccuacgcccagauguggacgcucauguacuuccacagacgggaccugcgcuuagcggcgaaugccaucugcagcgccguuccgccucacugggugccgaccucucggacgacguggaguauccacgccaagcacgaguggaugaccacugaagauaugcuugcgguauggaaucgcguguggauccaagaaaaucccuggauggaggauaagacuccuguggaguccugggaggaggugcccuaccuuggaaaacgggaggaucaguggugcggcucccugaucggucucacguccagagccaccugggccaaaaacauccagaccgcgaucaaccaggugcggucacugaucggaaacgaggaguauaccgacuacaugccaagcaugaagcgcuuucgacgggaggaggaagaggccggcguucugugguga

SEQ ID NO: 25062 - RNA, 9876 nt, Artificial Sequence
  derived and/or modified CDS sequence (opt11) from DENV-2__GQ199895__SS-prME
accgcaggcgugaucgucaugcucauuccuaccgccauggcguuccacuuaaccacccgcaacggggaaccccacaugauaguaggccggcaggagaaggggaaguccuuacuguucaagaccgaggauggcgugaacaugugcacacucauggccauagaccugggggaacugugcgaggacaccaucaccuauaagugcccccuccugaggcagaacgagcccgaggacaucgacugcuggugcaacagcacaagcacuugggucacguaugggaccugcaccaccacgggcgagcaccggagagagaagcgguccgucgcgcuggugccacacguugggaugggucucgagacccgcacggagacauggaugagcucagagggggccuggaagcacgugcagagaaucgagacguggauccugcgccacccgggcuucacaauaauggccgcaaucuuggccuauacaaucgggaccacgcauuuccagcgggcgcucauauucauccugcugacggccguggcgccuaguaugacgaugcgcugcauaggcauuuccaaucgggauuucgucgagggagugagcgggggcucauggguggacaucguguuggaacacgggagcuguguuaccaccauggccaaaaacaagcccacccuugauuucgagcuaauaaaaacugaggccaagcagcccgccaccuuacgcaaguacugcaucgaggccaagcugacuaauaccaccacagagucccgaugcccuacgcagggugaaccaagccugaacgaggagcaggacaagcgcuuuaucuguaagcacuccaugguggaccggggcugggggaacggcugcggucuguucggaaagggggggaucgugaccugcgcgauguucacgugcaagaagaacauggaaggaaaagugguacaaccagagaaccuggaguacaccaucguuaucacaccccacagcggggaggagcacgcagugggaaacgauacagggaagcacggcaaggagaucaagauaacgccgcaguccagcaucacagaggccgagcugacaggguacgggacggugaccauggagugcaguccucggaccggccucgauuucaacgagaugguccugcugcaaauggaagacaaagcguggcucgugcacagacaaugguuccuggaccugccccuccccuggcugccuggggccgacacucagggcagcaacuggauccagaaggagacacuggugaccuucaagaacccccacgcgaaaaagcaggacgucgugguccucggcucccaagagggcgccaugcacaccgcuuugaccggggcgacugagauucagaugagcagcggcaauuuacuguucaccgggcacuuaaaaugucgucugagaauggacaagcuacaguugaaggggaugaguuacaguaugugcaccggcaaguucaagaucgugaaagaaaucgcugaaacccagcacgggacgaucgugauccgcguucaguacgagggagauggcucgcccugcaagauccccuuugagaucaccgaucuggagaaacggcacguucucgggaggcugaucacagugaacccaaucguaaccgaaaaggacucgcccguuaacaucgaggcggagccccccuucggcgauucuuauaucauaauuggggucgagccgggccagcuaaaacucaacugguucaaaaagggcagcucuauugggcaaauguucgaaacgaccaugagaggcgccaagcggauggccauucugggcgacacugccugggauuuuggcagucucgggggcgucuucaccagcaucgggaaggcacuccaccagguguucggugcgaucuacggagcagccuuuagcggcguauccuggacgaugaaaauucugauuggcgucauaauaaccuggaucgggaugaacagccgcucgaccagccuguccgugucccugguacuugucgggguggugaccuuauaccuaggggccaugguccaggcagacuccggcuguguugugagcuggaaaaacaaggagcucaaguguggauccggaaucuuuaucaccgacaauguacacaccuggaccgagcaguacaaauuccagccagagagccccagcaagcuggccuccgccauacagaaggcucacgaagaggguaucugcgggauccggagcgugacccgacucgagaaccuaauguggaagcagaucacaccggaguugaaccacaucuuauccgagaacgaggucaagcuuaccaucaugaccggcgauaucaaggggaucaugcaagccggcaagcggucccugagaccgcagccgaccgaguuaaaguacuccuggaagacauggggaaaagccaagaugcucucaaccgagucccacaaucagaccuuccugaucgacgggcccgaaacagcggagugccccaacacaaaccgugcguggaacagccuugagguugaggacuaugguuucgggguguucaccaccaauaucuggcucaaauuacgggaaaagcaggacgucuucugcgacucuaagcugaugagcgccgccaucaaggacaaccgggcaguccacgccgacaugggcuacuggauugagucagcccucaacgauaccuggaagauggagaaggccagcuucaucgaggugaagucgugccacuggcccaaaagccauacgcugugguccaacggcgugcuggaaagcgagaugauuauucccaaaaauuucgccgggccugucucccaacauaauuaccgcccaggauaccauacucagaccgcggggcccuggcaccucggcaagcuggagauggacuucgaccugugcgaggggaccaccgucguggucacggaggacugcggcaauagaggccccagccucaggaccaccaccgccagcgggaaacugaucacggaguggugcugcagauccugcacccuaccuccgcuccgcuaucggggcgaggacggaugcugguacgggauggagaucagaccccugaaagaaaaggaggagaaccuggugaacagccucgugacagcgggacacggccagauagacaacuucucccuuggcguucugggcauggcccucuuccuggaggagaugcugcggacacgcauagguacaaaacacgcgauccuccugguggcugugagcuuugugacucugauaaccggcaauaugucguucagagacuuggggcgugucauggugauggucggagccacuaugacagaugacaucggcaugggcgugaccuaccuggccuugcucgccgcguucaaggugcgccccaccuucgccgccgggcugcugcuacggaagcuaacaucaaaagagcugaugauggcaacgaucggcaucgcacuccugucucagagcaccauuccagagaccauccuggagcucaccgacgcguuagcacuggggaugaugguccuaaaaaucgugcgcaauauggaaaaguaccagcuagcggugacgaucauggccauuucuugugugccgaacgcaguaauccugcaaaaugcguggaaggugagcugcaccauacucgccgccguuuccgugagcccccuacugcucaccaguagccagcagaaggcagacuggaucccccuggcgcugacaauuaagggacuaaaccccacugccaucuuccuuaccacccugucccggaccagcaagaagcgcuccuggccguuaaacgaggcaauaauggccguuggcauggugagcaucuuggcguccucacugcuuaagaacgacauccccaugacggggccccugguggcaggcggccugcucaccgucugcuacgugcuuacgggccguagcgcugaccucgagcucgagcgcgccgccgaugugaaaugggaggaucaagcagagauuucugggagcucccccauccugagcauuaccaucuccgaggacggcaguauguccaucaagaacgaggaggaagagcaaacgcuuacaauccucaucagaacuggccuucuggucaucagcgggguguucccgguuuccauccccaucacggcggccgcuugguacuugugggaggucaagaagcagagggccggcgugcugugggacgugcccagcccgccgccagucgagaaggccgagcuggaggacggggccuacagaaucaagcagcgcggcauccucgguuacucccagauuggcgccgguguguauaaggaggggacauuccauacgauguggcaugugaccagaggcgccgugcugaugcaccgcgggaagcguauugagcccagcugggccgacgugaagaaggaccugauauccuacggagggggcuggaagcucgagggcgaauggaaagaaggggaagaggugcagguccuagcgcuggagcccggcaagaacccccgcgccgugcagaccaagcccgggauauucaagaccaauacgggcaccauuggggccguuagccuagacuucucucccggcacuagcggcucccccaucgucgaucguaaagguaaggucgugggacuguacgggaacggagucgugacccgaagcggcgcauacguguccgccauagcgcaaacggagaaguccaucgaagauaaccccgagaucgaggaggacauuuucaggaaaaagcgcuugaccaucauggaccuccaucccggggccggcaagaccaaacgauaccugcccgccaucgugcgcgaggccauaaaacgggggcuaaggacacuaauuuuggccccaacgcgcgucguggccgccgaaauggaggaggcccuucguggccugcccaucagguaccagacccccgccauuaaaaccgagcauaccggucgggagaucgucgaucucaugugccacgccaccuucacaaugcgucuucugagccccgugcggguuccgaacuacaaucucaucaucauggaugaggcacacuucacagauccugcauccaucgccgcccgcggcuacaucagcacacgggucgagaugggagaagccgcugggauauuuaugacugccacgccgcccggcuccagggauccguucccacagagcaaugcccccaucauggacgaggagcgggagauacccgagcgcucguggaauucagggcacgagugggugaccgacuucaagggaaaaaccgugugguucgugccguccauaaaggcuggcaacgacaucgccgccugccugcgcaagaacgggaagaagguuauccagcuaagccgcaagacuuuugacuccgaguacgugaagacccgggccaacgauugggacuucgucguuaccaccgauaucucugagaugggcgcgaacuucaaggccgaacgagugauagacccacgacgcuguaugaaaccugucaucuugaccgacggggaggagagggugauccuggcgggcccuaugccaguaacacacuccucugccgcgcagcgucgggggcgaaucggccgcaacccaaagaacgagaacgaccaguacaucuacaugggggaaccccuugagaacgacgaggacugcgcccacuggaaggaggccaagaugcuccuggauaauaucaacacccccgagggcauuaucccguccauguucgagccggagcgcgagaaaguagacgcgauugacggcgaguaccgucugcgcggggaagcgcgcaagaccuucguggacuuaaugcgccgcggagaccugcccguguggcuggcuuacaagguagccgccgagggcauaaacuacgcugacaggaaauggugcuucgacggcaucaaaaacaaccagauccucgaggagaacauggagguggagaucuggacgaaggagggggaacgcaaaaagcugaagccgcgguggcuugaugcacgcaucuacucugaucccuuggcccugaaggaguuuaaggaguucgccgcgggccgcaagucccuaacccucaaccugaucaccgagaugggccgccugccgacguucaugacgcagaaggccagaaacgcccuagacaaucuggccguguugcacacugcugaagcugggggacgcgcuuacaaccacgcucucagcgagcugccagagacacuggagacccuacuucuucucacgcugcucgcaaccgucaccggaggcaucuuccucuuccugaugaguggcaaagggaucggcaagaugacccuggggaugugcugcaucauaacugcgucaauccuccugugguacgcgcagauccagccgcacuggauagccgcuuccaucauccuggaguucuuucucaucguacugcugaucccugaacccgagaagcagcggacaccccaggacaaccagcuaacguacguaguuaucgccauccugaccgugguagccgcgaccauggccaacgaaaugggcuuccuggagaagacgaagaaggaccucgggcugggcagcauuacuacacaggagagcgagucaaacauucuggacauagaccuccgaccggccagcgcauggacccuguacgccguggcgacgaccuuugugacccccaugcuccggcauuccaucgaaaacagcuccguuaacgugagucucaccgcaaucgccaaccaggccacaguguuaaugggccuggggaaaggcuggccccuguccaagauggacaucgggguuccccugcuugcgaucggauguuauagccaagugaacccgaucacccugacugcugcccugcugcuccuggucgcucacuacgccaucaucgggccgggucugcaggcaaaagccacccgcgaggcccagaagcgcgcagcagcgggcauaaugaagaaccccaccgucgaugggauaaccgugaucgaucucgagcccauaccguacgaccccaaguucgagaagcaguuaggccaagugaugcuuuugauacuaugugugacccaaguccugaugaugcgcaccacgugggcccucugugaggcccugacccuggcuacggggccaaucuccaccuugugggagggcaacccugggcgguucuggaacacgaccaucgccgugucgauggcgaacauauuccguggcuccuaucucgcgggcgccgggcuccuguucucgaucaugaagaauaccaccaacacgcgccggggcaccgggaacaucggcgagacccugggcgagaaguggaagucccgcuuaaaugcgcucggcaagagcgaguuccagaucuacaagaagagcgggauucaggaggucgaccggaccuuagcuaaggaggggaucaagagaggcgagacggaccaucacgccgugagccggggcuccgccaagcugcgcugguucguggagcggaacaugguuaccccagagggcaaggucguggaccucggcugcggaagaggcggguggagcuauuacugcggugggcugaaaaacguccgggaggugaagggccuaaccaaagggggacccggccacgaggaaccgauccccauguccaccuacgguuggaaccuugugagacuccaguccggagucgacguguuuuucacgccgccagagaagugcgacacacugcucugcgacaucggggaaagcucucccaaccccaccaucgaggcugggcggacccugagaguuuuaaaccucguggaaaacuggcucaacaacaacacgcaguucugcaucaaggugcugaacccguacaugcccucagugaucgaaaaaauggaagcucuccagcggaaauauggcggggcgcuaguccgcaacccccugucgcggaacagcacacacgagauguacuggguguccaacgccaccggcaacaucgugucuuccgucaacaugaucagccgaaugcuuaucaaccgguuuaccaugaagcacaaaaaagccaccuacgagccagacguggaccuuggguccggcacgcgcaacaucgggauugagucagagauccccaaccuagacaucaucgggaagcguaucgagaaaauuaagcaggagcaugagaccuccuggcacuacgaccaggaccaucccuacaagacgugggcuuaucacggcagcuacgagaccaagcagaccgggucugcaagcuccauggugaacggcguuguucgacugcucacuaagccaugggacgucgucccgauggugacccaaauggcaaugacugacacgaccccuuuugggcagcagcgcguauucaaggagaagguagacacccggacccaggaacccaaggaagggacgaagaagcugaugaagaucaccgccgaaugguuguggaaggagcucggaaagaagaagacgccccgcauguguacccgcgaagaguuuacccgcaagguacggucuaacgcagccuugggggccaucuucaccgacgagaauaaguggaaguccgcccgcgaggcuguagaggacggccgguucugggagcugguggaccgcgagcgcaaccuccaucuggaggguaaaugugagaccugcguguacaauaugaugggcaaacgcgagaagaagcuaggggaguucggaaaggccaagggcagcagggccaucugguacaugugguugggggcgagauuccuggaguucgaggcgcugggcuuccucaacgaggaccacugguuuucacggggcaacucucugucgggcguggagggcgagggccuacaccgccuuggcuauauccugcgggacgucgggaagaaggagggcggcgccauguacgccgacgacaccgccggcugggacacgcgcauaacgcuggaggaccucaagaacgaggagauggugacaaaccacaugaagggggagcauaaaaagcucgcggaagccaucuucaagcugacuuaucagaacaaggucguacggguacagcguccuacgccacggggcaccgucauggacaucaucucccgucgggaccagcgcggcagcgggcagguuggcaccuacggacucaacacguuuacgaacauggaagcacaacuuauccgucagauggagggcgagggcaucuucaaguccauacaacaccugacagccaccgaggagauugccgugcagaacuggcuggcgagagucgggcgcgagcggcugucaaggauggcgaucuccggagaugauugcguggugaaacccaucgacgaucgguucgccagcgcccuaaccgcacucaacgacauggggaagguccgcaaggacauccagcagugggagcccucccggggcuggaaugacuggacccaggucccguucuguagccaccacuuccacgagcuggucaugaaggacgggcgcguccugguggugcccugccggaaccaggaugagcucaucggacgggcucggauuucucagggcgcgggguggagccuaaaggagacagccugcuugggcaagucauaugcacagauguggacccucauguacuuccaccgccgggacuugagacuggccgcgaaugccauuugcagcgccguaccgccucacugggugccgacauccaggacaacgugguccauccacgcuaagcacgaguggaugacuacggaggacaugcucgcgguguggaaccgcguauggauccaagagaauccauggauggaagauaagacuccaguggaauccugggaggaggugcccuaucuggggaagcgggaggaccaauggugcggcagccugaucgggcucacgucgcgggccaccugggccaagaacauccagacggcgaucaaucagguccggagccugaucggaaacgaggaauauaccgacuacaugccgucgaugaagcguuuccgcagggaggaggaggaagccggcgugcugugguga

SEQ ID NO: 25063 - RNA, 9876 nt, Artificial Sequence
  derived and/or modified CDS sequence (opt11) from DENV-2__FJ898478__SS-prME
accgcuggcgugaucguuaugcugauccccaccgccauggcguuccauuugaccacccgcaacggggagccccacaugaucgugggcaggcaggagaagggcaaguccuuacuguucaaaaccgaggacggcgugaacaugugcacccucauggccaucgaccugggggagcugugcgaggauaccaucaccuacaagugcccccuccugcgccagaacgaaccugaggacaucgacugcuggugcaacagcaccagcaccugggucacguacggcaccugcacuaccacgggcgagcaccggcgcgagaaacgguccguggccuuggugccccacgucgggaugggccucgagacccgcaccgagaccuggaugagcucugagggggccuggaagcacgugcagcggaucgagacguggauccugcgccacccgggauucaccaucauggcagcgauccuggccuacaccaucgggaccacgcacuuccagcgggcacucaucuucaucuugcuuaccgccguggcgcccagcaugaccaugcgcuguauuggcaucagcaaccgggacuuugucgagggcgugagugguggcucuugggucgacaucguccucgagcacgggagcugcgugaccaccauggccaaaaacaagcccacccuggacuucgagcugaucaagaccgaggccaagcagcccgccacccuccggaaguauuguaucgaggccaagcugacgaauaccaccaccgagagucggugcccgacgcaaggcgagccaagccugaacgaggaacaggacaagcgcuucaucuguaagcacuccaugguggaccggggcugggggaauggcugcggguuauuugguaagggcgggaucgugaccugcgcuauguuuacgugcaagaagaacauggagggcaagguaguucagcccgagaacuuagaauacacuauugucaucacgccccauuccggggaggagcacgccgugggcaacgacaccgggaagcacggcaaggagaucaagaucaccccgcaguccucaaucaccgaggccgaauugacgggguacggcacggugaccauggagugcagcccccggacuggccucgacuucaacgaaaugguccugcugcagauggaggauaaggccugguuagugcaccgccagugguuccuggaucugccgcuccccuggcugcccggggccgacacccagggcagcaacuggauccagaaggagacgcuggugacauucaagaacccccacgcgaagaagcaggacgucgugguccucgggucccaggagggcgccaugcacaccgcccuuaccggggcgaccgagauccaaaugagcucgggcaaccuucuguucaccggccaccugaagugucgccugcggauggacaagcuccagcugaaggggauguccuacaguaugugcaccggcaaguucaagaucgugaaggagaucgccgagacccagcaugggacuaucgugauccgcguccaguacgagggcgacgggucccccugcaagauccccuucgaaaucaccgaccuggagaagcggcacgugcucgguaggcugauaacugucaacccgaucgucaccgagaaggacagccccgugaacaucgaggcugagccgcccuucggcgauuccuacaucaucaucggcguggagccgggccagcugaagcucaacugguucaagaaggggucguccaucggccagauguucgaaacuaccaugcgcggugcgaagcggauggccauccugggggacaccgccugggacuuuggcagccucgggggcgucuucaccucaaucggaaaggcucuccaccagguguucggcgcgaucuacggcgcagccuucagcgggguguccuggacaaugaagauccugauaggcgucaucauuaccuggaucgggaugaauagccgcuccaccagccuguccguaagccugguacucgucggaguggugacucucuaccugggggccaugguccaggcggacuccggcugcguggugagcuggaaaaacaaggagcucaagugcggcucagggaucuucaucacggacaacguccacaccuggaccgagcaguacaaauuccagccagagagccccagcaagcuggccuccgccauccagaaggcccacgaagagggaaucugcggcauucggagcgugacucggcuggaaaaccucauguggaagcagaucacgcccgaguuaaaucauauccuguccgaaaacgaggugaagcucaccaucaugaccggugacaucaaggggaucaugcaggccggaaagcggagccugcgcccacagcccaccgagcugaaguacuccuggaagacauggggcaaagcuaagaugcucagcaccgagagccacaaccagacuuucuugaucgacggccccgagacggccgagugcccgaauacgaaccgggccuggaacucccuggaggucgaggacuacggcuucgggguguuuaccaccaacaucuggcucaagcugcgcgagaagcaggacguguucugcgacuccaagcugaugagcgcggccaucaaggacaaccgggcaguccacgccgacaugggguacuggaucgagucggcccugaacgacacauggaagauggagaaggccagcuucaucgaggugaaguccugucacuggcccaagagccacacccugugguccaacggcgugcuagagucagagaugaucauccccaagaacuucgcgggccccguuucccagcacaacuacaggccgggcuaccacacgcagaccgcggggcccuggcaccucggcaagcuggagauggacuucgaccugugcgaggggaccaccgugguugucacggaggacugcgggaaccggggccccucacuccgcaccaccaccgccucgggcaagcugaucacagaguggugcugccgguccugcaccuuacccccacuccgcuaucggggugaggacgguugcugguacggcauggagauccgccccuuaaaggagaaggaagaaaaccuggugaacucucucgucacugccgggcacggccagauagacaacuucucccugggcguccugggaauggcccucuuccuggaggagaugcugcggacccgcauaggcacgaagcaugcgauccuccugguggccgugagcuucgucaccuugaucaccgggaacauguccuuccgggaccucggccgcgugauggugauggucggagccacuaugacggacgacaucggcaugggcgugaccuaccuggcccugcucgccgcguucaagguucgccccaccuucgccgccggacuacuucuccggaagcugaccagcaaggagcugaugauggcaacaaucggcaucgcccuccugucccagagcaccauacccgaaaccaucuuggagcucacugaugcgcuggcccuggggaugauggucuuaaaaaucgugcgcaacauggagaaguaccagcuggccguaacuaucauggccaucucuugcgucccgaacgccgugauccugcaaaacgcauggaagguaagcugcaccauccucgccgccgucuccguuagcccucugcugcucaccuccagccagcagaaggccgacuggaucccccuggcucugaccauuaagggucucaaccccacagccaucuuccucaccacccugagccggaccucgaagaagcgcuccuggccgcugaacgaggcgaucauggccgucggcauggugagcauccuggccuccagccugcucaagaaugacauccccaugacggggccccugguggcgggcgggcugcucacagucugcuacgugcuaaccggccggagcgccgaccuggagcucgagcgcgccgccgacgugaagugggaggaccaggccgaaaucuccgggagcucccccauccugucgauaacaaucuccgaggacggcagcauguccaucaagaacgaggaggaggagcagacgcugaccauccucauacggaccggccugcuggucaucagcgggguguuccccgugaguauccccaucaccgcggccgccugguaccucugggaggucaagaagcagcgcgccggcgugcugugggacgugcccagcccgccgccaguggagaaagccgaacuggaagacggcgcguaucggauuaagcagcguggcauccucggguacucccagaucggcgccggcguguacaaggaggggacauuccacacgauguggcacgugaccagaggcgccguccuuaugcaucgcggcaagcggauugagccgagcugggccgaugugaagaaggaucugaucuccuauggcgguggcuggaagcucgagggcgaguggaaggagggggaggaggugcagguccuggccuuggagcccggcaagaacccccgcgcggugcagaccaagcccgggaucuucaagacaaacacgggcaccauuggggccgugagccuggauuuuucccccggcacgagcggcucccccaucgucgaccguaaggggaagguggugggcuuauacgggaauggagucgugacccgcagcggcgccuacgugucugccaucgcgcagacggagaaguccauagaggacaaccccgagaucgaggacgacauuuuccggaagaagcgcuuaaccaucauggaucuccaccccggggccgguaagaccaagcgguaccugcccgcuaucguccgcgaggccaucaagcgaggucugcgcacccuaauccucgccccgacgcgcgugguggcggcagagauggaggaggcccugcggggccugcccauucgcuaccagacucccgcuaucaagaccgagcauaccggucgggagaucguggaccucaugugccacgccacguucaccaugcgccugcugagcccugugcggguuccaaauuacaaccuuaucaucauggacgaggcgcauuucaccgaccccgccuccaucgccgcgcgcggcuacaucagcacccgggucgagaugggcgaagccgccgggaucuucaugacggccacaccacccgguucccgagauccguucccccagagcaacgcccccaucauggacgaggagcgggagauccccgagcgcuccuggaacagcgggcaugagugggugaccgacuuuaagggaaagaccguaugguucgucccgucuaucaaggccgggaacgacauagcggcuugccugcguaagaacggcaagaaggugauccagcuaagccgcaaaacguucgacuccgaguacgugaagacccgggccaacgacugggauuucgucgucacaacggacaucagcgagaugggcgccaacuucaaggcggaacgcgugaucgacccccggcgcugcaugaagcccgucauccucacugacggggaagagcgggugauccuggccggacccaugccggugacccacuccagcgccgcccagcgccgggggcgcaucggccgcaaccccaaaaacgagaacgaccaguacaucuacaugggggaaccccuggagaacgacgaggacugcgcccauuggaaggaggcuaaaaugcuccuggacaauaucaacacccccgagggcaucaucccgucaauguucgagccugagcgggagaagguagacgcgaucgacggcgaguaucggcugcgcggggaggcccgcaagaccuucguggaccucaugcggcgcggagaccugccaguguggcuggcauacaaggucgccgcagaagggauaaacuacgcggaccggaagugguguuucgacggcaucaagaacaaccagauccucgaggagaacauggagguggagaucuggacgaaggagggggagcgcaagaagcugaagccacgguggcuggacgcccgcaucuacagcgacccccucgcccuaaaggaguucaaagaguucgccgcgggccggaagucccugacucucaaccugaucaccgagaugggccgccuccccacauuuaugacgcagaaggcccggaacgcccucgacaaccuggcugugcuacacacagccgaggccgggggcagagccuacaaccacgcccucuccgaacugcccgagacccuggagacacuauugcugcucacgcugcuggccacagucaccggcggcaucuuccucuuccugauguccggcaaagggaucggcaagaugacccuggggaugugcugcaucaucacugccagcauccuccuuugguacgcgcagauccagccgcacuggaucgcugcuuccauuauacuggaguucuuucucauagugcugcuaauccccgagccugagaagcagcggacuccacaggacaaccaguuaaccuacguagugaucgcgauccugacuguggucgccgcgaccauggccaacgaaaugggcuuccuggagaagacuaagaaagaccucggccugggcaguauaaccacccaggagagcgaguccaacauccuggacaucgaccuccgcccggcgagcgccuggacccuguacgcuguggcgacgaccuuugucacacccauguuacggcacuccaucgagaacucgucugucaacguaagccucaccgcaaucgcgaaccaggccacggugcugaugggccuggggaagggcuggccccucuccaagauggacaucgggguaccacugcuggcaaucggcugcuacucacaggugaacccgaucacccucacagccgcccugcugcuccugguggcccacuacgccaucaucgggcccggccugcaggcgaaggccacccgcgaggcgcagaagcgggccgccgcugggaucaugaagaaccccacggucgacgggaucaccguuaucgaccucgagcccaucccguacgaccccaaguuugaaaagcagcugggccaggugaugcugcucauccugugcgucacccaggugcugaugaugcgcaccaccugggcccucugcgaggcccugacccuggccaccggacccaucuccacccucugggaggguaaccccggacgguucuggaacaccaccaucgcugugagcauggcgaacauauuccgcggcuccuaccuggcgggcgcagggcuccuguuuagcaucaugaagaacaccaccuccacgcgccggggcacggggaacaucggcgagacccugggcgaaaaguggaagucccgcuuaaacgccuuagggaagagcgaguuccagaucuacaagaaauccggcauccaggaggucgaccguacucuggcgaaggaggggauaaagcgcggcgagacggaucaccacgccguuucccgagggagcgccaagcugcgcugguuuguggagcggaacauggucaccccggagggcaagguuguggaccuaggcugcgggcgcggcgguuggucauacuacugcggugggcucaagaacguucgggaagugaagggccugaccaagggcgggcccggccacgaagagcccauuccuaugagcaccuacggguggaaccucgugagacuacagagcggcgucgacguguucuucacgccgcccgagaagugcgauacucugcucugcgacaucggugagucaagcccuaaccccaccaucgaggccggccggacccugcgcgugcuaaaccucgucgagaacuggcugaacaacaacacucaguucugcaucaaggugcugaacccguacaugcccuccguaaucgagaagauggaggcccuccagcggaaguacggcggggcgcugguccgcaacccccugucgcggaacuccacgcacgagauguauugggugagcaacgccacgggcaacaucguguccagcgucaauaugaucucccgcaugcugaucaaccgauucaccaugaagcacaagaaggcuaccuacgagccggacguggaccuugggagcggcacgcgcaacaucgggaucgaguccgagauccccaaccuggauauaauuggcaaaagaauagagaagaucaaacaggagcacgaaacaagcuggcacuaugaccaggaccaccccuacaaaaccugggccuaccacggcuccuacgagacgaagcagacggggagcgccaguucaauggugaacggcgucguccgccugcucaccaagcccugggacguggucccgauggugacccagauggcgaugaccgacacgacccccuucgggcagcagcgcguguucaaggagaaggucgacacccggacccaggagcccaaagaaggcacgaagaagcucaugaagaucaccgcugaguggcuguggaaggagcucggcaagaagaagacacccagaaugugcacccgggaagaguucacgcgcaagguccgguccaacgcugcccugggggccaucuucacugacgagaacaaguggaaguccgcgcgggaggccguggaggacggccgguucugggagcuggucgaucgcgagcggaaccuccaccuggagggaaagugcgagaccugcguguauaacaugaugggcaagcgcgagaagaagcugggugaguucgggaaggccaagggcucccgugcaaucugguacauguggcugggggcgcgcuuccuggaguucgaggcucugggcuucuugaaugaggaccacugguucagccgggggaacucacuguccggcguggaaggggagggucugcacaggcucggcuacauccugcgagacgucgggaagaaggaggguggggccauguacgccgacgacaccgcggggugggacacgcgcaucaccuuggaggaccuaaagaacgaggagaugguaaccaaccacaugaagggggagcacaagaagcuggcggaggccaucuucaagcucaccuaccagaacaaggucgugcguguccagcgcccgacgccccgcggcaccgucauggacaucaucagccgccgggaccagcgcggcuccgggcaggucggcacauacgggcucaacaccuucacgaacauggaggcccaguuaauccgccagauggaaggcgagggcaucuucaaguccauccaacaccuuaccgccaccgaggagaucgccgugcagaauuggcucgcgcggguugggcgggagcggcugucccgcauggccaucagcggcgacgacugcguggugaagcccaucgaugaucgguucgcauccgcacugaccgcucuuaacgacauggggaagguccgcaaagacauacagcagugggagcccagccggggcuggaacgacuggacccaggugcccuucugcucccaccacuuccacgagcuggugaugaaggacgggcgcguccuggucgugccuugccggaaccaggacgagcucauaggccgcgcgcgaaucagccagggcgcaggauggucccugaaggaaaccgcuugccugggcaagucuuacgcacagauguggacccucauguacuuccaccgccgcgaccuacgccuggccgcgaaugcuaucugcuccgccguccccagccacugggugcccaccagucgaaccacgugguccauccacgccaagcacgaguggaugaccaccgaggacaugcucgcgguguggaaccgugucuggauucaggagaacccguggauggaggacaagaccccaguggagucaugggaggaggugcccuaccuggggaagcgggaggaccaguggugcggaagccugaucgggcucacgagccgcgccacgugggccaagaacauccagaccgcaaucaaucaaguccgcagucugaucggcaacgaggaauacaccgacuacaugcccucuaugaaacgcuuccgccgggaagaggaagaggcuggcguucugugguga

SEQ ID NO: 25064 - RNA, 9876 nt, Artificial Sequence
  derived and/or modified CDS sequence (opt11) from DENV-2__GQ199869__SS-prME
accgcgggaguuauugugaugcugauccccaccgcaauggcguuccaccucaccacccgcaauggugaaccgcacaugaucgugggucggcaggaaaaggggaagaguuugcuguucaagacggaagauggaguuaacaugugcacucucauggcuaucgacuugggggaacugugcgaagauaccaucaccuacaaguguccccuacuccgccagaaugaaccagaggacauagacugcuggugcaacagcacgagcaccugggucaccuacgguaccugcaccaccacgggcgagcaccggcgcgaaaagcgguccguggcccugguuccgcacgucgggaugggacucgagacgcgaaccgagaccuggaugagcagugagggcgccuggaagcacgugcagcguaucgagacguggaucuugcgccacccaggcuucaccauuauggccgcgauccuggcuuacaccaucgggaccacgcacuuucagcgugcccucaucuucauucuacugaccgccgucgcacccaguaugaccaugagaugcaucgguauaagcaaccgggacuuugucgaggggguguccgggggcucguggguagacauaguccucgaacacggguccugcguuaccacgauggccaagaacaagccaacccuggauuucgaauuaaucaagacggaagccaagcagccagccaccuuaaggaaguacugcaucgaggcgaagcugacgaacacgaccaccgaaucacggugcccaacucagggcgaacccagccugaacgaggaacaggacaagcgcuucauaugcaagcacuccaugguagacaggggcugggggaacggaugcgggcuguucggcaagggcggcaucgugacgugcgcgauguuuaccugcaaaaagaacauggagggcaaggugguucaaccggagaaccucgaguauaccauagucauaacgccccacagcggggaggagcacgcgguggguaacgauaccgggaaacacggcaaggagaucaagaucacgccgcagucaagcaucaccgaggcggagcuaaccgguuacggaacggugacaauggaguguucuccgcgaaccggacucgacuucaacgagaugguccuacugcagauggaggacaaggccuggcucgugcaccggcaaugguuucuggaccugcccuuacccuggcuuccgggggccgacauacagggcucuaacuggauccagaaggagacccuggugacauucaagaauccccaugccaagaagcaggacguaguggucuuagguagucaagagggugcaaugcacaccgcccuaaccggggccaccgaaauccagaugaguaguggcaaucuccuguucacgggccaucugaagugucggcugcggauggacaaacuucaguuaaaggggauguccuacagcaugugcaccgguaaauucaagaucgugaaggagauagcggagacucagcaugggaccaucgugauccguguacaguacgagggcgacggaucccccugcaagauccccuucgagaucacggaccuggagaagcggcacguauuagggcggcugauaaccgugaaccccaucgucaccgaaaaggacucucccguuaacauagaggccgaaccgcccuucggcgacuccuacaucaucaucggaguggagccaggccagcugaagcucaacugguucaagaaggggucguccaucggccagauguucgagaccacuaugcgcggggcaaaacggauggccauccugggcgauaccgcgugggacuucggcucucucgggggcguguucaccuccauaggaaaggcacuccaccagguauucggcgcgaucuacggcgccgccuuuagcggcguguccuggaccaugaagauccugauuggugucaucaucacauggaucggaaugaacagucgcucaaccagccuguccgucucacugguucucgucgggguggugacguuauaccugggggcaguagugcaggcggacuccggaugcguagucaguuggaagaacaaagagcucaagugcggcuccgggaucuuuaucaccgacaacgugcacacguggacugaacaguauaaguuccaacccgagagccccagcaaauuggcgagcgcaauccagaaagcccaugaggagggcaucugcggaauccgguccgugacccgccuagagaaccucauguggaagcaaaucacccccgaacugaaccacauccugucggaaaacgaggucaaacucacuaucaugaccggggacauaaaggguauuaugcaggccgggaagcggucuuugcguccgcagccaaccgagcugaaauacaguuggaagacuuggggcaaggcuaagaugcucucgacggagucccauaaccagaccuuccuaaucgacgggccggagaccgccgagugcccuaacaccaaccgggccuggaacucucuugagguagaggauuauggcuuuggaguuuucaccaccaacaucuggcucaagcugagggagaagcaggaugucuucugcgacuccaagcugaugagcgccgccaucaaagacaaccgggccgugcacgcggacaugggcuauuggauagaguccgcccuuaacgacacauggaaaauggagaaggccagcuucauagaaguaaaauccugccacuggcccaaaagccacacucucugguccaacggcguccuugagagcgagaugaucauccccaagaacuuugccggucccgugucccagcacaacuaccgcccagguuaccacacacagacggcggggccauggcaucucggcaaacuugagauggacuucgacuucugcgagggaaccaccgugguagugaccgaggauugcggcaaccgcggacccucccugcgcacuacuaccgccagcgguaaacugauuaccgaguggugcugccggaguugcacguugcccccguuacgcuaccggggcgaggacgggugcugguacggcauggaaauccgaccccucaaggaaaaggaagagaacuuggugaacagccuagucaccgccgggcacggccagaucgacaacuuuucgcugggcgucuuggggauggcccuguuucucgaggagaugcugcggacuaggaucggaaccaagcaugcgauucugcucguggccgucagcuuugugacguugaucaccgguaacaugucguuccgggacuuaggccgcgugauggugauggugggggcuaccaugacggacgacaucggcaugggcgugacguacuuagcucugcuggccgcguucaaaguccguccgacguucgccgcggggcugcuccugcggaagcucacaucaaaggaguuaaugauggccaccaucgguaucgcauuacucucccagucgacgauacccgaaacgauccuggagcucaccgacgcgcucgcucuggggaugauggugcugaagauuguucgcaacauggagaaauaccagcucgccgucacuaucauggccauauccugcguuccgaacgccgucaucuuacagaacgccuggaaaguuuccugcacaauccuggccgccguuuccgucucuccgcuccugcuuaccucgucgcagcagaaggccgacuggauaccccucgcucuaacgaucaagggucugaaccccaccgccaucuuccuuacuaccuugucacggaccagcaagaagcgcucuuggccucugaacgaagccaucauggccgugggaaugguguccauccucgcuucuagccugcuaaagaacgacauccccaugaccggaccucucgucgcgggcgggcugcuuacggucugcuacguguugacgggcaggagcgcugacuuggagcuggagagagcugccgacgugaagugggaagaucaagccgagaucuccgggagcagcccaauacuaucgaucaccaucuccgaggacggcagcaugucuauaaagaacgaggaggaggagcagacuuuaaccauccucauccggacggggcuccucgugauaagcggaguguucccgguauccauccccaucacugcggcggccugguaucugugggaggugaagaagcagcgcgccggcguacucugggacguccccagcccgccgcccguagaaaaggccgaguuggaggacggggcguaccggaucaaacagagaggcauccugggguacucccagaucggugccggcguguacaaggagggaacguuccacaccauguggcaugugacgcgaggugccguacucaugcaccgcgggaagcggaucgagccaucuugggccgacgugaagaaggaucugauauccuacggcgggggauggaaacuugagggugaguggaaagaaggagaggagguucagguucucgcucucgaacccggcaagaauccccgcgccgugcagaccaagccgggcaucuucaagaccaacaccggaacgauaggagccgucagccuggacuuuucucccggcacaagcggguccccuauaguggaucggaaggggaaaguggugggucucuacggaaauggcguggugacacgcagcggcgccuacguuagcgcaaucgcgcagaccgaaaaguccauugaagacaacccggagaucgaggacgacaucuuccggaagaaacgccucacgaucauggaccugcaccccggugcgggcaagaccaagcgguaucucccggccauaguacgagaggcuaucaagcggggguuacgcacccugauucuggccccuacgagggugguugcggccgaaauggaggaggcgcucagagguuuaccaauccgcuaccagaccccggccaucaagacggagcacaccgggagggagaucgucgaucugaugugccacgcuacauuuacgaugcggcuccugucgcccgugagagucccgaauuacaaccugaucaucauggacgaggcccacuucacugaucccgccucuauugccgcccgcgguuacaucagcacccguguagagaugggcgaggcagcagggauauucaugaccgccacgccgcccggaucccgggaccccuucccccaaagcaacgcccccaucauggacgaggagcgggaaauccccgagcggucuuggaacucugggcacgagugggugacugacuucaagggaaagaccgugugguuugucccguccaucaaggcggggaacgauaucgcggccugccucaggaaaaacggcaaaaaggugauacaauugagccgcaagaccuucgacuccgaguacguuaagacgcgggcaaacgacugggacuuuguggugaccaccgacauuucagagaugggcgcgaacuucaaggccgagcgcguuaucgacccgcggcgauguaugaagccggugauccugaccgacggggaggagcguguuauucucgcgggccccaugccggucacgcacuccagugccgcucagcgcagaggccgcauugggcgcaaccccaagaacgagaacgaccaguauaucuacaugggcgaaccccuggaaaacgaugaggauugugcccacuggaaagaggccaagauguuguuagacaauaucaauaccccggagggcaucauccccagcauguucgagccggagcgugagaagguggacgccaucgacggcgaauaccgccuucgaggcgaggcucgcaagaccuuugucgaccuaaugcggcgcggggacuuacccgucuggcuggccuacaagguagccgccgaggggaucaacuacgcggaccgcaaauggugcuucgacggcauaaagaauaaccaaauccuagaggaaaacauggaaguggagauauggaccaaggagggggagcgcaagaagcucaagccgcguuggcuggacgccaggauuuauagcgacccacuggccuugaaggaguucaaggaauuugccgcagguaggaagucccugacccugaaccucauuaccgagaugggccgccugcccacauucaugacucagaaggcgcggaacgcguuggacaaccucgccguacugcacacagcagaggcaggcggccgcgccuacaaccacgcccugagcgagcuccccgagacacuugaaacacuguuacugcugacacugcuggcaacggugaccgggggcaucuuccuguuccucauguccgguaaggguauuggcaagaugacacuggggaugugcugcaucaucaccgccagcauccugcucugguacgcgcagauccagccgcauuggaucgccgccuccauaaucuuagaguucuuccugaucguccuccugauucccgagcccgagaagcagcggacgccccaggacaaccagcugacguauguagucauagccauuuuaacagucguggcugccaccauggcuaaugagaugggcuuucuggagaagacaaagaaggaccucgggcucggcucuaucacuacacaggagagcgagucuaacauacuggacaucgacuugagaccggccagcgccuggacccucuacgcgguggcaaccacuuucgucacccccaugcuucggcacuccaucgagaauagcuccgugaacgugagccugaccgcuaucgcaaaccaggcaaccguccuaaugggucuugggaaaggcuggccccuguccaaaauggacaucggggugccucuccuggcuaucgguuguuacagccaggugaacccaaucaccuuaaccgcugcccuccugcugcucgucgcccacuacgccaucaucgggcccggccugcaggcgaaggcaacccgcgaggcgcagaagcgggcggcggcgggaauuaugaagaaccccaccguggauggaauaacggugaucgaucuggagcccauaccguaugaccccaaguuugagaaacaguugggucaagucauguugcugauccucugcgugacacagguguuaaugaugaggaccacaugggcucuaugcgaggcgcucacgcuggccacugguccuauuuccacucugugggagggaaaccccgggcgguucuggaauacuacgauagcggucucuauggcuaauaucuuccgcggcucuuaccuugccggcgccgggcuccuguuuucuaucaugaagaauaccaccuccacucgccggggcacggggaacauaggggagacccucggcgagaaauggaagucccgucugaacgcccucggcaagagugaguuccaaaucuauaagaaguccggcauccaggagguggacaggaccuuggcaaaagaagggaucaagcggggugagaccgaccaccacgccgugucucgaggaucagcgaaacugcgcugguucgucgagcggaacauggugacaccggagggcaaggucgucgaucuggguugcggucgcggcgggugguccuauuacugcggcggguugaaaaacgugcgggaagugaagggccugaccaaaggcggccccggccacgaggagcccauccccaugagcaccuacggguggaaccugguccgccuccagagcggcguggauguguucuucaccccgcccgagaagugugacacgcugcugugcgacaucggggagaguagccccaacccuaccaucgaggccggccgcacccugcgcguacugaaccuggucgagaacuggcucaacaacaauacccaguucugcauuaagguuuuaaacccguacaugccuuccguuaucgagaagauggaagcccugcagcgccaguacggcggggcguugguucgcaacccccuuagccggaacaguacgcacgaaauguacugggugagcaacgccacgggcaacaucgucagcagcgugaacaugaucucccgcaugcugaucaaucgguuuaccaugaagcacaaaaaggccacguaugagccggacguugaucuggggagcgggacacgcaacauagggaucgagagugaaauccccaaucucgacaucaucggcaaacguaucgaaaagaucaagcaggagcacgagaucagcuggcacuacgaucaggaccauccauacaagacuugggcuuaccacggcuccuacgagacuaagcagaccgggucagccuccagcaugguuaacggagucgugcggcuucugacgaagcccugggacgucgugccuauggucacacaaauggcgaugacugacacgacgcccuuuggucaacagcgcgucuuuaaagaaaagguggacacgcggacucaggagccgaaggagggcacgaaaaagcucaugaagaucaccgcggaguggcuguggaaggagcuuggcaagaagaaaacaccccgcaugugcaccagggaggaguucacgaaaaaggugcgaucgaacgccgcccucggggcaauauucacugacgaaaacaaguggaagucagcgcgggaagcgguugaggacggccguuuuugggaacugguggaucgggagaggaaccugcaccuagaggggaaaugcgagaccugcguauacaauaugaugggcaagcgggagaagaaguuaggggaguucggcaaggcgaagggcucccgcgccaucugguacaugugguugggugcccgguuccucgaguucgaggcucugggcuuccugaacgaggaccacugguucuccagggggaacagccucucuggcgucgagggggagggccugcaccggcugggcuacauccugcgcgacgugggcaagaaggaggguggcgccauguaugccgacgacaccgccgggugggacacacggauuacccucgaggaccugaaaaacgaggagauggucacuaaccauaugaaaggcgagcacaagaaacuugcggaggccaucuucaaacuuaccuaccaaaauaagguggugcgcguucaaaggccgacgcccagggguacggugauggacauaaucagcagacgagaccagcggggcuccggacaggucggcaccuauggacugaacacuuucacaaacauggaggcgcagcucauccgccagauggagggggaagguaucuucaaauccauacaacaccugaccgccacggaggagaucgccguccagaauuggcuggcuagaguggggcgggagcgacucucacgcauggccaucaguggugacgacugcguggucaagcccaucgacgaccgcuucgcauccgcucugacagcccugaaugacauggggaaggugcgcaaggacauacagcagugggagcccagucgcggcuggaacgacuggacacaggugccguuuugcucccaccacuuccacgagcucgucaugaaggauggucgggugcuggucgucccgugcagaaaccaggacgagcugaucggcagagcacgcaucagccagggugccggguggucucuuaaggagacggccugucugggaaagagcuaugcacagauguggacgcuaauguacuuccaccggagagacuuacggcuggccgcaaaugccaucugcuccgccguucccucucacugggugcccaccucccgcacuacaugguccauccacgccaagcacgaguggaugaccacggaggacaugcuggcggucuggaaccgcguguggauucaggagaacccguggauggaagacaagaccccaguugaguccugggaggaagucccuuaccucgggaagcgagaggaccaguggugcggcagcuuaaucgggcuuaccagccgggcgacaugggcgaagaauauccaaacggcuaucaaccaagugcgauccuugaucggcaacgaggaguacacagacuacaugcccagcaugaagcgguuccgccgugaggaggaagaagcgggcguacuuugguga

SEQ ID NO: 25065 - RNA, 9876 nt, Artificial Sequence
  derived and/or modified CDS sequence (opt11) from DENV-2__JX079688__SS-prME
accgcgggcgucaucgucaugcugauccccacggccauggcguuccaccucaccacccgcaacggcgaaccccacaugauagugggccggcaagagaagggcaagagccuguuguuuaagacggaggacggggugaacaugugcacccucauggccaucgaccuuggggagcucugugaggacaccaucaccuauaagugcccccuccugcgccagaacgagccugaggacaucgacugcuggugcaauagcaccucuacguggguuaccuaugggaccugcaccaccacgggggagcaccgucgggagaagcguucuguggcccuggugccccacguggggaugggccucgagacccgcacggagaccuggaugucuagcgagggugccuggaagcauguacagcggauagagaccuggauccugcgccacccggguuucaccauuauggccgcgauccuggccuacaccauagggaccacgcacuuucagcgggcccucaucuucauccuucugacggccguggcucccaguaugacaaugcgcugcaucggcaucagcaaccgggacuucgucgagggcgugagcgggggcucauggguggacaucguccuggagcacgggucaugcgugaccacgauggccaagaacaagcccacccuggacuucgagcugauaaagaccgaagccaaacagccagccacacuccggaaguacugcaucgaggcuaagcuaacuaauaccaccaccgaaucccggugccccacgcagggcgagcccagcuuaaacgaggagcaggacaaacgcuucaucugcaagcacuccaugguggauaggggcuggggaaacggcugcgggcuguuuggcaaagggggcauagugaccugcgcgauguucacaugcaaaaagaacauggagggcaagguggugcagccggagaaccuggaguacaccauagucauaacgccccacagcggggaggaacacgcggucggcaacgacaccgggaagcacggcaaggaaaucaagaucacaccccaguccucuauuaccgaggccgaguugaccggguauggcacggugacuauggaaugcaguccacggaccggccucgacuucaacgagaugguuuugcugcagauggaggacaaggccugguuggugcaccggcaaugguuucuggaccugccucuccccuggcugccgggggccgacacucagggguccaacuggauccaaaaggagacacuggugacauucaagaacccccacgcgaagaagcaagacgucgugguccucgggucacaagagggcgcgaugcacaccgcccugaccggggccaccgagauccagaugagcagcggcaaccuccuguucaccggccaccugaagugccgccugcgaauggacaagcuccagcuaaaggggauguccuauucgaugugcaccggcaaguucaagauagugaaggaaaucgccgagacccagcacgggacgaucgugauccgcguacaauacgagggcgacggcucacccugcaagauccccuucgagaucaccgaccuggagaagcggcacgugcucggacggcugaucacggugaacccgaucgucacggagaaggacagccccgugaacauagaagcggagccacccuucggcgacuccuauaucaucaucgggguugagccgggacaguugaagcucaacugguucaagaaagggagcagcauaggccagauguuugagacgaccaugcgcggcgcuaagagaauggccauccugggggacaccgccugggacuucggcagccucgguggcgucuucaccucgaucgggaaggccuugcaccagguguucggcgcaaucuacggcgccgccuucagcggggugagcuggacuaugaagauccugaucggcgucaucaucaccuggauagggaugaacucacguuccaccagucuguccgugucacuggugcucgucgguguugugacccuguaccugggagccguuguacaggcagauuccgguugcguggucaguuggaagaacaaggaguuaaagugcggcucagggauuuucaucacggacaacgugcacaccuggacugagcaguacaaguuccagcccgagagccccagcaagcuggccuccgccauccagaaggcacacgaagagggcaucugcgggauccggagcgugacccgcuuggagaaucucauguggaagcagaucaccccagagcugaaccacauucuuuccgaaaacgaggucaagcucaccaucaugaccggagacaucaaggggaucaugcaggccggcaagcggagccuccguccgcagcccacggagcugaaguacucguggaagacguggggaaaagcgaaaaugcucagcacagagucacacaaucagaccuuccugaucgacgguccagagaccgccgaguguccgaauacgaaccgggccuggaacagccuagagguggaggacuacggcuuugggguguucaccacgaacaucuggcucaagcugcgcgagaaacaggacgucuucugcgacuccaagcugaugagcgccgccauaaaggacaacagagcgguacacgccgauaugggguacuggaucgaguccgcccucaacgacaccuggaaaauggagaaggccagcuuuaucgaggugaaauccugccauuggcccaagagccacacccuuuggagcaacggcguccuggagagugagaugaucaucccaaagaacuucgccgggccugugucccagcacaauuaccgaccggguuaccacacgcagaccgcggggcccuggcaccucgguaagcuagagauggacuuugacuucugugaagggacuaccgugguagugacggaggacugcgguaaucggggccccagccugcgcacgacuacugccagcgggaagcucaucacggaauggugcugccgguccugcacccugcccccucugagguaucggggcgaggacggguguugguacgggauggaaauacgaccgcuaaaagagaaggaggagaaccuggugaacucgcuggucacagccgggcacggucagaucgacaacuuuuccuugggcgugcuggggauggcgcuuuuccucgaagagaugcugagaacccgcaucggcaccaagcacgcgauccugcucguggcggucagcuucgugacccugauuaccgggaacauguccuuuagggaucugggccgcgugauggucauggugggcgcuaccaugacggacgacaucgggaugggggugaccuaccucgcccugcuggccgccuucaaaguccgcccgaccuucgcugccgggcucuuacugcggaagcucaccagcaaggaguugaugauggccacgaucggcaucgcccugcugucgcagagcaccauccccgagaccauccuagagcugaccgaugcgcucgcccuggggaugauggugcugaaaaucguucgcaauauggagaaguaucaguuggccgucacgaucauggccaucuccugcgugccgaacgccgucauccugcagaacgcguggaaggucucaugcacaauccucgccgccgugagcguuagcccccuccugcugaccuccagccagcagaaggcagacuggaucccgcucgcccuuaccaucaagggacugaaucccaccgccaucuuccucaccacccugucucguacuagcaagaagagguccuggccgcugaacgaggcgaucauggccgugggcaugguuagcauccucgccuccucgcuucugaagaacgacaucccgaugacggggccucucgucgcgggcggccugcugaccgugugcuacgugcugaccggcagaagcgccgaccuggagcuggagcgcgccgccgacgucaaaugggaggaccaggccgagaucuccgggucgucccccauccucagcaucacuaucuccgaggacgguagcaugucuaucaaaaacgaggaggaagaacagacgcucacgauccugaucagaacgggccuacuggugauuagcggcguguucccggucucgauucccaucacagcggccgccugguacuuaugggaggugaagaagcagcgcgccggcgugcugugggacguccccagcccuccgcccguggagaaggcugagcucgaggacggggcguaccggauaaagcaacgcggcaucuugggguacucccagaucggcgccggcguguacaaagaagggaccuuucacacuauguggcaugugacccggggcgccguacucaugcaccgcggcaaacggaucgagcccagcugggccgaugugaagaaagaccuuaucuccuacggcggcggguggaaacuggagggcgaguggaaggagggugaggagguccagguccucgcccuggaacccggcaagaacccccgcgcggugcagaccaagcccgggaucuucaagacgaauacgggcaccaucggggccgucagccuggacuucucccccggcaccagcggcucucccaucguggaccggaaggggaagguggucggccucuacgggaauggcgugguaacccgcagcggcgccuacguaagugccaucgcgcagacggaaaagaguaucgaggacaaccccgagaucgaggacgacaucuucagaaagaagcgccugaccaucauggaccuccacccaggggccggcaagaccaagcgguaccuccccgccaucguucgagaggccaucaagcgggggcugcgaacccugauucuggcaccgacgcgcguggucgcggccgagauggaggaggcccucagaggccugcccauccgguaucagacccccgccaucaagaccgagcacacgggucgggagaucguggaccugaugugccacgcgacguucacaaugcgccuccucagcccugugcgggucccuaacuacaaccugaucaucauggacgaggcccacuucaccgacccagccuccaucgccgcucgcggcuauaucucgacgcggguagagaugggcgaggccgcggggaucuucaugacggcgacgccgccgggcucccgcgacccguuuccccagagcaacgcccccauaauggacgaggagcgggagauccccgagcgcuccuggaacagcgggcacgagugggugacagacuucaaaggcaagaccgucugguucgugccgagcaucaaggcagggaaugacaucgcggccugucuccggaaaaaugguaagaaggugauccagcugagcagaaagaccuucgacuccgaguacgucaagacgcgggccaaugacugggacuucguggugaccaccgacauuagcgaaaugggcgccaauuucaaagccgagcgcgucaucgacccccggcgcugcaugaaaccagugauacugacggacggggaggagcgggucauccucgcggggcccaugcccguuacccacaguucagcagcccagcgccggggucgcaucggccgcaauccuaagaacgaaaaugaccaguacaucuauaugggggagccccuagagaacgacgaagacugcgcccacuggaaggaggccaagaugcuacucgacaacauaaacacccccgagggcaucaucccguccauguucgagcccgagcgggagaagguagacgcuaucgacggcgaguaucgccugcgcggagaggcccgcaagaccuucguggaccuaaugaggcguggcgacuuacccguauggcuugccuacaagguggcagccgaggguaucaauuacgcggaccggaaguggugcuucgauggcaucaagaacaaccagauacuagaggagaacauggagguugagaucuggaccaaagagggggagcgcaagaaacuuaagccgcgguggcuggacgcccgcaucuacucagacccacuggcccucaaggaguucaaagaguucgccgcgggcaggaagucccuaacgcugaaccucauuaccgaaaugggacgccuacccacuuucaugacgcagaaagccaggaacgcccuggacaaccuggcaguccugcauaccgccgaagccgggggccgcgccuacaaccacgcucugagcgaacuccccgaaacccuggagacucugcuucuguuaacgcuccuggccaccgugaccggcgggaucuuccuguuccucauguccgguaaggggaucgggaaaaugacccuggggaugugcugcauuaucacugccagcaucuuacucuggcacgcgcagauccagccgcacuggaucgccgccucuaucaucuuggaguucuuccugaucguacuauugauuccugagcccgagaagcagcggacuccccaggacaaccagcugacguacguggucaucgccauacugacaguuguggccgcgaccauggccaacgagaugggcuuccuggagaaaacgaagaaggaccugggucucggcagcaucaccacccaagagagcgaguccaacauccuggacauagaccugcgcccggccagcgccuggacccucuacgccguugcgacgacguucgucacccccaugcugcggcauuccauagaaaauagcucugucaacguuucgcuaaccgccaucgccaaccaggccacgguucucaugggccugggaaagggcuggccccuguccaagauggacaucggagugccccuccuggcgaucggguguuacagccaggugaacccaauuacccugaccgccgcuuugcuguugcucgucgcgcauuacgccauuaucggaccaggccugcaggcgaaggccacucgcgaggcccagaagcgggccgccgcgggcaucaugaagaaccccacgguggacgggaucacugugauugaccuggaaccuaucccguaugacccgaaguuugagaagcagcucggccaggucauguugcugauauuaugcgugacccaagugcugaugaugcgcacaacaugggcacuaugcgaggcccucacccuggcaaccgggcccaucuccacccugugggaaggcaacccagggcgguuuuggaacacgaccaucgccgugagcauggcgaacauauuccgcggcuccuacuuagccggcgccgggcugcuguucagcauuaugaagaacaccaccucaacgcgccggggcacggggaacaucggcgagacccucggcgagaaguggaaaagcagacugaacgcuuuggggaaguccgaguuccagaucuacaagaaguccggcauccaggaggucgaccggacccuugcgaaggaggggaucaaacgcggcgaaacggaucaccacgccguuucccgggggagcgccaagcugagaugguucguugaacggaauauggugaccccggaaggcaaaguggucgaccugggcugcgggcgcggcgggugguccuacuacugcgguggucucaagaacgugcgggaggugaagggccugaccaaaggcgggcccggccacgaggagccgauccccaugagcaccuauggguggaaccuggugcgccuccagagcggcguggacguguucuucacgccgccggagaagugcgacacccugcugugcgacaucggggagucaagcccaaaccccaccaucgaggccggccguacccuccgcguccugaaccuggucgagaacuggcucaacaauaacacacaguucugcaucaaggugcugaauccguacaugcccuccgucaucgagaagauggaggcacugcagcggcaguacggaggggcucucgugcgcaacccccugagccggaacuccacgcacgagauguacugggucagcaacgcgaccggcaacaucgucuccagcgugaacaugaucucccgcaugcugauaaaccgguucaccaugaagcacaaaaaggcaaccuacgagccagauguugaccuugggagcggcacucgcaacaucgggaucgaaucggaaaucccgaaccucgacaucauagguaagcggauugaaaagaucaaacaggaacacgaaaucagcuggcacuacgaccaggaucaccccuacaaaaccugggccuaccacggcuccuacgagaccaagcagaccgggagcgcgucgagcauggucaacgguguagugcgccugcugacgaagcccugggacgucgugccgauggugacccagauggcgaugaccgauacuacgcccuucgggcagcagcgcgucuuuaaggagaagguggacacgcggacccaggagcccaaggaaggcaccaaaaagcucaugaagaucacggcugaguggcuguggaaggagcugggcaagaagaagacgcccagaaugugcacccgggaggaguucaccaaaaaggugcgcuccaacgccgcccugggggccaucuucacggacgagaacaaguggaaguccgcgcgggaggccgucgaggacggccgcuuuugggaguugguggaccgggagcgcaaccugcaccucgaggggaaaugcgagaccugcguauacaacaugaugggaaagcgggaaaagaagcuaggggaguucggcaaggccaaggggucccgcgcgaucugguacauguggcuaggagcgcgguuucucgaguucgaggcccucggcuuccuuaaugaggaccacugguucagccgugggaauagcuuguccggcgucgagggggaaggccugcaccggcugggcuacauucuccgagacgucgggaagaaggagggcggagccauguacgccgaugacaccgccggcugggacacccggaucacgcuggaagaccuuaagaaugaggagauggucacaaaucacaugaagggggagcauaagaagcucgccgaagccaucuucaagcuaaccuaccagaacaagguagugagaguccaaaggccgacgccccgcggaacggugauggacaucauuagccggcgcgaccagcggggcucggggcaggucggcaccuacggacugaauacguucaccaacauggaagcccaacucauccgccagauggagggugagggcaucuucaagagcauccagcaucugacagccaccgaggagaucgccguccagaacuggcuggcgcgcgugggacgcgagcggcucucacggauggcaaucaguggugacgacugcguugucaagccuaucgacgaccgcuucgccucugcccugaccgcccucaacgacaugggcaaggugcggaaggacauacaacagugggagccuagucgcggcuggaacgacuggacccaagucccguucugcucgcaccacuuccacgagcucgugaugaaggacgggcggguguugguggugcccugccgcaaccaggacgaacugaucggacgggcgaggaucagccagggcgccggguggucccucaaggagacggccugucugggcaagagcuaugcccagauguggacccugauguacuuccaccggcgcgaccuccggcuggcugcgaacgccaucuguuccgccgugcccagccacugggugccgaccucccgcaccaccuggagcauccacgccaaacacgaauggaugacgacggaggauaugcuggcugucuggaaucggguguggauccaagagaacccguggauggaggacaagaccccgguggaguccugggaggaagugcccuaccucggcaagcgcgaggaccaauggugcggcagccugaucgggcugacuagccgggccacgugggccaagaacauucagacugccaucaaccaagugcgcucacuaauuggaauugaggaguacaccgacuacaugcccagcaugaagcgguuccgcagggaagaggaggaggccggcgugcugugguga

SEQ ID NO: 25066 - RNA, 9876 nt, Artificial Sequence
  derived and/or modified CDS sequence (opt11) from DENV-2__JF357906__SS-prME
accgccggcgugauagucauguugauaccgacggccauggcguuccaccucaccaccaggaacggggaaccccacaugauugugggccggcaggaaaaagggaagucccugcuguuuaagacggaggacggugucaacaugugcacuuuaauggcaaucgauuuaggcgaacugugcgaggacaccaucaccuacaagugcccccucuuacgucaaaacgagcccgaggacauagacugcuggugcaacagcacgagcaccugggucaccuauggaaccugcaccacuacgggcgaacaccggcgcgagaaacgcuccguggcccuggugccccacgucgggaugggccucgagacccgcaccgagacuuggaugagcucggagggggccuggaagcaugugcagcggaucgagacguggauccugagacacccgggcuucaccaucauggccgcagugcuggccuauacgaucgggaccacgcacuuucagaaggcccucaucuucauccugcugaccgccgucgcgccuagcaugaccaugcgcugcaucggcaucagcaaccgcgacuucguggaagggguuagcggcggaagcugggucgacaucgugcucgaacacgguagcugcgucaccacgauggccaagaacaagcccacucuggauuucgagcugauaaagaccgaggccaagcagcccgccacucuccgaaaguacugcaucgaagccaagcugaccaacaccaccaccgagucccguugcccgacacagggggagcccagccugaacgaggaacaggacaagcgguuuauuugcaaacacucaaugguggaucgcggcugggggaacggguguggucuguuuggcaagggcgggaucgugaccugcgcaauguucacgugcaagaagaacauggagggcaaggucguccagcccgagaaccuggaguacaccauugucaucacaccccacucgggggaggagcacgccgugggcaacgacacagggaagcacggcaaggagaucaagaucacuccgcagaguagcaucaccgaggccgagcugaccggguacggcacgguuacgauggaguguagccccagaaccggccucgacuuuaacgagaugguucugcugcagauggaagacaaggccuggcuagugcaucgccagugguuccuggaccugccccuccccugguuaccgggagccgacacccaggguagcaacuggauccagaaagagacgcuggucacauucaagaacccccacgcgaagaagcaagacguggugguauuagggucccaggagggcgccaugcacaccgcccugaccggggccacggagauacaaaugagcuccggcaaccuccuguucaccggccacuugaagugccggcugcgcauggacaagcuccagcugaaggggauguccuacagcaugugcaccgggaaguuuaaaaucgugaaggagaucgccgaaacucagcaugggacgaucgucauucgggugcaguacgagggagacggcuccccuuguaagauacccuucgagaucacggacuuagaaaaacgccacgugcucggccgacugaucaccgucaacccgaucgucacugagaaagacagccccgugaacaucgaggcagagccgcccuucggugacuccuacaucaucaucgggguagagccgggacagcugaagcucaauugguucaaaaaggggagcuccauaggccagauguucgagacgaccaugcgcggcgccaagcgcauggccauuuugggcgacacagccugggacuucgguagccucggagggguguucaccuccauugggaaggcccuccaccagguguucggggcgaucuacggcgccgccuucagcggggucuccuggacgaugaagauccugaucggcgugaucaucacauggaucgggaugaacagccggucaacgagccuguccgugagccuggucuuagugggcgugguuacccuguaccuaggggccguggugcaggcugauaguggcugcgucgugagcuggaagaacaaggaacucaagugcggguccgggaucuuuaucacggacaacgugcacaccuggaccgagcaguacaaguuccagccggagucgcccucgaaguuggccagugccauccagaaagcacacgaggagggcaucugcgggauccguagugucacccggcuggagaaccucauguggaagcagaucacacccgagcuuaaccacauccuguccgaaaacgagguaaaguuaaccaucaugacaggcgacauaaagggaauuaugcaggccggcaaacguagccuccggccgcagccgacugaacugaaguacuccuggaagacguggggcaaagcgaagaugcucagcaccgaaucccacaaccagaccuuccugaucgacggacccgaaaccgccgaguguccgaacacaaaccgagccuggaauagccuggagguggaagacuauggcuuuggggucuucaccaccaacaucuggcuaaaguuacgggaaaagcaggacguguucugcgauucuaagcuaaugagcgccgccaucaaagacaaccgcgcgguucaugccgacaugggcuacuggaucgaguccgcccucaacgacaccuggaagauggagaaggcuucauucaucgaagucaaauccugccacuggcccaagucucacacccucugguccaacggcgugcuggaaucagagaugaucauccccaagaacuucgcugggcccgugucccagcacaauuaccgccccgguuaccacacgcagaccgcggggcccuggcaccucggcaagcuggagauggauuuugacuucugcgaggggacuaccgucguggugacggaggacugcggcaaccgcggccccagccugcggaccaccacugccucuggcaagcucaucacggagugguguugccgcuccugcacguuacccccucugcgguaccguggggaggacgggugcugguauggcauggagauccgcccccugaaagaaaaagaggagaaucuggugaauagccuggugaccgccgggcacggacagauugacaacuucagccuaggcguucugggaauggcccuguucuuagaggaaaugcugagaacgcggaucggcacaaaacacgcgauccuguuagucgccgucagcuucguaacccuuauuaccgggaacauguccuuccgcgaccugggacgcgugaugguaauggugggggcuaccaugaccgacgauauaggaaugggcguaaccuaccucgcccugcuggccgcguuuaaggugcgccccaccuucgccgcagggcuccugcugcgcaagcucaccagcaaggagcugaugauggccacgaucggaaucgcccuguugucccagucuaccauccccgagaccaucuuggagcugacugacgcccucgcccuggggaugauggugcucaagaucguccggaacauggagaaguaccaacucgccgugacgaucauggccauauccugcgugccgaacgccgucauccugcagaacgcguggaagguaagcugcacuauccuggccgccgucuccguguccccacucuugcugaccuccucgcagcagaaggccgacuggaucccccucgcgcucacaauuaagggccugaacccgacugccaucuucuuaaccacccugucucgcaccuccaagaagcgcucguggccgcugaacgaggccaucauggccgugggaauggugagcauccucgccuccagccuucugaagaacgauauccccaugacugggccucugguagcgggcggguugcugacagugugcuauguccuaaccggacgcucggccgacuuggaacuggagcgggcggccgacgugaaaugggaggaccaagccgaaaucuccgggucuucccccauccucagcaucacuaucucagaggacggcagcaugaguaucaagaacgaggaggaggagcagacguuaaccauccugauccgcaccggccuccuugugaucagcgguaucuucccggucucgauacccauuacggcggccgccugguaccugugggaggugaagaagcagcgggccggcgugcucugggaugucccgagcccgccaccaguggagaaagccgaguuagaagacggugcguaccgcaucaagcagcggggcauccugggguauucccagauuggcgcuggcguuuacaaggaggggaccuuccacacgauguggcacgucacccgcggcgccgugcucaugcaccggggaaagcgcaucgagccgagcugggcugacgugaagaaggaccuuaucucuuauggcgggggcuggaagcucgagggcgaguggaaggaaggggaggaaguacaggugcucgcccuggagccgggcaagaacccgcgggcggugcagaccaagcccgguaucuucaagaccaacacuggaaccaucggggccgucagccuggacuuuuccccggguaccagcggcucccccauuguggaccguaaggggaagguggucggccucuacgggaacggcgugguaacccguagcggcgccuacgucuccgcaaucgcacagacggaaaaguccaucgaggacaacccagagaucgaggacgacaucuuccgcaagaaacggcugaccauuauggaccuucacccaggggcgggcaagaccaagcgauaccuccccgccaucgugagggaggccaucaagcgcgggcuccggaccuugaucuuagccccgacgagaguggucgcggccgagauggaggaggcccuacgcggccugccaauccguuaucagacccccgccauuaagaccgaacacaccgggcgcgagaucguggaccugaugugccacgccacguucacuaugcggcuccugucgcccgugcgcguaccgaacuacaaccugaucaucauggaugaggcccacuucaccgaccccgcauccaucgccgcgcggggcuacaucagcacccgaguggagaugggcgaggccgcgggaaucuucaugacggcaacgccgcccggguccagagacccguucccccagagcaacgcccccauaauggaugaggagcgugagaucccggagcgguccuggaacagcgggcacgaaugggugacugacuuuaagggcaagacugucugguucgugccguccaucaaggccggaaacgacaucgcugccugccuccgcaaaaacggcaaaaagguuauccagcugagccggaagacguucgacuccgaguacgucaaaacccgcgccaacgacugggacuucguggugaccaccgauaucucugagaugggcgcgaacuucaaggcggagcgggucaucgauccccgccggugcaugaagcccgucauacugacggacggggaggaaagagugauacuggcgggacccaugccugucacccacuccagcgccgcccagagaagggggcggauaggccgcaaccccaaaaaugaaaacgaccaguacaucuacaugggggaaccccuggagaacgacgaggacugcgcccacuggaaggaggcaaagaugcuccucgacaacauaaacacgccagagggcauaaucccguccauguucgagcccgagcgcgaaaagguugacgcaaucgacggcgaguaccggcuuagaggggaggcacggaaaaccuucguggaucugaugcgccggggcgaccucccagucuggcuagccuacaagguagccgccgaaggcaucaacuacacugaccguaaguggugcuuugacggcaucaaaaacaaccagauccuggaggaaaacauggagguggagaucuggaccaaggaaggggagcggaagaaacuuaaaccacgcuggcuggaugcgcggaucuacagcgauccccuggcccucaaggaguucaaggaguucgccgccggccgcaaaagucugaccuuaaaccugauuaccgagaugggacgacugcccacguucaugacacagaaggcacgcaacgcccuggacaaccuugccguccugcacaccgccgaggccggaggacgcgcguacaaucaugcccuaagcgaguuaccagagacccuagaaacgcugcuccugcuaaccuugcuggcaaccgugaccgggggcauuuuccuguuccugauguccggcaaggggauuggcaagaugacccugggcaugugcugcauuauuacggccagcauacugcucugguacgcccagauccagccgcacuggaucgcggccagcaucauccuggaguucuuccugaucguccuccugauccccgagcccgagaagcagcgcacgccacaggacaaccagcugaccuacguggugaucgcgauccuuaccgucguggcggccacuauggcgaacgaaaugggcuuccuggagaagaccaagaaggaccuggggcugggcuccaucaccacccaggagagcgagucaaauaucuuagacaucgaccugaggccagcgagcgccuggaccuuguacgccguggcaaccaccuuuguuacgcccaugcucagacauuccauugagaacagcucugugaacguuagccucacggcgaucgccaaccaggccaccgucuugaugggccuggggaagggcuggccccuguccaagauggauaucggggugccccuccuggccaucggcugcuacagccaagugaacccuaucacccugaccgcggcccuucugcuacucgucgcccauuacgccaucaucggaccaggcuugcaggcaaaagcgacgagagaggcccagaagcgcgccgccgcgggcaucaugaagaaccccaccguggacgggaucaccgugauagacuuagagcccaucccguacgacccaaaguucgagaagcaguuaggccaggugaugcuccugauccucugcgugacccagguuuugaugaugcggacgacaugggcgcugugcgaggcccucacacuggccacugggcccaucucaacgcugugggagggcaacccugggcgcuucuggaacacaaccaucgccguuagcauggccaacaucuucaggggcuccuacuuagcgggcgccgggcuucucuucagcaucaugaagaacaccacguccaccagacgcggcaccgggaacaucggcgagacacucggcgagaaguggaaaucccggcugaacgcgcuggggaaguccgaguuucaaauauacaagaaguccggcauccaggagguggacaggacgcuagccaaggagggaaucaagaggggcgagaccgaccaccacgcggugucccgcgggagugccaagcugcgcugguucgucgaacguaacaugguaaccccggagggcaagguuguugacuuaggcugcgggcgggguggguggucguacuacugcggcgggcuaaagaacgugcgcgaggugaagggccugacaaagggcggccccggucacgaggagcccaucccuaugagcacuuacggguggaaccugguccggcuccaaagcggcguugacguguucuucaccccucccgagaagugcgacacgcugcugugcgauaucggggaguccagccccaacccuaccaucgaagccggccgcacgcuccgggugcugaacuugguggagaacuggcugaacaacaauacgcaguucugcaucaaggugcugaaccccuauaugcccuccgucaucgagaagauggaggcucugcagcgccaguacgguggggcccucgugcggaacccccucagccgaaacuccacgcacgagauguacugggugagcaacgcgaccggcaacaucgucuccagugugaacaugaucucccggaugcugaucaaccgcuucacuaugaaacacaagaaagcaacauacgagccggauguagaccuggggagcggcacccggaacauagggaucgaaucagaaauccccaaccucgacaucauagguaagcgcauagagaagaucaagcaggagcacgagaucagcuggcacuacgaccaggaccaucccuacaagaccugggccuaccacggcuccuacgagacgaaacagacggggagcgccuccagcauggucaacggcguggugcggcuguuaaccaagcccugggacguuguuccgauggugacccagauggccaugacggauacgacccccuucgggcagcagcgcguuuuuaaggagaagguggacacccgcacccaagagcccaaggagggcacgaagaagcucaugaagauaaccgcggaguggcuguggaaggagcugggcagaaagaagacgccccgcaugugcacccgggaggaguuuacgcgcaaggugcgguccaacgccgcccucggggccaucuuuaccgacgagaacaaguggaaguccgcucgcgaggcgguagaggacggccgguucugggaacugguggauagggagcggaaccugcauuuggaggggaagugcgagacgugcguguacaacaugaugggcaagcgcgagaagaaauugggggaguucgguaaagccaagggaucccgggccaucugguauauguggcugggggcccgcuuccucgaguucgaggcgcugggcuuccucaaugaggaccacugguucagcagagagaauagccuauccggcgucgagggcgaggggcuccaccgccugggcuacauccuucgggacgugggcaagaaggagggcggcgccauguacgccgaugacaccgccgggugggacacgcgcaucacccuagaggaucugaagaacgaggagauggucacaaaccacaugaagggggaacacaagaagcucgccgaggcgauuuuuaaacugaccuaccagaacaagguggugcggguccagcguccgacgccccgggggacagugauggacauuaucagccgccgggaccagcgcggcuccggccaagugggaacauacggccugaacacauucacgaacauggaagcccagcuaauccgccaaauggaaggggagggcaucuucaagagcauccagcaucugacggccaccgaggaaaucgccguccagaacuggcuggcgagggugggccgcgagcgguuaucccgcauggcgaucucaggggaugacugcguggucaaacccaucgacgaccgguucgccuccgccuuaaccgccuugaaugacaugggcaaggugcgcaaggacauucagcagugggagcccagcagaggguggaacgacuggacccagguuccguucugcucccaccacuuccacgagcucgucaugaaggacggccgcgugcuggugguccccugccggaaccaggacgagcugaucgggagggcccggauuucgcagggcgcgggcuggucccucaaggagaccgcaugccuaggcaagagcuaugcccaaauguggacucucauguacuuucaccgccgggaccuccgcuuggccgccaacgcaaucugcuccgccgugcccagccacugggugcccaccucccggaccacgugguauauccacgccaagcaugaguggaugaccaccgaggacaugcuggccguauggaaccgcguguggauccaagagaacccguggauggaggacaagacccccguggagagcugggaagagguccccuaccucggcaagcgggaagaccaguggugugggagccugaucggccucacgagccgcgcgaccugggccaagaacauccaaaccgccaucaaccaggugcggucccugaucggcaacgaggaguacaccgacuacaugcccuccaugaagcgcuuccgccgggaggaggaggaagccggcgugcugugguga

SEQ ID NO: 25067 - RNA, 9873 nt, Artificial Sequence
  derived and/or modified CDS sequence (opt11) from DENV-2__HQ705624__SS-prME
accgcgggugugaucguaaugcuaauacccacagcaauggcguuucaucucaccaccagaaacggggagccacacaugaucgugggccggcaggaaaaggggaagucccucuuauucaagaccgaagauggcgugaauaugugcaccuugauggcuaucgaccugggcgaguuaugcgaggacaccauuaccuacaagugcccccuccugcgccagaacgagccagaagacaucgauugcuggugcaacagcacuagcaccuggguaacauacgggacuuguaccacgacaggggagcacagacgcgaaaagcgguccguggcccuagucccccacgucgggaugggccucgagacacgcacugagaccuggaugagcagcgagggggccuggaagcacgugcagcggauagagaccuggauccuacgccacccaggcuucacuaucauggccgcuaucuuagccuacacaaucgggacaacgcacuuccaacgggcacuaauauucauccugcuuaccgccguagcgcccaguaugacuaugcgcugcaucggcaucucaaaccgggacuuuguggagggcguaucugggggcaguuggguggauauuguccucgagcacgggucuugcguaaccacgauggcaaagaauaagcccacgcuggacuucgagcuuaucaagaccgaggcgaagcagcccgccaccuuaaggaaguacuguaucgaggcaaagcugacgaauaccacgaccgaaucccggugcccgacgcagggcgagcccucccuaaacgaagagcaggacaagcgcuucaucugcaagcacuccaugguggacagggggugggggaacggcugcgggcucuucggcaaggguggcaucgugacgugcgcgaaguucacgugcaagaagaacauggaaggcaagguggugcagcccgagaaccuggaguacaccaucgugaucacgccccacagcggggaagagcacgccgugggcaacgacaccgguaagcacggcaaggagaucaaaaucaccccacaguccagcaucaccgaagccgagcugacaggcuacggcaccgugaccauggaguguucuccccgcaccggccuggacuucaacgagauggucuuacugcagauggaggacaaagccuggcucgugcaccggcaaugguuccucgaccugccccuccccuggcugccuggggcagacacccaaggcucuaauuggauacagaaggagacacuggugaccuucaagaacccccacgcgaagaagcaggacgucgugguccucggcagccaggagggcgcaaugcacacugcccugaccggggcaacggagauccaaaugagcagcggcaaccuacuguucacgggccaccugaaaugcaggcuucggauggacaagcuucagcugaaagguauguccuauagcaugugcacuggaaaguuuaagaucgugaaggagaucgccgagacccaacaugggaccaucgugauccgcguccaguacgagggcgaugggucccccugcaaggugccauucgagaucacugaccuggagaagcggcacgugcucgggcgacucaucaccgugaacccgaucgugaccgagaaggacagccccgugaacaucgaggcggagccgccauucggcgacucguacaucaucaucggcgucgaaccgggccagcugaagcucaacugguucaagaaggguagcuccauaggccaaauguucgagacgacgaugcgcggcgccaagagaauggccauccugggggacacggcgugggacuucggcagcuugggggguguguucaccuccauagguaaggcccugcaccagguguucggcgcaaucuacggcgccgccuucagcggggucuccuggacgaugaagaucuuaauuggcguuaucaucaccuggauugggaugaacagucgguccaccagcuuguccgugagucugguccuggugggcguggucacccuguaccucggggcaaugguccaagcggacaguggcugcguggucagcuggaagaacaaggagcucaaguguggauccgggaucuucaucacggauaacgugcacaccuggacggagcaguacaaguuucagcccgagagccccagcaagcuggccuccgccaucaagaaggcccacgaggagggcaucugugggauacggagcgugacccgacucgaaaaccuuauguggaaacagauuacgcccgagcugaaccacauccuguccgagaacgaagucaaacucaccaucaugaccggcgacauccgaggaaucaugcaggccggcaagcgcagccugcgaccgcagcccacagaacuuaaguacuccuggaagaccuggggcaaggcgaagaugcucuccaccgagucgcacaaucaaaccuuccugaucgacgguccggagaccgccgagugcccgaacacaaacagggccuggaacagccuggagguggaagacuacggcuucggggucuucaccaccaacaucuggcucaaacuacgagacaagcaggaugucuucugcgacucaaagcugaugagcgccgccauaaaagacaaccgcgcggugcacgcagauaugggcuacuggauugaguccgcuuugaaugacacauggaagauggagaaggccagcuucaucgaggugaaguccugccauuggcccaagagccacacccuguggucgaauggcguccuagagucggagaugaucauucccaagaauuuugccgggcccgugucccaacacaacuaccggccgggcuaccacacacagaccgcgggaccguggcaucucggcaaacuggagauggacuuugaccugugcgaaggcaccaccguggucguaacggaggacugcggaaacaggggccccagccuccgaacaaccacugccuccgguaagcugaucacggaguggugcugccgguccuguacccugcccccgcuccgguaccgcggugaagacgggugcugguacgggauggagauucggccgcugaaggagaaagaggaaaacuuagugaacagccucgucaccgcggggcacggccagauugacaacuucucccugggcgugcuggguauggcccuccugcucgaagagaugcuccgcacccggaucggcacuaagcacgccauccugcugguggccgucucauucguuacccugauaaccggaaauauguccuuucgcgaccugggacgggugauggucaugguaggggccaccaugacggaugacaucggcauggggguaaccuaccuggcccuccuagccgccuucaagguccggcccaccuucgcggcugggcugcuccuucgcaagcugacgaguaaggaguuaaugauggccacgaucggcaucgcccugcugucccagagcaccaucccagagaccauccucgagcucaccgacgcgcucgcgcucgggaugauggugcugaagaucgugcggaacauggagaaguaccagcuggcggucacggugauggcgaucuccugcgugcccaacgcaguaauuuugcagaacgccuggaaggugagcugcacaauucuggccgccgucuccgugagcccucugcuucugaccuccagccagcagaaggcagacuggaucccccuggcgcucaccaucaaaggccuaaaccccacggccaucuuccuuacgacccucaguagaacgagcaagaagcgguccuggccacugaaugaggccaucauggcaguugguaugguuagcauccuugccuccagccuccugaagaacgacauccccaugacgggcccccugguagccggcgggcuccugaccgugugcuacgugcugacgggccgcagcgccgaccucgagcuggagcgggccgccgacgugaagugggaggaucaggccgaaaucagugggucgucaccuauccugagcauuaccaucucugaggacggcagcauguccauuaagaacgaggaagaggaacagacgcucaccauccugauccgcacgggacugcucgugaucagcgguguuuucccgguguccauccccauaaccgcugcggccugguaccugugggagguuaaaaagcagcgggccggcguccugugggacgugccuucacccccuccgguagagaaggccgaacucgaagacggggccuaccgaauuaaacagcggggcauccucggguacucccagaucggcgccggcgucuacaaagagggcaccuuccacacgauguggcacguuacccgcggggccguucugaugcacagggggaagcguauagagccgagcugggccgaugugaaaaaggacuuaaucucauacgguggaggguggaagcuggagggcgaguggaaagagggggaggaaguccaggugcuggcccucgagcccggcaagaacccccgggcuguccagaccaagccuggaaucuuuaagaccaacacgggcaccaucggcgccgugucguuagacuuccccggcaccuccggcaguccuaucguggaucgcaaggggaaaguagugggucuguacgggaacggaguggucacccgguccggggccuacguguccgccaucgcccagacggagaagagcauagaggacaaccccgagaucgaagacgauaucuuccgcaagaagcgucucaccaucauggaccugcaccccggagccgggaagaccaagcgcuaccugccagccaucguacgggaggcuauaaagcgugggcugcggacccucauccuggccccaacgcgggucguggcggccgaaauggaggaggcgcuccgcggacucccuauccgguaccagaccacugccaucaagaccgagcacacggggcgcgagauuguagaccugaugugccacgcaaccuucaccaugcgucugcucagccccgucagggugcccaacuacaaccugaucauuauggacgaggcgcacuuuaccgacccggccagcauugccgcccggggcuacauauccacccgcguggaaaugggggaggcggcggggaucuucaugaccgccacgccgccuggcagccgggaccccuucccgcagagcaacgcgcccaucauggacgaggagcgcgagauccccgagcggucauggaacuccgggcacgagugggucaccgacuucaagggcaagaccgucugguucguaccuagcauaaaggccgggaacgacaucgcggcaugccuacgaaagaacggcaagaaggucauccaacuaucccggaagacauucgacagcgaguacgugaagacccgcgccaacgauugggacuucguggucaccacggacaucagcgagaugggcgcuaacuucaaggccgagcgggugaucgaccccaggcggugcaugaagcccguaauucugacggacggggaggagcgcgucauccuggcggggcccaugcccgugacccauagcuccgcggcccagcgaagggggcggaucggccguaaccccaagaaugaaaacgaccaauauauuuauaugggggagccccucgaaaacgaugaggacugcgcccacuggaaagaggccaagaugcugcuggacaacaucaauaccccggagggaauaauaccgagcauguucgagccugagcgcgagaaaguggacgcgaucgacggggaguacagguuacgcggagaggcccggaagacuuuugucgaccugaugcgccggggggaccugcccguguggcuagcguauaagguagcggccgaggggaucaauuacgcggaccggaaguggugcuucgacggcaucaagaacaaccagaucuuagaggagaacauggaggucgagaucuggacuaaggagggcgagcggaagaagcugaagccccgcugguuagaugcccggauuuacuccgacccgcuggcccugaaggaauucaaggaguuugccgcaggccgcaagagccucacgcugaacuuaauaaccgagaugggacgucuccccacguucaugacccagaaggccaggaacgcccuggacaacuuggccguacuccacacugcugaggcgggaggccgagccuacaaccacgcccuuuccgagcugcccgagacacucgaaacgcugcugcuccugacccuccuggccacugucacgggcggaauuuuccuuuuccucaugagcggaaaggggaucggcaaaaugacccucgggaugugcugcaucauuacggcaaguauccuacugugguacgcccagauccagccacacuggaucgccgccagcaucauccucgaguucuuccugaucgugcugcuaauaccagagccugaaaagcagcgcacgccccaggauaaccagcugaccuacgugguaauagccauacucaccgucguagcugcgaccauggccaacgaaaugggcuuccucgagaagaccaagaaagaucucggucugggcuccaucaccacccaggagagcgaaagcaacaucuuagacaucgaccugcggcccgccucugccuggacccuauacgccgucgccaccacuuucgucaccccgaugcuccgccauagcauagagaauucuagcgucaacgucucccugacagccaucgcuaaccaggcgaccgugcucaugggccucgggaagggauggccgcuuaguaagauggacaucggugugccccugcucgcgauaggcugcuacucccaaguuaaccccauaaccuugaccgccgcccugcucuugcugguggcccauuacgcgaucaucggaccgggccuacaggcgaaggcgacucgggaagcccaaaagagggccgccgcuggcaucaugaagaacccuacuguugacggcaucaccgucaucgaccuagagccuauccccuacgacccgaaauucgaaaagcaacuuggacagguuaugcuccuuauccugugcgugacucagguccuaaugaugcgaacgaccugggcccugugugaagcccugacucucgccacggggcccaucagcacguugugggagggcaaccccggucgcuucuggaacacgaccauugcaguguccauggcuaacaucuuccgcggcagcuaccuggccggagcaggccucuuauucaguauuaugaaaaauaccaccaauacccggagaggcaccgggaauauaggcgagacccuaggcgagaaguggaagucccggcucaacgcccuugggaaauccgaguuccagaucuacaagaaguccggaauacaggagguggaccgcacguuggcgaaggaggggauuaaaagaggcgagaccgaccaucacgcggugagcagagggagcgccaagcuccggugguuuguggaacgcaacaugguaacccccgagggcaaggucguggaccuggggugcgggcggggcgggugguccuauuacuguggggggcugaagaauguucgcgaggucaaggggcucaccaagggugggcccgggcaugaagagcccauccccaugagcacguauggcuggaaccuggugcggcugcaguccgggguggauguuuucuucacaccgcccgagaagugugauacccuccugugcgacaucggggagagcagccccaacccaaccaucgaggccggccgcacccugcgggugcucaaccuuguggagaacuggcugaacaacaacacgcaguucugcaucaagguccucaaccccuacaugcccucggugauugagaagauggaggcccugcagcguaaguacggcggagcacugguucggaacccccugagccgcaacuccacccacgagauguacugggucagcaacgcaaccggcaacaucgugagcagcguaaauaugaucuccagaaugcucaucaaccgauuuaccaugaagcacaagaaggcaacguacgagcccgacguagaccuggggagcggcacccggaacaucgggaucgaguccgagaucccaaaucucgacauaaucggcaagcgcaucgaaaagaucaagcaggagcacgagaccagcuggcacuacgaccaggaccaccccuacaagaccugggcauaccacggcuccuacgaaacgaagcagacagggucggcaucaaguauggugaauggcgucguccgccucuuaacaaaacccugggacguggugcccauggucacccagauggcaaugacggacaccacgcccuuugggcagcaaagaguguucaaggagaagguggacacucgcacacaggagcccaaggagggcaccaagaagcuuaugaagaucaccgcggagugguuauggaaggaguugggaaagaagaaaacgccccggaugugcacgcgcgaggaguucacccguaaggucagguccaacgcggcccucggugccauauucaccgacgagaacaaguggaaguccgcgcgggaggccguggaggacggccguuucugggagcuuguggacagggaacgcaaccuacaccuggaggggaagugcgagaccugcguuuacaauaugaugggcaagcgggagaagaaauuaggggaguuuggaaaggccaagggcucccgcgccaucugguacauguggcucggggcgagguuccucgaguuugaggcccucggcuuucugaacgaggaccacugguucagccgggggaauucccuaagcgguguggagggugaggggcuacaccgucugggguacauccucagggauguugggaagaaggaaggaggggccauguacgccgacgacacggccggcugggacacccgcaucacccucgaggaccugaagaacgaagagauggucaccaaccacaugaagggugagcacaagaagcuggcggaggcaaucuucaagcuuacguaccagaacaaggugguccgcgugcagagacccaccccacgaggcaccguuauggacauaaucagccggcgggaccagcgcgguucgggucaggucggaaccuacggguuaaacacguuuaccaacauggaggcacagcugauccggcaaauggagggugagggcaucuuuaagagcauucagcacuugaccgccaccgaagagaucgccguccaaaacuggcuggcgcgcguggggcgggagcgccugucgcggauggccaucucgggcgacgacugcguggugaagcccaucgaugaccgcuucgcguccgcguuaacagcccugaaugacauggguaaggugaggaaggacauucagcagugggagcccagccgcggauggaacgacuggacgcaagucccauucugcucccaccacuuccaugagcucgugaugaaggaugggcggguguuagucgugccgugccgcaaccaggacgagcugauuggccgggcucgcaucucccagggcgccggaugguccuugaaggagacagcgugccuggguaagagcuaugcccagauguggacccugauguacuuccaccggcgcgaucuacgguuagcagcgaacgcuauuugcuccgccgugcccucacacugggucccgacgucccgcacgaccuggagcauccacgcgaagcaugaguggaugaccaccgaagacaugcuggcgguguggaacaggguuuggauccaggagaaccccuggauggaggacaagacgccggucgaguccugggaggaggugccguaccuggggaagcgcgaggaccagugguguggcagccucauugggcugaccucucgggccaccugggccaagaacauccagaccgccaucaaucaggugcgaucccugaucggcaacgaagaguacacggauuacaugccaagcaugaagcgcuuucggcgcgaggaagaggaggccggcguccucugguaa

SEQ ID NO: 25068 - RNA, 9876 nt, Artificial Sequence
  derived and/or modified CDS sequence (opt11) from DENV-2__HQ705625__SS-prME
accgcgggcgugaucgucaugcuuauccccaccgccauggcuuuccaccucaccacccggaacggagagccucacaugaucguuggccgacaggagaagggcaagucgcugcuguucaagaccgaggacggcgugaacaugugcaccuuaauggccaucgaccuuggggagcugugcgaggacaccaucaccuauaaguguccucuccuucgccagaacgagcccgaggacaucgauugcuggugcaacagcacuagcaccugggugaccuaugggacaugcaccaccacgggcgaacaccggcgcgagaagcgguccguggcccuggugccacacguugggauggggcucgaaacccgcaccgagacuuggaugaguagugagggggccuggaaacacgugcagcggaucgagacguggauucugcgccacccgggcuucacaaucauggccgcgauccuugccuacacgaucggcaccacgcacuuucagagagcccucaucuucauacugcugacugccguggcgccuagcaugaccaugcgcuguaucggcaucagcaaccgggacuucguggagggcgugagcggggggucauggguggauaucguccuagaacacgggagcugcgugacgacuauggcuaagaacaaacccacccuggacuucgaguugaugaagaccgaggccaagcagcccgccacccuucgcaaguacugcaucgaggcaaagcugacgaacacuaccaccgagucucggugccccacgcagggugagcccagccugaacgaggagcaggacaagcgcuucaucugcaagcacuccaugguggaccgaggcuggggaaacggcugcgggcuguucggcaagggcggaaucgugaccugcgcgauguucacguguaaaaagaacauggagggcaagguggugcaaccugagaaccuggaguacaccaucgugaucaccccccacagcggggaggagcacgccgugggcaaugauaccgggaagcacggcaaggaaauuaagaucaccccacaguccagcaucaccgaggccgagcuuaccggauacggcacggucaccauggagugcagcccacggacuggacucgacuuuaacgagaugguccugcuccagauggaggacaaggccuggcucgugcaccggcagugguuucuggaccugcccuugcccuggcugccgggggccgacacccaggggagcaacuggauccagaaggagacccuggugaccuucaagaacccccacgcgaagaagcaggacgugguuguccucgggucacaggagggggcuaugcacacagcucuaaccggcgccacggagauccaaaugucaucaggcaaccuccuguucacgggccaucugaaaugccgccugcggauggacaaacuccagcugaaggggauguccuacagcaugugcaccggcaaguucaagaucgugaaggaaaucgcagagacccagcauggaacgaucgugauccgcguacaguacgagggugauggcuccccaugcaagauccccuucgagaucacugaucuggagaagcgacacgugcucggacgccugauaaccguuaacccgaucgugacugagaaggacagccccgugaacaucgaggcggagccgcccuucggcgacucuuacauuaucauugggguggaaccgggccagcugaagcucaauugguucaagaagggcagcuccaucggccagauguucgagacgaccaugcgcggugcgaagaggauggcgauccugggagacacagcuugggacuuuggcagccucgggggugucuucaccuccaucgggaaagcccuccaccagguguucggcgcgaucuacggcgcagcguucagcgggguguccuggacgaugaaaauccugauuggcgucaucauuaccuggaucgggaugaacagccgcuccaccagucugaguguaagccuggugcuugucggcguggugacucucuaccugggggccgucgugcaggcggacuccggcugcgugguuagcuggaagaacaaggagcucaagugcggauccgggaucuuuaucacggauaacguucauacauggaccgaacaguacaaauuccaaccggagucuccaagcaagcuggccagugccauccagaaggcccaugaggagggcaucugcgggaucaggagcgugacccgccuggaaaacuugauguggaagcaaaucacgcccgaacugaaccacauccuguccgagaaugaggucaagcucaccauuaugaccggcgacaucaagggaaucaugcaggcgggcaaacggagccugcgcccccagcccaccgaacugaaguauucauggaaaacguggggcaaggcuaagaugcucagcaccgaaucccacaaccaaaccuuccugaucgacgggccagagacagccgaaugcccgaacacaaaccgggccuggaacucacuagagguggaggacuacggcuucgggguguucaccaccaacauuuggcucaagcugcgcgagaagcaggacguauucugcgacuccaagcuuaugagcgccgccaucaaggacaaucgggcgguccacgccgacaugggcuacuggaucgaguccgcccucaaugauacguggaagauggaaaaggcgagcuucaucgaggugaagaguugccacuggcccaagagccacacccugugguccaacggcguccuggagagcgaaaugaucauccccaagaauuucgccgggccggugucccagcacaacuaccgcccaggcuaccacacgcaaacugcggggcccuggcaccuaggcaagcuagagauggacuucgauuucugcgaggggaccacaguagucgugacggaggacuguggcaaccgcggucccagccuucgaaccaccaccgccagcgggaaguugauaacugaguggugcugccggaguugcacccugcccccgcugcgcuaccguggcgaggacggcugcugguacggcauggaaauccgcccccucaaggaaaaggaggagaaccuggugaacagccuagucaccgcugggcacgggcagaucgacaacuucucccucggcgugcugggaauggcccuguuccucgaggagaugcugcggacccgcauuggcacaaagcacgcuauccugcuaguugccgucagcuucgugacucugauaaccgggaauauguccuuccgggacuugggccgcgugauggucauggugggggccaccaugacagacgacaucgguaugggcgugaccuaccucgcucugcuugccgcauuuaaggucaggcccaccuucgccgccgggcuacugcugcggaagcuuaccagcaaggaacugaugauggccacgaucggaaucgcgcuucucucccaaucuaccauccccgaaaccauccuggaacugacagaugcgcucgcccuggggaugauggugcugaaaaucgugcgcaauauggaaaaguaccaacucgccgucaccaucauggccaucuccugcgugccgaacgccgugauccugcagaaugcguggaaggucagcugcaccauccuggccgccgugucaguaagcccccuccugcugaccuccagccagcaaaaggccgacuggaucccccucgcgcuuaccaucaaaggccugaaucccacggccaucuuccugaccacccucucuaggaccagcaagaagcgcuccuggccccugaacgaagcaaucauggccguggggauggugucgauccucgcguccagccugcugaagaacgacauacccaugacggggccccucgucgcgggcggguuacugaccgugugcuacgugcuaaccggccggagcgccgaccuugagcuggagcgcgccgccgacgucaagugggaggaccaggccgagauuucagggucaagccccauacucagcauaaccauauccgaagauggaaguaugagcaucaagaacgaggaggaggagcaaacgcugaccauccugauccggaccggucuccuggugaucagcgggguguucccggucuccauccccaucaccgccgcggccugguaccugugggaggucaagaaacagagagcgggcgugcucugggacguccccagcccgccucccguggagaaggccgagcuggaggauggagcguacaggaucaagcagcgcggcauccugggcuacucacagaucggcgcuggcguuuacaaggagggcaccuuccauacgauguggcacguuacccgcggcgcuguccucaugcaccgcggaaagcggauugagcccuccugggccgacgugaagaaagaccugaucagcuacggcggaggcuggaagcuggagggcgaguggaaggagggggaggaaguacaggugcucgcccuggagcccggcaagaacccccgcgcagugcaaaccaagcccgggaucuucaagaccaacacgggcaccaucggggccgucagucuggacuucuccccaggcaccaguggcucccccaucguugaccggaaggggaaaguggucggcuuguacgggaauggcguaguuacacgcagcggggccuaugucuccgccauagcgcagacggagaaguccaucgaagacaaccccgagauagaggacgacaucuuccggaagaagcgccugaccaucauggaccugcaccccggggcagguaagacaaaacgguaccuccccgccaucgugcgcgaggccaucaaacgggggcugcgcacccugauacuggccccgacgcgcguagucgccgcugagauggaagaggcucuccggggccugcccauccgcuaucaaacgccugccauuaagaccgagcacacugggcgggagaucguggaccugaugugccacgccacguucaccaugcgccucuuaagccccguucgggucccgaacuacaacuuaaucauuauggacgaagcccacuucacagaucccgccuccaucgccgcacgcggcuacaucucuaccagaguggagaugggcgaggccgcggggaucuucaugacagccaccccgcccggcucgcgcgauccguuuccucagucaaacgcgcccaucauggacgaggagcgggagauccccgagcgcuccuggaacagcgggcacgagugggugaccgauuuuaaaggcaagaccguuugguucgucccgagcaucaaggcgggcaacgacaucgcggcaugucucagaaagaauggcaagaaggugauacaacuuucgcgcaagacguuugauucggaguacgugaagacccgggcuaacgauugggacuucguggucaccaccgacaucagcgagaugggcgcuaacuucaaggccgaacgcgugaucgaccccaggcgcugcaugaagccggugauccuuaccgauggggaagagcgcgugauccucgcgggcccaaugccggucacgcacuccucagccgcccagcgccgugggcgcaucggcagaaaccccaagaacgagaacgaccaguacaucuacaugggcgaaccccuggagaacgacgaggauugcgcacacuggaaggaggccaagaugcugcucgacaacauaaacacgcccgagggcaucauccccuccauguucgagccugagcgggagaagguggacgcaauugacggcgaguaucgccuccgcggggaggcccgcaagaccuucguggaucuaaugcggcgcggcgaccucccuguuugguuagcuuacaaaguggccgccgagggcaucaacuacgcggaccggaaguggugcuuugacggcacgaagaacaaucagauccuggaagagaacauggaaguggagaucuggaccaaggagggggagcgcaagaagcucaagccgcgguggcuggacgcccgcauauacagcgacccccuagcccugaaggaauucaaggaauucgccgcgggccggaagagcuuaacccugaaccucaucaccgagaugggcaggcugcccacguucaugacccagaaggcccggaaugcccuggacaaucucgccguccugcacaccgccgaagccggcggucgggccuauaaccacgcccugagcgagcuccccgagacccuggagacgcugcuucugcugacacugcuggccaccguaaccggggguaucuuucuguuccucauguccggcaaagggaucggcaaaaugacccuagggaugugcuguaucaucaccgccaguauccugcucugguacgcacagauccagccgcacuggaucgcggccuccauaauucuggaguucuuccugaucguacuccugauacccgagcccgagaagcagcggacaccccaggacaaucaguuaacauacguggugauagccauccuaaccgucguugccgcgacaauggccaaugagaugggcuuucuggagaagaccaagaaggaccucgggcuuggcagcaucaccacccaggagagcgagucaaacauccuggacauugaccugcgcccggcuagcgccuggacccucuacgccguggcgaccaccuuugucacccccaugcugcgucacuccauugagaacagcagcgugaacgugagcuugacggccaucgccaaucaggccaccguccucaugggccuggggaagggcuggccccugucgaaaauggacaucggcguaccccuccuagcgaucgggugcuacagccaggugaacccgauaaccuuaaccgccgcccuccuucugcucgucgcccacuacgccaucaucgggccgggccugcaggccaaagccacucgcgaggcccagaagcgggcugccgcggguaucaugaagaaccccaccguggauggcauaacugugauagaccuggagccgaucccguaugaucccaaguuugagaagcagcucggucaggugaugcugcuuauucuuugcgugacccagguucugaugaugaggaccacgugggcucugugcgaggcccucacccuggcaaccggccccauauccacgcugugggagggcaaccccgggcgguucuggaacaccaccaucgccgucagcauggcaaauaucuuucgcggcucauacuuggccggcgccgggcugcuguucagcaucaugaaaaacaccacguccacccgccggggcaccggcaacauuggugagacacucggggagaaguggaagucccgccugaacgcccuggggaaguccgaguuccagaucuacaagaaguccggcauccaggagguggaccggacgcuggcgaaagaggguaucaagcgcggagagacggaccaccacgcggugucgcgggguuccgccaaguuacgcugguucguugaacgaaacauggugacccccgaggggaagguggucgauuuggggugcggucgcggcgggugguccuacuacugcggcgggcucaaaaacgugcgggagguuaagggccugaccaaaggcgggccuggccacgaagagcccauucccaugagcacguacggguggaaccuugucagacuccagagcggaguggauguguucuuuaccccgcccgagaagugcgacacguugcugugcgauaucggggagucuagccccaaccccacgaucgaagccggccggacccuccgaguccuaaacuuaguagagaacuggcucaacaauaauacgcaguucugcaucaaggugcuuaacccguacaugcccuccgucaucgagaagauggaggcccugcagcggcaguacggcggugcccucgugcgaaacccccugagcagaaacaguacccacgagauguacugggugagcaacgccaccgggaacaucgucuccagcgugaacaugauaucccguaugcugaucaacagguucaccaugaagcauaaaaaggcgacguaugagccggacguggacuuaggcagcggcacccgaaacauagggauagaguccgaaauccccaaccucgacaucaucggcaagcggaucgaaaagaucaagcaggagcacgaaauaagcuggcauuaugaccaggaccacccuuacaagacuugggccuaccacgguuccuacgagaccaagcagacggggagcgcguccaguauggucaacggcguggugcgccugcuuacaaagcccugggacgucgugccaauggugacccagauggcgaugaccgacacaacccccuucgggcagcagcgcgucuucaaggagaaaguagacacccggacccaggaacccaaggagggcacgaaaaaacucaugaagaucaccgccgaauggcuguggaaggagcugggcaaaaagaaaacgccccgcauguguacucgugaggaguuuacgaagaagguccgcucaaaugccgcccucggcgccaucuucaccgacgagaacaaguggaagagugcgcgugaggccgucgaggacggucgauucugggaguugguggaccgggagcgcaaccugcaucucgaggggaagugcgagaccugcguguacaacaugaugggaaaaagagagaaaaagcugggggaguucggcaaggccaagggcucccgcgccauaugguacauguggcugggagcgcgguuucucgaguucgaggcacuaggcuuccugaacgaagaucacugguucagccgagggaauagccucuccggugucgagggggaggggcuccaucggcugggauauaucuugcgagacgugggcaagaaggagggcggggccauguacgcagacgacaccgccggcugggacacucggaucacccuggaggaccugaagaacgaggagauggucacuaaccauaugaagggggagcacaagaaacucgcggaggcaaucuucaagcugacauaccaaaacaagguggugcgcguccagcggccgacgccccgggggaccgugauggacaucaucagccggcgcgaccagcggggcagcggccaggucgggaccuacggacugaacaccuucacgaauauggaagcacaacucauccgccagauggagggcgaggguaucuucaagagcauccagcaccugaccgccaccgaggaaaucgccguccagaacuggcuggcgaggguggggcgggagcgccucucccggauggccaucucaggcgacgacugcgugguaaagcccaucgacgaccgcuucgcguccgcccugaccgcccugaacgacauggggaaggugcggaaggacauccagcagugggagcccagccgcggguggaacgauuggacucaggugccguucugcucccaccacuuccacgagcucgucaugaaggacgggcgggugcuggugguccccugcagaaaccaggacgaacugaucggccgggcgcgcauuucacagggcgccggguggucccuuaaggaaaccgccugcuuagggaagagcuacgcccagauguggacccugauguacuuccaccggcgggaccuccgccuggccgcuaacgccaucugcucggccgugccgucccauugggugcccaccucaaggaccacuuggagcauccacgcgaagcacgaguggaugaccaccgaggacaugcuggccguauggaaucggguguggauccaagagaacccauggauggaagacaaaacgcccguggaguccugggaggaggucccuuaucucggaaagcgggaggaccaguggugcggcagccugaucggccugacgagccgggccaccugggcaaagaacauccagaccgcgaucaaccaggugcgcucccucaucggcaacgaggaguacaccgacuacaugcccagcaugaagcgguuccgccgcgaggaggaggaggccggcguccugugguga

SEQ ID NO: 25069 - RNA, 9876 nt, Artificial Sequence
  derived and/or modified CDS sequence (opt11) from DENV-2__JF730052__SS-prME
accgcgggcgugauugucauguuaauaccaaccgccauggcguuccaccucaccacgcgcaacggggagccucacaugaucgugggacgucaggagaaggguaagucccugcuguucaagaccgaggacggugucaauauguguacgcucauggccaucgacuugggggagcugugugaggauacuauaaccuacaaguguccucuccugcgccagaaugaacccgaggauaucgacugcuggugcaacagcaccuccaccugggucaccuaugggaccugcaccaccaccggggagcaccggcgugagaagcgguccguggcccuggucccccacguggggaugggccucgaaacccgcaccgagaccuggauguccucagagggggccuggaagcacgugcagcggaucgagaccuggauccugcgccauccgggcuucaccaucauggcggcgauccuggccuacaccaucgguacgacacacuuucagcgggcgcugaucuucauccugcuuacggccguggcgcccucgaugaccaugcgcugcauuggcaucagcaauagagacuucgucgagggaguguccgguggcagcuggguggacaucguacucgagcacgggagcugcgugaccacgauggccaagaauaagcccacccuggauuucgaacugaugaaaaccgaggcgaaacagcccgcuacucuccgcaaguacugcauugaggccaagcugacaaauaccaccacagaaucucgguguccgacucagggcgagccgucucugaacgaggaacaggauaaacgauucaucugcaagcacagcaugguggaccggggaugggggaauggaugugggcuguucggcaagggcggaauaguaaccugcgccauguuuaccugcaagaagaacauggaggguaagguggugcagcccgaaaaccuggaauacaccauugucaucacgccacauagcggagaggagcacgccgugggcaacgacaccgggaagcacggcaaggagauaaagaucaccccgcaguccagcaucaccgaggccgagcugaccggguacggaacggugaccauggagugcucgccccggaccggccucgacuucaacgagaugguccugcuccagauggaagacaaggccuggcucgugcaccggcagugguuccuggaucugccacuccccuggcugccgggggccgacacgcagggcagcaacuggauccagaaggagacgcuggucacguucaagaauccccacgcgaagaagcaggacgucgugguccuagggagucaggagggcgccaugcacaccgcgcugacaggggccacggagauccagaugagcucugguaaccuccuguucacagggcaccugaagugccgcuuaaggauggacaagcugcaacugaaggggauguccuauagcaugugcaccggcaaguucaagauagugaaggagaucgccgaaacucagcacgguacgaucgugaucagaguccaauacgagggcgacggcuccccaugcaagaucccauucgagaucacggaucuggagaaacggcacgugcucgguagacugaucacagugaacccuaucgucacggagaaggacagccccguaaacaucgaggcggagccgccuuucggcgacuccuacaucaucaucggaguggagccgggacagcuuaagcucaauugguucaagaaagggagcucaaucggccagauguucgaaacgaccaugcgaggcgccaagcgcauggccauccugggggacaccgccugggacuucggcagccucgggggugucuucaccuccauagggaaggcguuacaccagguuuucggcgcgaucuacggugcagccuucagcggaguaucguggacgaugaagauccugaucggugucaucauuaccuggaucgggaugaacagucgauccaccucuuuauccguaagccuggugcucguuggcgugguaacccuguaucugggcgcaguagugcaggcggacuccggcugcguggugagcuggaagaauaaggagcucaagugcggcucggggaucuucauaacggacaacguccauaccuggacggagcaguauaaguuucaacccgagagccccagcaagcuggccucagccauccagaaagcucacgaggagggcaucugugggauccgcagcguuacccgccuggagaaccuaauguggaaacagaucacgccggagcugaaccacauacuguccgagaacgagguaaaacucaccaucaugacuggugauaucaaggggaucaugcaggcaggcaagcggagccugcgcccgcagcccaccgaacugaaguacucauggaagacguggggcaaggcuaagaugcucagcaccgagucccacaaccagacguuccugaucgacgggcccgagaccgcagagugcccgaacacgaaccgcgcauggaacaguuuagaggucgaggacuacggauucggagucuucaccaccaacaucuggcugaaacuucgcgagaaacaagacgucuucugcgacucaaagcuaaugagcgcggccaucaaggacaaccgugcagugcacgccgacaugggcuacuggaucgaguccgcccucaacgacacuuggaaaauggagaaggccagcuucaucgaggugaaguccugccacuggcccaagagccauacccuguggucuaacgguguccuggagagcgagaugaucauucccaagaacuuugcagggccugucucucagcacaauuaccgaccgggauaccacacgcagaccgcggggcccuggcauuugggcaagcuggagauggacuucgacuucugcgaagggaccacaguggucguuacggaggacugcgggaaccgcggccccucacugcgcaccaccaccgccucagggaagcucaucacagaaugguguugccgguccuguacccuuccuccgcuacgcuaucggggcgaggacgggugcugguacggcauggaaauccgcccccucaaggagaaggaggagaaucuggugaacagccuggucaccgcggggcacgggcagaucgauaauuucucguugggaguucuugggauggccuuguuccuagaagagaugcugagaacaaggauaggcacgaaacacgcgauuuugcuuguggcagucagcuucgugacccuuaccacuggaaacauguccuuccgcgaucuaggccgcgugauggucauggugggggccaccaugaccgaugacaucgguaugggugugaccuaccuagcccuccucgcagcguucaagguacgccccaccuucgccgcaggauugcugcucaggaaacucacaaguaaggaguuaaugauggcuaccaucgguaucgcccugcugucccagagcaccauccccgagacaauccuggagcugacggacgcgcuggcccuggggaugauggugcugaagaucgugcggaacauggaaaaguaucagcucgccguuacaauaauggcaauauccugcguaccaaacgcagugauccugcagaacgcguggaaggucagcugcaccauccuggccgccguguccgugagcccacucuugcugaccaguagccagcagaaggcagacuggaucccccucgcacugacgaucaagggccugaaucccacggccaucuuucuaacgacccugucccggacgagcaagaagcgcuccuggccgcugaacgaagccauaauggcugugggaauggugagcauccucgcgucuagcuugcucaagaacgacaucccaaugaccgggccccuagucgcgggaggacugcugaccgucugcuaugugcuuaccggccgguccgcugaccuagagcuagagcgcgcggccgaugucaagugggaggaccaggcagagauuuccgggagcucaccuauacugagcauuacgaucucggaagacggauccauguccauuaaaaacgaggaggaggagcagacccugaccauccugauacggaccggccucuuggugaucagugggguguucccggucuccauccccaucaccgccgccgccugguaccugugggaggugaaaaagcagagagcugggguacucugggacguccccagcccuccuccaguggaaaaggcggaacuggaagauggggcuuaucgcaucaagcagcgcggcauccugggguacagccagaucggcgcuggcguguacaaagagggaaccuuucacaccauguggcacgugacccggggagcuguucucaugcaccgggggaagcggaucgagccuucuugggccgacgugaagaaagaccuaauuuccuacggcgggggcuggaagcuggagggugaauggaaggaaggcgaggagguacaggugcucgcccuggaacccgguaagaacccccgggcggugcagaccaagcccgggauuuucaagacgaacacgggcaccaucggggcugucucccuagacuucucccccgguacaagcggcucccccauugucgaccgaaaggggaagguugucggucucuacggcaauggcguggugacgcguagcggcgcuuacguuuccgccaucgcccagacagagaagucgaucgaggauaaccccgagaucgaggacgacaucuuccggaaaaagaggcugaccaucauggaccugcauccaggggcugggaagaccaaacguuaccuccccgccauugugcgcgaagccauuaaacggggcuugcgcacgcuuauccuggccccgacgcgcguggucgcagccgagauggaggaggcccuccggggccugccaaucagauaccagacccccgccauuaagacggagcacacgggacgggagaucguagaccuaaugugucacgcgaccuuuaccaugcgccuccuuagcccggugcgcgugccuaacuacaaccugaucauuauggaugaggcgcauuuuaccgaccccgcguccaucgccgcccgcggcuacaucagcacgcggguggagaugggcgaggccgcgggcaucuucaugaccgccacgccucccggcucccgcgacccguuuccucaaagcaaugcccccaucauggaugaagagagagagauucccgagcgcagcuggaacagcgggcaugaguggguaaccgacuucaagggaaagacggucugguucgugccgaguaucaaggcugggaacgacaucgcggccugccuccggaagaacggcaagaaaguuauccaguugagccgcaagacguucgacuccgaauacgucaagacccgagccaacgacugggacuucgucgugaccacugacaucagcgagaugggggccaauuuuaaggcagagcgcgucaucgaccccagacgcugcaugaagccagucauccugaccgacggagaggaaagagugaucuuggcaggcccgaugccagucacucacucuagcgccgcccagcgccgcgggcgcauuggccgcaaccccaagaacgagaacgaccaguacauuuauaugggggaaccccuggagaacgacgaggauugcgcccacuggaaggaagcgaagaugcugcucgacaauaucaauaccccggaggggaucaucccguccauguucgagcccgagcgggaaaaaguggacgcgaucgauggugaguaccgacugagaggggaggccagaaagaccuucguggaucugaugcggcgcggagacuuacccguuuggcuggccuacaaaguggccgccgaggggaucaacuacgccgaccggaaguggugcuuugacgguacgaagaacaaccagauccuggaggaaaacauggagguggaaaucuggaccaaggagggcgagcgcaagaagcucaagccacgguggcuggacgcccguaucuacagcgacccccuggccuugaaggaguucaaggaauuugcggcgggucguaaguccuuaacccugaaccucaucaccgaaaugggccgcuuaccaacauucaugacccagaaggcccgaaacgcccuggacaaucucgccguacuccacaccgccgaagccggagggcgcgccuacaaccacgcccuuagcgagcucccagagacgcuggaaacacugcuucuucugacucuucuggccacgguuacuggaggcauuuuucuguuucucauguccgggaaggggaucggaaagaugacucuagggauguguugcauaaucaccgcguccauccuacucugguacgcgcaaauccaaccgcacuggaucgcugccuccaucaucuuagaguucuuccuaaucguccuccugaucccggagcccgagaaacagcggaccccucaagauaaccaacugacguauguggucaucgccauacucacugucguggccgcgaccauggccaacgagaugggcuuccuggaaaagaccaagaaagaccugggacucggcagcaucacaacgcaggagagcgaguccaacauccucgacaucgaccuacgaccggccagcgcguggacccucuacgccguagcgaccaccuucgugacgcccaugcuccgucacuccauugaaaauuccuccguaaacgugucccugaccgccauagccaaccaggccacgguccucaugggccuggggaaaggcuggccucugagcaaaauggacaucgguguaccgcuacucgcgauugggugcuacagccagguuaacccaaucacucucacugccgcauuauuacuucucgucgcccacuacgccauaaucgggcccggccugcaggcgaaggccaccagagaggcccaaaagcgggccgccgcgggcauuaugaagaaccccaccguggacgggaucacagugaucgaccuggagcccaucccguacgaccccaaguuugaaaagcagcucggccaggugaugcugcugauccucugcgugacacagguccugaugaugcgcaccaccugggcgcugugugaggcccucacccuggcgacugguccuaucuccacgcugugggagggcaaccccgggcgguucuggaacacgacaaucgccguaucaauggcuaacaucuuccguggcuccuacuuagccggcgccggucugcuguucagcauuaugaagaacacgaccucgacccgccggggcaccggaaacauaggggagacguuaggcgagaaauggaagucccgccugaacgcccuggggaaguccgaguuccaaauuuauaaaaagagcgggauccaggagguggaucggacccuugcaaaggaggggaucaagcgcggcgagacagaccaccacgccguguccagggggagcgcgaaguuaagaugguucgucgaacggaauaugguuaccccagagggcaaggugguggaucuggguugcggccgcggcgggugguccuacuacugcggcgggcucaagaacgugcgggaggugaagggccugacaaagggcgguccaggccacgaggaacccauaccgaugagcaccuacggguggaaucugguccggcuccagagcggcguugacgucuuuuucaccccgcccgagaaaugcgacacacuguuaugcgacaucggggaauccaguccuaaccccacuaucgaagccggccggacacuccguguccugaaccugguggaaaacuggcuaaauaauaauacccaguucugcauaaaggugcugaacccguacaugccauccgucaucgagaagauggaggcccugcagcgacaauacggcggugcgcucguucgcaacccacugagcagaaauucgacacaugagauguacugggugagcaacgcgacuggcaauaucgucucgagcguuaacaugaucucucgcaugcucaucaacagauucacuaugaagcacaagaaggccaccuaugagccggauguggaccuggguucugggacucgcaacaucgggaucgaguccgaaauccccaacuuggacaucaucggcaaacggauagagaagauuaagcaggagcacgagauuagcuggcacuaugaccaggaccaccccuauaagaccugggccuaccacggcucguacgagacgaagcaaacggguucagccucgagcauggucaacggcguugugcgccugcugacuaaacccugggacgucgugccgauggugacgcagauggcgaugacggacaccaccccauuuggacagcagagagucuuuaaggagaagguggacacccgcacacaggagcccaaggagggcaccaagaaauuaaugaagaucaccgccgaauggcucuggaaagaauugggcaagaagaagacgcccaggaugugcacgcgagaggaguucacuaagaagguccgcuccaacgccgcccuuggggcuaucuuuaccgacgaaaacaaguggaaguccgcgcgggaggcugucgaggauggccgcuucugggagcugguagaucgggagcgcaaccugcacuuagaggguaagugugagaccugcguguacaauaugaugggcaagcgggagaagaagcugggggaguuugguaaggccaagggcagccgcgcaaucugguauauguggcugggggcgcgguuccucgaguucgaggcgcugggcuucuugaacgaagaccacugguucagucgcgggaacucguugaguggagucgagggggagggccugcaucggcugggcuauaucuuacgcgacgucgggaaaaaggaaggcggggccauguaugccgacgacacggcuggcugggacacccggaucaccuuagaggaccugaagaacgaggaaauggucaccaaucacaugaagggggagcacaagaagcucgcggaggccaucuuuaagcugacguaccagaacaaagugguucgcguccagcggccgacgccccguggaaccgugauggacaucaucucucggcgcgaccagcgaggcuccggccaggugggaacauacggacuaaacaccuuuaccaacauggaggcccaguuaauucggcagauggagggcgagggcaucuucaagucuauacagcaccugaccgcaaccgaagagauagccguccagaauuggcucgcaaggguggggcgggagcgauugucccggauggccaucucgggcgacgacugcguggucaaacccaucgacgaccgcuucgcauccgcuuugacggcccugaaugacauggguaaggugcggaaggauauccagcagugggagcccucucggggauggaaugacuggacccaggucccauucugcucgcaucacuuccacgagcuagucaugaaggacggacggguguuaguagugccuugccgcaaucaagacgagcuuaucgggagagcgcgcaucucccagggugccggguggagccugaaggagaccgccugccugggcaagagcuacgcccagauguggacccugauguacuuucaccgccgcgaccuccggcuagccgcaaacgccaucugcuccgcgguacccagccacugggugccuaccagccgcacgaccugguccauccacgcgaagcacgaguggaugaccacggaggacaugcuagcggucuggaaccguguguggauucaggagaacccguggauggaggacaaaacgcccgucgaguccugggaggagguacccuauuuagggaagagagaagaccaauggugcggcagccugaucgggcugaccucccgggcaaccugggcaaagaacauccaaaccgccaucaaccagguacgcucccucaucgggaacgaggaguacacggacuacaugccuagcaugaagcgguuucgcagggaggaggaagaggccggcgugcugugguga

SEQ ID NO: 25070 - RNA, 9876 nt, Artificial Sequence
  derived and/or modified CDS sequence (opt11) from DENV-2__EU482748__SS-prME
accgccggcguaauugucaugcugauaccgaccgccauggcguuccaccucaccacccgcaacggggagccgcauaugaucgucggccggcaggagaaggggaagucccugcuuuucaaaaccgaggacgggguuaauaugugcacccucauggcgaucgaccugggggagcugugcgaggagacgaucaccuacaaguguccacucuugcgccaaaacgagcccgaagacauagacugcuggugcaauucuacuagcaccugggucaccuacggaaccugcacgaccacgggagaacaccggagagagaaacggucaguagcccucgucccccacgucgggaugggccucgagacacgcaccgagaccuggaugagcucugagggggcguggaaacacguucaacgaaucgagaccuggauccuccgucacccugguuucacaaucauggccgcgaucuuagccuauaccauugggaccacgcacuuccagcgggcccuuaucuucauccuucugaccgccguggcaccgagcaugaccaugcgcugcauagguauauccaacagggacuuugucgagggcgugagcggggguagcuggguggacaucgugcucgagcaugggagcugcgugaccacgauggccaagaacaaacccacccuggacuuugaacugaucaagacggaggccaagcagcccgccacuuuacguaaguacugcaucgaggcaaaacugacgaacaccaccaccgagucgcgcugcccgacgcagggcgagcccucacuuaaugaggaacaggacaagcgcuucauuugcaaacacucuaugguggaccggggcugggggaacggcugcggucuguucggcaaggggggcaucgugaccugcgcgauguucacguguaagaagaauauggaggguaagguugugcagcccgagaaccuggaguacacgauugucaucacaccccacagcggggaggagcacgccgucggcaacgacaccgggaagcacggcaaggagaucaagaucacuccgcaguccuccaucacagaggccgagcugaccggguacgguacggucaccauggagugcagcccccguaccggccuggacuuuaacgagauggugcuccugcaaauggaagauaaggcauggcucgugcaucggcagugguuccuggaccugccccuccccuggcugccgggggccgacacccagggcagcaacuggauccagaaagagacgcuggugaccuucaagaacccccaugccaagaagcaggaugucguuguccucgggucccaggagggcgccaugcacacagcacuaaccggggcuacggagauccaaaugagcagcggcaaccuccuguuuacaggccaucugaagugucgccuuaggauggacaagcuccagcucaaggggaugaguuacucaaugugcaccggcaaguucaagaucgugaaggagaucgcugagacccagcacggaacuaucgucauccgcguccaguacgaaggggacggcuccccaugcaagauccccuucgagaucaccgaucuugagaagcggcacgugcuagggcgacugaucacugugaacccgaucgugacugaaaaagacagcccggugaacaucgaggcggagccgcccuucggagacuccuacaucauuaucgggguugagccaggccagcugaagcucaacugguucaagaaagggucuucuaucggccagauguucgagacgaccaugcgcggcgccaagcggauggccauccugggggacacugcuugggacuuuggcagccuugguggggucuucaccuccaucgggaaggcccuccaucaagucuucggcgcgaucuauggcgccgccuucagcggaguguccuggacgaugaagauccugaucggcguuaucaucacuuggaucgggaugaacucacgauccacaagcuuguccgugagccuggugcucgucgggguggucaccuuguaucugggggccaugguccaggcggauuccggcuguguggugucuuggaaaaauaaggagcuaaagugcggguccgggaucuucaucaccgacaacguucacaccuggacagagcaguacaaguuccaaccggaaagcccaagcaagcuagccuccgcuauacaaaaggcccacgaggaggggaucugcggaauccggagcgugaccaggcuagagaaccucauguggaagcagaucacgccugagcugaaccacauuuuauccgagaacgaagugaagcucacuauaaugaccggcgacauaaaggguaucaugcaggccggcaagcggucccuacgcccgcagcccaccgagcugaaguacuccuggaagacgugggggaaagcgaagauguuaucaacggagucccacaaccagacguuccugaucgaugggcccgagaccgccgagugcccgaacacgaaucgagcauggaacagcuuagagguagaggacuaugguuucgggguguucacgaccaacaucuggcucaagcugagagagaagcaggacguguucugcgacuccaagcugaugagcgccgccauaaaggacaaccgggcgguacaugccgacaugggcuacuggaucgaauccgcccucaaugacaccuggaagauggaaaaggcaagcuuuaucgaggugaaguccugucauuggccaaagagccacacacuguggagcaacgggguacucgagagugagaugauaauccccaagaacuuugccgggccagucucccagcacaacuaccgcccgggcuaccauacgcagacugcggggcccuggcaccucggcaaacuggaaauggacuucgaucugugcgaggggaccaccgugguggugacugaggacugcggcaaccggggcccgagcuugcgcacgaccaccgcuucugggaaacugauuaccgaguggugcugcaggucaugcacacugcccccccuccgcuaccggggggaggacggguguugguacggaauggaaauccgcccucugaaggagaaggaggagaaccuugugaacagccuaguuaccgcugggcauggucagaucgacaacuucucccugggcgucuuggggauggcgcucuucuuggaagagaugcugcggacgcgcauaggcacgaaacacgcaauccuccucguggccguaagcuucgucaccuugauuacugggaacauguccuucagggaccucggccgcgucauggugauggucggcgccaccaugacggacgauaucggcaugggugucacauaccuugcucuguuagcggcguuuaaagugcgccccaccuucgccgcagggcuucugcuccggaaguuaaccagcaaggagcugaugauggccacgaucgguauugcgcuccugucacagagcaccaucccugagacaaucuuagagcucaccgaugcccuggccuuagggaugaugguccucaagaucgugagaaauauggaaaaguaccagcuggccguaacaaucauggcaaucuccugcgucccgaacgcugugauccugcaaaaugcauggaaggucagcuguacaauccucgccgccguguccguuucaccacuguugcucaccuccagccagcagaaggcggacuggaucccccucgcucugaccauuaagggucuaaaccccacggccaucuuccuaaccacucugagccgaaccagcaaaaagcgcuccuggccucucaacgaggcgaucauggccgucggcauggugagcauccuggcuucuagccugcuuaagaaugauauaccuaugacagggccccugguggcgggcgggcugcucacagucugcuacguucucacaggacggagugcggaccuggagcucgagcgcgccgccgaugugaagugggaggaccaggccgagauauccgguucuuccccuauauuaagcaucaccaucuccgaagauggcagcaugaguauaaagaacgaggaggaggagcaaacgcugaccauccucauccggaccggccugcuggucaucagcgggguguucccgguguccauacccaucaccgcggcagccugguaccucugggaggucaaaaaacaaagagccggcgugcugugggacguaccuagccccccgccuguggagaaggccgaacuggaagauggggcguaccgaaucaagcagcgcggcauccucggguacucgcagaucggcgcagggguguacaaggaggggaccuuccacacgauguggcacgugacucggggcgccguccugaugcaccgcgggaagcggaucgaaccuagcugggccgacgugaagaaggaccucaucuccuacggagggggcuggaaguuggagggcgaguggaaggagggagaagagguucaaguccuggcccuggagcccggcaagaauccacgugcgguacagaccaagcccgggaucuucaagacaaacacagguacuaucggggccgugagccucgauuucucaccuggaaccagcgguaguccgaucguggaucggaaagggaaagugguaggccuguacgggaacggcgucgugacccgcucuggcgcauacgucuccgccaucgcgcagacggaaaaguccaucgaagacaauccugagauugaagacgacaucuuccggaagaagcgccugaccaucauggaccuccaccccggggccggcaagaccaagagauacuuaccggcaaucguccgcgaagcuauaaagcgggggcuccgcacccuaauccucgccccgacgcgcgugguggcggccgagauggaggaggcccugagaggccuucccauccguuaccagacccccgcuauaaagacggaacacaccggacgggagaucgucgaccucaugugccacgccacguucaccaugcgguuacugagccccgugcgggugccgaacuacaaccucaucaucauggaugaggcgcacuucaccgaccccgccuccaucgccgcccgcggcuacaucagcacccgggucgagaugggcgaggcagcggggaucuucaugacggccacgccgcccggcucacgcgacccauucccccaaagcaaugcucccaucauggacgaggagcgggagauccccgagcgcuccuggaacucaggucacgaauggguuacagacuuuaagggcaagaccgucugguuugucccguccaucaaagcugggaaugacaucgcagccugccugcggaaaaacggcaagaaggugauccagcugucgcguaagacguucgacuccgaguauguaaagaccagggcuaacgacugggacuucgucgugaccaccgacaucagcgagaugggcgccaacuucaaggccgagcgcgugauagacccccgacgcugcaugaaacccguaauccuuacagacggggaggagcgagucauccuggcgggccccaugccugugacccacuccagcgccgcccagagacggggucgcaucggccgcaaccccaagaacgaaaaugaccaguacaucuacaugggggaaccacuggagaacgacgaggacugcgcccacuggaaagaggcuaagaugcuccuggacaacauaaauaccccagagggcaucaucccguccauguucgagcccgagcgggagaaggucgaugccaucgacggugaauacagacugcgcggugaggcccguaaaaccuucgucgaccucaugcggcgcggggacuugcccguguggcucgccuacaaggucgccgccgagggaaucaacuaugcggaccgaaaguggugcuucgauggaauaaagaacaaccagauccucgaggagaacauggagguggaaaucuggacgaaggagggggagaggaagaagcugaagccgcgguggcuugacgcucgcaucuacagugacccccuugcucugaaggaguucaaggaguuugcggcgggacggaagagucugacguugaaucugauaaccgagaugggcagacuuccgaccuucaugacgcagaaggcccggaacgcccucgacaacuuggcuguccugcacaccgccgaggccgggggucgcgccuacaaccacgcucucagcgaacugcccgaaacccuagagacgcuucuguugcucacgcugcuggccacaguuaccggcggcaucuuccuguuccuaaugucuggaaagggaaucgggaaaaugacauugggaaugugcugcauuaucaccgccagcauccuccuuugguacgcgcagauccagccgcauuggaucgccgccuccauaauccuggaguucuuucucaucguacugcugauaccugaacccgagaagcaacggacgccccaggacaaucagcuaaccuauguaguaaucgccauccugaccguggucgcagcgacuauggccaaugagauggguuuccucgaaaagacgaagaaagacuugggacugggcagcaucacuacccaagagucggaaagcaacauucuggacaucgacuugcgcccggccagcgcguggacccuguaugcaguagcgacgaccuucgugaccccuaugcugaggcacucuauugagaacagcucagugaacgugagccugacugcaaucgccaaccaggccacggugcugaugggccuggggaaaggcuggccccucagcaagauggacaucggggucccccugcuggcgaucgguugcuacagucaggugaacccgaucacccucacugccgcccugcuacuauuaguggcccacuacgccaucaucgguccaggccugcaggcuaaggccacccgagaagcucagaagagggccgccgcgggcaucaugaagaacccgacgguagacgggaucaccgugauugaucucgagccuaucccguacgaucccaaguucgagaagcagcugggucaggugaugcuccucauccugugugucacccaggugcugaugaugcggaccacgugggcccuuugcgaggccuuaacacuggccaccgggcccaucuccacccucugggagggcaaccccggucgguuuuggaacacgaccaucgccgugagcauggcgaacaucuuucgaggcuccuaccuggccggcgccgggcuccuguuuagcaucaugaagaacaccaccuccacgcgccgggggaccgggaacaucggggagacccugggcgagaaguggaaguccagacuaaacgccuuagggaaguccgaguuccaaaucuauaagaagucuggcauccaagagguagaccguacccuggcgaaagaagggaucaagcgcggcgagacggaccaccacgccgucucgagagggucggccaagcugcgcugguucguggagagaaacauggucacaccggagggcaagguggucgaccucgggugcgggcgcggcggguggucauacuacugcggcgggcuuaagaacguucgggagguaaagggccugaccaaaggcgguccaggccacgaagagccuauucccaugucuacguacggguggaaccucgugcgccugcaaagcggugucgauguguuuuucacgccgcccgagaagugcgacacccugcuuugugacauaggggaguccagccccaacccgaccaucgaggccggccguacccugcgcgugcugaaccucgucgaaaacuggcuaaauaacaacacccaguucuguaucaaagugcuaaacccauacaugccuuccgugauugagaaaauggaggcccuccagcgaaaauacgguggggcgcuaguacgcaacccucugagccggaacagcacucacgagauguacugggugagcaaugccaccggcaacaucguuuccagcgugaacaugaucucgcgcaugcugauuaaccgcuucaccaugaagcauaaaaagaccacguaugagccggacguggaucucgggagcggcacccgcaacauagggauagagagcgagauccccaacuuggacaucaucggcaagcggaucgagaagaucaaacaggagcaugagaccagcuggcacuacgaucaggaucaccccuacaagaccugggccuaccauggcuccuacgagaccaaacagaccgggagcgcaucaagcauggugaacggcgucgugcgccugcucaccaagcccugggacguaguuccgauggugacccagauggccaugacggacaccacucccuucgggcagcagcgcguguucaaggaaaaagucgacacccggacgcaggagcccaaggaggggaccaagaagcuuaugaagaucaccgcugaguggcucuggaaagagcuaggcaagaagaagacuccccgcaugugcacgcgggaggaguucacccgcaaggugcgguccaacgccgcccugggggcuaucuucaccgacgagaacaaguggaaguccgcucgcgaggcgguggaggacggacguuucugggagcugguggaccgggagagaaaccuccaccuggaggggaagugcgagacgugcguguacaacaugauggguaagcgagagaagaaacugggugaguucggcaaggccaagggcucccgggccauaugguacauguggcucggagcuagguucuuagaguucgaggcgcuaggcuucuugaacgaagaucacugguuuagccgggguaauagccuguccgggguugagggggagggacugcaccgcuuaggcuacauccugcgggacgucagcaaaaaggaaggaggcgccauguacgcugacgacacagccggaugggauacccgcauaacccuggaggaccucaagaacgaggagauggugacaaaccauaugaagggcgaacacaagaagcuggcggaggcuaucuucaagcuuacguaccagaacaaggucguucggguccagcgaccuacgccucgagggacggucauggacaucaucucccgccgcgaccagaggggcagcggccaggugggaaccuacggccucaacacguucacgaauauggaggcucagcugauccggcagauggagggggaaggaaucuucaagucaauccagcaucugaccgccaccgaggagaucgugguccagaacuggcucgcccgggugggacgcgagcgguugucgcgcauggccaucuccggcgacgacuguguggugaagccgauagacgaccgguucgcaagcgcccugacggcccuaaacgacauggguaaggugaggaaggacauccagcagugggagcccuccaggggguggaacgacuggacgcaggugccguucugcucccaccacuuucacgagcugguuaugaaggacggccgcgugcuggugguccccugccggaaccaggacgagcucaucggucgcgcaagaaucucgcagggugccggguggagccugaaggaaaccgccugccuggggaaguccuaugcccagauguggacccucauguacuuccacaggcgggaccugcgccuggcugccaacgccaucugcagcgcggugcccagccacugggugcccaccagccgcacgaccuggagcauccacgccaagcacgaguggaugaccaccgaggauaugcuugcggucuggaauagaguuuggauacaggagaaccccuggauggaagacaagacgccgguggagucgugggaggagguucccuaccuaggcaagcgggaggaccaguggugcggcagcuugauaggccucaccucccgcgccaccugggcgaagaauauccagaccgcuaucaaccagguccggagcuuaaucgggaacgaggaguacacggacuacaugccguccaugaagagguuccgccgggaagaggaggaggcaggcgugcuuugguga

SEQ ID NO: 25071 - RNA, 9876 nt, Artificial Sequence
  derived and/or modified CDS sequence (opt11) from DENV-2__EU482749__SS-prME
accgcgggcgugaucgugaugcugauccccaccgcuauggccuuccaucuaaccacccggaacggggagccgcacaugaucguuggucggcaggagaaggggaagucccugcuguucaagacggaggacggugugaacaugugcaccuuaauggccaucgaccuuggggagcucugugaggacacuaucacuuacaaguguccccuccuacggcagaacgagccugaagacaucgacugcuggugcaacagcaccagcaccugggucaccuacgggaccugcaccacaacgggagagcaccggcgcgagaaacgguccguggcgcuggugccucacgucggcaugggccucgagacccgaaccgagacauggaugaguuccgagggggccuggaagcacguucagaccauagagacguggauccuucggcacccgggcuuuacuaucauggcggcgauacuggccuacaccaucgggacgacccacuuucagcgcgcgcucauuuucauccugcugacugcaguagcccccucgaugacgaugcgguguaucggaauaaguaaccgcgacuucgucgagggcgugagcgguggcucuuggguggauaucguacucgaacaugguagcugcgugacgacuauggccaagaacaaacccacccuagacuucgagcugauuaaaaccgaggccaaacagcccgccacgcuacgcaaguauugcaucgaagcuaaacugacgaacaccaccacggagucccgcugcccuacucagggcgaacccagccuguccgaggagcaggacaagcgguucauuugcaagcacagcaugguggacagaggcugggggaacggaugcgggcuguucggcaagggcgggaucgucacgugcgcgauguucacgugcaagaagaacauggaaggaaaaguggugcagcccgagaaccucgaauacacaaucgucaucacgccccacuccggugaggagcacgccgugggcaacgauaccgguaagcacggcaaagagauaaagaucaccccccagucguccaucacagaagccgagcugaccggauacggcaccgugaccauggagugcagcccgcggaccggccuugacuucaacgaaaugguacugcugcaaauggaggauaaggccuggcucgugcaccgccagugguuccuggaccugccccuccccuggcugccgggugccgacacacagggauccaacuggauccagaaggagacccuggucacuuucaaaaacccccacgcgaagaagcaggacguugugguccucgggagccaggagggggcuaugcacaccgcccugacgggggccaccgagauucagaugagcuccggcaauuuacuguuuaccggccacuugaagugccggcugcgcauggacaagcuccagcugaaggggaugagcuacuccauguguaccggcaaguucaagaucgugaaggagauugccgagacgcagcacgggaccaucgugauccggguccaauacgagggcgacggaagcccaugcaagauuccuuucgagauuaccgaccuugagaagcgccaugugcuggggaggcuaaucaccgugaauccaaucgugacggaaaaggacuccccagugaauauagaggcggagccgccguucggcgauagcuauaucauuaucgggguggagccaggccagcugaagcucaacugguuuaagaaggggagcuccaucggucaaauguuugagaccaccaugcgaggcgcaaaaagaauggccauccugggggacaccgccugggacuucggcucccucgggggcguuuucacgucuaucgggaaggcccuccaccaaguuuucggcgcgaucuacggcgccgcguucuccgggguuucguggaccaugaaaauccucaucggaguaaucauaaccuggauagguaugaacucgcggagcaccucccugagcgugucccugguguuagucggcgugguaacgcuguaccugggggccaugguccaggcggacagcgggugcguaguguccuggaaaaacaaagaacucaagugcggcagcgggaucuucauaaccgacaacguccacacauggacagagcaguauaaguuccagccagagaguccguccaagcuggccagcgccauacagaaggcccaugaggagggcauaugcgguauccgcuccgugacccggcuggagaacuuaauguggaagcagauaacgccggagcugaaucacaucuugucggaaaacgaaguuaagcucaccaucaugacaggcgacauccgcggcaucaugcaagccggcaagaggucccugcgcccgcagcccacugagcugaaauacucuuggaagacauggggcaaggcgaagaugcucaguacugagagccacaaucaaaccuuccugaucgacgggcccgagacagcggagugcccgaacaccaaccgggccuggaacucacuggaagucgaggacuacggauucgggguguucaccacaaacaucuggcucaagcugcgcgagaagcaggacgucuuuugcgauagcaaacugaugucggccgccaucaaggacaaccgggcugugcaugccgacaugggcuacuggaucgaaagcgcccucaacgauacguggaagauggagaaggcauccuuuaucgaggucaagucuugucacuggcccaagagccacacgcuguggucuaacggcgugcuggaguccgagaugaucaucccuaaaaacuucgccgggcccgugagccaacacaacuaccgcccgggguaucacacccagacggcagggcccuggcaccugggcaagcuggagauggacuucgaccuaugcgaggggaccacggucguggucacagaggacugcggcaaccggggccccagccuccgaacuaccacggccuccggcaagcugauaaccgagugguguugccggagcugcaccuugccuccgcuccgcuaccgaggcgaggacgggugcugguacggcauggagauccgaccccugaaggagaaggaagagaaccugguaaacucacucgugaccgccgggcacggccaaaucgacaacuucucacuggguguccucggcauggcccucuuccuugaggagaugcuucggacgcgaaucgggacaaagcacgcaauccuccucguagccguguccuucgucacucugaucaccgggaacaugucuuuucgggaccucggccgcgugaugguuauggucggggcgacuaugacugacgacaucggaaugggcguuacauaccuggcccuucucgccgcguucaaggugcguccgaccuucgccgccgggcugcuucuccggaagcucacgucgaaggaacugaugauggccaccaucggcaucgcccuccuuucgcagucgacgauccccgaaacuauacuggagcugacggacgcgcuagccuuagggaugaugguccucaagaucgugcgcaauauggagaaguaccagcuggccgugacuauuauggcaauaucauguguccccaacgcggugauccuucaaaaugcguggaagguguccuguacuauucucgccgccgucagcgugucuccccuacuccuaacuagcucccagcagaaggccgacuggaucccccuugcgcugacuauaaagggccuuaacccuaccgccaucuuccugaccacccuuagccggaccuccaagaagcgcucauggccccucaacgaggccaucauggccgucggcaugguuuccauacuggccagcuccuugcucaaaaacgacauacccaugaccgguccgcugguugcgggcgggcugcucacagucugcuacgugcugacaggccgauccgccgaccucgagcuagaaagagccgccgacgugaagugggaggaccaagccgagaucucgggguccagccccauccuguccauaacaauuagcgaggacggcuccaugucaaucaagaaugaggaggaggagcaaacacugaccaucuugauccggaccggcuuacugguuaucuccgguguuuucccagugagcaucccuaucacagcggccgccugguaucucugggaggucaagaaacagcgugcgggaguacucugggacguccccucacccccccccguggagaaggccgaacuggaggacggggcauaccggaucaagcagcgcgguauccucggguacucccagaucggugccggcguguacaaggaggggacauuccacaccauguggcacguuacaagaggcgccgucuugaugcauagggggaaacggauugagccguccugggccgacgugaagaaggaccugauaagcuacggugggggauggaagcucgagggcgaguggaaggagggagaggaggugcagguucuggcccuggagcccggcaaaaauccccgcgccguacaaaccaaacccggaauauucaagaccaacaccggcaccaucggagcugugucccucgacuucagccccggcaccucagguagcccgaucgucgaccguaagggaaagguggugggacuauaugggaacgggguugugacgagguccggagccuacgucagcgcuaucgcgcagaccgaaaagagcaucgaggacaauccggagauugaggacgacaucuuucggaagaagcgcuuaaccauuauggaccuccacccgggugccggcaagacgaagcgguaccugccugccaucguccgcgaggccaucaagcgggggcugcgcacgcugauccucgcgccgacccgcgucguugcggcagagauggaggaggcccugcggggccugcccauccgcuaccagaccacggccaucaagacugagcacaccgggcgagagaucgucgaccucaugugucacgccacauucaccaugcgccuccugucccccgugcgcgugcccaauuauaaccucauuaucauggacgaagcgcacuucacugacccugccagcauagccgcuagaggcuacaucaguacacggguagaaaugggcgaggccgccgggaucuucaugaccgccacgccaccagguagccgagaucccuucccccagucaaacgcucccaucauggacgaggagcgggagauccccgagcgaagcuggaacucggggcacgagugggugacggacuucaaagguaagaccguaugguucguccccagcaucaaggccgggaacgacaucgcggcuugucugcggaagaacggcaagaaggugauccagcucucccgcaagaccuucgacucugaguacgugaagaccagagccaacgacugggauuucgucgugacgaccgacauauccgagaugggcgccaacuucaaggcugagcgcgugaucgacccgcggcgcuguaugaagccggucauucucaccgacggggaggagcgggugauacuggcaggacccaugccggugacacacagcagcgcggcucagcgccggggucgcaucggccguaacccgaagaaugagaaugaccaguacaucuacaugggcgagccccuggagaaugacgaagacugcgcacauuggaaggaagccaagaugcucuuggacaauauaaacacccccgagggcaucauccccucgauguucgagccggagcgggaaaaggucgaugcgaucgacggcgaauacaggcuccguggcgaggcccgcaagacauucguggaccugaugcgucgcggcgaccugccgguuuggcuggccuacaaggucgccgccgaagggauuaacuacgcggaccggaaguggugcuucgauggcaucaagaauaaucaaauccucgaggaaaauauggagguggagaucuggaccaaggagggggagcgcaagaaacugaaaccccgguggcuggaugcccgcauauacuccgacccucucgcccugaaggaauucaaagaguucgccgcgggcagaaagucacugacccucaaccugaucacagagaugggccgccugcccaccuucaugacccagaaggcucgcaacgcccucgacaaccucgccgugcugcacaccgccgaggccggugggcgcgccuacaaccacgcucucuccgagcucccugaaacucuggaaacccucuugcuccucacucugcuggccaccgucacaggaggcaucuuucucuuccugaugagcggcaaggguaucggcaagaugacgcugggcauguguugcauuaucacugccuccauucucuuaugguacgcgcagauccagccccacuggaucgcugccagcauaauccuggaguucuuucucaucgugcuacugaucccggagcccgagaagcagcguacgccccaggacaaucagcucacuuacguggugaucgccauccugacgguggucgccgcgaccauggcaaaugagaugggcuuccuggagaaaacaaagaaggaccugggguugggauccauuaccacgcaggagagcgagagcaacauccuggacauugaccuccgccccgccagcgccuggacccuauacgccgucgcgacuaccuucguuacgccuaugcugcggcacagcauagagaacuccagcgucaaugugucgcucaccgcaaucgccaaucaggccaccgucuuaaugggccuggggaagggcuggccccuaagcaagauggacaucgggguuccucugcuggcgaucggaugcuacagucaagugaacccaauuacccugacugcagcgcuacugcuccugguagcccacuacgcuaucaucgggccaggccugcaggcgaaagccacccgugaggcccaaaagcgggcugccgcggguaucaugaaaaaccccaccguagacgggaucaccguaauagaccucgagccuauccccuacgacccgaaauucgagaagcagcugggccagguaaugcugcuaauccugugcguaacccaaguccugaugaugcgcaccaccugggcucucugcgaggcgcugacgcuugcgacuggucccaucagcacacucugggagggcaacccggggcgguucuggaacaccacuaucgccguguccauggcaaacaucuuccggggcaguuaucuggccggcgccgggcuccuguuuucaaucaugaagaacaccacuaauacccgccggggcaccgggaacaucggggagaccuuaggcgagaaguggaaaucccgcuugaacgcccuagggaaguccgaauuccagaucuacaagaaauccggcauccaggaggucgaccggacccuggcuaaggaggggaucaagcgcggggaaaccgaccaccacgccgugucacgggggucggcaaagcugcgcugguucgucgagcggaacaugguuacccccgagggcaaggugguagaccuugggugcgggcguggcgggugguccuauuacugcggcggguugaagaacguccgggaggugaagggccugacgaagggcgggccgggccacgaggaacccaucccgaugagcacguacggguggaacuuggugcgccuucagagcggagucgacguguucuucacgccgcccgagaagugcgacacccugcucugcgacaucggcgaguccagcccaaaucccacuaucgaggcaggcaggacucugcgcgugcuuaaccucguugaaaauuggcugaacaauaacacccaguucugcaucaagguguugaacccguacaugcccuccgugaucgagaagauggaggccuuacagcggaaguacggcggggcucucguccgcaauccccugagccgcaacucaacgcacgagauguacugggugagcaacgccaccggcaacaucguguccagcgucaauaugauuucccgcaugcugauaaaucgauucacgaugaagcacaaaaaggccaccuacgagcccgacguggacuuagggagcggaacccguaacaucgggauagagagugagauucccaaccuggacaucaucggaaagcggaucgaaaagauaaagcaggagcacgaaaccaguuggcacuacgaccaggaccaucccuacaaaacgugggccuaccauggcaguuacgagacaaagcagaccgggagcgccuccagcauggugaauggcguggugcgccuacucaccaagccaugggacgucguccccauggugacgcaaauggcgaugaccgacaccaccccguucggucagcagaggguguucaaggagaagguugacacgcggacgcaggaacccaaggagggcacaaagaagcuaaugaagaucaccgccgaguggcuguggaaggaacucggcaagaaaaagacgccccguaugugcacccgggaggaguucacucgcaaggugcgguccaacgccgcccuaggggccaucuucaccgacgagaacaaguggaaguccgcacgcgaagccguggaggauggccgguucugggaguuggucgaccgcgagcgaaaccuucaccuggaggggaagugcgagacgugcgucuacaacaugaugggcaagcgcgagaagaagcugggggaauucgguaaagccaaagguucccgggccaucugguacauguggcucggggcgcgguuccuggaguucgaggcccugggcuuucucaacgaggaccacugguucagccgggggaacagccugucagggguggagggggagggccugcaccggcucggcuauauccuccgggacguugggaagaaagagggcggagccauguacgccgacgacaccgccgggugggacacccgcauaacccuggaagaucucaagaacgaggagauggucaccaaccacaugaagggggagcacaaaaagcuggcggaggccauuuucaaacucaccuaccagaauaagguagugcgggugcagcgccccaccccgcgggguacggucauggacaucaucagcaggcgcgaccagcguggcuccggccaggugggcacguacggacugaacacguucacgaacauggaggcccaguuaauacgccagauggagggcgaggggaucuucaagagcauacaacaccugaccgccacggaagagaucgccgugcagaacuggcucgcgcgggucgggagagagagacugucccgcauggccaucagcggggacgacugcguugugaagcccauagacgacagguucgccucagcucugaccgcccucaacgacauggguaaaauccgcaaggacauccagcagugggagccuucucgggguuggaacgauuggacccagguccccuucugcucacaucacuuccacgagcuggucaugaaggacgggcgaguacuggucgugccgugccgcaaccaagacgaguugaucggccgagcccggaucagccagggcgccggguggucccucaaggagaccgcgugucuuggaaaguccuaugcucagauguggacccucauguauuuucaccgccgggaccugcgccuggccgcgaacgccaucugcucggccgugcccagccacugggucccuacguccaggaccaccuggucuauacaugccaagcacgaauggaugaccacugaggacauguuggcgguauggaaucgcguguggauacaagagaaccccuggauggaagacaagaccccggucgaguccugggaggaggugccguaccuugguaagcgggaggaccaguggugcggcagccugaucgggcucacuagccgcgcaaccugggccaagaacauccagacagcgaucaaccaggugcgauccuuaaucggcaacgaggaauacaccgacuacaugccuucaaugaagcgguuucgccgugaagaagaggaggccggcguacugugguga

SEQ ID NO: 25072 - RNA, 9876 nt, Artificial Sequence
  derived and/or modified CDS sequence (opt11) from DENV-2__EU482751__SS-prME
accgcgggcgugauugucauguuaauuccaaccgcuauggcguuccaccucaccacccgcaacggggagccccacaugaucgugggccgccaggagaaggggaagucacugcucuucaagaccgaagauggcgugaacaugugcacgcucauggccauagacuuaggggagcugugcgaggacaccaucaccuauaagugcccccuccugagacagaacgagcccgaagacauugacugcuggugcaacucaacaucuaccuggguaaccuacggcacuugcaccaccacgggcgagcaccgccgcgagaagcgguccguggcccuggugccccacgucgggaugggccuugagacgcgcaccgagacauggaugagcagcgagggugccuggaagcacgugcagcggauagagaccuggaucuugcgccacccgggcuuuacgaucauggccgcuauccuggcauacaccauuggcacgacgcacuuccagcgggcccucauauucauccugcugacugccguugcgcccagcaugacuaugcgcuguaucggcauuagcaaccgggacuucgucgagggcgugagcgggggcagcuggguugacaucguccucgagcacggguccugcgucaccacgauggccaagaacaagccuacucuagacuucgagcugaucaaaaccgaggccaaacagcccgccaccuugcguaaguacugcaucgaggccaagcugacgaacaccacuaccgagagccggugcccgacucagggcgagccgagccuaaacgaagagcaggacaagcguuucaucugcaagcacuccaugguggaccgggggugggggaacggcugcgggcuguucggcaagggcggcauugugaccugcgcgauguucacgugcaagaagaacauggaggggaaggugguucagcccgagaacuuagaguauaccaucgucaucacgccccacucuggggaggagcacgccgugggcaacgacacugguaagcacggcaaagagaucaagaucacgccgcaguccagcaucacugaggccgagcugaccggguacggcacgguuaccauggagugcagcccccggaccggccucgacuuuaacgagaugguacugcugcagauggaggacaaggccuggcucgugcaccggcagugguuccuggaccugccuuugcccuggcugccgggggccgacacccaagggagcaacuggauccaaaaggagaccuuagugaccuucaagaacccccaugcgaaaaagcaggacgucgugguccuagggagucaggagggggccaugcacaccgcccugaccggggccacggagauccagaugaguagcggaaaccuccuguucaccggccaccugaagugucgccugcguauggacaagcuacagcugaaggggaugaguuacagcaugugcacaggcaaguuuaagauagucaaggagaucgccgagacccagcacgggacgaucguuauccgaguccaauacgagggcgacggcucccccugcaaaauccccuucgagauaacugaccuggagaagcggcacguguuagggaggcugaucaccgugaacccgaucgucaccgagaaggacagccccgugaauaucgaggcugagccgcccuuuggcgacuccuacaucaucauugggguggagccggggcaacugaagcuuaacugguucaagaaggggagcagcaucggacagauguucgagacgacaaugcguggggccaagcggauggccauccugggggacacagcaugggauuucggcucucuaggaggagucuucacauccauugggaaggcacuucaccagguuuucggcgcgauauacggagccgccuucucaggggugucuuggacgaugaagauccugaucggcguaaucaucaccuggaucggcaugaacagccgcuccaccuccuuauccgugagccuggugcuuguaggcguggugacguuauaccugggggccgucgugcaggcggacaguggcugcguggucagcuggaagaauaaggagcucaagugcggcuccgggauauucaucacggacaacgugcauaccuggaccgagcaguacaaguuccagcccgagagccccagcaagcuggccuccgccauacagaaggcgcacgaggagggcaucugcgggaucaggucugugacccgccuggaaaaccucauguggaagcagaucacucccgagcugaaucacauccuguccgagaaugaagucaagcucaccaucaugaccggcgacauuaaggggaucaugcaagccggcaaacggagccuacgcccgcagcccaccgagcugaaguacuccuggaagacguggggcaaggcgaagaugcucagcacugagucccacaaccagaccuuccugaucgacgggcccgagacagccgaguguccgaacacgaaccgggcauggaauagcuuggagguggaggacuacggguucgggguguucacuaccaacaucuggcucaaacucagagagaagcaggacgucuucugcgacagcaagcugaugagcgccgcgaucaaggacaaccgggcggugcacgccgacaugggcuacuggaucgaguccgcccucaacgacaccuggaagauggagaaggcuagcuucaucgagguuaaauccugucacuggcccaagagccacacccuuugguccaacggcgucuuggagagcgagaugauuauccccaagaacuucgccgggcccgugucacagcacaacuaccgcccgggcuaucauacgcaaaccgcggggccguggcaucucggcaaacucgagauggauuuugauuucugcgaggggaccacuguggucgugacagaggacugcgggaacaggggacccagcuugcgcaccaccacggccuccggcaagcucaucaccgaguggugcugccgguccugcacccuuccuccgcugcgcuacaggggcgaggacgggugcugguacggaauggaaauccgaccccucaaggagaaggaagaaaacuuggugaacagccuaguaaccgccgggcacggccagaucgauaauuucuccuugggcguucuugggauggcacuguuccuagaggagauguuacggacgcgcaucggcacgaagcacgcgauucugcucgucgccgucagcuuugugacccugaucaccgggaacauguccuuucgggaccuggggcguguaauggucauggugggggccaccaugacggacgacaucggcaugggcgugaccuaccucgcccugcuggccgcguuuaagguccgccccaccuucgccgcagggcuccugcugcgcaagcucaccagcaaagaguugaugauggccacgaucggcaucgcguugcugucccagucgacuauacccgagaccauacuggagcugacggacgcgcucgcccuaggcaugauggugcugaagaucgugcgcaauauggagaaguaccagcucgccgucacgauuauggccaucuccugcgucccgaaugcaguaauccugcagaaugcguggaaggucaguugcaccauccuggccgccguguccgucagcccucuccuacugaccuccagccagcagaaggccgacuggauaccccuggcgcugacgaucaagggccugaaccccacggccaucuuccucacaacacugagccggaccagcaagaagagauccuggccucuuaaugaggccaucauggcuguggguaugguguccauccucgccuccagccuacugaagaacgacauccccaugacggggccccucgucgcgggcgggcugcugaccgugugcuacguccucaccggccggucggcggaccuggaacuggagcgcgccgccgacgucaagugggaggaucaagcggagaucuccgggagcuccccaauccucuccaucacuauuuccgaggauggcagcauguccauuaagaacgaggaagaggagcaaacguuaacgauccugaucaggacaggccucuuagugaucagcggcguguucccggucuccauccccauuaccgcggccgccugguaucugugggaagugaagaagcagcgggccggagugcugugggacguccccagcccaccacccguggagaaggccgagcuggaagacggggcguaccggaucaaacagcgcgguauccuaggguacucccagaucggcgcuggcguguacaaggaggggaccuuucacacgauguggcaugugacccgcggcgccguacucaugcaucgcgggaaacggaucgagccuagcugggccgacgugaagaaggaccugaucuccuauggcgggggcuggaagcuggagggcgaguggaaggagggagaggagguccaggugcuagcccuagaacccggcaagaacccccgcgcggugcagaccaagcccggaaucuucaagacaaauacgggcaccaucggcgccgugucacuggauuucucccccggcaccagcggcucccccaucguggaucggaaggggaagguggucggccucuacggaaacggcgugguuacccgcagcggggccuacgucuccgccaucgcccagacggagaagucuaucgaagauaauccagagaucgaggacgacaucuuccggaagaagcgccugaccaucauggacuugcaccccggugccggcaagaccaagcgguaccuccccgccauugugcgcgaagccaucaagcggggacugcgaacacugauccuugccccgacgcgcguggucgcugcagagauggaggaagcccuccggggccugccuauccgcuaccaaacucccgccauuaagaccgagcauaccgggcgggagaucguugaccugaugugccacgccacguucacaaugcgucuccugagccccgugcgcgucccgaacuacaaccugaucaucauggacgaagcgcacuucaccgaccccgccucuaucgcugcccguggguacaucagcacacggguggagaugggcgaggccgccggaauuuuuaugacggcgacgccgcccggcucccgcgacccauuuccucaaagcaacgcccccaucauggacgaggagcgggagauccccgaacgcuccuggaacagcgggcacgaaugggugaccgauuucaagggcaagaccgucugguucgugccgucaauuaaagccgggaacgacaucgcggccugccuucggaagaacggcaagaaggugauccagcugagccgcaagacguucgacuccgaguaugucaagacccgggccaacgacugggacuucguggugacaaccgacaucuccgagaugggcgccaacuucaaggccgagcgcgucaucgacccccggcgcugcaugaagcccgugauccuuacugacggggaggagcgggugauccucgcgggccccaugccugucacccacuccagcgcagcucagcgccgggggcggaucggccgcaaccccaagaaugagaacgaccaguacaucuacaugggggagccccuggagaacgacgaggacugcgcccacuggaaggaagccaagaugcugcucgacaacaucaacacacccgagggcauaauaccgaguauguucgagcccgagcgggagaaaguggacgcaaucgacggcgaguaucgucuucgcggggaggcgcggaagaccuucguggaucugaugcggcguggcgaccuucccguguggcuggccuauaaaguggccgccgaggggaucaacuaugccgaccggaaguggugcuucgacggcaucaagaauaaccagauccuggaggagaacauggagguggagauauggaccaaagaaggcgagcgcaagaaacucaagccgcgguggcuggacgcccgcaucuacucagacccucuggcguuaaaggaguucaaggaguucgcggcgggccggaagucccugacccugaaccugauaacagaaaugggccgccugcccaccuucaugacgcagaaggcccggaaugcucuggacaaccuggcgguccugcacaccgccgaggccgggggccgcgccuacaaccaugcgcugagcgaacuccccgaaacccuggagacucugcuccugcugacguuacuggccacagugaccgggggcauauuccuuuuccugauguccggcaaaggcauaggcaagaugacccuggggaugugcugcaucaucaccgcaagcauccugcucugguaugcgcagauccagccacauuggaucgccgccaguaucauacuggaguucuuccugaucguccucuuaauccccgagcccgagaagcagcggacgccgcaggacaaccagcugaccuacgugguaauagcaauuuugaccguuguggcagcgacgauggccaacgagaugggauuucuggagaagacgaagaaggaccuggggcucggcagcaucaccacccaagagagcgagucaaauauccuggacauagaccugcgccccgccagugccuggacccuguaugccguugcgacaaccuucguuacucccaugcugagacacuccaucgagaauaguucugugaacgugagccugacagcaaucgccaaucaggccacgguccucaugggccuggggaagggcuggccccuguccaaaauggauaucggggugccccuccuagcgaucggcugcuacagccaggugaauccgauuacgcugaccgccgcccucuuacugcucgucgcacacuacgccauaaucgggcccggucugcaggcgaaggcuacccgcgaggcacagaagcgggccgccgcgggcaucaugaagaaccccacgguagacgggaucacggugaucgaccuugagcccaucccguacgaccccaaguuugagaagcagcucggccaggucaugcugcuaauccucugugugacccaggugcuuaugaugcgcaccacgugggcccuaugugaggcccucacccuggccaccgggcccauaucuacucugugggagggcaacccugggcgguucuggaauacaacgauagccguaagcauggcgaacaucuucagaggcucuuacuuggccggcgccggccuccuauucucuaucaugaagaacaccacuuccacccgccggggcacugggaacauuggcgagacccucggcgagaaguggaagucccgucucaacgcccuggggaaguccgaguuccaaaucuacaaaaaguccggcauccaagagguggaccggacgcucgcaaaggaggggaucaagcgcggcgaaacggaccaccacgccgugucccguggcagcgccaagcugcgcugguucgucgagcggaacauggugaccccggagggcaagguggucgacuuaggcugcggccgcggcggguggagcuauuacugcggagggcuaaaaaauguuagggaggugaaaggccucaccaagggcgggcccggccacgaggagcccauccccaugagcaccuacggcuggaaccugguccgccuccagagcggcgucgacguauucuucacgccgcccgagaagugcgacacccugcucugugacaucggggaauccagccccaaccccaccaucgaagccggccggacccuccgcguccugaaccugguggagaacuggcucaacaacaacacccaguucugcaucaagguguuaaacccguacaugcccuccgucaucgagaagauggaggcccugcaacggcaguacgggggggcgcucguucgcaacccccugagccgcaacuccacgcacgagauguacugggugagcaacgccaccggcaacauuguauccucgguuaauaugaucucccgcaugcugaucaaccgguucaccaugaagcacaagaaggccaccuaugagccggacguugaccuggggucgggcacgcguaacaucgggauagagucggagauccccaaccucgacaucauaggcaaacggaucgagaagaucaagcaggagcacgagauuucguggcacuacgaccaagaucaccccuacaaaaccugggccuaccacggcuccuacgaaaccaagcagaccgggagcgccuccagcauggucaacggaguggugcgccugcugacgaaaccgugggacgucgugccgauggucacacagauggcuaugaccgacaccacgccuuucgggcagcagcgugucuucaaggagaagguggacacccggacccaggagccgaaggagggcaccaagaagcucaugaagaucacggcugaauggcuguggaaggagcugggcaagaagaaaacgccucgcaugugcacgcgggaggaguucacccgcaaggugcgguccaacgccgcccuuggggcuaucuucacggacgagaauaaguggaaaucagcccgcgaagcagucgaggacggccgguucugggagcugguggaucgcgagcguaaccugcaucucgaggggaagugcgagaccugcguguacaacaugauggguaagcgcgagaagaagcugggggaguuuggcaaggcgaaggguucccgggccauuugguauauguggcugggggcccgcuuccuagaguucgaggccuugggcuuccugaacgaggaccacugguuuagccggggcaacucccucagcggggucgagggggagggacuccaccgccugggcuacauccuccgggacguggggaaaaaggagggcggcgcgauguacgcugacgacaccgccgguugggauacccgcauuacgcuggaggaucugaagaacgaggaaauggucaccaaccacaugaagggggagcacaagaagcucgcggaggcuaucuucaaguugaccuaccagaacaaggugguucggguccagcgcccgacgccccgggggacggucauggacaucaucagccgccgagaccagcgcggguccgggcaggucggcaccuacggguugaacaccuucaccaacauggaggcccaacucauccgccagauggaaggcgagggcauuuucaagagcauccagcaucugacagccaccgaagagauagccguccagaacuggcuggcgcggguggggcgcgagagauugucccggauggccaucagcggcgaugacugcguggucaagcccauagacgaccgguucgccucagcccugaccgcccugaacgauauggggaagguucgcaaggacauccagcagugggagccaagccggggcuggaacgacuggacccaggugccguucugcagccaccacuuccacgagcucgucaugaaggacggucgcgugcugguggucccgugcagaaaucaggacgagcugaucggccgcgcgcggaucagccagggcgccggguggucccugaaggagacggccugcuuaggcaagagcuacgcccagauguggacccugauguacuuccaccgcagagaccuccgccucgcggccaacgccaucuguucggcugugcccagccacuggguaccuaccuccaggaccaccuggagcauccacgccaagcacgaguggaugacgaccgaggacaugcuggcggucuggaaccgcguguggauccaggagaacccguggauggaagacaagacccccguggaguccugggaggagguccccuaccucgggaagcgagaggaccaguggugcggcucgcugauuggucugaccagccgugccacgugggccaagaacauacaggccgccaucaaccaggugcgguccuugaucggaaacgaggaguacaccgacuacaugccgagcaugaaacgcuuccgccgagaggaggaggaggcgggcguccugugguga

SEQ ID NO: 25073 - RNA, 9876 nt, Artificial Sequence
  derived and/or modified CDS sequence (opt11) from DENV-2__GQ868604__SS-prME
accgcgggcgugaucgucaugcugauucccaccgccauggcguuucaccucaccacacgcaacggagagccgcacaugaucguggggcggcaggagaaggggaagucccugcuguucaagacggaggauggcgugaacauguguacccucauggcgaucgaccugggggagcugugcgaggacaccaucacauauaagugcccccuccugagacagaacgaacccgaggauauagacugcuggugcaauagcaccagcaccugggucaccuacgggaccugcaccacaacgggcgagcacaggcgcgagaagcggucaguugcacuggucccccacgucgggaugggucucgagacccgaaccgagaccuggaugucgagugagggagccuggaagcacgugcagcggaucgagacguggauccuucgccauccgggguucacuaucauggccgcgauccuugccuacacaaucggaaccacgcacuuccagcgggccuuaaucuucauccugcugaccgccguggcgcccagcaugacuaugcgcugcaucgggaucagcaaccgggacuucgucgagggugugucggggggcagcuggguggacaucguccucgaacacggcagcugcguaaccacgauggccaagaauaagccgacucuggacuuugagcugaucaagaccgaggccaagcagcccgccacccuucgcaaguauugcaucgaagccaagcugacgaacaccacuaccgagucccggugcccgacccagggcgaaccaagccugaaugaggagcaggacaaacgcuucaucugcaagcauucuaugguggaccgaggcugggggaacggcugcgggcuauucggcaagggcggcaucgugaccugcgcgauguuuacguguaaaaagaacauggaggggaagguggugcagcccgagaaccuggaguauaccaucguuaucacgccccacucuggggaggagcacgcggugggcaacgacaccggaaagcauggcaaagaaaucaaaaucaccccccaguccagcaucaccgaggcggaacugaccggguauggcacggugaccauggagugcagcccccguaccggccuagacuucaaugagaugguccugcugcagauggaggauaaagccuggcucgugcaccggcaaugguuccuggauuuaccccuccccuggcugccgggggccgacacgcagggcagcaacuggauccagaaggaaacgcucgugacguucaaaaacccucaugccaagaaacaggacgucgugguacucggcucucaagagggcgccaugcacaccgccuuaacgggggccacggagauccaaaugagcagcgguaaccuuuuguucacuggccaccugaagugccgcuuaagaauggacaagcuccagcugaaagggauguccuacagcaugugcaccggcaaguucaagaucguuaaggagauugcggagacccagcacgggacgaucgugauccgcguccaguacgagggcgacgggucacccugcaagauucccuucgagaucaccgaccuggagaagcggcauguacuagggcgccugauaaccgugaacccgaucguaaccgagaaggacucucccgugaacaucgaggcggagccgcccuucggcgacuccuacaucaucauaggggucgagccgggacagcugaagcucaacugguucaaaaaggggucaaguauuggacagauguucgagacgacuaugcgcggcgccaagcggauggccauucugggggacaccgccugggacuucggcagccucggcggcgucuucacauccaucggcaaggcccuccaccagguguuuggggcgauuuacggagccgcguucagcggggugagcuggacgaugaaaauccucaucggcgucaucaucaccuggaucgggaugaacagccgauccaccagccuauccgugagccuggugcucgugggaguagugacccuguaccugggggccgucgugcaggcggauuccgggugcgucgucagcuggaagaauaaggagcucaaguguggcuccgggaucuucaucacggacaacgugcacaccuggaccgagcaguacaaguuccagcccgagucgcccagcaagcuggccuccgccauccaaaaggcccacgaggaaggcaucugcgggauccgaagcgugacccgccuugagaaccucauguggaaacaaaucacucccgaguugaaccacauccuguccgagaacgaagucaagcucaccaucaugacaggcgauauuaaggggaucaugcaagcggguaagcgcagccugcgaccacagcccacugagcugaaguacuccuggaaaacguggggcaaggcuaagaugcucagcaccgagagucacaaccagacuuuucugaucgacgggccugagaccgccgagugcccgaacacgaaccgggccuggaacagccuggagguggaagacuacggcuuugggguguucacuaccaacaucugguugaagcugcgcgagaaacaggacgucuucugcgacuccaagcuaaugagcgccgccaucaaggacaaccgugcggugcacgccgacaugggcuacuggaucgaguccgcccucaacgacaccuggaaaauggagaaagccucuuucaucgaggugaagucuugccacuggccaaagagccacacccugugguccaacgguguccuggagagcgagaugaucauuccgaagaacuucgccgggcccgugucccagcacaacuacaggccugguuaccacacgcaaaccgcuggcccauggcaucucggcaagcucgagauggacuucgaccuuugcgaggggaccaccguugucguuacagaggacugcggcaauagaggccccagccuccgcacuaccacugccucugggaagcugaucacggaauggugcugccgcuccugcacccugcccccgcuccgcuaccggggcgaggacgggugcugguacggaauggagauccguccccugaaggaaaaggaggaaaaccuggugaacagccucgucacugccgggcggggacaaaucgauaauuucucccugggcgugcuggggauggcccuguuccuggaggagauguuacgcacaaggaucggcacgaagcacgcgauacuccugguggccgucagcuuugugacccuuaucaccgguaacauguccuuccgcgaccuagggcgcgugauggucauggugggggccaccaugacagacgacauaggcaugggcgugaccuaccuggccuuacucgccgcguucaaggugcgucccaccuucgccgccgggcugcucuuacgcaagcugaccagcaaggaguuaaugauggccacgaucggcaucgcccuccugucacagagcaccauucccgagaacauccuggaacucaccgaugcgcuggcccuugggaugaugguguugaagaucgucagaaacauggagaaguaccagcuggcugucaccaucauggcaaucuccugcguuccgaacgccgugauccuucagaaugcguggaaggucaguugcacgauccucgccgccguguccgucagcccccugcugcucaccucaagccagcaaaaggcagacuggaucccacuggcgcugaccauaaaaggccucaaccccacugccaucuuccucacaacccugucccgcaccucgaagaagcgguccuggccgcucaacgaggcgaucauggccgugggcaugguguccauccuggccuccagccuacugaagaacgacauccccaugaccggucccuuggucgcugggggucuucucacggugugcuacguguuaaccgggcgcagcgcagaccucgagcucgaacgggcagccgaugucaagugggaggaucaagccgagaucucagguagcucccccauccuauccauaaccaucuccgaggacgguaguaugucaaucaagaacgaagaagaggagcaaacccugacgauccucauccgcaccggccugcugguaaucagcgggguuuucccggucuccauucccaucacagcggcagccugguaucucugggaaguuaagaagcagcgggccggcguucugugggacguccccagcccaccgcccguggagaaggccgaacuggaggacggggcauaccgcaucaagcagcgaggcauucucggguacucccagauaggugcuggcguuuacaaagagggaaccuuccacaccauguggcacgugacgcgcggcgcagugcugaugcaccgcgggaagcgcaucgagccaagcugggcggacgucaaaaaggaccugaucaguuacggcgggggauggaagcucgagggcgaguggaaggagggggaggagguccaagugcuggccuuagagcccggcaagaaccccagggcggugcagacaaagcccgggaucuucaagaccaacaccggcacgauaggggccgucagccucgauuucucccccggcaccagcggcucccccaucguggaccgcaagggaaaagugguaggcuuauacgggaacggcguggugacccggaguggcgccuacgucuccgccaucgcgcagaccgaaaaguccauugaggauaaucccgaaauugaagacgauaucuuccgaaagaagcggcugacgaucauggaccuccaccccggggccggcaagaccaagcguuaccugcccgcuaucgugcgggaggccauuaagcgcgggcugcgcacucugauccucgcaccgacccggguggucgcggccgagauggaggaggcccugcgcggccugcccauacgcuaucagacgccagccaucaagaccgagcacacagggcgggaaauuguggaccucaugugccacgccaccuucacgaugcggcugcuuagccccguccgcgucccuaacuacaaccucaucaucauggacgaggcgcauuuuaccgaccccgcuuccaucgcggcccggggauacaucagcacccggguggagaugggcgaggccgccgggaucuucaugaccgccaccccgccgggcucccgggacccguucccccaguccaacgcccccaucauggacgaggaacgcgagaucccggagcgguccuggaacucagggcacgagugggugaccgacuucaagggcaagaccgucugguucgugcccaguaucaaagcugggaacgacaucgcggcaugucuccgcaagaacggcaagaaggugauccagcugagccgaaagacuuucgacuccgaguacgucaagacgcgcgccaacgauugggacuucguggugaccaccgacaucagcgagaugggcgccaacuucaaggccgagcgggucaucgacccccgccggugcaugaagcccgugauucucaccgacggggaagagcgcgugauccuggcgggccccaugccagucacgcacuccagcgcggcgcagcggcgcgggcgcaucggacggaaccccaagaaugaaaacgaccaguacaucuacaugggugagccccuggagaaugacgaggacugcgcccacuggaaggaggccaagaugcuccuggacaauauaaauacucccgagggcaucaucccgagcauguucgagcccgaaagggagaagguggacgcgaucgacggcgaguaucggcugcgcggggaggcccggaagaccuucguggaccuuaugcgccggggcgaccugcccgucugguuggccuauaagguggcugccgagggaaucaacuacgcggaccgcaaguggugcuucgacggcaucaagaacaaccaaauacuggaggaaaacauggaggucgagaucuggacaaaggagggggagaggaagaaacugaagccgagguggcuggacgcgcggaucuacagugacccccucgcccugaaggaguuuaaggaguucgccgcggggcgcaagagucugacgcucaaccugaucacagagaugggccggcugcccaccuucaugacccagaaagcccgcaacgccuuggauaaccuggccguccugcacacggccgaggcagggggcagagccuauaaccacgcccucagcgagcugcccgaaacccuggaaacccuccuccugcucacccugcuggcgacgguuacagggggcaucuuccucuucuugauguccggcaaggggaucggcaaaaugacucuggggaugugcuguaucauuaccgccagcauccucuuaugguacgcgcagauccagccgcacuggaucgccgccuccauaauccuagaguucuuucucaucguucugcugauccccgagcccgagaagcagcgcacaccccaagacaaccagcucacguauguggugauagcgauccugaccgucguggcggccaccauggcgaacgagaugggcuuccuggaaaagaccaagaaggaccucgggcuaggcuccaucacgacccaggagagcgagagcaauauccuggacaucgaccucagaccggcaagcgccuggacgcuguacgccguggcgaccacguucgucacccccaugcuucggcacuccaucgaaaacucauccgugaauguaucgcugaccgccaucgcuaaccaggccacgguccugaugggccugggcaagggcuggccccuuuccaagauggacauuggggugccccuguuggcgaucggcugcuacagccaggugaacccgauuacgcucaccgccgccuugcugcuucuggucgcucacuacgccaucaucggacccggcuugcaggcgaaggccacccgggaggcccaaaagcgcgcggccgccggaaucaugaaaaaccccaccguggacgggaucacggugaucgaccuagagccaaucccuuacgaccccaaauucgagaagcaguugggccaggucaugcugcucauccugugcguuacccaggugcugaugaugcggaccaccugggccuugugcgaggcccugacgcuggccacagggcccaucucuacccuuugggagggcaaccccggucgcuucuggaacacgacaaucgccguguccauggcgaacaucuuccgcggcuccuaucuggcaggcgccgggcuccuguuuagcaucaugaagaacacgaccuccacacggagaggcacggggaacaucggcgagacacugggcgaaaaguggaaaucccggcucaacgcccuggggaaguccgaguuccagaucuacaagaaguccgggauccaggaaguggauaggacccuggcgaaggagggcaucaagcggggugagaccgaccaucacgccgugucccgcgggagcgccaagcuucggugguucguagagcgcaacaugguaacgccggagggcaaaguggucgaucucggaugcggccggggcggguggucauacuacuguggcgggcugaagaacgugcgcgaaguaaagggccucaccaagggcggucccggccacgaggagcccauccccaugucuacauacgguuggaaccucguccggcugcagaguggcguggacguauucuucaccccacccgagaagugcgacacccugcugugugacaucggggaauccagccccaaccccaccaucgaggccggccgcacccugcggguacugaaccucguggaaaacuggcugaauaacaacacccaguuuugcaucaaggugcugaacccuuacaugcccucgguuaucgagaaaauggaggcccuccagcgccaauacggaggggcacuugugcguaacccacugagccguaauuccacccacgagauguacuggguaagcaaugccacggguaacaucgucagcagcgugaacaugaucucucggaugcuaaucaaccgcuucaccaugaagcauaagaaggcuacuuacgagccggauguggaccucggaagcggcacccggaacaucgggaucgagagcgagauacccaaccuggacaucaucggcaaacgcaucgagaagaucaaacaggagcacgagaucucuuggcacuacgaccaggaccaccccuacaagacgugggcauaccacggcucuuacgagaccaagcagaccgguagcgcuuccagcauggucaacggcguggugcggcugcuaaccaagcccugggacgucgugccgauggugacacagauggcgaugacugacaccaccccuuuugggcagcagcgugucuucaaggagaagguggacacccgcacccaagagcccaaagagggcaccaagaagcugaugaagaucaccgcggaguggcuguggaaggagcucggcaagaagaagaccccucggaugugcacccgagaggaguucaccaagaaggugagauccaacgccgcccugggggccauauucaccgacgaaaacaaauggaaauccgcgcgcgaggccgucgaggacgggcgguucugggagcucguggaccgugagcggaaucuacaccuggaggguaagugcgagacgugcguguacaacaugaugggcaagcgcgagaagaaguuaggcgaauucggcaaggccaagggcucacgggccauaugguacauguggcucggggcgcgcuuccuggaguucgaggccuugggcuuccuaaacgaagaccacugguuuagccgggggaacagccucuccggcguggagggggaaggccugcaccgccuaggcuauaucuugcgggacguggggaaaaaggagggcggggccauguacgcggacgauaccgccggcugggacacccgaauuacccuggaggaccucaaaaacgaggagaugguaacuaaccauaugaaaggggagcacaagaaacuggccgaggccaucuucaagcugaccuaccaaaacaagguggugcggguccagcgcccgacaccccggggaaccgucauggacaucaucagccgccgggaccaacgcggcuccgggcaggucggcacguaugggcucaacaccuucaccaacauggaggcccagcugauccgccagauggagggcgaggguaucuucaagagcauacagcaccugacagcgaccgaggagaucgcuguccagaacuggcucgcgcggguggggcgcgagcggcugucccgcauggcgaucaguggcgacgacugcguugucaagcccaucgacgaucgguucgccuccgcccugaccgcccucaacgacauggggaaggugcgcaaggacauacagcagugggagccgagccggggcuggaacgacuggacucaggugccguucugcucccaccacuuccacgagcuggucaugaaggacgggcgcguacuggucgucccuugccguaaccaggacgagcucaucggccgcgcgcggaucagccagggcgccggguggucccugaaggagaccgccugucugggcaagagcuacgcccagauguggacgcuuauguacuuccauagacgugauuugcgccuggccgcgaaugccaucugcuccgccgugcccagccacugggugccaaccucacguaccaccuggagcauccacgccaagcacgaauggaugacaaccgaggacauguuagcgguguggaaccgcguguggauccaggagaacccuuggauggaggacaagacucccguggaguccugggaggagguccccuaccugggcaagcgggaagaccaguggugcggaucucugaucgggcucaccagccgcgccacuugggccaagaacauccagacggcuaucaaucaggugcggucccugaucggcaacgaggaauacaccgacuacaugcccagcaugaagcgcuuccgccgggaggaagaagaggccggcgugcugugguga

SEQ ID NO: 25074 - RNA, 9876 nt, Artificial Sequence
  derived and/or modified CDS sequence (opt11) from DENV-2__EU482752__SS-prME
acggcggggguuaucgucauguugauacccaccgccauggcguuccaccuaaccacccgcaauggcgaaccacacaugaucguuggccggcaggaaaaagguaaaucccuacucuucaagaccgaggacggcgugaauaugugcacccucauggccaucgacuuaggggagcuaugcgaggacacaauuaccuacaagugucccuuguuacgucagaaugagcccgaggacaucgacugcuggugcaacucgacuagcaccugggucacauacgggacuugcaccaccacgggcgaacaccgccgcgaaaagcgguccguggcccuggucccccacgucgggaugggccucgaaacgcgcacagagaccuggaugucaagugagggcgcuuggaaacacgugcaacggauagagacguggaucuugcgccacccuggcuuuaccaucauggccgcgauacuggcguacaccaucgggaccacucacuuccagcgcgcgcuaaucuucauccugcugaccgccguggcucccagcaugacgaugcggugcaucggcauauccaauagggacuucgucgagggcgugagcgggggcucauggguggacaucguucucgaacacgggucuugcgugaccaccauggccaagaacaaaccgaccuuggacuucgagcugaucaaaaccgaggccaagcagcccgccaccuugcguaaguacugcaucgaggcgaaguuaacuaacacuaccaccgaaagucggugcccgacgcagggcgagcccagccugaacgaggagcaggacaagcgcuuuaucuguaagcacagcaugguggaccggggcugggggaacggaugcgggcuguucggcaaaggcgggauugucacaugugcgauguuuacgugcaagaaaaauauggaaggcaaggugguccagccggagaaccuugaguacaccaucgucaucaccccucacagcggggaggagcacgcggugggcaacgacaccgggaagcauggaaaggagaucaagaucacuccucaguccagcauuaccgaggcggagcugacaggguauggcacagugaccauggaaugcagcccccguacagggcucgacuucaaugagaugguccugcugcagauggaggauaaggccuggcucguucaccgccagugguuccucgaccuuccccucccuuggcugccuggggccgacacacagggcucaaacuggauccagaaggaaacgcuagugaccuucaagaacccacacgcgaaaaagcaggauguugugguccucgggagccaggagggagcuaugcauaccgcccuaaccggggccacggagauccagaugagcagcggaaacuuauuauuuacgggccaccugaaguguagacuucggauggauaaacuccaguuaaaggggaugaguuauucgaugugcaccggcaaguucaagaucgugaaggaaaucgccgagacccagcacgggacgauugugauccgcguccaguacgagggcgacggcucccccuguaagaucccguuugaaauuaccgaccuggagaagcggcacgugcucgggcggcugaucaccgugaacccgaucgucaccgagaaagacagccccguaaacauagaggcggagccgccauucggugacuccuacaucaucauaggaguggagccaggccagcugaagcucaauugguuuaagaaggggagcuccaucggccagauguucgaaacgaccaugcgcggcgccaagagaauggccauucugggcgacaccgccugggauuucggcagccucgggggugucuucacauccaucgguaaggcccuccaccaaguguucggcgcuaucuauggcgccgcguucagcgggguguccuggacaaugaagauccuuauaggcguaaucaucacuuggaucgggaugaacagccgcucuaccagucugucugucucacugguccugguaggcguggugacccuauaccugggggccaugguccaggccgacuccggcugcguggugagcuggaagaauaaggagcuaaagugcggcuccggcauauucauaacggacaacguccacaccuggacagagcaguacaaguuucagcccgagagcccgagcaagcuggccagugccauccagaaggcccacgaggagggcaucugcggaauccguagcgugacucgccuggaaaaccucauguggaagcaaaucacgcccgagcugaaccauauucuguccgagaaugaggugaaacucaccaucaugaccggcgacauccgggggaucaugcaggcgggaaagcggagccugcggccccaacccaccgaacuuaaguacuccuggaaaacguggggcaaggcgaaaaugcugagcaccgagucccacaaucaaaccuucuugaucgacgggccugagaccgccgagugcccgaacacuaacagagcguggaacucacuggagguggaggacuaugguuucgguguguucacuaccaacaucuggcugaagcugagggagaaacaggaugucuucugcgacuccaaguuaaugagcgcagcuaucaaagacaaccgcgccguucaugccgauaugggcuauuggaucgaguccgcacucaacgacaccuggaagauggagaaggccagcuuuaucgaggucaaauccugccacuggccuaagagccauacccuuuggucaaacggcgugcuggagagcgagaugauaauccccaaaaacuucgccgggcccgucucccagcacaacuaccggccgggcuaccacacgcagacggcggggccuuggcaucucggcaagcuggagauggauuuugaccugugcgaggguaccaccguggugguuacggaggacugcggcaaccgcggcccuagccucagaaccaccaccgccagcggcaagcugaucacagaguggugcugccgcucuugcaccuuacccccgcuccgguaccgcggcgaggacgggugcugguacggcauggagauccguccccugaaggagaaggaggaaaaucuggugaacagccucguuacagccgggcacggccaaaucgacaacuuuucgcuaggcguacuggggauggcccucuuccuggaggagaugcugcgcacccggauaggcacuaagcacgcuauccuccugguagccgugagcuucgucacccugaucacggggaacaugucuuuuagggacuugggccgcgugauggugaugguuggggccacuaugacagaugacaucggcaugggcgugacuuaccuggcgcuccucgccgcguucaagguacguccuaccuucgccgcagggcugcugcuccgcaagcugaccagcaaggagcugaugauggccacgauaggcaucgcccuccugucccaaagcaccauccccgagaauauccuggaguugacagacgcgcuggcccuggggaugaugguccuuaagauuguacggaacauggaaaaauaccagcuggccgucaccaucauggcgaucuccugcgucccuaaugccgugauccugcagaacgcguggaagguaagcugcacuauccucgcagcggucuccgugagcccccugcuccucaccuccagccagcagaaggccgacuggauaccccuggcgcugacgaucaaaggucucaaucccaccgcgaucuuucuuacgacccucucacgaaccucuaagaaacguuccuggccucucaaugaggccauaauggccgucggcaugguaucgauccuggcauccagucuccucaagaacgacauucccaugaccgggccuuuaguggcuggcgggcugcucacggucugcuacgucuugaccggccgcucugccgaccuugaguuagaacgggccgcugacgugaagugggaggaccaggccgagauuuccgggagcucccccauccuaucgaucaccaucuccgaggacggcagcauguccauaaagaacgaggaggaggagcagacccugacgauccuuauccgcacaggcuuacuggucauuucugggguguucccgguuuccauccccaucaccgcggccgccugguaccuuugggaggugaaaaagcagcgggccggggugcugugggaugugccuagcccgccgcccgucgaaaaggcugagcuggaagacggggcguaucgcaucaaacaaagagguauccucggguacucccagaucggcgccggcguuuacaaggaaggaaccuuccacaccauguggcauguuacgcguggggccguccugaugcaucgggguaagcgcaucgaacccagcugggcggacgugaagaaggaccugaucuccuauggagggggcuggaagcucgagggcgaguggaaggagggggaggaagugcaaguccuggcccuggaaccugggaagaacccgcgggcgguccagaccaagcccgggauuuuuaagacgaacaccggcacaaucggggccgugagucucgacuucucccccggcacgagcggaucgcccauugucgacagaaaagggaaaguggugggccuguacgggaacggcgucguuacucggaguggcgccuacguguccgccaucgcgcagaccgagaaguccaucgaggacaauccugagaucgaagacgauaucuuucgcaaaaagcgccugaccaucauggaccuccaccccggggccggcaaaacuaagcgauacuuacccgccaucguucgggaggcgaucaagcgcggccugcguacccuuauccuagccccuaccagggugguggcggccgagauggaagaggcccucagaggccugcccauucgguaucaaacgaccgccaucaaaaccgagcacacugggcgggagaucgucgauuugaugugccacgcaacauucaccaugcgccuucugagccccgugcgcgugcccaauuacaaccucaucaucauggacgaggcgcacuucaccgacccggccuccaucgcggcccgcggcuacaucuccacccgagucgagaugggcgaagcagcggggaucuucaugacagccacgccacccgggucccgcgacccauucccgcagagcaaugccccgaucauggacgaggagcgcgagaucccggagcguuccuggaacucggggcaugaguggguaaccgacuucaaaggcaaaaccguaugguucguccccuccaucaaggccgggaaugacaucgcggcaugccucagaaagaacggcaagaaggugauccagcugagccgcaagacguucgacucugaguacgugaaaacccgugccaacgacugggacuucgucgugaccacagacaucagcgagaugggcgccaauuucaaggccgagagagugauugacccgcgccggugcaugaaaccggucauccucacggacggggaggagcgcgugauccuagcaggacccaugcccgucacacacaguagcgcagcccagcgacgcgggagaaucggccggaacccgaagaacgaaaacgaccaauacaucuacaugggagaaccgcuggagaaugacgaggacugcgcacacuggaaggaagcaaaaaugcuccuggacaacauuaauaccccagagggcaucauccccuccauguucgagccagagcgcgagaaagucgaugcgaucgacggugaguaccggcugcgcggcgaggcucggaaaaccuucguggaucucaugcgccggggcgaccugcccguguggcucgcuuauaaggucgccgccgaggggaucaacuacgcggaucgcaaguggugcuucgacggcauuaagaacaaccagauccuugaggagaacauggagguggagaucuggacgaaggagggugaacgaaagaagcugaagccaagguggcuugaugcccggaucuacagcgacccgcucgcccugaaggaguucaaggaguucgccgcgggccgcaagucacugacccucaaccugauuaccgaaaugggcagacugcccacauuuaugacgcagaaggcccgcaacgcucucgacaaccucgccgugcugcacaccgccgaggcagggggccgggcuuacaaucacgcgcucucugaacucccggagacccuggagaccuuacuacuguugacucuacucgccaccgucaccggggguaucuuucucuuucugauguccgguaaagggaucggcaagaugacccuggggaugugcugcaucaucaccgccagcauccuccugugguaugcacaaauucagccccacuggaucgccgcgucaaucauccucgaguucuuccugaucgugcugcugauuccggagcccgagaagcagcgcacgccccaggacaaccagcucacguaugucgugauagccauucugaccgugguugccgcuaccauggcgaacgagaugggcuuccuggagaaaacgaagaaggaucucggucugggcagcaucacuacccaggagagcgaguccaacauucuggacaucgaccuccggcccgccagcgccuggacucuguacgccguggcgacgaccuucgugaccccgauguuacgccacucaaucgagaacucuagcgucaacgugagccucaccgccaucgcuaaccaagccacggugcugaugggucuggggaaagguuggccccucucaaagauggauaucggggucccccuacuggccaucggcugcuacagccaggugaacccgaucacgcucaccgcugcccugcugcuccugguggcccauuaugccaucaucggcccgggccugcaagcgaaggccacccgggaagcacagaaacgagccgcggcgggcaucaugaagaaucccacggucgacgggaucaccguuauugaccucgagccuauaccuuacgacccgaaauucgagaagcagcugggacaggugaugcugcucauccugugcgucacccaggugcugaugaugcgaaccacgugggccuuaugcgaggcccugacccuggccaccgggccuauauccacacucugggagggcaaccccgggcgguuuuggaacacgacaaucgccgucagcauggcgaacaucuuccgcggcuccuaccuggccggcgccgggcuccuguucagcaucaugaagaacacgaccaacacgcggcgcggcaccgggaacaucggcgagacccugggcgagaaguggaagagucggcugaacgcgcucggcaagagugaguuccagaucuacaagaaauccgggauccaagaggucgaccgaacgcucgcgaaggaagggaucaagcggggugagacggaccaccacgccgucagcagggguuccgccaaacuccggugguucguggagcggaacauggucacucccgaaggcaaggugguggaccucgguugugggcgggguggguggagcuacuacugcggcggucugaagaacguacgcgagguuaagggccugaccaagggagggccgggucacgaagaacccauccccauguccaccuacggguggaaccucgugcgacugcaguccgggguagacguguucuucacuccgccggagaagugugauacccuccucugugacaucggggaaagcuccccaaacccgaccaucgaggcagggcgcacccugcgggugcugaaccucguagagaacuggcugaacaacaacacccaguucugcaucaaggugcugaaccccuacaugccgagcgugaucgagaaaauggaggcccuacaacgcaaguacggcggggcccugguccggaacccgcugucccggaacagcacccaugagauguacuggguuuccaaugccaccggcaacaucgugucgucagucaauaugaucagccggaugcugaucaaccgcuucacgaugaaacacaagaaagccacuuacgagcccgacguggaucucggauccggaacccggaacaucgggauagaaagcgagaucccgaaccuggauaucaucggcaagcgcaucgagaagauuaagcaggagcacgagaccuccuggcacuacgaccaggaccacccuuacaagaccugggccuaucacggcagcuaugaaaccaagcagacgggauccgccagcuccauggugaacggugucguucgcuuacucaccaagcccugggacgugguccccauggugacccagauggcgaugaccgacacgaccccauuuggccagcagcggguguuuaaggagaaggucgacacccgcacccaggagccuaaggagggcacgaagaaacuuaugaaaauaaccgccgaguggcuguggaaggaauuaggcaagaagaagacgccccggauguguacccgcgaggaguucacgcggaaagugcgcucaaaugccgcgcugggggccaucuucaccgacgaaaacaaguggaaaucugcgcgugaggccguggaggacggccgcuucugggagcuggucgaccgggagaggaaccuccaccuggaggggaagugugaaaccuguguguacaauaugaugggcaagcgggagaagaagcugggggaguucggcaaggccaagggcagccgcgccauaugguacauguggcucggggcgcgguuucucgaguucgaggcccugggcuuccugaacgaggaccacugguucucgcgcgggaacucucugagcggcguagaaggggaaggccuucaccggcucggguacauccuacgcgacguggggaagaaggagggcggggccauguaugcggacgacaccgcaggcugggacacacggauuacccuggaggacuugaagaacgaggagauggugaccaaucacaugaagggggagcacaagaagcuggcggaagccaucuucaagcucaccuaccagaacaaggucgugcgaguacagcggccgacgccgcgcggcacuguaauggacaucaucagucggcgcgaccagcgcggcucggggcaggucgggaccuacggucucaacacauucacgaacauggaggcccagcugauccggcagauggagggugaaggaaucuucaaguccauccagcaccuuacggccaccgaggagaucgccgugcagaacugguuagcgcgagucgggcgggagcgccugagucggauggccaucuccggugacgauugcgucguaaagcccauagacgaucgcuucgccagcgcucugaccgcccucaacgauauggggaaaguccgcaaggacauccagcagugggagcccucccgcggcuggaacgacuggacucaggugcccuucugcagccaccacuuccacgagcuagugaugaaggaugggcggguacugguggugccgugccgcaaccaggacgagcucaucgggcgggcgcgcaucucccagggcgcaggguggagccucaaggagaccgccugccugggcaaguccuacgcgcagauguggacccuaauguacuuucaccggcgcgaccugcggcuggcugcgaacgcuaucugcagcgccguccccucccacugggugcccacaagccgcaccacaugguccauccacgccaagcacgaguggaugaccaccgaggauaugcucgcgguguggaaccggguuuggauccaggagaacccuuggauggaggacaagaccccggucgagagcugggaggagguucccuaccuggggaagcgcgaagaccaguggugcgguucgcugaucggguugacgagccgagccaccugggccaagaacauacagaccgccauuaaccagguccgcagcuuaaucggcaacgaggaguacacugacuacaugccguccaugaaaagguucaggcgcgaggaggaggaagcuggcgugcugugguga

SEQ ID NO: 25075 - RNA, 9876 nt, Artificial Sequence
  derived and/or modified CDS sequence (opt11) from DENV-2__EU482753__SS-prME
accgcgggcgugaucgucaugcugauccccacagccauggcguuccaccucaccacccgcaacggggagccgcacaugaucgugggccggcaggagaaggggaagucccugcuguucaagaccgaagacggcgugaauaugugcacccucauggccauugaccugggggagcugugugaggacaccaucaccuacaagugcccccuccugcgccagaacgaacccgaggacauugacugcugguguaauagcacuagcaccugggucaccuacgggacauguaccacuacgggugagcaccggcgcgagaagcgguccguggcccuggugccccacgucgggaugggccucgagacccgcacagagacguggaugagcagugagggggccuggaaacacgugcagcggaucgagacguggauccugcgccacccgggcuuuaccaucauggccgcgauuuuagccuacaccaucgggaccacccacuuccagcgggcccucaucuucauccuguugaccgcuguggcgcccucuaugaccaugcgcugcauuggcaucuccaaccgggacuucgucgaaggcgugagcgggggcuccuggguggacaucguccucgagcacggaaguugcgugaccacgauggccaagaacaagcccacccucgauuucgagcugaucaagacggaggccaagcagccagccaccuugcgcaaguacugcaucgaggccaagcugacgaacacgaccaccgagucacggugcccuacacagggcgagcccagccuuaacgaagagcaggacaagcgauucaucugcaagcacuccaugguggaccggggcugggggaacggcugugggcuuuucggcaagggcgggaucgugacuugugcgauguuuacgugcaaaaagaacauggagggcaagguggugcagcccgagaaucuggaauacaccaucgucaucacgccccacagcggagaggagcacgccguggggaacgauaccgggaagcacgggaaagagaucaagaucacgccgcaguccucuaucaccgaggccgagcugaccggguacgggacggugacaauggagugcucaccccgcacaggacucgacuucaacgagaugguccugcugcagauggaggacaaggccuggcucgugcaccggcagugguuccuggaccugccccuccccuggcugccgggggccgauacgcagggcagcaacuggauccagaaggagacucucgugaccuucaagaauccccacgcgaagaagcaggacguugugguccuagggucccaggagggcgcaaugcacaccgcccugaccggggccacggagauacagaugagcagcggcaaccuccuauucacaggccaccuaaagugccgccugcggauggacaagcuccagcugaaggggauguccuacagcaugugcacuggcaaguuuaagaucgugaaggagaucgccgagacccagcacgggacgaucguaauacggguccaguacgaaggcgacggcucaccuugcaaaauccccuucgagaucaccgaccuugagaagcggcacgugcuagggcgccugaucaccgucaacccgauagucacggagaaggauagccccgugaacaucgaggccgagccucccuucggcgacucguacauaaucauugggguggagccgggccaguuaaagcucaacugguucaaaaaaggguccagcaucggccaaauguucgagacuacgaugcgcggcgccaagcggauggccauccugggggacaccgccugggauuuuggcagcuuagggggcgucuucaccuccauugggaaggcccuccaccagguguucggagcaaucuacggagccgccuucuccgggguguccuggacgaugaagauccucauaggcguaaucaucaccuggaucggaaugaacagccgcucuacaagccuguccgugagccuggugcucgucggcguggugaccuuguaccugggggccauggugcaggcggacuccggaugcguggugagcuggaagaacaaggagcucaagugcggcuccgggauuuucauuacggacaacguucauaccuggacggagcaguacaaauuccagcccgaaagccccagcaagcuggccuccgccauccagaaggcccaugaggaaggaaucugcggcauccggagugugaccaggcuggagaacuuaauguggaagcagaucacuccagagcugaaccacauccuguccgagaacgaggugaagcugacuaucaugaccggcgacauucgggggaucaugcaggccggcaagcgcagccugcggccacaacccaccgaacugaaguacuccuggaagacguggggcaaggcgaagaugcucagcacagaaucccacaaccagacauuccuaaucgacgggccagagaccgcagagugcccgaacacgaaccgcgccuggaacucccuggaagucgaggacuacggcuucgggguguuuaccaccaacaucuggcucaagcugcgggagaagcaggacguguucugcgauuccaaguugaugagcgccgccaucaaggacaaccgcgcgguccacgccgacauggguuacuggaucgaguccgcccucaacgacaccuggaagauggagaaggccuccuucauagaggugaaguccugccacuggcccaagagccacacccugugguccaacggcgugcuggagagcgagaugaucauccccaagaacuuugccgggcccgucucccagcauaacuaccggccuggauaccacacgcaaaccgcggggcccuggcaccucggcaagcuggagauggacuucgaccugugcgaggggaccaccgugguagucacggaggacugcgguaaccgaggccccagccuacggaccaccacagccuccggcaagcugauuacggaguggugcugucgguccugcaccuugcccccguugcgguaccgcggcgaagacgggugcugguacggcauggaaauacgaccccugaaggagaaggaggagaaccuggugaacagccucguaaccgcagggcacggccagauugacaacuucucccugggcguccuggggauggcccuauuccuggaggagaugcugcgcacccggaucggcacgaagcacgcgauccuccugguggccguuagcuucgucacccucauaaccgggaacauguccuuccgcgaccucggccgcguaauggugauggucggggccaccaugacggacgacauuggcaugggcguaaccuaccuggcccugcucgccgccuucaaggugcggcccaccuucgccgcgggacuucugcuccgcaaguugaccagcaaggaacugaugauggccacuaucggaaucgcccucuugucccaaagcaccauccccgagaccauccuggagcucaccgacgcgcucgcccuggggaugaugguccucaagaucgugcgaaacauggagaaguaccaauuagccgugacgaucauggccaucuccugcgucccgaacgccgugauucuucagaacgcguggaaggugucgugcaccauccucgccgccgucagugugagcccccuccuguuaaccuccagccagcagaaagccgacuggaucccccuggcgcugacgaucaagggccucaaccccaccgccaucuucuugaccacccugucccgcaccagcaaaaagcgguccuggccgcucaacgaggccauuauggccguaggcaugguaucgauccuggccuccagccugcucaagaaugacaucccgaugacggggccccugguggcgggggggcugcucacagucugcuacgugcugaccggccgcagcgccgaucuggaacucgagcgugccgcggacgugaagugggaggaccaggcggagaucuccggcagcucccccauccugagcaucaccaucuccgaggacggcuccauguccaucaagaaugaggaggaggagcaaacccugacaauccucauucgcaccggcuuacugguaaucagcgggguguucccaguguccauccccaucaccgcggccgccugguaccucugggaggucaagaagcagcgggccggggugcugugggacgugcccagcccuccgccggucgagaaggccgagcuggaggacggggcguacagaaucaaacagcggggcauccucgguuacucccagaucggggccggcguguauaaggaggggaccuuccacacgauguggcauguuacccgcggagcagugcuuaugcaccggggcaagcgcaucgaacccucaugggcggacgugaaaaaggaccugaucagcuauggcgggggcuggaaacucgaaggcgaguggaaggaaggggaggaggugcaaguccuggcccuggagcccggcaagaacccccgggcugugcagaccaagcccgggaucuucaagaccaacacgggcaccaucggggccgugagccucgacuucucccccggcaccagcggcucccccaucgucgaccgcaaggggaaggucgucggcuuguaugggaacggcgugguuacccggagcggcgcguacguguccgccaucgcgcagacggagaaauccaucgaggacaaccccgagauugaagacgacaucuuccgcaagaagcgguugaccaucauggaucuccaucccggggccggaaagaccaagcgguacuuacccgccaucguccgggaggccaucaagcgcgggcugcgaacccugauccucgccccgacgcgggugguggcggccgagauggaggaggcacugcgcggccugcccauccgguaccagaccaccgccaucaagaccgagcacacgggucgugagauagucgaccucaugugccacgccaccuuuaccaugcggcugcugagccccgugcgcgugcccaacuauaaccucaucaucauggacgaggcgcacuucaccgauccggccuccauagccgcccggggcuacaucagcacgcgcgucgagaugggcgaggccgcggggauuuucaugaccgccacgccgccggggucacgggaccccuucccgcagagcaacgcccccaucauggacgaggagcgcgaaaucccagagcgguccuggaauagcgggcaugaaugggugaccgauuuuaagggaaagacgguuugguuuguccccucgaucaaggccgguaacgacaucgcggccugccugcgcaagaacgggaaaaaagucauacagcugagccggaagaccuucgacuccgaguacgucaagacccgcgcuaacgacugggacuucguuguuaccacugacaucagcgaaaugggugccaacuucaaggccgagcggguuaucgacccgcgcaggugcaugaagcccgucauccucaccgacggggaagagcgcgugauccuggccggccccaugcccgugacccacucgagcgccgcacagcggcgcggacgcaucggccggaauccgaagaacgagaaugaccaguauauauacaugggggagccacuggagaacgacgaggacugcgcacacuggaaggaggccaagaugcuccuggacaacaucaacacccccgagggaaucauccccuccauguuugagcccgagcgcgagaaggucgacgccaucgacggggaguaccggcugcgcggggaggcucggaagacguucguggaccucaugaggcggggcgauuuacccguguggcuggcauacaaggucgccgccgaggggauaaauuacgcggaccgcaaauggugcuucgauggcauuaagaacaaccagaucuuggaggagaacauggagguggagaucuggacuaaagagggggagcggaagaagcugaagccucgcuggcuggacgcccggaucuacagcgacccgcucgcccugaaggaguucaaggaguucgccgcgggcagaaaaucacugacccucaaccucaucaccgagaugggccgacugccaacuuucaugacccagaaggcccgcaaugcucucgauaaccuggccgugcugcacacggccgaggccgggggccgggccuacaaccacgcccucagcgaacugccggagacucuggagacgcuccugcugcucacccuguuggccaccguuaccggcggcaucuuccuguuccugaugucagguaaggggaucggcaagaugacccucgguaugugcuguauaaucacagccagcauccuccuuugguacgcgcagauccagccccacuggaucgccgccaguaucaucuuggaguucuucuugaucguucuucugaucccagagccggaaaagcagcgcacgccccaggacaaccagcucaccuacgucgugaucgccauccugacaguggucgcugcgacgauggccaacgagaugggcuuccuggagaagacgaaaaaggaucucgggcugggcagcaucaccacccaagagagcgagaguaacauccuggauaucgaccucagacccgccucagcauggacgcuguacgccguggcgaccaccuucguuaccccgauguuacgccacuccauugagaacagcuccgucaacgugagccucacggccauagccaaccaggcuaccguucugaugggccuggggaagggauggccccucuccaagauggacaucggggucccccugcuggcgaucggcugcuacucucaggugaaccccaucacccugaccgccgcccugcugcuccugguggcccacuacgcaaucaucgguccgggccugcaggcgaaggcaacgcgggaggcccaaaagcgcgcugccgcgggcaucaugaagaaccccaccguggacgguaucaccgugaucgaccucgagccaauccccuacgauccgaaguucgagaagcagcugggacaggugaugcugcucauccugugcgucacccagguguuaaugaugcggacgaccugggcccucugcgaggcccuuaccuuggccaccgggcccauaucaacgcucugggagggcaacccagggcguuucuggaacaccacgaucgccguaagcauggcuaacaucuuccgaggcuccuacuuggccggcgccgggcuccuguucagcaucaugaagaacaccacgaacacgcggcgcggcaccgggaacaucggcgagacccugggcgaaaaauggaagucccggcugaacgcucucggcaagucggaguuccaaauauacaagaaguccggcauccaggaggucgacagaacgcuggcgaaggaggggaucaagcggggcgagacagaccaccacgccguuagccgcgggucugccaagcugcggugguucguggagcgcaacauggugacccccgagggcaaggucguggaccucggcugcggucggggcggcuggagcuacuacugcggcgggcugaagaacguccgcgaggugaagggccucacgaagggggggccgggccacgaggagccuauccccauguccacauacggguggaacuuggugcggcugcagagcggcgucgacguguucuucacgccgccugagaagugcgacacccugcucugcgacaucggggagucauccccgaauccgaccaucgaggccggccggacccugcgggugcugaaccucgucgaaaacuggcugaacaacaacacgcaauucugcaucaaagugcugaaucccuacaugccgagcgugaucgagaagauggaggcucuccagcgcaaguacggcggggcacugguccggaacccccucuccaggaacagcacucacgagauguacuggguguccaaugccacgggcaacaucgugagcuccgucaacaugaucagccggaugcugaucaaccgcuucaccaugaagcacaagaaggccacguacgagcccgacguagaccugggguccggcacucggaacaucgggaucgagagcgagaucccgaaccuggauaucaucggcaaacgcauagagaagaucaagcaggagcacgaaacuuccuggcacuacgaucaggaccaccccuacaagaccugggccuaccacggcagcuacgagacgaagcagaccgggucugcaagcuccauggucaauggcgucgugagguugcucaccaagcccugggacguuguccccauggugacccagauggcaaugaccgacacgaccccauuugggcagcagcggguguuuaaggagaaggucgacacccggacgcaggaaccuaaggagggaaccaagaagcugaugaaaaucaccgcagaguggcuguggaaggaguugggcaagaagaagacgccccggaugugcacgcgcgaggaguucacccggaaagugcgcagcaacgccgcguugggugcuaucuuuaccgacgagaacaaguggaaguccgcgcgggaggccguggaggacggccgcuucugggagcucguugaccgggagcguaacuuacaccuggaggggaagugcgaaaccugcguguacaacaugaugggcaaacgggagaagaagcugggggaguucggcaaggcgaaggggagccgcgccaucugguacauguggcucggugcgcgguuccuggaguucgaggcccugggauuccucaacgaggaccauugguucucccgcggcaacagccugagcggcguggagggcgagggccugcaccggcuuggauacauacugcgcgacgucgggaagaaagagggcggggccauguaugccgacgacacagcagggugggacacgcggauuacgcuggaggaccucaagaaugaggagauggugaccaaccacaugaagggggagcacaagaagcuggcggaggccaucuucaagcugacguaccagaacaagguuguuagagugcagcggcccaccccccgaggcaccgucauggacaucaucuccagacgcgaucaacgcggcagcgggcaggucggcaccuacgggcucaacacguucaccaacauggaggcccagcugauccggcaaauggagggcgagggcaucuucaaguccauccagcaccugaccgccaccgaggagaucgccgugcagaauuggcucgcgcgcgucgggcgggaacgccuaagccgaauggccauuuccggcgacgauugcguggugaaaccgauugacgaccgauucgccagugcccugacggcccucaacgacauggggaagguccggaaggacauacagcagugggagcccucccgcggcuggaaugacuggacccaggugcccuucugcagccaccacuuccacgagcugguaaugaaggacggucgggucuuaguggugccgugccgcaaccaggacgagcucaucggacgggcgcgcaucucccagggcgccggguggagccugaaagagaccgccugccugggcaagucguacgcacagauguggacccucauguacuuccaccggcgcgaccugcggcuggcggcgaacgccaucugcagcgccguacccucccacugggugcccaccagccgcacuaccugguccauccacgcgaagcacgaguggaugaccaccgaggacaugcuagcgguguggaaccgugucuggauacaggaaaacccguggauggaggacaagacgccgguggagagcugggaagaagugcccuaccuggggaagagagaagaccaguggugcggcuccaugaucgggcugaccucucgggccacaugggccaagaacauccagaccgccaucaaucagguucgcagccucaucggcaacgaggaguacacggauuacaugccuuccaugaagcgcuuucggcgcgaggaggaggaggccggcgugcugugguag

SEQ ID NO: 25076 - RNA, 9876 nt, Artificial Sequence
  derived and/or modified CDS sequence (opt11) from DENV-2__EU482680__SS-prME
acagcugguguaaucgucaugcugauccccaccgccauggcguuccaccucaccacccgcaacggcgagccccacaugaucgugggccggcaggagaaggggaagucacuguuguucaagaccgaggacggggugaauaugugcacucucauggccaucgaccugggggagcugugcgaggacaccaucaccuacaagugcccccuccugagacaaaacgagccggaggauaucgacugcuggugcaacuccacuagcaccuggguaacauacggcacuugcaccaccacgggcgagcaccgccgcgaaaaacggagcguugcccugguuccgcaugucggcaugggucuagagacccgcaccgaaacauggaugagcagcgagggggcguggaaacacguacagaggauagagacauggauccugcgccacccgggcuucacgauaauggccgcuauucuggcguacaccaucgggaccacgcacuuccaaagggcccucaucuuuauccuucugaccgccguugcucccagcaugaccaugcgcugcaucggcauaagcaaccgugacuucgucgagggcgugagcgggggauccugggucgacaucguucucgaacauggcagcugcgugacgacgauggccaagaauaagccgacauuagacuucgagcugaucaagaccgaagcuaagcaaccugccacucuccgcaaguauuguaucgaagccaagcugaccaacaccacaacggaaucccggugcccuacacagggcgagccaagccugaacgaggagcaggacaagcgcuuuaucugcaaacauucaaugguggaccggggcugggguaauggcugugggcuguucggcaagggcggaauagugaccugcgcgauguucacgugcaagaagaacauggaaggcaagaucgugcagccggagaaucuugaauacaccauagugauuacgccccacucaggggaggagcaugccgucgggaaugauaccggaaagcacgguaaggaaauaaagaucacaccgcaguccagcaucaccgaagccgagcugaccggguacggaacagugacgauggagugcagcccccgcaccggccucgacuucaacgagauggugcugcugcaaauggaggacaaagccuggcucguccaccggcagugguuccuggaucugccccucccaugguuaccaggugcagacacccagggcucaaacuggauccagaaggagacgcuggugaccuucaagaacccccacgcgaagaagcaggacguggucgugcucgggucucaagagggcgcaaugcacaccgccuugaccggggccacggaaauccagaugagcagcgguaaccucuuauucaccggccaucugaagugccgccugcggauggauaagcuacagcugaaggggauguccuauucgauguguaccgggaaguucaaaaucgucaaagaaaucgcggagacccaacacgggacgaucgugauccgcguccaauacgagggcgacggcucccccuguaagauaccauucgagaucacugaccuugagaagcgccacguccucgggagacugaucacugugaacccgaucgugaccgagaaggacucgccggucaacaucgaggcggagccgccguucggggacuccuacaucaucaucgggguggagccaggccagcugaagcuaaauugguucaagaaggggagcuccauaggucagauguucgagacuacgaugcgaggcgccaaacggauggccauacugggagacacagccugggacuuugggagccuagguggcguguucacgucgaucggcaaggcuuugcaccagguuuuuggagcgauauacggugccgcauucagcgggguguccuggacgaugaagauccugaucggggugauaaucaccuggauugggaugaacagccgauccacuagcuuauccguaucgcugguacucgugggcgucgugacacuguaccuaggggcuaugguacaggcggacuccggcugugugguaagcuggaagaacaaggaauuaaaguguggcagcggcaucuucaucaccgacaacgugcauaccuggacagagcaguacaaguuccagcccgagagucccuccaagcuggccagcgccauacagaaagcccacgaggaggggaucugcgggauacggucgguaacccgacuggagaaccugauguggaagcagaucacgcccgagcugaaccauauccugucagaaaacgaggugaaguugacgaucaugaccggcgacauccggggcaucaugcaagccggcaagcgcagccugcgcccccagcccaccgagcugaaguacuccuggaagacguggggcaaagcuaagaugcucagcaccgagucccacaaccagacguuucugaucgaugggccugagaccgccgagugcccgaacacgaaccgcgcuuggaacagcuuagaaguagaggacuacggcuucggggucuuuaccaccaacaucuggcucaagcuacgagagaagcaggauguguucugcgacuccaagcugaugagcgccgcaaucaaggauaaucgagcgguccacgccgacaugggcuacuggaucgaauccgcccucaacgacaccuggaagauggagaaggccagcuucaucgaggucaagagcugccauuggcccaaaagccacacacuguggagcaacggugugcuggaaagcgagaugaucauccccaagaacuucgccggccccguaucccagcacaacuaccggcccggcuaccauacgcagaccgcggggcccuggcaucuaggcaaacuggaaauggauuucgauuugugcgaggggaccaccgugguagugacggaggacugcgggaacaggggccccagccucaggaccacgaccgccagcgguaaauugaucacggaguggugcugccgcuccugcacccugcccccgcuccgguaccgcggcgaagacggguguugguacggcauggagauccggccccugaaggagaaggaggaaaacuuagucaauagccucgugaccgccgggcacggccagaucgacaacuucucucugggagugcuggguauggccuuauuccuggaagagaugcuacgcacccgcauagguacgaagcacgcgauacuccuggucgccgugucauucgugacccugaucacagggaauaugagcuuccgcgaccucgggcgcgucaugguuauggugggggcaaccaugacggaugauauuggcaccggugucaccuaccucgcccugcucgccgccuucaaggugcggcccacguucgccgccgggcuccugcuccgcaagcugacgucaaaggagcugaugauggcgaccaucggaaucgcccugcugucccagagcacaauccccgagacuauccuggaguugacggacgcccuggcccuggggaugauggugcucaagaucguccggaauauggaaaaguaccaacuggccgucacuauuauggccauuucaugcguuccgaacgccgucaucuugcagaaugcauggaaggucagcugcaccauccuugccgccguaagugucucuccccugcuccucaccuccucccagcagaaggcagacuggauuccucuggcguugacgaucaagggccugaaccccaccgccaucuuccugaccacucugucacgaacaagcaagaagcguaguuggccgcucaacgaggccaucauggccgugggcauggugagcauccuggccuccucucugcucaagaacgacaucccaaugaccggacccuuaguggcgggcggucuguugacugugugcuauguccugaccggucgcagcgccgaucuggaguuagagcgggccgccgacgugaagugggaagaucaggccgagaucuccggaagcuccccuauauugagcaucacgauuuccgaggauggcucgaugagcauuaaaaacgaagaggaggagcagacccugaccaucuuaauuaggacugggcuacuggugaucucggggguauucccgguguccauccccaucaccgcagcagcuugguaccucugggaggucaaaaagcagcgggccggaguacugugggacgugcccagcccgccgcccguggaaaaagccgaacuggaggauggggcguacaggaucaagcagcggggcauccucggguacucccagaucggcgcuggcgucuauaaggagggaacguuccacaccauguggcacgugacccgcggugccguuuugaugcacagggggaagagaaucgagcccuccugggccgacguaaagaaagaccugauuuccuacggcggaggcuggaaguuggaaggcgaguggaaggagggggaggagguccaggugcuggcccuggagccuggcaagaauccccgggcuguacagacuaaacccggaaucuucaagacgaacacgggcaccauuggagccguuagcuuagacuuuagucccggcaccagcggcuccccuaucguggaccgcaaggggaaaguuguaggccuguacgggaacggcgugguuacgcggagcggagcguauguguccgcgaucgcgcagaccgagaaguccauugaggacaacccggaaaucgaggacgauaucuuccgaaagaagaggcuuaccauaauggaccuccacccgggagccggcaagaccaaacgcuaccuacccgccaucgugagagaggccaucaagcgcgggcugagaacguugaucuuagcgccgacccgggucgucgcagccgagauggaagaggcgcugagaggucugccuauccgauaccagaccacagccaucaagacggagcacacugggcgcgagaucguagaccucaugugccacgcgacauucacuaugcgacugcugagcccaguccgcgugcccaacuacaaccugauuaucauggaugaggcgcauuucacugauccggccuccauugcagcacgcggcuauaucagcaccagaguugagaugggcgaggccgcggggaucuuuaugacagccacgccgcccgggucacgggaccccuuuccgcagucuaacgcucccaucauggacgaggagcgcgaaauucccgagcgcucguggaacagugggcacgagugggucacugauuucaaaggcaagaccgugugguuugugccauccaucaaggccgggaaugacaucgcugcuuguuuaagaaagaacggcaagaaggucauucagcugagccggaagaccuucgacuccgaauaugugaagacacgcgccaacgacugggacuucgugguaacgacagacaucagcgagaugggcgcaaacuucaaggcagagcgggugaucgacccacgcagaugcaugaagcccgugaucuuaacggacggagaggagcgcgucauccuggcgggcccaaugcccguuacccacuccagcgccgcccagcguagaggaaggaucggccgaaacccgaaaaacgagaacgaccaguacaucuacaugggcgaaccccuggagaaugacgaagacugcgcccacuggaaggaggccaagaugcuccuggacaacauuaacacaccagagggcauuaucccauccauguucgagccggagagagagaagguggacgcgaucgacggugaguacagacugcguggcgaagcccggaagaccuuugucgaccucaugcgccggggcgaccugccuguauggcuggccuacaagguugccgcugaggggaucaauuacgccgaccgcaaguggugcuuugacgggauuaagaacaaccagauccucgaggagaacauggagguggaaaucuggaccaaggagggggaacggaagaagcugaagccccgcuggcuggacgcccggaucuacucagacccgcucgcccucaaggaauucaaagaguuugccgcgggccgcaagucccugacucucaaucugaucacggaaaugggccgacugccaaccuucaugacacagaaggccaggaacgccuuggacaaucucgccguccugcauaccgccgaggccgggggaagggcauacaaccacgcccucagcgagcugccagaaacgcuggaaacacuccuacuccucacucuacuggccaccguuaccgggggcaucuuccuuuucuuaauguccgggaaaggaaucgguaagaugacgcuggggaugugcugcaucaucaccgccagcauccuccucugguacgcgcagauccaaccccacuggauagccgcuuccauuaucuuagaguucuucuuaauugucuuguuaauuccggagccagagaaacaacgaacgccccaggacaaccaguuaaccuacguggugaucgccauccuuacgguuguggccgcgacuauggccaacgagaugggcuuucuagagaagaccaagaaggaccuaggucugggcagcaucaccacgcaggagagcgaguccaacauacuggacaucgaccuccggccggccagcgccuggacuuuguacgccgucgcuaccacguucgugacgccgaugcuucgccacuccaucgagaauagcagugugaaugucucccuuaccgccauugccaaccaggccaccgugcugaugggcuuggggaagggauggccacugucgaaaauggacaucggggugccgcugcuggcgaucgguugcuacagccaagucaaccccaucacccucacggccgcccugcuccuacugguggcccacuacgccauaauugggccgggucuucaggccaaagcuacccgggaggcccaaaagcgcgccgccgccggcauaaugaagaaccccaccguggacggcaucacugucaucgacuuggagccgaucccguacgacccgaaguucgagaagcaauugggccaggugauguuauuaauacugugcgucacacagguccugaugaugagaaccaccugggcccucugcgaggcccucaccuuggccacgggccccaucaguacccugugggagggcaacccaggccgauucuggaacacuaccaucgcagugucuauggcgaacaucuuccgagguaguuaccucgccggcgcgggucuccuguucaguaucaugaagaacacgacaaacacccgcaggggcaccgggaacaucggcgagacgcugggcgagaaguggaaaucccggcugaacgcccucggcaagagcgaguuccagauauacaagaaguccggaauccaggaaguggaccgcacccuggcgaaggagggcaucaagcgaggcgaaaccgaccaucaugccguaagccgcggguccgcgaagcugcggugguucguggagaggaauaugguaacccccgagggcaaggucguagaucuaggcuguggccgaggcggguggagcuauuacugcgggggccugaagaacguccgcgaggucaagggcuuaacgaagggcgggccgggucaugaggagcccauccccauguccacuuauggguggaaucucgugcgguuacaaagcggcgucgacgucuuuuucacgccuccugagaaaugcgacacccuacuaugcgauauuggggagagcucccccaaccccaccauugaggcgggccgaacacugagggugcugaaccucguagagaauugguuaaacaacaacacccaauucugcauuaagguccugaaucccuacaugccuucugucaucgagaaaauggaggcacuccagcguaaauacggcggugcgcuggugcggaaccccuuaucccgcaacagcacccaugaaauguacugggucagcaaugccaccggcaacaucgugucuuccgucaacaugaucagccggaugcuuaucaacagauucacgaugaagcacaagaaggccacuuacgagccggacgucgaccucggcuccgguacccgcaacaucgggaucgagagcgagaagccgaaccuugacaucaucggcaaacgcauagaaaagaucaagcaggagcacgagaccuccuggcacuacgaccaggaccaccccuauaaaacgugggccuaccaugggagcuacgagaccaagcaaaccggguccgccaguuccauggugaacggcgugguccgccugcugaccaagcccugggacguggugccgauggucacgcagauggcgaugaccgauaccacccccuuugggcagcagcggguguuuaaggagaagguggacacgcgcacccaggagcccaaagagggaaccaagaagcuaaugaaaauaaccgccgaguggcuguggaaagagcucggcaagaaaaagacgccccggaugugcacccgggaggaguucacucgaaagguccgcagcaacgcggccuugggggcaaucuucaccgacgagaacaaguggaaguccgcgagagaggccguggaggacggccgauucugggagcugguagaccgugagcgcaaccuccaccucgaaggaaagugcgagacgugcguguauaacaugaugggcaaacgggagaagaagcugggggaauucggaaaggccaagggaagcagagccauuugguacauguggcucggugcacgguucuuggaauucgaggccuugggauuucucaaugaagaucacugguucagucgcgguaacagccugucaggcguggagggggagggccugcaucggcucggcuacauccugagggacguggggaagaaggaagguggagccauguacgccgacgacacugccggcugggacacccguaucacccuggaagaccucaagaacgaggagauggucacgaaccauaugaaaggcgagcacaaaaaacucgcagaggccauauucaagcugaccuaccagaacaaggugguuagaguccagcggcccaccccccgcggcaccgugauggacaucaucucccggcgcgaucagcggggcagcggccaggucgguacguauggccuuaacaccuucaccaacauggaggcccagcugauccggcagauggagggagaaggcaucuucaaauccauucagcacuuaaccgcgacggaggagauugccgugcagaacuggcucgcucgcguagggagggagcgccugagccggauggccaucucuggcgacgacugcguaguuaaaccaauugacgauagauuugcgucagcccuuaccgccuuaaaugacauggggaagguccggaaggacauccagcagugggaacccucccgcggcuggaaugacuggacccagguccccuucugcagccaucacuuccacgagcuggugaugaaggacgggcggguguugguggugcccugccgcaaucaggacgaguugaucggucgugcgcgcaucucccagggcgcuggguggagccugaaggaaaccgcaugucugggcaaauccuacgcgcagauguggacacucauguauuuccacagacgcgaccugcggcuggcagcaaacgccaucugcucagccgugccaucccacuggguccccacgagccgcaccacuugguccauccacgcuaagcacgaguggaugacuacggaggacaugcucgcgguauggaaucggguauggauccaggagaaccccuggauggaggacaagacgccgguggagaguugggaggagguacccuaccuagggaaacgcgaggaccaguggugcggcagccucaucgggcucacaucucgggcgacgugggccaagaacauccagacggccauaaaucagguccgcagccucaucggcaaugaggaauacacugacuacaugcccagcaugaagcgcuuccggagggaggaggaggaggccggcgugcugugguga

SEQ ID NO: 25077 - RNA, 9876 nt, Artificial Sequence
  derived and/or modified CDS sequence (opt11) from DENV-2__EU482754__SS-prME
accgcgggagugaucguaaugcugauccccacagcaauggcguuccaucugaccacgaggaacggagagccgcacaugauuguuggccgucaggagaaggggaagucgcuguuguucaagacagaagacgguguaaacauguguacucucauggcaauggaccugggggaguugugugaggacaccaucaccuauaagugcccccuccuucgccagaacgaacccgaggauauugacugcuggugcaacagcacuagcacaugggucaccuaugguaccugcaccacuacgggcgagcaucgacgcgagaagcggucaguggcccuagugccccaugucggaaugggauuggagacucgcaccgagacuuggauguccuccgaaggggccuggaagcacgugcagcggauugagacuuggauccugaggcacccugguuuuacuaucauggccgcgaucuuagccuacaccauugggaccacccacuuucagcgggcauugauauucauucuguugaccgcagucgcgccuagcaugaccaugcggugcaucggcaucucgaaccgggacuuuguagagggaguaagugggggcuccuggguggacaucguccucgaacacgggagcugugucaccaccauggccaagaauaagcccacauuggacuucgagcucaucaagaccgaggcuaaacagccugccacgcuccgcaaguauugcauagaggccaagcugacgaacacgaccacagaaucccggugccccacgcagggcgagcccucccugaacgaggagcaggauaaacguuucauuugcaagcacaguaugguggaccgggguugggggaacgguugcggguuauuuggcaagggagggaucguaaccugcgcgauguuuacgugcaagaagaacauggaggggaaggugguccagcccgagaacuuagaauacacuaucgucaucacgccucacagcggggaggagcaugcuguggggaacgacaccggcaaacacggcaaggagaucaagaucacgccacaguccagcauuaccgaggccgaacugacaggguacggcacggugaccauggagugcagcccccgcacgggccuggauuucaacgagaugguccuccugcaaauggaggacaaagccuggcuugugcaccggcagugguuucuggaccugccccuccccuggcugccgggggccgacacccaggguuccaauuggauccagaaggaaacgcuggugaccuucaagaauccgcaugcaaagaagcaggacguagugguccucggaucccaagagggcgcuaugcacaccgcccuaacgggggccacggagauccaaaugucaagcgggaaccuccuuuucaccggccaccuaaagugccgccugcguauggauaagcuccagcucaaggggauguccuacagcaugugcacaggcaaguucaagauugugaaggaaauugccgagacacagcacggcacgauagugauccggguucaguacgagggcgacggaaguccgugcaagauucccuucgagaucaccgaucuggaaaagcggcacguucuugggcgucuuaucacuguaaacccuaucguaacggagaaagacagcccagugaacaucgaagcugagccgccguuuggggacuccuauaucaucauagggguggaaccgggacaacugaagcugaauugguuuaagaaaggcagcuccauuggccagauguucgaaacaacaaugcgcggcgcuaagcggauggccauccugggggacaccgccugggacuuuggcagccucgggggcgucuucacguccauaggaaaggcccuccaccagguuuucggggccaucuacggagccgcguucagcgggguguccuggacgaugaagauccugauuggcgucauuauaacguggauaggcaugaacagccgcuccaccucucuguccgugagccugguccucgucggcguaguuacccuguacuugggcgcaaugguccaggcggacucuggcuguguggugagcuggaagaacaaggagcucaagugcggcuccgggaucuucaucacggauaacauccacaccuggacugagcaguacaaguuucagccagaauccccaucaaagcuggccucggccauccagaaggcccacgaggaggguauaugcggcauccggagcgucaccagacuggagaacuugauguggaagcaaauuacgcccgagcugaaccacauccugucggagaacgaggugaaguugaccaucaugacaggcgacauccggggcaucaugcaagccgguaagcgaaguuuaagaccucaacccaccgagcugaaguauuccuggaagacgugggguaaagcuaaaaugcucucaacagaaucacauaaccagacguuccuuaucgacggcccggagaccgcggaguguccuaauaccaauagagccuggaacagucuggaaguggaagacuacggcuucggggucuuuaccaccaauaucuggcucaagcugcgggagaaacaggacguguuuugcgauuccaagcugaugagcgcggccauaaaagacaaccgcgcgguccacgccgauaugggcuacuggaucgaguccgcacuaaacgacacguggaagauggagaaagccagcuucauugaggugaaaagcugucacuggccgaaaagccacacccugugguccaacggcgugcuggaaucagagaugaucauccccaagaacuucgccgggcccguuucucagcacaacuaccggccgggguaccacacccagacagcggggccguggcaucucggcaaguuggagauggauuuugaucuuugcgaagggaccaccgucguggugacggaggauugcggcaaccgcggccccagccuccggacuaccacggccagcgguaagcucaucacggagugguguugccgcuccugcacacugcccccgcuccgguacaggggcgaggaugggugcugguacggaauggagauccggccccugaaggagaaggaggaaaaucuugugaauagccucgugaccgcaggacacggccagauugacaacuucucccugggcgugcuggggauggcacucuuccuggaggagaugcugcggacccggaucggcacgaagcacgccauccuccugguagcuguuucuuucgugaccuugaucacugggaacauguccuuucgcgacuuaggccgcgucauggugauggugggagccacgaugacagaugauaucggcaugggggugaccuaccuggcccugcuagcugcguucaagguacggccgaccuuugcugccggacugcugcuccgcaagcugaccagcaaggagcugaugauggccaccaucggaaucgcguuacuuucccagagcaccauccccgagacaauccuggaacucaccgacgcacuggcgcuggggaugaugguccucaagaucguccggaacauggagaaauaccagcuagcggugacaauuauggccaucuccugcgugcccaacgcagucaucuuacagaacgcguggaaggugaguugcaccauacucgccgccguuucugucagcccguuacugcucacgucgagucagcaaaaagccgacuggaucccgcuggcucugacaaucaaaggcuugaacccgacggccauuuuccugaccacgcuuucccguaccagcaagaaacgguccuggccgcucaaugaggcaauaauggccguuggaauggucaguauuuuggccuccagccugcucaaaaacgauauuccgaugacuggcccgcuuguggcgggcggucuacuuacugucugcuauguucugaccggucgaagcgccgauuuagagcucgaaagggcugccgacgucaagugggaggaucaggccgagauuuccgggagcucgcccaucuuaagcaucacgaucuccgaagacggcagcauguccaucaagaaugaggaggaggaacaaacucugaccauacucauacgaaccggccuccuggugaucucgggaguuuuuccggugucgaucccaaucacagcagccgccugguacuugugggaagugaagaagcaacgggcggggguccuuugggacguccccuccccgccgccgguagaaaaggcugagcucgaggacggggcguaccggaucaaacagcgggggaucuugggauacucccagaucggagccggcgucuacaaagaggggaccuuccacacgauguggcacgugacccgcggggccgugcugaugcaccgggggaagcgcaucgagccgucgugggcagacguuaagaaggaccuaaucuccuacggcgggggcuggaagcucgaaggcgaguggaaggagggcgaggaaguccaagugcuggcccuugagccgggcaagaacccccgggcgguucaaacaaagcccgggaucuucaagaccaacacgggcaccaucggggccgucagccucgacuucucucccggcaccagcggaucgcccaucguggaccgaaagggcaagguagugggucuguacgggaacggcguagucacacguagcggugccuacguguccgcuauugcgcaaacggagaaguccauagaggacaaccccgaaaucgaggacgacaucuuccgcaagaagcggcucacuaucauggaccuccacccuggggccggcaagacuaagcgcuaucugcccgccauagugcgggaggccauuaagcgagggcugcgcacgcugauccucgcgcccacuagaguuguggcggccgaaauggaggaggcacugcgcggccugcccauucgguaucagacuaccgcgaucaaaaccgagcacaccgggcgcgagaucguggaccucaugugccaugccacauucacuaugcggcugcugucucccguccgugugcccaacuacaaccucaucauuauggacgaagcgcacuucaccgauccggccuccaucgcagcccggggcuauaucagcacgaggguggaaaugggcgaggccgccggcaucuucaugaccgcgacgccgcccggcucccgggaucccuucccgcagagcaacgcccccaucauggacgaggagcgcgagauccccgaacgaaguuggaacucugggcacgaaugggucaccgacuucaagggcaagacggucugguucgugcccagcaucaaggccgguaacgacaucgcggcgugccuacgcaaaaacggcaagaaggucauccaacugagccguaagaccuucgauagugaauacgugaagacccgcgcaaacgacugggauuucguugucaccacggauaucagcgagaugggugccaacuuuaaggcagagcgggugauugacccacgccguugcaugaaacccgugaucuuaaccgacggagaggaacgaguuaucuuagccgggccgaugccggugacccacuccuccgccgcgcaacgacgcgggcgcaucggccgaaauccaaagaacgagaaugaccaauacaucuacaugggggagccccuggagaacgacgaggacugcgcacacuggaaggaggccaagaugcuccuggauaacaucaacacccccgaaggcaucauacccucgauguucgagccggagcgcgagaagguagacgccaucgacggugaauaccggcugcgcggagaggcccggaagacguucguagaccuuaugcgcagaggggauuuacccguguggcucgccuacaagguggcagccgaggggauuaacuaugcugaccgcaaguggugcuucgacggcauaaagaacaaccagauccuagaagaaaacauggagguagagauauggacaaaggagggagagcggaagaagcucaagccccgcuggcuggacgcccggaucuacagugauccguuagcgcugaaagaguucaaggaguuugccgcgggccgcaaauccuuaaccuugaaccuaauuaccgagauggggcggcucccaacauuuaugacccaaaaggcacgcaacgcccuugacaaccuggcuguucuucacaccgccgaagccgggggcagagcauacaaucacgcccucucugaguuaccggagacacuagagacgcuuuuauugcucaccuuacuggccaccguaacgggaggcauuuuucucuuccugauguccggcaaggggaucggaaagaugacccugggaaugugcugcaucaucacggccaguauccuccugugguacgcgcagauccagccccacuggaucgccgccuccaucauccuggaguucuuccugaucguccuguuaaucccggaaccugagaagcaacgcacgccucaggacaaccagcucacuuacguggucaucgccauccugaccgugguggccgcgacuauggcgaacgaaaugggcuuccuggagaagaccaagaaggaccuaggucugggcagcauaacaacgcaagagucugagaguaacauccucgauaucgacuugcggccugcaagcgcguggacguuauacgcggucgcgaccaccuucguaacgccaaugcugcgccacuccaucgaaaauucgucagugaacgucaguuugacagccauugccaaccaggccacgguucugaugggucuugggaagggcuggccucucagcaaaauggacauugguguuccccuacuagcuaucggcuguuauagccaggucaaccccauaacacucaccgccgcgcuguugcuccuggucgcccacuacgcuaucauagggcccggccugcaagcgaaggcaacgcgggaggcccaaaagcgcgcugcagcgggaauaaugaagaaccccacgguagacgggauuaccgucaucgaccuagagcccauccccuacgacccgaaguucgagaaacagcugggacaggugaugcugcucauucucugugugacucagguucugaugaugcguacgacuugggcccucugcgaggcacugacguuggccaccggccccauaaguacguugugggagggcaacccuggacgcuuuuggaauaccaccaucgcggugagcauggcuaacaucuuccgcggcucguacuuagccggcgccgggcuacuguucucuaucaugaagaacaccacgaacacacgacgcggcaccggcaacaucggcgagacgcuuggggaaaaguggaaaucccggcugaacgcccucggcaaguccgaguuccagaucuauaagaaauccggaauccaggagguggaucgcacacuggcgaaggaagggaucaagcggggcgagacggaccaccacgcggucucucgcgguucggccaaacugcggugguucguggagcgcaacaugguuacccccgaaggcaaaguggucgaccucgguugugggcgaggcggguggucauauuacugcggaggacugaagaaugugagggaggucaaaggccuuacaaagggcggaccaggccaugaggagcccaucccgaugucuacguacggcuggaaccuagugcggcuucagagcggcguugacguguucuucacuccgcccgagaagugugacacccuguuaugugacaucggggagucuucccccaauccuacgaucgaagcgggccgcaccuugcggguccuuaaccucguugaaaacuggcugaacaacaacacgcaguucuguaucaagguccugaacccguacaugccauccgugaucgagaagauggaggcccuccaacguaaauacggcggggcucuggugcgaaaucccuuguccagaaacagcacucacgagauguauuggguauccaacgccacuggcaacaucguguccuccgugaacaugaucucgcggaugcuaaucaaccgcuucacuaugaagcauaagaaggccacguacgagcccgacgucgaccuuggguccggcacacggaauaucgggaucgagagugaaauuccgaaccucgacaucaucggcaagcguauagagaagaucaagcaagagcacgagacuuccuggcacuacgaccaggaccaucccuacaagacgugggcuuaucacgguagcuacgaaacuaagcagaccgggucagccagcucaauggugaacggcgugguccggcugcuuaccaagcccugggauguggugccaauggucacccagauggccaugacggacaccaccccauucggucagcagcggguauuuaaggagaagguggacacccgcacccaggagcccaaggaagguacaaagaagcugaugaagauuacggccgaguggcuguggaaggagcucgggaagaaaaagacgcccaggaugugcacccgcgaggaguucacccguaagguccgaaguaacgcggcccuuggagcgaucuucaccgacgagaacaaauggaaaagcgcaagagaagcuguagaagaugggcgcuucugggagcugguugacagggagcgcaaccuccaucucgaaggcaagugugagacuugcgucuacaacaugauggguaaacgggagaagaaacuuggggaguucggcaaagcgaaggggagccgcgcaaucugguacauguggcugggggcgcgguuccuggaguucgaggcccugggcuuccuaaacgaagaccauugguucucgcgugggaacagccugagcggaguagagggggaaggccugcaccgguuggguuauauucuacgcgacguuggcaagaaggaggguggggccauguacgccgacgacacggcgggaugggacacccggaucacacuggaagaucucaagaacgaggaaaugguaacgaaucacaugaaaggagagcacaagaaacuugcugaggccaucuuuaaacugacguaucaaaacaaagugguucgcgugcaaagaccaaccccgcgcggcaccgugauggauauuaucucccguagagaucagaggggcagcgggcaagucgggacuuacggguuaaauacuuuuaccaacauggaagcacagcucauccggcagauggaaggugagggaaucuucaaguccauucagcaccugaccgcuaccgaggagaucgccgugcagaauuggcucgcucgcgugggaagggaaagacugagccggauggccaucaguggcgaugacugcgucgugaaacccaucgacgaccgcuuugccagugcacuaacggcccucaaugacaugggcaaggucaggaaagauauccaacagugggaacccucacgcggauggaacgacuggacucaggucccguuuuguagccaccauuuccacgagcuggugaugaaagacgggcgggugcuggucguaccaugccgaaaccaggaugagcuaaucgggcgggcgcggaucucccagggcgccggauggucucugaaggagacggccugccuggggaaguccuacgcacagauguggacccucauguauuuccaccggcgcgacuuacggcuggccgccaacgccaucugcagcgcuguccccucccauuggguccccaccucccguaccaccugguccauccacgccaagcacgaguggaugaccacugaggacauguuggccguauggaaccgggucuggauccaggagaaccccuggauggaagacaagacaccggucgagagcugggaagaggugccauaccuggggaagagggaagaccaguggugcggcucucugauaggacuaaccucucgggcaaccugggccaagaacauacagaccgccaucaaucagguccgcucacuaaucggcaacgaagaauauacggacuacaugcccuccaugaagcgcuuccggcgcgaggaggaagaggcgggcguacugugguga

SEQ ID NO: 25078 - RNA, 9876 nt, Artificial Sequence
  derived and/or modified CDS sequence (opt11) from DENV-2__FJ478455__SS-prME
acugccggugugaucgucaugcugauccccaccgccauggcguuccaucucaccacucgcaauggggagccacacaugaucgucggcagacaagagaagggaaagucucugcuguucaagaccgaggacggcguuaauaugugcacccucauggccauugaccugggggaacugugcgaggacaccaucaccuacaagugcccucuccugcggcagaaugaacccgaggacauagacuguugguguaacagcaccagcaccuggguaaccuacgggacuugcaccacgacuggcgagcaccggagagagaagcggagcgucgcucuggugccccaugucgggaugggacuggagacccgcaccgagacuuggaugagcagcgagggggcguggaagcacguccagcggaucgagaccuggauccugcgccacccgggcuucaccauaauggcggcgauacuggccuacacgaucgggacuacucauuuccaacgggcccucaucuucauuuugcugaccgccguggcgcccucaaugacuaugcgaugcaucggcauuucgaaccgggacuucguugagggcgucucagggggaagcuggguggacaucguccucgagcacgggagcugcgucaccacgauggccaagaauaagccaacccucgacuucgagcugauaaagacggaggccaagcagcccgcuacccuccgcaaguacugcaucgaggccaagcugacgaacaccaccaccgagucccggugcccgacucagggggagcccucccuuaacgaggagcaggacaaacgcuucaucugcaagcauuccaugguggaucggggcugggggaacggcugcggucucuucggcaagggcggcaucgugaccugcgcgauguucacgugcaagaagaacauggagggcaaggugguccaaccugagaauuuagaauacacaaucgucauuacgccucacagcggagaggagcaugccgucggcaacgacaccgggaagcacgguaaggagaucaagaucaccccgcagucguccaucacagaggccgaacugaccggcuacggcacggugaccauggagugcagcccccggacuggcuuggacuucaacgagauggucuuacugcagauggaggacaaagccuggcucguccaccggcagugguucuuagaccugccccuacccuggcuaccaggggccgacacccagggcaguaacuggauccaaaaggagacgcugguaaccuucaagaacccccacgcaaagaaacaagaugucgugguccuugggucccaggagggcgccaugcacaccgcucugaccggggccacggagauccagaugagcagcggcaaccuccuguuuacgggccaccugaaaugccgccuccggauggacaagcuccagcuuaaggggauguccuacagcauguguaccggcaaguucaagaucguuaaggagaucgccgaaacgcagcacgguacgaucgucauccguguccaguacgagggcgauggcucccccugcaagauccccuucgagaucacugaccuggagaagcggcacgugcucggucgccuaaucaccgugaaccccaucgucacugagaaggacagccccgugaacaucgaagcggagccgccguucggcgacuccuacaucaucaucgggguggagccgggccagcugaagcuaaacugguucaagaaggggagcagcaucggccagauguucgaaacgaccaugaggggugccaagaggauggccauccuuggggacaccgccugggauuucggcagccucggcggcgucuuuaccucgaucgggaaggcccuccaucagguauucggcgcgaucuacggcgccgccuucagugggguguccuggaccaugaagauccugaucggcguuaucaucaccuggaucggaaugaauagccgcaguaccagccugucaguaucgcugguccucgucggugugguaacccuuuaucugggggcagucgugcaggcagacuccggcugcguugugagcuggaaaaacaaagagcucaagugcgguuccggaaucuucaucacggacaacgugcacaccuggacggagcaauacaaguuccaacccgagucacccagcaagcuggccucugcaauacagaaggcucacgaggagggcaucugcgggauccggagcgugacuagacuggaaaaccucauguggaagcaaauaacgcccgaguugaaccacauccucuccgagaacgagguuaagcucaccaucaugaccggcgacauaaaggguaucaugcaggccgggaaacgcucucuacgcccacagcccacagaguuaaaguauuccuggaagacguggggcaaggcgaagaugcucagcacagaaagccacaaccagaccuuccugauagaugggcccgagacggucgaguguccuaacacgaaccgggccuggaacagcuuagagguggaggacuauggguuugguguguucaccaccaacaucuggcucaagcugcgcgaaaagcaggacguguucugugacuccaaacugaugagcgcggccauuaaggacaaucgcgccgugcaugcggacaugggcuacuggaucgaguccgcccugaacgacaccuggaagauggagaaggccucguucaucgaggucaagucuugucacuggcccaagagccacacccugugguccaacggcguguuggagagcgaaaugaucauaccaaagaacuuugccgggcccgucucccaacauaacuaccgcccgggcuaccacacgcagacggcagggcccuggcaccuuggcaagcuugaaauggacuucgacuuuugcgaagggaccaccgucguagucacggaggacuguggcaacaggggccccagccugaggacgacgacggcgagcgggaaguuaauuacggaguggugcugccgguccugcacccugccaccacucagauaccggggcgaggacgggugcugguacggcauggagaucaggccccucaaggaaaaggaggagaaccuggucaacagccuggugaccgcggggcacggccagaucgacaacuuuuccuugggcguucuagggauggcccuguuccucgaggagaugcuucggacucgcauuggcacaaagcacgcaauccuccucgucgcggucucuuucgugaccuugaucacugggaauauguccuuccgggaccuaggccgcgucauggugauggugggggccaccaugacggacgacaucggcaugggcgucaccuaccuggcccugcuggcggcauucaaggugcgccccaccuucgcggccggucuccuacugcggaagcucaccaguaaggagcugaugauggcgacgaucggcaucgcccugcucucccagagcaccauccccgaaaccauacuggagcugaccgacgcccucgcacuugggaugaugguccucaaaaucguucguaacauggagaaguaucagcucgcagugacuaucauggcgaucuccugugugccgaacgccgucauccugcaaaaugccuggaaagugagcugcaccauccucgcggcagucuccgugagccccuugcuguuaaccaguagccagcagaaggccgacuggauucccuuggcccuuaccaucaaggggcugaaccccaccgccauauuccucaccacccugucgcggaccucgaagaaacgcucauggccguugaacgaggccaucauggccgugggcauggucaguauccuugccuccagccugcugaagaacgacauacccaugacggggcccuugguagccggagggcugcugaccgugugcuauguacucaccggccgcucagcggaccuggagcuggagcgcgcagccgaugugaagugggaggaccaggccgaaaucuccgggagcucccccauccugagcauuaccaucuccgaggacggcagcaugucuaucaagaaugaggaagaagagcagacccugacgauccuuauccggaccggucucuuggucaucagcggggucuuuccugugucgaucccaaucacggcagcggccugguaccuaugggagguaaagaagcagcgcgcuggcguucucugggacguucccagcccgccgcccguggaaaaggccgagcuggaggauggggccuauagaauaaagcaacguggcaucuuaggguauucccagaucggcgcgggugucuacaaggaggggaccuuccacacuauguggcaugucacgcggggcgcgguucucaugcaccgcgggaagcgcaucgagcccagcugggccgacgucaaaaaggaucucaucucuuacggcgggggcuggaagcuggagggcgaauggaaggagggggaggaggugcagguccucgcccuggagcccggcaagaacccccgcgccguccagaccaagccuggaaucuuuaagacaaauacuggcaccaucggggcggugucgcuggacuucucccccggcacaaguggcuccccgaucguggaccgcaaggggaagguuguggggcucuacggaaacggcguggucacccgcucaggugcauacguauccgcaaucgcccagacggagaaguccaucgaggacaacccagaaaucgaggacgacaucuuccggaagaagcgccugaccaucauggaucuucaccccggggcgggcaagaccaaacgguaucuccccgccaucguccgcgaagccauaaaacgggggcuccgcacccuuauacuggcuccgacgcgcgucguggccgcggagauggaggaggcucuccggggcuuacccauccgcuaccaaaccccagcaaucaagaccgagcacacggggcgggagaucguugaccugaugugccacgcgacguucaccaugcgucuccugagccccguccgggugccgaacuacaaccugaucauaauggaugaggcucacuuuaccgauccggccuccaucgcagcacgaggcuacaucagcacuagggucgaaaugggcgaggccgccgguaucuucaugacagcgacgccgcccggcucuagggacccguucccccaaaguaacgcccccauaauggacgaggagagagagaucccggagcgcuccuggaacagcggucacgagugggucacagauuuuaaaggcaagaccgugugguucgugccgucuauaaaggcggggaaugacauugcagcgugccuccguaagaauggcaagaaggucauccaguuaagccgcaagacguucgacucugaguacguuaagacccgagccaacgacugggacuucguaguaaccaccgacaucagcgagaugggcgccaacuucaaggccgagagggugaucgaccccaggcgcugcaugaagccggugauccugacggacggggaggagcgggucauccucgccggcccaaugccggugacacacuccucagcggcccagcgccggggccggaucggccgcaacccaaaaaacgaaaacgaccaguacaucuauaugggggagcccuuggagaacgacgaagacugcgcccacuggaaggaagccaaaaugcugcucgacaacaucaauacccccgagggcaucauccccuccauguucgagcccgaaagggagaagguagacgccauagacggggaguaccgccuccgcggggaagcacgcaagaccuucgucgaucugaugcgccgcggugaccuccccguauggcuggcguacaagguggccgccgaggggauaaacuacgccgaccguaaauggugcuucgacggcaucaagaacaaccagauauuggaagagaacauggagguugagauuuggacuaaggagggggagcgcaagaaacucaagcccagguggcucgacgcgcgcaucuauucugaccccuuagcccucaaggaguucaaggaauucgcugccgggcggaagucccugacccucaaccucauaacagagaugggccggcugccuacguuuaugacgcaaaaggcgagaaacgcacuggacaacuuggcagugcugcacaccgccgaggccggggggcgagcguacaaccacgcccuaagcgagcucccagaaacgcuggagacccugcuucugcucacgcuucuggcaaccgucacagggggaaucuuccucuuccucauguccggcaaaggaaucggcaagaugacccuaggcaugugcugcauaaucacggccagcauccugcucugguacgcccagauccaaccccacuggauagcggccuccaucaucuuagaauucuuccugaucgugcuccugaucccagagcccgagaagcagcggacgccgcaagacaaccagcugaccuauguggucauugccauccucacagugguggccgccaccauggcgaacgagaugggcuuccuagagaaaacgaaaaaggacuuggggcugggcuccauuaccacccaggagucugaaucaaacauacuggacaucgaucugcgcccggccagcgcuuggacccucuacgccgucgccacgaccuucgugacgcccaugcugcggcacaguauagagaacagcuccgugaacguuucguugaccgcgaucgccaaccaggccacggugcuuaugggucuugggaaaggcuggccccuguccaagauggacaucggggugccguuguuagcgaucggcugcuauucgcaggugaacccgaucacacugacagcagcccuccugcuacucguggcccauuacgccauuauaggucccggucugcaggccaaggccacucgcgaggcucaaaagcgggccgcugccgggaucaugaagaaccccacgguggacggaaucaccguaaucgaccuggaaccgauaccuuacgauccgaaguuugagaagcagcuuggucaggugaugcugcugauucucugcgugacgcagguccugaugaugcgcaccacgugggcgcucugcgaggcccucacgcuggccaccgggcccaucuccacccugugggaggguaacccggggcgguucuggaacacuaccauagcggucucuauggccaacaucuuccgcggcucauauuuagcuggcgccgggcugcuguucagcaucaugaagaauaccaccuccacgcgccggggcaccgggaacaucggggaaacucucggggagaaguggaagucccggcugaaugcccucggcaaguccgaguuccagaucuauaaaaaguccggcauccaggagguggaccggacucuugccaaggaggggaucaagcgcggagagacggaccaccacgcggucucucgggggucggcuaagcugcgaugguucguugagcggaacauggugacccccgaaggcaagguuguggaccugggcugcggacgcggugggugguccuacuacugcggcgggcucaagaacgugcgggaggucaagggccugaccaagggugggcccggccacgaagagccaaucccaaugucgaccuacggguggaacuugguucgccuccagagcggaguggacgucuucuucacgccuccggagaagugcgacacccuacugugcgacaucggggaguccagccccaaccccaccaucgaagccggccgcacacuccgcguauugaaccuuguggagaacuggcucaacaacaacacccaguucuguaucaagguccugaacccguacaugcccuccgugaucgagaagauggaggcccugcaacggcaguacgguggggcucucgugcgcaacccucugagccggaauuccacucaugagauguacugggucaguaacgccaccggcaacaucgucuccagcgugaacaugaucucccgcaugcucaucaaccgguucaccaugaagcacaagaaggcuacuuacgagccugacgucgaccuggggagcggaacuagaaacaucgggaucgagucugaaaucccuaaucuugacaucauaggcaagcggaucgagaagaucaagcaggagcaugagaucagcuggcacuacgaccaagaccaccccuacaagaccugggccuaccacggcuccuacgagaccaaacaaaccgggagugcuuccagcaugguuaacgggguggucagacuauugacgaagcccugggauguggugccgauggucacccagauggccaugacggacacuacgcccuucgggcaacagcgcguguucaaggaaaagguggauacaaggacucaggagccaaaggaggguaccaaaaaacucaugaagaucacugccgaguggcuauggaaggaauuaggcaagaagaagacgccccgcauguguacccgugaggaguucacccgcaagguccggucuaaugccgcuuuaggagccauauucacagacgagaacaaguggaaguccgcgcgcgaagcgguggaggacggccgcuucugggagcugguggaccgcgagaggaaccugcaccucgagggcaagugcgagaccugcgucuacaacaugaugggcaagagggagaagaagcugggggaguuuggcaaggcaaagggcuccagagccaucugguacauguggcuaggggccagauuccucgaguucgaggcgcugggcuuccugaacgaggaccacugguucagccggggaaauucucucuccggagucgagggggagggccugcaccgccugggcuacauccuccgggacgucgggaaaaaggagggcggggccauguacgccgaugacaccgccggcugggacacacgcaucacgcuugaggaccuuaagaacgaggagauggugaccaaccauaugaagggugaacacaagaaauuggccgaagcgaucuuuaagcugaccuaccaaaacaaggugguccgagugcaacggccgacgcccagaggcacgguaauggacaucaucagccgccgggaccagcgcggcagcggucaagucggcaccuacggucugaacacuuuuacaaacauggaagcccagcucaucagacagauggagggcgaaggcauauucaagucgauucaacaucugacggccaccgaagagaucgccguacaaaacuggcuggcacgggugggucgugagcggcucucccgaauggcgaucagcggcgacgacugcgucguuaagcccaucgacgacagauuugccuccgcccugaccgcacugaacgacauggggaaagugcguaaggacauccaacagugggaacccucacggggauggaacgacuggacccaggucccguucuguucucaccacuuccaugagcucgugaugaaggaugggcgcgugcuggucgugccuugccgaaaccaggacgagcuaauaggcagggcccgaaucucgcagggugcgggguggucccucaaggagacggccugccuggguaagucauacgcccagauguggacccucauguauuuccaccgucgggaucuccgccuggccgccaacgcuaucugcuccgcugugcccagccacuggguacccaccucccguacaaccuggaguauacacgccaagcacgaguggaugacgaccgaagacaugcuggccguuuggaaccgcguuuggauccaggagaacccguggauggaggacaagacacccgucgaguccugggaggaagugccauaccucgggaagcgggaggaucaguggugcggcagccugaucggccucaccucacgcgcuacgugggcuaagaacauucaggccgcaaucaaccaagugcggucccucauagguaacgaggaauacaccgacuacaugcccagcaugaagcgcuuccgccgggaggaggaggaggccgggguccugugguag

SEQ ID NO: 25079 - RNA, 9876 nt, Artificial Sequence
  derived and/or modified CDS sequence (opt11) from DENV-2__EU482756__SS-prME
accgcgggggugaucgucaugcugauccccacagcuauggcguuucaccucacgacacgcaauggggagccgcacaugaucgugggccggcaggagaaggguaagucccuacuguuuaagaccgaggauggcgugaauaugugcacccucauggccauagaccugggggaguuaugugaggacaccaucaccuacaagugcccccuccugcgccagaacgagcccgaagauaucgacugcuggugcaacucgaccucuaccugggucaccuacgggacuugcaccaccacgggcgagcaccggcgggagaagcgguccguggcacuggugccccacgucggaauggguuuggagacccgcaccgagaccuggaugucaucugagggcgcauggaagcacgugcagcggaucgagaccuggauauugcgacacccgggcuuuaccauaauggccgcgauccucgccuacaccauagggaccacccacuuucagcgggcccucauauucauccuguugaccgccguggcgcccagcaugaccaugcguuguaucggcaucuccaaucgggacuucgucgagggcgugagcgguggguccuggguggauaucguccucgaacacgggagcugcguaaccacgauggccaagaacaaacccacgcuggacuucgaguuaaucaagacggaggccaagcagcccgcuacccuacgcaaguacugcauagaggccaagcugaccaacacuacgaccgagucacggugcccgacgcagggcgagccuagccucaacgaggagcaggacaagcgcuucaucugcaagcauuccaugguugaccgggggugggggaauggcugcggguuauucggcaagggcgggaucgugaccugugcgauguucacguguaagaagaacauggaaggcaagguggugcagcccgagaaucuugaguauaccaucgucaucacgccacacagcggcgaggagcacgccgugggcaacgacaccgggaagcacggcaaggaaaucaagauaacaccgcaguccagcaucacggaggccgagcugacaggguacggaaccgugaccauggagugcagcccacggaccggccuagacuucaacgagaugguucugcugcagauggaggacaaggcuuggcucgugcaccggcagugguuccuggaccugccccuccccuggcucccgggggccgacacacaggguagcaacuggauucagaaggagacgcuggugaccuucaagaacccccacgcgaagaagcaggauguugucguccuggggucccaggagggcgcgaugcacaccgcccugaccggggccacggagauucagaugagcucggguaaucuccuauucaccggccaccugaaaugccguuuacggauggacaagcugcagcugaaggggaugucauacagcaugugcaccggaaaauucaagauaguuaaggagauagccgaaacccagcacggaaccauagugauacggguacaguacgagggcgacgguuccccauguaaaauccccuucgagaucaccgaccuggagaagcggcacgugcucgggcguuuaaucaccgugaacccgauugucaccgagaaggacagcccuguuaacauagaggcggagccgccauuuggcgauagcuacaucauaauaggaguggagccgggccagcugaagcucaacugguucaaaaagggaagcagcaucggccagauguucgagacgaccaugcgcggcgcaaaacggauggccauccugggggauaccgccugggauuuuggcagccucggaggggucuucaccuccaucgggaaagcacuacaccaaguauucggagcgauuuacggcgcugccuucuccggggugaguuggacgaugaagauccugaucggcguuaucaucaccuggaucgggaugaacucgcgcucuaccucccuguccgugagccuggugcucgucggcguggugacccuguaccugggcgccaugguccaagcggacuccgguugcgugguguccuggaagaacaaggaacucaaguguggcagugggaucuuuaucacugacaacguccacacauggacugagcaguacaaguuccagcccgagucacccagcaagcuggcauccgccauacagaaggcacacgaggaggguaucugcgggauccggagcguaacccggcuggagaaccucauguggaagcagaucacacccgaguuaaaccacauacugagcgagaaugaggugaaguuaacaaucaugaccggagauauccgggggaucaugcaggcuggcaagcgcagccugcggccccagccgaccgaacugaaauacagcuggaaaacguggggcaaggcgaagaugcucagcaccgagagccacaaucagaccuuccugauagacggucccgaaaccgccgagugccccaauacaaauagggccuggaacagccuugaggucgaggacuacggcuuuggaguguuuaccaccaacaucugguuaaagcugcgggagaagcaggacgucuucugcgacuccaagcucaugagcgccgccaucaaggacaaccgcgcgguccacgccgauaugggcuacuggaucgaguccgcccuaaacgacaccuggaagauggagaaggccucuuucaucgaagugaaauccugucauuggcccaaaucccacacccuguggucgaacggagugcucgagagcgagaugaucaucccgaagaauuucgccgggcccgucucccagcacaacuaucggccgggcuaccauacacagaccgcggggccauggcaccugggaaagcuagagauggacuucgaccugugcgaagggacaaccgugguugucacggaggacugcggcaaccgcggccccaguuuaaggacaaccacggccagcgggaaacugauuacggaguggugcugucgcuccuguacccucccuccgcugcgguaucgcggcgaggacgggugcugguacggcauggagauucggcccuuaaaggagaaggaggagaacuugguaaacucgcucgugacggcuggacauggccagaucgacaacuucagucuuggcguacuugguauggcccucuuccuggaggagaugcugcgaacccggaucggcacgaaguaugcgauccuucugguggccgugagcuucguaacccugaucaccgggaacauguccuuccgagaucucggccgaguuauggugaugguaggggccacuaugacugacgauaucggcaugggggugaccuauuuagcccugcucgcugcguucaagguacggcccaccuucgccgccgggcugcugcuccgcaagcugacgagcaaggagcugaugauggcuacgaucggcauugcccucuugucccagagcaccauccccgagacuauccuugagcugaccgacgcgcuggcccuggggaugaugguccucaaaaucgugcggaacauggagaaauaccaacuggcagugacgauaauggccaucuccugcgucccgaacgccgugauccugcagaaugcguggaaggugagcuguacgauccuugccgccgucuccguauccccacugcuauuaacgucaagccagcagaaggccgacuggaucccccuggcgcugacaauaaagggccucaauccaacggccaucuuccugacgacucuuucccgcacuagcaagaaaagguccuggccguugaacgaggccaucauggcagucggaauggucagcauccuggcguccagccugcucaagaacgauauccccaugaccgggccccuaguggcgggcgggcuacucaccgucugcuacguccugacggggcgcagcgccgacuuagaacucgagagagccgccgacguuaaaugggaagaccaagccgagauuagcgggagcuccccuauccugucuauuacaaucuccgaggacggcagcauguccaucaaaaaugaggaggaggaacagacgcuuaccauccucauccgcaccggccugcuggucaucagcggaguguuccccguguccaucccaaucacggcggccgccugguaccucugggaggugaaaaagcagcgcgccggagugcuaugggacgugcccagcccgccgcccgucgagaaggcggagcuugaggacggcgcguaccgcaucaagcagcgggguauccucggcuacucccaaaucggcgccggcguguacaaagaggggaccuuccauacaauguggcacgugacccgcggggccguccuaaugcaccgggggaagcggaucgagcccaguugggccgauguuaaaaaggaucugaucucauacggcgggggcuggaaacucgagggcgaguggaaagagggggaggaggugcagguccuugcacuggagcccggcaagaacccccgggcggugcagaccaagcccgggauuuucaaaacgaacacgggcaccaucggggccgugagccuggacuucucucccggcaccucaggcucgcccaucgucgaccgcaaggguaagguggucgggcucuacgggaauggcguggugacccguucgggcgcauaugugucagccaucgcgcaaacggaaaagagcaucgaggacaaccccgagauagaggacgauaucuucagaaagaagcgucucaccauuauggaccugcaccccggggccgguaagaccaagcgcuaccugcccgcaauaguccgcgaggcgaucaagcgcgggcugcggacccuaauccucgccccgaccagggugguggcggcggaaauggaggaagcccugcguggccugcccauccgguaucagacaacggcaaucaagaccgagcacacggggcgcgagauagucgacuuaaugugccacgccaccuuuaccaugcgauuacugucaccggugagagugcccaacuacaaccugaucaucauggacgaggcgcauuucaccgacccggccuccauugccgcgaggggcuacaucucgacucggguggagaugggcgaggccgcggggaucuucaugacagccacgccgccaggcagccgggaccccuucccgcagagcaacgcccccauuauggacgaggagcgggaaauccccgagagauccuggaacucugggcacgagugggugacagacuucaaaggcaagacgguaugguucgucccauccaucaaagccgggaacgauaucgcggccugccugcguaaaaacggcaagaaggugauccagcugucucggaagaccuucgacuccgaguacgugaagacgcgcgccaacgacugggauuucgucgugaccacggacaucagcgagaugggagcgaacuucaaagccgagcgggugaucgauccgagaaggugcaugaaacccguuauacucaccgacggggaggagcgcgugauucuggcgggcccgaugccagugacccauagcagcgcagcccagaggcgcggacguaucggcaggaacccgaagaaugagaaugaccaguacaucuacaugggggagccccuggagaacgacgaggacugugcacacuggaaggaggccaagaugcucuuggauaacaucaacacccccgaaggcaucauacccuccauguucgagccagagcgcgagaaggucgacgcgaucgacggcgaguaucgguugagaggggaagcccggaaaacguucgucgaccucaugcgcaggggugaucugccgguguggcuggccuacaaggucgcggcggaggggaucaauuacgcggaccgcaaguggugcuucgacggcaucaagaacaaccagauccucgaggagaacauggaggucgagaucuggaccaaggagggggagcggaagaaacucaagcccagauggcuggacgcccgcauuuacagugacccgcucgcucugaaggaguuuaaggaauuugcggcgggaagaaagucgcugacccucaacuugauuaccgagauggggaggcugcccacguucaugacccaaaaggcccgcaacgcgcucgacaaccuugcugugcugcauaccgccgaggccgggggccgggcguauaaccacgcgcugagcgagcugcccgagaccuuagagacgcuacugcugcugacccuacuggccaccgucaccgggggcaucuuccucuuucugaugucgggcaaggggauaggcaagaugacccugggcaugugcuguaucaucacggccucuauccuccugugguacgcccagauccagccacacuggauugccgcgucaauuauccuggaguucuuucucaucgugcugcucaucccggagcccgaaaaacagcgcacgccacaagacaaccagcucaccuacgucgugauagccauacugaccgugguggccgccacgauggccaacgagaugggcuuccuggagaaaacgaagaaggaccuagggcuggguagcaucaccacccaggaguccgagucaaacauccuugauaucgaccuccggcccgccagcgcauggacccuguacgccguggcgaccacauucgucaccccgaugcugagacacuccaucgagaacagcucggucaacgugagccucaccgcuaucgccaaccaggccaccguguugaugggcuuagggaaaggcuggccccugucaaagauggacaucggggucccccuacucgcgauuggcugcuacagccagguuaaucccaucacccucaccgccgcccugcugcuucugguggcccacuacgccaucaucgggccaggcuuacaggcgaaggccacgcgggaagcccagaagcgagccgccgcaggcaucaugaagaaucccacugucgacggcauaaccgugaucgacuuagagcccaucccauacgacccgaaguucgagaagcagcuagggcaaguaaugcugcucauccugugcgucacccaggugcugaugaugcgcacgaccugggcacucugugaggcccugacccuggcaaccgggcccaucucgacccucugggagggaaaccccggccgcuucuggaacaccacaaucgccgugagcauggcuaauaucuuccgcggcagcuaccucgccggagcggggcuccuguucaguaucaugaagaacacuaccaacacccguaggggcaccgggaauauuggcgagacccugggcgagaaguggaagucgcggcugaacgcccucggcaagucugaguuccaaaucuacaaaaaguccgggauccaggagguagaccgcacguuggcgaaggaggggauaaagcggggugaaaccgaccaccaugccgugagccgcgggucggccaaguuacggugguucguggagcgcaauauggucacccccgagggcaaagugguggauuuaggcugcgggcggggaggguggagcuacuacugcggcggguuaaagaacguccgcgaagugaagggccuuaccaagggcgguccuggccaugaggagccaauccccauguccacguacggguggaaucuggugcggcugcagagcggugucgacgucuucuucaccccgcccgagaagugcgacacacugcucugcgacauuggggaaagcucgccuaacccaaccauugaagccgggcguacgcuccggguacugaaccucgucgaaaacuggcugaacaacaacacccaguucugcaucaaagugcugaacccguacaugcccagugugaucgagaagauggaggcccugcagcgcaaguacggcggggcgcugguccggaacccacucucucgcaacuccacccacgagauguauugggugaguaacgccaccggcaacaucgugagcuccgucaacaugaucagcagaaugcugaucaaccgguucaccaugaagcauaagaaagccaccuacgagcccgacguggaccucggauccggaacccggaacauaggaaucgagagugagaucccgaaccuggauaucauagguaaacgcaucgagaagauaaagcaagagcacgaaaccucguggcacuacgaccaggaccaucccuacaagacgugggccuaccacggcagcuacgagacgaagcagacggguuccgcaucgagcauggugaacggcgucgugcgccugcuuaccaagcccugggacguggugccuauggugacgcaaauggcgaugacggacaccacaccauucggccagcagcggguguucaaggagaaggucgacacccgcacgcaggagcccaaggagggcaccaagaaacuuaugaaaaucaccgccgaauggcuauggaaggagcucggcaagaagaagacgccccggaugugcacgcgcgaggaguuuacucggaaggugcgcuccaacgccgcccugggugcuaucuucaccgaugagaauaaauggaaguccgcgcgggaggcuguggaggacggccgcuucugggaacucgucgaccgggagcgcaaccuccaccuagaagggaagugcgagaccugcguguacaacaugaugggcaagcgggagaagaagcugggggaguucggcaaagccaaggguagccgcgcaaucugguacauguggcucggggcgcgguuccuugaguucgaggcucuggguuuccucaaugaggaucacugguuuucccgcgggaacagccugagcggaguggagggggagggccugcaccggcucggcuacauacucagagacgucgggaagaaggagggcggggccauguaugccgacgauacggccggcugggauacccggaucacuuuagaggacuugaagaacgaggaaauggucaccaaucacaugaaaggagagcauaagaagcuggcggaggccaucuucaagcugacguaccagaacaagguagugcgggugcagagacccacgccccguggcaccgucauggacaucaucucccggcgcgaccagcggggcagcgggcaggucgguaccuacgggcucaacacguuuaccaauauggaggcgcaacugauccggcagauggagggagaaggcaucuucaagucaauacagcaccugacugccaccgaggagaucgccgugcagaauuggcucgcgcgcguaggucgggagaggcugucccguauggcgauauccggcgacgauugcguggugaagcccaucgacgaccgcuucgccagugcccugacggcucucaacgauauggggaagguccggaaggauauccagcagugggaacccagccgcggcuggaacgacuggacgcagguacccuucugcagccaucauuuccacgagcuagugaugaaggacgggcggguucugguagugccgugccgcaaccaagacgaacucauaggccgggcccgcaucucacagggcgccggguggucacugaaggagaccgccugccugggcaagucuuacgcccaaauguggacgcucauguacuuccaccggcgcgaccugcgguuggcggcgaacgccaucugcagcgccguccccucccacugggugccaaccagccgcacgaccuggucgauccacgcaaagcacgaguggaugaccaccgaggauaugcuagcgguguggaaccgagucuggauccaggagaaccccuggauggaggacaaaacgccgguggagucuugggaggaagugccuuaccuggggaaacgcgaggaccaguggugcgguucccugaucgggcucaccagccgggccaccugggccaagaauauccagaccgccaucaaccagguccgcagccugaucgguaacgaagaguacacggacuauaugccaaguaugaagcgcuuucggcgcgaggaggaagaggccggcgugcugugguga

SEQ ID NO: 25080 - RNA, 9876 nt, Artificial Sequence
  derived and/or modified CDS sequence (opt11) from DENV-2__EU482757__SS-prME
accgcgggcgugauagugaugcugaucccgaccgccauggcguuccaccuaacgacgcgcaacggggaaccacacaugaucguggggcggcaggagaaggggaagagucugcuguucaagaccgaggauggcgugaacauguguacucucauggcaauagacuuaggggaacugugugaagauacaaucaccuacaaguguccccugcuccgccagaacgagccagaagacaucgauugcuggugcaacucuaccaguaccugggucacuuacgguaccugcaccacaacgggcgagcaccggcgcgagaagcggucgguugcccuggugccccacgucgggaugggccucgaaaccaggacugagacuuggaugagcagcgagggggccuggaagcacguucaacggaucgagaccuggauccugcgccacccuggcuucaccauaauggccgcgauccucgccuacacgaucgguacuacccacuuucaacgggcgcucaucuuuauucugcugaccgccguggcgcccucaaugaccaugcggugcaucggcaucucgaacagagauuucguggagggcguaagcgggggcagcuggguggacauaguccucgagcaugggagcugcgugaccacgauggccaagaacaagcccacgcuggacuucgaacucaucaagaccgaagccaaacagccugcgacccugcgcaaguacugcauagaggcuaagcucacgaacacaaccacagagucccggugcccaacgcagggcgagccaagccucaacgaggagcaggacaaacgcuucaucugcaagcacuccaugguggaccguggcugggguaacggcugcgggcuguucggcaagggcgggaucgugaccugcgcgauguucacgugcaagaagaacauggaggggaaggucguacagcccgagaacuuagaguacacaaucguaauuacgccgcacucaggggaggaacacgcaguggggaacgacacagggaagcacggcaaggagaucaagaucaccccgcagucgagcauaaccgaagccgagcugaccggguacggcacugugacuauggagugcaguccccguacaggccucgacuucaacgagaugguccugcugcagauggaggacaaggccuggcucgugcaucggcagugguuccuggaccugccccuccccugguuaccgggggccgacacccagggcagcaacuggauccagaaggagacgcuggugacuuucaagaacccccacgcgaaaaagcaggacgucgugguccucgguucccaggagggugccaugcacaccgccuugaccggcgccacugaaauccagaugucgagcgguaaccuccuguucaccggucaccugaagugccgccugcggauggacaagcuacaauugaaggggauguccuacagcaugugcacagggaaguucaagaucgugaaagaaaucgccgagacccagcacgggacgaucgugauccgcguccaguaugagggcgacgggucacccugcaagauccccuucgagaucaccgacuuggagaagcggcaugugcucggcagacugaucaccgugaacccaaucgucaccgagaaagacucgcccguuaauaucgaggcggagccaccauucggagacuccuacaucaucaucgggguggagccgggccagcugaagcucaacugguuuaagaaggggagcuccaucggccaaauguucgagacaaccaugcgcggagccaagcggauggccauacugggggacaccgccugggacuucggcagccucggcggcgucuuuacgaguauuggcaaagcccuccaccagguauucggcgcuauuuacggcgccgccuucagcgggguguccuggacgaugaagaucuuaaucggcguaaucauuaccuggaucgggaugaacucucgcuccacgucucuguccgugagccugguccucgucggcguggugacccuguaucugggggccaugguccaggcagacucuggcugcguggugagcuggaaaaacaaggagcucaaguguggguccgggaucuuuauaacggacaacguccacacguggaccgaacaguacaaguuccagcccgagagccccagcaagcuggcuuccgccauccagaaggcccacgaggagggaaucugcgggauccggagcguuacacgccuggaaaaccuaauguggaagcaaaucacgccagagcugaaccacauacuguccgagaacgaggucaagcucaccauuaugaccggcgacaucaaggggaucaugcaggcaggcaagcggagccugaggccccagcccacugaguuaaaguacagcuggaagacguggggaaaagcgaagaugcucagcaccgagucccacaaccaaacuuuccugauagacgggcccgagaccgccgagugcccgaacacuaauagggcuuggaacagccuggaggucgaggacuauggcuucgggguguucaccaccaacauuuggcucaaguuacgcgagaaacaggauguguuuugcgacaguaagcugaugagcgccgccaucaaggacaaccgggcgguccaugcagauaugggcuacuggaucgagagugcccucaacgacacauggaagauggagaaagcgagcuucaucgaggugaagaguugccacuggcccaagagccacacccugugguccaacggcguucuggagagcgagaugauuauccccaaaaacuucgccggacccgucagccagcauaacuacagaccgggguaucacacgcagaccgccgggcccuggcacuuggguaagcucgagauggacuuugaucugugcgagggaaccaccguggugguaacggaagacugcggcaaccgggggcccucccugcgcaccaccaccgcuagcgggaagcugaucacugaaugguguugccggucguguacccugcccccgcuacgcuaccggggcgaggacggcuguugguacggaauggaaauccguccccucaaggagaaagaggagaaccucgugaacucccucgugacggccggacacggccagaucgauaacuucucccugggcguccuggggauggcguuguuccuugaggagaugcugcguacacgaaucggaacaaagcacgcgauccuccugguggcggugucauucgucacccugauaacagggaacauguccuuccgggaucugggccgcgucaugguaaugguaggggccaccaugacugacgacaucggaaugggcgugaccuaucuugcacugcucgccgcguucaagguacgccccaccuucgccgccggucuccugcuccgaaagcugaccagcaaggaacugaugauggccaccauugguaucgcuuuauugucgcaaucuacaauuccggagacuauucucgagcucaccgacgcgcuugcgcuggggaugaugguacuaaagaucgugagaaacauggagaaauaccagcuugccgugacgaucauggccauauccugcguuccgaacgccgugauacugcagaacgcguggaagguaagcuguaccauccuugccgccguauccgugagcccauuguuacuuaccuccucgcagcaaaaggccgauuggaucccccuagcgcugacgaucaagggccuuaaccccacggcaaucuuccugaccacccugagccggaccagcaaaaagcgcuccuggccgcucaacgaagccaucauggccgucgggaugguguccauacuggccucuagccugcuuaagaacgacaucccgaugacggggccccuggucgcgggaggucugcucaccgucugcuacgugcugaccgggcggagcgcugaccucgaacuugagcgagccgccgacguuaaaugggaggaccaagcggagauauccgggagcucccccauccuguccaucacaauuucggaagacggcuccaugucgaucaagaacgaagaggaagaacagacgcugaccauccucauccggaccggccugcuggucaucagcgggguuuucccgguuuccauccccaucacggcggccgccugguaccucugggaggugaagaagcagcgcgcaggcgugcugugggacgugccaagcccgccacccgucgagaaggccgagcucgaagacggggcguaucguaucaaacagcgggggauacucggauauucccaaaucggcgccggcguguacaaggaggggacauuucacacgauguggcaugugacccggggcgccguccugaugcaucgcgggaagaggaucgagccaagcugggccgacgugaagaaggaccugaucuccuacggcgggggauggaagcucgagggcgaguggaaggaaggcgaggagguucagguccuggcccuggagcccggcaagaacccacgugcggugcaaaccaagcccgggaucuucaagaccaacacgggcacgauaggugccgugagccucgauuucucccccggcaccucgggcucccccaucgucgaucggaagggaaagguggugggauuauacgggaacggcgucgugacccgcagcggcgccuacgugucugccauagcgcagacggagaaguccaucgaggauaaccccgagaucgaggacgacaucuuccggaagaagcgccugaccauaauggaccuccaccccggugcagguaagacaaagcgauacuuacccgccauugucagagaggccaucaagcgggggcugcgcaccuugauacuagcuccgacgcgcgugguggcggccgagauggaggaggcccuaaggggccugcccauccgcuaccagaccccggccaucaagacugagcacaccggccgugagaucguugaccucaugugccaugcgacguuuacgaugcgccugcugucucccgugcgggugccgaauuacaaccucaucaucauggacgaggcgcauuucaccgaccccgccuccaucgcggcccgaggcuacauuagcacccgagucgagaugggcgaggcugcggggauuuucaugacggcuacgccgcccggcucccgcgacccguucccccagagcaacgcccccaucauggacgaggagcgggagauccccgagcgcuccuggaacagcgggcacgagugggucaccgacuucaaaggaaagacagugugguuugucccgucuaucaaggccgggaacgacauugcggcuugccugcggaagaacgggaagaaggugauccaacugucacgcaagacguuugacagugaguacgugaagacccgggccaacgacugggacuucgucgugaccacagacauuagcgagaugggcgcgaauuucaaggcugagcgcgugaucgacccgcgccgcugcaugaagcccgucauccucacggacggagaggagagggugauauuagcgggcccaaugccggugacccacuccagcgccgcacagcgccggggacgcauaggccgcaaucccaagaacgagaacgaccaguacaucuacaugggggagccccuggagaaugacgaggacugcgcccacuggaaggaggccaaaaugcuacuggacaacaucaauacucccgagggcaucaucccguccauguuugagcccgagagggagaaggucgacgcgaucgacggcgaguaccgccugcgcggggaggcacgcaaaaccuucguagaccucaugaggcgcggcgaccuccccguguggcuggccuacaaggucgccgccgaggggaucaacuaugcggaccggaaguggugcuucgacggcaucaagaacaaccagauccucgaggagaacauggaaguggaaauauggacgaaggaaggcgagcgcaagaaacuuaagccacgguggcucgaugcccggauuuacuccgaccccuuagcccugaaggaguucaaagaguucgccgcggggcggaagucccugacacuuaaucugaucaccgagaugggccgccugcccaccuucaugacgcagaaggcgcggaacgccuuggacaaucuggccgugcugcacacggccgaagccggagggcgcgcguacaaccacgcccucagcgagcuacccgagacccuagagacccuccuucuguuaacgcuguuagccaccgucaccgggggcauauuccuauuccugauguccggcaaggggauuggcaagaugacccuggggaugugcugcaucaucaccgccagcauccuccugugguacgcgcagauccagccgcacuggaucgcagccuccaucauacuugaguucuuccucaucguucuacugauucccgagcccgagaagcagcggacgccccaggacaaccagcuaaccuacgucgugaucgccauccugaccgucgucgccgccaccauggcgaaugagaugggcuuccuggagaagacgaagaaggaccucgggcuggguagcaucaccacccaggagagcgaguccaacauccuggacauagaccuccgcccggccagcgcuuggacccuguacgcuguggcgacgaccuucgugacccccaugcugcggcacagcaucgagaauagcuccguuaacguuagccucaccgcuaucgccaaccaggccacaguucugaugggccuggggaaggguuggccccucuccaagauggacaucggggucccccuacuggccaucggcugcuauagccaggugaacccgauuacccucaccgccgcccuguugcuccuaguggcgcacuacgccaucaucgggcccggcuugcaggcgaaggccaccagggaggcccagaagcgggccgcagcaggcauuaugaagaaccccacuguagacgggaucaccgugaucgaccuggagcccauuccguacgaccccaaguuugagaagcagcugggacagguuaugcugcucauacugugugugacccaaguucugaugaugcgcaccacaugggcccucugugaggcccucaccuuagcaaccggcccaaucuccacucucugggagggcaaccccgggcgguucuggaacacuacuaucgccgugagcauggcgaacaucuuccgcggcuccuaccuggccggcgcaggucuccuguucaguaucaugaaaaacacgaccaguacccgccgaggcaccgggaacaucggcgagacccucggcgagaaguggaaaucccgccugaacgcccuaggaaaauccgaguuucaaaucuacaagaaauccggaauccaggaggucgaucggacccuggcuaaggaggggaucaagcgcggggagacggaccaucacgccgugucccgagguagcgccaagcugcgcugguucgucgagcggaacaugguuaccccggagggcaaaguaguugaccugggcugcgggcgcggcggguggucguacuacugcggagggcugaagaacguccgggaggucaagggccugacuaagggcgggcccggccaugaggagcccauucccaugagcaccuacggauggaaucucgugcggcugcagagcgggguagacguguucuucacgccacccgagaagugcgacacccugcuaugugacaucggggaaagcagccccaacccgaccauagaagccggcaggacgcugcgcgugcugaaccucgucgagaacuggcugaacaacaacacccaguucugcaucaagguucuuaauccguacaugccguccgugaucgagaagauggaagcgcuccagcggaaguacggcggggcgcucguacgcaacccccucagcagaaauuccacgcaugagauguauugggugagcaacgccaccggcaacaucgugucuucggucaacaugaucuccagaaugcuaaucaaccgauucaccaugaagcacaagaaggccaccuacgagccggacgucgaucucggguccggcacgcgcaacaucggaaucgaguccgagauucccaaccuggacaucaucggcaagcggaucgagaagaucaagcaggaacacgagacgagcuggcauuaugaucaggaccaccccuacaagaccugggccuaccacggcuccuacgaaaccaaacagaccgggagcgccuccagcauggugaacggggucguuagacugcucacuaaacccugggacguggucccgauggugacccagauggcaaugaccgacacuacccccuuugggcagcagcgcguguucaaggaaaagguagacacccggacccaggagcccaaggagggcacgaagaaacugaugaagaucaccgcggaguggcuauggaaggagcucggcaagaagaagacaccacgcaugugcacacgagaggaguucacucgcaaggugcguagcaacgcggcgcucggggccaucuucaccgacgaaaacaaguggaaauccgcgcgcgaggccguugaggacggccgguucugggagcuagucgacagagagcggaaccuacacuuagaggguaagugcgagaccugcguguacaacaugaugggcaagcgggagaagaagcugggggaguucgguaaggccaagggcucccgggccaucugguauauguggcucggagcgcgcuuccuggaguucgaggccuugggcuuccucaacgaggaccacugguucagccgggggaacagccucagcggcguggagggagagggccugcaccgccucggcuacauccugcgagacgucagcaagaaggaaggaggugccauguaugcggaugacaccgcggggugggacacucgcauaacccuggaggaccucaagaacgaggaaauggugaccaaccacaugaagggugagcacaagaaacuugcggaggccaucuucaagcugaccuaccagaacaagguggugcgggugcaacgcccgacgccccgggggaccgucauggacaucauaagccgccgggaccagcguggcagcggacagguggggaccuacgggcuuaacaccuuuacgaacauggaggcccagcugauucggcagauggagggggagggcaucuucaaguccauccagcaccugacugccacagaggaaaucgugguccagaacuggcucgcccgggucggcagggagcggcuuucaaggauggcgaucucuggggacgauugcguagucaagccgaucgaugaccgguucgccagugccuuaaccgcccucaaugacaugggaaaagugcgcaaggacauccagcagugggagccuucccggggguggaacgauuggacccaggugcccuucuguagccaccacuuccacgagcugguaaugaaagacggccgcgugcuggugguccccugccggaaccaggaugagcugaucggacgcgcccggaucagccagggggcgggauggagcuugaaggagaccgcuugccuggggaaaucguacgcacaaauguggacccucauguacuuccaccgacgugaccugcgccuggccgccaacgccaucuguagcgcugugcccucccacugggugcccaccagccguacaacgugguccauccacgccaagcacgaguggaugaccaccgaggacaugcucgcaguguggaaucgcguguggauucaggaaaacccguggauggaggacaaaacccccguggagagcugggaggaggucccuuaccugggcaaacgggaggaccaauggugcggaagccugaucggccucacgucccgcgcgaccugggccaagaacauccaaaccgcuaucaaccaggugaggagccugaucgggaacgaggaauacaccgacuacaugccaagcaugaagcgguuccggagagaggaggaagaggccggggugcugugguga

SEQ ID NO: 25081 - RNA, 9876 nt, Artificial Sequence
  derived and/or modified CDS sequence (opt11) from DENV-2__FJ906956__SS-prME
accgccggcgugauagucaugcugauccccaccgccauggcguuucaccucaccacccggaauggggaaccccacaugaucguggggaaacaggagaaggggaaaucacugcuguucaagaccgaagacggagugaauaugugcacccucauggcgaucgaccugggugaacugugugaggacaccauuaccuacaaaugcccccuccugcggcagaacgagcccgaggauaucgauugcugguguaacagcaccucgaccugggucaccuacgggaccugcaccaccacgggggagcaccgccgcgaaaagcgcucgguggcccuggugccccacgucgguaugggccucgagacccggacagagaccuggaugagcagugagggggccuggaagcacgugcagcggaucgaaaccuggauccugcggcaccccggcuucaccauaauggccgcgauucuggcauacacgaucgggaccacccacuuccagcgggccuuaaucuucauccugcugaccgccguggcgcccagcaugacuaugcggugcaucggcaucuccaaccgcgacuucgucgagggcgugucagggggcuccuggguggacaucguccucgaacacgggagcugcgugaccacgauggccaagaacaagcccacccucgacuucgagcugaucaagaccgaggccaagcagccugccacgcuccguaaguauugcaucgaggccaagcugacgaacacgacgaccgaaucccggugcccgacccagggcgagcccagccuuaacgaagaacaggacaagcgcuucauaugcaagcacuccaugguggaccgcggcugggggaacggcugcggccuguucgguaagggcgggaucgucacuugugcgauguucacgugcaagaaaaacauggaaggcaagguugugcagcccgaaaaccuggaguacaccaucgucaucacgccccauagcggggaggagcacgcggugggcaacgacaccgggaaacauggcaaagaaaucaagaucaccccgcaguccuccauaaccgaggccgagcucaccggguacggcacggugaccauggagugcucuccccggacuggacuagacuucaaugaaaugguccuucuccagauggaagauaaggccuggcucgugcaccgccagugguucuuggaucugccgcuccccugguuaccuggggccgacacccaggggagcaacuggauccaaaaggagacgcugguaaccuucaagaauccgcacgcgaagaaacaggacgugguuguccucgggucccaggaaggcgccaugcauacagcgcuaaccggggccacggagauccagaugagcucgggcaaccuccuguucaccggccaccugaagugccggcugcgcauggacaagcuccaguugaaggggauguccuacagcaugugcaccggcaaauucaagauagugaaggagaucgccgaaacgcaacacgggacgauugugauccgcguccaguacgagggcgacggcucgcccugcaagauccccuucgagaucaccgaccuggaaaagcgccaugugcucgggcgucugaucaccguuaacccuauagucaccggcaaggauagccccguuaacauugaagcggagccgccguucggggacuccuacauaaucaucgggguggagccggggcagcugaaacucaacugguucaagaaaggcagcaguaucggccagauguuugaaacgaccaugcgaggggccaagcgcauggcaauucugggggauaccgcgugggacuuugggagccuggguggggucuucaccuccauuggaaaggcccuccaucagguuuucggcgcgaucuacggggccgccuuuagcggcguguccuggacgaugaagauucugauaggggucauuaucaccuggaucggcaugaacucccggagcaccagcuuguccgugagccucgugcucgucgggguugugacgcuguaccugggagcgauggugcaagcggacuccggcugcgugguuagcuggaagaauaaggaacugaagugcggguccggcaucuucaucacugacaacguccacaccuggaccgagcaguacaaguuccagccugagagccccucgaagcuggccagugccauacaaaaagcccacgaggaggggaucugcgguauccgcagcgugacccggcuggagaacuugauguggaagcaaaucacgccugagcugaaccacauccuguccgagaacgaagugaagcucacaaucaugaccggggacauccgcggcaucaugcaggccggcaagcggagcuugcgaccucagcccacggaguuaaaauacuccuggaagacgugggggaaggcgaagauguuaagcaccgaaagucauaaccagaccuuuuuaaucgauggccccgagacagccgagugcccgaacacaaaucgggccuggaacagccuugagguggaggacuauggguuuggcguguucaccaccaacaucuggcucaaacugcgcgagaaacaggacguguucugcgacuccaagcugaugagcgccgccaucaaggacaaccgggcgguucacgccgacaugggcuacuggauagaguccgcccucaacgacaccuggaagauggaaaaggccucauuuaucgaggucaagagcugccauuggcccaaaucucacacccugugguccaacggugugcuggagagcgaaauggucaucccaaagaauuuugcaggccccgugucccaacacaauuaucgccccggguaucacacgcagaccgcgggucccuggcaucucgggaagcuggaaauggacuucgaucuaugcgagggcaccaccguugucgugacggaggacugcgggaaccggggucccagcuuacgcaccaccaccgccagcggaaagcugaucaccgagugguguugccgguccugcacucugccgccccuccgcuaccgcggggaggacggcugcugguacgggauggagauccgcccccugaaagagaaggaagagaaccuggugaacagccucguaaccgccggccacggccaaaucgauaacuuuucccugggggugcuuggaauggcgcuauuccuggaggagaugcugcggaccaggaucgguacuaagcacgcgauccugcugguggcagucagcuucguaaccuugaucaccggcaacauguccuuccgggaccucgggcgcguuaugguuauggugggcgccacgaugaccgacgauaucggcaugggggugaccuaccuggccuuacucgccgcauuuaagguacgccccaccuucgccgcgggccugcuguugcggaagcugacaagcaaggagcugaugauggccacgaucgggaucgcccuccugagucaaucaaccauacccgagaccauccucgagcucaccgacgcgcuagcacugggcaugauggugcucaagaucgugagaaauauggaaaaguaucagcuggccgucacgaucauggccaucuccugugugccgaacgccguaauccugcagaacgcguggaagguuuccuguaccauccucgcagcaguguccgugagcccccugcugcucaccucaagccagcagaaggccgacuggaucccgcuggcgcugaccaucaagggccucaaccccacugccaucuuccugacgacucucucccggacaagcaagaagcgcagcuggccgcuaaacgaggcaaucauggccguggggauggugagcauccuggccucgagccugcugaagaacgauauccccaugacgggcccgcuggucgccggugggcuguuaaccgugugcuacgugcugaccgggcggagcgccgaccuggagcucgagcgugccgccgacgucaagugggaggaccaggccgagaucuccgggagcucccccauccugagcaucaccaucuccgaagacgggagcauguccaucaagaaugaggaggaggagcagacgcucaccauccucauccggaccggucuguuaguaaucagcggcguguucccggucuccauccccaucacagccgccgccugguaccucugggaggugaagaagcagcgcgcuggggugcugugggacguccccucaccgccacccguagaaaaagcugagcuggaggacggcgcguaccggaucaaacaacgcgggauccucggcuacucccagaucggcgcggggguguauaaggagggcacguuccauacgauguggcacgucaccaggggcgccguacugaugcaucgggguaagcggauugagccgagcugggcugacguuaagaaggaccuaaucuccuacggggguggcuggaagcucgaaggggaguggaaggaaggcgaggagguccaagugcuugcucuggagcccgggaagaaccccagggccgugcagaccaagcccggaaucuucaaaaccaacacgggaacgaucggagccgugagucucgacuucagccccggcaccagcggcuccccgaucguggaccggaaaggcaagguggucggccuuuacggcaauggagugguaacccgcagcggcgcuuacguuuccgccaucgcgcaaacagagaagucaaucgaggacaaccccgagaucgaagacgacaucuuccggaagaagcgccugaccauuauggaccuccaccccggcgcagggaagaccaagcgguaucuaccggccaucguacgcgaggccaucaagagaggccugcguacccugauucucgccccgacgcgcguggucgcggccgagauggaggaggcccugcgugggcugcccauccgauaccagacgaccgccaucaagaccgagcacacgggccgggagaucguggacuugaugugccaugccaccuucacuaugaggcugcugagccccgugcgggugcccaacuauaaccucaucaucauggacgaggcgcacuucacagaccccgccuccauagccgcgcgcggcuacaucuccacgaggguggagaugggggaggccgcgggcauauucaugaccgccacaccucccgggagucgcgaucccuucccgcagagcaacgcccccaucauggacgaggagcgagagauuccugagcgcaguuggaacucuggucacgagugggugaccgacuucaaggggaaaacggucugguucgugcccuccaucaaggcuggcaacgacaucgcggccugccugcgcaagaauggcaagcgcguuauccagcugagccggaagaccuucgacuccgaguacgucaagacgcgggccaacgacugggacuuugucgugaccacggacaucagcgagaugggggcuaacuucaaagccgagagagucaucgacccacguaggugcaugaagcccgugauccucaccgacggcgaggagcgcgugauccuggcggggcccaugcccgucacacauucgagcgccgcccagcggcgcggccgcauugggcggaacccgaagaacgagaaugaccaauacaucuacaugggcgaaccccuggagaaugacgaggacugugcccacuggaaggaggccaagaugcuccuggacaacaucaacacccccgaggguaucauccccuccauguuugagccggagcgcgagaaggucgacgcgaucgacggggaguaccggcugcggggcgaggcccggaaaacguuuguggaccucaugcgccgcggggaccugccagucuggcuggcuuacaaaguggcugccgagggcaucaacuacgcggaccgcaagugguguuucgaugggaucaagaacaaucagauccucgaggagaacauggagguggagaucuggaccaaggagggcgagcgcaaaaagcugaagccuagauggcuggacgcgcggaucuauagcgacccguuggcccugaaggaguucaaggaguucgcugccggccgcaagagccugacccucaaccugaucaccgagaugggucgucugcccacguucaugacccagaaggcucgcaaugcccuagacaaccuggccguccugcacaccgcugaggcgggcggacgggcguacaaucacgcccucagcgaacugcccgagacccuggaaacucuccugcugcucacucugcuggcuaccgugacaggcggcaucuuccucuucuugauguccgggaaggggaucgggaaaaugacccugggcaugugcugcaucaucacggccagcaucuuacugugguacgcgcagauccagccccauuggauugccgccuccaucauccuggaguuuuuccucaucguauugcugaucccagagcccgaaaaacagcgcacgccucaggacaaccagcuaaccuacguggugauagccaucuugaccgucguggcagcgacaauggccaacgagaugggguucuuggagaagaccaaaaaggaccucggccugggcucgaucaccacacaggagagcgagucgaacauccuggacaucgaccuccggccugcuagcgccuggacgcuguacgcgguggcgaccaccuucguaacaccgauguuacgccacuccaucgagaacaguuccguaaacgucagccucacggccaucgccaaucaggccaccguccugauggggcuaggcaagggguggccccucucaaaaauggacaucggcguaccucugcuggcaaucggguguuacagccaagugaaccccaucacucucaccgccgcgcugcuccuauuagucgcucacuaugccaucaucggaccgggucugcaggcaaaggccacgcgggaggcccagaagcgcgccgccgcggggauuaugaagaaccccacuguggacggcauuacggugaucgaucucgaacccauccccuacgacccgaaguucgagaagcagcuggggcaggucaugcugcuuauccugugcgugacccagguucugaugaugcggacgaccugggcccucugugaggcccugacccuugcaacuggcccgaucuccacgcucugggaagggaaucccggccgcuucuggaauaccaccaucgcuguaagcauggcgaacaucuuccgcgguuccuaccuugccggggccggcuugcucuuuucaaucaugaagaauaccacgaacacccggcgcgggaccggcaacauuggcgagacccuaggagagaaguggaagucacgguuaaacgcccucggcaagagcgaguuccagaucuacaagaagucugggauccaagagguggaccgcacucuagcgaaggaagggaucaagcgaggggagaccgaccaccaugcaguauccagaggcuccgccaaacuacggugguucgucgagcgcaacauggugaccccagaggguaagguugucgaucucggguguggccgcggcggguggagcuacuacugcggaggucugaaaaacgugcgcgaagugaaggggcuaaccaagggcggcccggggcacgaggagcccauacccauguccacguacggcuggaaucuaguccggcugcagagcgggguggacgucuucuuuacgccgcccgagaagugcgacacccugcucugcgacauuggcgagaguucccccaaccccaccauagaagcgggccgaacccugcgggugcugaaccucguugagaacuggcuaaauaacaacacgcaauucugcaucaaagugcugaaccccuacaugcccagcgucauugaaaagauggaagcccuccagcgcaaguacgggggcgcgcuggugaggaacccccuuucccgcaacagcacccacgagauguacuggguuaguaacgcuaccgggaacaucgucucuucugugaauaugaucagccggaugcugaucaaccgcuucaccaugaagcacaagaaggccacuuacgagcccgacguggaccucggcuccgggacgcggaacaucggcaucgagagcgagauaccgaaccuggacaucaucggcaagcgcaucgagaaaaucaagcaggagcaugagaccuccuggcacuacgaccaggaccaccccuacaagacaugggccuaccacgggagcuacgagacgaaacagacgggguccgcgagcuccauggucaacggggugguucggcuguugacaaagcccugggacgucguccccauggugacccagauggcaaugacagacacuaccccguucggacagcagcgggucuucaaggagaagguggacacccgcacacaggagcccaaagagggcacuaagaaauugaugaagaucaccgccgaauggcuguggaaggagcucggcaagaagaagacgccgcgcaugugcacgcgcgaggaguucacccgcaaggugcgaagcaacgccgcccuuggcgccaucuucaccgaugagaacaaguggaaaagugcgcgggaggccgucgaagacgggcgcuucugggaguuaguggaucgagagcgcaaccuccaccuggagggcaagugcgagaccugcgucuacaacaugauggggaaaagagagaagaagcugggugaguuugggaaggcaaaggggagccgcgcuaucugguacaugugguuaggcgcccguuuccuggaguucgaggcccugggguuccucaacgaggaccacugguucucccgaggcaacagccugagcggggucgagggcgagggccugcacaggcucggguacauccugcgcgacgugggaaagaaggagggaggcgccauguaugccgacgacacggccgggugggacacccggaucacccuggaggaccucaagaacgaggagauggucaccaaccacaugaagggcgagcacaagaaguuggccgaggcgaucuuuaagcugacguaccaaaauaagguggugcgcguccagcggcccaccccucgcggcaccgugauggacauuauaucccggagagaccaacgcgggucaggccaggucgggaccuacggucucaacacguucaccaacauggaagcccaacuaauccggcagauggagggagaagggaucuuuaagucgauccagcaucugaccgccaccgaggagauagccguccagaacuggcucgcgagggugggccgggagcgccugagccggauggccauuuccggagacgauugcguggucaagcccaucgacgaucgcuucgccucagcccugacugcccucaacgauaugggcaagguacggaaggacauccagcagugggagcccucccgagguuggaacgacuggacccaggugcccuuuugcagccaccacuuccacgaguuggucaugaaggacggccggguccugguggucccgugccgcaaccaggacgaacugaucggccgggcgaggaucucccagggagccggcuggucacugaaggaaaccgccugccugggcaagucuuacgcccaaauguggacccucauguacuuccaccggcgcgaccugcgguuggccgcgaacgccauuugcucugccgugcccucccacugggugccuaccagccgcacgaccugguccauccacgccaaccacgaauggaugaccaccgaggacaugcucgcaguauggaaccggguguggauucaagagaacccguggauggaggacaagacgccgguggagagcugggaggagguccccuaccugggcaagcgcgaggaccaguggugcgggucccugauuggacucaccucacgggccaccugggccaagaacauccagaccgccaucaaccaggugcgcagccugaucggcaaugaggaguacacggacuacaugcccuccaugaagcgcuuucgucgcgaggaggaggaggcggggguacugugguga

SEQ ID NO: 25082 - RNA, 9876 nt, Artificial Sequence
  derived and/or modified CDS sequence (opt11) from DENV-2__EU482759__SS-prME
accgccggggugauagucaugcuuauaccuacugcaauggcauuucaccucaccacucggaacggggagccgcacaugaucgugggccggcaggaaaaggggaagucccuguuguucaagacagaggacggggugaauaugugcacccuaauggccaucgaccuuggggagcugugcgaagacacuaucaccuacaagugcccccuccugcggcagaacgaacccgaagauaucgacuguuggugcaacucgacgucgaccugggucaccuaugggacguguacuaccacgggcgagcaccggcgagaaaagagguccguagcccuggugccucacgucgggaugggucuagagacccgcaccgagaccuggaugucuuccgaaggggcuuggaagcacgugcagcgcaucgaaacauggauccuccggcaccccggguucaccaucauggcggcgauccuugccuacacaauugggacuacccacuuucaacgagcauugaucuucauccuacugaccgcaguggcgcccagcaugacuaugcgcugcaucggcaucuccaaucgcgacuucguggagggagugagcggagggagcuggguugacauaguccuggagcacggcagcugugugaccacgauggccaagaacaaaccuacucuggacuuugaauugaucaagacagaagcaaagcaacccgccacguugcgcaaguacugcaucgaggccaaacugacgaacacaacaacggagagucggugcccgacccagggcgagcccagccugaaugaggaacaggacaagcgguucaucugcaagcacuccaugguggaucggggcugggggaacggcugcggacuauucggcaagggcggcauugugacgugcgcgauguuuacgugcaagaagaacauggagggcaagguggugcagccggaaaaccuggaguauaccaucgucauuacgccucacagcggagaggagcacgccguggguaacgauaccgggaagcacgggaaggaaaucaagaucaccccgcaaaguucuaucacggaagcggagcuaaccggauacggcacggugaccauggagugcucgccccgcacuggccuagacuucaacgagaugguccuguuacaaauggaggacaaggccuggcucgugcaccggcagugguuccuggaccuuccacuccccuggcucccgggggccgacacccagggcuccaacuggauccaaaaggaaacgcuggugacauuuaagaacccucaugcuaaaaagcaggacguuguaguccucggcucacaggaaggcgccaugcacaccgcccugacgggggccaccgagauccagaugagcagcggcaaccuccuuuuuaccggccaucugaagugccgccugcggauggacaagcuccagcucaagggaauguccuauagcauguguaccggcaaguucaagaucgugaaagagaucgccgaaacccagcacgggaccauaguuauccgcguucaauacgagggcgacgguucucccugcaagauccccuucgagauuacugaccuugagaagcggcauguccucgggcgccugaucacggugaacccuaucgucacugagaaggacagcccugucaacaucgaggccgagccaccguuuggugacucuuacauuauuauaggggucgagccaggacaauuaaagcucaacugguucaagaaggggagcagcauaggacagauguucgagacgaccaugcgcggagcuaagcggauggcgaucuugggggauaccgccugggacuucggcagccucggcgggguguucaccuccaucgggaaggcccugcaccaggucuucggggcgaucuacggggccgccuucagcggcguguccuggacgaugaagauccucaucgggguaaucaucacguggaucgggaugaauagccggagcacuagccucuccguaagccuugugcucgucggcguggugacccuuuaccugggggccaugguccaggcggacucuggaugcguuguaucauggaagaacaaggagcuaaagugugguuccggcaucuucaucaccgacaacguucacaccuggaccgagcaguauaaguuccagccagaaagcccaucgaagcuggcuuccgcuauccagaaggcgcaugaggagggcaucugcgggauccguaguguaacccguuuagagaaucucauguggaagcaaauaacuccagagcugaaucacauccugucagagaacgaggugaagcucacaaucaugacgggugacauacggggaaucaugcaggcaggaaagaggagccugcggccgcagcccaccgaacugaaguacagcuggaagaccugggggaaagcgaagaugcucucaacagaaucccacaaccagacauuccugauagacggucccgagaccgccgaaugcccgaacacaaaccgagccuggaacucacuggaggucgaagauuacggcuucggaguauucacgacgaacaucuggcucaagcugcgggagaagcaggacguguucugcgacagcaaacugaugucggccgcgaucaaggauaacagggcgguccacgccgacaugggcuacuggaucgagucggcccuuaacgacaccuggaagauggaaaaggccagcuucaucgaagugaaguccugucacuggcccaagagccauacccugugguccaacgggguccuggaaagcgagaugaucauccccaaaaacuucgccggucccgugucccagcacaacuaccggccgggguaccacacccagaccgcggggcccuggcaccuuggcaagcuggagauggauuucgaccucugcgaggggacaacugugguggucacggaggauuguggcaacagaggcccuucauuacgaaccacgacagcaagcgggaagcugaucacggaguggugcugccgcuccugcacacugcccccgcucagauaucgcggcgaagacgguugcugguacggcauggagauccggccacugaaggagaaggaggaaaaucuggucaauagccuugucaccgccgggcacggucaaaucgacaacuucucccuagguguccuggggauggcccuguuccuggaggaaaugcugcgcacgcgcaucggcacgaaacacgcgauacuccugguggccgugagcuucgucaccuugaucaccgggaacauguccuuccgggaccucggccgcgugauggugauggucggggccacgaugaccgaugacaucggaaugggugucaccuaccuggcccugcuugccgcguucaaggugcguccgaccuucgcugccgggcugcugcuccgcaagcugacgagcaaagagcugaugauggccacgaucggcauugcccugcugucccagagcacgauccccgaaaccauccuggagcucacggacgcccuggcucuggggaugaugguccucaaaauagugagaaacauggagaaguaccaacuugcugugacgaucauggcgaucucuugugucccuaacgccgugaucuugcagaacgccuggaaggucagcuguaccauccucgcugcugugucggugagcccgcuccuucucaccuccagccaacagaaagccgauuggaucccucuggcccuuacaaucaagggccuuaaccccacggcuaucuuccugacuacccugucccgcaccuccaagaagcgguccuggccgcuaaacgaggcgaucauggccgucggcauggugucuauccuagcguccuccuugcucaaaaacgacauuccuaugacggggccauuaguggccggcgggcugcuaaccguaugcuaugugcuaacgggacguagcgccgacuuagaacucgagcgggcagcugaugugaaaugggaagaccaggcggagauaucagguagcucccccauccugagcauuacaaucuccgaggauggaucaauguccauuaaaaacgaggaggaggagcagacgcucaccauccuuauccgcacuggacuacucgucaucagcggggucuuucccgugucuaucccuaucaccgcggccgccugguaucucugggaggucaaaaagcagcgggccggcgugcugugggacgugccgaguccgccgcccgucgagaaggccgaacuggaggacggggcguaucgcaucaagcaacggggcauccucggguacucgcagaucggcgccggcguguauaaggaggggacauuucacacgauguggcacgugacccgcggcgccguacuaaugcaucgggggaagcgaauagaaccuagcugggcggacgugaagaaggaucugaucuccuacggcgguggcuggaagcucgaaggcgaauggaaggagggggaagaggugcagguacuggcccuggagcccggcaagaauccucgagcagugcaaacuaagccggggaucuucaagaccaacacuggaacgaucggagccguuucccucgacuucucccccggaaccagcggcucgcccaucgucgaccgcaaagggaagguggucggccuauacggcaauggagucguaaccagaucaggagcuuacgugagugccaucgcgcagacggagaaguccaucgaagacaauccugagauagaggacgacaucuuccgcaagaagcggcugacaaucauggaccuccacccuggcgcugggaagaccaagcgcuaccugcccgcaaucgucaggggugccauaaagcgcggccugagaacccucauccucgcuccgacgcgggugguugcggccgaaauggaagaagcccuaagggggcugcccauccgauaucagaccacggcgaucaaaacagaacacacggggcgcgagauagucgauuugaugugccacgcgaccuuuacuaugcggcugcugucgcccguuaggguucccaauuacaaccucaucaucauggacgaggcgcacuuuaccgacccggccuccaucgcagcccgcggauauaucucuacgcgagucgagaugggagaagccgcaggcauuuucaugaccgccacgccgcccgggucacgggaucccuuuccgcagagcaacgcacccauuauggacgaggaacgcgagauccccgagcgguccuggaacagcgggcacgaaugggucacagauuucaaggggaagacggugugguucgucccuuccaucaaagccggcaacgacauugcugccugccugcggaagaacggaaagaaggucauucaguuaagcaggaagaccuucgacucagaauauguuaagacgcgcgccaacgacugggacuuugucgugaccacggauaucucggagaugggcgccaacuuuaaggcagaacgggugaucgacccccgccguuguaugaagccugucauucucaccgacggagaggagcgcgugaucuuagcugggcccaugcccguaacccacuccagcgcagcccagcggcgcggccgcauugggcggaacccuaagaaugagaaugaucaguauauauauaugggcgagccccuugaaaacgaugaggacugcgcccauuggaaggaggccaagaugcuccucgauaauauaaacacccccgaggggauaaucccauccauguucgagccggagcgcgagaaggucgacgcgaucgauggggaguaccgccuucgcggcgaggcccggaaaacguucguggaccuaaugcgccgaggggacuugcccguguggcuggcauacaaggucgccgcagaagguaucaauuacgcagaccgcaaguggugcuucgaugggauuaaaaacaaccagauccucgaggagaacauggaggucgagaucuggaccaaagagggcgagcggaagaaacuuaaaccccgcuggcuggaugcccggaucuauagcgacccgcucgcguuaaaggaauuuaaagaguucgcugcuggcaggaagucucuaacccucaaucugaucaccgagauggggcggcugcccacguucaugacccagaaagcccgcaacgcccucgacaaucuagcggucuuacacacagccgaggcuggagggcgggcguauaaccacgcccucucggagcugccagagacccuggaaacgcucuuacuacucacccugcuagccaccguuaccgggggcaucuuucuauucuugaugucugggaagggcaucgggaagaugacccuaggcaugugcugcaucauuaccgccucaauacugcugugguacgcacagauccagccccacuggaucgcggccucuaucauccuggaguucuuucuaauaguccugcugauuccggagcccgagaagcagcguacgccccaggauaaccagcuaaccuauguagugaucgccauccugacugugguagccgcuacgauggcgaacgaaaugggguuccuggagaagaccaagaaagaccuaggguuaggcucuaucacuacccaggaaagcgaaucuaacauccuggauaucgaccucaggcccgccagugccuggacacuguacgccguggcgaccacuuucguaaccccgaugcuacgacauucaaucgaaaacagcucggucaacguuucucucacggcuaucgccaaccaggccaccgugcugauggggcuggguaagggguggccgcucuccaaaauggauaucggugucccccuguuagcaaucggauguuacagccaggucaacccaaucacccugacggcagcccuccuccuauuaguugcccacuaugcgauaaucggcccuggucugcaggcgaaggcaacacgggaagcgcagaagcgagcagccgcggggaucaugaaaaaccccacugucgacgggauaaccgugaucgaccucgagcccaucccauacgacccgaaguuugagaagcagcucgggcaggucaugcugcuuauccugugcguaacccagguacuaaugaugagaaccacgugggcucucugcgaggcucugacccuggccaccggccccauuuccacgcucugggaggggaaccccggucgcuucuggaacacgaccauagcugucagcauggcaaacaucuuccgcggcuccuacuuagccggggccggacuccucuuuagcauuaugaagaacacaacgaacacacgucgcgggaccggaaacauaggcgaaacucugggugagaaguggaaguccagacugaacgcccucggcaaguccgaguuccaaaucuacaaaaagaguggcauccaggaggucgacaggacgcuggcaaaagagggcauaaaacgcggggagacagaucaccacgccgugagcaggggcuccgcgaaacuucggugguucguagaacgcaauauggugaccccggagggcaaggugguggaccuugggugcggccgugggggcuggucguacuauugcgguggucugaagaacguccgcgaaguaaagggcuugacuaaaggcggcccggggcaugaggagcccauucccaugucuacguacggcuggaaccucguucggcugcagagcgggguggacguauucuucaccccgccagagaagugcgacacacugcucugcgauaucggcgagagcucucccaaccccacgauagaggcugggcgcaccuugcgggugcugaaccucgucgagaauugguugaacaacaacacacaauucuguaucaaggugcuaaacccauacaugccuucagugauugagaagauggaagcccuccagaggaaguacgggggcgcgcuggugcguaacccccugagucgcaacucuacgcacgagauguauugggucucaaacgccacuggcaacaucgugagcucggugaacaugaucucccggaugcuaauaaaccguuuuaccaugaagcacaagaaggcgacauacgagcccgacguagaccucggcuccgggacccggaauauuggcauagaaagcgaaaucccgaaucuggauauuauuggcaagagaaucgagaagaucaaacaagagcacgaaaccucuuggcacuaugaucaggaucauccuuauaaaaccugggcuuaccaugggucuuacgagaccaaacaaaccggcucggccagcuccauggucaacggggucgugcgcuuauuaaccaaaccuugggaugugguccccaugguuacgcagauggcgaugacugacacgacccccuuuggccagcaacgaguuuucaaggagaagguggacacccgaacccaggagccaaaggaggguaccaagaaacugaugaagaucaccgccgaauggcuguggaaagaacuagggaagaaaaagacgccccggauguguacgcgcgaggaguucacgcggaaggugcguuccaacgccgcuuuaggcgccaucuucaccgaugagaacaaguggaaauccgcccgggaggccguggaggacggccgcuuuugggaguuggucgaucgggagcgcaaccugcaccuugagggcaagugcgagacuugcguguauaacaugaugggaaagcgggagaaaaagcugggcgaguucggcaaggccaaaggaucgcgcgccaucugguauauguggcuuggcgcccgguuccuggaguuugaggcauugggguuccucaacgaggaccacugguucucgcgcggcaacucacugagcgggguagaaggugagggacuacaccggcucggguacaucuugcgcgacgucggcaagaaggagggaggggccauguacgccgacgauacggcgggaugggacacucggaucacauuggaagaccucaagaaugaggagaugguaaccaaccacaugaagggcgagcacaagaaacuugccgaggccaucuuuaagcugacguaccagaacaaggucgugcguguccagcgccccaccccuagaggcaccgucauggauauaaucucccgccgagaccaacgugggucgggccaggucgggaccuacggcuuaaacacguucaccaauauggaagcacagcugauacgccaaauggagggugaagggauauucaaguccauccaacaccucacugccaccgaagagauagccguacagaacuggcucgcccgcgucggccgggagcgccugagccggauggccauaucaggugaugacugcgucgugaaaccgaucgacgaccgcuucgcgagcgcccuuacggcucucaacgacauggggaaaguucgcaaggauauccaacagugggaacccucccgggguuggaacgacuggacccaggugccauucugcagccaccacuuccacgaacuggugaugaaggacggacgggucuugguggugcccugucgaaaccaggaugagcugaucgggcgugcacguaucagccagggggcgggguggagccugaaggagacugccugccuggguaagucguacgcccagauguggacucucauguacuuccaucggagagaccuccggcucgccgccaaugcaaucuguagcgccgugcccucccacuggguaccaaccucgcgcacgaccuggucaauccaugcuaagcaugaguggaugaccaccgaggacauguuggccguguggaaucgggucuggauccaggaaaacccauggauggaagacaagacgccagucgaaucuugggaggagguuccauaccuggggaaacgcgaggaccagugguguggcucccugauaggccucacaaguagagccaccugggcaaagaacauccaaacagccaucaaccagguacgcagccuaauaggcaacgaggaguacacagacuacaugcccucaaugaagcgcuuccggcgcgaggaggaggaggccgggguccugugguga

SEQ ID NO: 25083 - RNA, 9876 nt, Artificial Sequence
  derived and/or modified CDS sequence (opt11) from DENV-2__EU482760__SS-prME
accgcgggcgugaucgucaugcugaucccuaccgccauggcguuccaccucaccacccgcaacggcgagccccacaugaucgugggccgacaggaaaaggggaagucccuguuauucaagaccgaggacggugugaacaugugcacccucauggccauugaccugggugagcugugcgaggacacuaucaccuacaaguguccacuccugcgccagaaugagcccgaggacaucgacugcugguguaacucgacuaguacgugggucacuuaugggacaugugccaccaccggugagcaccggcgcgaaaagcgguccguagcacuggugccccacgugggaaugggccucgagacccggacggagacuuggaugaguuccgagggagccuggaagcauguacaacggaucgagaccuggauccugagacacccgggauucacgaucauggcggccauccuggcuuacaccaucgggaccacccacuuccagcgagcccucauuuucauccugcugacggcaguugcgccuagcaugaccaugcgcugcaucggcauuucaaaccgggacuucguagagggcgugagcggggguuccuggguggacaucguacuugagcaugguagcugcguuaccaccauggcuaagaacaagcccacguuggacuucgagcugaucaagacggaagccaagcagcccgcuacccuucgcaaguacugcaucgaggcgaaauugaccaacaccaccaccgaaucccggugcccuacucagggcgaacccagccugaacgaggagcaggacaagcgcuucaucugcaagcauuccauggucgacaggggcugggggaacgggugcggguuguucggcaagggagggaucgucacuugcgcaauguucacaugcaagaagaauauggaaggcaaggucgugcagcccgagaaccuggaguacaccaucgucaucacgccccacagcggggaggagcacgccguggguaaugacacggggaagcacggcaaggagaucaagaucaccccgcaguccucuaucaccgaggcagagcugaccggguacggcaccgugaccauggaguguucccccaggacuggccuggacuuuaacgagaugguccugcugcagauggaggauaaagccuggcucgugcaccgucagugguucuuggaucucccccuuccuuggcugccgggggcggacacccaggggagcaacuggauccagaaggagacccuaguuacguucaagaacccacaugccaagaagcaggacgucgugguccucgggucucaagagggggccaugcacaccgcccugaccggggccaccgagauccagauguccagcggaaaccucuuauucacgggccaccuuaagugccgauuacguauggacaagcuccagcugaaggggaugucguacagcaugugcaccggcaaguucaagaucguaaaagagaucgcggagacccagcacggaaccaucgugauccgcguccaguacgagggcgacggcucccccugcaagaucccuuucgagauaacugaccuggaaaagcggcacgugcuagggcgccugaucaccgugaacccgaucgugaccgaaaaggacagccccgugaacaucgaagccgaaccgcccuucggcgauuccuacauaaucaucgggguggagccgggccagcugaagcucaacugguucaagaaggggagcaguaucggccagauguucgagacaaccaugaggggcgccaagcggauggcaauccugggggacaccgccugggacuucgggagccucggcggggucuucaccuccaucgggaaggcgcuccaucagguauucggagccaucuauggcgccgccuucagcgggguguccuggaccaugaagauucugaucggcgucaucaucacguggaucgggaugaauucacgcaguacuagccuguccgucagccuggugcucgucggcguggugacgcuguaccugggggcgaugguucaggccgacuccggcugcguggugagcuggaagaacaaggaacucaagugcggcucagggaucuuuauuaccgacaacguccacacuuggaccgagcaauacaaguuccagccggagagcccuagcaaacuugccuccgcaauccagaaggcccaugaggagggcaucugcgggauccggagcgugacccgccuggagaaucucauguggaagcagaucacccccgagcugaaccacauccucuccgagaacgaggugaagcucacgaucaugaccggcgacauccgggggaucaugcaggcgggaaagcgcagccugcggccgcagcccaccgagcucaaguacucguggaaaaccuggggaaaggccaagaugcucucaacugagucccacaaccagacauuccuuaucgacgggcccgagaccgcugagugcccgaacaccaaucgcgccuggaacagccuggaggucgaggacuacggcuuugggguguucacgaccaacaucuggcugaaguuacgggagaagcaggacguguuuugcgacuccaagcuaaugagcgccgcgauuaaagacaacagagccguccacgcggacaugggcuacuggaucgaauccgcccucaaugacaccuggaagauggagaaggccagcuucaucgaagugaaguccugccacuggcccaagagccacacccugugguccaauggcguguuagagagcgagaugauuauccccaagaacuucgcgggacccguaucccagcauaauuacagaccaggcuaccacacgcagaccgcagggcccuggcaccucggcaagcuggagauggacuuugaccugugugaggggaccaccguggugguuaccgaggacugcggcaaccgcggacccucauuacggaccaccacggccagcggcaagcugaucaccgaguggugcugccgcuccuguacucugcccccgcuccgguaccguggcgaagacggguguugguacgggauggagauucggccccugaaggagaaggaggaaaaccuggugaacagcuuagugaccgccggucacggccagaucgacaacuucagucugggcguccuggggauggcccuguuccuggaggagaugcugcgcacccggauaggcaccaagcacgccauccuccugguggccgugagcuuuguaacguuaaucaccgggaacauguccuuccgcgaccucggccgcguuauggugauggucggggccaccaugaccgacgacaucggcaugggagugaccuaccuggcccugcucgcggcauuuaaggugaggcccaccuucgcugccggucugcugcuccgcaagcugaccagcaaagaacucaugauggccacgaucggcaucgcucuccugucccagucuacgauaccagagaccauccuugaacugacggacgcccuggcguuggggaugaugguccucaagaucgugcgcaacauggagaaguaucagcuggccguuaccaucauggcuaucuccugcgucccgaacgcggugauccugcagaaugccuggaaggugagcugcacgauccuugccgcggucucaguaucuccccugcugcucaccucgagccagcagaaggcggacuggauaccccuagcccugaccaucaagggccucaacccaaccgccaucuuccugacuacccugucccgcaccagcaagaaacgauccuggccgcucaacgaagccauuauggccgucgguauggugagcauucuggcgucaagccugcugaagaacgacauccccaugaccggacccuuagucgccggcgggcugcucacagucugcuacgugcugaccggccgcagcgccgaccuggagcucgagcgggcggccgacguaaagugggaggaccaagcggagaucuccgggucuucccccauccugagcaucaccaucucagaagacggcucaaugaguaucaagaaugaggaagaggagcagaccuuaacgauccucauacgcaccgggcuguugguuauuucaggcguguucccgguguccauacccaucaccgccgccgcaugguaccucugggaagucaagaaacagagggcuggcgugcuaugggacgugcccagcccgccgccaguugagaaagcggagcuggaggacggggcauaccgcauuaaacagcgcggcauccucggauacucccagauuggcgccggaguauacaaagaagggaccuuccacaccauguggcacgugacgcgcggcgccgucuugaugcaucgggggaaacgcaucgagcccagcugggccgacgugaagaaggaucugaucuccuauggcgggggauggaagcucgagggggaguggaaagagggggaagaggugcaaguccuggcccuggagcccggcaagaacccccgggcugugcagaccaagcccgguaucuucaagaccaacaccggaacgauaggggccgucagcuuggacuuuucacccggcacaagcggcuccccaauugucgaccgcaaggguaaggugguuggcuuguaugggaacggcguggugacccggagcggcgccuacguguccgcgaucgcccaaacggaaaaguccaucgaggauaacccagagaucgaggacgacaucuuccgcaagaagcggcugaccaucauggaccuccaccccggggccggcaagacgaagagauaccuucccgccaucgugagagaggcuaucaagcgcggacuacguacccucauccucgcaccgacccgggugguggccgccgagauggaagaagcccuccgcggccuacccauccgauaccagacaaccgccauuaagaccgagcauacagggcgcgagaucguugaccuuaugugccaugcgacguucaccaugcggcugcugagcccugugcgcgugcccaacuacaaucucauuaucauggaugaggcccacuuuacggauccggccuccaucgcugcccgcggcuacaucagcacccgcgucgagaugggcgaggcggccggcaucuucaugacggcuaccccgcccggcucccgugaccccuucccgcagagcaacgcccccaucauggaugaggagcgcgaaaucccagaaagauccuggaacagugggcaugagugggugaccgacuuuaaaggcaagaccguuugguucguccccuccaucaaggcggggaacgauaucgcugccugccugcgcaagaacggcaagaaggugauccagcugucacgcaagacguucgacuccgaguaugugaagacccgcgcuaacgacugggacuucgucgugaccaccgacaucagcgagaugggcgccaacuuuaaggcggagcgggugaucgauccgcgccgguguaugaagccagucauucucacggacggggaggagcgcgugauccuggccggccccaugcccgugacccacuccagcgcagcccagcggcgcgggcguaucggaagaaacccgaagaacgagaacgaccaguacaucuacaugggggagccccuggaaaacgaugaggacugugcccacuggaaggaagcgaagaugcucuuggacaacaucaacacgccggaaggcauuauacccaguauguucgagccggagcgcgagaaggucgacgccaucgacggcgaguaccggcugcgcggggaagcccggaagaccuucgucgaccucaugcgacgaggcgaucugcccguguggcuggccuacaaggucgcagcggagggaaucaacuacgccgaucgcaaguggugcuucgauggcaucaagaacaaccagauccucgaggagaacauggagguggagauauggacuaaggagggggagcggaagaagcugaagccccgcuggcuggacgcccgcaucuacucagacccgcucgcgcucaaggaauucaaggaguucgcggcuggccgaaagagccugacucucaaucugauaaccgagaugggccggcuacccaccuucaugacgcaaaaggcaaggaaugcccucgauaacuuagccgugcugcacacagcugaggcugggggccgggcguacaaccaugcccucagcgaguugccugaaacuuuagagacgcuccugcugcucacacugcuggcuaccguuaccggcggcaucuucuuguuucugauguccggcaaggggaucggcaaaaugacgcuugggaugugcugcaucaucaccgcgagcauccuccugugguacgcgcaaauccaaccccauuggaucgccgccucuaucauccuagaguuuuuccucaucgugcugcugauuccggagcccgagaaacagagaacgccucaggacaaccaacugaccuacguagugaucgccaucuuaaccguggucgcggccaccauggccaacgagaugggcuuccuggagaagacgaagaaggaccuugggcucggcagcauuaccacccaggagagcgaauccaauauucuggauaucgaccuccggccagccagcgccuggacucuuuacgcgguggccacuaccuuuguaaccccgaugcugcgccacuccaucgagaauucauccgucaacgucagccucaccgccaucgccaaccaggcgacggugcugaugggccuggggaagggcuggcccuuauccaagauggauaucggggucccccuccuggccaucggcugcuacagccaggugaacccgauuacccucaccgccgccuugcuacuacuugucgcccauuacgcgauuaucgggccgggccugcaggccaaggcaacccgggaggcccagaagcgcgccgcugccggcauaaugaagaaccccacggucgacgguaucaccgucaucgacuuagagcccauaccguacgauccgaaguucgagaagcagcugggccaggugaugcuucucauccugugcguaacccaggugcugaugaugagaaccacgugggcccucugcgaggcccugacccuggcgaccgggcccaucuccacccucugggagggcaaccccgggcgcuucuggaacacgacaaucgcgguuagcauggccaacauauuucgaggcucguaccuggccggcgcugggcuucuauucagcaucaugaagaacaccacgaacacucgucguggcaccgguaacaucggcgagacccuuggcgagaaguggaagagccggcugaaugcgcucggcaagagcgaguuccaaaucuacaagaagaguggaauucaggaggucgaucgcacccuggccaaggaagggaucaagcgcggcgagacggaccaccacgccgugucucggggguccgccaagcuccggugguuuguggagagaaacauggucacuccugagggcaaagugguugaucuaggcugcggacggggcggguggaguuacuacugcggcggguugaagaacguccgcgaggugaagggcuugaccaagggcgguccgggccacgaggagccuauccccauguccacguacggguggaaccucgugcgccugcaaagcggugucgacguguucuucacgcccccggagaagugcgacacccuacucugcgauaucggugagagcucccccaacccuaccaucgaggcaggccgcacccugcgggugcugaaccuggucgaaaacuggcugaacaacaacacccaguuuugcaucaagguguugaaccccuacaugccgagcgugaucgagaagauggaggcgcuucaacggaaauacggcggggcccugguccggaacccccugucgcgcaacagcacgcacgagauguacugggugaguaacgcaaccggcaacaucgugucuuccgucaacaugauuagccggaugcuuaucaaccguuucaccaugaagcacaagaaggccaccuacgagccggacguggacuuaggguccggcacuaggaauaucgggaucgagagcgagaucccaaaccuggacauuaucgggaagcgcaucgagaaaaucaagcaggagcaugagacuaguuggcacuacgaccaggaccaucccuacaagaccugggccuaccauggcagcuacgagaccaagcagacggggucagcaaguuccauggugaacggcguagugcgccugcucacgaagcccugggacguagucccaauggugacccagauggccaugaccgacacgacacccuucgggcagcagcggguguucaaggagaaggucgacacccgcacccaggagcccaaggagggcacgaagaagcugaugaagaucaccgccgaguggcuguggaaggaacucggcaagaagaaaacgccccgaauguguacccgcgaggaguucacgcggaagguccgcuccaaugccgcccucggcgcgaucuucaccgacgagaacaaguggaaguccgcccgggaggccguggaggacggcagauucugggagcuugucgacagggagaggaaccuccaccuggaggggaagugcgagaccuguguguacaacaugaugggaaagagggagaagaagcugggugaguucggcaaggccaaggggagccgcgcgaucugguacauguggcucggggcccgguuccuggaguucgaggcccuggguuuccucaacgaggaccacugguucucccgcgggaacucucuuaguggcguggaaggggagggacugcaccggcucggcuacauccugcgggauguaggaaagaaggagggcggggcuauguacgccgacgacaccgcggggugggacacgagaauaaccuuggaggaccucaagaacgaagagauggugaccaaccacaugaagggggagcacaagaagcuagcugaggccaucuucaagcugaccuaccagaacaaggucguucgcgugcagcgacccacgccgcggggcaccgucauggacaucaucagccgucgcgaccagcgcggcagcggccaggugggcaccuacgggcucaacaccuucacgaacauggaagcccagcuaauccggcagauggagggcgagggcaucuucaaguccauccagcaccugaccgccaccgaagagaucgcgguucaaaacuggcucgcccgcgucgggcgggagcgccugagccggauggccaucuccggcgacgacugcguugugaagcccaucgacgaccgcuucgcuagcgcccugaccgcauuaaaugacauggggaaaauccggaaggacauacaacagugggagcccucccgcggauggaaugacuggacgcagguucccuucugcagccaccacuuccacgagcuagugaugaaggaugggcgggugcuggucgugccuugccgcaaccaggacgagcucaucggccgggcccgcaucucucagggcgccggguggagccugaaggagaccgccugccugggcaagucauaugcccagauguggacccuuauguacuuccaccggcgcgaucuacggcuggcggccaacgcgaucuguagcgcaguccccucccacuggguccccacuagccgcaccacgugguccauucacgcgaagcacgaguggaugaccaccgaggacaugcucgccguguggaaccgggucuggauucaggaaaaccccuggauggaggacaagaccccggucgagagcugggaggaggugcccuaccuggguaagcgagaggaccaguggugcggcucccucaucgggcucacgagccgggccaccugggccaagaacauccagacugcaaucaaccaggugcgcagccuaaucggcaacgaggaauacacagacuacaugcccuccaugaagcgcuuccggcgcgaagaggaggaggcgggcguucugugguag

SEQ ID NO: 25084 - RNA, 9876 nt, Artificial Sequence
  derived and/or modified CDS sequence (opt11) from DENV-2__EU482762__SS-prME
acagccggagugaucgucaugcuaauaccuacugccauggcguuccaccuuacaacaaggaauggagaaccgcacaugauaguaggaagacaggaaaaaggaaaaagucuacuauucaaaacggaagauggcgugaacaugugcacauuaauggcgaucgaccucggcgaacuaugcgaagauacuauaacauacaaaugcccccuucuacgccaaaacgaaccagaagacauugacugcugguguaacucaaccuccacgugggugacuuacgggacgugcacaacaaccggcgaacaccgccgagagaaacgaagcguagcacucgucccucaugugggaauggggcuagaaacucgaacggaaacguggauguccuccgaaggagcguggaaacauguacaacguauagagacguggauucuccgucaccccggguucaccaucauggcugcaauucuugcguacacuauaggcacaacgcacuuccaaagggcguuaauauucauccuacuuacggcaguagcacccucaaugacaaugcggugcaucggcaucagcaaccgagacuucguugaggguguaagcgguggaagcugggucgauaucguacuggaacacgggaguugcguaacgacgauggcuaaaaacaaacccacguuagauuuugaauuaaucaaaaccgaggccaaacaacccgcgacacuucguaaauacugcauagaagcaaaacuaacgaacacaaccacagagucacgcugccccacccaaggagaacccagccuuaacgaagaacaagauaagcgauucaucugcaagcacuccauggucgacaggggauggggaaacggcugcggacuguucggcaaaggaggaaucguaacuugcgccauguuuacuugcaagaaaaauauggagggaaaaguagugcaaccggaaaaccuggaguauacaauaguaauaacgccacacaguggggaggaacacgcagucggaaacgacacgggaaagcauggcaaagagauuaaaauaacuccacaguccagcaucacagaggcggagcuaacggguuacggaacagucacaauggagugcucaccucgaaccggacucgauuuuaacgaaaugguucugcuacaaauggaagacaaagcguggcugguacacaggcagugguucuuggaccuaccguuaccauggcucccuggugccgacacgcagggaucaaacuggauccaaaaagaaacccuugucacauucaaaaacccgcaugccaagaaacaagacguuguagugcuuggaucccaggaaggcgcaaugcauacagcucugacgggcgcgacagaaauccaaaugagcucugggaaccuguuguucacuggccaccuuaaaugcaggcucaggauggacaaacuccaacucaaagggauguccuacucaaugugcacugguaaauucaagauuguuaaggaaauagcggagacccaacacggaaccauagugauacggguacaauaugagggggaugggaguccuugcaagauaccguucgagaucaccgaucucgagaaaagacacguacucggacguuuaauaaccgugaacccaauagugacagaaaaagacucacccgucaacauagaggccgaacccccguuuggcgacagcuacaucauaauaggcguagaaccuggacaacuaaaacugaacugguucaaaaaggggucauccauugggcagauguucgaaacaacaaugcggggagccaagcgcauggcaauccugggagauaccgcaugggacuucggcagccuagggggcguguucaccuccaucggaaaggcacuacaccagguauucggggccaucuacggcgcggcuuucagcggcguaucauggaccaugaaaauauugauaggggucaucauaaccuggauugggaugaacagucgaagcacgagcuugucaguaagucucguccuugucgggguaguaacucuguauuugggcgcgaugguucaagcagauuccggaugcgucgucucauggaaaaacaaggagcugaagugcggaucugguauauucaucacggacaacguacacacauggaccgaacaauacaaguuccagcccgagucaccuuccaaacucgcaagcgcaauccaaaaagcgcaugaagagggcaucugcggcauacguuccgugacucgacucgaaaaccuaauguggaagcagauuacaccagagcucaaucacauuuuaagcgagaaugagguaaaacuuaccaucaugacaggcgacaucagagguauaaugcaagccgggaagcgcagucucagaccacagccgacagaacucaaguacagcuggaaaacuugggggaaagcaaaaaugcucucaacugagagccacaaccaaacauucuuaauugacgggcccgaaacggccgaaugcccgaauaccaacagagccuggaacucacucgaagucgaggacuacggcuucggcguguucaccacgaauauauggcuaaaacucagagagaagcaggacguauuuugcgacagcaagcuaaugagugcggcaauaaaagacaacagagccgugcacgcggacaugggcuacuggaucgaaagcgcccugaaugacaccuggaaaauggagaaggcauccuucauagaagucaaaagcugcuacuggccaaaaucgcacacccuauggagcaauggaguccucgagagugagaugauaaucccuaaaaacuucgccggcccaguaucacagcauaacuacagacccggauaccacacccaaaccgcggggccauggcaccucgggaagcuagaaauggacuucgaccugugcgaagggaccacuguuguaguaacggaggacuguggcaaccgcggacccucccuccggacaaccaccgccucuggcaaacugaucaccgagugguguugccgaucgugcacacugccaccccuacgauaucgaggggaggacgguugcugguacggaauggaaauccgaccgcugaaggagaaagaggagaaucuagugaacagccuagucacagcgggccauggacaaauugauaacuuuagucuuggcguacuaggcauggcccuauuucucgaggagaugcuacguacacgaaucggcacaaagcacgcgauccuccugguggcagugagcuucgugacacugauuaccggcaacaugagcuuucgggacuuaggacgugucaugguaaugguaggagcaacaaugaccgacgacaucgggaugggagugacauaccucgcccuacuagcagcguucaaggugagaccgacauucgcggcuggccuccucuuaagaaagcuaaccucaaaggaacucaugauggccacgauaggaauagcacuucugagucagagcacgauaccggaaaccauacuggagcucaccgacgcauuagcgcuaggaaugaugguccucaagauuguaaggaacauggaaaaauaccaacucgccgucaccaucauggcaauaucaugcguuccaaacgcgguaauccuacagaaugccuggaaggucucauguacgauccuggccgccguaagcguuuccccacugcuccuuacaucgucacaacaaaaagcggauuggaucccacuagcacuaacaauuaagggccuaaaucccaccgcaauauuccucacaacucucucacgcacaucgaagaagcguagcuggccccuuaacgaagccauaauggccgucggaaugguaucuauacuugcaaguucacuauugaagaacgacauaccaaugacaggcccucuaguggccgggggacuacucacgguguguuacgugcugacuggacgcucggccgaccuagaacuggagcgcgccgccgaugugaagugggaggaccaagcagaaauuucggggucaucacccauccucucgaucacgaucucggaagauggcucuaugucaauuaaaaaugaggaagaggaacagacucuuaccauacuaauaagaacgggacuucuugugaucucgggggucuucccgguaucaaucccgauaacagccgcagcaugguaccucugggaggucaagaaacagcgcgcgggcguacucugggacguuccuagucccccgcccguagaaaaagcugagcuggaagauggcgcauacaggauuaagcaaagaggcauacuaggcuacagccagauaggcgcuggcguauauaaagagggcacauuucacaccauguggcacgugacacgaggugccgucuuaaugcaccgcggcaagagaauugagccaagcugggcugacguaaagaaggaccucaucaguuauggaggaggcuggaaauuggagggagaauggaaagagggggaagagguucagguauuagcauuggagccgggcaaaaacccacgcgccguccagacaaagccaggcauauucaaaacaaacacaggaacgaucggagcaguaucacucgacuuuuccccgggcacgucgggcucgcccaucgucgaucguaaaggcaaaguuguagggcucuacggaaauggcgucgucacgcgcaguggcgcguacgugagugcuaucgcccaaacggaaaagagcauagaggacaacccagagauugaagacgacaucuucagaaagaaacgccuaaccauaauggaccuacaucccggggcuggcaaaacaaaaagauaccuccccgccauaguucgugaagcaauaaaacgcggacuaagaacacucauccuagcgccaacacgcguagucgcugccgagauggaagaggccuuacgaggacucccaauaagauaucaaacaaccgccauaaaaaccgagcacacugggagggaaaucgucgaccugaugugccaugcgaccuuuacaaugaggcugcucaguccagucagaguaccgaacuauaauuugauaaucauggacgaggcgcacuuuacugacccggcauccauugccgcgcggggcuauauaucuacacgcguggaaaugggagaagcagcggguaucuucaugaccgcaaccccgccaggcucacgagaucccuucccgcaauccaacgccccaauuauggacgaggaacgagaaauaccagaaagaucauggaacucagggcacgagugggugacagacuucaaagguaaaacagugugguuuguccccucaaucaaagccggaaacgacauagcggcaugccuacguaaaaacggaaagaaaguaauccaacuaucaagaaaaacuuucgacagcgaguaugugaaaacgagggcaaacgacugggauuucgucgugacaacggacaucagugaaaugggagcgaacuucaaagccgagagaguaauagaccccaggcgcuguaugaaaccagucauucuaacagacggagaagaacgagucauccuggccgggcccaugcccguaacacacucgucagcggcacaaagacggggacgaauagggcgcaacccgaaaaacgaaaacgaccaauacauauacaugggcgaaccacucgaaaacgacgaagacugugcacacuggaaagaagcuaaaaugcuucuugacaacauuaauacgccggagggcaucauaccaagcauguucgaacccgagagagaaaaaguggacgcaaucgacggcgaauaucgauuaaggggugaggcacgcaagaccuucgucgaccugaugaggagaggggaccugccgguguggcuugccuacaaggucgccgcagagggcauuaauuaugccgacaggaaauggugcuuugacggcauaaagaacaaucaaauacucgaggaaaauauggaaguagaaaucuggacuaaagaaggcgagcguaagaaacugaaaccaagauggcuggacgcgcggauauacucagacccgcuagccuugaaggaauuuaaggaguucgccgcggggcgcaaaucacuaacacucaaccuaauuacggagaugggccgccuaccaaccuucaugacccaaaaggcccgcaacgcgcuagacaaccucgccguacuccacacugcagaggcgggcggacgcgcguacaaucaugcgcugagugagcucccagaaacauuagaaacgcuguuacuacugacccugcucgccacaguaaccgggggcauauuccuuuucuuaaugucaggaaaaggaauuggaaaaaugacccuagggaugugcuguauaauaacagcgaguauccuucuaugguacgcccagauacaaccacauuggauagccgccucgaucauccucgaguucuucuugaucguacuucuuauacccgagcccgaaaaacaacgaacaccacaagacaaucaacucaccuaugucguuauugcuaucuuaaccguaguugcggcaacgauggcaaaugaaaugggauucuuggagaaaacuaagaaagaccucggguuagguaguauaacaacucaggaaucagaguccaacauacuggauauugaucuaagaccggcuagcgcuuggacauuauaugccguagcuaccacguuugucacccccauguuaaggcacuccauugaaaacucaagcguaaacguuucgcuaacagccauagcaaaucaagcaacaguacuuauggggcugggcaaaggauggccccuaaguaaaauggauauagggguaccgcugcuagcaauaggauguuacagccaaguaaaucccaucacccuuaccgcagcguugcuccuguugguagcacacuacgcaaucaucggacccgggcugcaagccaaagcaacccgggaggcacaaaaacgcgcagcugcagggauuaugaaaaauccaacaguagacgguaucacugugauugauuuggaaccuauccccuaugaccccaaguucgagaaacagcugggccaggugaugcuacuaauucuaugcguaacccagguacuaaugaugaggacaaccugggcccucugcgaggcucugacccuagcaaccggcccaauuucaacgcugugggaagguaaccccgggcguuucuggaacacgaccauugcaguaaguauggccaacaucuuccgagguagcuacuuggcgggagcaggacugcuguucaguauuaugaagaacacaacgaacacccgacgagguaccggaaauaucggagaaacccucggcgaaaaguggaaguccaggcuaaacgcacuagggaagagugaauuucaaauuuauaagaaaucaggaauccaagaggucgaccguacacucgcgaaagagggcaucaagcgaggggaaacggaccaccaugcagugagcagggguuccgcaaaacugagaugguucguggaacgaaacauggugacaccggaaggaaaggucguagaccuggguugcggacgcggaggauggucauacuacuguggcggcuuaaagaacguaagggaggugaagggacuaacgaaaggcgguccaggacaugaggaacccaucccgaugaguacguacggauggaaucuggucaggcuccaaucuggaguggauguauucuuuacuccgccugagaaaugcgacacccugcucugcgacauaggugaguccucccccaacccgaccaucgaggcgggaaggacacugagagugcuaaaccuggucgaaaauuggcugaacaacaacacccaauucugcauuaagguacucaaccccuacaugccauccguaauagagaaaauggaagcccugcagcgaaaguacggaggcgcgcuaguucgcaauccgcuaucgagaaacucaacgcacgagauguacugggugucaaacgccaccggaaacauagucagcagugugaauaugauaagcagaaugcuaaucaaucgauuuaccaugaagcauaaaaaggcaaccuacgagccggacgucgaccuggggucgggaacucgaaacauaggcauagagucggaaaucccaaacuuagacaucauaggcaaacggaucgagaaaaucaagcaagagcacgagacaaguuggcacuacgaucaggaucauccguacaagacaugggcguaucaugguuccuaugaaacgaagcaaacgggaagugcaagcucaauggucaauggcguagugcgucuacugacaaagccgugggaugucgucccuauggugacacagauggcaaugacugacacaacgccguucgggcaacagcgcgucuucaaagaaaaaguugacacgaggacacaagaaccgaaagagggcacgaagaaacucaugaagauuacggcggaguggcuuuggaaggaauuaggcaagaagaaaacccccagaaugugcaccagagaagaguuuaccagaaagguccguaguaacgcagcgcuaggcgcaaucuucacagaugaaaacaaguggaaaagcgcccgcgaggccguggaagacgguagguucugggaacugguagaccgcgaaaggaaucuccaccuagaaggaaaaugcgagacaugcguauauaacaugaugggcaaacgcgaaaagaagcuaggggaguuuggcaaagcaaagggaagcagggcaauaugguacauguggcuaggagcgcgcuuccuggaguucgaagcccugggguuccuaaacgaagaccacugguuuagccggggcaauagccuauccgggguggagggugagggccuccaccgacuaggcuauauacugagagacguaggcaagaaagaaggaggagcgauguacgcugacgacacggcugguugggacaccagaaucacccuggaagaccucaagaaugaagaaauggugacgaaccacaugaaaggggaacacaagaagcucgccgaggcuauauucaaguugacuuaccaaaacaaagucgugagaguacagcgcccaacaccccguggaaccguaauggacauaaucuccagacgcgaccaaagaggcucaggacaagucggaaccuacggccucaacaccuuuacgaacauggaagcccaacuuauacgucagauggagggggaggggauauucaaaucgauucaacaccuuaccgcaaccgaagaaauagcaguccagaacuggcucgcaagaguggggcgggagcgucucagccgcauggcuauauccggagacgacugugugguaaagcccaucgacgaucgcuucgcaagugcccuaacggcacucaacgacaugggaaaaguacggaaagacauucaacaaugggaaccaagcaggggcuggaacgacuggacacaggugccauuuugcucccaccacuuccacgaacucgucaugaaagacggccgagugcuugucguacccugcagaaaccaagacgaacucaucgggagagcacgcaucagccagggagcgggauggucgcuaaaagaaacggcaugccuuggaaaaucauacgcacaaauguggacacugauguacuuccaucgcagagaccugcgucucgcugcaaacgcaauaugcuccgcaguacccucccacuggguucccaccuccaggacgaccugguccauacacgcaaaacacgaguggaugacgacagaggacaugcuagcaguguggaacaggguuuggauacaagagaacccauggauggaagacaagacuccaguagagagcugggaagaaguaccauaccuagggaaaagggaagaccagugguguggaaguuuaaucgguuugaccaguagagccacgugggccaagaacauccagaccgcaaucaaccagguccgcucacuaaucgggaacgaggaguauacagacuacaugccaucaaugaagcgcuuccgacgggaggaagaggaagccggaguguuaugguga

SEQ ID NO: 25085 - RNA, 9876 nt, Artificial Sequence
  derived and/or modified CDS sequence (opt11) from DENV-2__EU482763__SS-prME
accgccggcguuaucgucauguugauccccaccgccauggcuuuccaccugacuacccguaacggggaaccgcacaugaucgugggccggcaggaaaaggggaagucccugcuguucaagaccgaggauggcgugaacaugugcacccucauggcgauggaccugggggagcugugcgaggacacuauaaccuacaaaugcccccuccugcgccagaacgagcccgaggacaucgacugcuggugcaacaguaccagcaccuggguaacuuacgggaccugcacgacgacgggggagcaccggcgcgagaagcggucuguggcccuggugccccaugucgggaugggccucgagacccgcaccgagaccuggaugucuuccgagggggcguggaaacacgugcagcggaucgagacguggauccugcgccaccccggcuucaccaucauggccgcgauacuggcuuacacaaucgggaccacgcauuuccagcgggcucucaucuucauucugcugacggccguugcccccagcaugaccaugcgcugcaucggcaucuccaaccgggacuucgucgagggcgugagcgguggguccuggguggacaucguccucgagcacgggagcugcgugaccacgauggccaagaacaagcccacucuggacuucgagcugaucaaaaccgaggcgaagcagcccgcuacccuccgcaaguacugcaucgaagccaagcugacgaacaccacuaccgagucccgcuguccgacgcagggcgagcccucucuuaacgaggagcaggacaagcgcuuuauuugcaagcacuccaugguggaccguggcuggggaaacggcugcgggcuguuuggcaagggcgggaucgugaccugcgcgauguucacaugcaagaaaaacauggagggcaagguggugcagcccgagaaccuugaauacaccaucgucaucacgccgcacagcggugaggagcacgcugugggcaacgacaccgguaagcauggaaaagagaucaagaucacgccccaguccagcaucaccgaggccgagcugaccggguacggcacggugaccauggagugcagcccccgcaccggccucgacuucaacgaaaugguccugcugcagauggaggacaaagccuggcucgugcaccggcagugguucuuggaccugccacucccgugguugccuggggccgacacacaggggagcaacuggauacagaaagaaacgcuggucacguucaagaacccgcacgcgaagaaacaggacgucgugguacucgggucacaggagggcgccaugcacaccgcccugaccggggccacggaaauucagaugaguagcggcaaucuccuguuuaccggacauuuaaagugccgucugcggauggacaaacuucaacuuaaggggauguccuacucaauguguaccggcaaguucaagaucgugaaggagaucgccgagacccaacacggaacgaucguaauccguguccaauaugagggugacggcuccccaugcaaaauccccuucgagauuaccgaccuggagaagcggcacgugcucgggagauugaucacggugaauccgaucgucaccgagaaggacagccccgucaacaucgaagcggagccacccuucggcgacucuuacaucauuauagggguggagccggggcagcugaagcucaacugguucaagaaggggagcuccaucggccagauguucgagacgacgaugcgcggcgccaaacgaauggccauccugggggacaccgcgugggacuucggcucgcucggagguguuuuuaccuccaucgggaaggccuugcaccagguguuuggggcaaucuacggcgccgccuuuuccggggucuccuggacaaugaagauccugaucggcguaaucaucaccuggaucgggaugaacagcagauccacuagccuguccgugagccuggugcuuguaggcguggugacgcuguaucugggugcgaugguccaggcggacuccggcugcgugguguccuggaagaacaaggagcugaaguguggcagcgggauauucauaacggacaacguccacaccuggaccgagcaguacaaguuccagcccgagagccccuccaagcuggcuucugccauccagaaagcacacgaagagggcaucugcgggauccggagcgugacgcgccuggagaaccuaauguggaagcagaucacgccggagcugaaccacauccuguccgagaacgaggugaagcucaccauaaugacuggcgacaucagggggaucaugcaggccggcaagcgcagccugcggccccagcccacugaacugaaguacuccuggaaaacguggggcaaagcgaagaugcucagcaccgaaucccacaaccagaccuuccugaucgacgggcccgagaccgccgagugcccgaacacgaaccgugcguggaacagcuuagaggucgaggacuacggcuucgguguguucaccaccaacauauggcuuaagcugcgagagaagcaggacguguucugcgacuccaaacucaugagcgccgccaucaaggacaaucgagcgguccacgccgacaugggauacuggaucgagucagcccucaacgacaccuggaagauggagaaggccuccuucaucgaggugaaaaguugccacuggcccaagagccacacccuguggucaaauggcgugcuggagagcgaaaugaucauccccaagaacuucgccgggcccgucucccagcacaacuaccggccugguuaccacacgcaaaccgcggggcccuggcaccucggcaagcuggagauggacuuugaccugugugaagggacgaccgugguggugacggaggauugcggcaaccgcggcccgagccugcggacaacuaccgccagcgggaaacuuaucacggagugguguugccguuccugcacccugccaccccuccgcuaccgcggagaggacggaugcugguacggcauggagauccggccccugaaagagaaggaggaaaaccucgugaacagccucguuacggcuggccacgggcagaucgacaacuuuagucugggcguacugggaauggcacucuuccuugaggagaugcugcgcacccggaucggcacgaaacacgcgauccuccugguggccgugagcuucgucacccugaucaccgggaacauguccuuucgcgaucucggccgcguuauggugauggucggggcuaccaugacggacgacaucggcaugggcgugaccuacuuagcucuguuagccgccuucaaggugaggcccaccuucgccgccgggcugcuguuaaggaagcugaccagcaaggagcugaugauggccacgaucggcauagcccuccugucccagaguaccauccccgaaacaauacuggagcucaccgacgcucucgcccucgggaugauggucuugaagaucgugcggaacauggagaaguaccaacuggccgucacgauuauggccaucuccugcgucccgaacgccguuauccugcagaacgcguggaaggucagcuguaccauucucgcugcgguuuccgugagcccccugcuguugacguccagccagcagaaggccgacuggauaccccucgcucugaccaucaagggacuaaauccgacggccaucuuccugacgaccuugucccgcacaagcaagaagcgguccuggccacugaacgaggcgaucauggccgucggcauggugagcaucuuagccuccagccugcucaagaacgacauacccaugacggggccccuggucgcggguggccugcucacggucuguuacgugcugaccgggcgcucugccgaccuggagcucgaacgugccgccgacgugaagugggaagaucaagcagagaucucggggagcucgccaaucuuaagcaucaccaucuccgaggacggcucuaugagcaucaagaacgaggaagaggagcagacgcugacgauccucauccgcaccggcuugcuagucaucagcgggguguucccgguauccauccccaucaccgcggcugccugguaccucugggaggucaagaagcagcgggccggcgugcugugggaugucccgagcccgccgcccgucgagaaggccgagcuggaggacggggcguacaggaucaagcagcgaggcauccucggguacucccagaucggcgccggggucuacaaggaggguaccuuccacacgauguggcacgugacccgcggugcuguccugaugcaccgggggaagcggaucgagcccagcugggcggacgugaaaaaggaccugauaucuuacggagguggguggaagcucgagggggaguggaaggagggagaggaggugcaaguccuggcccuggagccggguaagaacccucgggcggugcagaccaagcccgggaucuuuaagaccaacacggguaccauaggggccgugagccucgacuucuccccuggaacaagcggcucacccaucgucgaccgcaaggggaaaguagugggccuguacgggaauggcgucgugacccggucaggcgccuacguguccgccaucgcccagacggagaaguccaucgaggacaaucccgagaucgaggaugacaucuuccgcaagaagcgacugaccaucauggaccuccaucccggggccggaaagaccaagagguaccugccugcuauaguccgggaggccaucaagcgaggccugcgcacccugauucucgccccuacucgugucguggcagccgagauggaagaagcccugcgcggccugcccauccgguaccagacuaccgccauaaagaccgaacacacggggagagagaucgucgaccucaugugucacgccaccuuuaccaugcggcugcucagcccagugcgcgugcccaacuacaaccucaucaucauggacgaagcgcacuucaccgaccccgccuccaucgccgcucgagguuauaucagcacgcgcgucgaaaugggcgaggccgcgggaaucuucaugaccgccacuccacccggaucccgggacccauucccgcaaagcaacgccccaaucauggacgaggaacgcgagauccccgaacggucuuggaacucugggcacgagugggugaccgacuucaagggcaagacggugugguucgugcccuccaucaaggccgggaacgauaucgcggcgugccugcgcaagaacgggaagaaggugauccagcugagccgcaagaccuuugacucagaguacgugaagacccgugccaacgacugggauuucgucgugaccacggacaucucagagaugggcgcgaacuucaaggccgagcgggugaucgacccucgccgguguaugaagcccgucauccucacugacggggaggagcgcgugauccuggcgggccccaugcccgugacccacuccagcgcggcccagcggagagggcgcaucggucggaacccgaagaacgagaacgaccaguauaucuauaugggcgagccacuggagaacgacgaggacugcgcccacuggaaggaggccaagaugcuccuugacaauauuaacaccccagagggcaucauccccuccauguucgaaccggagcgagaaaaggucgacgcgaucgacggcgaguaccggcugcgcggggaggcccggaagacauucguggaccucaugcgccguggcgaccugccuguaugguuagccuacaaggucgcagccgaggggauaaauuacaccgaccguaaguggugcuucgacggcaucaagaauaaccagauccucgaagagaacauggagguugaaaucuggaccaaggagggggagcggaagaagcugaagccccgcuggcuggacgcacggaucuacucagacccgcucgcccucaaggaguucaaggaguucgccgccggucgcaagucucugacucucaaccugaucacggagaugggccggcugccaaccuucaugacucagaaggcgcgaaacgcccucgacaaccuggccgugcugcauaccgccgaggccgggggccgggcguacaaccacgccuuaagcgagcugccagagacgcuggagacccuccugcugcucacccugcuggccaccgucaccggagggaucuuccucuuccugauguccggcaaggggaucggcaagaugacgcuggggauguguugcaucauuacugccucgauccuccugugguacgcgcaaauccagccccacuggauugcagccaguauaauccucgaguuuuuccucaucguccugcugaucccggaacccgagaagcagcgcacgccccaggacaaucagcucaccuacgucgugaucgcaauucugaccguggucgccgccaccauggcuaacgagaugggauuccuggagaagacaaagaaggaccucgggcuggguagcaucacuacgcaggagagcgaauccaacauccuggacaucgaccucagacccgcuagcgccuggacccuguaugccguagccacgacguuugugacgccgaugcuaaggcacuccaucgaaaacucguccgucaacguuagccucaccgcgaucgccaaccaggcuaccguccugaugggccuggggaaggguuggccccucuccaagauggauaucggggucccgcugcuggccaucggcugcuacagccaggugaaccccaucacccucacggccgccuugcugcuccugguggcccauuaugccaucaucgggccggggcuucaggcuaaggccaccagggaggcccagaaacgcgcugccgccggcauaaugaaaaaccccaccgucgacgggaucacagugauugaucucgaacccaucccuuacgacccgaaauuugaaaagcagcugggccaagucaugcugcugauccugugcgucacccagguccugaugaugcguaccaccugggcgcucugcgaggccuugacacuggccacgggucccaucuccacccucugggagggcaaccccggccgcuucuggaauaccaccaucgccgugagcauggccaacauauuccgcggcuccuaccuggcuggagccgggcuccuguucucaaucaugaagaacacgaccaacacccggcgaggcaccgggaacaucggcgagaccuuaggcgagaaguggaaaagccggcuuaaugcucuaggcaagucagaguuccagaucuacaagaaguccggcauacaggaaguugaccgcacccuggccaaggaagggauaaagcggggcgagaccgaccaccacgcggugagccgcggauccgccaagcugcggugguuuguggagcguaacauggucacccccgagggcaaaguuguggaccucggcugcgggagaggcggguggagcuauuacugcggcgggcugaagaacguuagagaggugaagggccuaacgaagggagggccgggucacgaggagcccauccccaugucgaccuauggcuggaacuuagugcggcugcagagcggcgucgacguguucuucacaccgccggaaaagugcgauacucugcucugcgacaucggggagagcagucccaaucccaccauugaggccggccguacgcugcgggugcugaaccucguugagaacuggcugaacaacaauacccaguucugcaucaaggugcugaaccccuacaugccuagcgugaucgagaagauggaagcccuccaacgaaaguacggcggggcccugguccggaacccccugucccgcaacagcacccacgagauguacuggguguccaacgcgacgggcaacauugugagcuccgucaacaugaucagccggaugcuuauuaaucgcuucacgaugaagcacaagaaggcgaccuacgagcccgacguugaucucggguccggcacccgcaacauugguaucgagagcgagauaccgaaucuggacaucauaggcaagcgcauugagaaaaucaagcaagagcacgagaccuccuggcauuaugaccaggaccaccccuacaagacgugggccuaccacggcagcuacgagaccaagcagaccgguuccgccagcuccauggugaacggcgucgugcggcugcucacaaaacccugggacgugguccccauggugacgcaaauggccaugaccgacacgaccccauucggacagcagcgcgucuucaaggagaaagucgacacacgcacccaggagccgaaggaggguaccaagaagcugaugaagaucaccgcggaguggcuguggaaggagcucgguaagaaaaagacaccccggaugugcacccgcgaggaguucacgcggaaggugagaucaaaugccgcccugggggcgauauucacagacgagaacaaguggaaguccgccagggaggccguggaggacggccgcuucugggaacugguggaccgggagcgcaaccuccaccuggaggggaagugcgagacaugcguuuacaacaugaugggcaagcgggaaaagaagcugggugaguucggcaaagccaagggcagccgcgccaucugguacauguggcucggcgcacgguuccuggaguucgaagcccugggcuucuuaaacgaagaccauugguucucaagggggaacagccucagcggaguggagggggagggccuccaccggcugggcuauauccugcgcgauguagggaagaaagagggcggcgccauguacgcagaugacaccgccgguugggacacccggaucacacucgaggaccucaagaaugaggagaugguuacgaaccacaugaagggggagcacaagaagcuggccgaggcuaucuucaaacugaccuaccagaauaaggucguccgcguacagcgucccacgccacgcggcaccgucauggacauuaucucgcggcgcgaccagcgcgggagcggacaggucggcacguacgggcugaacaccuucaccaacauggaggcucagcugauccggcagauggagggcgaggggaucuucaaguccauccagcaccugaccgcaacggaagagaucgccgugcagaauuggcucgcccgcgucgggcgggagcgccugagccggauggcgaucuccggcgacgacugcguggugaagccuaucgacgaccgcuuugcgagcgcccugaccgcacucaacgacauggggaaaguccggaaagacauccagcagugggagcccagccgcgguuggaacgauuggacgcaagugcccuucugcagucaucacuuccacgagcuagugaugaaggacgggcgggucuuaguggugccgugucgcaaccaggaugagcucaucggacgugcccgcauaagccagggcgcgggcuggucacugaaggagaccgcaugccuggggaaauccuaugcccagauguggacccucauguacuuccaccggagggacuuacggcuggccgcuaacgcgaucugcagcgccguacccucgcauugggugcccacgagccgcacgaccugguccauacacgccaagcacgaguggaugaccacggaggacauguuggccguguggaaucgggucuggauccaggagaaccccuggauggaggauaagaccccagucgagagcugggaggaaguucccuaccuggggaagcgcgaagaccaguggugcggcucccugaucggucuuaccucccgggcgaccugggccaagaauauccaaacggcgaucaaucagguccgcucccuaaucggcaacgaggaguacacugacuacaugcccuccaugaaacgcuuccggcgcgaggaggaggaggccggugugcugugguga

SEQ ID NO: 25086 - RNA, 9876 nt, Artificial Sequence
  derived and/or modified CDS sequence (opt11) from DENV-2__EU482444__SS-prME
acggcggggguaaucgucauguugaucccaacugccauggcuuuccaucucacgacacgcaacggcgagccgcacaugaucgugggcagacaggagaaggggaagagucugcuguucaaaaccgaggacggcguaaauauguguacuuuaauggccauggaucucggggagcugugcgaggacaccaucaccuauaagugccccuugcugcgucagaacgagcccgaggauauagauuguugguguaacagcacgucaaccugggucaccuacgggaccugcacaaccaccggcgagcaucgacgcgagaagcggucuguggcgcuggugccccacgucgggaugggccuagagacccgcacggagaccuggaugagcuccgagggggccuggaagcacgugcaacguaucgagacguggauccugcgacacccgggauuuaccaucauggcggcgauccuggccuacaccauuggaacgacucauuuccaaagggcccugaucuucauccugcugacggccguggcgccaagcaugacaaugcgcugcaucggcauauccaacagagacuucgucgagggcguguccgguggcucauggguggacauagucuuagagcacgggagcugcguaaccacgauggccaagaacaagcccaccuuggauuucgagcugaucaagaccgaagccaagcagccugccacacuccgcaaguacuguaucgaagccaaguugacgaacaccaccaccgagucgcggugcccaacacagggcgagccaagccugaacgaggagcaggacaagcgcuucaucugcaagcacaguaugguggaucgaggcugggggaacggcugcggguuauucgguaagggcgggaucgugaccugcgcgauguuuacguguaagaagaacauggagggcaaggugguucagcccgaaaaccuagaguauaccaucgugaucacuccucacagcggcgaagaacacgccgugggcaacgacacagggaaacacgggaaggaaauuaagaucaccccgcaguccagcaucaccgaggccgagcugaccggauacggcacgguaaccauggagugcucuccccgcaccggucucgacuucaacgagaugguccugcugcaaauggaggacaaagccuggcucgugcaccggcagugguucuuggaucugccccuacccuggcugccgggggccgacacccaaggaagcaacuggauccaaaaggagacguuggucaccuucaagaauccccacgccaagaagcaagacguggugguccuugggucacaggagggugccaugcacaccgcgcuaaccggcgcaacggagauccagaugagcaguggcaaccucuuguucaccggucaccugaagugccgccugagaauggacaagcuccagcugaagggcauguccuacuccaugugcaccggcaaguucaaaaucgugaaggaaauugccgagacccagcacgggacgauagugauccgcguccaauacgagggcgacgguucccccugcaagauacccuucgaaaucaccgaccuggaaaagcgacacgugcucgggcgacugauuacagugaacccaaucgucaccgagaaagacagcccagugaacaucgaagcagagccgcccuuuggcgacuccuacaucaucauugggguggagccgggucaauugaagcucaauugguucaagaaggggagcuccaucggccagauguucgagacgacaaugcgcggcgccaagcguauggcuauccugggggacaccgccugggauuucggcagccucgggggcgucuucacaucgaucggcaaggcacuccaccagguguucggagcgaucuacggcgccgccuucucugggguguccuggaccaugaagauucugaucggggucaucauaaccuggauaggaaugaacagccgcuccaccagcuuauccguaagccuugucuuggucggcguggugacccuguaccugggcgccaugguccaggcggacuccggcuguguggugagcuggaagaacaaggagcucaaguguggcagugggaucuucaucacggauaacguccacaccuggacugaacaauacaaauuccaacccgagagcccguccaagcucgccuccgccauucagaaggcacacgaggaggguaucugcgggauccguagcgucacccgccuggagaaccucauguggaagcagaucacgccugagcuuaaucauauucucagcgagaacgagguaaagcucaccaucaugaccggcgacauccguggaauaaugcaggccggcaagaggagccugcgaccgcagccgaccgaguuaaaguacuccuggaaaacguggggcaaggcgaagaugcugagcacugaaucccacaaccagaccuuuuugaucgacgggcccgagaccgccgagugcccgaacacgaaccgcgcauggaacucccuggaggucgaggauuacggcuucggagucuucaccaccaauaucuggcucaagcuccgugagaagcaggacgucuucugcgacuccaaguuaaugagcgccgccaucaaggauaaucgcgcgguccacgccgacaugggcuacuggaucgaguccgcccugaaugacacauggaagauggagaaggcuagcuucauagaggugaaguccugccauuggccuaagagucacacccugugguccaacggcguucuggagagcgagaugaucauccccaagaacuucgcugggcccguuucccagcacaacuaccggccgggguaccacacgcagaccgcgggacccuggcaucucggcaagcuggaaauggacuucgaucugugcgaggggaccaccgugguugucacggaggacugcggcaaccgcgguccgagccugcggaccacgaccgcaagcgggaagcugauaacggaauggugcugccguucaugcacacugccgccacucagguaucgcggcgaggauggguguugguacggcauggagauucggcccuugaaggaaaaggaggagaaccuggugaacagucuggucaccgccgggcacggccagauagacaacuuuucccugggaguucuggggauggcccuguuccuggaggaaaugcugcgcacccggauuggcacgaagcacgcgauucuccugguugccgugucguucgucacccugauuacggggaacaugucuuuccgggaccucggccgcgugauggugauggucggggccacaaugaccgacgacaucggcaugggcguaaccuaccuagcacugcucgccgcauucaagguacggccuaccuucgccgccgggcugcugcuccgcaagcugacuagcaaggagcugaugauggccacgaucggcauagcccuccuaucccagagcacuauccccgagacgauucuggagcucaccgacgcgcuggcucugggaaugaugguccucaagaucgugcggaacauggagaaguaccagcucgccgugacgauaauggcaaucuccugcguaccgaacgcagugauccugcagaacgcguggaaggugucgugcacuauccuugccgccgucuccgugucgccgcuucugcucacuuccucacagcaaaaggccgacuggauccccuuggcgcucacuaucaagggccucaaccccacggccaucuuccuuacaacccucucucgcaccagcaagaagcggaguuggccgcucaacgaagccauaauggccguuggcauggugaguauccuggccuccucucuguuaaagaacgauauaccuaugacggggccccuaguggcgggcggguugcucaccgucugcuacguguuaaccggccgaagcgccgaccucgagcucgagagagcugccgacgugaaaugggaggaccaggccgaaauaagcgggagcucuccaauccugucuaucacuaucuccgaggacggcagcauguccauaaagaacgaggaggaggagcagacgcugaccauucucaucaggaccggccugcuugucauaagcgggguauucccgguguccauccccaucacugcagccgccugguaucugugggaggucaagaagcagcgcgccggagugcugugggacgugccuuccccgccgcccgucgagaaggcggagcuugaggacggggcguaccgcauuaagcaacggggaaucuugggauacucccagaucggcgccggugucuacaaggaggggaccuuucacacgauguggcacgugacucguggcgcgguccugaugcaccgcgggaagagaaucgagcccagcugggccgacgugaagaaggaccucaucucguauggugggggcuggaagcucgagggcgaguggaaggagggggaggagguacagguacuggcccuggagcccggcaagaacccccgggcgguucagaccaagcccgggaucuuuaagaccaacaccggcacaaucggggccguuucucucgacuucucgcccggcacaagcggcucccccaucgucgaccgcaaagggaaaguggugggccuguacgggaacggcgucguuacccggucuggagcauauguguccgccauagcccagacggaaaaguccaucgaggacaacccugagauagaggacgacauauuuagaaagaagcggcugaccaucauggaccuccaccccggggccggcaagaccaagcgcuaccugccggcgaucguccgggaggcaauaaagcgcggguugcgcacccuuauccucgcacccacgcggguggucgcagcagagauggaagaagcacugcgcgguuuacccauccgguaccagacuaccgccaucaagaccgagcacacagggcgcgaaaucgucgacuuaaugugucacgccacguucaccaugcgguuguuaagccccguacgcgugcccaauuacaaccucauuaucauggacgaggcgcauuuuaccgaccccgccuccauugccgcccggggauacaucuccacgcgcgucgagaugggugaggccgcggggaucuucaugacagccaccccacccggcucccgggaccccuucccucagagcaacgcccccauuauggacgaggagcgcgagaucccugagcguaguuggaacagcggucacgagugggugaccgacuucaagggcaagacggugugguuugucccguccaucaaggccgggaacgacaucgcggcuugccugcgcaaaaacggcaagaaggugauccaguugagcaggaaaaccuucgacuccgaguacgucaagacccgcgcuaacgacugggacuucgucgucacaaccgacaucagugagaugggcgcaaacuucaaggcugaacgggugaucgauccgcgcagaugcaugaagcccgugauccucaccgauggggaggagcgcgugauauuagcgggcccaaugcccgugacccauuccuccgccgcccaacggcgcgggcgcaucggccggaaccccaagaaugagaacgaccaauacaucuacaugggagagccgcuagaaaacgacgaggacugcgcccacuggaaagaagccaaaaugcuccuggacaacaucaacacgcccgagggcaucaucccauccauguucgagccagaacgcgagaaggucgacgcgaucgacggcgaguacagguuaaggggagaggcucggaaaacguucguagaccugaugcgccggggugaccugcccguguggcuggccuacaagguugccgccgaggguaucaauuacgcggaccgcaaguggugcuucgacggcauaaagaacaaccagauccuagaggagaauauggagguggaaauuuggacuaaggagggagagcggaagaagcugaagccgcgcuggcuggacgcccggaucuacagcgauccgcucgcccugaaagaguucaaggaauucgcagcgggcaggaagagcuugacccucaaccucauuacugagauggggcgucugccuacguucaugacccagaaggcccgcaacgcccuagacaaccuggccguacugcauaccgcagaggccggaggccgggccuauaaccacgcgcuaagcgagcuucccgagaccuuggagacgcuccuccuacuuacccugcuggccacagucaccggcgguaucuuccucuuccugaugagcggaaaggguaucggcaagaugacccuggggaugugcuguaucaucacggccagcauccuccugugguacgcgcagauccagccucacuggaucgcagccuccaucauccucgaguucuuccucaucgugcugcugaucccggagccagagaagcagcgcaccccccaggacaaccagcucaccuacguggucauugccauccugaccguggucgcggcuaccauggcgaacgaaaugggcuuccuagagaagaccaagaaagaucucgggcugggcagcaucacuauccaggagagugaguccaauauccuggacaucgaucuccggcccgcuucggccuggaccuuauaugccguggcgacgacguucgugaccccgaugcugcgccacuccaucgagaacucguccgucaauguaagccucacugccaucgccaaccaggccaccguguugaugggccuggggaagggcuggccccuauccaagauggacaucgggguuccccugcuugcgaucgguugcuacagccaggugaaccccauuacgcucaccgccgcccugcugcuccucguggcccauuacgcaaucauagggccaggcuuacaggcaaaggccacccgggaagcccagaagcgcgcugccgcaggcaucaugaagaaccccacggucgacggcauuaccgugaucgaccucgagccuauccccuacgacccgaaguucgagaagcagcugggccaggugaugcugcucauccugugcgucacacagguccugaugaugcggaccacgugggcacucugcgaagcccugacccuugccaccggacccauuuccacucucugggagggcaaucccgggcgcuucuggaacacgaccaucgccgugagcauggcgaacaucuuccgcggcuccuaccuggccggagccgggcucuuauucagcaucaugaagaacacgaccaacacgaggcgcggcaccgggaacaucggcgagacccuuggcgagaaauggaagucccggcugaacgcccucggaaagucagaauuccagaucuacaagaaguccgguauccaggaggucgaccgcacccuugcgaaggaggggauuaagcggggggagacggaccaucaugcgguuagccgcggaagugccaagcugcggugguucguggagcgcaacauggucacacccgagggcaaaguuguggaccucggcugcggaagaggaggguggagcuacuacugcggggggcugaagaacguccgagaggugaaaggacugaccaagggagggccggggcaugaggagcccauccccauguccacguacggguggaaccucgugaggcuucaaagcggcguugacguguucuucacgcccccggagaagugcgauacucugcucugcgacaucggggaaagcuccccuaaccccacaauugaggccgggcgcacccugcgggugcuaaaccucgucgagaacuggcugaacaacaacacccaguucugcaucaaggugcugaaccccuacaugccguccguuaucgaaaagauggaagcccuccagcgaaaguacggcggugcgcucguacggaacccauuaucccgcaacucuacucacgaaauguacugggucucgaacgccaccgggaauauagugagcuccgucaacaugaucagccggaugcugaucaaccgcuuuacgaugaagcacaagaaggccaccuaugagccugauguggaucucggguccgguacgcggaacaucgggaucgagagcgagaucccgaaccuggacaucauaggcaagcggaucgagaaaaucaagcaggagcacgagaccuccuggcacuacgaccaggaccaccccuacaagaccugggcguaccacggcagcuacgagaccaagcagacgggguccgccagcucaauggugaauggcguagugaggcugcucaccaagcccugggacguagucccuauggugacccagauggcgaugaccgacaccaccccguucgggcagcagcggguguucaaggagaagguggauacuaggacccaagaaccgaaggaaggcacgaagaaacugaugaagaucaccgccgaguggcuuuggaaagaacucggaaaaaagaagacgccccggaugugcacacgcgaggaguucacccgcaaggugcgcagcaacgccgcccugggggcaauauucaccgacgagaacaaguggaaguccgcgcgggaggccguggaagauggccgcuucugggaacuggucgaccgggagcgcaacuugcaccuggagggaaagugcgagaccugcgucuacaacaugauggguaagcgagagaagaagcugggggaguucggcaaggccaagggaagcagggccauaugguacauguggcugggggcucgguuuuuggaauucgaggcgcugggcuuccuaaacgaggaccacugguucucccgcgguaacucauuaagcgggguggaaggggagggcuuacaucggcucggcuacauccugcgcgacgucggaaagaaggagggagggguuauguacgccgacgacacugccggcugggacacccggauuacccuggaggaccucaagaacgaggagcugguuacaaaccacaugaagggagagcauaagaagcuggcggaggcgauuuucaagcucaccuaccagaacaagguggugagaguccagcggccuacgccgagaggcaccgugauggacaucaucucacggcgggaccagcgaggcagugggcagguuggcaccuacgggcuaaacacuuucaccaacauggaggcccagcugauccggcagauggagggcgaggguauauucaaauccauccagcaccucacugcgaccgaggagauagccguccagaauuggcuggcccgaguggggagggagcgccugucucggauggcgaucucuggugacgacugcguugucaagcccaucgacgaccgcuucgccagcgcccucaccgccuuaaacgauaugggcaaggugagaaaagacauccagcagugggagcccucgcgcggcuggaacgauuggacccagguucccuuuugcagccaccacuuccacgagcuggucaugaaggacggccgaguacucguggucccuugccgcaaccaggaugaauugaucgguagggcccgcaucucccagggcgcaggguggagccuaaaggagaccgcgugccucggcaaguccuacgcccagauguggacucugauguacuuccacaggcgcgaccugcggcucgccgcgaacgcgaucuguagcgcgguccccucccacuggguucccaccucucggaccacuugguccauccaugcgaaacacgaguggaugaccaccgaggacaugcuggccguauggaaucguguauggauccaggaaaaucccuggauggaggacaaaaccccgguggagagcugggaagagguccccuaccuggggaagcgugaggaccaguggugcgggucccugauaggccugacgagccgggcgacaugggcaaagaauauacaaaccgcuaucaaccaggugcgcagccugaucggcaacgaggaguacaccgacuacaugcccuccaugaaacgcuuccgaagagaggaggaggaagccgguguucucugguga

SEQ ID NO: 25087 - RNA, 9876 nt, Artificial Sequence
  derived and/or modified CDS sequence (opt11) from DENV-2__EU482684__SS-prME
acagccggcgugaucgucaugcugauaccgaccgccauggccuuucaucucacaacccgcaacggggagccucacaugaucguaggucgccaggaaaaggggaaguccuuguuauucaagaccgaggacggcguaaacauguguacccucauggccaucgaccugggggaguuaugcgaggauacgaucaccuacaagugcccccuucugagacagaacgagcccgaggacaucgacugcuggugcaauagcaccagcaccugggucaccuacgggacuugcacuaccacuggagagcacagacgcgagaagagguccguggcccuggugccccacguggguaugggcuuggaaacccgaacugagaccuggaugucgagcgagggggcguggaagcacgugcagcggaucgagaccuggauccuucggcauccuggcuucacgaucauggcuaccauccuggcuuacaccaucggaaccacccauuuucagcgagcccucauuuucauauugcugaccgccguggcccccagcaugacuaugcgcugcaucggcauuagcaacagagauuucgucgagggcguuucgggcggcucguggguggacaucgugcucgaacacgggaguugcgugacgaccauggcgaagaacaagccaacccuggauuucgagcugaucaagaccgaagccaagcagcccgcuacccuccgcaaguacugcaucgaagcuaagcugaccaacaccacaacggaguccagaugcccuacacagggcgagccaucgcugaacgaagaacaggacaaacgcuuuaucugcaaacauuccaugguggaucgggggugggggaauggcuguggacuguuuggaaaaggcggcaucgugaccugugccauguuuacgugcaagaagaacauggaggggaagguagugcaacccgagaaccuggaguacacgaucgucaucaccccgcauagcggggaggaacacgcggugggcaacgacaccgggaaacacggcaaagagauuaagauaaccccccaguccagcaucaccgaggccgagcugacggguuacgguaccgucacuauggagugcagcccccggacuggguuggacuucaacgagauggugcugcugcagauggaggacaaagccuggcuggugcaccggcagugguuccuggauuugccccuacccuggcugcccggggccgacacacagggcucuaacuggauccagaaggagacccuaguaaccuucaaaaacccgcacgcaaagaaacaagacgucguggugcuggggucucaggagggcgcgaugcacacagcccugacgggggccaccgagauccagauguccucgggcaaccucuuauucaccggccaccugaaauguaggcuucggauggacaagcuccagcugaagggaauguccuauucuaugugcaccggcaaguuuaagaucgugaaggagaucgccgagacgcaacaugguaccaucgugaucaggguacaauacgagggagacgggagucccugcaagauccccuuugagauaacagaucuggagaagcgucaugugcucgggcggcugaucaccgugaacccgaucgugaccgagaaggauucucccgugaacaucgaagcggagcccccuuucggugauucguauaucaucaucggcguggagccgggccagcugaaguuaaacugguuuaagaaggggagcuccaucggccagauguucgaaacaaccaugagaggcgcgaagcgaauggccauccugggggacacugccugggacuucgggagccucgggggcgucuucacuucgauaggcaaggcccuacaccagguguucggcgccaucuacggcgcagccuucuccggugugucguggaccaugaagauccugaucggagucaucaucacguggaucgggaugaacagccgcuccaccagucuguccgugucucugguacucgucgguguugucacacuauaucugggggccguugugcaggccgacuccggcuguguggucagcuggaaaaacaaggagcuaaaaugcggguccgggaucuucaucacggacaauguacauaccuggaccgagcaguacaaauuucaaccugagagcccaagcaaacuggcgagugccauucagaaggcccaugaggagggaaucugcggaauacgguccgugacgcggcuggagaaucucauguggaagcagauuacccccgagcugaaucacauccuuuccgagaacgaggucaagcuaacaaucaugaccggcgacaucaaagggaucaugcaggcgggcaagcggagccuucgcccgcagccgacggagcucaaguacuccuggaagaccuggggcaaggcgaagaugcucucaaccgagucccacaaccagaccuuccugaucgacgggccagagacugcggagugcccgaacacaaauagggcguggaacagccuggaaguggaggacuacggcuuuggaguguucaccaccaacaucuggcucaagcugcgcgagaagcaggacguuuucugcgauuccaagcuuaugucggccgccauaaaggauaaccgggccgugcacgcggacaugggcuacuggaucgaguccgcccucaacgauacguggaagauggagaaggcaagcuuuaucgagguaaagagcugccacuggcccaagagccacacgcugugguccaacgguguucuggagagcgagaugaucauccccaagaacuucgcgggccccgugucccagcauaacuacagaccgggcuaucacacccagaccgccggccccuggcaucucggcaagcucgaaauggacuucgacuucugcgagggcacuacggugguggugacugaagacugcggcaacaggggcccuucgcuaagaacuaccacggcgagcgggaagcucaucacggagugguguugccggucuuguacccuccccccacugcgguaccggggcgaggacgggugcugguacgggauggaaauccgccccuugaaggagaaggaggagaaucugguuaacucucuuguaaccgcugggcacggccagaucgauaacuuuucccucggugugcuggggauggcccuguuccuugaggagaugcugaggacgcggaucggaaccaaacaugccauucugcuagucgccgucagcuucgugacccugaucaccgggaacaugucguuccgggaccuaggucgcguuauggucauggugggggccacgaugaccgacgacauuggaaugggugugaccuaccuugcgcugcuggccgcauucaagguccggccuacauucgcggccggguuauuacugcggaagcuuacgagcaaggagcugaugauggcaaccaucggcaucgcccuccucucacagucuaccauccccgaaacgauauuagaacugacagacgcucucgcgcuggggaugauggugcugaagaucgugcgcaacauggagaaauaccagcucgcagucaccaucauggcaaucuccugcgugccgaacgcaguuauccuccagaacgccuggaagguuagcugcaccauucuggcggcggugucugucagcccccuguugcuuacaagcagccagcagaaagcagacuggauuccucuugcccugacgauaaaaggcuuaaaucccaccgcgaucuuucucaccaccuugucacggacguccaagaagcgcuccuggccgcugaacgaggccauaauggcuguggggaugguguccauccuagcauccucucuacuaaagaacgacauucccaugaccgggccccucgucgccggagggcugcugaccguauguuacgugcucaccggccguagugcagaccuggaacuugagcgcgccgcugauguaaaaugggaggaccaggccgagauaucagggucuuccccuauucucagcaucacuaucuccgaggacggcagcaugaguauuaagaacgaggaagaggagcagacccuuacuauauugauccggaccggguugcuggugaucuccggaguguuccccgucuccauccccaucaccgccgccgccugguaccugugggagguaaaaaagcagcgcgccggcguccucugggacguccccagccccccgccaguggagaaggccgagcuggaagacggugcguaccggaucaagcagcgcggcauccugggcuacucacaaauuggagcgggcguuuacaaggaggggacuuuccacacaauguggcacguuacccggggagcgguucuaaugcaucgcgggaagagaauagagcccagcugggcugacgugaagaaggaccuuaucuccuacggugguggguggaagcucgaaggagaauggaaggagggcgaggaaguccaagugcucgcccuggaacccgguaagaauccccgcgcugugcagaccaaacccgggauauucaagaccaacaccggcaccaucggggcggucagccuugacuuuucccccggcacuagcggcucgcccaucguggaccggaaggggaagguugugggccucuacgggaauggcguggugacccgcucuggggcauacguauccgcgauagcccagaccgagaaguccaucgaggacaaccccgagaucgaggacgacauauuccggaagaagcgccuaacuaucauggacuugcacccaggagcgggaaaaaccaaacgguaccuucccgccaucgugagggaagccaucaagcgggggcugcgcacgcugauccuggcucccacccgcguggucgccgcggagauggaggaggccuuacggggccuaccuauccgcuaccaaaccccggcgauaaagaccgagcauacgggccgggagaucguggaccugaugugccacgcaacauucaccaugcgccuccugucccccguucggguuccaaacuacaaccugaucaucauggacgaggcccacuucacagacccugcauccauugccgcccgcggguacaucucaacgcggguggagaugggcgaggccgccggaaucuucaugaccgcgacgccgcccggcucacgcgacccguucccccaguccaaugccccgauaauggacgaggagcgggaaauccccgaacgcucguggaacuccggucacgaaugggucaccgacuucaagggcaaaacugucugguucguuccgagcauuaaggccgggaacgacaucgcagcgugccuccggaagaacggaaagaaggugauacagcugagccguaaaacuuucgacuccgaauacgucaagacccgggcaaacgacugggacuucguugucaccacggacauauccgagaugggggcgaacuuuaaggccgagcgcgucaucgaccccaggcgcuguaugaagccggugauccucaccgauggcgaggagcgggugauacucgccgguccgaugccagucacccauuccagcgcggcccagagaagagggcgcaucggccgcaaccccaaaaacgaaaacgaccaguacaucuacaugggggagccccuggagaacgaugaggacugcgcccacuggaaagaggcgaagaugcugcucgacaacauuaacacccccgagggaauaaucccauccauguucgagccugagcgggagaaaguagacgcaaucgacggcgaauaccgccuacgcggggaggcgaggaagacauucguugaccuaaugcggcgcggcgaccuccccguuugguuagccuacaagguggccgccgagggcaucaacuaugcggacagaaaguggugcuucgacggcaucaaaaacaaccagauccucgaggagaacauggagguggagaucuggaccaaggaaggggagcgcaagaagcucaagccgcgguggcuggacgcccgcauuuacagcgacccccuggccuugaaggaguucaaggaguucgccgccggccggaagagccugacccugaaucucaucacagaaauggggcgccugccuacauucaugacgcagaaggcgcggaacgcgcuggacaaccuugcaguacugcacacggccgaggccgggggccgcgcguacaaccacgccuugagcgagcuccccgagacccuagaaacgcugcuccuguuaacgcuccuggcgaccgugacgggcggcaucuuccucuuccuuauguccggaaaggggaucggcaaaaugacacuggggaugugcugcaucaucacggcaagcauccuacuaugguacgcacaaauccagccgcauuggauugcugccuccaucauacuagaauucuuccugauuguacuucuaauccccgagcccgaaaagcagcggacgccccaggacaaccagcugaccuaugugguaaucgcuauuuuaaccgucguggccgcuacuauggcgaacgagauggguuuccuggagaagaccaagaaggacuuaggguuaggcaguaucaccacccaggaauccgaguccaauauccuggacaucgaccugcgcccggccucggccuggacgcucuacgccguggccaccaccuucgucacccccaugcugcgacacucaaucgagaacagcuccgugaaugucagccugacagccaucgccaaccaagcgaccguccucaugggauuagggaagggguggccacucuccaaaauggacaucggggugccccuccuggcaaucggcugcuacagccaggugaacccgaucaccuugaccgcugcccuccugcugcucgucgcccacuacgcgaucaucgggcccggccuccaggcgaaggcaacgcgcgaggcccagaagagggccgcagccggaaucaugaaaaacccuaccguggacgggaucaccguuaucgaccuggagccaauccccuaugaucccaaguucgagaagcagcucggccaggucaugcugcugauuuuauguguaacgcaggugcucaugaugcguacgaccugggcgcugugcgaggcgcucacucuugccacagggcccaucuccacccugugggaagggaaucccgggcgguucuggaauaccacuaucgccguuagcauggccaacaucuuccgcgguagcuaucucgcgggagccgggcugcuguuuuccaucaugaagaacacaacgagcaccagacggggcacggggaacaucggcgagaccuugggcgagaaauggaagagccgccugaacgcacugggcaagucggaguuucagaucuauaagaaauccggcauccaggaaguggaccggacacucgcaaaggaggggaucaagcgcggcgagaccgaccaccacgcggugucaagagggagcgccaaacuacgcugguucgucgaacggaacaugguuacgccggagggcaaagugguagaccugggcuguggacgaggcggguggagcuauuauugugguggccucaagaacgugcgggagguaaagggcuugaccaagggcgggccuggccacgaagagcccauucccaugagcacguacggguggaaucugguccgccuacagagcggcguggauguguuuuuuacaccgcccgaaaagugcgacacacugcuaugcgacaucggcgagagcagcccuaaucccaccaucgaggccggccguacccuccgcguccuuaaccuaguggagaacuggcucaauaacaacacgcaauuuugcaucaaggugcugaacccguacaugccauccgucaucgagaaaauggaggcccuacagcggcaauacggcggggcccucguucgcaacccccugagccggaacuccacccacgagauguauuggguuagcaacgcaaccggcaacauuguuagcagcgugaauaugauaucccgcaugcugauuaaccgguucaccaugaagcacaagaaggcuacguacgaaccggacgucgaucugggcaguggaacccgcaacauagggauagagucagagaucccaaaucucgacaucauaggcaagcguaucgagaagaucaaacaggagcacgagauuucuuggcacuacgaccaggaccacccuuacaagaccugggccuaccauggcucguaugagaccaaacagacggggucugccuccucgauggucaacggugugguacgccuguuaaccaagccaugggaugucgugcccauggugacccagauggccaugacggauacgacgccguucgggcagcagcgcguuuuuaaagagaagguggacacccguacucaggagccgaaggaaggcacgaagaaacucaugaagauaaccgcagaguggcuguggaaggagcuuggcaagaagaagacgccccgaauguguacgcgggaggaguucacuaagaaggugcgcuccaaugccgcccucggggccaucuucaccgacgagaacaaguggaagucagcccgggaggcgguugaagacggcagauucugggaacuggucgaccgggagcgcaaccugcacuuagaggggaagugcgagaccuguguguacaacaugaugggcaagcgggagaagaagcugggcgaauucggcaaggccaagggcucacgcgccauuugguacauguggcugggggcaagguuccuggaguucgaggcgcugggcuuucuuaacgaggaccacugguucagccgcgggaacagccucuccggcgucgagggggagggccuacaccggcucggcuacauucucagagauguggggaagaaggaggggggggcuauguaugccgacgacaccgcaggaugggauacgcggauaacccuugaggaccugaagaaugaggagauggugaccaaccacaugaaaggugagcacaaaaagcuggccgaggcaauuuucaagcugaccuaucagaacaaggugguucgcgugcagcggcccacgccccgcgguacggugauggacaucaucucccggcgcgaccagaggggcuccggucaggucggaaccuacgggcugaacaccuucacgaacauggaggcccagcucauccgccaaauggagggcgaaggcaucuucaagagcauccagcacuuaacagccacggaagagaucgccguccagaacuggcuggcccguguggggcgugagcgcuuaucccggauggcgauaucgggagacgauugcguggucaagcccaucgacgaucgcuucgcgucagccuugaccgcccugaaugacauggggaaggugcgcaaggacauccagcagugggaacccucgcgcggcuggaaugacuggacgcaggugccuuuuugcucccaccacuuccacgaacucgucaugaaggauggaagggugcugguagucccaugccgcaaccaagacgaacugaucggucgagcccgcaucucucaaggggcuggguggucgcucaaggagaccgcaugccuggggaagagcuacgcgcagauguggacacugauguacuuccacagaagggauuuacggcuggcugccaacgcgaucugcuccgccgugcccucccauugggugcccaccucccggaccacauggagcauccacgccaagcaugaguggaugaccacugaggacauguuggccgucuggaaccguguguggauacaggagaacccguggauggaggacaagacccccguggaguccugggaggagguucccuaucuggggaaacgagaggaccagugguguggcagccugauugggcuaacaagucgggcgaccugggccaaaaacauccagacugccaucaaccaggugcgcucccugaucggcaaugaggaauauacagacuauaugcccagcaugaagcgguuccgucgagaggaggaggaggcuggcgugcugugguga

SEQ ID NO: 25088 - RNA, 9876 nt, Artificial Sequence
  derived and/or modified CDS sequence (opt11) from DENV-2__EU482685__SS-prME
accgcgggcgugaucguaaugcucauccccaccgccauggcguuccaucugaccacccgcaacggggagccccauaugauagucggacggcaggaaaaggggaagucccugcucuuuaaaacggaagacggcguuaauauguguacacucauggcgauagaucugggggagcugugugaggacaccaucacguacaagugcccccuccugcgccaaaaugagccggaggacaucgacugcuggugcaacucaaccucuaccugggucaccuacggaacuugcaccaccacgggagagcacagacgcgaaaagcgguccguagcccuggugccacauguagggaugggacuagagacgcgcacggagacguggaugagcucugagggggccuggaagcacgugcagcggaucgagaccuggauccugcgccacccuggcuucaccaucauggcugcgauccuggccuauaccaucgggaccacgcauuuccagcgggcgcugaucuucauccuccugaccgccguggcgcccucuaugacgaugcgcugcaucgguaucagcaaccgcgacuucgucgagggcgucucaggcggcagcuggguggauaucgucuuagaacacgggucuugcgugaccaccauggccaaaaacaagcccacgcuggacuuugagcugauaaagaccgaggcgaaacagcccgcaacccuacgcaaauacugcaucgaggcuaagcugacgaacaccaccaccgagucccggugcccgacgcagggcgagcccagccugaacgaggaacaggauaagagguucaucugcaagcacuccaugguggaccggggguggggcaacgggugugggcuguucgguaagggcggcaucguuaccugcgcaauguucacgugcaagaagaacauggagggcaagguggugcagcccgagaaucuggaguacacuaucgucaucacgccccacucuggcgaggaacacgccgugggcaacgauacgggaaagcacggaaaggaaaucaagaucacaccccaguccagcaucacagaagccgagcucaccggguacggcacugugacuauggaaugcagcccccggacaggccucgacuucaacgagaugguacugcugcagauggaggacaaggcuuggcucgugcaccgacagugguuccucgaccugccccuuccauggcugcccggggcugauacccagggcagcaacuggauacagaaggaaacgcuuguuacguuuaagaauccccacgcuaagaaacaggacguuguagucuuaggaucccaggaaggcgccaugcacaccgcccugaccggggccacggagauacagaugucuagcggcaaccuauuauuuacaggccaccuuaagugccgccuccggauggauaagcuccagcuaaaagggaugaguuauagcaugugcaccggcaaguucaaaauuguaaaggaaauagccgagacccaacacgggacgauugugauccgcguccaguacgagggcgacggcagccccugcaagaucccuuucgagaucacagaccucgagaagcggcacguucucgggcgccugauaaccgugaacccgauagucacugagaaggacagccccgugaauaucgaggcggagccgccauucggagacuccuacauuaucaucggggucgagccgggucagcugaaacucaacugguuuaagaaagggagcaguaucggccagauguucgagacgacgaugcgaggcgccaagcggauggccauccugggggacaccgccugggacuucggcagccucgggggcgucuuuaccuccaucggaaaggcccuccaucagguguucggcgcgauauacggcgcagccuuuagcgguguuuccuggacaaugaagauucugauaggcgugauuaucaccuggaucgguaugaacucucgcuccaccucguugucagugagccuggugcucgucggcguggugacucuguaccugggggcagucguucaggcggacuccggcugcguggucagcuggaagaauaaggagcucaagugcggcucuggaaucuuuauaaccgauaauguacacaccuggaccgagcaguacaaauuccagccugaaagccccagcaaacuggccuccgccauccagaaggcccacgaggagggcaucugcgggauccgcucugugacccgcuuggagaaccucauguggaagcaaauuacgccagaacugaaccacaucuuauccgagaacgaggucaagcucaccaucaugaccggugacaucaaggggaucaugcaggccggcaagaggagccuccgcccgcagcccaccgagcugaaguacuccuggaagacguggggcaaagccaaaaugcucuccaccgagucccacaaccagaccuucuuaaucgacggacccgaaacggccgagugcccgaauacgaaccgggccuggaauucacuggaaguggaggacuacggauucgggguguucaccacuaacaucuggcucaagcuacgcgagaagcaggacgucuucugugacaguaaauuaaugagcgcggccauaaaggauaacagggcaguacaugccgacaugggcuacuggaucgaguccgcccuuaacgacaccuggaagauggagaaggccuccuuuauagaggugaaguccugccacuggcccaagucacacacguuguggucuaacggcgugcuugagagcgagaugaucauccccaagaacuucgccgggcccgugucccagcacaauuacagaccuggauaccacacgcaaaccgcagggcccuggcaccucggcaagcuggaaauggacuucgacuucugcgaggggaccacaguggucgugacggaggacugcgguaacaggggccccagccugcgcacaaccaccgcgagcgggaagcucaucacggagugguguugccggucgugcacccugcccccgcugagauacagaggcgaggacgggugcugguauggcauggaaauccggcccuugaaggagaaggaggagaaccuggucaacagccuggucacggccgggaacggccagaucgauaacuucucccucggcgugcuggggauggcccuguuccucgaggagaugcugcguacgagaauaggcacgaaacacgcgaucuuacuaguggccgucagcuucguuacccugauaacugggaacauguccuuccgggacuuaggccgcgugauggucauggugggggccaccaugacggacgacaucggcaugggcgugaccuaccucgcccugcuggccgcguucaagguccgcccgaccuucgcugcaggauuacuucugcggaagcucaccagcaaggagcugaugauggcuacgaucggcaucgcccugcucucccagagcaccauuccggagacgauccuagaacugaccgacgcgcucgcccuugggaugaugguucugaagaucgugcguaacauggagaaguaccagcucgccgucacgaucauggccaucaguugcgucccgaaugccgugauccugcagaaugcuuggaaggucagcugcaccauccuagccgccguguccgugagcccccucuuacugacaucaagccagcagaaggcggacuggauaccccucgcguugacaaucaaagggcugaaccccacggcgaucuuccucaccaccuuaucccguaccucgaagaagcgcucguggccgcugaaugaggcaauaauggcuguuggcaugguuagcauccucgccuccagccuucugaagaaugacaucccaaugacggggccccuuguggcgggggguuugcugaccgugugcuacgugcucaccggcagaagcgccgaucuggagcuggagcgcgccgcagaugucaagugggaggaccaggcagagaucuccgguagcuccccaauucucucuauaaccauuuccgaggacggcagcaugucaaucaaaaacgaggaggaagagcagacgcugaccauucugauccggaccggccuucuggucaucagcgguguguuuccggucuccauccccaucaccgcggcagcuugguaucuuugggaggugaagaagcagagggccggcgugcucugggacguccccagccccccucccguggaaaaggcggagcuggaggacggggcguaccggauaaagcagcguggaauccuaggguauucccagaucggcgcuggcguauacaaggagggcaccuuccacacgauguggcacgucacuagaggagccgugcucaugcaucgcgguaagcgcaucgaacccagcugggcugacgucaagaaagaccugaucuccuacggcgggggauggaagcuggagggggaauggaaggagggggaggagguucagguguuggcccuggaaccuggcaagaacccucgugcggugcaaacuaagcccgggaucuucaagacuaacacggggacuaucggcgccgucagccuagacuucuccccagguaccucgggcuccccaaucguggaccggaaaggaaagguggucggauuauacggaaacggcguggugacccgcucaggcgccuacgucuccgccaucgcgcagacggagaaguccaucgaggacaaucccgaaaucgaggaugauaucuuucggaagaaacgccugaccaucauggaccugcaccccggggcgggcaagacgaagcgguaccuccccgccauagugcgagaggccaucaagagagggcugcgcacccugauacuggcccccacgcgcguuguagcugcugagauggaggaggcccuccggggccugccgaucagauaccagacgcccgccaucaaaaccgagcacacgggaagggaaaucguggaccugaugugccaugccacguucaccaugcgccuucucagccccguccgggucccgaauuauaaccugaucaucauggacgaggcgcacuucaccgaccccgccuccaucgccgcccgcggcuacaucagcacccgcguggagaugggcgaggcggcgggcaucuucaugacggccacgccgccgggcucccgcgacccguucccccaaucuaaugcccccaucauggaugaggagcgagagauccccgagcgcuccuggaacagcggacacgagugggugaccgacuucaaaggcaaaaccgugugguucgugccgucuaucaaggccgggaacgacauugcggccugccuccggaagaacggaaagaaggugauccagcugagccgcaagacguucgauuccgaguaugucaagacucgggccaaugacugggacuuuguggugaccaccgacauaagcgagaugggugccaacuucaaggccgagcgcgucaucgacccccggcggugcaugaagcccgugauccugacggacggggaggagcgggugauucuagcggggccaaugccggucacucacucaagcgccgcccagcgccgggggcgcaucggacgcaaucccaagaaugagaaugaccaguacaucuacaugggggagccccuggagaacgacgaggacugcgcccacuggaaggaggcgaaaaugcuguuggacaacauuaacacccccgaaggcaucauccccaguauguucgaacccgagcgggaaaagguggacgcuaucgauggcgaguaccgccugcgcggggaagcccgcaagaccuucguggaccugaugcggcguggagaccuaccggucuggcuugccuacaagguggcggccgaagggaucaacuaugcagaccggaaguggugcuucgaugggaucaagaacaaccagauccucgaggaaaacauggagguggagaucuggacgaaggagggggaacgaaagaagcuuaagccgcgguggcucgacgcccgcaucuacagcgacccccucgccuugaaggaguucaaggaguuugccgcgggccggaaaucccuaacccugaaccucauaacugagauggggcgccugccuaccuucaugacgcagaaggcaaggaacgcucuggacaaucucgccguacugcacaccgcggaggccgggggccgcgcauacaaccacgcucugagcgaacuacccgagacccuggagacccugcuccuuuuaacgcuccuggcgaccguuacgggaggcaucuuccuguuccuaauguccggcaaggggaucggcaagaugacacuggggaugugcuguaucaucaccgccagcauccuacucugguacgcgcagauacagccacacuggaucgccgccaguaucauccuggaauuuuuccugaucgucuuacugauccccgagcccgagaagcaacggaccccccaggacaaccaacugaccuacgugguuaucgccaucuuaaccguggucgccgcgacuauggccaacgagaugggcuuccuagagaagaccaaaaaggaccuuggacucggcuccaucaccacccaggaguccgaguccaacauucuugauaucgaccuucgcccggccucggcguggacccucuacgccguggccaccaccuuugucacucccauguugaggcacuccauugagaacucauccgugaacgugagccugacggccaucgccaaccaggccacgguccucaugggccuggggaagggcuggccuuuauccaagauggacaucggggugcccuugcuggcaaucgggugcuauagccaggugaauccgaucacccugaccgcugcccucuugcugcucgucgcccacuacgccaucauuggacccggccuacaagcaaaggccacccgagaggcgcagaagcgggcugcagcgggcauuaugaagaacccgacaguggacggcauuaccgugaucgacuuagagcccauuccguacgaccccaaguucgaaaaacagcucggccaggucaugcugcugauccucugcgucacacaggugcugaugaugcgaaccacgugggcccugugcgaggccuugacacuagccacgggucccaucuccaccuugugggagggcaaucccgggcgguuuuggaauacgacuaucgccgucagcauggcuaacauauuccgcggcucuuaccucgccggcgcggggcuguuauucuccaucaugaagaacaccaccuccacgaggcggggcaccgggaacauuggcgagacccucggcgagaaauggaaaagccgccugaacgcccuggggaagagugaguuucagaucuacaagaagucagggauucaggaggucgaccggacccuagcaaaggaggguaucaagcgcggcgagacagaccaucacgccgugucccggggcagcgccaagcugcgcugguucgucgagagaaacauggugacuccggagggcaaggugguagaccuggggugcgggcgcggcgguugguccuauuacuguggcgggcucaagaacgugcggcagguuaaagggcugaccaagggcgggcccggccacgaagagcccauuccaaugucuaccuacggguggaaccugguccggcuccagucuggcguggacguguucuucacgccgcccgagaagugugacaccuuauuaugcgacaucggagaguccagccccaaccccacgauugaggccggccguacccuccgcguccugaaccugguggagaacuggcucaacaauaacacccaauucugcauaaaagugcugaacccuuacaugcccuccguuauugagaaaauggaggccuugcagcggcaguacggaggggcgcucgugcgcaacccccugagccggaacaguacgcacgagauguacugggucagcaacgccacggguaacaucgucuccagcgugaacaugaucucccgcaugcuaaucaaucgauucaccaugaagcacaaaaaggccaccuaugagcccgacguggacuugggcagcggcacgcgcaacaucgggauagaguccgagauaccgaaucuugacauaaucggcaagcggaucgagaagaucaagcaggagcacgaaauaucguggcacuaugaccaggaccacccauauaagaccugggcauaccacggguccuacgagaccaagcaaaccgggagugcaagcagcauggucaauggaguggugcgccugcucacgaagcccugggacgucgucccuaugguaacccagauggcaaugaccgauaccacucccuucgggcagcaacgcgucuuuaaggaaaagguagacacccggacucaggaaccuaaagaaggcacuaaaaagcucaugaagauaaccgccgaguggcucuggaaggagcuuggcaagaagaaaacgccgcgcauguguaccagagaggaauuuacuaagaaggugcgcagcaacgccgcccucggggcuaucuucaccgacgagaacaaguggaaguccgcacgggaggccguagaggacggacgcuucugggagcugguagaccgggagagaaaccuucaccuagaggggaagugcgaaacguguguguauaacaugauggguaaacgggagaaaaaacugggggaguucggcaaggccaagggcucccgcgccaucugguacauguggcugggggcgcgguuucuagaguuugaggcccugggauucuuaaacgaagaccacugguucucgcgcgggaacagccucucuggcgucgagggugagggccugcacagguuaggcuacauucuccgcgauguggguaagaaggaaggcggggccauguacgccgacgacaccgccggcugggacacccgcauuacgcuggaagaccuaaagaacgaggagauggucaccaaucacaugaagggggagcauaaaaagcucgcggaggccaucuucaagcugaccuaucagaacaagguggugcgcguccagcggccgacgcccagagggacugugauggauauaaucagccggcgcgaccagcggggauccggccagguaggcaccuacgggcugaauaccuucaccaauauggaggcccaacucauccgccagauggagggcgagggcauuuucaagaguauccagcaccuuacggcuaccgaagagaucgccguccaaaacuggcuggcccgcgugggacgggagcgccuaucccggauggccaucagcggcgacgauugcguggucaagcccaucgacgaccgcuuugccucagcgcugacagcccugaaugacauggggaaggugcggaaggauauccagcagugggagccuagccgcggcuggaacgauuggacccaggugccguucugcucacaccacuuccacgagcucgucaugaaggacgggcggguucugguggucccgugccgcaaccaggaugagcuuauaggccgggcgcgcauaagccaaggagcuggguggucccugaaggagacggccugccuagggaagagcuacgcccaaauguggacucugauguacuuccaucggcgcgaccuucggcuggcagcuaacgccaucugcuccgcugugccaagccacuggguccccaccucccgcaccaccuggucuauccacgccaagcacgaguggaugacaaccgaggacaugcuggcggucuggaaccggguauggauccaggagaauccguggauggaggauaagacccccgucgaaucaugggaagagguccccuaucucgguaagcgcgaggaccaguggugcggcagccugauagggcugaccucgcgggccacgugggccaaaaacauccagacggcgaucaaccaggugagaucucuuauaggcaacgaggaauacacugauuacaugcccuccaugaagcgguuccgccgcgaggaggaagaagcaggcgugcucugguga

SEQ ID NO: 25089 - RNA, 9876 nt, Artificial Sequence
  derived and/or modified CDS sequence (opt11) from DENV-2__EU482687__SS-prME
accgcgggggugaucguuaugcucauccccaccgccauggcguuccaccucaccacccgcaacggggagccccacaugaucgucgggcggcaggagaaggggaagucccugcuguucaagaccgaggacggcgugaacaugugcacacucauggcgaucgacuugggggaguuaugcgaggacaccaucacguauaagugcccccuccuucgacaaaacgagcccgaggacaucgacugcuggugcaacagcaccagcaccugggucacuuauggcacguguaccaccacgggcgagcaccggcgcgagaagcgauccguggcccuugugccccacgucgggaugggucucgagacccgcaccgagacuuggaugucgagcgagggcgcguggaaacacgugcagcggaucgaaacauggauccugcgccacccugguuucacuaucauggcggccgugcuggccuacaccaucgggaccacgcacuuccagagagcccucaucuuuguccugcugaccgccguggcucccagcaugaccaugagauguaucggcaucagcaaccgggacuucguggagggcgucagcggcggaagcuggguggacaucgugcucgagcacgggaguugcgucacaacgauggccaagaacaagccuacacuggacuucgagcuuaucaagaccgaggccaagcagcccgcuacccuccgcaaguauugcaucgaagccaaacugacgaauaccacuaccgagagucggugcccgacgcagggcgagcccagccugaacgaggagcaggauaagcguuucaucugcaagcacuccaugguugaccgggguugggggaacggcugcggccuguucgggaaaggagggaucguaaccugcgcgauguucacgugcaagaagaacauggagggcaaggucgugcaacccgaaaaccuggaauacaccaucgugaucacuccccauagcggggaggagcacgccgucggcaacgacaccgggaagcacggcaaggaaaucaagauaaccccucaguccucaauaaccgaagccgagcuuaccggguacggcacggugaccauggaguguucacccagaaccggcuuagacuucaacgagauggugcugcuccagauggaggacaaggccugguugguccaucggcagugguuccuggaccugccgcuccccuggcucccgggggccgacacccagggcagcaacuggauccagaaggagacccuagugacauuuaaaaauccccacgcgaagaaacaggacguugucgugcucggcucacaggagggggccaugcacaccgcccugaccggggccacugagauccagaugagcagcggcaaccuccucuucaccggccaccugaagugccgcuugcggauggacaagcuccagcugaagggcauguccuacagcaugugcacaggcaaguucaaaaucgucaaggaaauagccgagacccagcacgggaccaucgugauacgggugcaguaugaaggcgacggcucccccugcaagauccccuuugagaucacagaccuggagaagcgacacgugcucgggcgccuaaucaccgugaacccgaucgugaccgagaaagacagccccgucaacauagaggcggaaccuccguucggcgacuccuacaucaucaucgggguggagccgggccaguuaaaguugaacugguucaagaaagggagcuccaucggccagauguucgagacgaccaugcgcggcgccaaacggauggccauccugggggauaccgccugggacuucggcucauuagggggcguguuuacguccaucgguaaggcccuucaccagguguuuggcgcaaucuacggcgccgccuucagcggaguguccuggaccaugaaaauucugaucggcgugaucauuaccuggaucgggaugaacucacguuccaccucgcuguccgucagccuaguguuagugggcguugugacccuguaccugggggcagugguccaggcggacucaggcugcguggugagcuggaagaauaaggaacucaagugcggauccgggauauucauaacggacaacguucacaccuggaccgagcaguacaaguuccaacccgagagccccagcaaacuugccuccgccauucagaaggcccacgaggaggggaucugcgggauccggagcguuacccgccuugagaaccucauguggaagcagaucacgcccgagcugaaccacauucuguccgagaacgaagucaagcucacaaucaugacuggcgacaucaaaggcaucaugcaggccggcaagcggagccugcgcccacagccaaccgagcugaaguacuccuggaaaacguggggcaaagcuaagauguuaagcaccgagucccacaaccagacauuccugauagacgggcccgagacagccgagugcccgaauacgaaccgggccuggaacagccuggaggucgaagacuacggcuucgggguuuucaccaccaacaucuggcucaagcugcgcgagaagcaggacguauucugcgacagcaagcuaaugagcgccgccaucaaggauaaccgggcgguccacgccgacaugggcuacuggaucgagucagcucuaaacgacaccuggaagauggagaaggcuagcuucaucgagguaaagagcugccauuggcccaagucccacaccuuaugguccaacggcguacuggagagcgagaugauaauaccuaagaacuuugccgggcccgucucccagcacaauuaccgcccgggauaccacacgcagaccgcugggcccuggcaucucggcaaguuagagauggacuuugacuucugcgaggguaccacggugguggucacggaggacugcggcaaccggggccccucacugcgcaccacuaccgccagcgggaagcucaucacagaauggugcugccgguccugcacccuacccccgcugcgcuaccgcggggaagacgggugcugguacggcauggagauacggccccucaaggagaaggaggagaaccuggugaacagccuggugaccgcugggcacggccagaucgacaacuucucccucggcguccuggguauggcccuguuccuugaagagaugcuacgcacccgcaucggcacuaaacaugcgauacugcucguggccgugagcuucgucacccuaauuaccgggaauauguccuuuagggaccucggccgcgugauggucauggucggugcaaccaugacggacgacauaggcaugggcgugacuuaccucgcccuguuggcagcguucaaggugcgccccaccuucgcagccgggcuccugcuaaggaagcucaccagcaaggagcugaugauggccacgaucggcaucgcccugcucucccagagcaccauccccgagaccauccuagagcugaccgacgcguuagcccuggguaugaugguccugaaaauagugcgcaacauggagaaguaccagcucgccgugacgauuauggccaucaguugcgucccgaacgccgugauccugcagaacgcguggaaagucucgugcacgauccuggccgccgugucgguuagcccccuccugcugaccuccucgcagcaaaaggccgacuggaucccuuuggcgcuuaccaucaagggacugaaccccacggccaucuuucucaccacccugucucggaccagcaaaaagcgcuccuggccgcugaacgaggccaucauggcagucgggauggugagcauccucgcguccagucugcuuaagaacgauauccccaugacgggcccgcuugucgcgggcgggcugcugaccguaugcuacgugcucaccggccggagcgccgaccuggagcuggagcgcgcugcggacguuaaaugggaggaccaggcggaaauauccgggagcagcccgauccucucuaucaccaucucugaggacggcagcauguccauaaagaacgaggaggaggagcagacccugacuauccuaauccggaccggccuccuggucaucagcgggguguucccuguguccauccccauuaccgcggcugccugguaccugugggaggucaagaaacagcgcgcaggcgugcucugggacgugcccagcccgccgcccguugaaaaggcagagcuggaggacggggcguaccguaucaagcaacgcggcauccugggguacucccagauuggggccggcguguauaaagaggggaccuuucacacaauguggcacgucacccgcggcgccguccuaaugcaccgugggaagcggaucgagcccagcugggccgacgugaagaaggaucuuaucuccuauggcggaggcuggaagcuggagggcgaguggaaggagggugaggaagugcaagugcuugcccuggagcccggcaagaauccaagagccgugcagaccaagcccgggaucuucaagaccaacacgggcacuaucggggccguaagucuggacuucucccccggcaccagcggcuccccgaucgucgaucggaaggguaaaguggucggccucuacggcaauggcgucguuacccggagcggcgccuacguguccgccauugcccagacggagaaauccaucgaggacaaucccgagaucgaagacgacaucuuccggaagaagcgccugaccaucauggaccugcaccccggggcggguaaaacuaagcgguaccucccagccaucguccgcgaggcuaucaagcggggguuacgcacccucaucuuggcccccacacgcguuguggcggccgaaauggaggaagcccucagaggccugccuauccgcuaccagacccccgccauuaagaccgagcacaccggucgggagauugucgaccugaugugccacgccacguucaccaugcgccuccugagccccgugcgggugccgaacuacaaccugaucaucauggacgaggcgcacuucaccgaccccgccuccaucgccgcccgcggcuacauaagcacccguguugagaugggggaagccgcugggaucuuuaugacggccacgccucccggcucccgggacccguucccccaaagcaacgcccccauaauggacgaggagcgggagauccccgagcgcaguuggaacagugggcaugaguggguuacagacuucaagggcaaaaccgugugguuugucccgucaauaaaagccgggaacgacauugcggccugucuccggaagaacggcaaaaaggugauucagcugagucgcaagacguuugacuccgaguacguuaagaccagggccaacgacugggacuucgucguaaccaccgauauuagcgaaaugggcgccaacuucaaggccgaacgcgugaucgacccucggcgcugcaugaagccaguaauccuuacggacggggaggagcgugugauccucgcgggaccuaugccagugacccacuccucagccgcccagagacggggcagaauaggcagaaaccccaagaacgaaaacgaucaguacaucuacaugggggagccacuggagaaugacgaggauugcgcccauuggaaggaggccaagaugcugcucgauaacaucaacacacccgagggaaucaucccguccauguucgagccagagcgggagaaagucgaugccauugauggcgaauaccgccugcgcggggaagcccgcaagacauucguggaccugaugcggcgcggggacuuaccgguguggcuggcuuauaaggucgccgcggaggggauaaacuacgcggaccggaaauggugcuuugacggcaucaagaacaaccagauucuggaggagaacauggaggucgagaucuggacaaaggagggggagcgcaagaagcucaagccacgguggcuagacgccagaaucuacuccgacccguuagcacucaaggaguuuaaggaguucgccgcgggccggaaaucccugacccuuaaccuuauaaccgagaugggccgccugcccaccuucaugacgcagaaggcccggaacgcccuugacaaccucgccguccugcacacagccgaggccgggggccgcgcuuacaaccacgcgcugagcgagcuccccgagacccuggagacccuucugcugcugacauuacuggccacugugaccggcggaaucuuccuguuccucauguccggcaaggggaucggcaagaugaccuuggggauguguugcaucauuaccgcuagcauccuccucugguaugcgcagauccagccacauuggauugccgcauccaucaucuuggaguucuuccuuaucguacuccugauccccgagcccgagaaacagcggacuccacaggacaaccagcugacauaugucgugauagccauacuaacagugguagccgcgaccauggcgaacgagaugggcuucuuggagaaaacgaagaaggaccuggggcucggcagcaucacgacacaggagagcgaauccaacauccuggacaucgacuugcgcccagccagcgccuggacccucuacgccguagcgacuaccuucgugacgccgaugcugcggcacuccaucgagaauagcuccgucaaugugagccugaccgcuaucgccaaccaggccaccgugcugaugggccuggggaagggcuggccccuguccaagauggauauuggggucccacucuuggcgaucggcugcuacagccaggugaacccgaucacccugacugccgcacuccuccugcucguugcgcacuacgccaucauugggcccggccugcaggcgaaggccaccagagaggcccaaaagcgggcugcagccgguaucaugaagaaucccacggucgacgggaucaccgugaucgaucuggagccgaucccguacgaucccaaguucgagaagcaauuaggccaggugaugcuacugauccucugcgugacccaggugcugaugaugaggaccacgugggcacugugcgaggcccucacccuggccacagggcccauaucgacccugugggagggcaaccccgggcgguuuuggaacacgaccaucgccguuagcauggcgaacaucuuccgcggcuccuaccuggccggcgccggacugcuguucagcaucaugaagaacaccaccuccacgcgccggggcaccgggaacaucggugagacccucggagagaaguggaagucucgccugaacgccuuagggaagucugaguuccagaucuacaagaaguccgguauccaagaggucgaccggacccuggcgaaggaagggaucaagcgcggcgaaacggaccaccacgcagugucacgggggagcgccaagcugcguugguucguggagcggaacauggugacgcccgagggcaaggugguggaccuaggcugugggcggggugggugguccuacuacugcggcgggcuaaagaauguccgggaggucaaaggucugaccaagggcgggcccggccacgaggagcccauccccaugucuaccuacggguggaaccugguacgccuccagagcggggucgacguguucuuuacuccgccggagaagugcgacacccugcugugcgacaucggggaguccagccccaaucccaccaucgaggccggccggacucuccgcgugcugaaccuggucgagaacuggcucaacaacaauacccaauucugcauaaaggugcugaauccguacaugccauccgucaucgagaagauggaggcacugcagagacaguacggcggggcacucguccgaaacccccugagccggaacaguacgcacgaaauguauugggugagcaacgccaccggcaacaucguguccuccguuaacaugauaucccgcaugcugaucaaccguuucaccaugaagcacaagaaagccaccuacgaaccggacguggaccuggggagcggcacgcgcaauauugggaucgaguccgagauccccaaccucgacauaaucggcaagcggaucgagaagaugaagcaggaacacgagaucagcuggcauuaugaucaagaccaccccuacaagaccugggcguaccauggcuccuacgaaaccaagcagaccgggagcgccucuagcauggugaacggcgucguccgccugcucacgaagccgugggacguggucccgauggugacucaaauggccaugaccgacaccacgcccuucgggcagcagagaguguuuaaggagaaggucgacacacgcacccaggagccgaaggagggaacgaagaagcucaugaagaucacggccgaguggcuguggaaggagcuggguaagaagaagacgccacgcaugugcacccgggaggaguucacccgcaaggugcggucaaacgccgcccucggugccauuuucacggacgagaacaaauggaaguccgcgcgcgaggccguggaggacggccgcuuuugggagcuggucgauagagagcggaaccugcaccucgaggggaagugcgaaacgugcgucuacaacaugauggguaagcgcgagaagaagcugggggaguucggcaaggccaaggggucccgggccauuugguauauguggcuaggggcgcgcuuccucgaguucgaggcccugggcuuccugaacgaggaccacugguucucacgggggaauagccucuccggcguagagggggaggguuuacaccgccugggcuacauucuccgggacgugggcaaaaaggaaggaggggcuauguaugccgacgacaccgccgguugggacaccaggauaacgcucgaagaccugaagaacgaggagaugguaacuaaccacaugaagggcgagcauaagaagcucgcggaagcgauauucaagcugaccuaucagaacaaagucguccgggugcagcgcccgacgccccggggaacggucauggacauuaucagccgccgggaccagcgcggauccggacagguggggacauacggauuaaacaccuuuacuaacauggaagcucagcucauccgacagauggagggcgagggcauauucaagagcauccagcaccugacggccaccgaggagaucgccgugcaaaacuggcuggcgcgcgucggacgcgagcggcucucccgcauggccaucagcggcgacgacugcguggucaagccuaucgaugaccgguucgcuuccgcccugaccgcccugaacgacaugggcaaagucagaaaggacauccagcagugggagcccagccggggcuggaacgacuggacacaggugccguucuguucucaccacuuccacgagcucgugaugaaggaugggagagugcugguggugcccugccggaaccaagaugagcugaucggccgcgcgcggaucagucaaggugccggguggucccucaaggagacugccugccugggcaagaguuacgcccaaauguggacccugauguacuuucaccgccgggaccugcgccuggcggcgaacgccaucuguuccgccguacccagccacugggugccuaccucccggacuaccuggagcauccacgccaagcacgaguggaugacgaccgaggacaugcuggcggucuggaaccguguuuggauccaggaaaacccguggauggaggacaagacgccgguugaauccugggaggaggugcccuaccuggguaagcgggaggaccaguggugcggcagucugaucgggcugaccagccgugccacuugggccaagaacauccaggccgccauuaaccagguccggucccucaucggaaacgaggaguauaccgacuacaugcccagcaugaaacgcuuccgccgagaggaggaggaggcgggaguccucugguga

SEQ ID NO: 25090 - RNA, 9876 nt, Artificial Sequence
  derived and/or modified CDS sequence (opt11) from DENV-2__EU482688__SS-prME
accgcgggcgucaucgucaugcugauccccacagccauggcguuucaccucaccacccgcaacggggagccccacaugaucgugggccggcaggagaaggguaagucccugcuguucaagaccgaggauggaguaaacaugugcacucucauggccauagaccugggugagcugugcgaggacaccaucacuuauaagugcccccuccuucgccagaacgagcccgaggauaucgacugcuggugcaauagcaccagcaccugggucaccuacggaaccugcaccaccacgggcgagcaccggcgagagaagcgguccguggcccucgugccucacgucgguaugggacucgagacgcgcaccgagacguggaugucgucugagggggcuuggaagcacgugcagcggaucgagacguggauucuacgccauccgggcuucaccaucauggccgcgauccuggccuacaccaucgguaccacgcacuuccagcgggcccucaucuucauucugcugaccgccguggcgcccucgaugaccaugcgcugcaucggaaucuccaauagagacuucguugaaggcgugagcggaggcuccuggguggauauaguccucgaacacgggagcuguguaaccacgauggccaagaacaagcccacccuggauuucgaacugauaaagaccgaggccaagcagcccgccacccucagaaaguacugcaucgaggccaagcugacgaacaccaccaccgaaucccgguguccgacgcagggcgagcccagccuaaacgaggagcaggacaagcgcuucaucugcaagcacuccaugguggaccggggcugggggaacggcugcggccucuucggaaaaggggggaucgugacaugugcgauguucacgugcaagaagaacauggaagggaagguggugcagcccgaaaaccuggaguauaccaucgucauaacgccccacagcggggaggagcaugcagugggcaacgacaccgggaagcauggcaaggagaucaagaucaccccgcaaucaagcaucaccgaggcugagcuaaccggcuacggcacggugaccauggagugcagcccccggaccggccucgacuucaacgagaugguccugcugcagauggaggauaaggccuggcucgugcaccggcagugguuccuggaccugccacuccccuggcuuccgggggccgacacccagggcucgaacuggauccagaaggagacauuagugaccuucaagaacccccacgcgaagaaacaggaugucgugguccuagggucccaggagggcgccaugcacaccgcccucaccggggccacagagauccagaugagcucaggcaaccuccuguucaccggucaccugaagugccgccugcggauggauaagcuccagcuaaaagggauguccuacagcaugugcacuggcaaguucaagauagugaaggagaucgccgagacccagcacgggacgaucgugauccggguccaguaugagggcgacggcucaccaugcaagaucccguucgagaucaccgaccuagagaagcggcacgugcucgggagacugaucaccguaaauccgaucgucaucgaaaaggacagccccgugaacaucgaggccgagccucccuucggcgacuccuauauuaucaucgggguggagccgggccagcugaagcucaacugguucaagaaggggagcuccaucggccagauguucgagaccacgaugaggggcgccaagcgaauggccauccugggugacaccgcuugggacuucggcagccucgggggcguauuuaccuccauagggaaggcccuucaccagguguucggcgcgauauacggggcugccuuuagcgggguguccuggacgaugaagauccugauaggcgucauaaucaccuggaucggcaugaacagccgcuccacgucgcucuccgugagccuugugcuggucgguguggugacacuguaccugggggccaugguacaggcagacuccggcugcguggugagcuggaagaauaaggagcucaagugcggcucagggaucuucaucaccgacaacguacacacguggaccgagcaguacaaguuccagccggagagccccagcaaguuagcguccgcaauucagaaagcccacgaggaggguauaugcgggauccgaagcgugacccgccuugagaaccucauguggaaacaaaucacucccgaacugaaccacauucuguccgagaacgaagugaagcucacgaucaugaccggcgacauccggggcaucaugcaggccggcaagcgcuccuugcgcccgcagccuaccgagcugaaguacuccuggaagaccuggggcaaggcgaagaugcucagcacggaaucgcauaaccagacauuccugaucgacgggcccgagacagccgagugcccgaacaccaaccgcgccuggaacagccuggaagucgaggacuacggcuuugggguuuucacgacaaacaucuggcucaagcugagagagaagcaggacgucuucugcgauucaaagcugaugagcgccgcuauuaaagacaaccgcgcgguccacgccgacaugggcuacuggaucgaguccgccuugaacgauaccuggaagauggagaaggccagcuucaucgaggugaaguccugccacuggccaaagucgcacacccugugguccaacggcgugcuggagagcgagaugaucauccccaaaaacuucgccgggccuguuucccagcacaacuaccggccgggcuaucacacucaaacggcggguccguggcaucucggcaaacuggagauggacuucgacuugugcgaagggaccacuguaguggucaccgaggacugcggcaacagaggccccagccucagaacgaccaccgcuucugggaagcucaucacagagugguguugccgcuccugcacgcugcccccgcuccgguaucgcggcgaagacgggugcugguacggcauggagauccggccuuugaaggagaaggaggagaaccugguaaauagucuaguaaccgcggggcacggccaaaucgacaacuucucucugggcgucuuggggauggcccucuuccuggaagaaaugcugcgaacucggaucggcaccaagcacgcgauccuccugguggccgucucccucgucacgcucauaaccgggaacauguccuuccgugaucugggccgcgugauggugauggucggggccaccaugaccgacgacaucggcaugggcgugacguaucuggcacucuuggccgcguucaaggugcggcccacuuucgccgcuggguugcuucugcgcaaauugacaagcaaggagcucaugauggcaaccaucgguaucgcucugcugucccagucuacgauccccgagaccauccuagagcuaaccgacgcgcuggcccugggaaugaugguccuaaagauugugcggaacauggagaaguaccagcuggccgugaccaucauggcaaucuccugcguacccaacgcagugauacuccagaacgcuuggaaggugagcugcacaauccuggccgccguauccgugagcccccugcuccugaccuccagccagcagaaggccgacuggaucccccuggcgcuuaccauaaagggccugaaucccaccgccaucuuccugacgacccucuccagaacaagcaagaaacgguccuggccucugaacgaggccauuauggcggucggaauggugagcauccuagccuccagccuccugaaaaacgacauccccaugaccgggccccugguugcgggcgggcuccugacggucugcuacgugcugaccggccgcucagccgacuuagaguuggagagagcagcggaugugaagugggaggaccaggccgaaauaucggggaguagcccgauccugagcaucaccaucagcgaggauggcagcauguccauaaagaacgaggaggaggagcagacccucacgauccugauccgcaccggccugcucgucaucagcggaguauucccggugucgauacccaucaccgccgccgccugguaccugugggaggucaagaagcagcgggcgggcgugcuuugggacgugccgucuccgccccccgucgagaaggcagaacucgaggacggggcguaccgcaucaaacagcgaggcauucugggauacucgcagaucggcgccggcgucuacaaggaagggaccuuccacacuauguggcacgugacgcgcggcgccguccugaugcaccgggguaagcgcaucgaaccaagcugggccgacguuaaaaaggacuugaucuccuacggcgggggguggaagcucgagggcgaguggaaggagggggaggagguacagguucuggcccucgagcccggcaagaacccgcgugcgguacaaacuaagcccgggaucuucaagacuaacaccggcacuauuggggccguaucacuggacuuuuccccgggcaccagcggcucccccaucgucgaucgcaaggggaagguggugggccuguacggaaacggcgucgugacacggagcggcgccuacguaucugccaucgcgcagaccgagaaguccaucgaggacaacccggagaucgaggaugacauuuuccgcaaaaagcggcucacgaucauggaccugcaccccggggccggcaaaaccaagcgcuaccugcccgcgauuguucgggaggcuaucaagcggggacugcgcacacucauucuggccccgaccagaguaguagcggccgagauggaggaagcccuccgcggucucccuauccgguaccaaacgaccgccaucaagaccgagcacacugggcgcgagaucguugaccugaugugccaugcuacguucaccaugcggcuacucagccccgugcgcgugccuaacuauaaccucaucaucauggacgaggcgcacuucaccgacccggccucuaucgccgcucgcggcuacaucagcaccagaguugagaugggcgaagccgcggggauuuucaugacggccacgccucccggcucccgggaucccuuuccgcaaagcaacgcccccaucauggaugaggagcgcgaaauccccgagcgguccuggaacagcgggcacgagugggugacagacuuuaagggcaagaccgucugguucguccccuccaucaaggcggggaacgacaucgcggcaugcuugagaaaaaauggcaagaaggugauacagcucucccguaagacguucgacuccgaauacguuaagacccgggccaacgauugggacuucgucgugaccaccgacauuucugagaugggugccaacuucaaggccgagcgggugaucgacccacgccguugcaugaaacccgucauccugacggacggcgaggagcgggugauacuggcgggccccaugcccguuacccacuccucggccgcccagcggcgugggaggaucgggcggaacccgaaaaacgaaaaugaccaauauaucuacaugggggagccucucgaaaacgacgaggacugcgcccacuggaaggaggccaagaugcugcuggacaauauuaacacccccgaggggaucauaccuuccauguucgagccggagcgagagaaagucgacgcgaucgacggcgaguaccgacuucgcggggaggcccgcaaaaccuucguggaucuaaugcgccgcggcgaucuccccgugugguuggccuacaaggucgccgccgaagggaucaacuacgcggaccgcaaauggugcuucgacggcauaaagaacaaccagauccuugaggaaaauauggagguggagaucuggacgaaggagggggagcgaaagaagcugaagccccgcuggcucgacgcucggauuuacagcgacccguuagcccugaaagaguucaaggaguuugccgcgggccgcaaaucuuuaacccugaaccuaaucaccgagaugggacggcuuccaaccuucaugacgcaaaaggcccgcaacgcucuggacaaucuggcagugcuccacaccgccgaggcugggggcagagccuacaaccaugcgcugagcgagcugcccgagacgcucgagacccugcugcuccugacgcuccucgccaccgucaccgggggcauuuuccuguucuuaaugucaggcaaggggaucggcaagaugacccucggaaugugcugcaucaucaccgcgagcauccugcucugguacgcccagauccagccucacuggauagccgcguccaucauucuugaguucuucuugaucguguugcucauuccggagcccgagaagcagcgcacgccccaggauaaccagcugacguacgucgugaucgcuaucuuaaccguggucgccgcgaccauggccaacgagaugggcuuccuugagaaaacgaagaaggaccuggggcugggcagcaucaccacccaagagucggagucaaacauccucgacauugaucugcggcccgccagcgcguggacccuguaugcaguggcgacgaccuucguaaccccgaugcuccgccacuccaucgagaacucuuccguuaaugugagccugacugccaucgccaaccaggccaccgugcugaugggcuugggaaaggguuggccucuguccaagauggacaucggggucccccugcucgcgaucggcugcuacucgcaggugaacccaauaacccugaccgccgcccugcuccugcugguagcccauuacgccaucaucgggccgggcuugcaggcgaaggcaacccgggaggcccagaagcgcgccgcugcgggcaucaugaagaaccccacggucgaugggaucaccgugaucgaucuggagcccauccccuacgacccaaaguucgaaaagcagcugggccaggucaugcuccucauccugugcgucacccaagugcuuaugaugcggaccacgugggccuuaugcgaggccuugacccucgcgaccgggccuauauccacccuuugggagggcaacccaggacguuucuggaacacgaccaucgccguguccauggcgaacaucuuuagaggcuccuaccuggccggcgccgggcuccuauucagcaucaugaagaacaccaccaacacgcggcgcggcacagggaauauuggcgagacccugggcgagaaguggaagucccggcucaacgcccugggcaagucagaauuccagaucuauaagaaguccggcauccaggaggucgaccgcacccuggcgaaggaggggauaaagagaggcgagacugaccaccacgccguuucacgcgggagcgccaaacuccggugguucguggagcgcaacauggucacccccgagggcaaggugguagaccugggcugcgggagaggcgguuggagcuauuacugcggagggcugaagaauguccgagagguuaagggccucaccaaggguggcccuggccacgaggagcccauccccauguccaccuacggguggaaucuggugcggcugcagagcggcauugaugucuucuuuacgccccccgagaagugcgauacacuccugugcgacauuggggagagcuccccgaaccccaccaucgaggccggccgcacccuccgggugcucaaucugguggagaacuggcugaacaacaacacccaauucugcaucaagguccucaaccccuacaugccgagcgugaucgagaagauggaggcccugcagcgcaaguacgggggggcgcuggugcgcaaucccuugaguaggaacagcacucacgaaauguacugggucuccaaugccacaggcaacaucguuagcuccgugaacaugauuucacggauguuaauaaaucgcuucaccaugaagcacaaaaaggccaccuacgagcccgaugucgaccuggggucgggcacgagaaacaucgggaucgagucugagaucccgaaccuggacaucaucggcaagcgcaucgagaagauuaagcaggagcaugagaccuccuggcacuacgaccaggaccaccccuauaagaccugggccuaccacggcagcuacgagaccaagcagacgggguccgccagcucaauggugaacggcgugguccgacuccugaccaagccgugggacguggugcccauggucacccagauggcgaugaccgacacgaccccguuugggcagcagcggguguucaaggagaagguggacacgcgcacccaggaaccuaaagagggcacgaagaaguugaugaaaaucacagccgaguggcucuggaaggagcugggcaagaaaaagacccccaggaugugcacccgcgaggaguucacgcggaagguccgcagcaaugccgcccugggggccaucuucaccgaugagaacaaguggaaguccgcucgggaggccguggaggacggccgcuucugggagcucguagacagagaacggaaccugcaucuggaagggaagugcgagaccugcgucuacaacaugaugggcaagcgcgagaagaagcucggugaauucggcaaagcaaagggaagucgcgcaaucugguauauguggcugggagcgcgguuucuggaauuugaggcccucggcuuccugaacgaggaccacugguucucccgcggcaacagccugagcggcguggagggggagggccuccaucgacucggauauauccugcgcgacgucgggaagaaggagggcggggccauguaugccgacgacaccgccggcugggacacgcggauaacccucgaagaccugaagaacgaggagaugguuaccaaccacaugaagggggagcacaagaagcuggcggaggccaucuuuaagcucacauaccagaauaaagugguccgcguccagcggcccacgccgcgcggaaccguuauggacaucaucucccggcgcgaccagcgugguagcgggcaggucggcacauacgggcugaacacauucacuaacauggaggcccaacuaauccggcagauggagggcgagggcaucuucaaguccauacaacacuuaaccgccaccgaagagaucgccgugcagaacuggcuugcgcgcguggggcgggagcgccugagccggauggccauuuccggcgacgauugcguggucaagcccaucgacgaucgcuucgccucggcccucaccgcccucaacgacauggguaaggugcggaaggacauccagcagugggagcccucccgcggguggaaugacuggacgcagguccccuucugcagccaccacuuccaugaacuggugaugaaggacgggcgggugcucgucgugcccugccgcaaccaggacgagcugaucggccgggcccgcaucucgcagggcgccggcuggagccugaaggaaacggccugccucgggaaguccuacgcccagauguggacacugauguacuuccaucggcgcgaucugcggcucgccgcgaacgcgaucugcucagccgugcccucucacugggucccaacuagucgaacaacaugguccauccacgccaaacacgaguggaugaccacugaggacaugcuagcuguguggaaccgcguguggauacaggagaaccccuggauggaggauaagaccccaguugaguccugggaggaggugcccuaccuggggaagcgcgaggaucaauggugcggaucgaugaucggguugacaucacgggccaccugggccaagaauauucaaacggcgaucaaccaaguucgcucccugaucgggaacgaggaguacacugacuacaugcccuccaugaagcgguuccggcgcgaggaggaagaggccggcguccucugguag

SEQ ID NO: 25091 - RNA, 9876 nt, Artificial Sequence
  derived and/or modified CDS sequence (opt11) from DENV-2__EU482691__SS-prME
accgccggcgucaucgucaugcugauaccgacggccauggcguuccaccuaaccacucgcaacggagagccacacaugauagucggucggcaagagaaggggaaaucccugcuguucaagacagaggacggggugaacaugugcacccucauggccaucgaccugggggagcugugcgaggacaccaucaccuauaagugcccccuccugcgccaaaacgagcccgaggacauagacugcuggugcaacagcaccagcaccugggucacauacgggaccuguaccaccacgggcgagcaccggcgcgagaagcgguccguggcuuugguaccccauguaggaaugggccuggagacccgcaccgagaccuggaugagcagcgagggugcauggaagcacgugcagcggaucgagacguggauccugcgccaccccggcuucacaaucauggccgcgauccuugccuacaccaucgggaccacgcacuuccagcgugcccucauuuuuauccugcugacugccguggcuccaagcaugacgaugcgcugcaucggaauuagcaaccgggacuucgucgagggcguuucagguggcagcuggguggacauaguccucgagcacgggagcugugugacaacgauggccaaaaacaagccaacccuggacuucgagcugaucaaaaccgaagcaaaacagcccgcaacgcuccgcaaauacugcaucgaagccaagcugacgaacaccaccacggagucccggugcccgacgcagggagagcccagccugaacgaggaacaggacaagcgcuucaucuguaagcacuccauggucgaccgaggcugggggaacggcuguggcuuauucggcaagggcggaauagugaccugcgcgauguucacaugcaagaagaacauggagggcaagguugugcagcccgagaaucuggaguauacgauugucauaacgccccauagcggggaggagcacgcagugggcaaugacacaggcaagcacggcaaggagauuaagaucaccccgcagucaagcaucaccgaggccgagcugaccggguacggcacggugacaauggaaugcagcccccgcaccggcuuagacuucaacgagaugguccugcuucagauggaggacaaagcguggcucguccaccgccaaugguuccuggaccugccucucccauggcugccgggggccgacacccagggcagcaacuggauccagaaggagacgcuggugaccuucaagaacccccacgcgaagaagcaggacguaguuguacucggcucccaggagggcgcgaugcacaccgcccugaccggggcaacugagauccaaaugagcuccggcaaccucuuguucaccggccaccugaagugccgucugcggauggauaagcuucagcugaaggggauguccuacagcaugugcaccggcaaauuuaagaucgugaaggaaaucgccgagacccagcacggaacgauagugaucaggguccaauacgagggugacggauccccuugcaagauccccuucgagaucaccgacuuagagaagcggcaugugcucgggaggcuuaucaccgugaacccgaucgucaccgaaaaagacucucccguaaacaucgaggcggagccccccuucggcgacucauacaucaucauagggguugagccuggccaguuaaagcucaacugguucaaaaaggggucauccaucggucagauguucgaaacgacuaugcgcggcgccaagcggauggccauccugggggauaccgccugggacuucggcucacucggggguguguucaccaguaucgguaaggcccuucaccagguguuuggugcgauauacggcgcggccuuuagugggguguccuggacgaugaagauacugaucggcgucaucaucaccuggaucgggaugaauagcagauccaccagccuguccguuagcuuagugcucguaggcguggugaccuuguaccugggggccgucguucaggcggacuccggcugcguggucagcuggaagaacaaagagcucaagugcggcuccggaauuuucaucacggacaacgugcacaccuggacggagcaauacaaguuccaacccgagucacccucuaagcuugccuccgccauccagaaagcccacgaggagggcauaugcgguauccgaucagugacccgacuagagaaccucauguggaagcagaucacgccugagcugaaccacauacuguccgagaacgaggucaagcucaccaucaugaccggcgacaucaaggggaucaugcaagccggcaagcggagccugcgcccacaacccaccgaacugaaguacucauggaagacguggggcaaagcgaagaugcuaagcaccgagucucacaaucagaccuuccugaucgacgggcccgagaccgccgagugcccgaacaucaaucgggccuggaacagccuagagguggaggacuauggcuucgggguguucacgaccaacaucugguugaagcugcgcgagaagcaggacgucuucugugacuccaaacugaugagugcggccaucaaggacaaccgggcaguucacgccgauaugggcuacuggauugaguccgcacugaacgacaccuggaagauggagaaggccagcuuuauagaggucaaaagcugccacuggccuaaaucacacacgcugugguccaaugggguccuggaaucagagaugaucaucccaaagaacuucgccgggccggucucccaacacaacuaccgcccgggcuaccacacgcagaccgcugguccguggcacuuaggcaagcuggagauggacuucgauuucugcgaggggaccaccgugguugugacagaggauugcgguaaccgggggcccagcuugcgcacgaccaccgccucugguaagcucaucaccgaguggugcugcagguccugcacuuugcccccgcugcgcuaccguggugaggaugggugcugguacggaauggagauucgaccuuugaaggagaaggaggagaaccuggugaacagccuggucaccgccgggcacggccaaauagacaacuucucccucggggugcuggggauggcccuguuucucgaggagauguugcggacucgcaucggcacuaagcacgcgauccugcucguggccgucuccuucgugacccugaucacugggaacauguccuuccgggaucugggccgaguuauggucauggugggggccacuaugacugacgacauagggaugggcgugacguaccucgcccugcuggccgcguuuaagguccgcccaacuuucgcggccgggcuauuauugcggaagcuuaccagcaaggaacugaugauggcuaccaucggaaucgcccugcucucgcagucgacgauucccgagaccauccucgagcugaccgaugcgcucgcccuggggaugauggugcugaagaucguccgaaacauggagaaguaccagcucgccguuacaaucauggcaaucuccugcgugccgaacgcagugauccugcagaacgcguggaaggugagcugcacgauccuggccgcgguguccguaagcccccuccuguuaaccucgagccagcaaaaggccgacuggauuccccucgcgcucaccaucaagggccugaaccccaccgccaucuuucucacuacccugucccggaccucaaagaaacgcagcuggccucugaacgaggccaucauggccgugggcauggugucuauacucgcaucuucucugcugaagaacgauauacccaugaccggcccccucgucgcgggcgggcuucucacgguaugcuacguacucacaggucggagcgcggaucuggagcuggagcgcgccgcagacgugcggugggaggaccaggcggagaucuccgggucgucccccauccucagcaucaccauuuccgaagacggcagcauguccaucaagaacgaggaggaggagcagacccugacgauacugauccgcaccgggcuccuggugaucagcgguguguucccggucuccauccccaucaccgcggcugccugguaccugugggaggugaaaaagcagcgcgccggggugcucugggacguccccagcccgccuccaguggagaaggccgagcuggaggauggggcguaccgcaucaagcagcgcggcauccuaggguacucccagauuggcgcuggcguguacaaggaagggaccuuccacaccauguggcacgucacgcggggugcuguccucaugcaccgggggaagcgcaucgagccaagcugggcugacguaaagaaggacuugauaaguuacggcggaggcuggaagcuggaaggugaguggaaagagggagaggagguccaagugcucgcgcuggaacccggcaagaacccucgggcggugcagaccaagccagggauuuuuaagaccaacaccggaaccaucggggccgucagccuggacuuuagucccgggaccagcggaucccccaucguggacaggaaagggaagguggucggccucuacgggaacggcguugugacccgguccggugcguaugucuccgcaaucgcgcaaaccgagaaauccaucgaggauaaccccgagauugaggacgacaucuucagaaagaagcggcugacgaucauggaccugcaccccggggccggaaagacgaaacgcuaccucccugcuauuguacgugaggccauaaagcgcgggcugcgcaccuuaauccuggccccuacccgcguggucgcagcggagauggaggaagcucuucgcggccugcccauucgauaccagacgcccgccauaaagaccgagcacacagggcgcgagaucguagacuugaugugccacgccaccuucacuaugcggcuccugucucccgugcgagucccgaacuacaaccugauaaucauggacgaagcucauuucaccgaccccgcguccaucgccgcccguggcuacauuaguacccgcguggaaaugggcgaggccgcggguaucuucaugaccgcuacuccgcccggaucccgggacccuuucccucagucgaacgcaccgauuauggacgaggagcgcgaaauccccgagcgguccuggaacucagggcacgagugggugaccgauuucaagggcaagaccgucugguucgugccguccauaaaggcggguaacgacaucgcugccugcuuacgcaagaacggcaagaaggugauacaacugagccggaagaccuucgacuccgaauauguaaaaacgcgcgccaacgacugggacuucgugguaaccaccgauaucagcgagaugggagccaacuucaaagccgaacggguuaucgacccccgccgcugcaugaagcccgugauccugacggacggggaggagcgaguaauccucgcgggcccgaugccggucacgcacuccucggcagcccagcggcgcggucggauuggccggaaccccaagaaugagaacgaucaguacaucuauaugggggagccccuggaaaacgaugaggacugcgcccacuggaaggaggcaaagaugcugcucgacaauaucaacacccccgagggcaucaucccgaguauguucgagcccgagcgcgagaagguggaugcgaucgacggcgaguaccggcugcgcggagaagcacgcaagaccuuuguugaccugaugcgccggggcgaucugcccgucuggcuggccuacaagguggccgccgaagggaucaacuauaccgaucgcaaguggugcuucgacgguaucaagaauaaccagauccuggaggagaacauggaaguggaaaucuggacgaaggagggggagcggaagaagcuuaaaccccgcugguuggacgcucggaucuacagcgauccccuugcauugaaagaguuuaaagaguucgccgccggccgcaagucucugacccuaaacuuaauuaccgagaugggccgacuucccacguucaugacgcagaaagcgcgcaaugcccuggacaaccucgcuguucugcacaccgccgaggccgggggccgcgcguacaaccacgccuuaagcgagcuccccgagacccuggagaccuugcuguuacugacgcuacuggccaccgugacggggggcauuuuccuguuccuuauguccgguaaggggaucggcaagaugacucuagggauguguugcaucaucaccgcaagcauccuccucugguacgcucagauccagccgcacuggauagcagcgucaauuauccuggaauucuuucugaucguccugcugaucccagagcccgagaaacagcgcacgccccaggacaaccagcugaccuacguugugaucgccauccucaccgucguggccgccacgauggccaacgagaugggcuuccuggagaagacgaagaaagacuuaggguuagguagcaucaccacgcaagagucugaguccaacauccuggacaucgaccuccggccggccagcgccuggacccucuacgccguggcuacuacuuucguuacccccaugcugcgccacagcaucgagaacagcuccgugaacgucagucucacugcgaucgcaaaccaggccacgguccucaugggccuggggaagggcuggccccuguccaaaauggacaucggggugccccuccuggccaucggaugcuacagccaggugaacccgauuacacuaaccgcggcccuccuacugcucguagcacacuaugcgaucaucggacccggccugcaggccaaggcgacucgggaagcccagaaacgcgccgcugccggcaucaugaagaaccccacgguggaugggaucaccguuaucgacuuggagcccauaccguacgacccaaaauuugagaagcagcuuggccaggugaugcugcugauccucugcgugacccaggugcuuaugaugcggaccacgugggcccugugcgaggcccucacccuugccaccgggcccaucuccacauuaugggagggcaacccugggcgcuucuggaauacgaccauagcagucaguauggcaaacaucuuucgcgguuccuaccucgcgggcgccggguugcuguucagcauaaugaagaacacuaccuccacacggcgcggcaccgguaacauaggcgaaaccuuaggugagaaguggaagucgcggcugaaugcccuggggaagagugaauuccaaaucuauaagaaguccggcauccaggagguggaucgcacccucgccaaggaggggaucaagcgcggggagacggaucaccacgcgguaagcaggggcagcgccaaguugcggugguucguggagcgcaauauggucaccccggagggcaaaguggucgaucugggaugcgggaggggugggugguccuacuacugcggagggcuaaagaaugugcgcgaggugaagggccugaccaagggcggccccggccacgaggagccaauucccauguccaccuacggguggaaccugguacgucuccagagcggcguggacguauucuucacgccgcccgaaaagugcgacaccuuacugugcgacauuggggagaguagccccaaucccaccaucgaggccggcagaacccucaggguccuuaaccuggucgagaauuggcucaacaauaacacucaauucugcguuaaggucuuaaauccguauaugcccuccgugaucgagaaaauggaggcccuccaacgccaguacggcggggcccucgugcggaacccccugagccgcaacuccacgcaugaaauguacuggguuagcaacgcuacaggcaacaucguguccagcgucaacaugaucucgcggauguugaucaaucgcuuuacuaugaagcacaagaaggccacauacgagccggacguagaucuggguagcggcacacggaauaucgggaucgaguccgagaucccaaaucuggacaucauaggcaagcgcaucgagaagaucaagcaggagcacgagaucagcuggcacuacgaccaagaccacccuuacaagaccugggcuuaccacggcuccuacgaaaccaagcagaccggguccgccaguagcauggugaacgggguagugcgccugcugacaaaacccugggacguggugccgauggucacccaaauggccaugaccgacaccacccccuucgggcagcagcggguguucaaggagaagguggauacucguacccaggagccuaaggagggcaccaagaaacuuaugaagauaacggcggaguggcuuuggaaagaacugggaaagaaaaagacgccccgcaugugcacccgcgaagaguucacccggaaggucagguccaacgccgcccucggggcgaucuucacggacgagaacaaguggaaguccgcccgggaggcgguugaggacggccgcuucugggagcuggucgaccgggagcguaaccugcacuuagaagggaagugcgagacgugcguauacaacaugauggguaagagagagaaaaagcugggggaguucgggaaagccaaggguucccgcgcuaucugguacauguggcugggggcccguuuccuggaguucgaggcgcugggcuucuugaacgaggaccacugguuuagccgagggaauucccucuccggaguagagggggagggccuccacagauuaggcuacauccuccgcgacgucgggaagaaggagggcggagccauguacgccgacgacaccgcuggcugggacacccgaauaacgcucgaagaccugaagaacgaggaaauggugaccaaccacaugaagggggagcacaagaagcuggcggaggcaaucuucaagcugaccuaccagaacaagguggucagagugcagcgaccgacgccccgcggcacggugauggacaucaucagccggcgcgaccaacgcggauccggucaggucggcaccuaugggcugaacaccuuuaccaacauggaggcccagcuaauccggcagauggagggcgagggcaucuucaaaagcauccagcaucugacggccacugaggagaucgcagugcagaacugguuggcccggguggggcgggagcgccucucccgcauggcaaucucuggugacgacugcguaguuaagcccaucgacgaccgcuucgccagugcccuaaccgcccugaacgacauggggaagguacggaaggauauccagcaaugggagccaucuaggggcuggaaugacuggacacaagucccguucugcucccaccacuuccacgagcucgucaugaaggauggacggguccucgucgugcccugccgcaaccaagaugagcuaaucggccgagcgcgcaucagccagggcgcgggguggucccuaaaagagacggccugucugggcaagagcuaugcacagauguggacccugauguacuuccacagacgcgacuugagacuggcugccaacgcgaucugcuccgccgugcccucucacugggucccaaccuccagaacgaccuggagcauccacgccaagcaugaguggaugacaaccgaagacaugcuggccguguggaaccggguguggauccaggaaaacccuuggauggaggacaagacccccguugaaucaugggaggagguccccuaccucgggaaacgcgaggaccagugguguggcagccuaauugggcugaccagucgcgccaccugggccaagaacauucagacagccauaaaccaggugcgcucgcugaucggcaacgaggaauacaccgacuacaugcccuccaugaaacgauuccggcgcgaggaggaagaggccgguguccuaugguga

SEQ ID NO: 25092 - RNA, 9876 nt, Artificial Sequence
  derived and/or modified CDS sequence (opt11) from DENV-2__EU482693__SS-prME
accgcaggagucauugugauguuaauaccaacggcgauggcauuccaucucacaacccguaacggugaaccacacaugaucgugggucgacaagaaaaagggaaaucuuugcucuuuaaaacggaagauggagucaacaugugcacacugauggcgaucgaccugggagaacugugcgaagauacaaucaccuacaaaugcccacuuuuacggcagaaugaaccugaagauauagacugcuggugcaacucgaccagcacgugggugacguacggaacuuguaccacgacaggugaacaccggcgugagaaacgauccguggcgcuugucccacacgucggcaugggucuggaaaccagaacagaaacguggaugagcucggaaggagcauggaaacaugugcagaggauagaaacguggauccuacgccauccaggcuucaccaucauggcagcaauacuagccuauacaaucgguacgacccacuuucagcgggcgcucauauuuauacugcugaccgcgguugccccaaguaugacaaugcgcuguaucggaauaagcaacagagacuuuguagaaggggucagcggaggcaguuggguugacauugugcuugaacacggguccuguguaaccacuauggccaaaaacaagccgacacuagacuucgaacugauaaagacagaagccaagcaaccagcgacacuuagaaaguauuguauagaagcuaaacuuaccaacaccacgaccgagucacgcugcccaacacaaggcgaacccucgcuuaacgaagaacaggacaagcgcuucauauguaagcacaguaugguagaccggggcuggggaaacggaugcggccuuuucggaaaaggagggauagucacgugcgcgauguucacuugcaagaaaaacauggaaggaaaagucguucagccagaaaacuuagaguauacaauuguaaucacgccacacucgggagaggaacaugcggucgggaacgacacaggaaaacacggcaaagagauaaaaauaacgccacagagcagcaucacggaagcggaacucacuggcuacgguacaguuaccauggaauguagcccuaggaccggacuagacuucaacgaaauggugcuauuacagauggaagauaaggccuggcucguacaccggcagugguuucuagacuuaccauuaccauggcuaccuggggccgacacgcagggcuccaacuggauccagaaggaaacccuaguaaccuucaagaauccacaugccaagaaacaggacguagucguacuggguucgcaagaaggugcgaugcacacagcacuaacgggugcgaccgaaauccaaauguccucuggaaaucuauuauucaccggacaccuaaaaugcagacugcgaauggacaagcuccagcuaaaagggaugaguuauuccaugugcaccggaaaguucaagauugucaaggaaaucgcggaaacacagcacggaacgauagucauccgggugcaauacgagggagacgguucgcccugcaagauaccguucgagauaacggaccuagaaaaacgacaugucuuaggaaggcuaauuacaguaaacccgauaguuaccgaaaaagacucgccaguuaauaucgaagcagagccacccuuuggagacagcuacaucauaauugggguggaaccggggcaacucaaacucaacugguucaagaaaggcagcucaaucggucagauguucgaaacgacaaugcggggagccaaaagaauggcaauacucggggacacugcgugggacuucgguagucuaggcgggguauuuacuagcauaggaaaggcacuacaccagguauucggagcaauauauggcgcagcuuucucaggagucagcuggacgaugaagauacucaucgguguaaucauaaccuggauaggaaugaacucacgcucgacgucucucucggugagucuaguccuugucggagugguuacccuauaccuaggcgccguagugcaagcagacagcggcugugucguaagcuggaagaacaaagaguugaaaugugggaguggaauuuuuaucaccgauaaugugcacacauggacagaacaauacaaauuccaaccagagaguccgucaaagcucgcguccgcgauucaaaaggcacacgaggaaggcauaugcggaauccgcagcguaacaagauuggaaaaccuaauguggaaacaaauaacccccgaacuaaaccacauccuauccgaaaaugaaguaaaacuuacaauaaugaccggagacaucaaagguaucaugcaggcggguaaaagaucgcuaaggccacaaccgaccgaacuuaaguacaguuggaagaccuggggaaaagcgaaaaugcuaucgacagaaagccacaaucagaccuuccugauagacggccccgagacggccgagugcccaaauacuaaccgcgcauggaacucacuggaaguagaagauuacggcuuuggaguguucacgacaaacauauggcugaaacuacgggaaaagcaagacguauucugcgacuccaagcuaaugagugcggcgauaaaagauaaccgcgccgugcacgccgacaugggauacuggaucgaaucagcucugaacgauaccuggaagauggagaaagcaucauuuauagagguuaagucaugccacuggccaaagucccacacucugugguccaacgggguauuagaaagugagaugaucauacccaaaaauuucgcaggucccgugucucaacauaauuaucgaccaggcuaucauacucaaaccgcgggacccuggcacuugggaaagcuggagauggauuucgaccucugcgaaggcaccacagucgucguaacagaggacugugggaauaggggccccagcuuacggacaacgacagcgagcgggaaacuaauuacugagugguguugucguagcuguacacugcccccgcugagguaccguggcgaagacgggugcugguacgggauggagauccgaccgcuaaaggagaaagaggaaaaucuggugaacaguuugguaaccgcaggucauggccaaauagacaacuuuagcuuagguguccuuggaauggcccuauuccuagaagaaaugcuacgcacgaggaucggcaccaaacacgcgacccuacucgucgccguaucauuuguaacacugauuacggggaacaugagcuuccgagacuuaggccggguaauggugauggucggggccaccaugaccgacgacauaggcaugggcguaacauaccuagcguugcucgcggcauucaaagugcggcccacauucgcagcagggcuccugcuaaggaagcucacaaguaaagaauuaaugauggccacgaucggaauagcguuacuaagccaaagcacaauaccagaaaccaucuuagaauuaaccgacgcuuuagcacuaggcaugaugguccuuaagaucguccgcaacauggagaaguaccaacucgcgguuacaauaauggcaaucagcugugugccgaacgccguaauccugcaaaacgcauggaaagucucaugcacaauacuagcagcaguguccgugaguccauuacugcugacgucgucccagcagaaagcagacuggauaccccuagcccugacaauaaaaggccucaauccgaccgcuauauuccuaacuacgcucagccggacgagcaagaaacggagcuggccgcugaacgaagccaucauggccgugggaauggucuccauccuagcaagcagcuuacuaaagaaugauauaccgaugacaggaccacuuguagcgggcggccuacucacgguaugcuacguacuaacaggaagaagcgccgaccuggaauuagaacgagcagcagauguuaaaugggaagaucaggccgaaauaagcgguucauccccaauacuaagcauuacgauaucagaagacggcuccauguccaucaaaaacgaggaagaagaacagacgcuaaccauacuaauccgaaccggacuacucguaauaagcgggguauucccagucagcauaccaauaaccgcugccgcgugguaccucugggagguaaagaaacaacgggccgggguccugugggacgucccaagcccgccacccguagagaaggcggagcuagaggacggggcauaccggaucaaacaacgggggauuuuaggcuauagccaaauaggggcaggcguauauaaagagggaacguuccacacuauguggcacgugacuagaggggcgguucugaugcacaggggaaagcgcaucgaaccaucaugggccgacgucaagaaagaucucaucucguacggugggggauggaaacucgaaggggaguggaaggaaggcgaagaaguacagguccuugcacuggaaccggggaaaaacccacgggcaguccaaacaaaaccaggaaucuuuaaaacuaauacaggcaccauuggagcuguaagccucgacuuuagcccaggaaccagcgggagcccgauaguagaccgaaaaggaaaagucgugggccucuacggaaacggcgugguaacuaggaguggagcauacguaucugcgauagcccagacagaaaaaucaaucgaagacaacccagagauagaagaugauauauuuaggaagaaacgucugacaauaauggaucuccacccaggagcugggaagacgaagagguaccugccagcaauaguccgagaggccaucaaaagaggccugcggacauuaauacucgcuccuacucgaguaguggcggccgagauggaagaggcacuccgagggcugcccauccgauaccaaacaccagcaaucaaaacggaacacaccgggcgcgaaauuguagaucucaugugccacgccaccuuuacuaugcgacucuuauccccaguacgcguaccgaauuauaaccuuaucaucauggacgaagcgcacuuuacugacccugcgucaauugcggcucgcggguacauaucgacacguguagagaugggggaagcggcgggaauauuuaugacagccaccccacccggaucacgagacccauuuccacaaucaaacgcaccaauaauggacgaagaacgcgaaauuccggagcgguccuggaauaguggacacgagugggucaccgauuucaaagguaaaacgguaugguuuguaccaagcaucaaagccggaaaugacaucgcagccugccucaggaagaacgguaagaaggugauacagcugucucggaagacauucgauagcgaauacgucaagacacgagcgaaugacugggacuucgucguaaccaccgauaucagcgaaaugggcgcgaauuucaaagcggagcgcgugauagacccgaggcgaugcaugaagccaguaauuuuaaccgacggugaagaacgcgugauccucgcaggacccaugcccgugacacacuccucagcggcccagagacgaggccgcauagggaggaacccgaagaacgagaacgaccaauacaucuacaugggagaaccccuugaaaaugacgaagacugcgcccauuggaaagaggccaaaaugcugcuggacaacaucaacacgccagaagggauaauaccaaguauguucgaaccggagcgagaaaagguagacgcuauagacggagaauacagacuacgaggcgaggcgagaaaaacguucguggaccucaugagacguggcgaccuaccgguuuggcuagccuacaaagucgcagcggagggcauuaauuacgcggacagaaagugguguuucgacggaauuaagaacaaccagauccucgaggaaaacauggagguagaaauauggaccaaggagggcgagagaaagaaacucaaaccgagauggcucgacgcacgaauauauucagauccacucgcucucaaagaguucaaggaguucgcagcggguaggaaaucgcucacacugaacuugauaacggagaugggucggcuaccgaccuucaugacccagaaagcccgcaacgcccuagacaaccucgccguccugcacacggcugaggccggaggacgagccuacaaucaugcacugucggagcugcccgaaaccuuagaaacacuacugcuccugacauugcucgcaaccgucacaggaggcauauuccucuuccuaaugagcggcaaaggaaucggcaaaaugacccugggcaugugcuguauaauuaccgcaucuauccuacucugguacgcacaaauacaaccgcauuggauagcugccucaaucauacuagaguucuuucugauuguacuacugauuccggaacccgaaaaacaacgcacaccccaagacaaccaguuaaccuacguugucauagcaauucucaccguuguugccgccaccauggcaaaugagaugggcuuccuagagaaaacgaagaaagaccuagggcuaggauccaucacgacccaagagagcgagagcaacauacuagacauagacuuacgccccgcgucagccuggacgcuauacgcggucgccacgacauucguuaccccaaugcugcgccacaguauagagaacucauccgugaacgugagccuaacggccaucgcgaaccaggcgaccguuuugaugggccuaggcaagggauggccgcuauccaagauggacauaggcgucccacugcuugcgauugggugcuauagccaggucaacccgaucacccucaccgccgcccuacuccucuuagucgcgcacuacgcaaucaucggucccggcuuacaagcgaaagcuacccgcgaggcccagaagcgagccgcagcgggaauaaugaaaaaucccacaguggacggcaucacggucauagaccuagagccuauacccuacgaccccaaguucgaaaagcagcucgggcaagucaugcuguugauccuuugcgucacccaaguuuugaugaugcgaaccacgugggcccucugugaagcguugacucuagcgaccggcccgaucagcacacucugggaaggcaauccaggccgcuuuuggaacacaacaauagcgguaagcauggccaacauuuuccgcggaucguauuuagcgggcgcuggccuccucuucucgauaaugaagaacaccacuuccacacgacgggguacaggcaacauuggcgaaaccuuaggagaaaaauggaagucaaggcucaacgcacucggaaaaucagaauuucaaauauauaagaaaagcgguauccaagaaguggaccggacacuggcgaaagaaggcauaaaacgcggugagacugaccaccacgcugucucaagagguuccgcaaagcugcgcugguucgucgagaggaacauggugaccccagagggcaaaguuguggacuuaggcuguggaagggguggcuggaguuauuacugcggcggcuugaagaacgugcgcgaaguaaaagggcuaaccaagggcggccccggacacgaggagccgauccccaugucaacauacggcuggaaccuuguaagacuucagucaggcguagacguauucuucaccccgccggaaaaaugcgauacacuccuuugcgacauuggcgagagcuccccgaacccaacgaucgaagccggacggacauuaaggguauuaaaccuugucgagaacuggcucaauaacaacacacaguucugcauaaaaguccugaauccguacaugccuucugucauagagaaaauggaggcacuccaaaggaaguacggaggggcacucgucagaaacccccugagcagaaacucgacacacgaaauguacuggguaagcaacgcgaccggcaauaucgucagcucggugaacaugauuucacggauguugaucaacagauucacgaugaaacacaagaaagccacauaugaaccggacguagaccuagguagcggaacucgcaacauagggaucgagagcgagaucccaaaccuggacauaauaggaaaacgaauagagaaaaucaagcaggaacaugaaacuucguggcacuacgaccaagaccacccuuauaagacaugggcauaccacggaucauacgagaccaaacaaaccggaucagcauccucgauggugaaugggguaguacgcuuacugaccaaacccugggacgucgucccaaugguaacccagauggccaugaccgacacuaccccguucggacagcagaggguauucaaagaaaagguggacacacgcacacaggaaccaaaagagggcaccaagaaauugaugaaaaucacagcagaauggcuauggaaagaacucggcaagaagaagacaccacgcauguguacaagggaggaguucacgcggaagguacguuccaacgcagcucugggcgcgauauucacagaugaaaacaaauggaaaucggcaagggaagcgguugaagacggccgcuucugggaacuuguggaccgcgagcgcaaucuucaccuagaaggcaagugcgaaacaugcgucuauaacaugaugggaaagagagagaaaaaguuaggagaguucgggaaggcaaaaggaucacgcgcuauaugguauauguggcucggggccagguuccucgaguuugaagcgcucgguuuucucaacgaagaccacugguucagcaggggcaacagccuaucagggguggaaggagaagggcuacaccgacugggguauauauugcgcgacgugagcaagaaagaagguggcgccauguacgccgacgauaccgccggcugggacacccgaaucacacuagaagaccucaagaacgaagagauggucacgaaccacaugaagggggagcacaagaaacucgccgaggccauauucaaacuuaccuaccagaacaagguuguaagaguacagcgaccaacuccacggggaacggugauggacauaauaucccgacgcgaccagagggguucaggacaagucggaaccuacggacucaauacuuucacaaauauggaagcacagcugaucagacaaauggagggcgagggaauauucaaaucaauacagcaccugacagcagcggaagaaaaugucguccaaaacuggcuagcgagaguaggccgagagcgacucagcagaauggcgaucagcggggaugacugcguagucaagccaaucgaugaucgauucgccuccgcccugacugcccugaacgacauggggaaaguucguaaggauauccaacaaugggaacccucacgggguuggaacgacuggacacaaguuccguuuugcagccaucacuuccacgaauuagugaugaaagacggacgaguucucgucgugcccugcagaaaccaggacgaacucaucgggcgagcccgaaucucacaaggcgcaggauggucacuaaaggaaaccgcaugccucggcaaauccuacgcacaaauguggacgcucauguacuuccaccgacgagacuuacgacucgcggcgaaugcaauauguucggcaguccccagucauugggugccgaccagccgcacaacguggucaauacaugcuaaacacgaguggaugacgacagaagacaugcucgccgucuggaacagaguuuggauccaagagaacccuuggauggaagacaagaccccaguugagaguugggaagaagugccauaucuagguaagagagaagaccaauggugcgguagccucauaggucuaaccucaagagcaacuugggccaagaauauacagacagcgaucaaccagguccggagucuaauagguaacgaggaguacacggauuacaugccgucaaugaagcgauuccgcagggaggaagaagaagcaggaguacuaugguag

SEQ ID NO: 25093 - RNA, 9876 nt, Artificial Sequence
  derived and/or modified CDS sequence (opt11) from DENV-2__EU596483__SS-prME
accgccggugugaucgucaugcugaucccgaccgccauggcguuucaccucaccacccgcaacggggaaccgcauaugaucgugggucggcaggaaaagggcaagagccugcuguucaagacggaggacggggugaacaugugcacccucauggccauagaccuuggggagcugugcgaggacaccaucaccuacaagugcccccuccugcgccagaaugaacccgaggacaucgacuguugguguaauagcaccagcaccugggucaccuacgggaccugcaccaccacgggcgagcaccgacgagagaagcgguccguggcacuggugccgcacgucgggaugggccucgagacgaggaccgagaccuggaugagcagcgagggggccuggaagcacguacagcggaucgagacguggauccuccgccauccgggcuucaccaucauggccgcgauccuggcuuacaccauagggaccacgcacuuccagcgggcccucauuuucauccuguuaaccgccguggcgcccucgaugaccaugcgaugcaucggcauaagcaaccgugacuucguugagggcgucagcgggggcucauggguggacaucguccucgagcaugggagcugugugaccacaauggccaagaacaagcccacccuggacuuugagcugaucaagaccgaggcaaaacagcccgccacccuccggaaguauugcaucgaggccaaacucacgaacaccaccaccgagucccggugcccgacgcagggggagcccucccugaacgaggagcaagacaagcgcuucaucugcaagcacuccaugguggaccguggcugggggaauggcugcgggcuguucgggaaggguggcauagugaccugugcgauguucacgugcaagaagaacauggagggcaaagugguucagcccgaaaacuuggaguacacaauugucaucacaccccauuccggggaggagcacgccguugggaacgacaccgguaagcaugggaaggagaucaagaucaccccgcaguccaguauaaccgaggccgagcugaccggguacggcacggugaccauggaguguagcccccggaccggccuagacuuuaacgagaugguccuucugcagauggaagacaaggccuggcucgugcaccggcagugguuucuggaccugccccuccccuggcugccuggggcagacacccagggcucuaacuggauccagaaagaaacgcuaguuacauucaagaacccccacgcgaagaagcaggacguugucgugcucgggucacaggaaggcgccaugcacaccgcccugacaggugccacggaaauucagaugagcucgggcaacuuacuguucacuggccaccucaaaugccggcugcggauggacaagcuccaacugaaggggauguccuacagcaugugcaccgggaaguucaagaucguaaaggaaaucgccgaaacucagcacgggacgauugugauccgaguccaguacgagggcgauggcuccccaugcaaaauacccuucgagaucacugaccuggagaagcggcacgugcucgggagacugaucacagugaaccccauuguuacugagaaggauucgcccgugaacauugaagcagagccucccuucggcgacaguuacaucaucaucgggguggagccgggucagcugaaacucaacugguucaagaagggcagcuccaucgggcagauguucgagacaaccaugaggggcgccaaacggauggcuauacugggggacaccgccugggacuucggaucgcucggcggcgucuuuaccucgaucgggaaggcccuccaccagguguucggcgcgauauacggagccgccuucagcggggugagcuggaccaugaaaaucuugaucggggucaucaucacauggaucggcaugaacagcagauccaccagccuaagugugucgcugguucucgucggcgugguaacucuuuaccugggugccguaguucaggcggacagcggcugcguggucagcuggaagaauaaggaacucaagugcggcuccgggaucuucaucacggacaaugugcacaccuggaccgagcaguacaaauuccagccagagucgcccagcaagcuggcauccgcaauccaaaaggcccacgaggaggggaucugcgguauccggagcgucacacgccuggaaaaccuaauguggaaacagauaacccccgagcugaaccacauccucuccgaaaacgaagugaaguuaaccaucaugaccggagacaucaaggggaucaugcaggccggcaagcggagccuuaggccgcagccuaccgagcugaaguacuccuggaagacguggggcaaggcgaagaugcucagcacagagucccauaaccagacguucuugaucgacgggcccgagaccgccgagugcccgaacacgaaccgugccuggaacagccuggagguggaggacuacggcuucgggguguucaccaccaacaucuggcucaagcuacgcgaaaagcaggacguuuucugcgacuccaagcugaugucggccgccauuaaggacaaccgggcggugcaugcagacaugggcuacuggauggaaagugcccucaacgacaccuggaaaauggaaaaggccucguucaucgaagugaaguccugccacuggcccaagagccauacccugugguccaacggcgugcuggagagcgagaugaucaucccgaagaauuucgccggaccuguuucccagcacaacuaccgcccgggcuaccacacacagaccgccgggcccuggcaccucgguaaacuggagauggacuuugacuucugcgagggcacaacuguggucgugacggaggauugcggcaaccggggacccagccugcgcaccaccaccgccagcgggaagcucaucacugaguggugcugccgguccugcacccugccgccgcugcgcuaccgaggugaggacgggugcugguacggcauggagauccgcccccucaaagagaaggaggagaauuuggugaacucucuggucacggccgggcauggccagauugacaacuucucccucggcgugcuggggauggcccuguuucuggaggagaugcugcggacccggaucggcacgaagcacgcuauucuacucguggccgucagcuucguuacccuuaucaccgggaacaugucauuccgagaccugggucgcguuauggucauggugggggccacuaugaccgacgacaucggcaugggcgugaccuauuuggcccugcuggcggcguucaaaguucgccccaccuucgccgccggguuacugcugcggaagcucaccagcaaggagcugaugauggcgacuaucggcaucgcccuccucucccagagcacgauccccgagaccauucucgaacuuacagacgcgcucgcucuggggaugauggugcugaagaucguccgcaacauggagaaguaccagcucgccgucacgaucauggccauuuccugcgugccgaacgccgugaucuuacagaaugcguggaaggucucuugcacaauccuggccgccguguccgucagcccccuccuguuaacauccagccagcaaaaggccgacuggaucccccuugcgcugaccaucaaagggcugaauccgaccgcgauauuccucacaacccugucccggaccagcaaaaagcgguccuggccgcugaacgaggccaucauggccgugggcaugguuagcauuuuagcguccucgcugcugaagaacgacauccccaugacgggaccccucgucgccgguggguuacugaccgugugcuacgugcucaccggccgcagcgcugaccuggaauuagagcgugcugcagacgucaagugggaggaccaggccgagaucagcgggaguuccccaauucucagcauuaccauaucagaggauggcaguauguccaucaagaacgaggaggaggagcagacgcugacaauccugauccggaccggccuccugguaauaagcgguguauucccagucuccauccccauaaccgcggccgccugguaccuaugggaggugaagaagcagcgcgccggcgugcucugggacguccccagcccgccgcccguugagaaggccgagcuggaagacggugcguacaggaucaaacaacgcgggauccugggguacucccagaucggcgcugguguauauaaagaagggaccuuccacacgauguggcacgugacccgaggcgccgugcucaugcaccgcgggaagcggauugagcccagcugggccgaugugaaaaaggaccuaaucucguacggagggggcuggaagcuggagggcgaguggaaggagggggaggagguccaggugcuggcccuggagccgggcaagaacccucgagcggugcagaccaaacccgggaucuucaaaaccaacacgggcacaaucggggccguuagcuuagacuucuccccgggcaccagcgggucccccauuguggaccggaaagggaaaguugucggucucuacggcaauggcguaguaacccgcucaggcgccuacgucuccgccauagcgcaaacggaaaaguccaucgaagacaauccagagaucgaggacgauaucuuccggaagaagcgccuuaccaucauggacuugcacccaggggccggcaagaccaaacgguaccuccccgcuaucguucgagaggccauuaaacgggggcugcguacccucauccuggcaccgacgagaguggucgcggccgagauggaggaagcgcucaggggccugcccauccgcuaucagaccccugccaucaaaacagagcacaccgggcgggagaucguggaccuaaugugucacgcgacguuuaccaugcgccuccuaaguccaguacgggucccaaacuacaacuuaaucauaauggacgaggcgcacuucacugaccccgcuuccaucgccgcacggggcuacaucaguacgcggguggagaugggagaagcggcgggcaucuucaugacagccaccccgcccgguucccgcgacccuuucccgcaguccaacgcccccaucauggacgaggaacgugagauucccgagcgcuccuggaacagugggcacgagugggugaccgauuucaaggguaagaccguaugguuugugccguccaucaaggcagggaacgacaucgcggcgugccuccggaagaacggaaagaagguuauccagcugagucgcaagacguucgacuccgaguacgucaagacccgggccaacgacugggauuucguggugacaacugacaucagcgaaaugggugcuaacuucaaagcggaaagagucauugacccccggaggugcaugaagcccgugauacugacggacggggaggaacggguuauccucgcgggcccaaugcccgucacccacuccagcgccgcccagcgccguggacgcauuggccgcaacccaaagaacgaaaacgaccaguacaucuacaugggggaaccauuggagaaugacgaggacugcgcccacuggaaggaagccaagaugcuacucgacaauaucaacaccccugagggcaucaucccguccauguucgaacccgagcgggagaagguggacgcgaucgacggugaguaccgccugaggggcgaggcccgcaagaccuuuguggacuuaaugcggcgcggggaccucccaguuuggcuggccuacaaaguugccgcugaggggaucaacuacacggacagaaaguggugcuuugacggaaucaaaaacaaccagauacuggaggaaaacauggaaguggagauuuggaccaaggagggggagcgcaagaagcucaagccgcgguggcuggacgcgcgcaucuacagugauccccuggccuugaaagaguuuaaagaguucgcugccgggcggaagucccugacccuaaaucucauuaccgagaugggacgccucccaaccuucaugacccagaaagcgcguaacgcgcuggacaaccucgccgucuugcacaccgccgaggccgguggccgcgcguacaaccacgcccugagcgagcuccccgagacccuagaaacacugcuccugcugacccuccuggcuaccgugaccgggggcaucuuucuguuccucauguccggcaaggggaucgggaagaugaccuuagggaugugcugcauuaucaccgcuagcauccugcucugguaugcucagauucagccacacuggaucgcagccuccaucauccuagaguucuuccugaucgucuuacugauccccgaaccggagaagcaacggacgccacaggacaaccagcugaccuacgugguaauugccauucuaacagucguggccgcgacgauggcgaacgagaugggcuucuuagagaagacaaagaaggaccucggccucggcagcaucaccacucaggagucggaguccaauauccucgacaucgacuugcgcccggccucggccuggacucucuacgccguggcaacgacguuugucacucccaugcugcggcacucuaucgaaaacagcucugugaacgugagucuuacugcgaucgccaaccaggcuaccguccugaugggcuugggaaagggcuggccuuuaaguaagauggacauuggagugccccuucuggccauuggcugcuacagccaggucaacccgaucacccugaccgcggcccugcugcugcucgucgcccacuacgccaucauuggacccggccugcaggccaaggcgacgcgcgaggcucaaaagcgagccgccgcuggcaucaugaaaaaccccaccguggaugguaucaccgucauugaccuggagcccauccccuacgaccccaaauuugagaagcagcuaggccaggucaugcugcucauacuuugcguaacacagguguugaugaugcgcacgaccugggcgcuaugcgaggccuuaacccuggccacagggcccaucuccacguuaugggagggcaaccccgggagguuuuggaacaccaccauagccguaagcauggccaacaucuuccgagguucguaccuugcaggcgccgggcugcuuuucagcauaaugaagaacaccacguccacccgccggggcaccgguaauauaggggagacgcucggugagaaguggaaaagucgccugaaugcacuggggaagucugaguuucagauauacaagaaguccggaauccaggagguggaccguacgcucgccaaggaggggaucaagcgcggcgagaccgaccaccacgcaguguccagggggagcgccaaacugcgcugguucgucgagcggaacauggugaccccggagggcaaggugguugaccugggcugcgggcgcggagggugguccuacuacugcggcgggcucaagaacguacgggaggucaagggccugacgaaaggagggcccggccacgaggagcccaucccaaugucuacguacggguggaaccugguacgucuccagucuggcguugacguauuuuucaccccgcccgagaagugcgacaccuugcugugcgacaucggggaguccucucccaacccgacgaucgaggccggccgcacccuccguguucugaaccugguggagaacuggcuaaacaacaauacgcaauucuguaucaaggugcugaacccguacaugcccucggucaucgagaagauggaggcccuucagcggcaguacggcggggcccucgugagaaacccccugagccggaacaguacccaugagauguacuggguguccaacgcgaccggcaauaucgucucuuccgucaauaugaucucccgcauguuaauaaaccgguuuaccaugaagcacaaaaaggccacguacgagccggacguggaccuggggagcggcacccggaauaucgggaucgagagugaaauccccaaccucgacauuaucggcaaacggaucgagaagaucaaacaagagcacgagauaagcuggcauuacgaccaggaucaccccuacaaaacgugggccuaccauggguccuacgagacgaagcagacggggagcgccucgagcauggugaacggcguggugcgccugcugaccaagcccugggacgucgugccaauggugacccagauggcuaugaccgacacgaccccauucgggcagcagcgcguguucaaggagaagguggacacccguacucaggagcccaaggaaggaacgaagaagcugaugaagaucaccgcggaguggcucuggaaggaacugggcaagaagaagacgccccgcaugugcacccgggaagaguucacgcgcaaggugcgguccaacgcggcccucggggccauauucaccgacgagaacaaguggaaguccgcccgcgaggcggucgaggacggucgguucugggaacugguggaccgugagcggaaccugcaucucgaggggaagugcgagaccugcguguacaacaugaugggcaagcgcgagaagaaguuaggggaguucgguaaggccaagggcucacgggccaucugguauauguggcugggggcccgcuuccucgaguucgaggcgcugggcuuccuaaacgaagaccacugguucagccgggggaacagccucucaggcguggagggggagggccugcaucggcugggauacauacuccgggacguagggaagaaagagggcggggccauguacgcugacgacaccgccggcugggauacacgcauaacacuggaggacuugaagaacgaggagauggugaccaaccacaugaagggggagcacaaaaagcucgccgaggccaucuucaaacugaccuaccagaauaaaguaguacggguccagcgcccgacgccccggggcacagugauggacaucauaucgcgucgggaccagcgcggcuccgggcaggucgguaccuacgggcugaauacauuuacgaauauggaagcacagcucauccggcagauggaaggcgagggaaucuucaagagcauucagcaccugaccgccaccgaagagaucgcuguccagaacuggcuggcccggguagggcgcgaacggcucagucgcauggcgaucagcggagacgacugcgucgucaagccgaucgacgaucgguucgccucggcccuaaccgcccugaacgacauggggaaggugcgcaaggacauccagcagugggagcccucacggggcuggaaugacuggacccaggugccguucugcucccaccacuuccacgagcucgucaugaaggaugggcgagugcugguggugccgugccggaaccaggaugagcugaucggccgggcacggaucagccagggcgcggguuggucgcucaaggagaccgcgugccugggcaagagcuacgcccagauguggacccugauguacuuccacagacgggaucuccgcuuggccgcgaacgcgauaugcucagcugugcccagccauugggugccuaccucacggaccacguggagcauccacgccaagcacgaguggaugacaacagaggacaugcuugccgucuggaaccgcguguggauccaggagaacccguggauggaggacaagacccccguggaauccugggaggaggugcccuaccucgggaagcgggaggaccaauggugcggcagccugauugggcugacgagccgcgcgaccugggccaagaauauccagaccgcaaucaaccaggugcgguccuuaauaggcaaugaggaauacacugacuauaugcccagcaugaagcgcuuucgucgagaggaggaggaaacgggcgugcugugguaa

SEQ ID NO: 25094 - RNA, 9876 nt, Artificial Sequence
  derived and/or modified CDS sequence (opt11) from DENV-2__EU482597__SS-prME
accgccggugugaucgucauguuaauaccgacggcaauggcuuuccacuuaaccacgcgcaacggggagccgcacaugauugugggccgucaggagaaggggaagucccuguuguucaagaccgaggacggcgugaacauguguaccuugauggccaucgacuuaggggagcugugugaggauaccaucaccuauaagugcccccuccuucggcagaacgaacccgaggacaucgacugcuggugcaacagcaccagcaccuggguaaccuacgggacuugcaccacuaccggcgagcaccgacgugagaagcgcuccguggcccuggugccccacgucgggaugggacuggaaacccgaaccgaaacuuggaugagcucagaaggagcguggaagcauguccagcggauagagaccuggauccugcgccacccgggcuucacuaucauggccgcgauccuggccuacacuauagggacaacccauuuccagcgggcccucaucuucauccugcuuacggccguagcacccagcaugaccaugagaugcaucggcaucagcaaccgugauuucgucgaaggcguguccggcggcuccuggguggacaucguccucgagcacggcucaugcgugaccacaauggcaaagaacaagccgacccuggacuuugaguuaauuaagaccgaggccaagcaaccggcgacccuccggaaguacuguaucgaagccaaacuuacuaacacuacgaccgagagccgcugcccgacgcagggcgagcccucucuguccgaagaacaggacaaacgcuucaucuguaagcacagcaugguggacagaggcugggguaacggcugcggccuguucggcaaggguggcaucgugaccugcgcgauguucacgugcaagaagaacauggagggaaaggugguacagcccgagaaccuggaguacaccaucgugaucacgccccacucgggggaagaacacgcggugggcaacgacaccgggaagcacggcaaggagaucaagauuaccccgcaguccucgaucaccgaggcagagcugacggguuauggcacggugaccauggagugcagccccaggaccgggcucgacuuuaacgaaaugguccugcuccagauggaagacaaggccuggcuggugcaucggcaaugguucuuggaucugcccuuaccguggcuaccgggugcugacacccagggcuccaacuggauccagaaggaaacgcuggugaccuuuaagaauccacacgcgaagaaacaggauguggugguacuagggagccaggagggcgccaugcacaccgcccugaccggggcuacggagauccagauguccuccggaaaccuccuauucaccggccaucugaagugucgccugcggauggacaaauugcaguuaaagggcaugagcuauuccaugugcaccgguaaguucaaaaucguaaaggagaucgccgagacccagcaugggacuaucgugauccgcguccaguacgagggagauggcagcccuuguaagauccccuucgaaaucaccgaccuggaaaagcgucaugugcuugggcgccucaucaccgugaacccgaucgucacugagaaagacucccccgugaacauugaggcugaaccgcccuucggcgauuccuacaucaucauaggaguugaaccgggccagcugaaacuuaacugguucaagaaggggucaagcaucggucagauguucgagaccaccaugcgcggcgccaagcggauggccauauugggggacaccgcgugggauuucgggucauuagggggagucuucacuucuaucgggaaggcccuccaccagguguucggggcaaucuacggcgccgcguuuagcggugugagcuggacaaugaagaucuuaaucggggucaucaucacuuggaucggcaugaacucgagaaguacaucccugagcgugucccuggugcucgucggaguggucacccuguaccugggggccaugguucaggcggacagcggcugugucguguccuggaagaacaaagagcuaaaguguggcagcgggaucuuuaucacagacaacgugcacaccuggacugagcaauacaaguuucagccagagucaccguccaagcuggccagcgccauccagaaggcccacgaggaggggauaugcgggauucggucggugacacggcuggagaaccugauguggaagcaaaucacgcccgagcugaaucacauccugagcgagaaugagguaaagcucacaaucaugaccggggacauccggggaaucaugcaggcgggcaagcgcagucugcgaccgcaacccaccgaguuaaaguauagcuggaagaccuggggcaaggcuaaaaugcuaucaaccgaaagccacaaccaaaccuuccugaucgaugggcccgaaacugccgaguguccgaacacuaaccgcgccuggaacucccuggaggucgaagacuacggauucgguguguuuaccacuaacauauggcuaaagcuacgcgaaaagcaggacguauucugcgacagcaagcucauguccgccgccaucaaggacaaccgcgcggugcacgccgacaugggcuacuggauagagagcgcccucaaugacaccuggaagauggagaaggccuccuucaucgaggugaaaagcugccacuggccuaaaucccacacccucuggagcaaugggguguuggaguccgagaugaucaucccgaagaacuucgccggaccggugagccaacauaauuaccggccgggauaccacacgcaaaccgcgggacccuggcaccucgguaagcuggaaauggacuuugaccugugcgaggggaccaccgugguggugacggaggauugcggcaaccgcggaccuagccuccggaccaccacggccuccgggaaacuuaucacagaaugguguugucgcagcugcacccugcccccacuccgguacaggggcgaggacggguguugguacggaauggaaauccggccccucaaggagaaggaagaaaaccucguaaauucccucgugaccgccggacacggccagauugacaauuucagccugggcgucuuggggauggcccucuucuuagaggagauguugcgcacgcggaucgggacgaagcacgcaauccuacuuguagccgugaguuuuguaaccuuaauaaccgggaauaugagcuuccgggaccucggccgaguaauggugauggugggcgccacuaugacggacgacaucggaaugggcguuaccuaucuggcgcugcuugccgcguucaagguccggcccaccuuugccgccggguugcugcuccgcaagcugaccuccaaggagcuuaugauggcgacgaucggcaucgcccuacugagccagucgaccaucccggagaccauauuagagcuaacugacgcacuggcacuggggaugaugguccucaagaucguccggaauauggagaaguaccagcuggccguuacaaucauggccauuagcugcguaccgaaugccgugauacugcagaacgcguggaaggugucaugcaccauccucgccgccgucagcgugagcccccuucuacucaccaguucccagcagaaggcggacuggauccccuuagcccugaccaucaagggccucaacccgacagccaucuuccugaccacacugucgcgaaccuccaagaaacggagcuggcccuugaaugaagccaucauggccgucggcaugguguccauccuggcuucgagccugcuaaagaacgauaucccgaugaccgggccccugguggcuggcgggcugcucaccgucugcuacgugcugaccggccgauccgccgaccuggaguuagagcgggcggccgaugugaagugggaagaccaagcugagaucagcgggagcagccccauccugagcaucacgauaagcgaggacggcuccaugagcaucaagaacgaagaggaggaacagacgcugaccauccucauccgcacgggccugcugguaaucuccgggguguucccagugagcauaccgauaaccgcggccgccugguaccucugggagguuaagaagcagagagccggcgugcucugggacgugcccagcccgccaccggucgagaaggcugaacuggaggacggggccuaccgcaucaagcaacggggcaucuuaggauacagccaaaucggcgcaggcguauacaaagaggggacguuucauacaauguggcaugugacccguggggccguccugaugcaccgggggaagcgcaucgagccaagcugggccgacgucaagaaggaccugauuagcuacgguggaggcuggaagcuggagggcgaauggaaggagggggaggagguucaagucuuggcccuggagcccggcaaaaacccccgcgcggugcagaccaagccagggauuuuuaagaccaacacaggcaccauuggagccgugucgcuugacuucagccccggcacaaguggcagccccauagucgaccgcaagggaaagguugugggccuguacgggaacggcguagucacccgguccggugccuacgugagcgcgaucgcccagacggagaaguccaucgaagacaaccccgagaucgaggacgauaucuucagaaagaagcggcucaccaucauggaccuccaccccggggcgggaaagaccaagcgcuaccugcccgcuaucguuagggaggcuaucaaacgcggcuuacguacccuaaucuuagccccgacucgggucgucgcggccgaaauggaggaggcucugcgcggcuuaccgauccgcuaccaaacgaccgccaucaagacugaacacaccgggagagagaucgucgaccucaugugccaugccaccuuuacgaugcgacugcugucccccgugcgcgugcccaacuacaaccuuauuaucauggacgaggcccacuucaccgacccagccuccaucgccgcgagaggguauaucuccacgcgcgucgaaaugggagaggccgcggggaucuucaugacagccacaccacccggcagucgcgaccccuucccccaguccaacgcccccaucauggaugaggaacgcgagauacccgagcggagcuggaacuccgggcacgaaugggugaccgauuuuaagggaaagacgguaugguuuguuccuagcaucaaggccgggaacgacauugcggccugucugcgcaagaacggcaagaaggugauccagcugucccggaaaaccuucgacagcgaguacguaaagacccgcgcuaacgacugggacuucgucgucacgacugacauuuccgaaaugggcgccaacuuuaaggccgagagggugaucgacccccgccgcugcaugaagcccgucauccucaccgacggugaagaacgcgugauacuggcgggcccaaugcccgugacccacagcagugccgcacaacggcgcgggcggauaggccgcaacccgaagaacgagaacgaccaguauauauacaugggggaaccauuagagaacgaugaggauugcgcccacuggaaggaggccaaaaugcuccuggacaacaucaauacacccgagggcaucaucccgagcauguuugagcccgagcgcgagaaagucgacgccauagauggcgaguaucggcuacgcggggaggcccggaagacuuucguggaccucaugaggaggggcgaccuaccgguuuggcucgcuuacaaggucgcagcggaggggaucaacuacgcggaccgaaaguggugcuucgacggcaucaagaacaaccagauccucgaagagaacauggagguggagaucuggacuaaggagggggaacgaaagaagcugaaaccacgcuggcuggacgcgaggaucuacuccgacccguuggcccuaaaggaguucaaggaauuugccgcgggucgcaagagccugacccucaaccugaucacggagaugggccggcugcccacguucaugacccagaaggcccguaaugcccucgacaaccuggcgguguugcacaccgccgaggccgggggccgggccuauaaccaugcccucuccgaguugcccgagacccuggagacucuccugcugcucacccugcuggccaccgucacagggggcaucuuccucuuccugaugucuggcaaggggauaggcaagaugacccuugggaugugcugcaucaucacggccucgauacuccugugguacgcgcagauccagccccacuggaucgccgccucgaucauccuggaguucuucuugaucguguugcugaucccggagcccgagaagcagcgcacgccccaggacaaccagcucacguacgucgugaucgccauucucaccguugucgccgcgacgauggccaacgagaugggauuuuuggagaagaccaagaaggaucucgggcuaggcagcaucaccacucaggaguccgagucaaauauacuggacaucgaccugcguccugccuccgccuggacgcuguacgccgucgcaacuaccuuugugacccccauguugcgccauagcaucgagaacuccagcguaaacgugucccucacggccaucgcuaaccaggccaccguacucaugggacuggguaagggcuggccccucucaaagauggacauagguguccccuugcuggcgaucggcugcuacucccaggugaauccgauaacccucaccgccgcccugcugcugcugguggcacacuacgccaucaucggaccgggccugcaggcgaaggccacccgggaggcacagaagcgcgcugccgcggguaucaugaagaacccaaccgucgacgggauaacuguuaucgaucucgagcccauucccuacgauccaaaguuugagaagcagcuaggccagguuauguuacucauccugugcgucacccagguccugaugaugaggacgaccugggcccucugcgaagccuugacguuagccaccgggcccaucuccaccuugugggaaggcaaucccgggcgauuuuggaauaccacaaucgccguguccauggcaaacaucuuccgcggaaguuaccuggccggagccggguugcuguucuccauuaugaagaacacgacgaauacccggcgaggcaccggcaauaucggcgagacccugggcgaaaaguggaaaucccggcugaacgcgcucggcaaauccgaguuucagaucuacaagaagaguggcauccaggaggucgaccgcacguuggcgaaagaggggaucaagcgcggcgagaccgaucaucacgccguaucccgcgguucagccaagcugcggugguucguggagagaaacauggucacgccggagggcaaggucguugaucucggcugcggacggggcggguggagcuacuacuguggcggguuaaagaauguccgcgaaguuaaggggcuuacuaaaggagggccgggacacgaggagccuauacccaugaguacguauggguggaaccugguaaggcuccagucgggcguugacguguucuucacgccgcccgagaagugcgacacccuucuaugugacauaggcgaaucaagccccaaccccaccauugaggccggccguaccuuacgggugcugaaccucgucgaaaacuggcugaacaauaacacucaguuuugcaucaaggugcugaacccguacaugccguccgugaucgagaagauggaggcccuccaacgcaaguacggcggggcucuagucaggaacccuuuaagccguaacuccacccacgagauguacuggguuagcaaugcaaccggcaacauuguguccagcgucaacaugaucuccagaaugcugaucaaccguuuuaccaugaagcacaagaaggcaacguacgagccggacguggaccucggaaguggcacccguaacaucgggauagaguccgaaaucccgaacuuagacaucauaggcaagcgcauugagaaaaucaagcaggagcacgagaccucauggcacuacgaccaggaccaucccuacaagaccugggccuaucacggcuccuaugagacgaagcagaccgggagcgccucgaguauggugaacggcguagugcgcuuacucaccaaacccugggacgucgucccaauggugacccagauggcgaugacggacacuacgccguuuggccagcagagggucuucaaggaaaagguggacacccgcacgcaggagcccaaagagggcaccaagaaacuuaugaagauuaccgccgaauggcuguggaaggagcuuggcaagaagaagacgccccggauguguacccgcgaggaguucacccggaaggugcgguccaacgccgcccugggagcaaucuucacggacgagaauaaguggaaguccgcgcgcgaagccguugaggacggccgcuucugggagcucgucgaccgugagaggaaccuccaccuggaggguaagugcgagaccugcgucuacaacaugaugggaaaacgggagaagaaguugggggaguucggcaaggccaagggcucccgcgcgaucugguacauguggcucggugcgcgguuccuggaguucgaggcccugggcuucuugaacgaggaucauugguucucgagagggaauagucugaguggcguugagggagagggccuucacaggcucggcuauauacugcgcgacguugguaagaaggaaggaggggccauguacgcggaugacacggccggcugggauacccggaucacccuggaagacuugaagaacgaggagaugguaacaaaccauaugaagggggagcauaagaaacuggcagaagccaucuucaagcugacguaccaaaacaaagucgugcgcguacagcgccccaccccgaggggcacugugauggacauuauuagccggagggaccagcgcggcuccgggcaggucgggacuuacgguuuaaauaccuucaccaacauggaggcccagcugauacggcagauggagggcgaggggauauucaagaguauccagcaucuaacagcaacagaggagaucgccgugcagaacuggcuggcgcgcgucgggcgggagagacugucgcggauggccaucagcggagacgacuguguggugaaacccaucgaugaccgcuucgcguccgcacugacagccuugaacgauauggggaagauaagaaaagacauccagcagugggagccuucccguggguggaacgacuggacccagguccccuucugcagucaccacuuccacgagcuggugaugaaagaugggcgaguccuggucguuccuugccgcaaccaggacgaacucaucggccgggcgagaaucagccagggcgcgggcuggucccugaaggagaccgccugccugggaaagagcuacgcccaaauguggacccugauguacuuccacagacgcgaccugcggcucgccgcgaacgccaucugcuccgccgugcccagccauuggguccccaccagucgcacgaccuggucaauccacgccaagcacgaguggaugaccaccgaagacaugcucgccguauggaacaggguguggauacaggagaacccuuggauggaggacaaaacgccggucgaguccugggaagaggugccguaccuggggaagcgcgaggaucaguggugcggcagccucaucggcuugacaagccgugcaaccugggcuaaaaacauccagaccgccaucaaccaggugcgcagccugaucggaaacgaggaauacacggacuauaugcccagcaugaagcgcuuccggcgcgaagaggaggaggccggcguacugugguag

SEQ ID NO: 25095 - RNA, 9876 nt, Artificial Sequence
  derived and/or modified CDS sequence (opt11) from DENV-2__EU482598__SS-prME
accgcgggcgugauugucaugcugauccccacugccauggcguuucaucucaccacucguaauggggagccgcauaugauagugggccggcaagaaaaggggaaaagucuguuguucaagaccgaagauggcgugaacaugugcacccucauggccaucgaccugggggagcugugcgaagacaccaucaccuacaagugcccccuucugaggcagaacgagcccgaggacauugacugcuggugcaacucuacaagcaccugggucacauacgggacuugcaccaccacgggcgagcaucgacgcgaaaagcgcaguguagcccuagugccccacguggggaugggccuugaaacccgcacugagaccuggaugagcuccgaaggugcuuggaagcaugugcagcggaucgagaccuggauccugcgccacccgggauucaccaucauggccgcgauccucgcuuacaccaucgguaccacccauuuccagcgggcccucaucuuuauucuguuaaccgcuguggcucccagcaugaccaugcgcugcaucgggaucuccaaccgggacuucguugagggggugucugggggguccuggguggacaucguucucgagcacgggagcugcgugaccacaauggcaaagaacaagccuacccuggacuucgagcugaucaagacagaagccaagcaacccgccacccuccgcaaguacugcaucgaagccaagcugacgaacaccaccaccgagucccggugcccgacgcagggcgagcccagccugaaugaagagcaggauaagagauucaucugcaagcacaguaugguagaccggggcuggggaaauggcugcgggcuguucggcaaaggcgguaucgugacgugcgcgauguucacgugcaagaagaacauggagggcaagaucgugcagcccgagaaccuagaauacaccaucgucaucacgccccauucgggggaggagcacgccgucgguaacgacaccgggaaacacggcaaggagauaaagaucaccccgcagucuagcaucacggaggccgaacugaccggguacggcacggugaccauggaguguagucccagaaccggcuuagacuucaacgagaugguacuguuacagauggaggacaaggcguggcucguccaccgccagugguuccuggaccugccauugcccuggcugccgggggcugacacucagggcagcaacuggauccagaaggagacgcuggucaccuucaagaauccccaugcgaagaagcaagacgugguagugcucggaucccaggagggcgccaugcacaccgcccugaccggcgccacggagauccagaugucuagcggcaaccuccuguucaccggccaccugaagugccgccugcggauggauaaguuacagcugaagggaauguccuacuccaugugcaccggcaaguuuaagaucguaaaggagaucgccgagacccagcacgggaccaucgugauacgcgugcaguacgagggcgauggcucccccugcaagauccccuucgagaucaccgaccuggagaagagacacguucucgggagacugaucaccgugaacccgauagugaccgaaaaggacagccccgucaacaucgaggcggaaccgccauucggcgacucauacaucaucaucgggguggagccgggccagcugaagcucaauugguucaagaaggggagcuccaucggccagauguucgagacgaccaugcgcggggccaagcggauggccauacugggugacacggccugggacuucggcagccucgggggaguuuucaccuccaucgggaaggcccuccaccaggucuucggcgcgaucuacggcgccgccuucagcgggguuuccuggacgaugaagauacugauuggcgugauaaucacguggaucgggaugaacuccagauccaccucucuguccgucucauuggugcucgugggcguagugacccucuaccugggggccauggugcaggcggauuccggcugcgucgugagcuggaaaaauaaggagcuuaagugcggcucugggaucuucaucacggacaacgugcacaccuggaccgagcaguauaaguuccagcccgaaagccccaguaagcucgccuccgccauccagaaagcccacgaggaaggcaucugcgggauccggagcguaacccgccuggagaaccucauguggaagcagaucacuccggagcugaaccacauccugucggaaaacgaggucaagcucaccaucaugaccggcgacaucagaggaaucaugcaggccggcaagcgaucccuccggccacaacccaccgaguugaaguacuccuggaagacguggggaaaggcgaagaugcucaguaccgagucccacaaccagaccuuccucaucgacgggcccgagaccgccgagugcccgaacacgaaccgcgccuggaacagccuggagguggaggacuacggcuuuggcguuuucacaacuaauaucugguugaagcugcgggagaagcaggacguguucugcgacucgaaacugaugagcgccgccauaaaagauaacagagcgguacacgccgacaugggcuauuggaucgagagugcccuaaacgacacguggaagauggagaaggccagcuucaucgaggucaaauccugccacuggcccaagagucacacucugugguccaacggcgugcuggagucggagaugaucauacccaagaacuucgcagggcccgugagccaacacaacuaccggccgggcuaccacacgcagaccgcggggcccuggcaccugggcaagcuggagauggacuucgaccugugcgaggggaccaccgucguggugacggaggacugcggcaaccgcggccccucccuccggaccacaaccgccagcgggaagcugauaacggaguggugcugccgcaguugcacccugcccccgcuccgguaccggggcgaagauggaugcugguacggaauggagaucagaccccugaaggagaaggaggagaaccugguuaacagccucgugaccgccggacacggccaaaucgacaacuucagccugggcgugcugggcauggcucucuuccuugaagaaaugcugcgcacacggaucggcaccaagcacgcgauacuccucgucgccgugagcuucgugacccuaauuaccgggaauauguccuuccgcgaucugggccgcgucauggugauggugggggccaccaugacggacgauaucggcaugggcgucacuuaucuggcgcugcuagcagcguucaaggugcggcccaccuucgccgccggacugcugcuccgaaaguuaaccagcaaggagcugaugauggccacaaucggaaucgcgcuccugucccagagcaccauacccgagaccauccuggaacucacggacgcgcuagccuuggggaugaugguacucaagaucguccggaacauggagaaguaccaacuggccgugacgauaauggcuaucuccugcgugccgaacgcgguuauccugcagaacgcguggaaggugucuugcacuauccuggccgccguguccgucagcccccugcugcucaccuccagccagcagaaggccgacuggaucccccuugcucugaccaucaaggggcucaaccccacggcuaucuuccugaccacccugucccgcaccucgaagaagcgcuccuggccgcucaacgaggccaucauggccguggggauggucagcauccuggccuccucucuccuaaagaacgacauccccaugacggggccccugguagcgggggggcugcucaccgugugcuacgucuuaaccgggcgcucagccgaccucgagcucgaacgggccgccgacgugaagugggaggaccaggccgagaucuccggaagcucccccauccugagcaucaccaucuccgaggacggcagcauguccaucaagaacgaggaggaggagcagacgcugaccauccucaucaggacgggccugcuggugaucagcgggguuuucccgguguccaucccaaucaccgcggcggccugguaccucugggaggugaagaaacagcgggccggcguccugugggacgugcccagccccccgcccguggagaaggcugaacuggaggacggagccuaucgcaucaaacagcguggcauccucggguacucccagaucggggccggcgucuacaaggagggcaccuuccacacgauguggcacgugacccgcggcgccgugcugaugcaccggggaaagcgcaucgagcccagcugggccgaugugaagaaggaccugaucucuuacggcggaggcuggaagcucgagggagaguggaaggagggggaggaaguccaaguccuggcccuggagcccggcaagaacccccgggcgguccagaccaagcccgggaucuucaagaccaacacagguaccaucggcgccgugagccucgacuucucccccggcaccagcggcucccccaucguggaucgcaaggggaagguaguuggccuguacgggaacgguguggucacccgguccggcgccuacgugagugccauagcgcaaacugagaaauccaucgaggacaaucccgagaucgaagacgacaucuuccgaaagaaacggcuaaccaucauggacuugcaccccggagccgguaagacuaagagauaucugcccgccaucgucagagaggccaucaagcgcgggcugcgcacccugauccucgccccgacgcgagucguagcggccgagauggaggaggcucugagaggccugcccauccgguaccagaccacagccaucaagaccgagcacacggggcgcgagauuguggaccugaugugccacgcuaccuucaccaugcgucugcugagcccuguccgcguucccaacuacaaccucauuaucauggaugaagcacacuucaccgacccggccuccauugccgcucgugguuacaucucaacgcgcguggagaugggagaggcggcagggaucuucaugaccgccaccccgccagguucccgggaccccuucccgcagagcaacgcacccaucauggacgaggagcgugagauaccggagcgguccuggaacagcgggcacgagugggucacggacuucaaggguaagacggugugguuugugcccuccaucaaggccggaaacgacaucgcagccugccugcgcaagaacggcaagaaggugauccagcugagccggaagaccuucgauuccgaguaugugaagacccgcgccaacgacugggacuucguggucaccacggacaucagcgaaaugggcgccaacuucaaggccgagcggguaaucgacccgcgccggugcaugaagcccgugauccucaccgacggcgaggagcgcgucauccuggcgggccccaugccaguaacucacuccagcgccgcucagcggcgcgggcgcauuggccggaacccgaagaacgagaacgaccaguacaucuacaugggcgagcccuuagagaacgacgaggacugugcccacuggaaggaggccaaaaugcuccuagacaacaucaacacccccgaggggaucauccccuccauguucgaaccggaacgagagaagguggacgccaucgacggcgaauauagguugcgcggggaggcccgaaaaacguucguagaucucaugaggcggggagaccuacccguguggcuggccuacaagguggccgcagaggggauuaacuacgcggaccgcaaguggugcuuugacggcauuaagaacaaccagauucucgaggagaacauggaggucgagaucuggaccaaggagggggagcggaagaaacugaagccccgcuggcuggacgcccggaucuacagcgacccgcucgcccugaaggaauucaaggaguuugccgcgggcagaaagucccugacccugaaccuaaucacagagaugggacggcugcccacguucaugacgcaaaaggcccguaacgcuuuggacaaccuggccgugcuucacaccgccgaggccggaggccgggccuacaaucacgcccuuagcgagcugcccgagacucuggagacgcucuugcugcucacccuccuggccaccgugaccggcggcaucuuccuauuccugauguccggcaaggggaucggcaagaugacacuagggaugugcugcaucaucacggccuccauccuuuugugguacgcccagauccagccccacuggaucgccgccuccaucauccuggaauuuuuccuaaucguccugcugaucccugagcccgaaaagcagcgcacgccccaggauaaccagcucaccuacguuguuaucgccauccugacagugguggccgcgacgauggcuaacgagaugggcuuccuggagaagaccaagaaggaccuggggcugggcuccaucaccacucaggagagcgaguccaauauccuggacaucgaccuccggcccgccagcgccuggacuuuguacgcaguggcaaccaccuucgugaccccuaugcugagacauuccaucgagaacagcuccgugaacguaagucucacggcuaucgccaaccaggccaccgugcuaaugggccuggggaaaggcuggccccucagcaagauggacaucgggguaccucugcuggcgaucggcuguuacagccaggucaaccccaucacccuaaccgccgcccuucugcugcugguggcucacuacgccaucaucgggccgggccugcaggcgaaggccacgcgugaggcccagaagcgcgcggcagcgggcaucaugaagaaccccacuguggacgggaucaccgucaucgaccucgagccgauccccuacgacccgaaguucgagaagcaguuaggccaggugaugcuucucauucugugcgugacacagguccugaugaugcggacgacaugggccuuaugcgaggcccugacgcuggccaccgggccgaucuccacgcucugggagggcaaccccgggcgcuuuuggaacaccaccaucgccguaagcauggcgaauaucuuccgaggcuccuaccuggcaggcgccggucugcuuuucagcaucaugaagaacacgacgaacacccggcgcgggacuggcaacauaggggagacccugggcgaaaaguggaagucccggcugaacgcgcucggcaagagcgaguuccagauauacaagaaguccgguauccaggaaguggaccgcacgcuggcgaaggaggggaucaagcggggcgagacagaucaccacgccgucagccgcggcuccgcgaagcugcggugguucguggagcgcaacauggugacccccgagggcaaagucguggacuuaggcugugggcgggguggcuggagcuacuacugcggcgggcugaagaacguacgugaggucaagggcuuaaccaagggcggaccggggcaugaggagcccauccccauguccacguacggguggaaccucgugcggcugcaaagcggcguggaugucuucuucacgccgccagaaaagugcgauacacugcucugcgacaucggggagagcuccccgaaccccaccaucgaagccggccgcacccugcgggugcugaaccuuguggagaacuggcugaacaauaacacgcaguucugcaucaagguccugaaccccuacaugccgucugucaucgagaagauggaggccuuacagcgcaaguacggaggggcgcugguacggaacccccugucccgaaauagcacccacgagauguacugggucuccaacgcaaccgggaauaucgugagcuccguaaacaugaucagccgcaugcugauaaacagauucacgaugaagcacaagaaggccacauacgagcccgaugucgaucuaggguccggcacgcguaacaucgggaucgagagcgagaucccgaaucuggacaucauagguaagcgcaucgagaagauuaagcaagagcacgagaccuccuggcacuacgaccaggaucaccccuacaagaccugggccuaccauggcagcuacgagacuaagcagacggggucugccucuuccauggugaacggcgugguccgccugcucacuaagcccugggacguggugccgauggucacgcagauggcgaugacggacacgacccccuucgggcagcagcgggucuucaaggagaagguggacacucgcacgcaggaaccuaaagagggcaccaagaagcucaugaagaucacugccgaguggcuguggaaggagcuuggaaaaaagaagacaccccggaugugcacgcgugaggaguucacccggaagguccggucuaacgccgcccuaggcgccauauucaccgacgagaacaaguggaaaucggcgcgggaggccguggaggacggccgcuucugggagcugguggaccgggaacgaaaucuccaccuggaggggaagugcgaaacgugcguguacaauaugaugggcaagcgggagaagaagcugggggaauucggcaaggcaaagggaagccgcgccaucugguauaugugguuaggagcgagguuccuggaauucgaggcccugggauuucucaacgaggaccacugguucucuaggggaaacagccugagcggcgucgagggggaggggcugcaccgccucggcuacauccugcgcgacguggggaaaaaggagggcggggcaauguacgccgacgauacggccggcugggacacucggauaacccuugaggaccucaaaaaugaggagauggucacaaaucauaugaagggggagcacaagaaacuggcggaggccaucuucaaguugacuuaucagaacaagguggucagagugcaacguccuaccccgcgcggcaccgugauggacauuaucucccggcgugaccagcgcggaagcgggcaggucggcaccuacgggcucaauacguucaccaacauggaggcccagcugauacggcagauggagggggagggcauuuuuaagagcauccagcaccugacggccaccgaagagaucgccguacagaacugguuggcgcgcguggggcgggagcgguuguccagaauggccaucaguggcgacgacugcgucguuaagcccaucgaugaccgcuucgccagcgcccugacggcucugaacgacaugggaaaagugcggaaggacauccaacagugggagcccucccgcggcuggaacgacuggacacagguccccuucugcucgcaccacuuccacgagcuggugaugaaggacgggcgggugcuggucgugccgugucgcaaucaggaugagcucaucggcagagcgcgcaucucucagggcgcaggauggagccuaaaggagaccgcuugccuaggcaaguccuacgcccagauguggacacuaauguauuuccaccggcgcgaccugcggcuggccgcgaacgccauauguucagccgugcccucccacuggguccccaccagccgcacgacuugguccauucacgcgaagcacgaguggaugaccacggaggacauguuagcuguguggaaccggguguggauccaggagaacccauggauggaggauaaaacgccugucgagagcugggaggaagugcccuaccuggggaagcgugaggaucagugguguggcucccugaucgggcuuaccagccgggccacgugggcgaagaacauucagaccgccaucaaccaggugcgaagccuuaucggcaacgaggaguacaccgauuauaugcccuccaugaagcgguucaggcgcgaggaggaggaagccgggguuuuaugguga

SEQ ID NO: 25096 - RNA, 9876 nt, Artificial Sequence
  derived and/or modified CDS sequence (opt11) from DENV-2__EU482603__SS-prME
accgcgggcguaaucgucaugcugauccccaccgccauggccuuccaccucaccaccagaaacggggaaccgcacaugauaguggggcgccaggagaaggggaaguccuugcucuucaagaccgaggacggcgugaauaugugcacucucauggccaucgaccugggggaacuuugcgaagacaccaucaccuacaaaugcccccucuugcgccagaacgagcccgaagacaucgacugcuggugcaauucaacuuccaccugggucaccuacggcaccugcaccacgacgggugagcaccggcgugagaagcggaguguggcccuggugccccaugucggcaugggccuagaaacaagaacggagacauggaugagcagcgagggcgcguggaagcacguucaaaggaucgagaccuggauacugcggcacccgggcuuuaccaucauggcugcgaucuuggccuacacgaucggcaccacacacuuccagagggcccucaucuucauucugcugaccgccguggcgcccaguaugacuaugcgcuguaucggaauauccaauagagacuuugucgagggcguaagcggggguucauggguagauaucguucucgagcaugggucuugcgugacgacgauggccaagaacaagccaacccuggacuuugaauuaaucaagaccgaggccaagcagccggccacccuucgaaaguacugcaucgaggccaagcugacaaauacaacuacggaguccagaugcccgacgcaaggcgaaccaucgcucaacgaggagcaagacaagcgauucaucugcaagcauuccaugguggaucgggggugggggaacggcugcgggcuuuucgggaagggugggauugugacaugcgcgauguuuacguguaaaaagaacauggaggguaagguuguucagcccgaaaaccuggaauacaccaucgugaucacuccccauagcggggaggagcacgcggugggaaaugacaccgggaagcacgggaaagagaucaagauaaccccucaauccagcaucaccgaagccgaacugaccggguacggaacggugacaauggaguguuccccccggaccggccuugauuucaacgagaugguuuugcuacagauggaggacaaggcaugguuagugcaccggcaaugguuccuggaccucccccuccccuggcuuccgggggcugauacacagggcagcaacuggauucagaaggagacgcuggugaccuucaagaauccccacgcgaagaaacaagaugucgugguccucgggucccaggaaggcgcaaugcauacagcccuaaccggggcaacggaaauacagaugagcucgggcaaucucuuguuuaccgggcaccugaagugccgccugcggauggauaagcuccagcugaaggggauguccuacagcaugugcacgggaaaauucaagauuguaaaggaaaucgccgagacccagcacgggacgauaguuauccgcguccaauacgagggagacggcucccccugcaagauuccguucgagaucacagaucuggagaagcggcacguguuggggagacugauaaccgucaacccgaucgucaccgagaaggacaguccggugaacaucgaggccgagccacccuucggcgauuccuacaucauaaucgggguagagcccggccagcugaaacugaacugguuuaaaaaggggaguucaaucggccagauguuugagacuaccaugcguggcgcgaaacggauggcaauauuaggggacacagccugggacuucggcagccugggugguguauuuaccuccaucgggaaggcccuacaccagguguucggugcaaucuauggagccgcauucagcgggguauccuggacgaugaagauccugaucggcguaaucaucaccuggauugggaugaauucccgcaguacaagcuuauccguuagucuggugcuuguaggcgucguuacccuguacuuaggugcaaugguccaggcggacuccggcugugugguauccuggaagaacaaagaguugaagugcggguccgggaucuucaucacugauaacguacauacuuggaccgagcaauacaaguuucagcccgaaagcccuucaaaacuggcuuccgccauucagaaggcccacgcagaagggaucugcgguauccggagcguaacucgccucgagaaccucauguggaagcaaaucacgcccgagcucaaccauauccuguccgagaacgaagugaagcucaccaucaugacaggagacauaaagggcauuaugcaagcgggaaagcguagcuugcgcccgcagcccaccgagcugaaauacuccuggaagacgugggggaaggccaagaugcucuccacggagucccacaaccagaccuuccugaucgacggccccgagaccgccgagugcccaaacacuaaccgggcguggaacagccuggaggucgaggacuacggcuucggaguguucacgaccaacaucuggcuuaagcuacgagaaaagcaggacguguucugcgauuccaagcugaugagcgccgcuaucaaagacaaucgggcgguccacgccgacaugggcuacuggauagaguccgcccucaacgacaccuggaagauggaaaaagccagcuuuauugaggugaaaaguugccacuggcccaagagccacacucuaugguccaauggcguccuagaaagcgagaugaucauccccaagaacuucgcgggucccgucucccagcauaacuaccguccgggguaccacacgcagaccgcugggcccuggcaucucggcaagcucgagauggacuucgaucuuugugaggggaccaccguagugguuaccgaggacugcgggaaccgcggccccucauuacguaccaccaccgccagcgggaagcugaucaccgagugguguugucggagcugcacacugcccccgcuccgcuacaggggugaagacggaugcugguacggaauggaaauucgcccccugaaggagaaagaagagaaccuggugaacagccucguaacugccggccacggccagaucgacaacuucuccuuaggcguccugggcauggcccucuuccuggaggagaugcuacggacccgcauaggaacgaagcacgccauccucuuaguggccgugagcuucgugacccucaucacgggcaacaugucauucagagaccuaggucgcgugaugguuauggucggggccaccaugaccgacgacaucggcaugggcgugaccuaccuggcccuguuagcagccuucaaggugcggcccaccuucgccgcgggucuccuccuccggaagcuuacaaguaaggaacuaaugauggcgacgaucggcaucgcguugcuuucucaaucaaccauacccgaaacgauacuagagcucaccgacgcccuggcucugggcaugaugguccuuaaaaucguacgugacauggaaaaauaccaacuggccgugacgaucauggccaucagcugcguuccgaaugcugucaucuugcaaaaugccuggaaagugucaugcaccauccucgccgccguuucuguuagcccucugcuucucaccuccagccagcagaaagcggauuggaucccacucgccuugacuaucaagggccugaaccccacagcuaucuucuugaccacacugucccggaccagcaagaagcgcuccuggccgcuuaacgaagccauuauggcagucggcauggugagcauccuagcauccagccugcucaagaaugacauccccaugacagggccccuaguggcuggcggccuucucaccguauguuacgugcugaccggucggagcgccgacuuggaacuggaaagagccgccgacgugaagugggaggaccaggccgagauaagcgguucuuccccuauucugagcaucaccaucuccgaagauggcagcaugaguaucaagaacgaggaagaggaacagacgcuaaccauucucaucaggacgggucuucuaguaaucagcgggguauucccuguguccauucccaucaccgccgccgccugguaucucugggaagucaaaaaacagcgcgccggcgugcugugggacgugccuucuccgccgcccgucgaaaaggcggaacucgaggauggggccuaccggaucaaacagcgcggcauccucggguacucccagaucggagcuggcguguacaaggaggguacauuccacacgauguggcacgucacccggggggccguccugaugcaccgagggaagcgaauagagccuagcugggcggacgugaaaaaggaucugauauccuacggggggggcuggaaacucgagggcgaguggaaggagggugaggagguccagguccuggcgcuggaacccggaaagaauccgcgagccgugcagaccaagccggggaucuucaaaacaaauaccggaacuauuggggccgugucucucgacuuuagcccuggaaccagcggcucccccaucgucgaccggaagggcaaggucgugggccuguacgggaacggcgucgucaccaggagcggugcuuacguguccgcaaucgcccagacggagaaauccaucgaggacaaccccgagauagaggacgacaucuuucgcaagaagcgccucacgaucauggacuugcacccgggggccggcaagaccaagagauaccugccggccaucguucgcgaggcaauaaagcgaggacugcgcacccugauccucgcaccaacuagggucguggcugcugagauggaggaggcccugcggggccugcccauuagguaccaaacgcccgcgaucaagaccgagcauacuggucgggagauagucgauuuaaugugccacgcgaccuucacaaugagguugcuuucaccaguccgggugccaaacuacaaccuaaucaucauggacgaggcccacuucaccgaccccgcuuccauugccgcucgcggcuacaucuccacccggguugaaaugggcgaagcggcuggaaucuucaugacugcgacgccccccgggucgcgggauccuuucccccaguccaaugccccaauuauggacgaggagcgggagauccccgagcguuccuggaacucgggucacgaguggguaacagacuucaaaggaaagacggugugguucguccccucaauaaaggcagggaacgacaucgcagccugccuacggaagaacggcaagaaggugauccagcugucacgcaaaacguucgacuccgaguacguaaaaacccgggccaacgacugggauuuugucgugaccaccgacauaagcgaaaugggggccaacuucaaggcggagcgagugaucgacccacguagguguaugaagcccgucauccucacggacggggaagagcggguaauacuagcaggcccaaugccggugacgcauuccucugccgcccaacgccgggggcgcaucggccgcaaucccaagaacgagaacgaccaguacaucuauaugggugagccgcuggaaaaugacgaggacugcgcccacuggaaggaagcgaagaugcugcuggacaacauaaauacccccgagggcauuauuccauccauguucgagcccgagcgggaaaaggucgacgccauugauggcgaguaccgccugcguggcgaggccagaaagaccuucguggaccugaugcggcgaggcgaccuuccgguguggcuagcuuacaagguggcagcagagggaaucaauuacgccgacaggaaguggugcuucgauggcaucaagaacaaccagaucuuggaagagaacauggagguggagaucuggacgaaggagggagagcgcaaaaagcuaaagccgcguuggcucgaugcgcgcaucuacagcgacccgcucgcacucaaggaguucaaggaguucgcggcuggccggaagucccugacccucaaccuaauuacggaaaugggccgccugcccaccuucaugacgcagaaggcccggaaugcccucgacaaccuggccgugcugcauacggcagaggccgguggccgcgccuacaaccacgcguugucugaguugcccgagacucuugaaacccuccuacuguuaacgcugcucgccacggucacuggggguaucuuucucuuccuuaugucgggcaaggggauaggcaaaaugacucucggcauguguuguauuaucacagcgagcauccuccugugguacgcgcagauccagccgcacuggaucgccgccuccauaauucuggaguucuuucucaucgugcugcugauccccgagccugagaagcagcggaccccacaggauaaccaguuaacauacgucguaaucgccauacugaccguagucgcggccaccauggcuaacgagauggguuuccuggagaagacgaagaaggacuuagggcugggcagcauaacgacucaggagucggaguccaacauucuugacauugaccucagaccugccagcgccuggaccuuguacgcgguugccacgacguucgucacgccuauguugcggcacuccaucgagaauucuucuguaaacgugagccucacagcaaucgcaaaccaagcgacgguccugaugggucugggaaaaggauggccccucagcaagauggacauaggcgucccccugcuggccaucggcugcuauagccaagugaaucccauuaccuuaacugccgcccugcugcuccuuguagcccacuacgccaucaucgggcccggcuugcaggccaaggcgacccgcgaggcccagaagcgggcugcggcaggcaucaugaaaaacccuacgguggaugggauaaccgugaucgacuuggaacccauuccguacgaucccaaguuugagaagcaacugggccaagugaugcugcugauccugugcgucacccaggugcuaaugaugaggacgacgugggcccucugcgaagcccugacccuggccaccgggcccauuagcacccucugggagggcaaccccggccgguucuggaacacgacgaucgcgguuagcauggccaacaucuuccgcggcuccuaucuggcaggcgccgggcuccuuuucucgaucaugaagaacaccaccuccacacgccggggaaccgggaacaucggcgagacccugggugagaaguggaagucucgauugaaugcucucgggaagucggaguuccaaaucuacaagaaguccggcauccaggagguagaccggacccuggccaaggaggguaucaaacggggagaaacggaucaccaugcagugucccgggggagugccaagcuucgcugguucguggaaaggaauaugguuaccccggaggguaagguuguugaucucggcugcgggcgcggcgggugguccuacuacugcggcggccugaagaacguacgggagguuaagggccugacaaagggcgggcccggccacgaagaacccauuccuaugagcaccuacgguuggaaccuugugcgacuucaaagcggcguagauguuuucuucacgcccccggagaagugugacacccugcucugcgacaucggcgaguccagccccaaccccacuaucgaggcugguagaacccugcgcgugcugaaccucguugagaauuggcugaacaauaauacccaguucugcaucaaggugcuuaacccauacaugcccuccguuaucgagaagauggaggcacuccagaggaaguauggcggcgcccuggugcgaaacccccugagccgaaacucaacucacgagauguauugggugagcaaugccacgggcaacaucguguccagcgucaauaugauaucccgaaugcugauaaaccguuuuacgaugaagcauaaaaagaccacguacgagcccgacguagaccucgggucagggacccgcaacaucggaaucgagucagagauccccaaccucgacauuauaggcaagcggaucgagaagauaaagcaggagcacgagaccagcuggcacuacgaccaggaccacccauacaagaccugggcuuaccacggcucauacgaaacgaagcagacgggaucggccuccagcauggugaacggggucgugcgucugcucacgaagcccugggauguggucccgauggucacccagauggcaaugacggacaccacuccguuuggucagcaacgcguguucaaagaaaaggucgacacccggacgcaggagcccaaggagggcaccaagaagcugaugaagaucaccgccgaauggcuauggaaggagcucgggaagaagaagacgccgcggaugugcacgcgggaggaguucacccgcaaggugcgguccaaugccgcccuuggggcuauuuucacggacgagaacaaauggaaauccgcgagggaagccguugaggacggccgguuuugggaguuggucgaccgugaaaggaaccuccaccuggaggggaaaugugagacguguguguacaacaugauggguaagagagagaagaagcugggagaguucggcaaggccaaaggcagucgggcuauuugguacauguggcucggggcgcgcuuccuggaauucgaagcccucggcuuucucaacgaggaccauugguucucacgcgggaauagccugagcggcgucgagggggaaggacugcaccgccuaggcuauauccugcgggacgucagcaaaaaggagggaggcgccauguacgcggaugacacggccgggugggacacccgcaucacccuggaggaccucaagaacgaggagaugguuacgaaccacaugaagggugagcauaagaaguuggcggaggccaucuucaaacugacguaccagaacaagguugugagaguucagcgcccgacgccccggggaaccgucauggacaucaucagucgccgcgaucaacgcgguagcggccaaguggggacuuacggcuugaauacguuuaccaacauggaggcccagcugauccgccaaauggagggggagggcauuuucaagucuauccagcaccugacugccaccgaagagaucguuguccaaaacuggcucgcccggguaggccgugagcgguugagcaggauggccauuaguggggacgacugcgugguaaagccgaucgaugaucgcuuugcaagugcccugacggcgcucaaugacaugggcaaggugagaaaggauauacagcaaugggagccauccagagguuggaacgacuggacccaagugccguuuugcagucaccacuuccacgaacuugucaugaaggacggcaggguacuugugguccccugccggaaucaagaugaacugaucgggcgagcacggaucucccagggcgcgggcuggagccugaaggagacugccugucuggguaaguccuacgcacaaauguggacgcucauguauuuccaccgccgggaccugcgucuggccgccaacgcgaucugcagugccgugcccucccacugggugccuaccagccguacgaccugguccauucaugcaaagcacgaauggaugacaaccgaggauaugcuugcggucuggaaccgcguguggauccaggagaacccguggauggaggacaaaaccccuguggagagcugggaggagguccccuacuuaggcaaacgggaggaccaguggugcgggagccugauaggucuaacuucccgcgcgacuugggccaagaacauacagacugcaauaaaucaggugcggucgcucaucgguaacgaggaguacacggacuacaugccuucaaugaagcgcuuucggcgggaggaggaagaggccggcgugcugugguga

SEQ ID NO: 25097 - RNA, 9876 nt, Artificial Sequence
  derived and/or modified CDS sequence (opt11) from DENV-2__EU482599__SS-prME
acugccggcguuaucgucaugcugauccccaccgccauggcuuuccaccucaccacccgcaacggcgagccgcacaugaucguagggcggcaggagaaggguaagucccuguuauucaagacggaagacggcgugaauaugugcacccucauggcaauagaccugggggagcugugcgaagacacgaucaccuacaagugcccccuccugcgccagaacgaaccagaggauaucgacugcuggugcaacagcaccagcaccugggucacguacgggaccugcaccaccaccggggagcaccggcgcgagaagagguccguggcucugguuccccacgucggaaugggccucgagacacgcaccgagaccuggaugucauccgagggggccuggaagcacguacagcggaucgaaaccuggauucugcgccacccgggcuucaccaucauggccgcuauccuugccuacaccaucgggacgacccacuuccagcgggccuugaucuucauucugcugacagcuguggcucccaguaugaccaugcgaugcaucgggaucuccaaucgugacuucgucgagggcgugagcgggggcuccuggguggacaucguccucgagcacggcucuugcgugaccacgauggccaagaacaagcccaccuuagacuuugagcugauuaagaccgaagccaagcagcccgcuacccuccguaaguacugcaucgaggccaagcugacgaauaccacaaccgaaucccguugcccuacgcaaggcgagccuagccugaacgaggagcaggacaagcgguucauuuguaagcacuccaugguggaucgcggcugggguaacggcugcggacuguuuggcaagggcgggaucgugaccugcgcgauguucacuugcaaaaagaacauggaaggaaaggucgugcagccggagaaccuggaguacaccaucgucaucaccccccacaguggggaggagcaugccgugggcaaugacaccgggaagcacggaaaggagaucaagaucaccccgcaguccucgauaacggaggccgagcuaacgggguacggcacgguaacaauggaaugcuccccccgcaccggccuggacuucaacgaaaugguccuucuacagauggaggauaaggccuggcucgugcaccggcagugguuccuggaccugccgcuuccgugguugccgggugccgacacccagggcucaaacuggauccaaaaagagacgcuggugaccuucaagaacccucaugcgaagaagcaggacgucgugguccucggcucccaggaaggcgccaugcacaccgcgcugaccggggccacggagauccagaugucaagcggcaaccuccuguucaccggccaccugaagugcaggcugcggauggauaagcuccagcugaagggaauguccuacagcaugugcacgggcaaguuuaagaucgugaaagagauagccgaaacucagcaugggacgauugugauccgcguccaguacgaaggcgauggcagcccuuguaagauccccuucgagaucacagacuuggaaaaacggcacguucucgggcgccugaucacggugaacccgauagucaccgagaaggauucgcccgucaauaucgaggcggagccgcccuuuggggacucguacauaaucaucgggguggagccgggucagcuaaagcuaaacugguucaagaaagggucguccaucgggcagauguucgagacgaccaugcgcggagccaaaagaauggcgauccugggcgacacugcaugggacuuuggcagcuuggggggagucuuuaccaguaucgguaaggcucuccaccagguguucggcgcgauauacggggccgcguuuagcgggguguccuggacgaugaaaauacugaucggcgugauuaucaccuggaucgggaugaacagccgcuccaccagcuuauccgugucucuggugcucguuggagugguuacccuguaccugggagccauggugcaggcggacuccgggugcguggugagcuggaagaacaaggagcuuaaguguggcuccggaaucuuuauaacugacaacguacauacguggaccgagcaguauaaguuccaacccgagucccccagcaagcuggccucggccauccagaaggcccacgaggaaggaaucugcgggauccggagcguuacucgccuggagaaccucauguggaagcagaucacgcccgagcugaaccacaucuuauccgaaaacgaagugaagcucaccaucaugaccggcgacauccgugggaucaugcaggccgguaagcgcucacugcggccacaacccaccgagcugaaguauuccuggaagaccuggggcaaggcgaagauguuaagcaccgagagucacaaccaaaccuuccugaucgacgggcccgagacagcggagugcccgaacacgaaccgagccuggaacaguuuggaagucgaggauuacgguuucggcguguuuacaacaaacaucuggcugaagcugcgggagaagcaggacguguucugcgacuccaaguugaugagcgccgccaucaaggacaaccgcgcgguccacgccgacauggguuacuggaucgagucugcccuaaaugacacuuggaaaauggagaaggcaagcuucaucgaagugaaguccugccacuggccaaagucucacacccugugguccaacggcgugcuggaaagcgagaugaucaucccaaagaauuucgccgggcccgucucccagcacaacuaccggcccggcuaucacacgcagacugcgggcccauggcaccuggguaaacuggagauggacuucgaccugugcgaggggaccaccgucgugguuacggaggacugcggcaaucgcggccccucgcuaaggaccaccaccgccucagggaaacugaucacggaguggugcugccgcuccugcacccugcccccacucagauaccgcggcgaggacgggugcugguacggaauggaaauucggccccugaaggagaaagaggagaaccugguaaauagccucgugacugcagggcacggacaaaucgacaacuucucccugggagucuuggggauggcccucuuccuggaggagaugcugcgcacccggaucggcacgaagcacgcgauccuccugguggccgugucauucguaacccugauaaccgggaacauguccuuccgcgaccucggccgcgucauggucauggucggcgccaccaugaccgaugacauuggcaugggcgugaccuaccuggcucuguuagcggcuuucaaggugcggccgaccuuugccgccgggcugcuccuccgcaagcugaccagcaaggagcugaugauggccacaauugguaucgccuuacugucccagagcaccauccccgagacgauccuggaguugaccgacgcgcuggcacugggcaugaugguccucaagaucgugagaaacauggagaaguaccagcuugcagucacgaucauggucaucaguugcgugccgaacgcagugauccugcagaaugccuggaaggucagcugcaccauccucgcggccguguccgucagcccccuucugcucacaaguagccagcaaaaggccgacuggaucccguuagcccugaccaucaagggccuaaaccccacagcgaucuuccugacuacccugagccgcaccuccaaaaagcgguccuggccgcucaaugaggcaaucauggcggugggaauggugagcauccuggccagcagcuugcucaagaacgacauccccaugacgggcccucuggucgccggaggauugcuaaccgugugcuaugugcugaccggccgcagcgcggacuuagagcucgagcgcgccgccgacgucaagugggaggaccaagccgagaucuccgggagcucccccaucuuaagcaucaccauuuccgaggacgggagcauguccaucaagaacgaggaggaggaacagacccucaccaucuugauccgcacuggccuacuggugauaucgggcguguucccugucuccauccccaucaccgcggccgccugguaccuaugggaggugaagaaacagcgggccggcguccugugggacguacccagccccccgcccguggaaaaagccgagcuggaagacggggccuaccgcaucaagcagcggggcauccucggguacagccagaucggagcgggcguguauaaggaggggaccuuucacacgauguggcacgucacccguggggccguucucaugcaccgaggcaagcgcaucgaaccgagcugggccgacguuaaaaaggaccuaaucagcuacggcgggggcuggaaacuggagggugaguggaaagagggggaggagguccaggugcuggcccuggagccgggcaagaaccccagagccguacaaacgaaaccagggaucuucaagaccaacacggguaccaucggggcgguuucucucgauuucucccccggcaccaguggcucccccauagucgaccgcaaggggaagguagucggccuguaugggaacggcgugguaacccggucuggcgcauacguuagugcgaucgcccagacggagaagucaauugaggacaaccccgagaucgaagacgacauauuccgcaagaagcggcuuaccaucauggacuuacaccccggggcgggaaaaacgaagcgcuaucugccagccauagugagggaggccauuaagcgcgggcugcgcacucugauccuagccccuacgcggguggucgccgcggagauggaggaggcgcugcgaggacugcccauccgguaccagaccaccgccaucaaaaccgagcacacgggacgcgagauaguggaccucaugugccacgccaccuucaccaugcggcugcugagcccuguccgcgugccuaacuauaaucucaucaucauggacgaggcucauuuuaccgacccggcguccaucgccgcccgaggguacaucagcacgcgcguggagaugggugaggccgccgggaucuucaugaccgcuacgccgcccggcucccgagacccuuucccgcagagcaacgcccccaucauggacgaggagcgcgagauucccgagcggucauggaacagcgggcacgaaugggugacugacuucaagggaaagacggucugguucguaccguccaucaaggcuggcaacgacaucgccgcgugccugcgcaagaauggaaaaaaggugauucagcugagccggaagaccuucgacagugaauacguuaagacccgcgcuaaugacugggacuucguggugaccacggacaucagcgaaaugggggcgaacuuuaaggccgagcgggugaucgacccgcgccggugcaugaagcccgugauccucaccgacggggaggagcggguaaucuuagccggcccgaugcccgucacccacucaagcgcggcucagcggcgcgggcgcaucggccggaacccgaagaacgagaacgaccaguacaucuauaugggugagcccuuggagaaugaugaggacugcgcccacuggaaggaggccaagaugcugcuggacaacaucaacacgcccgagggcauaauccccuccauguuugagccugaacgcgagaaaguggaugcaaucgacggcgaguaccggcugcgcggagaggcgcggaaaacauucguggacuuaaugcgccggggggaccugcccgucuggcucgccuacaagguggccgccgaggggaucaacuacgccgacagaaaguggugcuucgauggcaucaagaacaaccagauccucgaggagaacauggagguggagauuuggaccaaggagggcgagcggaagaagcucaagccccguuggcuggacgcgaggaucuacagcgauccacucgcacuaaaggaguucaaagaguucgccgccggcaggaagucuuugacccucaaccugaucacggaaaugggccggcugcccacguucaugacccagaaggcgcgcaacgcauuggacaaucuggccguccugcacacagcugaggccgggggcagagcguacaaccacgcccucucggagcugcccgagacccuugagacgcucuuacugcucacauugcucgccaccgugaccgggggcauauuccuauuccugaugaguggaaagggaaucggcaagaugacccuggguaugugcuguaucauaacagccagcauucuccugugguaugcccagauccagccccacuggaucgcggccuccaucauacucgaguucuuccucaucgugcuccuaaucccggagcccgagaaacagagaacgccccaggauaaccagcucaccuacgugguaaucgccauccugaccgucguggccgccacuauggcgaacgagaugggcuuucuggagaagaccaagaaagaccucgggcugggcagcaucaccacccaagagagcgaauccaacauucuggauaucgaccuccggcccgccagcgccuggacuuuauacgccguagccacaaccuucgucaccccgaugcugcgccacuccauagaaaacagcucugugaacgugucucucaccgcgauagcuaaccaggccaccguccugaugggccuggggaagggcuggccucucuccaaaauggacauaggagugccccuacuugccaucggcuguuacagccaggugaauccaauuacccugaccgcggcccugcugcuccucguugcccauuacgccaucauugggccaggccugcaggccaaagcgacgcgggaggcccagaagcgcgccgccgccggcaucaugaagaacccuaccguggacgggauaacugugaucgaucucgagcccauaccauacgacccgaaauucgagaagcaacugggccaggucaugcugcucauccugugcgugacccagguguugaugaugcggacgaccugggcgcucugcgaggcccugacucuggcuaccgggcccaucuccacucucugggagggcaaccccgggcgcuucuggaacaccacgaucgccgucagcauggcaaacauauuccgcggcucuuaccuggcgggcgcagggcuccuguucagcaucaugaagaacaccacgaacacccggcgcgggaccgggaacaucggugaaacccucggcgagaaguggaaguccaggcugaacgcccucggcaagucggaguuccagauauacaaaaaguccggcauccaggagguggaccgcacgcuggccaaggagggaaucaagcgcggcgagaccgaccaccacgcggugucccgcggguccgccaagcugcggugguucguagagcgcaacauggugacgcccgagggcaagguggucgaccucgguugcgggcggggagguuggaguuacuauugcggcgggcugaaaaacgugagggaggugaagggccuaaccaagggcgggccgggccacgaggagccaauucccauguccacguacggguggaaccucguccggcugcagagcggcguggacguguuuuuuacaccgccugagaaaugugacacucugcucugugacaucggggaaagcucccccaaccccaccaucgaggccggccgcacccugcggguccugaaccucguggagaacuggcuaaauaacaacacacaguucuguaucaaggugcugaaccccuauaugccguccgucaucgaaaagauggaggcccuccagcgcaaguacggcggggcgcugguucggaacccgcugucccgcaacagcacccacgagauguacugggugucuaacgcgaccggcaacauugucagcucagugaacaugaucucucggaugcugaucaaccgcuuuacuaugaagcacaagaaggccacguacgaaccugacgucgaccucgggucagggacccggaacauagggauugaaagcgagaucccgaauuuagacauaaucggcaagcgaaucgagaaaaucaagcaggagcacgagaccuccuggcacuacgaccaggaccaccccuacaagacuugggccuaccauggcagcuacgagacgaagcagaccggguccgccucuuccaugguuaacggcguggugcgacuccucaccaagcccugggacgucguaccuauggugacccagauggccaugacggauaccaccccguucgggcaacaacgggucuucaaggagaagguggauacccgcacucaggaacccaaggagggcaccaagaagcugaugaagauuaccgcggaguggcuguggaaggagcuuggcaagaagaagacgccucguauguguacgcgcgaggaguucacccggaaggugcggagcaacgccgcccugggggccaucuucaccgacgagaacaaguggaagagugcccgggaggcgguagaggacggccgcuucugggagcugguagaccgggagcgcaacuuacaccuggaagggaagugcgaaaccugcguguauaacaugaugggaaagcgggagaagaagcugggggaguucggcaaggccaagggcagcagagcuaucugguacauguggcucggcgcccgguucuuagaguucgaggcacugggcuuccucaacgaggaccauugguucucccgcgggaacagcuugagcggcgucgagggggagggccugcaucggcucggauacauccugcgcgacgucgggaaaaaggaaggcggggccauguacgccgaugauacugccggaugggauacccgaaucaccuuagaggaucucaagaacgaggagauggucacgaaccacaugaaaggggagcacaaaaagcuggccgaggcgaucuucaagcuuacguaccaaaacaaggugguuagaguccagcggccaaccccgcgcggcaccgugauggacauaaucucccggcgggaccagcgcggaucggggcaggucggcaccuacgggcuuaacacguucaccaauauggaagcucaguugauccggcagauggagggugagggcaucuucaaguccauccaacaccugaccgcaaccgaggagaucgccguccaaaacuggcucgccagggugggccgggagcgucugagccggauggcgauuuccggcgacgauugcgugguuaaacccaucgaugaccgcuucgccagcgcccugacugcccucaacgauauggguaaagugcggaaggacauccagcagugggagcccagccgcggcuggaacgacuggacccaggucccuuucugcucccaccacuuccacgaacucgucaugaaggacgggcgggugcugguggucccaugccgcaaccaggacgaguugaucggacgcgcccgcauuucccagggggcaggguggucccucaaggaaacggcaugcuuaggcaaguccuacgcucagauguggacucucauguacuuccaccggcgcgaccugcggcuggccgccaacgcgaucugcagcgccgugcccucccacugggugccaaccagccgcacgaccuggaguauccacgccaagcacgaauggaugacuacugaggacauguuagcggucuggaaucguguauggauucaggagaacccauggauggaagacaagacgccuguggaguccugggaggaggugcccuaccuggggaagcgcgaggaccaaugguguggcucccugaucgggcucacuagccgggcgacuugggccaaaaauauccagaccgccaucaaccaggugcgcagccugauugggaacgaagaguacacggacuacaugcccucgaugaagcgcuuccggcgcgaggaggaagaggcgggcgugcugugguga

SEQ ID NO: 25098 - RNA, 9876 nt, Artificial Sequence
  derived and/or modified CDS sequence (opt11) from DENV-2__FJ898436__SS-prME
accgcgggggugaucgucaugcugaucccuaccgccauggcauuccaccucaccacccgaaacggggaaccgcauaugaucgugggccggcaggaaaaagguaagucccugcuguucaagaccgaagacggcgucaacauguguacccucauggccaucgaccugggggaacugugugaagauacuaucaccuacaagugucccuugcucagacaaaacgagccugaagacaucgacuguugguguaacucgacuagcaccuggguaaccuacgggaccugcacuacgacgggagagcaucggagagagaagcgguccguugcccuggucccccaugucgggaugggccucgaaacucgcaccgagaccuggaugagcucugaaggggccuggaagcacgugcaacggaucgaaacauggauccugcgccacccgggcuucaccaucauggcggcuauccuggccuacaccaucgggacgacucacuuccagcgggcccucaucuucauucugcuuaccgccguggcgcccagcaugaccaugagauguaucggcaucuccaacagggacuuugucgagggcgucagcggcggcucauggguggacaucgugcucgagcacgggagcugcgugacaacuauggccaagaacaagcccacccuggacuucgaguugaucaagaccgaggccaagcagcccgcgacccuacgcaaguacugcaucgaggcuaagcuaacgaacacgaccaccgagucccgcuguccgacgcaaggcgagcccagccucaacgaggagcaggacaagcgauuuaucugcaagcacuccaugguggaucggggcuggggcaacggaugcggguuauucgguaaaggcgggaucguaaccugcgcgauguucacgugcaagaaaaauauggagggcaaggugguacagcccgagaaccuggaguacaccaucgugaucacgccccacucaggggaggaacaugccguuggcaacgacaccgguaagcacggcaaagagaucaagaucacaccgcaaaguagcaucaccgaagccgaacucacuggguacgggacggugaccauggaaugcagcccgcgcaccggccuggauuuuaacgagaugguccuguugcagauggaggauaaggcguggcucgugcaccggcagugguuccuggaccugccccuccccugguugccgggggccgacacccagggcagcaauuggauccaaaaggagacucuggugaccuuuaagaacccccacgcgaagaaacaggacgucgugguccuaggcagccaggagggagccaugcacaccgcacugacuggggccacggagauccagaugagcagugguaaucuccuauucaccggccaucuaaagugccgccugaggauggacaagcuccagcugaaagguaugucguacagcaugugcacgggcaaguuuaaaaucgugaaggagauugccgaaacccagcacggcacgauugugauccggguccaguacgaaggcgacgggucccccuguaagaucccauucgagaucaccgauuuggagaagcgucacguguuggggaggcugauuacugugaacccaaucgucacggaaaaagacucccccguaaacaucgaagcggagccgccuuucggugacuccuacaucaucauaggcguggaaccuggccagcugaaguuaaauugguuuaagaaagggagcuccauuggccagauguucgagacuaccaugcgcggcgccaagcggauggccauccugggugacaccgccugggacuucggcagccucgggggcguguucaccuccauuggcaaggcacuccaucaaguguucggugcgaucuacggcgccgcauucagcgggguguccuggacgaugaagauccugaucggcguuauuaucaccuggaucgggaugaacucucgcuccacuucgcuuuccgucucgcugguguuaguuggcgugguuacccucuaccugggugccaugguccaagcggacuccgguugcguggugucuuggaaaaacaaggagcucaagugcggcucuggaaucuucaucacggacaauguacacacauggaccgagcaauacaaguuccagcccgagucacccagcaagcuagccuccgcgauccagaaggcccacgaagagggcaucugcgggaucagaagcgucaccaggcuggagaaucucauguggaagcagaucacgcccgagcugaaccacauccuguccgagaacgaggucaaacuuaccauuaugacaggggacauacggggaaucaugcaggcagggaagagaucucugcgaccgcagcccaccgagcugaaguacuccuggaagaccuggggcaaggcgaagaugcucagcaccgagucccacaaucagaccuucuugaucgacggaccggagaccgccgaaugcccgaacacgaaccgagccuggaacagccuggaggucgaggacuauggcuuugguguauucaccacaaauaucugguuaaagcugagagagaagcaggacgucuucugcgacuccaagcugaugucggccgcaaucaaagacaaccgcgcgguccacgccgacaugggcuacuggaucgaguccgcccucaaugacacauggaagauggagaaggccagcuucaucgagguaaagagcugccauuggccaaagucacacacacuuuggucuaacggcguguuagagagcgagaugaucauccccaagaacuucgccgggcccguuucccagcacaacuaucgcccgggcuaccacacgcagaccgcggggcccuggcaucuuggaaagcuggagauggacuucgaccucugcgagggaacaacaguuguggucacggaagacuguggcaaccgcggccccagcuugcggacaaccacugccagcgggaaacugaucaccgagugguguugucgcuccugcacucugccaccccuccguuaccgcggcgaggaugggugcugguacggcauggaaauccggccccugaaggagaaggaggagaaccucgugaacagccucgugaccgccgggcacggccagaucgacaacuucucacugggcguccuugggauggcgcuuuuccuagaggagaugcugcgcacccggaucgguacuaagcacgcaauccuccuaguagcugugagcuucgucacccuuaucaccgggaacauguccuuccgcgaccucggccgcgugauggugaugguaggggcaacaaugacggacgacaucggcaugggaguaacauacuuggcccugcucgcagccuucaagguccggcccaccuucgccgccgggcugcuacuuagaaagcugaccagcaaggagcuaaugauggccacgaucggcaucgccuugcugagucaaagcacuauccccgagacgauucuggagcucacagacgcccuugcccuggggaugaugguacucaagauagugagaaacauggagaaauaucaguuggccgugacgaucauggcuaucaguugcgucccuaacgcgguaaucuugcagaaugcguggaaggugagcugcaccauucucgccgcgguguccgugagcccccugcugcucacauccucacagcaaaaggcugacuggaucccccuugcccugaccaucaagggccucaaccccacggccaucuuucucacaacacugucacggaccagcaagaaacguuccuggccgcucaacgaggcgaucauggccgucggaauggugagcauccuggccagcagccuguuaaagaacgacauccccaugacggggcccuuaguggcagggggucugcuaacggucugcuacguuuugacgggccgaagcgcggaccuggagcucgaacgggccgccgaugugaagugggaggaucaggcugaaaucucuggcagcuccccaaucuuaagcaucacuaucucagaggacggcaguauguccaucaagaacgaagaggaggagcagacucugaccauccuaauacgcacgggccugcucgucaucagcggagucuuuccgguauccaucccuaucaccgcggccgcgugguaucuuugggaggucaagaagcagcgugcaggcguuuuaugggaugugcccagcccgccaccuguggagaaggccgagcuggaagacggggcguacaggaucaagcagcggggaaucuuggguuacucccagaucggagcaggcguguacaaggaagggacuuuccacacgauguggcacguuacuaggggagccguacugaugcaucgggggaaacgcaucgaacccagcugggcagaugugaagaaagaccugauauccuacggcgggggcuggaaguuagagggagaauggaaggagggggaggaggugcaaguccuugcgcucgaacccggaaagaauccccgggcggugcaaaccaagcccgggaucuuuaagacuaauacagggaccauaggagccgucucacucgacuucucccccggcaccagcgggagcccuaucgucgaccgcaagggaaagguggugggccuguacgguaacggcguugugacuagaucgggagccuacguuuccgcuauugcacagacggagaaguccaucgaggacaacccugagaucgaggacgauauauuccgcaagaaacgguuaacuaucauggaccuccaccccggggccggcaagacgaagagauaccugcccgccaucguccgggaggccaucaagagagggcugcgcacccucauucuagccccgacgcggguaguggcggccgaaauggaggaggcccugaggggacugcccauuagauaccagacuacggccaucaagacugaacacacggggcgcgagaucgucgaccucaugugccacgccaccuuuaccaugcgccugcugucuccugugcgcguucccaacuacaacuugaucaucauggacgaagcgcauuucaccgacccugccucuaucgccgcucguggcuacauuaguacgcgcgucgagaugggcgaggccgcaggaauuuuuaugaccgcaacgccgccgggaucucgugaccccuucccgcagagcaacgcccccaucauggacgaggagcgcgagauucccgaacggucauggaacucugggcaugagugggugaccgacuuuaagggcaagacggucugguucguccccuccaucaaggccggcaacgauaucgcugccuguuuacggaaaaauggcaagaaggugauacaacugagcagaaagaccuucgauucggaguacgugaaaacccgggccaacgacugggacuuugucgugaccacggacauuagcgagaugggcgcgaacuucaaggccgagcgagugaucgauccucgccgguguaugaagccgguaauccucaccgacggugaggagcgcgugauacuggcgggcccuaugcccgugacccauaguagcgccgcccagagacgcgggcggaucggacggaacccuaagaacgagaacgaccaguacaucuacaugggggagcccuuggagaaugacgaggacugcgcgcacuggaaagaggccaagauguugcuggacaacaucaacacccccgaaggcaucauccccuccauguucgagccggagcgggagaaggucgaugcgaucgacggcgaguaccgacugcgcggggaggccaggaagacauucguggaccuuaugcgccggggcgaccugcccguguggcuggccuauaaggucgccgccgaagggauaaacuacgcggaccgcaaguggugcuucgauggcaucaagaacaaccagauccuagaggagaacauggaggucgagaucuggaccaaggagggugaacgaaagaagcucaagccccgcuggcuggacgcccggaucuacucugacccacuugcccugaaggaguucaaggaguucgccgccgggaggaagucccugacccucaacuugaucaccgagauggggcgguuacccacuuucaugacccagaaggcccgcaacgcgcucgacaaccuggccgugcuucacacagccgaggcugggggucgggccuauaaccacgcgcucagcgagcugcccgagacccuggagacguugcuccugcucacuuuauuagcaaccgucaccgggggaauuuuccucuuucugauguccggcaaggggaucggcaaaaugacccuggggaugugcuguaucauuacagccagcauccuccugugguacgcgcagauccagccucauuggaucgcggccuccaucaucuuggaguucuuccucaucgugcuacugaucccggagccagagaaacagcgcacuccccaagacaaccaacuaaccuacguugugaucgccauacugacgguggucgcagcgacaauggccaacgaaaugggauuccuggagaagacaaagaaggaccuggggcugggcucgaucacaacccaggagagugaaaguaacauccucgacaucgaccuucggcccgcgucggcuuggacgcuguacgccguggccacuaccuucgugaccccgaugcugaggcacaguaucgagaacucauccgucaacgugucccucacugcuaucgccaaccaggcuacagugcugaugggcuugggcaagggcuggccccucuccaagauggacauagggguuccccuccuggcaaucgguuguuacagccaggugaaccccaucaccuuaaccgccgccuugcugcugcucguagcucauuacgccauuaucgggccgggacuucaagcgaaggccacacgggaggcccagaaacgcgccgccgcgggcaucaugaaaaaccccacagucgacgggaucaccguuaucgaccuagagccuaucccauacgauccgaaguucgagaagcagcugggccaagugaugcuauuaauucucugcguuacccaggugcugaugaugcggacgacaugggcccucugcgaagccuuaacccuggccaccgggcccaucaguacguugugggagggaaaucccggccgcuucuggaacaccacaaucgcggugagcauggcgaacauauuccgcggguccuacuuggccggggccgggcuccuguuuuccauaaugaaaaauacaacgaacacccgcaggggaacgggaaacauaggcgagacccucggcgagaaguggaaguccagguugaacgcccugggcaagagcgaguuccaaaucuauaagaaguccggcauucaggaggucgaccgcacacuggcgaaggaggggauuaagcggggcgagaccgaucaccacgccgucagccgagggucugcuaaacugaggugguucguggagagaaacauggucacacccgaggguaaggugguugaucucggcugcgggaggggcggguggagcuauuacugcggcgggcugaagaacguccgggaggugaaaggccugacuaagggcgggccaggacacgaggagcccauccccaugucgaccuauggcuggaaccucgugcggcuucagaguggcgucgacguguucuuuacgccgcccgaaaagugcgacacccuccugugcgacaucggugagagcucccccaacccuaccaucgaggccggccguacccugcggguccucaaccucguggagaauuggcugaacaacaacacccaguucugcaucaaagugcugaacccauacaugccuuccguuauagagaagauggaggcccuccagcgcaaguacggcggcgcacucguccgcaacccccugagccgcaacagcacccacgagauguauuggguuuccaacgccacuggcaauaucguuucgucgguuaacaugaucagccggaugcugauuaaucgcuucaccaugaaacacaagaaagccacguaugagcccgacguggaccucggguccggcacccggaauaucgggauagaaucggaaaucccgaaccuggacaucauaggcaagcgcauagagaagaucaagcaggagcacgagaccucguggcacuacgaucaggaccacccguacaagaccugggccuaccacggcagcuaugagacuaagcagaccgguucggcaagcucaaugguaaacggcgucguaagauuacucaccaagccaugggacguaguccccauggugacgcagauggccaugacggacaccacaccguucggacagcaacggguguucaaggagaaggucgauacccgcacucaagagcccaaggaaggcaccaagaaguuaaugaaaaucacggcggccuggcuguggaaggagcucggcaagaagaagacaccccggaugugcacucgggaggaguuuacccguaagguccguagcaacgcugcccugggagcuaucuucacggacgagaacaaguggaaguccgcccgggaagcaguggaggacggucgcuucugggagcuggucgaccgggaacgcaacuugcaccuugaggggaagugugagaccugcguguacaacaugaugggcaagcgggagaagaagcugggggaguucggcaaggccaagggaagcagagccauuugguacaugugguugggcgcccgguuucuugaguucgaggcgcugggauuccuaaacgaggaccacugguuuaguaggggcaacagccugaguggcguugaaggagagggccugcaccggcucggcuauauacuucgcgaugucgggaagaaagaaggaggggccauguacgccgaugacaccgcggguugggacaccagaauaacacuggaggaucucaagaacgaggagauggugaccaaucacaugaagggugagcacaagaagcuggccgaggccaucuucaaacuuacguaccagaacaaggucguacgcgugcaacggcccacgccgcgcggaacgguaauggacauuaucuccaggcgcgaccagcgcggcagcgggcaggucgguaccuaugggcucaacaccuucacuaacauggaggcgcaacugauucggcagauggaaggcgaggggaucuuuaaguccauccagcaccugacugccacagaggagaucgcgguucagaacugguuagcgcgcgucggucgggaaagacugagccggauggcaaucucgggcgacgacuguguggugaagccaaucgacgaccgcuucgccagcgcccugacggcgcuaaacgauauggggaagguccggaaagacauacaacaaugggagccgucccgcggcuggaacgauuggacccaaguacccuucugcagccaccacuuccacgagcucgucaugaaggacgggcgaguccugguggugccaugccgcaaccaggacgagcucaucggucgggcacgaaucucccagggagccggguggagcuuaaaggagaccgccugccuggggaaguccuacgcccagauguggacccucauguacuuucaccggagagaccugcgguuagcugccaaugccaucugcagcgccgucccuucccauugggucccaaccucacguaccaccugguccauccaugcgaagcacgaguggaugaccacagaggacaugcuagccguguggaaccgggucuggauacaggagaaccccuggauggaggacaagacgccgguagagagcugggaagaggugcccuaucuggggaaaagagaagaccaguggugugggucccugaucgggcuaaccagccgggccacgugggccaaaaacauucagacggcgauaaaucaaguccgcagcuuaaucgguaacgaggaauacacggacuacaugccaagcaugaagagauuccgucgcgaggaggaggaggcgggcguccugugguga

SEQ ID NO: 25099 - RNA, 9876 nt, Artificial Sequence
  derived and/or modified CDS sequence (opt11) from DENV-2__EU482634__SS-prME
accgcggggguuauugucauguugauacccaccgcaauggcguuucacuugacuacccgaaauggagaaccccauaugaucgugggccggcaggagaaggggaagucccugcuguuuaaaacggaggacggcgucaacaugugcacccuuauggcaaucgaccugggggagcugugugaggacaccauaaccuacaagugcccccuacugcgccagaacgagccugaggacauagacugcuggugcaacucgaccagcaccugggucacuuacgguaccugcaccacaacgggcgagcaccggcgcgagaagcggagcguagcccuggugccccacgucgggaugggcuuagagacccgcacggagaccuggaugucuagugaaggggcguggaaacauguccagcggauagagacuuggauccugcgccaccccggcuuuaccaucauggccgccaucuuagccuacaccaucggcacaacacacuuccaacgggccuuaauauucauuuugcugaccgccguagcgccgagcaugacgaugcgcugcaucggcaucagcaaucgggacuuugucgaaggaguguccgggggaucauggguugauaucguacucgagcacgggaguugugugaccacgauggccaagaacaagccaacucucgacuucgaacugauuaaaaccgaggcgaagcagcccgccacccuucgcaaguacugcaucgaggccaaacugacaaacacuaccaccgaguccagguguccgacgcaaggcgagcccagccugaaugaagaacaagacaagcguuuuaucugcaagcacuccaugguagaccggggcugggggaacggcugcgggcuguucggcaagggcgggaucguaaccugcgcgauguucacgugcaagaagaauauggaaggcaaaguugugcaaccugagaaucuggaauauaccaucguuaucacuccccacagcggggaggagcacgcugugggcaacgacaccgggaagcauggcaaggagaucaagauaaccccgcaauccucaaucacagaggccgaguuaacaggauacgggacagugaccauggagugcaguccucggacgggccucgacuucaacgaaaugguacugcugcagauggaggauaaggcguggcucgugcaccggcagugguucuuagaccugccccuccccuggcugccgggggccgacacccaaggcaguaacuggauacagaaagagacgcuuguuaccuucaagaacccccacgcgaagaaacaggacgucgugguccucgggucccaggagggcgccaugcacaccgcccugaccggggcgacggagauccagaugagcucuggcaaccuucuguucaccggccaccugaagugcagacugcgcauggacaagcuccagcuaaagggcauguccuacagcaugugcaccggcaaguucaaaaucgugaaggagaucgcagagacccagcaugggacgaucguaaucaggguccaguaugagggcgacgguucacccugcaagauccccuucgagaucaccgaccuggagaagcggcacgugcucgggcgccuuaucacggugaacccgaucgugaccgagaaggacagcccaguaaacaucgaagcggaacccccuuucggagauuccuacaucaucauugggguggaaccgggccaguuaaaacucaacugguucaagaaggggagcuccaucggacaaauguucgagacgaccaugcgcggagccaagcggauggcaauccugggggacaccgccugggacuucggcucacucgggggcguauuuaccuccauugggaaagcacuccaccagguguuuggcgcaaucuacggcgcugccuucagcggggugucuuggacgaugaagaucuuaaucggcgucaucaucacuuggaucgggaugaacagccgcucuacgagccuguccguuagucuggugcucgucggcgucgugacgcuguaccuuggggccaugguccaggcggacuccggaugcguggugagcuggaagaacaaggagcugaaguguggcaguggaauuuucauuacggacaacguccacaccuggacagagcaguacaaguuucagccagagagccccagcaaacuggccuccgccauccagaaggcccaugaggagggcauuugcgggauccggagcguuacgaggcuggagaaucucauguggaagcaaaucacgcccgagcugaaccauauacuggccgagaaugaggugaaacuuacuaucaugacaggugacaucaaggggaucaugcaagcgggcaagcggucccugcgcccgcagcccacagaguuaaaauacagcuggaagacguggggaaaggcuaagaugcucucaacggaaagccacaaccagacuuuccugaucgacgggcccgaaacagcugagugcccgaacacgaacagggcuuggaacucccuggaagucgaggauuaugguuucgggguguucaccaccaacaucuggcucaagcugcgcgaaaagcaggacguguucugcgacagcaaguuaauguccgcggcgaucaaggauaaccgggccguccacgccgacaugggcuacuggaucgaaagcgcccucaacgacaccuggaagauggagaaggccucuuucaucgaggucaagagcugucauuggcccaagucccacacccuguggagcaacggcgugcuggagucggaaaugauaaucccgaagaacuucgccggcccugugagccagcacaacuaccgcccggguuaccacacgcagacggcugggcccuggcacuuaggcaagcuggagauggauuucgacuuaugcgaggggaccacggucguggucacggaagacugcgguaaucgaggcccaucucuccgcaccaccacggccuccgggaagcugauaacggaguggugcugccggucuugcacccugcccccgcucagauaccggggcgaggacgggugcugguacggcauggagauucgaccccugaaggagaaggaggagaaccuggucaacucccucgugaccgccgggcauggccagaucgauaacuucagccuggggguccuggggauggcacuguucuuagaggagaugcugagaacucgcaucgguacgaagcacgccauccuccucgucgccguguccuucgugacccugaucaccggaaacaugucguuucgggaccucggcagagugaugguuauggucggggccaccaugacggacgacaucggcaugggcgugaccuaucucgcccugcucgcggccuuuaaggugcgcccaaccuucgcggccgggcugcuccuccggaagcugaccucgaaggagcugaugauggccacgaucggcauagcgcuccugagccaauccaccauccccgagaccauccuggaguuaaccgacgcauuagcccuggggaugaugguccuaaagaucguuagaaacauggagaaguaccagcuggccgugacgaucauggcgaucagcugcgucccgaacgcggugauccugcaaaaugccuggaaggucaguugcaccauccucgccgcugucagcguaagcccauugcuacucaccagcucccaacagaaggcggacuggaucccccuggcguugacgaucaagggccuaaaccccacggccaucuuucugaccacauugagccggacuaauaagaaacgcuccuggccacugaacgaagccauaauggccgucggcauggugagcauccuggcauccagccugcucaagaacgauauaccaaugacgggaccccugguggccggcgggcugcucacagucugcuacgugcugaccggccggagugcagaccuggagcucgagcgcgcggccgacgugaagugggaggaccaggcugagauuagcgggagcuccccgauucugucuaucacgaucucagaagacggcagcauguccaucaagaacgaagaggaggagcagacccugacgauccucauucggaccggucuccuggucaucucaggcguguucccaguguccauccccaucaccgccgcugcgugguaccugugggagguaaagaagcagcgagcgggagugcugugggacgugcccuccccgccgccggucgagaaggcugagcuggaagacggggcauaucggauuaagcagcgcgguauccucggguauucccagauaggcgcuggcguuuauaaggagggaaccuuccacaccauguggcacgugacccggggcgccguacugaugcaccguggcaagagaaucgagcccagcugggccgacgugaaaaaggaccugaucucuuacggcgggggcuggaagcucgaaggggaguggaaagagggggaggaagugcagguccuggcgcuggagcccggcaagaacccccgcgccguacagacuaagcccgggaucuucaaaaccaauacuggcaccauuggugccgugagccucgauuucucuccaggcaccagcggauccccuaucguugaucggaagggcaaaguggugggccuguacgggaacggggucgugacccggagcggcgcuuaugucuccgcgauugcucagacugagaaaagcaucgaagauaacccugaaaucgaggaugacauauucaggaaaaagcgcuuaaccauuauggacuugcaccccggggccggaaagacaaagcgguaccuacccgcuauagugcgcgaggccaucaagagaggccugcgcacccugauccuggcgccgacgcgcgugguggcagcggagauggaggaggcccugcggggccugcccauacgcuaccagacgccggccauuaaaaccgagcacacagggcgggagaucgucgaccucaugugccacgcgacguucaccaugcgccugcuguccccggugcggguuccaaacuacaaccuaaucaucauggacgaggcucauuucacugaccccgccaguaucgcagcccgcggcuauaucaguacacgggucgaaaugggcgaggcggccgguauauucaugacugccacgcccccaggcagucgggauccguucccccagucuaacgcccccaucauggacgaggaacgggaaauccccgagcgcuccuggaacuccggacacgagugggugacugauuuuaagggcaagaccguaugguucgucccguccaucaaggcagggaacgacaucgcugccugucugcgaaagaauggcaagaagguaauccaguugagucgcaagacguucgauuccgaguacgugaaaacgcgugccaacgauugggauuucgucgugacaacugauaucagugaaaugggcgcuaacuucaaggcggagcgcgugauugacccaaggcguugcaugaagcccgucauccuuacagacggggaggagaggguaauccuagccggccccaugccugugacccacuccagcgccgcgcagcgccgggggcgcaucggccgcaacccuaaaaacgagaacgaccaguacaucuauaugggcgagccccuggaaaacgacgaggacugcgcgcacuggaaggaggcuaagaugcugcuggacaacaucaacacccccgaggguaucaucccgucgauguuugagcccgagcgggagaaggucgaugccaucgacggcgaguaccgccugcgcggugaggcacgcaagaccuucguggaccucaugcggcgcggugaccugcccguguggcuggccuacaaggucgcagcugaagggaucaacuacgccgaccgcaaguggugcuuugacgguaucaagaauaaccagauacucgaggagaauauggagguggagaucuggacgaaggagggggagcguaaaaagcugaagccgcgguggcuggacgcccgcauuuacagcgacccccuggcccucaaggaguucaaggaguucgcggccggccggaagucacucacauuaaaccugauuaccgagaugggucgccugcccaccuucaugacgcagaaggcccgaaacgcucucgacaaccuggcaguccugcacaccgcggaggccgggggucgcgccuacaaucacgcccucagcgagcugcccgagacacuggaaacccuccugcugcucacccuguuggccaccgucaccggcggcaucuuucucuuccugauguccggcaaggggaucggcaaaaugacccuggggauguguugcauaauuaccgcgagcauucucuuaugguacgcccagauccagccccacuggauugccgccaguaucauccuggaguuuuucuuaaucgugcugcugauccccgagcccgaaaagcaacggacgccucaggacaaccaguuaaccuacgucgugaucgcaauccugaccgucgucgcggccacaauggcgaacgaaauggguuuccucgagaagacgaagaaggacuuagggcucggcucgauaacuacccaggaauccgagucgaacauacuagacauagaccuccgcccggcaagugccuggacgcuguacgcuguggccacgacauuugugacccccaugcugaggcauaguaucgagaacagcuccgucaacguaagccugacggccaucgccaaccaggcgacuguucugaugggccuggggaaaggguggccccucuccaaaauggacauaggugugccgcuacuggccaucgguugcuacagccagguuaacccgaucacacucaccgccgccuugcugcuccugguagcccacuacgcuaucaucgggccaggccugcaggccaaggccacccgcgaagcccagaagcgcgccgcagcaggcaucaugaagaaccccacggucgacgguaucacugugaucgacuuggagcccauuccguacgaccccaaguucgagaaacagcucggacaggugaugcugcugauccuuugugucacccagguucugaugaugcgcacgacuugggcccucugcgaggcccuaacucuggccaccgggcccaucuccacccucugggaggggaaccccggccgauuuuggaacacgaccaucgcugugagcauggccaauaucuucagagguuccuaccuggccggggccgggcuccucuucagcaucaugaagaacacgaccuccacgcgcagagggacaggcaauaucggcgagacccucggcgagaaguggaaaagccgccugaacgcgcucgggaaguccgaguuucagaucuacaagaaguccgguauccaggagguagaccguacccuggccaaagagggaauaaagcgcggcgagacggaccaccaugcggugagccgggggagcgccaagcugcgcugguucguggagcggaacauggucacgccggagggcaaagugguggaccucgguugcgggcgcggcgggugguccuacuacugcggcgggcugaagaauguccgggaggugaagggauugaccaagggcgggcccggccacgaggaacccauacccaugagcaccuacgguuggaaucuagugcgccugcagagcggcgucgacguguuuuucacgccgcccgagaagugcgacacccugcucugcgauaucggggagagcagccccaaccccaccaucgaggcgggccggaccuuacgcgugcuaaaccucgucgagaauuggcugaacaacaacaccaaauucugcaucaaggugcugaaccccuauaugcccuccgugaucgagaaaauggaagcucuccagagaaaauacggcggggcccugguccgcaaccccuuaagccggaacuccacgcacgagauguauuggguuagcaaugccaccgggaacaucguguccucggucaauaugaucucccggaugcugaucaaccgguuuaccaugaagcacaaaaaggccaccuacgagccggacguggaccucggguccggcacgagaaacaucggaaucgaguccgagaucccaaaccuggacauaaucggaaagcggaucgagaagaucaagcaagagcacgagaccagcuggcacuacgaccaagaccacccuuacaagaccugggcauaccauggcuccuacgagaccaaacagacggggagcgcguccagcauggugaacggugucgugcgcuuguuaaccaagcccugggauguggucccgauggugacccagauggccaugaccgacacgaccccguucgggcagcagcgcguguucaaggagaagguggacacccggacgcaggagcccaaggaggguacgaagaagcugaugaagaucacagcugagugguuguggaaggagcuggggaagaaaaagacgccucgcaugugcaccagagaggaguucacgcgaaaaguucggaguaacgccgcucugggggcgauuuucaccgacgagaacaaguggaagucagcucgcgaagcgguugaagacggccgauuuugggagcuggucgaccgcgaacggaaucuucaccuggaggggaagugcgagaccugcguguacaacaugaugggcaaacgcgagaagaagcuaggugaguucggaaaggccaaaggcucucgggcgaucugguacauguggcucggggcccgcuuccuggaguucgaggcccugggcuuccugaacgaggaccauugguucucgagaggcaacuccuugagcggcguggagggugagggccugcaccgccucggcuacaucuugagggacgucagcaagaaagagggcggcgccauguacgccgaugacaccgcggggugggacacccgcaucacccuggaagaccucaaaaacgaagaaauggugaccaaccacaugaagggcgagcacaagaaguuagccgaggccaucuuuaaacucaccuaccaaaacaaggucguccgcguucagcgcccgacgccccgggggaccgucauggacaucauauccaggagggaccagcgcgguucgggccaagugggcacauacggccucaacaccuucacgaauauggaagcccagcugauacgccaaauggagggugaaggcaucuucaagucuauacagcaccugaccgccaccgaggaaauugucguccagaacuggcuggcgcgggugggccgcgagaggcugagccgcauggccauuuccggggacgauugcguggucaagcccauagacgaccgcuucgcuagcgcccugaccgcucucaaugacauggggaaggugcgcaaggacauccagcagugggagccuagucggggguggaacgacuggacccaggucccauucugcagccaccacuuccacgagcuagucaugaaagacgggcgggugcugguaguccccugccggaaccaggacgagcucaucgggcgcgcucggauaucucagggcgcaggcuggagccucaaggagaccgcuugccuggggaaguccuacgcacagauguggacccucauguauuuccaucgccgggacuugcguuuagccgccaacgccaucugcagcgccgugcccucccacugggugcccaccagccggaccacguggucuauccacgcgaaacacgaauggaugaccaccgaggacaugcucgccgucuggaaccgcguguggauccaggagaacccguggauggaggacaagacccccguggaguccugggaggagguccccuaccuugggaagcgggaagaccaguggugcgggucucugaucgggcucacgagccgcgcgaccugggccaagaacauccagaccgcgaucaaccaggugcggagccugaucgggaacgaggaguacaccgacuacaugccuuccaugaagcgcuuccgccgggaggaggaggaggccggcgucuugugguaa

SEQ ID NO: 25100 - RNA, 9876 nt, Artificial Sequence
  derived and/or modified CDS sequence (opt11) from DENV-2__EU482635__SS-prME
accgcgggcguuauugucaugcugaucccaaccgccauggcuuuccaucuaaccacccgcaacggugagccucacaugaucgugggucgucaagagaaaggaaagucccugcuuuucaaaaccgaggauggcgucaacauguguacgcucauggcuaucgaccugggggagcugugcgaggauaccaucaccuacaagugcccucuccugcgccagaacgagccagaggauaucgacuguuggugcaacucaaccagcaccuggguaacauaugggaccugcaccacaacgggcgaacaucgccgcgagaagcggaguguggcucuaguaccccacgucgggaugggccucgagacccgcacugagaccuggaugagcucggaaggcgccuggaagcacgugcagcggaucgagaccuggauccugagacacccgggcuucacaaucauggccgcgauccuggccuacacuaucggcacuacccacuuccagcgcgcccucauuuucauccugcugaccgccguugcccccaguaugaccaugagaugcaucggcaucucaaaucgggauuucguagagggugucagugguggcuccugggucgauauaguccucgaacacgggagcugcgugaccaccauggccaagaauaagcccacacuggauuucgagcuuaucaagaccgaagcuaagcagcccgcaacccucaggaaguacugcauugaggccaaacuuacgaacaccaccaccgaauccagguguccgacucagggcgagccaagccugucggaagagcaggacaagcgguucaucugcaaacauucgaugguggaccggggcugggggaacggaugcgggcuguuuggcaaaggcggaauaguuacaugcgcaauguucacgugcaagaagaacauggagggaaaggugguccagcccgagaaucuggaguacaccauagucauaacuccccacuccggagaggaacacgccgugggcaacgauaccgggaagcacgggaaagagauuaaaaucacgccgcagucaucaauaacagaggccgagcuaaccggguacggcacgguuaccauggaguguagcccccggacgggacucgacuucaaugagaugguccugcugcagauggaggacaaggcguggcucguucaccggcaaugguuucuggaccugccccucccuugguugccaggggccgauacccaggguuccaacuggauccagaaagaaacccuggucacuuucaagaauccccaugcaaaaaagcaggacguaguaguuuuggguagccaagagggcgccaugcacacugcccugaccggggcuacggagauucaaaugagcuccggcaaccuccuguuuaccggccaccugaagugccgacuccggauggauaagcuccagcuuaaggggaugagcuacuccauguguacuggaaaguucaagaucgugaaggagauagcagagacccagcacggaaccauagugauccggguccaauacgagggcgacgguagccccuguaagauacccuucgagaucaccgaccuagaaaaacggcacguccucggucggcugaucaccgugaacccuaucguaaccgagaaagacuccccagucaauaucgaggcagagccgcccuucggcgacucuuacaucaucaucgggguggaaccggggcaacugaaguuaaacugguucaaaaagggguccagcauaggccagauguucgagacgaccaugcgcggcgcuaagcggauggcgaucuuaggggacaccgccugggacuucggaagccugggugguguguucacuucaauagguaaggcgcuccaccagguauuuggggcgaucuacggggccgccuucuccgguguuucauggacgaugaagauccugaucggcgucaucauaacauggaucgggaugaacucccgcagcacaucccucaguguaucacuuguguuagugggcgugguaacucuguaccugggcgccaugguucaagcggacucggggugcguuguguccuggaagaacaaagagcucaaauguggcagcgggaucuucauuacugauaacguccacaccuggaccgaacaguacaaauuccagcccgagagcccuuccaaauuggccagcgccauucagaaagcccaugaggaaggcaucugcggcauccggucugucacgcgccuggaaaauuugauguggaaacagaucacaccggagcugaaccacauccugucggagaaugaaguuaagcuaaccaucaugaccggcgacauuagagggaucaugcaggcagguaagagaucacugcggccgcagcccacugaacuuaaguacagcuggaagaccuggggaaaggcgaagaugcuuuccaccgaaagucacaaccagaccuucuugauugaugggccagagaccgccgaguguccgaauacaaaccgcgcauggaacucccuggagguugaagacuacggguucgggguguucaccacaaacaucugguuaaagcugcgggagaaacaggauguauucugcgacucuaaacugauguccgcugccaucaaggacaaucgcgcgguccacgccgacaugggguacuggauugagucggcccuuaaugacacguggaaaauggaaaaggcuagcuucaucgaaguuaagaguugccacuggccgaagagccacacccucuggucuaauggcgugcuggaguccgaaaugaucauacccaagaacuucgccggaccagucagccagcacaauuaccggccuggcuaccacacgcaaaccgcugggccguggcaccugggcaagcuugagauggacuucgaccuaugcgaggggaccaccguugucguaacagaagacugcggcaacaggggcccgagccuccgcaccaccaccgccucugguaaauugaucacggaauggugcugccgauccugcacccucccuccgcucagauaucgcggggaggacggguguugguauggaauggagauccgaccccugaaggagaaggaggagaaccuggugaacucacuagugacagcaggucauggacagaucgacaacuucagccugggcgugcugggcauggcccucuuccuggaagagaugcugaggacacguaucggcacuaagcacgccauccuccuaguggcaguguccuuuguuacacuaaucacugggaacaugucguuccgcgaucucggccgcgucauggugaugguaggggccacaaugacagacgacaucggcaugggugucaccuaccuggcccuguuagccgcguucaagguucgccccaccuucgcagccggauugcuccuccgaaaacugacaucaaaggagcugaugauggccacuaucgggauagcgcuccugagccaguccaccauccccgaaaccauccuggagcuuacagacgcgcuggcacuagggaugaugguacucaagaucgugcggaacauggagaaguaccagcuggcggugacuaucauggcgaucucgugcguaccgaacgccgugauucuccagaacgcguggaagguguccuguaccauacucgccgcagucagcguuuccccucuccuccucaccagcucccagcagaaagcggacuggauucccuuagcccugacuaucaagggccucaaccccacggccauuuuucugaccacccugucacgcacuucuaaaaagcgguccuggccacucaaugaggccauaauggcggucggcauggugagcauccuggcuagcagccuccucaagaaugacauccccaugacagggccccugguggcgggcgggcuccucaccguuugcuaugugcugaccggccgcuccgcagaucuagagcuagagcgggccgccgaugugaagugggaggaucaggccgaaaucagcgggucgucaccaauccuguccauuaccaucucugaggacggcaguaugagcauuaagaacgaggaggaggaacaaacucuaaccauucucaucagaacgggccugcuagucaucuccgggguguuuccggugagcauccccauaaccgcggcagccugguacuuaugggagguaaagaagcagagggccgguguguuaugggaugugccuagcccaccgccaguugagaaagcugaguuggaggacggagcguauaggauaaagcaacgagggauccucggguacagccagauaggcgccggcgucuacaaggaggggaccuuucacacgauguggcacgugacccgaggggccguucucaugcaccgugggaagcgaaucgagcccuccugggcggacguuaagaaggaccuuauuaguuauggaggggguuggaaacucgaaggcgaguggaaagaaggggaagaggugcaggugcuggcacuugagcccgguaagaauccccgagcgguucaaacuaagcccggaauauucaagaccaacacugggacaaucggggccgucucccucgauuuuagcccgggcaccucgggaagccccauugucgacagaaaggggaagguaguagggcucuaugggaauggcguugugacccgguccggcgccuacguauccgcuauugcgcagacagaaaaguccaucgaggacaacccugagauagaggacgacaucuuccgcaagaagcggcugaccaucauggaccuccacccuggggcaggcaagaccaagcgcuaccugccagccauaguucgggaggcuaucaaacgugggcuacgcacccugauacucgcaccuacgcgggucguggcggcugagauggaagaggcccugcgcggccuaccgauccgguaccaaacgaccgccauuaagaccgagcacaccgggcgcgagaucguagaucuaaugugucaugccacauuuaccaugagguuauugucaccagugcguguccccaacuacaacuuaauaauuauggacgaggcucauuucaccgacccugcgagcaucgccgccagagguuacauuagcacgcgcgucgagaugggcgaggcugcgggaauuuucaugaccgccacgccgccaggcucccgugaccccuucccgcaauccaaugcccccaucauggacgaggagcgcgagauccccgagcggucauggaacagcgggcacgaauggguuacagacuucaagggcaaaacgguuugguucgugccuagcaucaaggccgggaaugacaucgcggccugccugcguaagaacggcaagaaggugauacagcugucacguaagaccuucgacucugaauaugugaagacccgcgccaacgacugggauuucguugugacuacagacauauccgagaugggcgcaaacuucaaggcugaacgggucaucgacccccgccggugcaugaagcccgucauccugaccgacggagaggagcgcgugauacuggcgggccccaugcccgugacacacaguagugcagcccagcggcgcgggcgcaucggucggaaucccaagaaugagaaugaucaguacaucuauaugggggagccacucgagaacgacgaagauugcgcccacuggaaggaggcaaagaugcuccuggauaauaucaacacuccggaggggaucauccccucgauguuugagccugagcgcgagaaggucgacgcgauagacggcgaauaccggcuaaggggggaggcucggaaaacguuuguggaucucaugagacggggcgaccugccuguauggcuggcguacaaggucgcugccgaggggaucaauuacgcggaccgcaaaugguguuucgauggcauuaagaauaaccagauccucgaagaaaacauggaaguggagaucuggaccaaggagggagaaagaaagaagcuaaaacccagaugguuagacgcccguauauacucagauccguuagcccuuaaggaguucaaggaauucgccgcuggccgcaagucgcugacccuuaaucugaucaccgaaaugggacgcuugcccaccuuuaugacucagaaggcucgcaacgcccucgauaacuuggcugugcugcacacugccgaggcaggcgggcgggcguauaaccacgccuuguccgagcugcccgagacacuugagacacuucugcuguugaccuuauuagcuacagucacaggcggcauuuucuuauuccugaugagugggaagggaaucggcaaaaugacccuggguaugugcuguauaaucaccgccaguaucuugcugugguacgcacaaauccagccucacuggaucgcugcgaguauaaucuuggaguuuuuccugaucguucugcugaucccggagcccgagaaacagcggacgccccaggacaaccagcucaccuacgucgugaucgcaauauuaacuguggucgcagcaaccauggccaacgagaugggcuucuuagagaaaacgaagaaagaccucgggcugggcagcaucacgacccaagaaucagaaagcaauauacuugacauagaccuucgucccgccucggccuggacacuauaugccguggcgaccaccuucgugaccccgaugcugcgacauucgauugagaacuccagcgucaacgugucccucaccgccaucgccaaccaggccacugugcugaugggcuuagggaaaggguggccccuuuccaagauggacauuggagucccccugcuggcgauagggugcuacucucaagucaaccccaucacccucaccgccgccuugcugcuccuggucgcacacuacgcaaucaucgggccaggccugcaagcgaaagcuacgagagaggcucagaagcgcgccgccgcgggaaucaugaagaacccaaccgucgacgggauaaccgugaucgaccucgaacccauccccuacgacccgaaguucgagaagcaacugggccaggugaugcuucuuauccucugcgucacccagguucugaugaugcggacgaccugggcccugugcgaggcacugacccuggccacaggacccaucuccacacuaugggagggcaaccccgggcgcuucuggaacaccaccaucgccgugucgauggcaaacaucuuccgcggcagcuaucuggccggcgccggguugcuguucucgaucaugaagaacacaacgagcacccggcgcggcacggggaacaucggagagacccucggcgagaaguggaagucccggcugaacgcacucgguaagagcgaguuccagaucuacaagaagaguggcauccaggaaguggaccgcacccuggcgaaggagggaauuaagcggggggagacugaucaccacgccgugagccguggcuccgccaagcugcggugguucguagaaaggaacauggucacuccagaaggcaaggugguggaucucggcugcgggcggggcggguggagcuacuacugcggcggacuuaagaacguccgcgaggugaagggccugacuaagggcggaccgggacacgaagagcccauucccaugagcacguacggguggaaccucgugaggcuacaguccggcguugacgucuucuucacgccgcccgagaagugcgacacccugcuuugcgacaucggcgagagcucccccaauccuaccaucgaggccggccggacccugcguguguugaaccucguagagaauuggcuaaacaacaauacccaauucugcaucaaggugcugaaccccuacaugcccucggugaucgagaaaauggaagccuugcagcgcaaguacggaggagcgcugguccggaauccucuuuccagaaacagcacacacgaaauguacugggucuccaacgcgacaggaaacaucgugucguccgucaacaugaucagcagaaugcugauaaacagguuuaccaugaagcauaagaaggccaccuaugagccagacguagaccucgguucaggaacucgcaacaucgggauugaaagcgagauuccgaaucuggacauuaucgguaagcgaaucgagaagaucaaacaggagcacgagacguccuggcacuacgaccaggaucaccccuacaagacgugggcauaccaugggagcuacgagacgaagcagaccggguccgcuagcucaaugguuaacggcgucgugcgccugcuuaccaagcccugggaugugguccccaugguaacccaaauggcgaugacagacaccaccccguucggucaacagcggguguucaaggagaaagucgacaccaggacgcaggagcccaaagagggcaccaagaagcugaugaagauuaccgccgaguggcuguggaaggaguugggcaagaagaagacaccgcguaugugcacgcgagaggaguucacccggaaggugagauccaacgccgcucugggggccauauucaccgacgaaaacaaauggaaguccgcucgggaggcgguggaggacggcagguucugggaguuaguugaccgggaacgaaaucuccacuuagagggcaaaugcgagacgugcguauacaauaugauggggaaacgggagaagaagcugggcgaguucgguaaggccaaggguagccgggccaucugguacauguggcucggcgcgcgcuuucuggaguucgaggcccugggcuuccucaaugaggaccacugguucagccgcgggaauuccuugagcggaguggaaggugagggccugcaucggcucggguacauacugcgugacguguccaagaaagagggcggcgcgauguaugccgacgacacggcgggcugggauacccggaucacgcuggaggauuugaagaacgaggagauggugacgaaccauaugaagggcgagcacaagaagcuggcggaggcuaucuucaagcugacguaccaaaacaagguugugcgcguucagcggccgacgccgagggggaccguaauggacaucaucucccggcgcgaccagcgcggcuccggucagguugggacuuauggccucaacacguuuacaaacauggaggcacagcuuaucaggcaaauggagggggagggaaucuucaaaagcauucagcaccugacugcgaccgaggagaucgcaguacagaacuggcuggcgcgcgucggccgggaacgacuuucccguauggccaucagcggagacgacugugucgugaagcccauugacgaccgauucgcguccgcccucacagcccucaacgacaugggcaaggugcgcaaagauauccagcaaugggagccaagucgaggauggaaugacuggacgcaggucccauuuugcucacaccacuuccacgagcuagugaugaaggacggccguguccucguggugccgugccgcaaccaggaugagcuuauaggccgcgcuagaaucagccagggcgcgggguggagcuugaaggagaccgcgugccugggcaagagcuaugcccagauguggacccuuauguacuuccaccgacgcgaccugcgacuggccgcuaacgcgaucugcucagccguccccagccauuggguuccgaccuccagaacgaccuggucaauacacgcuaagcacgaguggaugaccaccgaggacaugcuugcgguguggaaucgagucuggauccaggagaaccccuggauggaagacaaaacgccuguggagagcugggaggaggugcccuaccugggcaaacgagaggaccaguggugugguucccugaucggccucaccagccgggccacgugggccaagaauauccagaccgccaucaaccagguccggucucugauagguaacgaggaguacacggacuacaugcccagcaugaaacgcuuccggcgcgaggaggaagaagccgggguguugugguga

SEQ ID NO: 25101 - RNA, 9876 nt, Artificial Sequence
  derived and/or modified CDS sequence (opt11) from DENV-2__GQ199874__SS-prME
acugcuggcgugaucguaaugcugauccccaccgcuauggcguuccaccucaccacgcggaacggggagccgcacaugauuguggggcggcaggagaaggggaaaucccuacuguucaagaccgaggacggcgugaacaugugcacccucauggccauggaccugggagaacugugugaggacaccaucaccuacaagugccccuuguuacgccaaaacgagcccgaagacaucgacugcuggugcaauagcacuagcaccugggucaccuaugggacuugcaccaccacgggcgagcaccggagagaaaagcgcuccguggcucuggucccccacguugggaugggccucgagacccguacagagaccuggaugagcuccgagggugcguggaagcaugugcagcguaucgagaccuggauccugcgccacccgggcuuuacuaucauggccgcgaucuuggccuacaccaucgggaccacccauuuccagcgggcucuaaucuucauucugcugacggccguggcaccuagcaugacaaugcgcuguaucgguaucucaaaccgggacuucguggaaggggugagcggcggcuccuggguggacauaguccucgagcacgguucaugcgugaccaccauggcuaagaacaagccuacccuggacuucgagcugaucaaaaccgaggcgaagcagcccgccacacuucgcaaguacugcaucgaggccaagcugacgaacaccaccaccgagucacggugcccgacucagggcgagcccucccugaacgaagaacaggacaagcgcuucaucugcaagcauuccaugguggaccggggcugggggaacggcugcggucuuuuuggcaagggcgggaucgugaccugcgcgauguucacgugcaagaaaaacauggaggggaaaguaguucagcccgaaaaccuggaauacaccaucgucaucacgccccacagcggggaggaacaugccgugggcaacgacaccgggaagcauggcaaggagaucaaaaucacaccgcaguccagcaucaccgaagccgagcuuaccggguacggcacggugaccauggagugcagcccccguaccggccucgacuucaacgaaaugguccugcugcagauggaggacaaagccuggcucguacaccggcaaugguuccuggaccugccccuccccuggcuaccgggggccgacacucagggcagcaacuggauccagaaggagacgcugguaaccuucaagaauccucacgcgaagaagcaggacguugucguucucggcagccaggagggcgccaugcacacagcgcugaccggggccacggagauacaaaugucuuccggcaaccuccuguucaccggccaucugaagugccgcuuacggauggauaaacuccagcuaaaggguaugucguacucgaugugcaccggaaaguucaagaucgugaaggagaucgccgagacccagcacggcacgaucgugauacgcgugcaauacgagggcgacggcucccccugcaaaauucccuucgaaaucacagaccuggagaagaggcacguccucgggcgccucauaacagugaauccuaucgucaccgaaaaggacucgcccgugaacaucgaggcggagccgcccuucggcgauucauacaucauuaucgggguggagccgggccaauugaaguuaaacugguucaaaaaggggagcuccaucggccagauguucgagacuacuaugcgcggcgccaagaggauggccauccuaggggauaccgcgugggacuucggcagccuugggggcgucuucaccuccauagggaaagcccuccaccagguguucggcgcgauauacggcgccgccuucagcgggguguccuggacgaugaaaauccuuauaggcgucaucaucacguggaucgggaugaacucucgcuccaccagccuguccgugagccuggugcucgucggcguggugacccuguaucugggcgccaugguacaggcggacucaggcugcgugguuagcuggaaaaacaaggagcuaaagugcggcuccgggaucuuuaucacggacaacguccacaccuggaccgaacaguacaaguuucagcccgagagccccucuaagcuggccuccgccauccaaaaggcccaugaagaaggcaucugcgggauccgcagcgugacccgccuggagaaucuuauguggaagcagaucacacccgagcugaaccauauccuuuccgaaaacgaagugaagcucaccauuaugacgggagauauccgggggaucaugcaggccggcaagcgcagccugcgaccccagcccacugagcugaaauacuccuggaagaccugggggaaggcgaagaugcuuagcaccgagucgcauaaccagacuuuccugaucgacgggcccgaaacagccgagugcccgaacacgaaccgcgcguggaacagccuggagguugaggacuauggguucgggguguuuaccacuaauaucuggcucaagcugcgggagaagcaagauguguucugcgacuccaaacugaugagugcagccaucaaggacaaccgcgcgguacacgcagacaugggcuauuggaucgaguccgcccucaacgauaccuggaagauggagaaggccuccuucaucgaggugaaguccugccacuggcccaagagucacacgcugugguccaacggcgugcuagaaagcgagaugaucauaccgaagaacuucgccgggcccgucucccagcacaacuaccggccgggcuaccauacucagaccgcggggcccuggcaccucggcaagcuggaaauggacuucgaccugugcgaggguaccaccguuguggucaccgaagauuguggcaaccguggaccgucccuccggaccaccaccgcuucagggaagcuaaucacggaguggugcugccggagcugcacccugccgccgcuccgguaccgcggcgaggacggguguugguaugguauggagauccggccccugaaagagaaggaggagaaucuugugaacucccucgugaccgcugggcacggucagauugacaauuucagccugggcguccuagggauggcccucuuccucgaggagaugcugcgcacacggaucggcacgaagcaugcgauccuccuaguggccguauccuucgugacccugaucaccgggaacauguccuuccgugaucuggggcgagucaugguaauggucggggcaaccaugacggacgacaucggcaugggcgugaccuaccuggcccuacuugccgccuucaaagugcggccuaccuucgccgcuggguuauuacuccgcaagcugaccagcaaggaguuaaugauggccacgaucggcaucgcacuucugucccagucaacgauccccgagacuaucuuggaacuuacggacgcgcuggcccugggaaugaugguccuaaagaucgugaggaacauggagaaguaucagcuggccguuacgaucauggccaucucgugcgucccaaacgccgugaucuuacagaaugcguggaaggugagcugcacuauucucgccgccgucucuguaagcccccugcugcuuaccagcagccagcagaaagcagacuggaucccccuggcgcuaacuaucaagggcuugaacccgacagcaaucuuccucaccacacugagccgcaccagcaaaaagcgauccuggccgcucaacgaggccauuauggccgucggcauggugucgauccuggccuccagccuauuaaagaacgacauccccaugaccgguccccugguggcgggcggucugcucacagucugcuacgugcugaccggacgcagcgcggaccuagagcucgagcgggccgccgacgugaaaugggaggaucaggccgaaaucagugggucuucccccauccugaguaucaccauauccgaagauggcagcauguccaucaagaacgaggaggaagaacagacgcugaccauccucaucaggaccggucugcuggucaucagcgggguguuccccguguccauccccaucaccgcggccgcgugguaccucugggaggucaagaagcagcgggccggcgugcugugggacguucccaguccaccgcccguagagaaagccgagcucgaggacggggccuaucgcaucaagcagagaggaaucuuaggguauucccagaucggcgccggcguauacaaggaggggaccuuccacacgauguggcaugugaccaggggcgccguucuuaugcaccgggggaagcgcaucgagcccagcugggcagacgucaaaaaggaccuaaucuccuacggcgggggcuggaagcucgaaggcgaguggaaagaaggggaggaggugcaggucuuagcccuggaacccggcaagaacccccgggcgguccaaacaaagcccgguauauuuaagaccaacacgggcaccaucggggcaguuagcuuagacuucucccccggaaccucugggucccccaucguggaccgcaaggggaaggucguggggcuauacgggaacggcguuguaacccggucaggcgccuacgucuccgccaucgcgcagacggaaaaguccaucgaggauaaccccgaaaucgaggacgacaucuuccgcaagaaacggcugacuaucauggaccuccaucccggugccgguaagacaaagcgcuaccugcccgccauugugagggaggcgaucaagcgcggguugcgcacccugaucuuagccccgacgcgggugguggccgccgagauggaggaggcccuccgcgggcugcccauccgguaccagaccaccgccaucaagaccgagcacacgggacgcgagaucgucgaccucaugugccacgccaccuuuaccaugagacugcugagccccgugagagugccgaacuauaaccuuaucauaauggacgaggcgcacuucacggauccugcuuccaucgcggcccggggauacaucagcacgcgcgucgagaugggcgaggcagcggguaucuucaugaccgccaccccgcccgguucccgggaccccuucccacagagcaacgcccccaucauggacgaggaacgcgagaucccggaaaggucguggaacucagggcacgagugggucaccgacuuuaagggcaagacgguaugguucguccccuccaucaaggcugggaacgacaucgcggccugucugcgcaagaacggcaagaaagugauccaacugucgcggaagaccuucgacucggaguacgugaagacccgcgcaaacgacugggacuucgucguaaccacagacaucagcgagaugggggccaacuucaaggccgagcgggugaucgauccgcggcggugcaugaaacccgucaucuugacggauggggaggagcgagugauacuagcggggcccaugcccgugacccacuccagcgcugcccagcggcgcggucguaucggucggaauccgaagaacgagaacgaccaguacaucuacaugggggaaccccuggagaacgacgaggacugugcccacuggaaggaagccaagauguugcuugacaacaucaacacaccugagggcauuauccccuccauguucgaaccggagagggagaaggucgacgccaucgauggcgaguaccggcuaagaggugaggcgcggaagacuuucguggaccucaugcgccggggugaccugcccguguggcucgcauacaaggucgccgccgaggggauuaauuacgcugaucggaaguggugcuucgaugggaucaagaacaaccaaauccucgaggagaacauggaaguggaaaucuggacuaaagagggggagcggaagaaacuuaagcccagauggcuggacgcgaggaucuacagcgauccgcucgcccugaaagaguuuaaggaguucgccgcgggccgaaagucacugacccuuaaccugaucaccgagaugggccggcugccaacguucaugacccaaaaagcacgcaacgcucuagacaaccuggcgguguuacacaccgcugaggccgggggccgcgccuacaaccacgcgcuaagcgaacuacccgagacccuugagacguuacugcuacucacacugcuggccaccgucaccggcggcaucuucuuguuccugaugucuggcaaagggaucggcaagaugacccuggggaugugcugcauaaucacagccagcauccuccugugguacgcgcaaauccagccgcacuggauugccgccuccauaaucuuggaguucuuucucaucgugcugcuuauaccggagcccgaaaaacagcgcacgccccaggacaaccagcuuaccuaugucgugaucgccauccugaccguggucgccgcgacgauggcgaacgagaugggcuucuuggagaagaccaagaaagaccucgggcugggaucaauuaccacccaggaguccgaguccaacauccuugacauugaccuccgacccgccagcgcauggacgcuauacgccgucgcgaccacuuucgugaccccgaugcugcggcacuccaucgaaaacagcuccgucaaugugucuuugacggccaucgccaaccaggcaaccguguugaugggcuugggaaagggcuggccccucuccaagauggacauugggguacccuuacuggcgaucggcugcuauagccaggugaaccccaucacccucacggccgcacugcuccuccugguggcccacuacgccaucaucgggccgggcuuacaggcgaaggccacgcgggaggcccagaagcgugccgccgcaggaaucaugaagaaccccacggucgacggcaucacugugaucgaccucgagcccauuccuuacgacccgaaauucgagaagcagcugggucaagugaugcugcucauccugugcgucacccaggugcugaugaugcggacgacuugggcgcucugcgaagcacucacccuagccacggggccgaucagcacgcuaugggagggcaaccccgggcgcuucuggaacaccaccaucgccgugagcauggcgaacauauuccgcggcuccuaccuggcuggcgccgggcucuuauucuccauaaugaagaacaccacgaauacccggcgugggaccgggaacauuggcgagacucuuggagagaaauggaagucccggcucaaugcacucggcaagagcgaguuccagaucuacaagaaguccggcauccaggagguagaccgcacgcuggcgaaggaggggaucaagcggggcgagaccgaccaucacgccguaagccgcggguccgccaagcugcggugguucguggagcgcaacauggucacgcccgaggguaaagugguggaccucggcugcgggcguggaggguggagcuauuacuguggcggucugaagaacguucgcgaggugaagggguuaaccaagggugggcccggccacgaggaacccauaccuauguccacuuacggguggaaccucgugcgguuacagagcggcgucgauguauucuuuacgccacccgagaagugugacacucugcucugcgacaucggggaaagcucccccaaccccaccaucgaggcgggcaggacccugcgggugcugaaccucguugaaaacuggcucaacaacaacacucaguucugcaucaagguguuaaaccccuacaugccgagcguaauugagaagauggaggcccuccagcgcaaauacggcggggcgcuggugcgcaacccccugucgcgcaacagcacccacgaaauguauuggguguccaaugccaccggcaauauagucagcucagucaacaugaucagccgaaugcugaucaacagauucacgaugaaacacaagaaggcgacguacgagccggacguggaccucgggucgggcacccgaaacaucggaaucgagagcgagaucccgaaccucgacauuaucgggaagcgcauugaaaagaucaagcaagaacacgaaaccucuuggcacuaugaccaggaccacccguauaagaccugggccuaccacggaucguacgaaacgaagcagaccggguccgccagcuccauggugaacggggucgugagacuuuugaccaagcccugggacgugguccccaugguuacucagauggcuaugacagauacuacuccauucggucaacagcgaguauucaaagagaagguggacacccgcacacaagagccgaaggaaggcacuaaaaagcucaugaagaucacugccgaguggcuguggaaggagcuaggaaagaagaagacaccccggaugugcacgcgggaggaauuuacccggaaggugcggagcaacgccgcacugggcgccauuuucacagacgagaauaaguggaaguccgcccgggaggccguggaggacggucgguuuugggagcugguagaucgggagagaaaccuacaccuggagggcaagugcgagaccugcgucuacaacaugaugggcaagcgggaaaagaagcucggggaguucggaaaggccaagggcagucgugccauuugguauauguggcucggggcgcgguuccuggaguucgaggcccugggcuuccucaacgaggaucacugguucucgcgcgggaacagccugagcggcguggagggggaaggccuccaccggcucggcuacauccugcgcgacgucgggaaaaaggaaggcggggcuauguacgccgacgacaccgcgggcugggacacaaggaucacccuggaagaccucaagaacgaagagauggugaccaaccacaugaagggcgagcauaagaaguuagcugaggccaucuuuaagcugacguaucagaauaaggucgugcgcgugcagcgacccaccccgcgaggaaccgucauggacaucaucagccggcgcgaccagagagguagcggucaggucggcacauaugggcucaacacguuuaccaacauggaggcccagcugauccggcagauggagggggagggcaucuucaagucaauccagcaccuuaccgccaccgaggaaaucgcggugcagaacuggcuugcgcgcgucgggcgagaacgccucagccggauggccauuagcggagaugacugcgugguaaagccaaucgaugaccgcuucgccagcgcucugacggcucuaaacgacauggguaagguccggaaggacauccagcaaugggagcccucacgcggcuggaacgacuggacccaggugcccuucugcagccaccacuuccacgagcuggucaugaaggaugggcggguccucguggugccaugucggaaccaggacgagcucaucgggcgggcgcgcauuucccaaggcgcuggauggucacugaaggagaccgccugccugggcaaguccuaugcccagauguggaccuugauguacuuccaccgacgcgacuugcggcuggccgcgaacgccaucugcagcgccguccccagccacugggugcccaccagccgcacgaccuggucgauucacgccaagcacgaguggaugaccaccgaagauauguuagcuguguggaaucgggucuggauccaggagaaccccuggauggaggauaaaacgccgguggagagcugggaggagguucccuaccuggggaagcgcgaggaucaguggugcggcucgcugaucgggcuuaccucucgcgcuacaugggcgaaaaacauccagacagccaucaaccagguccgcucacugaucggcaacgaggaauacacggacuacaugcccuccaugaagcgcuuccggagggaagaggaggaggccggcgugcugugguga

SEQ ID NO: 25102 - RNA, 9876 nt, Artificial Sequence
  derived and/or modified CDS sequence (opt11) from DENV-2__EU482639__SS-prME
accgcgggcgugaucgucaugcugauccccaccgccauggcguuccaccuaaccacacgcaauggugagccgcacaugauagugggccggcaggagaaggguaagagucugcuguucaaaaccgaggacggcgugaacaugugcacccucauggccaucgaccugggagaguuaugcgaggacaccaucaccuacaagugcccccuccuucgccaaaacgagcccgaggacaucgacugcuggugcaacagcacaagcaccugggucaccuacgggaccugcaccaccacgggcgagcaccgccgcgaaaagcgguccguggcacuagucccccacgucgggaugggccucgaaacccgcaccgagaccuggaugagcuccgagggugccuggaaacaugugcagcggauagagaccuggauucugcgccacccugguuuuaccaucauggcagcaaucuuggccuauacgaucgggaccacucacuuucagcgggcauugaucuucauucugcugaccgccguggcgcccagcaugacaaugcgcuguauaggcaucucgaaccgggacuucguugagggcgugagcgggggcagcuggguugacaucguccucgaacacgggagcugcgugaccacgauggccaagaacaagccaacccuggacuucgagcugaucaagaccgaggccaaacagcccgcgacccuccguaaguacugcauugaggccaagcugacaaacaccaccaccgagucacggugcccgacgcaaggcgaacccagccugaacgaggagcaggacaagcgcuuuauuugcaagcacucaauggucgaccggggcuggggcaacgguugugggcuguucggcaagggcgggaucgugacuugcgcgauguucacgugcaagaagaacauggaggggaagguggugcagccagagaacuuggaauacaccaucguuaucacgccccauaguggggaggagcacgccgugggcaacgauaccggcaagcacggcaaggagaucaagaucaccccgcagaguagcaucaccgaggccgagcugaccgguuacgggacggugaccauggaaugcagcccccgcacgggccucgacuucaaugagauggugcugcugcagauggaggacaaggccuggcucgugcaccggcagugguuccuggaccugcccuuacccuggcugccuggggcggacacccagggcagcaauuggauccagaaggagacgcucgugaccuuuaagaacccccaugcgaaaaagcaggacgucgugguccucgggucccaggaaggcgccaugcacaccgcccugacuggggccacggagauccaaaugagcagcggcaaccuccuauucaccgggcaccugaagugccgccugcggauggacaaguuacagcuuaaagggaugucguauagcaugugcacggggaaguucaagauugugaaggaaaucgccgaaacccaacaugggacgaucguuauccguguccaguacgaaggcgauggcucccccugcaagauccccuucgagaucacugaccuggagaaacggcacgugcucggacgccuaaucaccgugaacccaaucgucacugagaaggacaguccggugaacaucgaggcggagccgccauuuggcgacucguauaucaucaucggcguugagccagggcagcucaagcucaacugguucaaaaaggggucguccauuggccagauguucgagacaaccaugcggggagccaagcggauggccauccugggggacaccgccugggacuucggcagccucgggggagucuucaccuccaucgggaaggcccuccaccagguguucggcgcuaucuacggcgccgccuucagcgggguguccuggacaaugaaaauccugaucggcguuauuaucaccuggaucgggaugaacagccgcucuaccagccuguccgugagccuggucuuaguaggcguggugacccucuacuugggugccaugguccaggcggacuccggcugcguggugagcuggaagaacaaggagcucaagugcggcuccgggaucuuuaucacggacaacguccacaccuggacagagcaguauaaguuccagcccgagagcccaucgaaguuagccuccgcgauccaaaaggcacaugaggaaggcaucugcggcauacggucugugacccgccuugagaaccucauguggaagcaaaucacaccagagcugaaccacauccugagcgagaacgagguuaaauugaccaucaugaccggcgacauccggggcaucaugcaggcugguaaacggagccugagaccgcagccaaccgagcugaaguacuccuggaagacguggggcaaagcgaagaugcucagcaccgagucccauaaccagaccuucuuaaucgacgggcccgagacugccgagugcccaaacacgaaccgcgccuggaacagccuggaggucgaggacuacggauucgggguguucacuaccaacaucuggcucaaacugcgggagaagcaggacguuuucugcgacuccaagcugaugagugccgccauaaaagacaaccgcgcaguacacgccgacaugggcuacuggauagaguccgcccucaacgacaccuggaagauggagaaggcgagcuucaucgaggugaaauccugucacuggcccaagucacacacccugugguccaacggcgugcuagagagcgagaugaucauacccaagaacuucgccgggcccgucagccagcacaauuaucgaccuggcuaccacacgcagaccgcggggcccuggcaccucggcaagcuggagauggacuucgaccugugugaggggaccaccguuguggucaccgaggacugcggcaaccgcggcccuucgcucagaaccaccaccgccucagggaaguugauaacggagugguguugucgcuccugcacccugccgccgcugcgguaccgcggggaggacgguugcugguacggcauggagauacggccccugaaagagaaggaggagaaucuggugaauagccucguaacagccgggcauggccagauugacaauuucucccugggcguccuggggauggcccuuuuccuggaggagaugcugcgcacccgaaucggcacuaagcacgcuauucuccugguggcuguaagcuucgucacacuaaucaccgggaacauguccuuccgcgaccucggccgcgugauggugauggucggcgcuaccaugacggacgacaucgggaugggcgugaccuaccuagcccugcuugcagcguucaaggugcggcccaccuucgccgcugggcuguugcuccgcaagcugaccagcaaggaguuaaugauggccacgaucggcaucgccuugcuaagucaguccaccauccccgagacgauccuggaacucacagacgcacuugcccuggggaugaugguauuaaaaaucguaagaaacauggagaaguaccagcuggcggugacgaucauggccaucuccuguguaccgaacgccgugauccugcaaaacgcguggaaggugagcugcaccauccucgcggccgucuccguaagcccccugcucuugaccucuagccagcagaaggccgacuggauuccccuggcgcugaccaucaaggggcucaaucccacggccaucuucuugaccacauugucccgcaccagcaagaaaagguccuggccgcucaacgaggccauaauggccgugggcauggugagcauccuggccuccagccugcucaagaacgacauccccaugacgggacccuuggucgcgggcgggcuucucaccgucugcuaugugcugaccggccguagcgccgaucuggaauuggagcgagccgccgaugugaagugggaggaccaggccgagaucuccgggagcucccccauccugagcaucaccaucagugaggacggcucaaugucaauaaagaacgaggaggaggagcaaacacugaccauccucauccgcaccggccucuuagucaucagcgggguguucccgguguccauccccaucaccgcggccgcaugguaccucugggagguaaagaagcagcgggccggcguccugugggaugugcccagcccgcccccagucgagaaggccgagcuggaggacggggcauaccgcaucaagcagcggggcauccucggguacucacagaucggggccggcguguacaaggaggggaccuuccacacgauguggcacgugacccggggugccguucugaugcaucgagggaagcguaucgagcccagcugggccgacgugaagaaggaccugaucaguuauggcgggggcuggaagcuugagggcgaauggaaagagggagaggaggugcagguccuggcccuggaacccgguaagaacccgcgggcggugcagaccaagcccgggaucuuuaagaccaacacgggcaccaucggggccgugucauuggacuucucccccggcaccucaggcucccccaucgucgacaggaaggggaagguggugggccucuacggaaacgggguugugacccggagcggcgcuuacguguccgccaucgcgcaaaccgagaaguccaucgaggacaaccccgaaaucgaggacgacaucuuucgcaagaagcggcugaccauuauggaccuccacccuggggcgggaaaaacaaagcgcuaccugcccgccaucguccgggaggccaucaagcgagggcugagaacccugauccuugccccgacgcgggugguggcugccgagauggaagaagcccugagaggccugccaauccgguaccagaccaccgcuaucaagaccgagcacaccggucgugagaucgucgaccucaugugccacgccaccuucaccaugcggcucuugucgcccguccgcguccccaacuacaacuuaauaaucauggacgaggcgcauuucaccgacccggcgucaaucgccgccagaggcuacauuagcacgcgcgucgagaugggcgaggccgccgggauuuucaugacggccaccccucccggcucaagggaccccuucccgcaaagcaacgcgccaaucauggacgaggagcgcgaaauccccgagcgguccuggaacagcggccacgagugggugaccgacuucaagggcaaaacggugugguuugucccuuccaucaaggccgguaacgauauagcggccugccugcgcaaaaacggcaagaaggugauccagcuaagccgaaaaaccuucgauuccgaguacgucaagacccgcgccaacgacugggauuucgucguuaccacggauauaagcgagaugggcgccaauuucaaggcggaacgggugaucgacccgcgccgguguaugaaacccgucaucuuaaccgacggagaggagcgcgugauacuggcgggaccaaugcccguaacgcacuccagcgccgcccagcggcgcggacggauaggccgcaacccgaagaacgagaacgaccaguacaucuacaugggggagccccuggagaacgacgaggacugcgcccacuggaaggaggccaagaugcuccuggacaacaucaauacccccgaggguaucaucccauccauguucgagccggagcgcgagaaggucgacgcgaucgacggcgaauaucggcugcgcggcgaggcccggaagacguucguugaccucaugcgcaggggagaucugcccguguggcuagccuacaagguagccgccgaggggauuaauuacgcggaccgcaaguggugcuuugacgguaucaagaacaaccagauccucgaggaaaacauggagguggaaaucuggacaaaggagggggagcggaaaaagcugaagccccgcuggcuggacgcccggauuuacagcgauccccucgcgcugaaggaguucaaggaauucgcugcgggccgcaaguccuugacccucaaccugaucaccgagauggggaggcugcccacguuuaugacccagaaggcccgcaacgcccucgauaaccuggcagugcuccacaccgccgaggccgggggccgggcauacaaucaugcacucagcgagcugccagagacccuggaaacgcuccuucugcucacccugcuggccaccgucaccgguggcauauuccucuuccugauguccggcaaggggaucggcaagaugacccuggggaugugcugcauaaucacagccagcauauugcugugguacgcgcaaauccagccccacuggaucgccgccuccaucauccuggaguucuuccucauugugcugcucaucccggagcccgagaagcagcgcacaccacaggacaaccagcucaccuacguugugaucgccauccugaccguggucgccgcgacgauggccaaugaaaugggauuccuggagaagaccaaaaaagaccucgggcugggcagcaucaccacgcaggagucagagucgaacaucuuggacaucgauuugcggcccgccagcgccuggacgcuguaugcaguggcgaccacccuggugaccccuaugcucagacacagcauagaaaacuccuccgucaacgugagccugacggccaucgccaaucaggccaccgugcuaaugggccucgggaagggcuggccccuguccaaaauggacaucggggucccccuccucgcgaucggcuguuacucacaggugaaccccauuacccugaccgccgcccuguuacuccugguggcccacuacgccaucauugggccgggccuccaggcgaaggccacgcgggaggcccagaaacgugccgcugcgggcaucaugaagaaccccaccguugacgggaucaccguaaucgaucuggaacccauccccuacgacccgaaguuugaaaagcaguuaggccaagugaugcuccugauccugugcgucacgcaggugcucaugaugcggacgaccugggcccugugcgaggcccugacccucgccaccggaccuaucuccacccugugggagggcaaccccgggcgcuucuggaacaccaccaucgccgugagcauggcgaacaucuuccgcggcucauaccuggcgggcgcaggucuccuguucagcaucaugaagaacaccacgaacacccggcgcggcaccgggaacauuggcgagacccuaggcgaaaaguggaaaucgcggcuuaacgcccugggcaagucagaauuucagaucuacaaaaaguccggcauccaggaggucgaccgcacguuagcaaaggaggggaucaagaggggggaaaccgaccaccaugcugugagccgugggagcgccaagcugcggugguuuguggagcgcaacauggucacccccgagggcaaggugguagaucuggguugugggcggggcggguggagcuacuacuguggcgggcugaagaacguccgcgaggugaagggccucaccaagggcgggccgggccacgaggagcccauccccauguccacguacgguuggaaccuggugcggcugcagagcggcgucgacguguucuucacgccgcccgagaagugcgaaacccuccugugugacauaggggagucuucccccaaccccaccaucgaggcaggccgcacccuacggguguuaaaccugguagagaacuggcugaauaauaacacgcaauucugcauaaaaguacucaaccccuauaugcccagcgugaucgagaagauggaggcccugcagcgcaaguauggcggggcgcugguccggaacccccugagucgcaacagcacccacgagauguacuggguguccaaugcgaccggcaacaucgucagcuccguuaacaugaucagccggaugcucaucaaccgguucaccaugaaacacaagaaggccacguacgagccggauguagaccuugguucuggaacccggaauaucgggaucgagagcgagauuccuaaccuugacaucaucgggaagaggaucgagaagaucaagcaagagcacgagaccuccuggcacuacgaccaagaccaccccuauaaaacuugggccuaccacggcagcuacgaaacuaagcagaccggguccgcuagcuccaugguuaauggggucguccgucuccugaccaaacccugggacgugguccccauggugacccaaauggcgaugacugauaccaccccuuucgggcagcagcggguauucaaggagaaggucgacacccgaacgcaggagcccaaggagggcacaaagaagcuuaugaagauaaccgccgaguggcucuggaaggagcugggcaagaagaagacgccccggauguguacgcgcgaggaguucacccggaaggugcgcaguaacgccgcccugggugcuaucuucacggacgagaacaaauggaaguccgcgcgugaggccguagaggacggccgauucugggagcucgucgaccgggagcgcaacuuacaccuggaggggaagugcgagaccugcguguacaacaugaugggcaaaagggagaagaaauuaggcgaguucgggaaggcgaagggaagcagggccaucugguacauguggcugggggcacgguuccuggaguucgaggcccucggcuuccugaacgaggaccauugguuuucccgcgggaauagccuuagcgggguggaaggggagggucuccaccggcuuggcuacauucugcgcgaugucgguaagaaggaaggcggugccauguacgccgacgacacggccggcugggacacccggaucacucucgaggaccugaagaacgaggagauggugacgaaucacaugaagggggagcacaagaagcucgcggaggccaucuucaagcucacguaccagaauaaggucgugcgcgugcagcgaccaaccccgcgcggcaccguuauggacaucauuaguaggcgagaccagcgcggcagcggacaagucggcaccuacgggcugaacacguucaccaacauggaggcacagcugauccggcagauggagggcgagggcaucuuuaagucaauccagcaucucaccgccacagaagagaucgccgugcagaacuggcuggcacgcgucggccgggagcgccugagcagaauggcgauuuccggcgacgacugcguugugaagcccaucgacgaccgcuucgccagcgcccucacggcccugaacgacauggggaaaauccgaaaggacauacagcagugggagcccuccagaggcuggaacgacuggacccaggucccuuuuugcagccaccacuuccacgagcucgugaugaaagauggacgggugcuggucgugccuugccgcaaccaggacgagcugaucggccgagcgcgcauaucgcagggcgcgggguggagccugaaggaaacggccugccucggcaaguccuacgcgcagauguggacccugauguacuuucaccggcgcgaccugcggcucgccgcuaacgccaucugcagcgccgugcccucccauuggguccccaccagccgcacuaccugguccauacacgccaagcacgaguggaugaccaccgaggacauguuagcgguguggaaccggguguggauacaggagaacccguggauggaggacaagacgccggucgagagcugggaggaggugcccuaucuggggaagcgcgaggaccaguggugcgguuccuuaaucggacugaccagccgggccaccugggcgaagaacauucagacggcgaucaaccaagugcgcagccugaucggcaacgaggaauacacggacuacaugccuucgaugaagcgcuuucgucgcgaggaggaagaggccggcguccucugguga

SEQ ID NO: 25103 - RNA, 9876 nt, Artificial Sequence
  derived and/or modified CDS sequence (opt11) from DENV-2__EU482766__SS-prME
accgcgggcgugaucgucaugcugauccccaccgcuauggccuuccacuugaccacccgaaacggggagccccacaugauagugggccggcaggagaaggggaagagccugcuguucaagacggaagacggcgugaauaugugcacacucauggccauugacuugggggagcuaugcgaggauaccaucaccuacaagugcccgcuucugcgccagaaugagcccgaggacauugacuguuggugcaacuccacaagcacuugggucaccuacgggacgugcacaaccacgggugagcaccgccgagagaaacgguccguggcuuuagugccccacguagggaugggccucgagacccgcacagagaccuggaugagcagugagggcgccuggaagcacgugcagcggaucgagacguggauacugcgccaccccggcuucaccaucauggccgcgauucuggccuacacaaucgggaccacccacuuccagcgggcacucaucuuuauacuccucacugcuguggcacccagcaugacaaugcgcuguauuggcaucucgaaccgggacuucgucgagggcgugucuggugguucuuggguagauaucgucuuggagcacggaagcugcguuaccacgauggccaagaacaagccuacccuggacuucgagcuuaucaagaccgaggccaagcagcccgccacucucaggaaguacuguaucgaggcuaaacugaccaacaccaccaccgagucucguugucccacgcaaggcgagcccaguuuaaacgaggaacaggauaagagauucaucugcaagcacuccaugguggaccggggcugggggaacggcugcgggcucuuuggcaagggcgguaucgugaccugcgcgauguucacguguaagaagaauauggagggcaaggugguucagcccgagaaccuggaauacaccaucgucaucaccccccauagcggggaggagcacgccgugggcaacgacacggggaagcacggcaaggagaucaagaucacaccgcagucuagcauaaccgaggcggagcugaccggguacggcacggugaccauggagugcaguagcaggaccggccucgacuucaacgaaaugguccuucuucagauggaggacaaggccuggcucguccaccgccagugguuccuggaccucccucucccauggcucccgggggccgauacccagggcuccaauuggauucagaaggagacgcuggugaccuucaaaaacccucaugccaaaaagcaggacguagugguccucggcucccaagagggggccaugcacacggcccuuaccggugccaccgagauccaaaugagcuccggcaacuugcuuuucaccggccacuuaaagugccgccugcggauggauaagcuccagcugaaggggaugagcuacuccaugugcaccggcaaguucaagaucgugaaggaaaucgccgagacucagcacgguacgaucguuauacgcgugcaguacgagggcgacggcagcccgugcaaaauccccuucgagauaaccgaccuggagaagcggcacguucucggaagguugaucaccgugaaccccaucgucacugagaaggacuccccggugaauaucgaagcggagccgcccuucggagacuccuauauuauuaucgggguggagccuggccaacucaagcucaacugguucaagaaagggagcagcauagggcagauguucgagacgaccaugcgcggcgccaagcggauggcgauccugggggacaccgccugggacuucgguuccuugggaggcgucuucaccagcaucgggaaggcccuccaccagguauucggcgcgaucuauggcgccgccuucucuggggugagcuggacgaugaagaucuugaucggcgucaucaucacguggaucgggaugaacucccgcagcaccucacugagcguaucucuugugcugguugggguggugacccuauaccugggggccgucguccaggcggacagcgggugcguuguuuccuggaaaaauaaagaacucaagugcgguagcgggaucuuuaucacggacaaugugcacacguggacagagcaguacaaguuccagcccgaguccccuucgaagcuggccagcgccauccagaaggcccacgaggaaggcauuugcgggauccgguccguaacccgacuggagaaucucauguggaagcagaucacgccugagcugaaccacauacugucggagaacgaaguaaagcucacgaucaugacaggggacaucaaggggaucaugcaggccggcaagcggucccuacggccccagccgaccgagcugaaauacagcuggaagaccugggguaaagcgaagaugcucuccacagaaagccacaaccaaacuuuccugaucgaugggcccgagaccgccgaaugccccaauacgaaucgcgccuggaacucucuggagguggaggauuacggauucgggguguucaccacgaacaucuggcucaagcugagagagaagcaagacgucuucugcgauucgaagcugaugagugccgccaucaaggacaaccgggcggugcacgccgauaugggcuacuggaucgaaagcgcccuaaaugacaccuggaagauggagaaggccuccuucauugagguuaaaagcugucacuggcccaaaucccacacccuguggagcaacggugugcucgagagugagaugaucaucccuaagaauuuugcggggccugugucgcagcacaacuaccgcccgggcuaucacacgcaaaccgcgggaccguggcaccucggcaagcuggagauggauuucgacuuuugugaagggaccacgguggucguuacggaagacugcggcaacaggggcccuagccugcggacgaccacggcuuccgggaagcucaucacagaguggugcugccggagcuguaccuugccgccccugcgcuaccguggcgaagacgggugcugguauggcauggagauccgcccgcucaaggagaaggaggaaaaccuggugaauuccuuaguuaccgccgggcaugggcagaucgauaacuucagucuagggguccuggggauggcgcuguuccuggaagaaaugcugaggacccgcaucggaacgaaacacgcgauccugcucguggccgucuccuucgugaccuugaucaccgggaacaugagcuuccgggaucuuggccgcgugaugguaauggucggggccacuaugacggacgacaucggcaugggcgugaccuaccucgcgcugcuggccgcguucaaaguaagacccaccuucgcugccgggcuccugcugcggaagcucaccuccaaagagcugaugauggccacgauuggcaucgcccugcucagccaguccacuauccccgagacuauacuagaacugacggacgcgcucgcccuggggaugauggugcugaagaucgugcgcaacauggaaaaguaccagcucgccgucacaaucauggccaucuccugcgugccaaacgccgugauucugcaaaacgcguggaaggucagcugcacaauccuggcugccgugucagucagcccgcuucugcuuacgagcucccagcaaaaggccgacuggaucccacucgcucugaccaucaagggacugaaccccacggcaaucuuccucaccacgcugagccgaaccuccaagaaacguagcuggccccugaacgaggccaucauggcuguuggcaugguguccauccucgcgucuagccuucugaagaacgacaucccgaugacggggccccucgucgcgggcggccuucugacuguaugcuacgugcuuacgggccgguccgccgaccuggagcuggagcgcgcugcagacgucaagugggaggaccaggccgagaucagcgggaguuccccaauccuuuccaucacaauuagcgaggaugguuccaugagcaucaagaacgaggaggaggagcaaacacugacgauccugaucagaaccggccucuuagugaucuccggcguguuccccgucaguauaccgaucaccgcagccgccugguaucugugggagguaaagaagcagcgcgcgggggugcucugggacguccccucucccccgcccguggagaaggccgagcuggaggauggggccuaccgcauaaagcaacgcggcauucuggguuacucgcaaauuggcgccggcguguacaaggaggggaccuuccacacgauguggcacgucacgcggggcgcugucuuaaugcaucgcgggaagcggaucgagccauccugggccgacgugaagaaggaccugaucucguacggcgggggguggaaguuggagggcgaguggaaggagggcgaagaaguccagguccuugcccuggaacccgggaagaacccccgcgcugugcagaccaagccagggaucuucaaaaccaacacggguaccaucggggcagucucccuggacuucagccccggcacaucgggcagcccuauuguugaccgaaaggggaaggugguaggccucuacggaaacggcguggugacucgcucaggcgccuacgucagugcgaucgcgcagacggagaaauccaucgaggauaacccggagaucgaggacgacauauuccggaaaaagcgccugaccaucauggaccugcacccgggggccggcaaaaccaagcgguaccucccugcaaucgugcgcgaggccaucaaacgggggcugcgaacccugauacuggcuccuacgcgcguggucgcggcagagauggaggaagcccucagaggacugccgauucguuaccaaaccccagccaucaagaccgagcauacggggcgggagaucguagaccugaugugccacgccacguucacgaugcgccuccuguccccagugcgggugcccaacuacaaccucaucauuauggacgaggcgcacuucaccgacccggccuccauagccgcccgcggguacaucuccacccggguggagaugggcgaggcagcgggaauuuucaugacggccacgccgcccggcagcagagaccccuuuccgcaauccaacgcccccauuauggacgaggaacgugagauccccgagcgcucguggaacuccgggcacgagugggugaccgacuucaagggcaaaaccgugugguucgugcccucgaucaaagcggggaaugacauagcggcgugucuccggaaaaacggcaagaaggugauccagcugucacgcaagacguuugacucugaguacguuaagacccgcgccaacgacugggacuucguggugacaacagauauuuccgagaugggcgccaacuucaaggccgagcgcgucaucgacccgcggaggugcaugaagcccguaauccugacggacggggaggaacgcgugauccucgccggccccaugccagucacccacucuucggccgcccagcgccgugggcgcaucggcagaaacccaaagaaugagaacgaccaguacaucuacaugggugagccgcuagagaacgacgaggauugcgcccacuggaaggaggcuaagaugcugcucgacaacaucaauacccccgaggguauuauccccaguauguuugagccggagcgggagaaaguggacgcgaucgauggcgaguaccgccugcgcggcgaggcucgcaagaccuucguggacuugaugcggcgcggugacuuacccgucuggcuggccuacaagguggccgccgagggcauaaauuacgcggaccguaagugguguuucgacggaaucaaaaacaaccagauccuugaagaaaacauggaggucgaaaucuggacuaaggagggagaacgcaagaagcucaagccgcgguggcuggacgcccgcaucuacuccgacccccuggcccucaaggaguucaaggaauucgccgcgggccgcaagagccugacccugaaccucaucaccgagaugggccgccugccuaccuucaugacucagaaagcccggaacgcacuggacaaccucgcagucuuacacaccgccgaggccgggggccgcgccuacaaccacgcccuuagcgagcucccugagacccuggagacccugcuccugcugacuuugcuggccacugugaccgggggcaucuucuuguuccucaugagcggcaaggggaucggaaagaugacccugggcaugugcugcaucaucaccgccuccauccuacucugguacgcgcagauccagccccauuggaucgccgcgagcaucauccuagaguucuuccugauagugcucuuaaucccggagccagagaagcaacggacgccccaagacaaccagcugaccuacguggugaucgcuauucucaccgucguggccgcgaccauggcaaaugagaugggcuuccuggagaagacgaagaaggaccuggggcucgggagcaucacuacccaggaguccgagagcaacauccuggacaucgaccuccgccccgccuccgccuggacccucuaugccgucgcuaccaccuucgugacgccgaugcugcggcacagcaucgagaacucaagcgugaacgugucacucaccgccauagccaaccaggccacaguccucaugggacugggaaagggcuggccccugagcaagauggauaucggugugccccuccuugccaucgguugcuacucgcaggugaaucccaucacucuaacggccgcccuacuacuccucgucgcccauuacgccauaaucgggcccggucugcaagcgaaagccacccgcgaggcacagaagcgagccgccgcgggcaucaugaagaaccccacuguggacgggaucaccguaaucgaccuggaaccgauccccuaugacccgaaguucgagaagcagcucggccaggucaugcuccugauccugugcgugacgcaggugcugaugaugcgcacaaccugggcacuuugcgaggcccucacccuugccaccgggcccaucagcacccugugggagggcaaucccggucgguucuggaauaccacgaucgcagucuccauggcgaauaucuuccgcggcagcuaccucgcaggggccgggcuguuauucuccauaaugaagaacaccacaucuacgcgccggggcaccgguaacaucggcgaaaccuugggcgaaaaguggaagucgcgacuaaacgcccugggcaagucagaguuccagaucuacaagaaauccggcauccaagagguggaccguacacucgcgaaggagggaauaaagcgcggcgagaccgaccaccacgcagugagccggggguccgccaagcugcguugguuugucgagcggaauauggugacccccgagggcaaagugguagaucugggcugcgggcgcggcggcuggagcuacuacugcggcggguuaaagaacgugcgugaggucaagggccugaccaagggcggaccuggccacgaagagccuauccccaugagcaccuauggguggaaucugguccgccuucagucuggcguugauguauucuuuacgcccccugagaaaugcgauacccugcugugcgauaucggggaaucuucccccaaucccaccaucgaggccggcaggacccuccgcgucuugaaucugguugagaacuggcuaaauaacaacacacaguucugcaucaagguccugaaucccuauaugccuucggucaucgagaaaauggaagcccugcagagacaauauggcggggcccucgugcgaaacccacuguccagaaauagcacgcacgaaauguacuggguguccaacgccaccggcaacaucgucagcuccgugaacaugaucagccgcaugcugaucaaccgcuucacuaugaagcacaaaaaggcuaccuacgagccagacguggaccucggguccgguacgcgcaacaucgggauugaaagcgaaaucccgaaccucgacaucaucggcaagagaaucgagaagaucaagcaggagcacgagaucuccuggcacuacgaucaggaccaccccuacaagaccugggcuuaccacgguagcuacgagaccaagcagaccggcuccgccagcagcauggucaacggcgugguucgccugcugacgaagccaugggacgucgugcccauggugacccaaauggcgaugaccgacacaaccccguucggccagcagcgcgucuucaaagagaagguggacacccggacucaagagccgaaggagggcaccaagaaacucaugaagauuacagccgaguggcuguggaaggagcugggcaagaagaaaacgccccggaugugcacccgggaggaguucacacguaaggugagaagcaacgccgcccucggggccaucuucacggacgagaacaaguggaagucugcacgcgaggccgucgaggacggcagguucugggaacugguugaccgugagcggaaccugcaccucgaggggaagugcgagaccugcguuuacaacaugaugggcaagcgggagaagaaacugggagaguucggcaaggcaaagggcagcagagccauuugguacaugugguugggggcgcgcuuccucgaguucgaagcccugggcuuccugaacgaggaccacugguuuagccgggggaacucccucagcggcguggagggggaaggccugcaccgccugggcuacauucucagagacguggguaagaaggaaggcggggccauguacgccgacgacaccgccggcugggauacccgcaucacgcuggaggaccugaagaacgaggagaugguaaccaaccauaugaagggugaacacaaaaagcucgcggaggccauauucaaguuaacguaccaaaacaagguaguccggguccagcgccccaccccgcggggcacgguuauggacaucaucucucgccgagaccagcgcggcucggggcagguaggaacuuacggccugaacaccuuuaccaacauggaggcccaguuaauucgccaaauggagggggaaggcauauucaagucaauccagcaccugacggccaccgaagaaaucgcgguccagaacuggcucgcgagaguggggagggagcgucuuucucgcauggccauuuccggugacgauugcgucgucaagccgaucgacgaccgguucgccagcgcccugaccgcccugaaugauauggggaaagugcgaaaggacauccagcagugggagcccucccguggcuggaacgauuggacccaaguacccuucugcagccaccacuuucacgagcucguuaugaaggacgggcgcguguugguggucccaugcaggaaccaggacgaacucaucggccgcgcccggaucucccagggagcgggguggagccucaaggagacggccugccuaggcaagucauacgcccagauguggacccugauguauuuccaccgccgggaucuucgccuggccgccaacgccaucuguagcgcggugcccucgcacuggguucccaccucucgaaccaccuggagcauccacgccaagcacgaguggaugacgaccgaggacaugcuagcgguauggaaccgcguguggauacaggagaaucccuggauggaggacaagaccccgguggaguccugggaggaggucccauaccucggcaaacgggaggaccaguggugcggaucacugauagggcuaaccucacgcgcaacgugggccaagaacauacagaccgcuauuaaucaagugcggucgcucaucggcaacgaggaguacaccgauuauaugcccuccaugaagcgcuucaggcgggaggaagaggaggccggggugcuuugguaa

SEQ ID NO: 25104 - RNA, 9876 nt, Artificial Sequence
  derived and/or modified CDS sequence (opt11) from DENV-2__EU482695__SS-prME
acggcgggcgugaucgucauguuaaucccuacugcgauggcguuccaccucaccacccgcaacggggaaccgcauaugaucguggguaggcaggaaaaagggaaaucccugcuguucaaaaccgaggauggcgugaacaugugcacccuuauggccaucgaccugggggagcuaugcgaggacacgauaaccuacaaaugcccccuguugcgacaaaaugagcccgaggacaucgauugcuggugcaauuccacaaguaccugggucacguacgggaccuguaccacuacuggagagcaccggcgggaaaagagguccguggcccucguaccccacguagggaugggccucgaaacccgcaccgaaaccuggauguccagcgagggggcuuggaagcaugugcagcgcaucgagacguggauucugcgccauccgggauuuaccauaauggccgcaauacuagccuacacuaucgguaccacccacuuucaacgggcccuuaucuuuauccuccugaccgccguagcgcccagcaugaccaugaggugcauuggcauaucuaaccgggacuucgucgagggugugagcgggggcuccuggguggacaucguccuggagcacggcagcugcgucacaacgauggccaaaaacaagcccacacuggacuucgagcugauuaaaacagaagcuaagcagcccgcuacacuccgcaaguauugcaucgaggcuaagcugacgaauaccaccaccgagucccggugucccacgcagggggagcccagcuuaaacgaagaacaggacaaacguuuuaucugcaagcacucaaugguggaccgcggcugggggaacggaugcggguuguuuggcaagggcgggauaguaaccugcgcgauguucacaugcaagaagaacauggaggguaaggugguacagcccgagaaccuggaguacacuaucguaaucacaccccacaguggcgaagaacaugccgugggcaacgacacggggaaacauggcaaggagaucaagaucaccccgcaguccagcaucaccgaggcagagcugacgggguacgguaccgugaccauggagugcucgccccgcaccggccuggauuucaacgagaugguccugcugcagauggaagacaaggccuggcucgugcaccggcagugguucuuggauuugcccuuacccuggcugccgggggccgacacgcagggcucaaacuggauccagaaggagacgcuggugacuuucaagaacccccacgcgaagaaacaggacgucgugguacucgggucccaagagggcgccaugcacacggccuugaccggugccacggagauccagaugaguagcggaaaccuccucuuuacuggucaccugaagugucggcugcgcauggauaagcuccagcuaaaggggauguccuacuccaugugcaccggcaaguucaagauagugaaggagaucgccgagacccagcaugggacgauugugauucgcguccaguacgaaggggacggcuccccaugcaagauccccuucgagauaaccgaccuggaaaagaggcacguacucggccgccugauuaccgugaacccgaucgucaccgagaaggacagccccgucaacauagaggcggagccgcccuucggcgacucauacaucaucaucggaguggagccggggcaacugaaguuaaacugguucaagaaggguucguccaucggccagauguucgaaacgacuaugcgcggcgccaagcggauggccauccugggagacaccgcuugggacuucggcagccucggaggggucuuuaccagcaucgggaaggcccuccaccagguguucggcgcgaucuacggagccgccuucucugggguaucauggacgaugaaaauccugaucggagucaucaucacguggauagggaugaacagcagguccaccagcuuguccgugagccuggugcucguaggcguggugacccuauaucuaggggccaugguccaggcggauuccggcugugucgucagcuggaagaacaaggagcucaagugcggcuccggaaucuuuauuacagauaauguccauaccuggaccgagcaguacaaguuccagcccgagagccccagcaaacucgccuccgccauccaaaaggcccacgaggagggcauaugugggauucgcagcgugaccaggcuggaaaaccucauguggaagcagaucacgcccgagcugaaccauaucuuauccgagaacgaggugaaguuaaccaucaugaccggagacauccgggggaucaugcaggccggcaaacguucccugagaccgcaacccacugagcucaaguacucuuggaaaacgugggggaaggcgaaaauguuaagcaccgagucccacaaccagaccuuccugaucgacgggccggagacagccgaaugcccgaauacuaauagggccuggaacucuuuagaggucgaagacuacggauucgggguguucaccacuaacaucuggcugaagcuacgggagaagcaggacguguucugcgacuccaagcugaugagcgcugccauaaaggauaaccgggcggugcacgccgacaugggguacuggauugaauccgcucucaacgacacguggaagauggagaaagccagcuucaucgaggugaaguccugccacuggcccaagagccauacccuguggucaaacgguguguuagagagugagaugaucauucccaagaacuucgccgggccuguaagucagcacaacuacagaccggguuaccacacgcaaaccgcggggccuuggcacuugggcaagcuggagauggacuuugaccugugcgaggggaccaccguaguggucacggaggacugcggcaaccgcggcccgucacuccggacaacgaccgccucugggaaacugaucacggaguggugcugccgcaguugcacccuucccccucuccguuaccgcggcgaggacgggugcugguacggcauggagauucggccacugaaagagaaggaggagaaccuggugaacagccuggugacagccgggcacgggcagaucgauaacuucagccugggcguguuagggauggccuuguuccuggaagagaugcugcgcacucggaucggcacgaagcacgcgauccuccugguggccgugagcuuugucacacugaucaccgggaacauguccuuccgagaccucggccgcguuauggugauggucggggccaccaugacggacgauaucggcaugggcgugacauaccuggcccugcucgccgccuucaaagugcggccaaccuucgccgccggucuucuguuaaggaagcugacauccaaggagcugaugauggcaacgaucggcaucgcccuccugucccagagcaccauccccgagaccauccuggagcucaccgacgcccuggcacuggggaugaugguacucaagaucguccggaacauggagaaguaucaacuugccgugacuauuauggccaucuccugcgucccgaaugccgugauacuccaaaacgcguggaaggugucgugcaccauacuggcagcggucuccgugaguccccugcugcucaccaguagucagcagaaggcagacuggauccccuuagcucugaccaucaaagggcucaaccccacggccauuuuccugacgacccugucccgcaccuccaagaaacgguccuggccucucaaugaggccaucauggcggucggcauggugucgauccuggccaguagccugcucaagaacgauauaccaaugacggggccccugguggcggguggguugcucaccgucugcuaugugcugacgggccgcagcgccgaccuggagcuagagcgggcugccgacgugaagugggaggaccaggcagagaucuccggcagcuccccaauccugagcaucacgaucuccgaagacggcuccaugagcaucaagaaugaggaggaggagcagacgcugacgauacucauccgcaccgggcuucuggucaucagcggaguguucccggucuccauccccauuaccgcggccgccugguaccucugggaggucaaaaagcaaagggccggggugcugugggacguacccagcccuccacccgucgagaaggccgagcuggaggacggggcguaucguaucaagcaaagaggcaucuuagguuacucgcaaaucggcgccggaguguacaaggaagggacguuucacacgauguggcacgugaccagaggcgccguccugaugcaucgggggaaacgcaucgagccaagcugggccgacgugaagaaggacuuaaucucguacggcggcggcuggaaacucgagggcgaguggaaggaaggggaagaggugcaggucuuagccuuagagcccggcaaaaacccccgugcggugcagaccaagccugggaucuucaagaccaacacgggcaccauaggcgccgugagccucgauuucuccccaggcaccagcggcucccccaucguggacagaaaagggaaaguggugggacuuuacgguaacggcgucgugacccggucgggcgcguacguuagugccaucgcgcagacggaaaagagcaucgaggacaaccccgagaucgaagacgacaucuuucgcaaaaagcggcugacuaucauggaccuccacccgggcgcuggcaaaaccaaacgcuaucugcccgccaucguccgggaggcgaucaagcgaggucuucgaacccugauuuuagccccgacgcgaguggucgcugccgagauggaggaggcccugaggggccugccaauucguuaccagaccacggccaucaagaccgagcacaccgggagagaaaucgucgaccuaaugugccacgccaccuucacuaugcggcugcugagcccggugcgagucccgaauuacaaccucaucaucauggaugaagcgcacuucaccgacccugccuccaucgcugcgcggggcuacaucagcacucgcgucgagaugggcgaggcggcggggaucuucaugaccgcgacgccgcccgggucccgggaccccuuuccccagagcaacgcacccaucauggacgaggagcgagagauccccgagcgguccuggaacagcgggcacgagugggugaccgauuucaagggaaagacggugugguucgucccuuccauaaaagccgggaacgacaucgcugccugccugcgcaagaauggcaagaaggugauccagcuaagccguaaaaccuuugacuccgaguaugugaagacgcgcgccaacgauugggacuucgucguaaccaccgacauuagcgaaaugggcgccaacuucaaggccgagcgcgugaucgacccacgcagaugcaugaagcccgucauccucaccgacggggaggagcgcguuauccuggcgggccccaugcccgucacccacuccagcgcagcccagcggcgcggccgaauuggccggaacccgaagaacgagaaugaucaguacaucuacaugggcgaaccgcuggagaacgacgaggacugugcgcacuggaaggaggccaaaaugcuccuggacaauaucaacacgccagagggcauaauuccuuccauguuugagccggagcgcgagaaggucgacgcgauugacggcgaauaccggcuacgcggggaagccagaaagacguucguggacuuaaugaggaggggcgaucugcccgugugguuggccuacaaggucgccgccgaggggaucaacuacgcggaccgcaagugguguuucgacgggauuaagaacaaccagauccucgaggagaacauggaggucgagaucuggaccaaggagggggagcggaagaagcugaagccucgcuggcuggacgcccggaucuauagcgacccacucgcacugaaggaguuuaaggaguucgccgccggucgcaagucccugacccuuaaccucaucaccgaaaugggccgacugcccacguucaugacccagaaggccaggaacgcccucgacaaccuggccgugcugcacaccgccgaggccgggggccgggcguauaaccacgcccucagcgagcugcccgagacccuggaaacgcugcugcugcuaacccugcuggccaccgucaccgggggcaucuucuuauuccugauguccgggaaggguauugguaaaaugacacuggggauguguuguaucaucacggccaguauacuccugugguaugcgcagauccaaccccacuggauugccgccuccauaauucuggaguucuuccucaucgugcucuugaucccggagcccgaaaagcagcgcacgccccaggacaaucagcugacuuaugucgugaucgccauccugacgguagucgcagcgaccauggcaaacgagauggguuuccuggagaagaccaagaaagaccucgggcugggcuccauaaccacccaggagagcgagucaaacauccuagacaucgaucucagaccggcaucugccuggacgcuguacgccguggcgacuaccuucgugaccccuaugcuucgucacuccaucgagaacagcuccgucaacguuagccucacggcuauugccaaccaagccacagugcugaugggccuggggaagggcuggccccucuccaaaauggacaucggggugccccugcuggcgaucgggugcuacucucagguaaacccaauuacccugacugcugcccuacugcugcugguggcucacuaugccaucaucgggccgggccuacaagcaaaagccacgcgggaagcgcaaaaacgcgccgcugcggguaucaugaagaaccccacugucgacggcaucaccgugaucgaccucgaacccauccccuaugacccaaaguucgagaagcagcugggacagguuaugcugcucauccugugcgucacccaagugcuuaugaugaggacgaccugggcccucugugaggcucugacccuggcaaccgguccuauaaguacgcucugggagggcaaccccgggagguucuggaacaccaccaucgccgugagcauggcgaacauauuccgcggguccuaccuggcuggggccggccuacuguucagcaucaugaagaacaccacgaauacccgaagaggcaccgggaacaucggcgagacgcugggcgagaaguggaagucccggcugaacgcccuuggcaagagcgaguuucaaaucuacaagaaguccgggauccaggaggucgaccgcacacuggcgaaggagggcaucaagcggggcgagaccgaccaucacgcugugagccgagggagugccaaacugcggugguucgucgaacgcaacauggucacccccgagggcaaggucguggaccucggaugcgggcggggcggauggucauacuacugcggcgggcugaagaacguccgcgaggugaagggccucaccaagggaggaccgggccaugaggagcccauucccauguccaccuauggguggaaccucgugcggcuccagagcggcguugacgucuucuucacgcccccggagaagugcgauacccugcucugcgacauuggggagagcucccccaaccccacuauugaggccggacgcacacugcgggugcugaacuugguagagaacuggcugaacaacaacacgcaguucugcauaaaggugcugaaucccuacaugccuagcgugaucgagaaaauggaggcccuccagcgcaaguacggcggcgcgcugguccggaauccacucuccaggaacagcacacacgaaauguacuggguauccaaugcgaccggcaacaucgugagcagugucaacaugaucagccggaugcugaucaaucgcuucaccaugaaacacaagaaagccaccuacgagcccgacguggaucucgggucuggcacccguaacaucgguauugaguccgagaucccgaaccuagacauaaucggaaaacgcaucgaaaagaucaaacaagagcaugagacgucauggcacuacgaccaggaucaccccuacaagaccugggcuuaccacggcagcuacgaaacaaagcagacuggcuccgcgagcuccauggugaacggcguaguucggcugcucaccaaacccugggaugucguccccauggugacccagauggcgaugaccgacaccaccccguucggucagcagaggguauucaaggagaaagucgacacgcgcacgcaggagccaaaagaggguaccaagaagcugaugaagaucaccgcugaauggcuguggaaggagcuuggcaagaagaaaacuccccggauguguacgcgagaggaguucacccgaaaggugcgcagcaaugccgcccugggagccaucuucaccgacgagaacaaguggaaaagcgcgagggaggcuguggaggacggccgcuuuugggagcuggucgaccgggaacgcaaccuccaucuggaggggaagugcgagaccugcguuuacaacaugaugggcaaacgagagaagaagcugggggaguucggcaaggccaagggcucacgcgccauuugguacauguggcucggggcgcgguuccuagaguucgaggcccugggcuuccucaacgaggaucacugguucucccgcgguaauagcuuaagcgguguggagggggagggcuugcaccgacucggcuacaucuuacgcgacgucgggaagaaggagggcggggcgauguaugcggacgacacggccggcugggacacccggaucacgcuggaggaccuuaaaaacgaggagauggugaccaaucacaugaagggggagcacaagaagcuggcggaagcuauauuuaagcugacguaccagaacaaggucgugcgcgugcagcggccuaccccgcgcggcacaguaauggauauaaucucccggcgcgaucagcgcggcagcgggcaggucgggaccuacggacugaacacauucaccaacauggaggcucaguugauccggcagauggagggagagggcaucuuuaagaguauccaacaccugaccgcaaccgaggagauugcagugcagaauuggcucgcgcgcgucgggcgggagcgccugagccguauggccaucucgggcgaugacugcguggugaagcccauugacgaccgcuucgccagcgcccugacggcccucaaugacaugggaaagguccggaaggacauucagcagugggaacccucccgcggcuggaacgacuggacccaggugcccuuuugcagccaccacuuccacgaguuagugaugaaggauggucggguccugguggugccgugccgcaaccaggacgagcucaucggccgggcgcgcauaucccagggggccggguggagccucaaagagaccgccugccuggguaaguccuacgcccaaauguggacacucauguacuuccaccggcgagaucugcggcuggcugcgaaugccaucuguagcgccguaccgucccauugggugcccaccagcagaacgaccuggagcauccaugccaaacaugaauggaugacuacggaagauaugcucgcgguguggaacagagucuggauccaggagaauccauggauggaggauaagacgccgguagagaguugggaggaagugcccuauuuaggcaagcgcgaggaccagugguguggcucccuaauagggcucaccagucgggccaccugggccaagaauauccagaccgccaucaaccaagugcgcagccugaucggcaaugaggaauacacggacuacaugcccuccaugaagcgcuuccggagggaagaagaagaggccggcguccugugguga

SEQ ID NO: 25105 - RNA, 9876 nt, Artificial Sequence
  derived and/or modified CDS sequence (opt11) from DENV-2__EU482769__SS-prME
acggcagggguaauugugaugcuaauaccuacugcaauggcauuccaucugaccaccaggaacggagaaccccacaugauagucgggcgccaggaaaaagggaaaagucuacuauucaaaacugaagacggggucaacauguguacacugauggcgaucgaccuaggggaacuaugcgaagacacgaucacuuacaaaugcccccuccugcgccaaaacgaaccggaagacaucgacugcugguguaacagcacgagcacguggguuaccuauggaacuugcacaacaacaggugaacauagacgcgaaaaacgaagcguggcgcucguaccgcacguagguaugggguuagaaacuagaacagagacauggaugucuuccgagggcgccuggaaacacguccaacggaucgagacauggauccuacggcaucccggcuucacaaucauggcagccauccucgccuacacuauaggaacgacgcauuuucaacgggcgcuaauauucauacuacucacggcuguugcccccucaaugacgaugagauguaucggcauaagcaauagagacuucgucgaagggguaagcggaggaucauggguagauaucguauuagagcaugggucaugcguaacaaccauggccaaaaacaaaccgacgcuggauuucgagcucauaaaaacagaagcaaagcaacccgccacacugcgaaaauacugcaucgaagccaagcucacaaauaccaccacagaaagccguugucccacacagggcgagccaucacugaacgaggagcaggacaaaagauucaucugcaaacacucaaugguagaccgaggauggggcaacggaugcggacuguucggaaaaggggguauuguaacaugcgccauguucacaugcaaaaagaacauggaggggaaaguaguccaacccgagaauuuagaauacacuaucgucaucacuccccacagcggggaagaacacgccguaggcaacgacaccggaaagcacggcaaagaaaucaaaauaaccccacagagcagcauaaccgaagccgagcuaacggguuacggcaccgucacuauggaaugcucaccaagaacggguuuagacuuuaacgaaauggugcugcuccagauggaggauaaagcauggcuuguacauaggcaaugguuccuagaucuaccacucccauggcugccaggcgcggauacccaagggagcaacuggauacagaaggagacacucguaacauuuaaaaacccccacgcaaagaaacaggacguuguaguacuggggucccaagaaggcgcuaugcacacugccuugacaggcgcaaccgagauccaaaugaguaguggcaacuuacucuucacaggacacuugaagugcaggcuucgaauggacaagcuccaacugaagggcaugagcuacucaaugugcacgggcaaauucaaaauuguuaaggaaauagcugaaacccagcacggaacgauaguaauacgagugcaauacgagggagacggaucccccugcaagauucccuuugaaauaacagaccucgagaaacgacauguacuaggaagacuuaucacaguaaaccccauaguuacagaaaaggauucuccgguaaauaucgaggccgagccacccuucggggauucauacauaauaauugguguggagcccggccagcucaaacugaacugguuuaagaaaggguccagcauaggacagauguucgaaaccaccaugagaggggccaagcggauggccauacugggggacacugccugggacuucgggagucuagguggcgucuucacaagcaucgguaaagcgcuucaucagguguuuggagcgaucuauggagcagcguuuagcggggugagcuggaccaugaagauucugaucggcguaaucaucacuuggauaggaaugaauaguaggucuacaagucugagcgucucacuugugcuaguuggcguagucacgcuuuacuugggggccaugguccaagccgacagcggcuguguggucucauggaagaacaaagaauuaaaauguggcucggggauauucauaacugauaacguucacaccuggacagaacaguacaaguuucaaccggaauccccaucgaagcuagcauccgcgauccaaaaggcacacgaggaaggcaucugcggaauacgcuccguaacacgcuuagaaaaucucauguggaaacaaaucacccccgagcuaaaccauauucugagcgaaaacgaggucaaacucaccauuaugacaggagacauccgcgggauaaugcaggcgggaaaacguagccuaagaccucaacccaccgaacugaaauauuccuggaaaaccugggggaaagcgaagaugcuuuccacggagagccacaaccagacauuucuaaucgacggccccgaaacagcugagugcccgaacacgaacagagccuggaacucccuagaagucgaggauuauggguuuggggucuucacaacaaacaucuggcucaagcugcgcgagaagcaagacguguucugcgauaguaaacugaugagugccgcaaucaaagacaauagagcaguacaugcugacaugggcuacuggaucgagagugcccuaaaugauaccuggaaaauggaaaaggcaucguuuaucgaagugaaauccugucacuggcccaagucgcacacacucuggaguaacggaguacucgagucagaaaugaucauccccaaaaacuucgcuggacccguaagccaacacaacuaccgacccggcuaccacacacagacagcgggacccuggcauuuggguaaacuggaaauggacuuugaccuaugugaggggacgacagucgugguaacggaagauugcggcaacagggggccaucccugaggaccacuacagcgucggguaagcugaucacggaguggugcugccgaucgugcacauuaccaccccuacgauacagaggggaggaugggugcugguacggaauggaaauaagaccgcugaaggagaaagaggagaaccuagugaauagucucguaacggcgggacaugggcagauagauaauuuuuccuuaggggugcucgguauggcguuguuccuggaggagauguugaggacccgaauaggaacaaagcacgccauucucuuaguggcagucagcuucguaacacuaauuacagggaacaugagcuuuagagaccugggcagaguuaugguaauggucggugccaccaugacggacgacauaggcaugggagugacauaccuagcccucuuagccgcguucaaagugcgccccacguucgccgcagggcuacuccugcguaaacucaccucgaaggagcucaugauggccacgauuggaauagcacuccucucacaaagcacaaucccagaaaccauacuugaacuuaccgacgcgcucgcacuaggcaugauggucuugaaaaucgugcggaacauggaaaaguaccaacuggcaguaacgauaauggccauaucauguguaccgaacgcagugauucuacaaaaugcguggaaagucaguugcacaauacuagccgcugucagcguaagcccuuuauugcuaacaucaagccagcagaaagccgauuggaucccucuggcacugacuaucaagggcuuaaauccgacggcuauauucuugaccacguuaucccgaacaagcaagaaaagaucguggccccuaaacgaagcgauaauggcuguaggcauggucaguauacuagcauccucccuccucaaaaacgacauaccaaugacagguccccucguugcaggcggauugcuaacaguauguuacgugcuaacaggccgcagcgccgaccuugagcucgagcgggccgcagaugucaagugggaggaccaagcagagauuucggggagcaguccaauucuuagcaucacaauaucagaagauggaaguaugucgaucaaaaacgaagaggaggagcagacccuaacgauacucauccgaacagggcugcuggugaucuccggaguauucccaguaucuauacccaucacagcggcggcgugguaucucugggaggucaagaaacaacgcgcaggagugcuaugggacguaccaucaccaccacccguggagaaagcggaacuagaggacggagcguacaggauaaaacaaagaggaauauuaggcuauagccagaucggggcugggguguacaaagaaggaacguuccacacaauguggcacgucacccguggcgcaguacuaaugcaccgcggcaaacgcauagagccgaguugggcagacgugaaaaaggaccucauauccuaugggggaggcuggaagcucgaaggagaauggaaagagggcgaagagguacaaguacuagcccuagaacccggcaaaaacccaagagcaguucaaaccaaacccggaaucuucaaaaccaacacaggaacgaucggagcagucucacuugauuucucacccgggacaucaggaaguccaaucguagauagaaagggaaagguaguuggguuauacggcaacgggguggucacgagaagcggcgccuacgucucggccauagcgcagaccgaaaagucgaucgaggacaaccccgaaauagaagaugauaucuuccggaaaaagcggcugaccauuauggaucuccacccgggggcgggaaaaacgaaacgguaccucccggccauaguaagggaggccauaaagcgcggucuacgaacuuugauccuggcgccgacacggguagucgccgcggaaauggaagaggcacuacgcggccuuccgauacgcuaccaaaccaccgccaucaaaacugaacacacgggccgcgagauugucgauuuaaugugccaugccacguucacgaugcgcuuacuguccccagugagagugccuaacuacaaccuuauuaucauggacgaagcccauuucaccgaucccgcaagcaucgccgcuaggggcuacauaagcacacgagucgaaaugggggaagcagcuggaaucuucaugacugccacgccgccaggaaguagggacccguucccacaaucgaacgcacccauaauggacgaagaacgagaaauuccagagcggagcuggaacaguggacacgaauggguuacugacuuuaaggguaagacuguuugguuugugccgagcaucaaggcgggcaaugacaucgccgcaugccugcgaaagaacggcaagaaggugauccaguuguccagaaagacguuugacagcgaguacgugaagacacgggcaaacgacugggacuucgucgugacaacagauaucagcgaaaugggagcuaauuuuaaagccgaacgaguaauugacccgagacgcugcaugaaaccggugauccuuacggacggagaggagagagucauacuagcggggccgaugccaguaacucacagcucggcagcccaacgccgaggccgaauagggcggaaccccaaaaacgaaaacgaucaguacauauacaugggugagcccuuagaaaacgacgaggauugcgcgcacuggaaagaggcgaaaaugcugcuggacaacauaaacacgcccgaagggaucauccccucuauguuugagcccgaacgugagaaaguggacgcgaucgacggcgaguaucgcuugagaggggaagcgaggaagaccuucguggacuugaugcgccgaggcgaccugccggucuggcuagccuacaaagucgcagcggaaggaauaaacuacgcggaccgcaaguggugcuuugaugggauaaagaacaaccaaauucucgaggagaacauggaaguggaaaucuggaccaaagaaggugagaggaagaaacugaagccgagguggcucgacgccagaauauacagcgauccacucgcacuuaaggaguucaaagaauuugccgcuggccgcaagucccucacguugaaccucaucaccgaaaugggcagacuaccaaccuucaugacucagaaagcaaggaacgcccucgacaaucucgcagugcuccacacggccgaggccggcggcagagcguauaaucacgcacucuccgaacugccagaaacacucgagacccugcugcuccucacacuccuggcgacagugaccggaggaaucuuccuguuucuaaugucggggaagggcaucggcaaaaugacccuaggcauguguuguauaaucacagcgaguauucuccuuugguacgcccaaauccaaccacacuggauagcggcaucgauaauccuagaguucuucuugauugugcucuugaucccggaacccgaaaaacagcgaacgccccaggacaaccaauuaacguacgucgugauugccauccuaaccguuguagcggccacuauggccaacgagaugggauuccuggagaaaacaaagaaagaccugggucuaggcucuaucaccacacaagagagcgaaucuaacauccucgauauagaucuacgaccggccucggcguggacuuuauacgcgguugccacaacauucgucacccccaugcucaggcacucaauugaaaacagcucaguaaacguaagucugaccgccaucgcaaaccaagcaacgguacugaugggcuuagguaaaggcuggccacuaucaaaaauggacauaggcguuccucuacuggcgauagguugcuauucucaaguaaacccgauaacguugacagccgcucuacugcuuuugguagcucacuacgccauaaucgggcccggccuacaagcaaaagcgaccagagaggcccaaaagcgagcggcggcuggcauaaugaaaaaccccacuguagacggaauaacagucauugaccucgagccaaucccuuacgacccaaaguucgaaaagcagcuggggcaagugaugcuucuaauccucugcgugacacaaguccuaaugaugcggacaacuugggcccucugcgaggcccucacgcuagcgacagggccgauauccacgcucugggagggcaaccccggccgauuuuggaauacgacaauagccguaagcauggcgaacauauuccgagguagcuacuuagcgggugccggacuccuguucagcauaaugaaaaacacuaccaauacacgacgggguacaggcaacaucggcgagacguugggagagaaauggaaauccagacugaacgcgcuugggaaguccgaguuccagauuuauaagaaaucaggcauccaagaaguagauagaacacuagcgaaagaggguauaaaaaggggagagaccgaccaccacgcggucagccgcggcuccgcaaaacugcgaugguucguugagcgcaacauggucaccccagaagggaagguaguagaccuaggcugcggacggggcggguggucauacuacugcgggggacucaaaaacguaagagaggugaaaggucuaacuaagggagggccugggcacgaagaaccgaucccaaugaguacguacgguuggaaccugguaagacuucagagcgggguagaugucuucuuuaccccgcccgaaaagugugacacuuuacucugcgauaucggagagucaucacccaacccaaccaucgaggcggggcggacucucaggguccugaaccucguagagaacuggcuaaacaauaacacacaguucugcauuaaaguccuaaacccguauaugccguccguaauagaaaagauggaagcucuacagcguaaauacggcggggcccugguccgaaacccgcucagcagaaacuccacccacgaaauguacugggugagcaacgcaacggguaauauagugucgucgguuaacaugauaucaagaaugcuuauuaacagguucacaaugaaacacaaaaaggcaacguacgaaccagacguggaccuaggcucggggacccgcaauaucgguauagaaagcgaaaucccgaaucuggacauaaucggaaagcggaucgagaaaaucaagcaagaacacgaaacaucuuggcacuaugaccaggaucacccuuauaaaaccugggcuuaccacggcagcuacgagacuaaacagacggggagcgcaagcagcaugguaaacgggguagugcgacuucucaccaaaccaugggaugucguccccauggucacacaaauggccaugacggacacaacccccuucggucagcaaaggguauuuaaggagaaaguagacacccgaacgcaggagcccaaagaaggaacuaagaaauugaugaaaaucaccgcggaauggcuuuggaaagagcucggcaagaagaaaacaccgcgcauguguacaagagaagaguucacacggaaaguacgaucaaacgcagcacugggggcaauuuuuaccgacgaaaacaaguggaagagugcacgggaagcagucgaagacgggcgcuucugggagcuaguagaccgagaacgaaauuugcaccuagagggcaaaugcgagacuugcguauauaacaugauggggaaacgagagaagaagcuaggagaguuuggcaaagccaaaggcucuagagcaauaugguacauguggcuaggagccagauuccucgaguucgaggcgcugggguuccuuaacgaagaccacugguucagcagaggaaauaguuuaucuggaguagagggagaaggacuccaccgccugggcuacaucuuaagagacguggggaagaaagaaggaggggcgauguaugccgacgauacggccggaugggacacaaggauaacgcuagaggaccugaagaacgaggaaaugguaacgaaccacaugaagggcgaacacaaaaaguuggcagaagcaauauucaagcugaccuaucagaauaaagucgugcgaguccagcguccaaccccacgagggacaguuauggauauuauuagcagacgagaccaaagagggagcggacaagucggaaccuacggauuaaacaccuucaccaacauggaagcccagcucauaagacaaauggagggagaaggaauauuuaaauccauccaacaccucacugccacagaagaaaucgccgugcaaaacuggcuggcccguguaggccgcgagagacucucacgaauggcaauuuccggcgacgacuguguugugaagcccauagaugaccgcuuugccucagcccuaacugcguugaaugauauggggaagguccggaaagacauccaacaaugggagccuucacgcgguuggaaugacuggacgcaagugccguuuugcagccaccacuuucaugaguugguaaugaaggacggacgagugcuagucgugcccugccggaaccaagacgagcuuauagguagagcaagaauaagccaaggugcaggguggagcuuaaaagaaacagccugucucggcaaaucauacgcgcagauguggacccuuauguacuuccacaggagagaucucagacuagcugcgaacgcaaucuguagcgcggucccaucccacuggguccccacgucccgaacgacuuggucuauacacgccaaacaugaauggaugaccaccgaagauaugcuugcuguauggaaucgaguguggauacaagaaaauccauggauggaagacaagaccccagucgaaucaugggaagaaguuccuuaucugggcaaacgcgaggaccaguggugcggcagcaugaucgggcugaccucaagagcgacgugggccaaaaacauucagacugccaucaaccagguccgaucacucaucggcaacgaagaguacauagacuacaugccauccaugaagcgguuccgaagagaagaagaagaggccgguguguuaugguaa

SEQ ID NO: 25106 - RNA, 9876 nt, Artificial Sequence
  derived and/or modified CDS sequence (opt11) from DENV-2__EU482696__SS-prME
accgcgggcgugauagucaugcugauccccacggccauggcguuccacuuaaccacucguaacggggagccacacaugaucgugggucggcaggagaaggguaagucccugcuguucaagaccgaggacggcgugaacauguguacccuaauggcuaucgaucugggggaacuuugcgaagauaccauuaccuacaaaugcccccuccugcgccagaaugagccagaggauauagacuguugguguaacagcaccagcaccugggucaccuaugggaccugcaccaccacgggcgagcaccggcgcgagaagcgcuccgucgcccuggucccucacgucgggaugggcuuagagacccguaccgaaaccuggaugagcagcgagggggccuggaagcacgugcagcguaucgaaacuuggauucugcgccauccugguuucaccaucauggccgcgauauuggccuacacgauagggaccacccacuuccagcgcgcccugauauucauccuguuaaccgcuguggcgcccucaaugacaaugagaugcaucggcaucucuaaucgggauuucgucgagggggugucagggggaucuuggguggacaucguccucgagcacgggagcugcgugaccacgauggcgaagaacaagccgacgcuggacuucgagcugaucaaaaccgaggccaaacaacccgccacacuacgcaaguacugcauugaagccaaguuaacgaacaccaccacagagucccgguguccgacccagggagagcccagccuaaaugaggagcaggacaagcgcuucaucugcaagcacuccauggucgacagggguugggggaacggcugcgggcuuuuuggcaaaggagggaucguaaccugcgcuauguucacaugcaagaagaacauggagggcaagguggugcagccagagaacuuagaauacacgaucgucaucacaccccacagcggggaggagcacgccguggguaacgacaccggcaagcacggcaaggagaucaagaucacaccccaauccaguaucacggaggcagagcugaccgguuacggaacggucaccauggagugcagcccccggaccggucucgacuucaacgagaugguccugcuucagauggaggacaaggccuggcucguucaucgacagugguuccuggaccugccccuucccuggcugccuggcgccgacacccagggcuccaacuggauccagaaggagacgcucguaaccuucaagaacccccacgcgaaaaagcaggacgucgucguccucgggagucaggagggcgcaaugcacacagcccugaccggggccacggagauccagaugagcagcggcaaccuacuauucacuggccaccugaagugcagauugcgaauggacaagcuccaguuaaaagguaugucguacucgaugugcaccggcaaauucaaaaucgugaaggagaucgccgagacccagcacgggacuaucgugauccgcguucaauacgagggcgacggguccccgugcaagaucccauucgagaucaccgaucuggagaagaggcacgugcucgggcgcuuaaucaccgugaacccgaucgucaccgagaaggauagcccugugaacaucgaggcagagccgcccuucggcgacuccuacauuaucaucggcguggagccgggccagcuuaaacuuaacugguucaagaaggguagcucuaucggucagauguuugaaacgaccaugcgcggcgccaagcgaauggccauacugggagacacagccugggacuucggcagccucgggggcgucuucacaucaaucgggaaggcucuccaccagguguucggugcgaucuacggcgccgccuucagugggguguccuggacgaugaagauccuuauaggcguuaucaucaccuggaucggaaugaauagcagaucgaccagccuguccguuagccuggugcuggucggaguggugacacuguaccucggggccaugguccaggcggacuccggcugcguagcuuccuggaagaacaaagaacuuaagugcgguuccgggauauucauuaccgauaacguccacaccuggaccgagcaguacaaguuccagccggaaagccccucuaaacuggccuccgccauccagaaggcccacgaggagggcaucugcgggauccggagcgucacccgccuggaaaaccucauguggaagcaaaucacgcccgagcugaaucacauccuguccgagaacgaggugaagcucaccaucaugaccggcgauaucaaggggaucaugcaggcuggaaagcggagccugcgcccgcagccgaccgagcugaaauacuccuggaagacguggggcaaggccaaaaugcucucuaccgaaucucacaaccagacauucuuaaucgacgggccggagaccgcugagugcccgaacacgaaucgggccuggaacagccuggagguugaggacuacggcuucgggguauucacaacuaacaucuggcucaaguugagggagaagcaggacguguuuugcgacuccaagcuaaugagcgccgcgauaaaggacaaccgggccguucacgcagacaugggauacuggaucgaauccgccuuaaaugacaccuggaagauggagaaagcgagcuucaucgagguuaaguccugccacuggccuaagucccacacccugugguccaauggaguucuggagagcgagaugauaauccccaagaacuucgcggggccagugucccaacacaacuacagaccgggcuaucacacacagaccgccgggccguggcaccucggcaagcuggagauggacuuugaccugugugaggggaccaccgucguggucacugaggacuguggcaaccgcggucccucacuccggaccaccacagccagugggaagcugaucacggaguggugcugccggucgugcacccugccuccgcuccgcuaccggggcgaggacgggugcugguacggcauggaaauccgcccccugaaggagaaggaggagaaccucgucaauucucuugucaccgcgggucacggccagaucgacaauuucucccugggagugcucgggauggcccuauuccuggaggagaugcugcggacccgcaucggcaccaagcacgcuacucuccuagucgccguguccuucgugacccugauaaccgggaacauguccuuccgagaccucggcagggugauggugaugguaggggcuacgaugacagacgauaucggcaugggcgucaccuaccuggcccugcucgcggccuucaaagugcgcccuaccuucgccgccgggcugcuacuccggaaacuuacgucuaaggaguugaugauggccacaaucggcaucgcacuccugucccagagcaccauuccggaaaccauccuggaacucacggaugcccuggcccuuggcaugauggugcucaagauaguccguaacauggagaaauaccagcuggcagugacuaucauggcaauauccugcgugccuaaugcgguaauccugcagaaugccuggaagguuuccugcaccauccucgccgccguuuccguuagcccccugcugcucaccuccagccaacagaaggcggacuggaucccucuggcccugacgaucaagggccucaacccuacggccauuuuccugaccacccugucaaggacgagcaagaagagguccuggccgcucaacgaggccaucauggccguggguauggucagcauccuggcuuccagccuucucaagaaugauauccccaugaccgggccgcugguagccggcgggcugcucaccgugugcuacgugcugaccgggcgguccgccgaucuggagcucgagcgugccgccgacguuaagugggaggaccaggcggaaaucuccgggagcucacccauacugagcaucaccaucuccgaggaugguuccauguccaucaagaacgaggaggaggagcaaacccugaccauccucauaaggaccggccuccuggugaucagcggcgucuuuccgguauccauccccauaaccgccgccgcaugguaccuuugggagguuaaaaagcagcgcgccggcgugcuaugggacgugcccagcccgccgccuguggagaaggcggaguuagaggauggggccuaucggaucaaacagcgcggcauccugggguacucgcagaucggcgcgggagucuacaaagagggcacguuucauacuauguggcacgugacccgaggggccgugcugaugcaccgaggaaagcggaucgagcccucuugggcagacgucaagaaggaccucaucuccuacggugguggcuggaagcucgaaggggaguggaaagagggggaggagguccaggugcuggcauuagagccuggcaagaacccccgcgcaguccagaccaagcccggaacguucaaaaccaauacaggcacuauaggugccgugagccucgacuucucccccggcacgagcggcagcccaaucguggaccggaaggguaaggucguggggcucuacgggaacggcgucguaacccgcagcggcgccuacguguccgccaucgcccagacagagaaaagcaucgaggauaaucccgagauugaagacgacaucuuccggaagaagcgccugaccaucauggaccugcaccccggcgccgggaagacgaagcgguaucuucccgccauuguccgcgaggcuaucaagcgggggcugagaacccugauccucgcgccaacucgcguuguugccgccgagauggaagaggcccugcggggccugcccauccgcuaccagaccccugccaucaagacggagcacaccgggcgggagauuguggaccucaugugccacgcgacguucacgaugagacugcugagccccguucgcgugccgaacuacaaccucaucaucauggacgaagcccacuucacagaccccgcuuccaucgcggcgcgcggcuacaucagcacccgcguggagaugggcgaagcugccgggaucuucaugacggccacgccgcccggcucccgcgacccguucccccagagcaacgcacccaucauggacgaggagcgggagauccccgagcgcuccuggaacagugggcacgagugggucaccgacuucaagggcaagaccguaugguucgucccgucaaucaaggcgggaaacgacauugccgcuugccugcggaaaaaugggaagaaggucauccaguuaagcagaaagacuuucgauuccgaauacguaaagacacgagccaacgacugggacuuuguggucacgacagauaucucagagaugggcgccaacuucaaagcagagcgcgugauugacccacgacgcugcaugaagcccguaauccucacggacggggaggagcgcguuauccucgccggccccaugccggugacccacucgagcgccgcccagcgccgggggcgcauaggccgcaaucccaagaaugagaacgaccaguacauauacaugggagagccgcuggagaacgacgaggacugcgcacauuggaaggaggcgaaaaugcuccuggacaacauuaacacgccggaggggaucaucccguccauguucgagccugagagagagaagguggaugcgaucgauggcgaguauagacugcguggggaggcccgcaagacauucgucgacuugaugcggcgcggcgaccugcccguguggcuagccuacaagguagccgcggaagggaucaacuaugcagaccggaaguggugcuucgauggcauaaagaacaaucaaaucuuagaggagaacauggaggucgaaaucuggacuaaggagggggaacgcaagaagcugaaaccgcgguggcuugacgccagaaucuacucggacccgcucgcgcugaaggaguucaaggaauuugcggcuggucggaagucccugacccucaaccuuaucacggagauggguaggcuucccaccuucaugacgcagaaagcccggaacgcgcucgacaaucuggccgugcugcacaccgcggaggccgggggccgagcauacaaccacgcccucagcgagcugcccgagacgcuugagacccuccugcugcucacccuucuggccacggugacuggggguauauuccucuuccugauguccgguaaagguauagguaagaugacguuggggaugugcugcaucaucaccgcgucuauacugcugugguacgcccagauucagccacacuggaucgccgccuccaucauccuggaguucuuccucaucguccugcugaucccggaaccugagaaacagcguacgccacaggacaaccagcucaccuacguagucaucgcgauccugacggugguggcggcgaccauggccaacgagaugggcuuccuggagaagaccaagaaagaccucggucugggcagcauaaccacgcaggagagcgaguccaacauccucgacauugacuugcgcccggccagcgcuuggacguuguacgcggucgcgacaacauucguaacgcccaugcugcggcauuccauugagaacagcucggugaacgucagccucaccgccauugccaaccaggcgaccguguugaugggccuggggaaaggcuggccccucuccaagauggacaucggugugccccuguuggccauaggaugcuacagccaggucaacccgaucacccucacggccgcgcuccuguugcugguggcccacuacgcgauuauagggcccggccugcaagccaaggcuaccagggaagcccaaaaacgggccgcggcaggaaucaugaagaaccccaccguagacgggauuaccgucaucgaccucgaacccaucccuuaugauccaaaguucgagaagcagcugggccaaguuaugcuucucauacugugcgugacgcagguccuaaugaugcgcaccaccugggcccucugcgaggccuuaacccuggccacggggcccaucuccacccucugggaaggaaaucccgggagguucuggaauacaacuaucgcggucagcauggcuaacaucuuccgcgguucuuaccuggccggcgcugggcuccucuucagcauuaugaaaaacacaaccuccacccgacggggcacugggaacaucggcgagacgcugggugagaaguggaagucgcgccugaaugcgcucggcaaaucugaguuccagaucuacaagaaguccggaauccaagaaguugaccggacccuggccaaggaggggauuaagcgcggcgagacagaucaccacgccgucagucggggaagcgccaagcucaggugguucguagagcggaauauggugaccccggagggcaaggucguggaccucgggugcgggcgcggugggugguccuacuacugcgggggucucaagaacgugcgggaaguuaagggccuuacgaagggaggccccggccacgaggagcccauccccaugucaaccuacggguggaaccuagugcgccugcagagcggcguggacgucuucuucaccccgcccgaaaagugcgacacccugcuuugcgacaucggggaguccagccccaaccccaccaucgaggccggccggacgcuccgcguucugaauuugguagagaacugguugaauaacaacacacaauucugcaucaagguccuuaacccguacaugcccucagugaucgagaagauggaggcccuccagcggaaguauggcggugcccugguacgcaacccacugagccggaacuccacccacgagauguauugggucagcaacgccacuggcaacaucguguccagcgugaacaugaucucccgcaugcugauaaaccguuucacgaugaagcacaagaaggccacguacgagccggacguugaccucgggagcggcacccgcaauauugggaucgaauccgagauccccaauuuggacaucaucggcaagcggaucgagaagaucaagcaggagcacgagaccagcuggcacuacgaucaggaucaucccuacaaaacgugggccuaucacggaucguacgaaacuaagcagaccgggagcgccaguagcauggugaacggcgugguccgccugcucacgaagcccugggacguggugccgauggugacacagauggcaaugaccgacaccacccccuucgggcagcagcgcguguucaaggagaagguggacacgcggacccaggagcccaaggagggcaccaagaagcugaugaagaucaccgccgagugguuauggaaagaacucggcaagaagaagacgccccgcaugugcacacgggaggaguucacgcgcaagguccggucgaaugccgcgcugggggcaaucuucaccgacgagaauaaguggaaguccgcccgcgaagccguggaggacggccgguuuugggagcuaguagacagagagcggaaccuacaccuagaggggaagugcgagacuugcgucuauaacaugaugggcaaacgcgagaaaaagcugggggaguuuggcaaggccaaggggucucgggcaauuugguacauguggcucggggcucguuuccucgaguucgaggcccuaggauuccugaacgaagaccacugguucagccggggcaacagccucaguggcguagaaggggagggucugcaucgcuuaggcuacauucugcgggacgucagcaagaaggagggcggcgccauguacgccgacgacaccgcggggugggacacccguaucacgcuggaggaccugaaaaaugaagagauggucacgaaccacaugaagggcgagcauaagaagcuagccgaggccaucuucaagcuaaccuaccagaacaaggugguccgggugcaacgcccgacgcccagagggauagucauggacaucaucucgcgccgggaccagcgcggcucuggccaggucgggaccuauggccucaacacguucaccaacauggaggcccagcugauccgccagauggagggggagggcauuuucaaguccauccagcaccugaccgccgcugaggagaucguggugcagaauuggcuagcgcgggucggccgcgagcggcugaguaggauggccaucagcggggacgacugcguggugaaacccaucgacgaccgguucgccuccgcccugaccgcgcucaacgacaugggcaagguccgcaaggacauccagcagugggagcccucccggggguggaacgacuggacccaggucccguuuugcucccaccacuuucaugagcuggugaugaaggauggcagaguccugguagucccuuguaggaaccaggacgagcucaucgggcgagcccggaucucccagggcgcagguuggucacucaaggagacagccugccuggguaaauccuaugcacaaauguggacccucauguacuuucaccgccgggaccugcgccuggcggccaacgccaucugcagcgccgugcccucacacugggucccuaccucacgaaccacaugguccauccacgccaagcacgaguggaugacuaccgaagacaugcucgccguauggaaccgcgucuggauccaggagaauccguggauggaggacaagacccccguggagagcugggaggaggugcccuauuuggggaagcgggaggaccaguggugcgggagccucaucggccugacgucccgcgccaccugggccaagaacauccagaccgcuaucaaccagguacggagccugaucgggaaugaagaguacaccgacuacaugccauccaugaagcgauuccggcgggaggaggaagaggccggugugcugugguga

SEQ ID NO: 25107 - RNA, 9876 nt, Artificial Sequence
  derived and/or modified CDS sequence (opt11) from DENV-2__KC294207__SS-prME
acugcaggggugauagucaugcucauuccgaccgcgauggcauuccacuugaccacgcgaaacggggaaccccauaugauaguggggaggcaggaaaaaggaaaaagccuccuauuuaaaaccgaagauggggugaacauguguacacuaauggcgaucgaccuaggcgaacucugcgaagauacaauaacguacaaauguccccugcuuaggcagaacgaaccggaagacauugacugcuggugcaauucgacgucaacguggguuaccuacggaaccugcacgacgacuggggagcacaggcgggaaaaacggagcgucgcacuugucccgcacguaggcaugggccuggaaacaaggacugaaacguggaugaguagcgagggagcguggaaacaugugcagcgcauagaaacauggauacuccgucaucccggguucaccauuauggccgcaauacuagcguauacgauaggaacgacccauuuucagagggcgcucauauucauccuacucacagccgucgcaccgagcaugacgaugcgcugcauagguauaucaaaucgagacuuuguagaaggcgugagcggaggcucuuggguggacauaguccuagagcacggcuccugcguaacgacaauggcgaaaaacaaaccgacacuagacuucgaacugauuaaaacagaggcaaaacaacccgcuacgcuccgaaaauauugcauagaagcaaaacucacaaacacgacaacagaaucgaggugccccacucaaggggagccaagccuaaacgaggaacaagacaaacgcuucauaugcaaacacaguaugguagacagggguugggguaaugggugcgggcuguucgggaaaggcgggaucguuacgugcgcuauguuuacaugcaagaaaaacauggaaggcaaaauaguccaaccagaaaaccuggaauacacaauagugauuacgccacacucaggcgaggaacaugcggucggcaacgacaccggaaaacacgguaaagaaaucaaaauaacaccccaaaguaguacaaccgaggcggagcuuacuggguacgggaccguuaccauggaguguaguccucguacagggcuggauuucaaugaaaugguucuucuacaaauggaggacaaagcguggcugguccacaggcagugguuccucgaccucccccucccguggcucccaggggcugacacacaaggaucuaauuggauccaaaaggaaacccuagugaccuucaaaaacccccacgcuaagaagcaggacgucgucguuuuaggcucgcaagaaggcgcaaugcacaccgcccuaacuggagcaaccgaaauccagaugucgagugggaaccuccuguuuacgggacaucuaaaaugccgacugagaauggacaaacuacagcucaagggcaugagcuauuguauguguacagggaaauuuaagaucguuaaggaaauagcagagacacaacacgguacaauagucauacgcguacaauaugaaggggacggcucacccugcaagauucccuucgagauaacggaccuggaaaagcgacacguccuaggacgccugaucacagucaacccuauaguuaccgaaaaggacucacccguaaauaucgaagcagaaccgccguuuggggacucguauauaaucgucgguguagagccaggccaguugaaacuaaacugguucaagaagggaaguagcaucgggcagauguuugagaccacaaugcggggcgccaagcgaauggcaauccugggagauaccgccugggacuucggaucacugggagggguuuucacaucuaucgguaaagcucuacaccagguauucggcgcgauauacggcgccgcauucuccggcguauccuggaccaugaagauacugaucggggucaucauaaccuggaucggcaugaacucgagaagcacgagccuuagcguuaguuugguccuugugggaguagugaccuuauaucuaggcgccauggugcaagccgacucugguugcauugugagcuggaaaaacaaagaacuuaaguguggaucggggauuuucauaacggacaacguucacacuuggacagaacaauacaaauuccaaccugagucccccagcaagcuggcuucagcaauacagaaggcccacgaggaaggaaucuguggaaucagaucaguaacacgauuagaaaaccucauguggaagcaaauaacaccggaacucaaccacauacuaagcgagaacgaagugaaacuaaccaucaugacgggagauauaaagggcauuaugcaagcgggaaaaagaucccugcgcccgcaaccgacggaauuaaaguauagcuggaaaacuugggggaaggcaaagauguuauccacggaaagccacaaucaaaccuucuuaauagacggcccggaaacagcagaaugcccgaacacuaaccgcgcauggaauagccuagagguugaagacuacggguucggcguguucacaaccaacaucuggcuaaagcugagggaaaaacaggauguauucugugacuccaaacugaugagugcggcuaucaaagacaaccgugccguccacgccgacaugggauacuggaucgagagcgcgcugaacgacacguggaagauggagaaggcgucauucauugagguuaaaaguugucacuggcccaagucgcacacacuuuggaguaacggcguccuagagucagaaaugauuauuccgaagaauuucgccggccccguuucucaacacaacuacagaccggguuaucacacacaaacagccggcccaggacaccuaggcaaacuggaaauggacuucgaccugugugagggaacaacgguagucgucaccgaagacugcgggaaccguggaccaucuuugcggacaacaacagccagcggaaaacuaaucaccgaguggugcugcaggucaugcacccuuccuccacuucgauaccgaggagaggauggauguugguacggaauggagaucagaccacuaaaagagaaagaagaaaaccucguaaauagccugguuaccgcaggccacggacagaucgacaacuuuucgcuaggagucuuaggcauggcacucuuccuagaagaaaugcucaggacucgcguugggacaaagcacgcaauacuuuuaguagcuuuaucauuuguaacacucaucacagggaacaugagcuuccgagaucuaggccgagucaugguaauggugggcgcgacgaugacagacgauauuggcauggguguaacauacuuagcgcuacucgcugccuucaaaguccgcccaacguucgcugccggauuauuguuaagaaaguugacauccaaagaacucaugauggccaccaucggcauagcacuguugucacaguccacacuccccgagacgauauuggagcugacugaugcccuggcacuagguaugauggcccuuaagaucgugaggaacauggaaaaguaucaacucgcggucacgauuauggcgauaucgugugucccaaaugccgugauacuccaaaacgcauggaaggucaguugcacuaucuuggcugccgucagcguaucgccccuacugcugacaucaagccagcagaaagcggacuggaucccucucgcacucaccaucaagggacuaaaccccacagcgauauuucuuaccacccucagcagaaccuccaagaaaaggaguuggccauuaaacgaggccauuauggcgguagggaugguauccauacuagcaagcucgcugcucaaaaaugacauaccaaugacaggcccgcuuguugccggagggcugcuuacaguuugcuacguacucaccggaaggagcgccgaccucgagcuagaaagggcggcagaugugaaaugggaagaucaagcggagauaagcgggagcagcccgauacuaucaaucaccauaagugaagacggaagcaugucgaucaaaaaugaagaggaggaacaaacucuaacuauucugaucaggacgggacuacucguaaucucuggcguguuuccagucucaauuccaaucaccgcggcugcaugguacuugugggaagucaagaaacaacgggcaggcguacucugggauguaccauccccacccccagucgggaaagccgaacuugaagacggcgcguaccggaucaagcaaagagggauacucggguauagccaaauaggagcaggagucuacaaagagggaaccuuucacacuauguggcaugugacccgcggugcaguucugaugcaccgaggaaagcggauagaacccucaugggccgacguuaagaaagacuugauaagcuacgguggcggguggaaacuugagggcgaguggaaggaaggugaagaaguccaaguauuagcgcucgaaccgggcaagaacccccgcgcagugcaaaccaagccgggaaucuucaaaacaaauacugguacaauuggcgccguaagccuagacuucuccccaggcacaagcggcagccccauagucgacaggaagggaaagguaguaggccuauacggaaacggggucguaacgagaagcggggcuuacguaucggccaucgcacaaacagagaaaagcauagaagacaacccagagaucgaagaugacaucuucaggaagaagcggcugaccauuauggaccuucaccccggggccggcaaaaccaaacgcuaccuaccggcuaucgugcgcgaagccaucaaacgaggauuacguacgcugauacuggccccaacgcgcguuguagcggcugaaauggaagaagcacuccgaggccuccccauccgcuaccaaaccccugcaaucagagcagagcacacgggcagggagauuguugaccugaugugccacgcuaccuucacgaugagacuacucucuccgguccgaguaccaaauuacaaccugaucaucauggaugaggcccacuucacagacccagcgagcauagcggcgcggggguacaucucaacccgcgucgagaugggcgaagcagcgggaaucuucaugaccgcgacucccccaggcagcagagauccauucccucagucgaacgcucccaucauggacgaagaacgagaaaucccggagaggagcuggaacagcggacacgaaugggugacggacuucaaagggaaaaccguuugguucgugccaagcauuaaagcgggaaacgacauugccgccugccucagaaagaacggaaagaaaguuauccaacuuucccgcaaaacauuugacagcgaauaugucaagacuagggcgaacgacugggacuucguagucacaaccgacauaagcgagaugggagcaaacuuuaaggcagaacgcguaauagacccacgccgcugcaugaaaccaguaauacuaaccgauggugaagaacggguuauccucgccggacccaugccaguaacccacagcagcgcggcccaacgccguggcagaauaggaagaaacccaaagaacgagaacgaccaguauauuuauaugggcgagccacuagaaaaugacgaagacugcgcccacuggaaagaagcaaaaaugcugcucgauaacauaaacacgccagaaggaauaaucccgagcauguucgagcccgagcgggaaaaagucgacgcuauagacggagaauaccgccugcgaggcgaagcgagaaaaaccuuuguggacuuaaugcggcgcggagaccuaccaguaugguuagcauacaaggucgcagcggaaggaauaaacuacgcggaucgaaagugguguuuugacgggaucaaaaacaaccaaauccuagaggaaaauguagaaguugaaauauggacgaaagaaggagaaagaaagaaacugaagccucgcuggcuggacgcgaggaucuacagugacccccuagcccuaaaggaauuuaaagaauuugccgcgggcaggaaaagccuaacgcuaaaccucaucacagaaauggggcgucuacccacguucaugacucaaaaagcccgcaaugcgcuagacaauuuggcaguccugcacacggcggagguaggagggaaagcguauacccacgcgcucagugaacugcccgagacgcucgagacacugcucuugcucacacuacuggcggccgucaccgggggaauauuccucuuccucaugucgggaaaaggcgugggaaaaaugacacugggcaugugcuguaucaucaccgcauccaucuuacugugguacgcacagauacaaccgcauuggauagccgccaguauaauucuagaguucuuccuaaucguccuauuaauacccgagccagaaaaacagcgaacgccacaagacaaccaauuaacguacguaguaauugcgauccuaacaguagucgcagcaacaauggcaaaugagaugggcuuccucgagaaaaccaaaaaggaccucggcuucggcaguauaacaacgcaagaaagugaaucgaauauacucgacauagaccuacggccggcgagcgcauggacccuguaugcugucgccacuacauucgucaccccaaugcugagacacucuaucgaaaauucaucaguaaaugugagcuuaacagcgauugcgaaucaggcaaccguguuaaugggucucgguaaaggauggccauuguccaaaauggauauuggagucccguuauuagccaucggcugcuacucucaggucaacccaaucacauugacggcggcccuccuccuucuaguagcccauuacgccauuauaggcccgggacugcaagccaaagcgacacgagaagcucagaaaagggcagccgcaggcaucaugaagaaccccaccguagacggcaucacaguaauagaccuggagcccaucccguacgacccaaaauucgaaaaacagcuaggacaggucaugcuacugauauuaugcguaacucaaguuuuaaugaugcgaacaacuugggcccuuugcgaagcacuaacgcuugccacaggaccgaucuccacgcugugggaggguaauccggggagguucuggaacaccacgaucgcaguaagcauggcuaacaucuuccgagguuccuaccuagcaggggccggccuacucuucaguauaaugaaaaacacaaccaacacacgccgggggaccggaaacguaggggaaacucucggggaaaaauggaaaagccggcuaaacgcacucgggaaaucagaguuccagauauacaaaaagagcggaauccaagaaguagaucggacuuuagcgaaggaggggaucaaacgcggggaaacggaccaccacgccguaagccgaggaucggcaaaauuacgcugguucgucgaacgcaauaugguaacgccagagggaaaagucgucgaccuuggcugcggacggggaggguggaguuauuacugcgguggacucaaaaacguccgagaagucaaaggccuaacgaagggcggcccgggccacgaagaaccaaucccgaugagcacguacggcuggaaucuagucagacuccaauccgguguagauguguucuucacuccacccgagaaaugcgacacacuccuaugcgacauaggugaaagcucaccgaacccaacgauugaggcaggacgcacauugcgaguacucaaccuaguagaaaauugguugaacaauaauacacaauuuuguauaaaagugcugaacccguauaugccaagcgucauugaaaagauggaaacgcuccagcggaaguacggcggugccuuggucagaaauccgcugucacgcaauagcacccaugagauguacugggucucgaacgcuaccgggaacauagucagcucgguuaauaugaucagccgaaugcugaucaaccgauucaccaugaaacauaaaaaggcgacuuaugagcccgacgucgaccuaggcagcgguacuagaaacaucggaaucgaaagcgaaauaccaaaccucgacaucguuggcaagagaauagaaaagaucaagcaggaacaugaaaccagcuggcacuaugaccaagaucacccauacaagacaugggcauaccacggaucauacgaaacuaagcaaacaggcagcgcaucaagcauggugaacgggguaguaagacuccuuaccaaaccuugggacguaguacccauggugacgcagauggcaaugaccgacacuacacccuucgggcagcaaagggucuucaaggaaaaagucgacacaaggacccaggagccuaaagaggggacgaagaaacucaugaaaaucacagccgaauggcuuuggaaggaacuaggcaaagagaaaacacccaggaugugcacacgggaagaguucacacgcaagguccgaaguaacgccgcacuuggggccguauuuacagaugaaaacaaguggaaguccgcaagggaagcgguugaggacggucgauucugggaguuaguggaucgggaaagaaaccugcaucucgaaggcaaaugcgaaacgugugucuacaauaugaugggcaaacgagaaaagaaacugggagaguucggcaaagccaaaggaagccgcgcgauaugguacauguggcuaggcgcccgcuuucuugaguucgaggcgcuaggcuucuuaaacgaagaccacugguuuucgcgaggcaauucgcuuagcgggguggaaggcgaaggacuucaccggcuaggcuacauacuacgggagguagguaagaaagagggaggggccauguaugccgacgauacugccgggugggacacccgcaucacucucgaggaccucaaaaacgaggagauggucacgaaccacaugaagggagagcacaagaaacuagccgaggccauauucaaauuaacguaucagaacaaagugguccgaguccaaaggccaacaccacgcggaacggugauggacauaaucucccgaaaggaccagcggggguccgggcaaguaggaaccuauggacucaauaccuucacaaauauggaagcacaguuaauaaggcagauggagggggagggaauauucaaaaguauccaacacuugacagcgacugaggaaaucgcaguacaaaauuggcuagcacguguggggcgggagaggcucagucguauggcuauaucgggggaugauugcgucguaaagccaaucgacgaccgauuugccuccgcguuaaccgcgcucaaugauauggggaaaguacgaaaagacauccaacaaugggaacccucacgaggauggaacgauuggacccaggugcccuuuugcucccaccacuuccacgagcucgucaugaaagacgggagagugcuggugguuccaugccguaaccaagaugaacucaucgggagggcgcguauuagucagggcgccggauggagccugaaggaaaccgcaugccuaggcaaaucauacgcccaaauguggacacugauguacuuucacaggagagaccuccggcucgcugcgaaugccauuugcagcgcagugcccucccacugggucccaaccucgaggacaaccuggagcauccaugcuaaacacgaguggaugacuaccgaagacaugcuagucguauggaacaggguguggauucaggaaaacccuuggauggaagacaagacaccgguggagaguugggaagaaguaccuuaccucggcaaacgcgaggaucaauggugcgggagcuuaauugggcugaccaguagggcaaccugggcgaaaaacauccagacggcaauaaaccaagugagaucacuuaucggaaacgaaggguacacagacuauaugccaucaaugaagcgguuucggcgggaagaagaagaagcuggcguccuaugguaa

SEQ ID NO: 25108 - RNA, 9876 nt, Artificial Sequence
  derived and/or modified CDS sequence (opt11) from DENV-2__KC294208__SS-prME
accgccggcguaauagucaugcugauaccgaccgccauggcguuccaccuaaccacucggaacggggagccccacaugaucgugggacggcaagagaaggggaagucccugcuguucaagacugaagacggcgugaacauguguacgcucauggcuauugaccuuggcgagcugugcgaggacaccaucacguacaagugccccuugcugcgccagaacgagcccgaggacaucgacuguuggugcaacagcaccagcaccuggguaaccuacggcaccuguaccaccacgggcgagcaccggcgagagaagcgcucuguggcccuagugccucacgucggcaugggacucgagacccgcaccgagacuuggaugagcagcgaaggggccuggaagcacguccagcggaucgagaccuggauacugcgccacccgggcuucacaaucauggcggcgauacuggccuacaccaucgggaccacgcacuuccagcgggcccucauuuucauccuccugaccgcgguugcgcccagcaugaccaugcgcugcaucggcaucuccaaccgagacuucgucgaaggcguuagcgggggcuccuggguggacaucguccucgagcacggcagcugcgugaccacgauggccaagaacaagcccacccuggacuucgagcugaucaagaccgaagccaagcagcccgccacccuucgcaaguauugcaucgaggccaagcugaccaacaccaccaccgagucccggugcccgacgcagggcgaaccuagccugaacgaggaacaagacaagcgcuucaucugcaagcacucgaugguagaccggggcugggggaacgggugcgggcuguucggcaagggcgggaucguaaccugcgcaauguucacgugcaagaagaacauggaaggcaagaucgugcagcccgagaaucuagaguacaccaucgugaucacgccccacagcggggaggaacacgcugucggcaaugacacagggaagcacggcaaggagaucaagaucaccccgcaguccucgaccaccgaggcugagcuaacggguuacggcaccgugacuauggagugcuccccacggaccggccucgacuucaaugagaugguauugcugcagauggaggacaaggccuggcucguccaccggcagugguuccuggaccugccacuccccuggcugccuggggcagacacgcaaggcucaaacuggauucagaaggagacccuagugaccuucaagaacccccacgccaagaagcaggacgugguggugcuagguucccaggagggcgccaugcacacugcccuaacgggcgcuacggagauacagauguccagcggcaacuuacuguucaccgggcaccugaagugccgcuugcggauggacaagcuccagcuaaaagggauguccuauaguaugugcacgggcaaguuuaagauugucaaagaaauagccgagacgcagcacgggaccaucgugauccgcgugcaguacgagggcgauggcucacccugcaagauccccuucgagauuaccgaccuugagaagcggcacguccuuggucgccugaucaccguuaacccgauagugacggaaaaggacagccccgugaauaucgaggccgagccgcccuucggugacuccuacauaaucguggggguggagccgggccaacugaagcuaaacugguucaagaaagggagcuccaucggccagauguucgagacgaccaugcgcggcgccaagcggauggccauccugggggacacagccugggacuuuggcagccucggcgggguguucacguccaucgggaaggcccuccaccaaguguucggggcgauauacggcgccgccuucagcggaguuuccuggacgaugaagauccugaucggcgugaucaucaccuggaucgggaugaacagccgcuccacgagccugagugugucccugguacucgucggcguggucacgcucuaccugggcgccaugguccaggcggacucuggcuguaucgugaguuggaagaacaaggagcuuaagugcggcuccgggaucuucaucaccgacaacguacacaccuggaccgaacaguacaaauuccagccugaaagccccagcaagcuugccuccgccauccagaaggcccacgaggaaggcauuugcgguaucagaagcguaacgcgccuugagaaccucauguggaagcagaucacgcccgagcugaaccacauccuguccgaaaaugaggugaagcucacgaucaugacuggcgacaucaaggggaucaugcaggccggcaagcggagccugcgcccgcagcccaccgagcugaaguacuccuggaaaaccuggggcaaggcgaagaugcucuccaccgagucucacaaccaaacguuccugaucgacgggcccgagacggccgagugcccuaacaccaaccgggcguggaacagccuggaggucgaagauuacggcuucggagucuucaccacuaacaucuggcucaagcugcgagaaaaacaagacguguucugcgauuccaagcugaugagcgccgccaucaaggacaaccgggcggugcacgcagacaugggauacuggaucgagagugcccucaacgacaccuggaaaauggagaaggccagcuucaucgaggugaaguccugccacuggcccaagagccacacucuguggucaaacggcguccuggagagugagaugaucauccccaagaacuucgccggcccugugucccagcacaacuaccgcccgggcuaccacacccaaaccgcggggcccuggcaccucggcaagcuggaaauggacuucgacuuuugcgaggggaccacagucguggucaccgaggacugcggcaaucggggcccgucucugcgcaccaccacggccagcgggaagcuuaucaccgagugguguugcaggucuugcacccugcccccgcugcgcuacaggggugaggacgggugcugguacggcauggagauccgcccgcucaaggagaaagaagagaaccuugucaacucccuggugaccgccgggcacggacagaucgacaacuucucccucggaguacuggggauggcgcuguuucucgaggagaugcugcgcacgcgcgucggcaccaagcacgcgauccugcucguagcccugagcuucgugacccugauaaccgggaacauguccuuccgagaucuuggucgcgucaugguuauggugggcgccacgaugaccgacgacauuggcaugggcguuaccuaccuggcccugcucgccgcguucaaggugcgccccaccuuugcugcugggcugcugcuccggaagcugacuagcaaggagcugaugauggccaccaucggcaucgcccuccugucccagagcacccugcccgaaaccauccucgagcugacggacgcgcuggcacuugggaugauggcccucaagaucguacgcaacauggagaaguaccagcuggccgucaccaucauggccaucucuugcgugccgaacgcggugauccugcagaacgccuggaaggucagcugcaccauacuagcggccguguccguaagcccucugcucuuaaccucaagccagcagaaggcugacuggauaccucuggcccucacgaucaagggccuuaauccuaccgccaucuucuugaccacccucucccguacgagcaagaagcgauccuggccgcugaacgaggccaucauggcagucggcauggugagcauacuggcauccagccugcugaagaacgacaucccaaugaccgggccccuggucgccggcgggcuccugaccguguguuaugugcugacaggccggagcgccgaucucgagcuggaacgcgccgccgacgucaagugggaggaccaggcugagaucuccgggucaucccccauccugagcaucacgauauccgaggacgggagcauguccaucaagaacgaggaggaggagcaaacccucaccauccugauccguaccggucugcuugucaucagcgggguauucccggucuccauacccaucaccgccgccgccugguaucugugggaggugaagaagcagcgcgccggagugcugugggauguuccgagcccaccuccaguggggaaggcggagcucgaggacggcgccuaccggauaaagcagcgcgggauccugggcuacucgcagaucggcgcuggcguguacaaggagggaacuuuccacacuauguggcauguuacccgcggagccgugcugaugcacaggggcaaaagaaucgaaccuagcugggccgaugugaagaaggaccucaucuccuaugggggcggcuggaagcuggagggggaguggaaggagggcgaagaggugcaggugcuagcgcucgagcccgggaagaacccccgcgccguccagaccaagcccggcaucuucaaaacgaacaccgggaccauuggcgccgucagccuagauuucucccccgguaccagcgggucccccaucguugaccggaaaggcaagguggucgggcuguacggcaacggcguggugacgcggagcggggccuacgucuccgcgaucgcccagacugagaagucaaucgaagacaaccccgagaucgaggacgauaucuuccggaagaagagacuuaccaucauggaucugcaccccggcgccgggaagaccaagcgguaccugcccgccaucgugcgcgaggcaaucaagcggggccugcgcacgcucauucuggcgccgacccgcguggucgcagcagagauggaggaggcccugcggggacuccccauacgcuaccagacccccgccauccgcgcggagcacaccggaagggagaucguggaccugaugugccaugccacauucacaaugcgccugcucagcccggugcgcgucccgaacuacaaccugaucaucauggacgaggcucacuucaccgaccccgccucgaucgcggcgcggggcuacaucucuacacgaguggagaugggggaggccgccggcaucuucaugaccgcgacgccgcccggguccagggauccauucccccagucaaaugcgcccaucauggaugaggaacgggagauccccgagcgguccuggaacagcggccacgaaugggugaccgacuucaaggggaagaccgucugguucgugccgucaaucaaggccggcaacgacauagccgccugccuacggaagaacggcaagaaagugauccagcucagucggaagacguucgacuccgaguacgucaagacgcgcgccaacgacugggacuucguggugaccacggacaucagcgagaugggagcgaacuucaaagcugagcgggucaucgauccccgccgguguaugaagcccgugaucuugacggacggcgaagagcgcgugauccuggcagggcccaugccgguuacccacuccagugccgcacagcggcgcggaagaaucgggcggaaccccaagaacgagaacgaccaguacaucuacaugggcgagccccuagagaaugaugaggauugugcgcacuggaaggaggccaagaugcugcuggacaacauaaacaccccggagggaaucaucccgaguauguucgagccggaacgugagaagguggacgcaauagacggggaguaccggcuccgcggagaggcccggaagacauuuguggaccugaugcgccgaggggaccugcccgucuggcucgcuuacaagguggcggccgaggggaucaacuacgccgaccgcaagugguguuucgacgggaucaagaacaaccagauccuggaggagaacguggaggucgaaaucuggacuaaggaaggcgagcggaagaaguuaaagccgcgcuggcucgacgcgcggaucuacagcgacccccuggcgcugaaagaguucaaggaauucgccgccggccgcaaaucccucacccugaaccugaucaccgagaugggucggcucccaaccuucaugacgcagaaggcccguaacgcacuggauaaccucgcggugcuccauaccgccgaggugggcgggaaagccuacacccacgcgcugagcgagcugcccgagacacucgaaacguuacugcuccugacccugcuagccgcagucaccggcgguaucuuccuuuuccugauguccggaaagggcauagggaaaaugacccucgguaugugcugcauaaucaccgccucuauccugcugugguaugcucagauccagccgcacuggaucgcagccuccaucauccucgaguucuuucugaucgugcugcucauccccgagccugagaagcagcggacaccccaggacaaucagcugaccuacgucgugaucgcaauccugaccguugucgccgccacuauggcuaacgagaugggguuccucgagaagacaaagaaggaccugggcuucggcuccaucaccacccaagaaucagaguccaacauccuggacaucgaccugcgcccugccagcgcguggacucuguacgccgucgccacgaccuucgugaccccaaugcugcggcacuccaucgagaauagcagugucaacgugucgcucacagcuaucgcgaaccaggccacgguccugaugggucugggcaagggguggccccucuccaagauggauauuggcgucccccugcuggccauugggugcuacucgcaggugaacccgauaacccucacugccgcacugcugcuccuggucgcucauuacgccaucaucggccccggcuugcaggcgaaggcgacccgcgaggcccagaagcgggccgccgcugggaucaugaagaaccccacggucgacgguaucaccgugaucgaucucgagcccauaccguacgaccccaaguucgagaagcagcucgggcaagugaugcuccucauccugugcgucacccaggugcugaugaugcgcaccacgugggcccuuugcgaggcccugacacuggcgaccggcccgaucuccacccucugggagggggacccaggccgguucuggaacaccaccaucgcggucagcauggccaacaucuuccgcggauccuaccuggccggggcgggucuacuguucagcaucaugaagaacaccacaaauacgcgccgggggaccggcaacgucggcgagacccuaggggagaaauggaaaucccgccucaacgcucuuggcaagucagaguuccagaucuacaagaaguccgggauccaggagguagaccggacccuggccaaggaggggauaaagcgcggggagacggaucaccacgcggucagccggggcuccgcgaagcuacgcugguucgucgagcggaacauggucaccccggagggcaaggucgucgacuuggggugcggcagggggggcuggagcuacuacugcggcggccugaagaacgugcgggagguaaagggccugacaaagggcggcccugggcaugaagagcccauacccauguccaccuacggcuggaacuugguacguuuacagagcgggguugacguguucuucacgccgcccgagaagugcgacacgcuguugugugacaucggcgagagcagcccuaacccgaccaucgaggcaggccggacccugcgcguccugaaucucgucgagaacuggcugaauaacaauacccaguuuugcaucaagguccugaacccuuacaugcccagcgucaucgagaagauggagacgcuccagcggaaguacgggggggcacuggugcgcaacccccugucccggaacucuacccacgagauguacugggugucuaacgccacggggaacaucguaagcucgguaaacaugauuagccgcaugcuaaucaauagauuuaccaugaagcacaagaaggccacguacgagccggauguggacuuaggcaguggaacccgcaacaucggcaucgagagcgagaucccaaaccuggacaucguggguaagcgaaucgagaagaucaaacaggagcacgagacguccuggcacuaugaccaggaccaccccuacaaaacgugggccuaccacgggagcuacgagacgaagcagacuggcuccgccagcuccauggugaacgggguuguccgacuacucaccaagcccugggauguggugccgauggucacccagauggcuaugacggacaccacccccuucggccagcagcgcguguucaaggaaaagguggacacuaggacgcaggagccaaaggagggcaccaagaagcugaugaagaucacagccgagugguuguggaaagagcucgggaaggagaagaccccccgaaugugcacacgugaggaguucacccgcaagguccggagcaacgccgcccugggcgcgguguucacggacgagaacaaguggaaguccgcccgcgaggcgguagaagacgggcgguucugggaacugguugaucgcgaacggaaccuccaccuggagggcaagugcgaaaccugcguguauaacaugauggggaaaagggagaagaagcugggcgaguucggcaaagccaaggggucgcgcgccaucugguacauguggcucggcgcccgcuuccuggaguucgaggcccuaggguuccucaacgaggaccacugguucucccggggcaacagcuuaagcggcgucgagggcgagggccuacaccgccucgguuacauccugcgggagguaggcaagaaggaaggcggcgcaauguacgccgacgauacggcgggcugggauacccgcaucacccuggaggaccucaagaacgaggagauggugacgaaccacaugaagggcgaacacaagaagcuggccgaggccaucuucaagcugacguaccagaacaaggucgugcgggugcagcgcccgacgcccaggggcaccguaauggacaucaucucccgaaaggaccagcgaggauccggccagguggggaccuauggccucaacacguucaccaacauggaggcccagcugauccggcagauggagggcgaggggaucuucaaguccauccagcaccugaccgccaccgaggagaucgcggugcaaaauuggcucgcccguguuggccgggagcgcuuaagcaggauggccaucuccggggaugacugcguagugaagcccaucgaugaccgauucgccagcgcccugacagcgcucaacgacauggguaaggugcggaaggacauccagcagugggagccaucccgcggguggaaugacuggacucaggugccguucugcagccaccacuuccacgagcuggugaugaaggacggccgaguccugguggugcccugccgcaaccaggacgagcucaucggccgggcccgcaucucacaaggggcgggauggagccugaaggagaccgccugccuggggaaguccuacgcccagauguggacccucauguacuuccacaggcgcgaucuacgccuggccgccaacgccaucugcagcgccgucccaucccacuggguucccaccagccgcacgaccugguccauucaugcgaagcacgaguggaugacuaccgaagacaugcucgugguuuggaacaggguguggauucaggagaacccguggauggaggacaagacgcccguggagucaugggaggaagucccauaccugggcaagcgcgaagaccaguggugcggguccuugauuggccucacgagccgggcaaccugggccaagaacauccagacggccaucaaccaggugcggagccugauuggcaacgagggguauacggacuacaugccguccaugaagcgguuccgccgcgaggaagaagaagccggugugcugugguaa

SEQ ID NO: 25109 - RNA, 9876 nt, Artificial Sequence
  derived and/or modified CDS sequence (opt11) from DENV-2__KC294209__SS-prME
accgccggcgucauugugaugcugauacccaccgcuauggcguuccaccucacgacccgcaacggggagccccacaugaucguggggcgccaggagaagggaaagucccugcuguucaagaccgaggacggcguuaacaugugcaccuugauggcaaucgaccuaggcgagcugugugaagacaccaucaccuacaagugcccucucuugcgccagaacgagccugaagacauugacugcuggugcaacuccacuucuaccugggucacuuacgggaccuguaccaccacgggcgaacaucgccgcgagaagcgguccgucgcccuagugccccacgucgguaugggccucgaaacucgcaccgagaccuggaugagcuccgagggcgccuggaaacaugugcagcgaauagagacuuggauccugcgucaccccggcuucaccaucauggccgcgauccuugccuacaccaucgggaccacucauuuccaacgagcacucaucuucauccugcuaacagcaguggcgccuagcaugacaaugagaugcauuggcaucuccaaccgggacuuugucgagggcgugagcgggggcuccuggguugacaucguccucgagcacgggaguugcgugaccacgauggcuaaaaacaagcccacccuggacuucgagcuaauaaagaccgaggcaaagcagccugccacccugcgcaaguacugcaucgaggccaaacugacgaauaccaccaccgagucccgaugcccuacccagggagagccuagccuaaacgaggaacaagacaagcgcuucaucugcaagcacuccaugguggaucgugggugggggaacggcugcgggcuguucgguaagggcgggaucgugaccugugcaauguucacguguaagaaaaacauggagggaaagauagugcagcccgagaaccuggaguauaccauagugaucacgccccacagcggugaggaacacgccguuggcaacgacaccgggaagcauggcaaggagaucaagaucaccccgcaguccagcacaaccgaggccgagcucacgggguacggcaccgugaccauggaaugcagcccgcggaccgguuuagacuucaacgagaugguccuguuacagauggaggauaaggcguggcucguacacaggcagugguuccuggaccuuccucucccuuggcugcccggagccgauacucaggggagcaacuggauccagaaggaaacccuagugaccuucaaaaacccucacgccaagaaacaggaugucguaguucucggaucucaggagggagcaaugcacacagcccugacgggagcuaccgaaauccagauguccagcggcaaccuccuguucacgggccacuuaaagugccgcuugcggauggacaagcuccagcuaaaggggauguccuacagcaugugcaccggcaaguuuaagaucgugaaggagauugcugagacacagcacgggacgauuguaauucguguacaguacgagggugacggcucccccuguaagauccccuuugagauaaccgaccuagagaaacgccauguccucgggagauuaaucaccgugaauccuauugugacggagaaggacagcccagucaacaucgaggcagagccgcccuucggagauuccuacauuaucguggggguggaaccgggccagcuaaagcucaacugguucaagaaggggagcuccaucggccagauguucgaaacuacgaugagaggggccaagagaauggccauccuaggggacacagccugggacuuuggcucuuuaggcggggucuucacuuccauaggaaaggcccuccaccagguguucggugcgaucuauggcgccgccuucagcggggugagcuggacaaugaagauccugaucggcgucauuaucaccuggaucgggaugaacagccguuccacuucucuguccgugagccuugucuuggucggcgucgugacgcuuuaccugggggccaugguacaggcggacuccggaugcauugugagcuggaagaacaaggagcucaagugcgggucggggaucuuuauuacagacaacgugcacaccuggaccgaacaguacaaauuccagcccgagagcccuagcaaacuugcauccgccauccaaaaggcccacgaagaaggcaucugcgggauccggagcgucacccgccuggagaaccucauguggaagcagauaaccccagagcugaaccacauccugagcgagaaugaggugaaacucaccaucaugacaggugacaucaaagggaucaugcaagccggcaagagaucacugagaccgcagcccacagagcugaaguacaguuggaagaccuggggcaaggcgaagaugcugagcaccgagucccacaaccaaaccuuccugaucgauggacccgagacggccgagugcccaaacacaaaccgcgccuggaacagccuggaggucgaggacuauggcuucgggguuuucacgaccaacaucuggcucaaguugcgggaaaagcaggacguguucugcgauucaaaacuuaugagcgccgccaucaaggacaaccgcgccgugcacgccgacaugggguacuggauugaauccgcccucaacgacaccuggaagauggaaaaagccagcuuuauugaggucaaguccugccacuggcccaaaagccacacgcugugguccaauggcguucuggagucugagaugauuauacccaagaacuucgccggaccuguuucacagcauaacuaccgaccaggguaccacacccagaccgcaggccccuggcaccucggcaagcuggagauggacuuugacuucugcgaggggaccacggucguggugaccgaggauugcggaaaccggggccccucccugcgcacuaccacggcuagcgggaagcucaucacggaguggugcugccgauccugcacacugcccccgcugcgcuaccggggcgaggacggaugcugguacggcauggagauccgccccuugaaggagaaggaagagaaccuagucaacagccugguaaccgccgggcacggccaaaucgauaacuuuagucucggcgugcuggggauggccuuauuccucgaggaaaugcugagaacacgagucgguacgaagcaugcgauccugcucguggcucugagcuucguuacccuaaucaccggaaauaugaguuuccgagaucucggccgcguuauggugauggugggggccacaaugacagaugacauaggcaugggaguaacuuauuuggccuugcuggccgcguucaaagugcgacccacuuucgccgccgggcugcuucuccggaagcugacgagcaaagagcuuaugauggcaaccaucggcaucgcccuccugucccaaagcacccugcccgagacuauccuggaacugaccgaugcccucgcccucgggaugauggcucugaaaaucgugagaaacauggagaaauaucagcuagccguaaccaucauggccaucuccugcgugccgaacgccgugauccuccagaacgccuggaaggucagcuguacgaucuuagccgccguguccguuagcccccugcuccugaccaguucccagcagaaagcggacuggaucccucuggcgcucacgaucaagggccugaacccaaccgcgauuuuucuuacaacccucucccggacgagcaagaagcguaguuggccgcuaaacgaagccauaauggcugucggcauggugucaauccuggcgucuaguuuacugaagaacgauauacccaugacugggccgcuggucgccggcggccuccugaccguauguuacgugcugaccgggcgauccgccgaucucgaacuggaacgagccgccgacgucaagugggaggaccaagcggaaaucuccgggaguucccccauccuguccaucacgauuuccgaggaugguagcauguccaucaagaacgaagaagaagaacaaacccucaccauucuuauccguaccggccugcucgugauuucagggguguucccagucuccauucccaucacggccgccgcaugguauuuaugggaggugaagaaacagcgcgccggggugcugugggacguccccagcccgccuccgguggggaaggcugagcucgaagacggagcuuaccgaaucaagcagcgcgggauccugggcuacagucagauaggggcggggguguauaaggagggcacguuucacacaauguggcacgucacccgcggugcuguacugaugcaccgcgggaagcgaaucgagcccagcugggccgaugucaagaaggaccucaucuccuacggcggaggcuggaagcuggagggggaguggaaggagggcgaggagguccagguacuggcuuuagagcccgggaagaacccccgcgccguucaaaccaagcccggcaucuucaaaacgaacacugggaccaucggagccgucucgcuggacuucucaccuggcaccagugggucccccaucguggaccggaagggcaaggugguggggcuguacggcaacggcguggucaccagaagcggggccuacgucucugccauugcccagaccgagaaauccaucgaagacaacccggagaucgaggaugacaucuucaggaagaaacgacucacgauuauggaucuucacccgggcgccggaaaaaccaagcgguaccuacccgccaucgugcgcgaggccaucaagaggggccuccgcacgcucauccucgcgccuacgcgcgugguggccgccgagauggaggaagcccugcgggggcucccgauccgcuaccagacccccgccauccgggcggaacacaccggccgagagaucguggacuugaugugccaugcuacuuucacaaugcgguugcucucgccggugcgcgucccuaauuacaaccugaucaucauggacgaggcgcauuucacggaccccgcgucgauagccgcgcgggguuacauaagcacccgcguggagaugggugaggcugccggcaucuucaugacggcuacaccgccggggucccgagacccguucccacagagcaaugcgcccaucauggacgaggagcgagaaauccccgagaggucguggaacagcggccacgagugggugaccgacuucaaggggaaaacggucugguucgugccgagcaucaaggccgguaacgacaucgcugccugccugcguaagaacggcaagaaggugauccagcucucacgaaagaccuucgacagugaguacgucaagacccgcgccaaugacugggacuucguggugaccacugacaucagcgagaugggggcgaacuucaaagccgagcgggucaucgacccccgacggugcaugaaaccugugauacugacggauggcgaggagcgcgugauacuggcggggccuaugccgguuacccacuccagcgccgcccagcggcgcggccgcaucggucguaaccccaagaacgaaaacgaucaauauaucuauaugggugagccuuuagagaacgacgaggacugugcgcacuggaaggaggcgaagaugcuguuagauaacaucaacaccccugagggcaucaucccgucgauguucgagcccgaacgcgagaaaguugacgccaucgacggggaguaccggcucaggggcgaggcccggaagaccuuuguggaccugaugcgccgcggggaccugcccgucuggcucgccuacaagguugcggccgagggcaucaacuacgcagaccguaaauggugcuucgacgggauaaagaacaaccagauccuggaggaaaacguggaggucgaaaucuggaccaaggagggcgagaggaagaaauuaaaaccaagauggcucgacgcucggauuuacagcgacccauuggcgcugaaggaguucaaggaguucgccgcaggaagaaaaucccucacccugaacuuaaucacggaaauggggcggcuccccaccuucaugacgcagaaggcacgcaaugcuuuagacaaccuggcagugcuccacacagccgaggucggcgggaaggccuacacccacgccuuaagcgagcuacccgagacccucgagacgcugcugcuccucacccugcucgcagcggucaccggcggcaucuuucuguucuugaugucagggaaaggcguggggaagaugacccucggcaugugcugcauuaucacggccagcaucuugcucugguacgcucagauacagccgcacuggaucgccgcuucaaucauacucgaguucuuccugaucgugcugcucauccccgagcccgagaagcagcggacgccccaggacaaccaacucaccuacguugucauugcaauccugaccgucguggcagccacaauggccaacgaaaugggguuccuagagaagacgaagaaagaccuaggauuuggcagcauuaccacccaggagucugaguccaacauccuggacauugaccuccgcccagccagcgcguggaccuuauacgccgucgccacuacauucgucaccccgaugcugcggcacaguauugaaaauuccuccguaaaugucagccucaccgcuaucgcuaaccaggccacggucuugauggggcuugggaagggguggccccucuccaagauggauaucggugugccccugcuggccaucggguguuacucacagguaaaccccaucacccucaccgccgcccugcugcucuuggucgcccacuacgccaucaucggcccgggccugcaggcuaaggcuaccagggaagcccagaagcgggcggccgccgguaucaugaagaaucccacaguggauggcaucaccgugauagaccucgaacccaucccguacgaccccaaauucgagaaacagcugggccaggucaugcugcugauccugugcgucacccagguacugaugaugcgcaccacgugggccuugugugaagcccuaacucuggcgaccggccccaucuccaccuugugggaggggaacccgggccgguucuggaacacuaccaucgccguuagcauggccaacaucuuucgaggcuccuaccuggcaggggcgggccuccuguuuagcaucaugaaaaacaccaccaacacccgccggggaaccggcaacgugggugagacccugggggagaaguggaagucccgccugaacgcacucggcaagucugaguuccagaucuacaaaaagucggggauccaagagguggaccggacccuagccaaggagggaaucaaacgcggggagacggaccaccaugccguaagccgggguucggcuaagcugaggugguucguugaaaggaauauggugacgccggagggcaaggucguugaccucgggugcggucgcgguggcuggagcuacuacugugggggccugaagaacgugcgagaggucaagggacugaccaagggcgggcccgggcacgaggaacccauccccauguccacguacgguuggaaccuagugcgccuucaaagcggcgucgacgucuucuucacuccgcccgaaaagugugacacccugcugugcgauaucggcgaaagcucccccaaucccaccaucgaggcgggcagaacccugcgugugcugaaccucguggaaaauuggcugaacaacaacacccaauuuugcaucaagguccugaacccuuacaugcccucaguuauugagaagauggagacgcuacaaagaaaguauggcggagcccuuguccguaauccguuaagucggaacuccacccacgagauguacuggguauccaacgccaccggcaauaucgugagcucugucaacaugaucagccgcaugcugauuaaccgcuuuaccaugaagcauaagaaggccacguacgagccggacguggaccuaggcagugggacccguaacaucgguaucgaaagcgagauccccaaucuagauauagugggcaaacguaucgagaagauaaaacaagagcacgaaaccuccuggcacuacgaccaggaucaucccuacaagaccugggccuaucacggcucauacgagacgaaacaaacaggcuccgcgagcuccauggugaacgggguggugcgucugcucaccaagcccugggauguggucccgauggugacccaaauggccaugacggauacuaccccauucggccaacaacggguauucaaagaaaaagucgacacgcggacgcaggagccuaaggaaggcaccaagaagcugaugaagaucaccgcugaguggcuguggaaggagcucgguaaggagaagaccccucggaugugcacgcgggaggaguucacccgcaagguucggagcaacgccgcccugggcgcgguguucaccgacgagaauaaauggaaguccgcucgcgaagccguggaggacgggcgguucugggagcugguggaccgcgagcgcaaucuccacuuagagggcaagugcgagacaugugucuacaacaugaugggaaagcgggagaagaagcugggggaguucggcaaggcuaaggggagccgggcaauuugguauauguggcucggcgcccgcuuccucgaauuugaggcccugggguuccucaacgaagaccacugguucucccgaggaaauucccugucagguguggagggagagggacugcaucgccucggguauauacugcgggaagugggcaagaaagaaggcggcgccauguacgccgaugauacggcugggugggacacccgcauaacccuggaagaccugaagaaugaggaaauggucaccaaucacaugaaaggggaacacaagaaacuggcagaggccaucuuuaagcuaacguaccagaacaaaguggugcggguucagcgcccgacuccccggggaaccgugauggacauaaucucccgcaaggaccagcggggaagcggucagguggggaccuacggccucaauacguucaccaacauggaggcccagcugauccgccaaauggagggcgaggggauauuuaaguccauccagcaccugaccgccaccgaggagaucgcgguccagaacugguuggcccgggugggcagggaacgucugagccgaauggccaucaguggugacgauugcguggucaagcccaucgacgaccgcuucgccagcgcccugacggcacucaacgacauggggaagguuagaaaggacauccaacagugggaacccucccgcggguggaacgacuggacccaggugccauucuguucacaccacuuucacgaguuaguuaugaaagauggccgagugcugguggucccgugccgcaaccaggaugagcucauaggccgcgcccgcauaagucagggugccggauggagccugaaggagaccgccugucuagguaaguccuacgcucagauguggacgcuuauguauuuccaccggcgcgaccugcgacuugcagccaacgcaauuugcagcgccgugccaucccauugggugcccacgagucggacgaccugguccauacacgcaaagcacgaguggaugaccacggaagacaugcuagucguguggaaccguguguggauccaggaaaacccauggauggaggacaaaacgcccgucgaaucaugggaggaggugccuuaccuggggaagcgcgaggaccaguggugcgguuccuugaucggccucaccagccgggccaccugggccaagaacauccagaccgccaucaaucaaguacgcagccugauuggcaacgagggguacacagacuauaugccgucuaugaagcgguucagacgcgaggaagaagaggccggcguucugugguga

SEQ ID NO: 25110 - RNA, 9876 nt, Artificial Sequence
  derived and/or modified CDS sequence (opt11) from DENV-2__KC294214__SS-prME
acugccggcgugaucgucaugcugaucccaaccgccauggcguuccaccucaccacacggaacggggaaccccacaugaucguggggcggcaggagaaggggaagagucuguuguucaaaaccgaggacggcguaaacaugugcacccucauggccaucgaccugggggagcugugcgaggacaccaucaccuacaagugcccccuccugaggcagaacgaacccgaagacaucgacugcuggugcaauagcaccagcaccugggucaccuacgggaccugcaccaccacuggcgagcaccggcgcgaaaagcgguccguugcgcucgugccccacgucgggaugggccucgagacgcguacugagaccuggaugaguuccgagggggccuggaagcacgugcagcggaucgagacguggauccugcgccacccgggcuucaccaucauggccgcgauccuggccuacaccauagggaccacacacuuccagcgggcccucaucuucaucuugcugaccgccguugcgccgagcaugaccaugcgcugcaucgguaucucgaaccgggauuucgucgagggcgugagcgggggcuccuggguggacauuguccucgagcacgguagcugcgucaccacaauggcgaagaacaagccuacccuggacuucgaacugaucaagaccgaggcaaagcaaccggccacccuccgcaaauacugcaucgaggccaagcugacgaacacuaccaccgagucacggugcccgacgcagggcgagccuagccugaacgaggagcaagauaagcguuucaucugcaagcacuccauggucgaccguggcugggggaacggcugcggucuguucggcaagggcggcaucgugaccugugcgauguuuacguguaagaagaauauggagggcaagaucgugcaacccgagaauuuagaguacacuaucgugaucacgccccacagcggggaagagcacgccgucggcaacgacaccgggaaacacggcaaggagaucaagaucaccccgcaguccagcaccaccgaagccgagcugaccggguacggcacagugacaauggagugcagcccccggaccggccucgacuucaacgagauggugcugcugcagauggaggacaaggccuggcugguccaccgacagugguucuuggaucugccccucccauggcugccgggggcggacacgcagggcagcaacuggauacagaaagagacccugguaaccuucaaaaacccccacgcgaagaagcaagacguggucguucucgggucccaggaaggcgccaugcacacugcccugacgggcgccaccgagauucagaugagcuccggcaaccuucuguucaccggccaccugaagugccgccugcggauggacaagcuccagcugaaggggauguccuacagcaugugcaccggcaaguuuaagaucguaaaggagaucgcugagacucagcacgguacuauagugauccgcgugcaguaugagggcgacggcucccccugcaagauccccuuugaaauaaccgaccuggagaagcggcacgucuuagggagauugaucaccgugaacccgauagugacagagaaggacagccccgucaacaucgaagcggagccacccuucggcgacuccuacaucaucgugggggucgagccgggacagcucaagcucaacugguucaagaagggguccuccaucgggcagauguuugagaccaccaugcgcggcgccaagcggauggcuauccugggggacaccgccugggacuuuggcagccucggcgguguguucacguccaucgggaaggcccuccaccaagucuucggggcuaucuacggcgccgcuuucagcgggguguccuggaccaugaagauacuaaucgggguuaucaucacauggauugggaugaacagccgcuccacuagccuguccgugagccugguucucguggggguagugacgcuuuaucugggggccaugguccaggcggacuccggauguaucgugagcuggcggaauaaggagcucaagugcggcuccgggaucuucauaaccgacaacgugcacaccuggacagagcaguacaaguuccaaccggagagcccgaguaagcuggcguccgccauccagaaggcccacgaggagggcaucugcgggauccgcucugucacccgacucgagaaccuaauguggaagcaaaucacucccgagcugaaccacauccuguccgagaacgaggugaagcucaccauaaugaccggcgacauuaaggggaucaugcaggccggcaagcgcuccuuacgaccgcagcccacggaacugaaguacuccuggaagaccuggggcaaggcgaagaugcucaguacagagucgcacaaccagaccuuccugauagaugggcccgagacggccgagugcccgaacaccaaccgcgccuggaacagccuggaaguggaggauuauggcuucggggucuucacuaccaauaucuggcucaaacugcgggagaagcaggacguguuuugcgacuccaaguugaugagcgcagccaucaaagacaaccgcgccgugcacgccgacaugggcuacuggaucgaguccgcccucaacgauacuuggaagauggagaaagccagcuucaucgaggucaaguccugccacuggcccaaaagccacacgcugugguccaacgguguguuagagagugagaugaucauccccaagaacuucgcagggcccgugucccagcauaacuaccguccgggcuaccauacccagaccgcggggcccuggcaccuggguaagcuggagauggacuucgacuuuugcgaggggacgacgguaguggugaccgaagacuguggcaaccgcggccccucguuacggaccaccaccgccagcgggaagcucaucacggagugguguugccgcuccugcaccuuacccccgcugcgguaccgcggugaggacgggugcugguacggaauggaaauccgcccccuuaaggagaaggaggagaaccuggucaacagcuuggugacugccgggcacggucagaucgacaacuucucacucggcguccuggggauggcgcuguuccucgaggaaaugcugcguacgagagucggcacuaagcacgcgauccugcucguggcacugagcuucgugacccugauaaccgggaacauguccuuccgggacuugggccgcgucaugguaauggugggggccacgaugacggaugauaucggcaugggcgucacuuaccuggcccugcucgccgcguucaaagugcggccgaccuucgccgcugggcugcugcucaggaagcugacgagcaaagagcugaugauggccaccauaggaaucgcccuauuaucccagagcacccugcccgagacgauccucgagcugacggacgcgcuggcccucgggaugauggcccugaagaucgugcgcaacauggagaaguaccagcuggcggucaccaucauggcuaucuccugcgugccgaaugcggugauccuccagaacgccuggaaggucagcuguacgauacuggccgccguuucagugagccccuuacuccuuaccuccagccagcaaaaggccgacuggauccccuuagcccucacaaucaaaggccugaauccgacagccauauuccugaccacccucagucgcacgagcaagaaacgguccuggccgcuuaacgaggccauaauggccgugggaauggugagcauccuggccuccagccuccugaagaacgacauucccaugacggggcccuuggucgccggcggucuccucaccgucugcuacgugcugaccgggcggagcgccgaccuagagcuagaacgggcugccgacgucaagugggaagaucaggcggaaaucuccgggagcucccccauacugagcaucacgaucagcgaggacggcucgauguccauuaaaaaugaggaggaggaacagacccucaccaucuuaauccggaccggccugcucgugauuagcgggguguuuccgguuaguauccccaucacugccgccgccugguaccugugggaggugaagaaacagcgugccggugugcugugggacguccccucgccgccgcccguugggaaagcggagcuggaggacggcgcguaccgcaucaagcaacggggcauccugggcuacucccagaucggcgccgggguguacaaggagggcacguuccacaccauguggcacgucacccgcggggccgugcuuaugcaccggggcaagaggaucgagcccagcugggccgacgugaagaaggaccucaucuccuacgggggaggcuggaagcuggagggugaguggaaggaaggcgaagagguacagguucuggcccucgagccugggaagaacccccgggccgugcagaccaagcccggcaucuucaagacgaacaccgggaccaucggcgccgucagccuggacuucucccccggcacaagugggucgcccauuguggaccgcaagggcaagguggucgggcuguacgggaacggcguggugacgagaucgggagccuacguaagcgcgaucgcccagacagagaagucgaucgaagacaaccccgagauagaggaugacaucuuccgcaagaagagacucaccaucauggaccuccaccccggagccgguaaaaccaaacgcuaccugcccgccaucguccgggaggccaucaagcguggucugcgcacgcucauccuugcgccgacccggguggucgccgccgaaauggaagaggccuugcgggggcuacccauccgguaccagaccccagccauacgcgcggagcacaccggccgggaaaucguggaccuaaugugccacgccacguucaccaugcgccugcucucccccguaagaguuccgaauuacaaccugaucaucauggacgaagcccacuucacagacccagcguccaucgccgcgcguggcuauaucagcacgagaguggagaugggggaggccgccggcaucuucaugacggccacaccgcccggcucccgcgacccuuucccccagaguaacgcgcccaucauggacgaggagcgggagauccccgagagauccuggaacucuggccacgagugggugacugacuucaaagggaagaccgucugguucgugccauccaucaaggccgguaacgacaucgccgccugccugcgcaagaacggcaagaaggugauccagcucagccguaagacauuugacuccgaguacgucaagacccgggcaaacgacugggacuucguggugaccacagacaucuccgagaugggagccaacuucaaagccgagcgggucaucgacccccggcgcugcaugaagcccgucauccugacggacggcgaggagcgggucauacuggcugggcccaugccggucacccacuccagcgccgcccagcgcaggggccggaucgggaggaaccccaagaacgagaaugaccaguacaucuauaugggcgagccgcucgagaacgacgaggacugcgcgcacuggaaggaggccaagaugcugcuggacaacaucaacacccccgagggcaucaucccgucuauguucgagcccgagcgggagaagguggacgccaucgacggggaguacaggcucagaggagaggcuagaaagaccuucgucgacuugaugcgaagaggggaucugcccgucuggcucgccuacaagguggcagccgagggcaucaacuacgccgaccggaaauggugcuuugacggaaucaagaacaaccagaucuuagaggagaacguggaggucgagaucuggacgaaggagggagagcggaagaagcugaagccgcgauggcuugacgccagaaucuacagcgacccucucgcguuaaaggaguucaaggaguucgcagccggccggaagucccucaccuugaaccugaucacagagauggggcgcuugcccaccuuuaugacgcaaaaggcccggaacgcgcuggauaaucuggcggugcuccacaccgccgaggugggcgggaaggccuacacccacgcccugagcgaacucccugagacccuggagacgcugcugcucuuaacccucuuagcugcggucaccggaggcaucuuccuguucuugauguccgggaagggcaucgggaagaugacccucggcaugugcugcaucaucaccgcgagcauccugcucugguacgcgcagauccagccgcacuggaucgccgccagcauuauucucgaguuuuuccugauugugcugcucauucccgagccagagaaacagcgcacgccacaggauaaccaacugacguacgucgugaucgcuauccucaccguugucgccgccaccauggccaaugagauggguuuccucgagaagacgaagaaggaccucggcuucggcagcaucaccacucaggagagcgaauccaacauuuuagauaucgaccuucggccggccuccgcguggacccuguacgccguggcgacuaccuucguaacucccaugcugcgccacuccaucgagaacagcuccgucaacgugagccucaccgcaaucgcgaaccaggccacugugcugaugggccugggcaagggguggccccucuccaagauggacaucggcgucccccugcuggccauugggugcuacagccaggugaacccgaucacccucaccgccgcccugcugcuacugguggcucauuacgccaucaucggacccggccuacaggccaaggcgacccgggaggcccagaaacgcgcugccgccgggaucaugaagaaucccacagucgacggcaucaccgugaucgaccuggagcccaucccauaugaccccaaguucgagaagcagcuggggcaggucaugcuucucauccugugugucacccaagugcugaugaugcggaccacgugggcccucugcgaggcccugacccuggcgaccggcccaaucuccacccucugggaggggaaccccggccgauucuggaacaccaccauagccgugagcauggcaaacaucuuccgcggcuccuaccuagccggggcgggccuccuguucagcaucaugaagaacaccaccaacacgcggcgcgggacuggcaacgugggcgagacccugggugagaaguggaaaucgcggcugaacgcccucgggaagagugaguuccaaaucuacaagaaguccgggauccaagaggucgaccgcacgcucgcuaaggagggaaucaagcgcggggagacggaccaccacgcugugagccgcggcagcgccaaacugcgaugguuuguagagcgcaauaugguaaccccggagggcaaaguggucgacuuaggcugcggccgcgggggauggagcuauuacugcgggggccugaagaaugugcgcgaggugaagggcuugaccaagggcggccccgggcacgaggagcccauccccauguccaccuacggcuggaaccucguccggcugcagagcgggguugacgucuuuuuuacgccgcccgagaagugcgauacccugcucugcgacaucggagagagcucgccuaaccccaccaucgaggcgggccgcacccuacgggugcugaaccucguggagaacugguuaaacaacaacacccaguuuugcaucaagguacugaacccguacaugcccagcgucauugagaagauggagacgcuccagcgcaaguacggcggcgcccuggugcgaaacccccugucccgcaauucgacacacgagauguacugggugaguaacgccaccgggaacauuguaagcucugugaacaugaucagccggaugcugaucaaccgcuucaccaugaagcacaagaaagcgacguacgagccugacguggaccucggcuccgggacgcggaacaucggcauugagagcgagauucccaaccuggacaucgucggcaagcgaaucgagaagauuaagcaggagcacgagaccucuuggcacuaugaccaagaccacccuuacaagaccugggccuaucacggcagcuacgagacgaagcagaccggcuccgcuagcucaauggucaacgggguaguccgucugcucaccaagcccugggacguggugccgauggucacccagauggccaugacggacaccacccccuuuggucagcagagaguuuucaaggagaagguagacacccgcacgcaggagcccaaagaggguaccaagaagcugaugaaaaucacagccgaauggcuguggaaggaacuggggaaggagaagacgccccggaugugcacgagagaggaguuuacacggaagguccgaagcaacgccgccuugggugcggucuucaccgacgaaaacaaguggaagagugcccgggaggccguggaggacgggcgcuucugggaacuagucgaccgggagcgcaaccuacaucuggagggcaagugcgagaccugcgucuacaacaugaugggaaaaagggagaagaagcugggcgaguucggcaaggccaaggggagccgcgcgauaugguacauguggcucggcgcccgguuucuggaguucgaggcccugggguuccucaacgaagaccacugguucucccgcggcaacucucugagcggcgucgagggagagggccugcaccggcucggguacauucugcgcgaggugggcaaaaaggaaggcggcgccauguacgccgacgacaccgcggggugggacacccgcaucacccuggaggaccucaaaaacgaggagaugguaacuaaucacaugaagggcgagcacaagaagcuagccgaggccaucuucaagcuuacguaccagaacaaagucgugcgcguccagcggccgacgccccggggcaccgucauggacaucaucagucggaaagaccagagggggagcggacagguggggaccuacggacucaacacguucacgaacauggaagcccagcugauucgccagauggagggcgaggguaucuucaaguccauccagcaccugaccacgacagaagagaucgccgugcagaacugguuggcgcggguuggccgagagcggcugagccgcauggccaucuccggcgacgauugcgugguuaaaccgaucgacgaccguuucgccagcgcgcugaccgcccucaaugacaugggcaagguccgcaaggacauccagcagugggagccaucacgaggguggaacgacuggacccaggugccguucuguucacaccacuuccaugagcuggugaugaaggacggccgcguacugguggugcccugccggaaccaggacgagcugaucgggcgcgcacguaucucacaaggagccggcuggagccugaaggagaccgccugccuugggaaguccuacgcccagauguggacgcugauguacuuucaccgccgggacuuacgccuggccgccaacgccaucuguagcgccguucccucccacugggugcccacuagccggaccaccugguccauacacgccaagcacgaguggaugaccacggaggauaugcucgucgucuggaaucgcguguggauacaggagaauccguggauggaagacaagacucccguggagagcugggaggagguccccuaccugggaaagcgggaagaccaauggugugggucccugaucggccucaccagucgcgcgaccugggcuaaaaacauacagacggcgaucaaccaggugcggagccugaucggcaacgaaggguacaccgacuacaugcccuccaugaagcgauuuagaagggaggaggaggaggccggcguguugugguga

SEQ ID NO: 25111 - RNA, 9876 nt, Artificial Sequence
  derived and/or modified CDS sequence (opt11) from DENV-2__KC294205__SS-prME
acugccgggguuaucgucaugcuaauccccaccgccauggcguuccaccucaccacacguaacggggagccccauaugaucgugggccgucaggagaaagggaagucguuacuguucaaaacagaggacggcgucaacaugugcacccucauggccaucgacuugggggaguuaugcgaggauaccaucacauacaagugcccacucuugcgccaaaacgagcccgaggacauagacugcuggugcaauagcaccagcaccugggucaccuaugggacaugcacgaccacgggcgagcaccggagggaaaagcgguccguggcauuagugccccacgucgggaugggucucgaaacucgcaccgagacuuggaugaguuccgagggggccuggaagcacguucaacggaucgagacuuggauccuacgccacccaggcuucaccaucauggccgcgauucucgccuacaccauugggaccacgcacuuccagagagcccucaucuuuauacugcugaccgccguggcucccagcaugacaaugcguugcaucgguaucuccaaccgggacuucguugaggguguaagcggaggcaguuggguggacauugucuuggagcacgggagcugcguaacuacgauggcaaagaauaagccuacccuggacuucgaguuaauaaagaccgaggcuaagcagccggccacccuccgcaaauacugcauugaggcuaaacugacuaacaccaccaccgagucccgguguccgacgcagggugagcccagccugaaugaagagcaggacaaacgcuucaucugcaagcauaguaugguggaucggggaugggggaacggcugugggcuguucgggaagggcgggauagugaccugcgcgauguucacuugcaaaaagaauauggaaggcaagaucguacagccggagaacuuggaguacacaaucgugaucacgccucacuccggggaggagcacgccgucggaaacgacaccgggaagcauggcaaggagaucaaaaucacaccgcaguccagcacaacagaggccgagcugacaggguacggcaccguuacgauggaauguagcccaagaaccggccucgacuucaacgagauggugcugcugcagauggaggacaaggccugguuaguccaccggcagugguuccucgacuuaccacuccccuggcugccaggcgcugauacgcagggaaguaacuggauucagaaggagacccuggugaccuucaaaaacccccacgccaagaagcaggaugugguaguguuagggucccaggagggcgccaugcacaccgcucugacgggggcgacggagauacagaugagcagcggcaaccucuuguuuacaggccaccugaagugccggcuucggauggauaaacuccagcuuaaggggauguccuacagcaugugcacugggaaguuuaagaucguaaaggagauugcagaaacgcaacacgggaccaucgucauccgagugcaguacgagggggacggcagccccugcaagauccccuucgagaucacagaccucgagaagcggcacgugcucggucgccugaucacugugaacccaaucgugacugagaaggacagcccggucaacauagaggcggagccgccuuucggagacuccuacaucaucguggggguggagcccggucaacuaaagcuaaacugguucaagaaggggucgucaauaggccagauguucgagacuacuaugcgcggcgccaagaggauggcaauccugggggauaccgcuugggacuuuggaucccucggaggggucuucacguccaucgggaaggcacuccaccaggucuucggagcgaucuacggcgccgccuucagcggggugucguggaccaugaagauccugauaggcgucaucaucaccuggaucgguaugaacagccgguccaccagccuguccgugagccuggugcucguggggguggugacauuguaccugggugccaugguccaggcggauuccggguguaucgugagcuggaaaaauaaagagcucaaaugcggcuccgggaucuucaucacagacaacguccacaccuggaccgagcaguacaaguuucagcccgaaagcccuucuaagcuggccucggcaauccagaaagcccaugaggagggcaucugcgggaucagaagcgucacccgcuuggaaaaccucauguggaagcagaucaccccagaguugaaccacauccuguccgaaaacgaggugaaacucaccaucaugaccggcgauaucaaggggaucaugcaggccggaaagcguucccugcgcccgcagccgacggagcugaaauacagcuggaagaccuggggcaaggcgaagaugcucagcaccgagucccauaaccaaaccuuccugaucgacgggccagagacagccgaaugcccaaacaccaaccgggccuggaacucucuggagguggaagacuacggcuucgggguguucacgacuaauauuuggcucaagcugcgugaaaaacaagacguguucugcgauagcaagcucaugagcgccgccaucaaggauaaccgugcgguccacgcugacaugggcuacuggaucgagagcgcccucaacgacacguggaagauggagaaggcuagcuucaucgagguuaaguccugccacuggcccaagagccacacgcuguggucaaacggcguacuggaguccgagaugaucauccccaaaaacuucgccgggcccgugucccagcacaacuauagaccuggguaccacacacagaccgcgggacccuggcauuuaggcaagcuggagauggauuucgacuucugugagggcacgacgguaguggugacagaggacuguggcaaccgugguccgucucugcgcaccaccacggccagcggcaagcucaucaccgaguggugcugcagauccugcaccuugcccccgcugcgguaccggggcgaggacggcugcugguacgggauggagauccgcccccucaaggagaaggaagagaacuuagucaacagcuuggucacagccggucauggacaaaucgacaacuuuuccuuaggggugcuaggaauggcccuuuuccucgaggagaugcugagaacgcgcguugguacgaagcaugcgauccugcucguggcccugucuuucguuacucuuaucacgggaaacaugaguuuccgggacuugggacgcguuauggugauggugggagccaccaugaccgacgauaucggcaugggcguaaccuaccuggcccugcuggcggcuuuuaaggugcgccccaccuucgccgccgggcugcuccuccggaaacugaccuccaaggagcugaugauggccaccaucggcaucgcccuacucucccaguccacccugcccgaaacuauccucgaguuaacggacgcgcuggcacucgggaugauggcccugaagaucgugcgcaacauggagaaguaccagcuagccgucaccaucauggccauuuccugcgugcccaacgcggugauccuccaaaaugcauggaagguuagcuguacgauccuggcugccguauccgugagcccccugcuucugacuuccagccaccagaaggcggacuggaucccccuggcacucacgauuaagggcuuaaaccccaccgcaauuuuucugaccacuuugucccggacgucgaagaagagaucguggccgcugaacgaggccaucauggccgucggcauggugagcauccuggcguccagccuccucaagaacgacaucccaaugaccgggccacuggucgccggugggcuccuuaccgugugcuacgugcugaccgggcggucggcagaccucgaacuggagcgcgccgccgacgucaagugggaggaccaggcggaaaucuccgguaguucccccauccugucuaucacgauaucggaggacgguucaauguccaucaagaacgaggaagaagagcagacccuuaccauccugauccggacuggccuacucgugaucucagggguguucccggucagcaucccgauaacggccgccgccugguaccuaugggaggucaaaaaacaacgcgcugguguguugugggacguuccaagcccgccccccguuggaaaggcggaguuagaggauggcgccuaccggaucaaacagagaggaauccuuggauacucccagaucggcgcggggguguacaaagagggcacguuccacaccauguggcaugucacccgcggggccguucugaugcaccguggcaaacggaucgagcccagcugggcagaugugaagaaggaccuuaucagcuacggcgguggcuggaagcuggagggagaguggaaggagggcgaggaaguucaggugcuugcgcuagagcccgggaagaacccgagagccgugcagaccaaacccggcaucuucaagaccaauaccgguaccauaggcgccguuagccuggacuucucccccggcaccagcgggagucccauaguggaucggaaggggaagguagucggacuguacggcaacggcgugguuacacgauccggugcuuaugucuccgcgaucgcccaaacggagaaguccauugaggacaacccggaaauugaggacgacauuuuccggaagaagcgcuuaaccaucauggaccugcacccuggcgcuggaaagaccaaacgguaucuccccgcgauuguacgugaggcuauaaagcggggccugcguacacuuauccuggcgccgaccaggguggucgccgcggaaauggaggaggcccugcgggggcugcccauucgcuaccagacccccgcgauacgggcggagcauaccggacgugagaucgucgaccugaugugccacgcuacauuuacgaugcggcugcucagccccgugcgcguaccgaacuauaaccugaucaucauggacgaggcgcacuucaccgaccccgccuccaucgccgcgcguggcuacauaagcacccgcguggagaugggggaggcugccggcauauucaugacggccaccccacccggcucccgggacccguucccccaaaguaacgcgcccaucauggaugaagagcgagagauacccgagcggucauggaacagcggccacgagugggugacugacuucaaggggaagaccguuugguuuguacccuccaucaaggcaggcaacgacaucgccgccugccugagaaagaacgggaagaaggugauucaacucagcagaaagacguuugauuccgaguacgucaagacacgcgcaaaugacugggauuucgugguaacuaccgacaucucugagaugggagcuaacuuuaaagccgagcggguuauagacccccgccggugcaugaagcccgucauucucacugacggggaggagcgcguuauacuagcagggcccaugccggucacccacuccuccgccgcccaaagacgcggccgcaucggucggaaccccaaaaacgagaacgaucaauacaucuacaugggcgagccucucgaaaacgacgaagacugcgcgcauuggaaggaggccaaaaugcuucuggauaacaucaacacccccgaagggaucaucccguccauguucgagcccgagcgcgagaaaguggacgccaucgacggggaauaccgccuccgaggcgaagcucggaagaccuucguggaccuaaugagaagaggggaccugccaguuuggcucgccuacaaaguggcagccgagggcaucaacuacgcugaccgcaaguggugcuucgacgggaucaaaaacaaucaaauccuggaagagaacguagaggucgagaucuggacgaaggagggcgagcggaagaagcugaagccgcgauggcuggacgcccggaucuacagcgaucccuuggcgcugaaggaguucaaggaguucgccgccggucgcaagucgcucacccugaaucuaaucacugaaaugggaagacuccccaccuucaugacucagaaggcccggaacgcccucgacaaccuggccgugcuccauaccgccgaagucggcgggaaggccuauacgcacgcgcugagcgagcugccggagacccuggaaacccuacuauugcuaacccugcucgccgcggucaccggcggcauauucuuguuccugaugucagggaagggcaucgggaagaugacgcucggcaugugcugcauaauaaccgccuccauccugcucugguacgcccagauccagccucacuggauagcagccuccaucauccuggaguucuuccugaucguccuguuaaucccagagcccgagaagcagcggacgccacaggauaaccagcugaccuaugucguuauagcgaucuugaccguggucgccgccacaauggccaacgagaugggauuccuagagaagacgaagaaggaucugggcuucggcagcauuaccacgcaggagucggagaguaauauccuggacauagaccuccgcccggccucagccuggacccuauacgccguugccacgacguucgugaccccgaugcugagacacucaaucgaaaacagcuccgucaacgugagccucaccgcuaucgcgaaccaggcgacagugcugauggggcucggcaagggguggccccucucgaagauggacaucggugugccacugcuggccaucggcuguuacagccagguaaacccaaucaccuugaccgccgcccugcugcucuuaguggcgcacuacgcaauaaucggccccggauugcaggcgaaggcgacccgcgaagcccagaagcgggcggccgccggaaucaugaaaaacccuacgguugauggcaucacgguuauagaucucgaaccaaucccguacgaccccaaguucgaaaagcagcuggggcaaguuaugcugcucauccugugcgucacccaggugcugaugaugcgaaccacuugggcccucugcgaggcccugaccuuagcgacagggccaaucucaacccucugggaggguaaucccggucgcuucuggaacacaaccaucgcgguuaguauggccaacaucuuucgcggcuccuaucuagccggggcgggccucuuguuuucaaucaugaaaaacaccaccaacacgcgcagagggaccggcaacgucggcgagacccucggggagaaguggaagucccgccuaaacgcacucggcaagagcgaauuucagaucuauaagaaguccgggauccaggagguggaccggacacuggccaaggaaggcaucaagaggggggagacggaccaccacgcggugagccggggguccgcgaagcugcgcugguucgucgagcggaacaugguuacaccggagggaaagguggucgaccuugggugugggagagggggcuggaguuacuacugcgggggccugaaaaauguacgggaggugaagggccugaccaagggcggcccuggacacgaggaacccauccccauguccacguacggcuggaaucucguucgcuuacaaagcggcguugauguguucuucacgccgccagaaaagugcgacacccugcucugugacauaggcgagagcucccccaacccuaccaucgaggcgggccggacgcugcgagugcucaacuuaguugaaaacuggcugaacaccaauacccaguuuuguauuaaaguucucaauccguacaugcccagcgucaucgagaaaauggaaacucuucaaaggaaauaugggggcgcccucgugcgcaacccgcugucccgaaacagcacccaugagauguacuggguguccaaugccaccgggaacaucgucagcucaguuaacaugaucagccgcaugcugauuaaccguuucacgaugaagcacaagaaggccaccuacgaacccgauguggaccucggguccgguacccgcaacauugggaucgagagcgagaucccuaaccuggacauagucggcaaacggaucgagaagaucaaacaggagcacgagaccuccuggcacuacgaucaagaccaccccuacaaaacgugggccuaucacgggagcuaugagaccaagcagaccggcucagcuagcuccaugguaaacgggguuguccgccugcucaccaagcccugggacgucgugccaauggucacucagauggccaugaccgauacgacccccuucggccagcaaaggguguucaaagagaagguagacacgagaacccaggagcccaaggagggcacaaagaagcugaugaagauuacugccgaguggcuguggaaggaacucgggaaggagaaaacgccacguaugugcacgagggaagaguuuacccguaagguccggagcaacgcagcucugggcgcgguguuuaccgacgagaacaaguggaaauccgccagagaggccguggaagacgggcgguucugggagcuggucgaccgcgagcggaacuugcaccuagaggggaagugcgagacgugcguguacaacaugauggggaagcgcgagaagaagcucggggaguucggcaaggccaagggcagccgggcgaucugguacauguggcucggcgcccgcuucuuagaguucgaggcgcugggguuccucaaugaggaccacugguuuagucggggcaacucacuaagcggggucgagggcgaaggccugcaccgccucggguacauccugagggaagugggcaaaaaagagggcggggccauguacgcagacgacaccgcggggugggacacccguaucacccuggaggaccucaagaacgaggagaugguuacgaaccauaugaagggcgagcauaagaagcucgcggaggccaucuucaaacugacauaccagaacaagguagugcgggugcagcgcccgacgccccguggcaccgucauggacauuaucucgcgcaaggaucagcgggggagcggacaaguggggacguauggacucaauaccuuuaccaacauggaagcccagcugauccgccagauggagggugaggggaucuuuaaauccauccaacaccuuaccgccacggaggagauagcgguucagaacugguuggcccgcgugggacgggagcgccucagccggauggccaucucgggggacgacugcguggugaagcccaucgacgaccgcuucgccucggcccucaccgcguugaaugacaugggaaaaguccggaaggacauccagcagugggagccgucccgcggguggaacgacuggacccaagugccguucugcagccaucauuuccacgaacugguaaugaaggauggccggguccuaguggugcccugucgcaaccaagaugagcucaucggacgcgcccgcauuucccagggggcuggcuggucgcugaaggaaaccgcaugccucgggaaguccuacgcccaaauguggacgcucauguacuuccaccggcgcgaccugcgucucgcggccaacgccaucugcagcgccgucccaucccauuggguccccacaucccgcacgacgugguccauccacgcuaaacacgaguggaugacaacggaggacauguuggugguuuggaacagaguguggauccaagagaacccguggauggaggacaagacccccguggagucaugggaagaggucccuuacuuggguaagcgggaggaccaguggugcgggagucugaucggcuugaccagccgggcgaccugggccaagaacauccagaccgcaauaaaccagguacgcagccugaucgguaacgaaggauacaccgacuacaugcccagcaugaagcgguuccgccgcgaagaggaagaggccggcgugcugugguga

SEQ ID NO: 25112 - RNA, 9876 nt, Artificial Sequence
  derived and/or modified CDS sequence (opt11) from DENV-2__KC294210__SS-prME
accgcgggcgugauagucauguuaauacccaccgcgauggcguuucaucucaccacucggaauggggagccccacaugauagugggucgucaggagaagggcaagucccuguuguucaagaccgaggacgggguuaacaugugcacacuaauggcaaucgauuuaggggagcugugcgaggacaccauaacauauaagugcccccuccugcgccagaacgagccggaggacaucgacugcuggugcaacagcacuagcacguggguuacguaugggaccugcaccacaacgggugagcaccggcgcgagaagaggucgguggcauuggugccccacguggggaugggccucgagacacgcaccgagaccuggaugagcagcgagggggccuggaagcacguucagagaauagaaacguggaucuugcgccauccgggcuucaccaucauggccgccauucuggccuacaccauugggacaacgcauuuucagcgggcgcucaucuucauccugcuuaccgccguggcgccgagcaugacaaugcgcugcaucggaaucagcaaucgugauuucgucgaaggcguuucaggcggcuccuggguggauaucguccucgaacacgggucaugcgucaccacgauggccaagaacaaaccgacguuggacuucgagcugauaaagacagaggccaagcagcccgccacccugcgcaaauacugcauugaggccaaacuuacgaacacaacaaccgagucccggugccccacucaaggagaacccucccugaacgaggagcaggacaagcgauucaucugcaagcacuccaugguggacaggggcugggggaauggcugcgguuuauucggcaaaggcgggaucgugaccugugcgauguucacgugcaagaagaacauggaggggaagaucguccaacccgaaaaccuggaguacacuaucgugaucacuccccauucaggggaggagcacgcuguuggaaaugauaccgggaaacacggcaaagaaaucaagaucaccccgcaauccagcaccaccgaggcugaacugacgggcuacggcaccguaaugauggaguccagcccccgcaccggccucgacuucaaugagauggugcugcuucaaauggaggacaaggcuuggcucguccaccggcagugguucuuagaccugccccuacccuggcucccgggugcagacacccaaggguccaacuggauccagaaggagacgcugguaaccuucaagaacccgcacgcgaagaagcaggacguggucguguugggaucacaggagggugcuaugcauaccgcccugaccggggccacggagauacagaugagcagcggcaaucuccuguuuaccgggcaccugaagugccgccugcggauggacaagcuccagcugaaggggaugagcuacucgaugugcaccgggaaguuuaagaucgucaaggaaaucgccgagacccaacacggcacaaucgugauccgcguucaguacgaaggggacggcagcccauguaagauaccauucgagaucaccgaccuggagaagcggcacguccucgggcggcuaaucaccgugaacccgaucgugaccgagaaggauucgcccgucaacaucgaggcugagccacccuucggcgacagcuacaucauaguggggguugagccgggccagcuaaagcucaacugguuuaagaagggcuccagcauuggccagauguucgagacgacgaugaggggcgccaagaggauggcaauacugggggacaccgccugggacuucggcucccucggcgggguuuucacgagcaucgggaaggcccuccaccagguguucggggcgaucuauggcgcugcuuuuuccggggugucauggacgaugaagauccugaucggcgucaucaucacauggauugggaugaacuccaggucgacuucguugaguguaucacuggugcucguagguguggugacccuguaccugggcgccaugguccaggcggacagcggcugcaucgugagcuggaagaacaaggagcugaaaugcggcucgggaauauuuauuacggauaacgugcauacuuggacggagcaauacaaguuccagcccgagagccccucaaagcuggccagcgccauucagaaggcacacgaagaaggcaucugugggauccgcuccgucacccgccuugagaaucugauguggaagcagauaacacccgagcugaaccacauuuugagcgagaacgaggugaagcucaccaucaugacuggcgauaucaaggggaucaugcaagccggcaagcggucccuccgcccucagcccaccgagcugaaauauagcuggaagacguggggaaaggcgaagaugcucuccaccgagagccauaaccagaccuuucuuauugacgggcccgaaacugccgaguguccgaacacgaauagagcuuggaacucauuagagguggaggacuacggcuucgggguuuucacuacgaacaucuggcucaagcuccgggagaagcaggauguauucugcgacucaaagcugauguccgccgccaucaaagacaaucgggcgguucacgccgacaugggcuauuggaucgaaagcgcccucaaugauacguggaagauggagaaggccuccuuuaucgaagucaagaguugccacuggccuaagucccacacccuguggagcaacggcgugcuggaguccgagaugaucaucccuaagaacuucgccggucccgugagccaacacaacuaccgcccgggcuaccauacgcaaaccgcggggcccuggcauuugggcaaacuugagauggacuucgacuuuugcgagggcaccaccgucgucgugaccgaagauuguggcaaccggggaccgagcuugcguacgaccacagccagugggaagcucauuaccgaguggugcugccggagcugcacccugccaccgcugcgcuaccggggcgaggacgggugcugguacgguauggaaauucgcccccuaaaggagaaagaagagaaccugguuaacagccuaguaaccgccgggcacggccagaucgacaacuucucacucggugugcuggggauggcccuuuuccucgaggagaugcuucggaccagagucgguacgaagcacgcgauacugcucguggcccuguccuucgugacccugaucaccgggaacaugucauuccgggaccucggcagggugauggugauggugggggccacuaugacggacgacaucggcaugggcguuaccuaccuggcccuacucgcagcguucaagguacgucccaccuucgcggccggccugcuacuccggaagcugaccuccaaggaacuaaugauggcgacaauugggauugcguugcugagccaauccacccuacccgagaccauccucgagcugaccgacgcccuugcauuaggcaugauggcgcugaagaucgugcgcaacauggagaaguaccagcuugccguaacuauuauggccaucagcugcgugcccaaugcgguuauacuccagaacgccuggaagguauccugcacgauccuugccgccgugagcguuaguccgcugcugcucaccucgucccagcagaaggcggacuggaucccacuugcgcucacaaucaagggauugaaucccacggccaucuuuuugacaacccucucucggacuucuaagaaacgcagcuggccgcugaacgaggccaucauggccguugguaugguguccauuuuagccuccucgcuccugaaaaacgauauccccaugacggggccgcugguggcuggcgggcuccugaccgugugcuacguucugacggggcguuccgccgaccucgagcuggagagggccgccgacgucaagugggaggaccaggcggagaucagcggguccucacccauccugagcauuaccauuagcgaggacggcucuaugagcaucaaaaaugaggaggaggagcagacgcucaccauccugauccggacaggucugcucgucaucuccgggguguuuccggucucaauucccaucacagccgcagccugguaccuuugggagguaaagaaacagcgcgccgguguacugugggacguccccagcccgccacccgugggaaaggcggaacucgaggacggggccuaccggaucaagcagcgcgggauccugggcuauagccagauuggcgccggugucuacaaggagggaaccuuccauacgauguggcacgucacacgcggggccgugcucaugcaccgcggcaagcggaucgagcccuccugggccgacgucaaaaaggacuugauuaguuauggcggcggcuggaagcuggaaggggaauggaaggaaggcgaggagguccaggugcuggcgcuggagcccgggaagaacccgcgcgccgugcagacuaagcccggcaucuuuaaaacuaacaccggaacaauuggcgcugucagccuggacuucagccccggcaccuccgggucccccaucguagaccggaaagggaaaguggucggguuguacggaaauggagugguuacgcgcucaggugcuuacgucagcgcaaucgcccagaccgagaaauccaucgaggacaaccccgagaucgaggacgacaucuuccggaagaagcgacuuaccaucauggaucuccaucccggggcggggaagaccaagcgguaccugcccgccaucguucgcgaggcaauuaagcggggacugcggacucucauccucgccccgacgcgcguggucgccgccgagauggaagaggcccuacgggggcuuccuauucgguaccagacccccgcuauccgggcggaacacaccggucgugagauuguugaccugaugugucacgccaccuucacaaugcgguuacuuucccccgugcgcgucccgaacuacaaccugauaaucauggacgaggcccacuucaccgaccccgccagcauugccgcgcggggcuacaucuccacccguguggagaugggggaggccgccggaaucuuuaugaccgccacgccgcccgggucaagggauccuuucccccaguccaacgcgcccaucauggacgaggaacgcgagauaccagagcggagcuggaacuccggccacgaaugggugacagacuuuaaggggaaaacaguaugguucgugccgagcaucaaggccggcaacgauaucgccgccugccugcggaaaaacggcaagaaagugauacagcucagcaggaaaacuuuugacagcgaguacguuaagacgcgugcaaaugacugggacuuuguggugacuaccgacauauccgagaugggcgcuaauuucaaggcugagcgggucaucgacccccgucggugcaugaagcccguaauccuuaccgauggcgaggagcgcgugauccuggcggggcccaugccggucacgcacagcuccgcggcccagcggcggggccgaauaggacgcaaucccaaaaaugaaaacgaccaguacaucuauaugggcgagccccucgagaacgacgaggacugugcacacuggaaagaggcaaagaugcugcucgacaacaucaacacccccgagggcaucauccccucgauguucgagcccgagcgugagaaaguagacgccaucgauggggaguaccgacuacggggugaagcccgcaagaccuuugucgaccugaugcgccggggagaucugcccgucuggcucgcguacaaggucgcagcggaaggcaucaacuacgccgaucgaaaguggugcuuugaugggaucaagaacaaucagauccuggaggagaacguugaggucgagaucuggaccaaggagggcgagcgaaagaagcugaagccgcgcuggcucgacgcgaggauauacuccgacccccuggcgcugaaggaguucaaggaguucgccgccggacgcaaaagccuuacgcugaaccugaucaccgagauggggagacucccuaccuucaugacccagaaggcacgcaaugcccuggacaaucucgcggugcuccacacggccgaggugggcgguaaagccuacacccacgcacuauccgagcugcccgagacacucgagacccugcuacuccugacgcuccuagcagcagucacaggcgggaucuuucuguuucuaaugucugguaagggcaucgggaagaugacacucggcaugugcugcaucauuacugccucgauucugcugugguacgcccagauccagccgcacuggaucgccgccagcaucauccucgaguucuuccugauagugcuacucauuccagagccggagaagcaacggacaccccaggacaaccaguuaacguaugucgucaucgcgauccugaccguggucgcugccacaauggccaacgaaaugggcuuccucgaaaagaccaagaaggaucuggguuucgggagcaucacgacccaggaauccgaguccaauauccuagacaucgaccuccgcccggccucugcuuggacgcuuuacgcuguggccaccacguucguaacacccaugcugcggcacagcauugagaacaguagcgugaaugugucccucaccgcaaucgcgaaccaagccaccgugcugaugggguuaggaaagggguggcccuugagcaaaauggacaucggcguuccacugcuggccaucgguugcuacucccaggugaauccaauuacucucaccgccgcccugcugcuccugguggcacacuacgcuaucaucggucccgggcugcaggccaaagccacccgcgaggcgcagaagcgggcggcggcuggcaucaugaagaaccccaccgucgacggcaucacggugaucgaccuagagcccauccccuacgacccgaaguucgagaagcagcuggggcagguuauguugcucauccugugcgucacgcaagugcugaugaugcgcaccacuugggcccucugcgaggcccugacgcuggcgaccggccccaucuccacccucugggaaggcaaccccggccgguucuggaacacgacgauagccgugucgauggccaauaucuuccgcggcagcuacuuggcaggggcgggccuccuauucaguauaaugaagaacaccaccaacacccgccggggcaccggcaaugucggagaaacccugggggaaaaauggaaaucucgccugaacgcacucggcaaauccgaguuucagaucuacaaaaagagugguauacaggagguugaucggacucuggccaaggagggcaucaaacgcggggagacggaucaccacgcggugagucggggcagcgcaaaguuacggugguucgucgagcggaacauggugacgccggagggcaagguagucgaccucggaugcggcagagggggcuggagcuacuacugcgggggucugaagaacgugcgggaggucaagggccugacaaagggugggcccgggcacgaggagcccauccccaugagcaccuacggcuggaaucucguucgccuccagagcgggguggacgucuucuuuacuccacccgagaagugcgacacccugcucugcgacaucggcgaguccagcccgaaccccacgaucgaggcaggccggaccuuacgcguccugaaccuugucgagaacuggcuuaacaacaauacacaguucugcauaaagguguugaacccguacaugccguccgucaucgagaagauggaaacucugcaacguaaauacgggggagcacugguccgcaauccccugucucgcaacuccacucacgagauguacugggucagcaacgcgaccggcaauaucgugucgagcgucaauaugauaucgcgcaugcugauuaaccgguuuaccaugaaacacaagaaggcgaccuacgaaccggacguugacuugggaucagggacgcgcaacauuggcaucgaguccgagauucccaaccuggacaucgucggcaagcggaucgaaaagaucaagcaggagcacgagaccaguuggcacuaugaccaggaccaccccuacaaaacgugggcguaccacggguccuaugagacuaaacaaacuggaagugcgucaagcauggugaacgggguggugagacugcuuaccaagcccugggacguggugcccauggucacccagauggccaugaccgauacgacacccuucggccagcagcgcguguucaaggagaagguggacacccggacccaggagcccaaggaggguacaaagaagcugaugaaaauuacugcagaauggcuguggaaggagcucgggaaggagaagacgccucguaugugcacccgggaagaguucacgcggaagguccgguccaaugccgcucucggcgcgguguucaccgacgagaacaaguggaaaucggcccgcgaggcaguggaggacgggcgguucugggagcuggucgacagagagcgcaaccuccaucuggaggguaaaugcgagaccugcguguacaauaugauggggaaaagggagaaaaaguugggcgaguucggcaaggccaaggguucccgagcuauuugguacauguggcucggggcccgcuuucuggaguuugaggccuugggguuucucaacgaggaccauugguucagccggggcaacagccuauccggggucgagggcgaaggccugcaccgccucggcuacauccugcgcgaaguuggcaaaaaggaagggggagccauguacgccgacgacacugcgggaugggacacgcgcaucacccuggaagaccuaaagaacgaggaaauggugacuaaccauaugaagggagagcacaagaagcucgccgaagccaucuucaaguuaaccuaccagaacaaggucguccgggugcagcgcccgacgccucgaggcaccgugauggacaucauuagccguaaagaccaacgggggucuggccagguggggaccuacgguuuaaauacguuuacgaacauggaggcccagcuuauucgccagauggagggcgaaggaauuuuuaaaucaauacagcacuuaaccgcaacggaggagaucgcggugcagaacuggcucguccgcguaggucgggaacgccugucucggauggcgaucaguggcgacgacugugucgugaagccgaucgacgacagauucgcguccgcccugaccgcucucaacgacaugggcaaggugcggaaggacauacaacagugggagcccagccggggguggaacgacuggacccaggugccguuuuguucccaccacuuccacgagcuggugaugaaggacgguagaguacuggugguccccugccgaaaccaggacgagcucauaggacgggcccguaucagccagggggccggcuggucccugaaggagacagccugucugggaaagagcuaugcccagauguggacccucauguauuuucaccggcgcgaccuacggcuggccgcgaacgccaucugcuccgcggugcccagccacugggugcccaccagccggaccacguggagcauccaugccaaacacgaguggaugaccaccgaggacaugcuagugguuuggaaccggguguggauccaggaaaacccuuggauggaggacaagacccccgucgaguccugggaggaggugccauaccugggaaagcgcgaggaucaguggugcgggagcuuaaucggccucacgagcagagcgaccugggccaagaacauccaaaccgccaucaaccaggugcgaagucucaucggcaacgaggguuauaccgacuacaugcccaguaugaagagauuccgccgcgaggaggaagaggccggcguuuugugguga

SEQ ID NO: 25113 - RNA, 9876 nt, Artificial Sequence
  derived and/or modified CDS sequence (opt11) from DENV-2__KC294215__SS-prME
accgcaggcgugauagucaugcugaucccgacggccauggcguuccaccucacgacccgcaacggggagccccacaugaucguuggccggcaggagaaggggaagucucugcuuuucaagaccgaggacggcgugaacaugugcacccucauggccaucgaccugggugagcugugcgaggacaccaucaccuacaaaugcccccuccuccgccagaaugaacccgaggauauugacugcuggugcaacagcaccagcaccugggucaccuacgggaccugcaccaccacgggcgagcauagacgcgagaagcgguccguggcccuggugccccacgucgggaugggccucgagacccguacggagaccuggaugagcuccgagggggccuggaagcacgugcagaggaucgagacauggauccugcgccacccaggguucacaaucauggccgcgauucuggcuuacaccaucgggaccacgcacuuccagcgggcucucaucuucauccugcugaccgccguggcgcccagcaugacgaugcgcugcauugggaucuccaaucgggacuucgucgagggcgugagcggcggcuccuggguggacaucguccucgaacacgguagcugcgugaccacgauggccaagaacaagccuacccuggacuucgagcugaucaagaccgaggccaagcagcccgcuacccuccgcaaguacugcaucgaggcgaagcugacgaacacaaccaccgagucccggugcccaacgcagggcgagcccagccugaaugaggagcaggauaagcgcuuuauuuguaaacacuccaugguggaccggggguggggcaacggcugcgggcuguucggcaaggguggaaucgugaccugcgcgauguucacgugcaagaagaacauggagggcaagaucguucagcccgagaaccuggaguacaccauagugaucaccccgcacagcggggaggagcacgccgucggcaacgacaccgggaagcacggcaaagagaucaagaucaccccgcaaucgagcaccaccgaggcagagcugacgggauaugguaccgugaccauggagugcagcccccggaccggccucgacuucaacgagauggugcuccugcagauggaggacaaagccuggcucguccaccgccagugguuccuggaccugccccuacccuggcugccuggggccgauacgcaggguagcaacuggauccagaaggagacucuugugaccuucaagaacccccaugccaagaagcaagaugugguagugcucggcucccaagagggcgccaugcacaccgcgcugacgggggccaccgagauucagaugucgagcggcaaccuccuguucaccggccaccugaagugccgccugcguauggacaaguuacaacugaaggggauguccuacagcaugugcaccggcaaguucaagaucgucaaggagauugccgagacgcagcacgggaccaucgugauccgugugcaguacgagggcgacggcucccccugcaagauucccuuugagaucaccgaucuggagaagcggcacguguuaggaagacugaucaccgugaacccgaucgugacagagaaggacaguccugucaacaucgaagccgagccgcccuuuggcgacuccuacaucauaguaggcguggagccuggccagcugaagcucaacugguucaagaagggauccucaauaggccagauguucgagaccaccaugcgcggcgcgaagcgcauggcaauccuuggcgauacugccugggacuucggcucucucggcggggucuucacguccauugggaaagcccuccaccagguguucggggcgaucuauggcgccgccuucagcggggucuccuggaccaugaagauccugauuggcgucauaaucaccuggaucgggaugaacagccgcuccacuagccugucuguuagccuggugcucguuggcgucgugacguuauaucugggggccaugguccaggcagacaguggcugcaucgugucauggaagaauaaggagcucaagugcggcuccggcaucuucaucaccgauaaugugcacaccuggaccgagcaauacaaguuucagcccgagucgccgagcaagcuugccuccgccauccagaaggcgcacgaggagggcaucugcgggauccggagcgucacaaggcuggagaaccucauguggaagcaaaucacaccggagcuaaaccacauccugagcgagaacgaggugaagcuaaccaucaugaccggagauaucaaggggaucaugcaggcaggcaagcggagcuuacgcccacagcccacggagcugaaguacagcuggaagaccugggguaaggcaaagaugcucagcaccgagucccacaaucagaccuucuugauagaugguccugagacggccgaaugcccgaauaccaaccgcgcauggaacagucuggagguggaggacuauggcuucggcgucuucaccaccaacaucuggcucaagcugcgcgagaagcaggacguguucugcgacuccaagcugaugagcgccgcaaucaaggacaaccgagcaguucacgcggacaugggguauuggauugagucugcccucaacgacaccuggaagauggagaaggccagcuuuaucgaagucaaguccugccacuggcccaagagccacacgcugugguccaacggcgugcuggagagcgagaugaucauccccaagaacuucgccggccccgugucccaacacaacuaccguccgggauaccacacccagaccgcggggccuuggcaccucggcaagcuggagauggacuuugacuucugugaggggaccacggucguggugaccgaggacugcggcaaccggggccccagcuuacguaccaccacggccagcgguaaacucaucaccgaguggugcugccgaucuugcacucugcccccgcugcguuacagaggugaggacgggugcugguacggcauggagauccgccccuugaaggagaaagaggagaaccuggucaacagccugguaaccgccgggcacggccagauugacaacuucucccucggcgucuuggggauggcccuguuccucgaggagaugcugagaacucgcgucggcaccaagcaugcgauucugcuaguggcccugagcuucguaacccugaucaccgggaacauguccuucagggaccucggccgcgucauggugauggugggggccacgaugacugacgacaucggcaugggcgucacuuaccuagcguugcucgcggcauucaaggugcggcccaccuucgcggccgggcugcuccucaggaaacugacgagcaaggaguugaugauggccaccaucggcaucgcccuccugucccagagcacccugcccgagaccauucuugagcucacggacgcguuagcccucgggaugauggcucugaagauagugcgcaacauggaaaaguaccagcuagccgucaccauuauggcgaucuccugcgugccgaacgcggugauucuccaaaaugccuggaaggucucaugcaccauccuggcggcgguguccgugagcccccugcucuugaccuccagccaacagaaggcggacuggaucccccucgccuugacgaucaagggccugaaccccaccgccauauuccugaccacccucucacgaacgagcaagaagcgcucguggccgcugaacgaggccaucauggccgucggcauggugagcaucuuggcuuccagccuccugaagaacgacauaccaaugaccgggccacuggucgccggcgggcugcugaccgugugcuacgugcugaccggccggagcgccgaccucgaguuagagcgcgcggcugacgucaagugggaagaucaggcggagaucuccgggagcucccccauccugagcaucacgaucuccgaggacggcuccauguccauaaagaacgaagaggaggagcagaccuugaccauccugauccggaccggacugcucgugaucagcgggguauucccggucuccaucccuaucaccgccgccgcgugguacuuaugggaggugaagaagcagcgcgccggcgugcugugggaugugcccagcccgccacccguggggaaggcggaacucgaggauggcgccuaucggaucaagcagcgcggcauacugggcuacucacagauaggcgccggaguuuacaaggagggcacauuccacaccauguggcaugucacacguggggccgugcugaugcaccgagguaagcggauugagccaagcugggccgacgucaagaaagaccuuaucuccuacgggggcggcuggaaguuagagggggaguggaaggaaggcgaggagguccaaguacuggcacucgaacccgggaaaaaccccagggccgugcagacgaagccagguaucuucaagacgaacacuggaaccaucggcgccguuagccuggacuuuagccccggaaccucuggcagucccaucguggaccgcaaaggcaagguggucgggcuguacggcaacggcguggugacaaggagcggagccuacgucuccgcgauagcccagaccgagaaguccaucgaggacaacccugagaucgaggacgacaucuuucggaagaagcgccucaccaucauggaccugcacccaggagccgggaagaccaagcgguaccuacccgcaauugugcgcgaggccaucaagcggggccugcgcacgcucauacuggcgccgacccgcguggucgccgccgaaauggaggaggcccugcguggacuccccaucagguaucagacccccgccauccgcgcggagcacaccggccgcgagaucguggaccugaugugccacgccacuuucaccaugcggcugcugagcccuguacgcgugccuaacuacaaccugaucaucauggaugaggcccacuucaccgaccccgccuccaucgccgcgagaggcuacaucagcacccgcguagagaugggggaggccgccgggaucuuuaugaccgcaacgccgcccggguccagagaccccuucccccagucaaaugcgcccaucauggacgaggagcgcgagauaccggagcgguccuggaauuccggucacgagugggugaccgacuucaaagggaagaccgucugguuugugcccuccaucaaggcuggcaacgacauugccgccugucugaggaagaacggcaagaaggugauccagcucucccggaaaacguucgacucggaauacgucaagaccagggccaacgacugggacuucguggugaccacagacaucagcgagaugggggccaacuucaaggccgagcgggucauugauccccgccggugcaugaagcccgugauccugacggacggcgaggaacgcgucauccuggccgggcccaugccggugacccauucaagcgccgcccagcggcgcggccgcaucgggcggaaccccaagaacgagaacgaccaguacaucuacaugggcgagccccucgagaacgacgaggacugcgcgcacuggaaggaagccaagaugcugcuggacaauauuaacacccccgagggcauuaucccguccauguucgagcccgagcgugagaagguggaugccaucgacggggaguauagacugcgcggcgaagcucggaagacguucguggaccugaugcgccgcggggaccugccaguguggcucgcguacaagguggcggcagaggguaucaacuacgccgaccguaagugguguuucgacgguaucaagaacaaccagauccuggaggagaauguugaagucgagaucuggacgaaggagggcgagcggaagaaacugaagccgcguuggcucgacgcccggaucuacagcgacccccuggcgcugaaggaguuuaaggaauuugccgccggcagaaagucccucacccugaauuugauaaccgagauggggagacuccccaccuucaugacgcaaaaagcccgcaacgcccuugacaaccuggcggugcuccacaccgccgaggugggggggaaggccuacacccaugcgcugagcgagcugccagagaccuuagagacgcugcugcuccugacccugcuggccgcggucaccggaggcaucuuccuguuccuaauguccgguaagggaaucgggaagaugacucucgggaugugcugcaucaucaccgccagcauccugcugugguacgcacagauccagccucacuggaucgcggccaguauuauccuggaauucuuccugaucgugcuguuaauccccgagcccgagaagcagagaacgccccaggauaaccagcugacguacgucgugaucgcgauccugaccguagucgcagccaccauggcuaaugagaugggguuccucgagaagacaaagaaggaucugggcuucgggagcaucaccacgcaggaguccgaauccaacaucuuagacaucgaccuccgcccugccagcgcguggacauuauacgcaguggccacgacuuucgugacccccaugcugcggcauuccaucgagaauuccuccgucaaugugagccucacugccaucgcaaaccaggccacggugcugaugggucuaggcaagggcuggcccuuguccaagauggauaucggcgucccuuuauuagccaucgggugcuacagccagguuaacccgaucacccuuaccgccgcccugcugcuccucguggcgcacuaugccaucaucggucccggccugcaggcgaaggcgacccgcgaggcccaaaagcgggccgcagccgggaucaugaagaaccccacggucgacggcaucaccgugaucgacuuggaacccauuccguaugacccuaaguucgagaagcagcuggggcaggucaugcuguugauucugugcgucacccagguacugaugaugcgcaccacgugggcucucugcgaggcccugacacuugcgaccggccccaucuccacacucugggaaggcaacccaggccgguucuggaacacaaccaucgcaguaagcauggccaacaucuuccgcggcuccuaccuggcaggagcgggacuccuguucucaaucaugaagaacaccaccaacacgcgccgggggaccgguaacgucggggagaccuugggggaaaaguggaagucccgauugaaugcacucggcaagagcgaauuccagaucuacaaaaaguccgggauccaggaaguagaccggacccuggcaaaggaggggaucaaacgcggggagacggaccaucacgcuguaagccgggguuccgccaaguugcgcugguucgucgagcggaauauggugacaccggaaggaaagguggucgaccucggcugcggccgcgggggcuggucguacuauugcgggggccugaagaaugugcgggagguaaagggcuugacgaagggcgggcccgggcacgaagagcccauccccaugucgaccuacggcuggaaucucguuaggcuucagagcgggguggacguguucuucaccccacccgagaagugugacacccugcuaugugacaucggugagucaucccccaaccccaccaucgaggcaggccguacccugcgcguccugaauuugguggagaacuggcuaaacaacaacacccaguucuguaucaagguccugaacccguacaugccaagcguaauagagaagauggagacgcuccagcggaaguacgguggcgcccuggugcgcaauccccugagccggaacagcacccacgagauguacugggugucuaacgccaccgggaauaucgucagcuccgugaacaugaucucgcgcaugcugaucaaccgcuucacgaugaagcacaagaaggccacguacgagccggacguugaccucggcuccggcacccguaauaucggaauugagagcgaaauacccaacuuagacaucgucggcaagcggaucgagaagauaaagcaggaacacgagaccuccuggcacuacgaccaagaucaccccuacaagaccugggccuaccacgggagcuaugagacgaaacagacaggcuccgcgagcuccaugguuaacggggugguacgccugcugacaaagcccugggacgugguaccgauggucacccagauggccaugaccgacaccaccccguuugggcagcagaggguguucaaggagaaaguugacacccgaacgcaggagccgaaggagggcacuaagaagcugaugaagaucaccgccaaguggcuguggaaagaacucgggaaggagaaaacgccccggaugugcacucgggaagaauucacccgcaaggugcggagcaacgccgcccugggcgcgguauuuaccgacgagaacaaguggaagucagccagggaagcaguggaggacgggagguucugggaguuagucgaccgagagcggaaccuccaccuggagggcaagugcgagaccugcguauacaacaugauggggaagcgcgagaagaagcugggugaguucgguaaggccaaaggcucaagggcgaucugguacaugugguuaggcgcccgcuucuuagaauucgaggccuugggauuccucaacgaggaccacugguuuucccggggcaacucccugagcggagucgagggcgagggacuacaccgccucggguacauccugcgggaggucggcaagaaagagggcggcgccauguaugcugacgacacggcggggugggacacccgcauaacccuggaggacuuaaagaacgaggagauggucaccaaucacaugaagggggagcacaagaagcuggcggaggccaucuucaagcugacguaccagaauaaggucgugcgggugcaacgcccgacgccccggggcacagucauggacaucaucuccaggaaggaucagcgggggagcggacagguggggacauacggcuugaacacauucaccaacauggaggcccagcugauccgucagauggaaggcgagggcaucuuuaaaagcauacagcaccugaccgcaacagaggagaucgcggugcagaacuggcucgcccgcgucggccgggagcgccuuagucggauggcaauuaguggggaugacugugucgugaagcccaucgacgaccgcuucgccagugcccugacggcguugaacgacaugggcaaggucaggaaggacauacagcagugggagcccucuagaggguggaacgacuggacacaggugccguuuugcagccaccacuuucacgagcuggugaugaaggauggccggguacugguggugccgugccgcaaccaggacgaacucaucgguagggcccgcaucagucagggggccggcuggagccugaaggagaccgccugccuggggaaguccuacgcacaaauguggacccuuauguauuuucaccggcgcgaccugcggcuggcggccaaugcgaucugcagcgccguccccucccacugggugcccaccagccgcacgaccuggagcauucacgcgaaacacgaguggaugacgacagaggauauguuaguggucuggaaccggguguggauccaggagaaccccuggauggaggacaagacgcccguggagagcugggaggagguccccuaccugggcaagcgagaggaccaguggugugggagucugaucggccucaccagccgggccacgugggccaagaacauccagacugccauuaaucaagugcgcucucugaucgguaacgagggauacacggacuacaugcccuccaugaagcgguuccgacgagaggaggaggaggccggcguucugugguga

SEQ ID NO: 25114 - RNA, 9876 nt, Artificial Sequence
  derived and/or modified CDS sequence (opt11) from DENV-2__KC294216__SS-prME
accgcuggggugaucauuaugcuuauccccaccgcaauggcguuccaccuaaccacccgcaacggggagccucacaugauugugggccggcaggagaaggggaagucccugcuguucaagaccgaggacggcgugaacauguguaccuugauggcgaucgaccugggcgaacuuugcgaggacaccaucaccuauaaauguccucuacugcgccaaaacgagccagaggacauagacugcugguguaauagcaccucuaccuggguaaccuacgggaccuguacgaccacgggggaacaccggagggagaagcgguccgucgcccuggugccccacguuggcaugggccucgagacccgaaccgagaccuggaugagcucagaaggagccuggaagcauguacagcggaucgagaccuggauccugcgucacccgggcuucgccaucauggccgccauccuugccuacaccauugggaccacgcacuuucagcgggcauugauuuucauccuguuaacggcgguggcaccaagcaugaccaugcgcugcaucgguaucagcaaccgggacuucguagaaggcgugagcggaggcuccuggguggacauuguacucgagcacgggagcugcgucacaacuauggccaagaacaagcccacgcuggauuuagaacucaucaagaccgaggccaaacagccggccacccugcggaaguauugcauagaagcgaagcugacgaacacaaccaccgaaucccgguguccgacgcagggggagccuagucucaacgaagaacaagacaaacgauucaucugcaaacacagcaugguggacaggggcugggggaacggcugugggcuguucggcaagggcgggaucgugacgugcgcaauguucacguguaagaagaacauggaagggaaaguugugcuucccgagaacuuagaauacacuauaguaaucacuccucacucaggggaggaacaugccguaggcaacgauacugggaaacacggagaggagaucaagaucacaccccaauccagcaucacggaggccgaacugaccggauauggcacugugacuauggagugcucgccccggaccggccuggauuucaacgagaugguguuacugcagauggaggaaaaggccuggcuggugcaccggcagugguuccuagacuuacccuugccuuggcuacccggggcagacacccaggguagcaacuggauccaaaaagaaacccuggugacguuuaagaacccccacgcgaagaagcaggauguggucguacuggggucccaggagggagccaugcacaccgcccugacaggggccaccgagauacagaugagcucaggaaaucugcuguuuacgggucaccucaagugcaggcuucggauggauaaacugcagcucaaagggaugucuuacagcauguguaccgggaaguucaagaucgugaaggagauugcggagacucagcacgggaccaucguaauccgcgugcaguacgaaggagacggcuccccgugcaagauccccuucgaaaucauggaccuugaaaagcggcacgucuuggggcgccucaucacagugaauccgauuguuaccgagaaggacagccccgucaauauagaggcagagccgcccuucggugacuccuacauuaucauaggagucgagccaggucagcugaagcuaaauugguucaagaagggcuccuccaucggucaaauguucgagaccaccaugcgcggcgccaagcggauggccauccucggagauaccgccugggacuucgguucucucgggggaguguucacaaguaucgggaaggcacuccaccaggucuuuggagccaucuacggcgcugcauucuccgggguguccuggacuaugaagauccugaucggugugaucaucacauggaucggcaugaauagccgcaguaccucauuauccgucucacugguacuggugggcgucguaacccuauaccuuggggcaauggugcaggcagacuccggaugugucgugucguggaaaaacaaggagcugaagugcggcuccgggaucuuuauuaccgacaacgugcacacuuggacagagcaguauaaauuccagccugaguccccguccaagcucgccuccgcgauccagaaggcucacgaggaaggcaucugcgggauccggagcgucacccgucuggagaacuugauguggaagcagauuacccccgaauugaaccacauccuguccgagaacgagguuaagcugaccaucaugacaggcgacaucaagggaaucaugcaggcgggcaagcggucucuccguccucagccuaccgagcuuaaguacucguggaagaccuggggcaaggccaagaugcuaagcaccgaaucccacaaccagaccuucuuaauugaugggccugagacggcagagugcccgaauaccaaccgcgcuuggaacagccuggaaguggaggacuacggauucggagucuucaccacuaauaucuggcugaagcuccgugagaagcaagacguguucugcgacuccaaacugaugagcgccgcuauaaaggacaaccgggcugugcacgccgacaugggcuacuggauagaguccgcgcugaacgacaccuggaagauggagaaggccagcuuuaucgaggucaaaucaugucacuggcccaagagccacacccugugguccaacggcguacuugagagcgagaugaucauacccaagaauuucgcuggcccggugagccagcacaauuaccggccgggcuaccacacccaaacugccgguccguggcaucugggcaaacuugaaauggacuucgacuucugcgaagggacuaccgucgugguaacugaagacugcgguaaucggggacccagccugaggaccaccaccgccagcgggaagcugauaaccgaguggugcugccguuccugcacacuuccaccucugcgcuacagaggcgaggacgggugcugguacggcauggagauccgccccuuaaaggagaaagaggagaaucucgugaacagucuggucacggccggacacggacaaauugacaacuucucccuggggguucucgggauggcgcuguuucuggaggagauguuacggacgcgcguuggcaccaagcacgccauccucuuaguggccgugagcuucuuaaccuugaucacagggaacaugagcuuccgggaucuggggcgagugaugguaaugguaggcguugcuaugaccgacgacauuggcaugggagugacuuaccucgccuuauuggcagccuucaaggugcggcccacuuuugccgccggacuccugcugcgaaaguuaacgagcaaggagcugaugauggcaacaauaggcaucacccuauuaucucagagcaccacgcccgaaaccauccuggaguuaacugacgcgcucgcgcugggaaugaugguccugaaaaucgugaggaacauggaaaaguaccagcucgcaguaaccaucaugacgauuuccugcguuccaaaugccaugauucugauaaaugccuggaaggugagcuguaccauccuggccgugguguccgugucaccucugcugcugaccuccucacagcagaaaacggacuggauaccucucgcgcugacaaucaagggccugaacccuaccgccaucuuucucacaacccucucccggacgagcaagaaacgcucauggccgcugaacgaggccguaauggcagugggcauggugucgauccucgccucaagccugcucaaaaaugacauucccaugaccgguccccuagucgccgggggucugcugacuguuuguuacgugcugaccggccggagcgcugaucuggagcuggagcgggcagccgacguaaaaugggaagaucaagccgagauaagcgggucgagucccauucucagcaucacgauauccgaggacggcucaaugaguauuaaaaaugaggaggaggagcaaacccugaccauauuaauccggaccggccuccuggugauaagcgggguguucccggucuccauucccauuaccgccgcugccugguaccuaugggaggugcgcaagcagcgggcuggcgugcucugggacgucccaagcccgccgccaguggagaaggcugaauuggaagauggggccuauagaauaaaacagcgcggcauacugggguacucccagauaggcgccgggguguacaaagagggcacguuccauaccauguggcacgucacccgcggggcgguccuuaugcaucgggggaagcgcaucgaacccagcugggcagacgugaagaaggacuuaaucucuuauggcgguggauggaagcuggaaggcgaguggaaggagggggaggagguccaagugcuagccuuagagcccggcaaaaauccccgggccgugcagacuaagcccgggcuguucaagacaaauacagguaccauaggcgccgucagcuuggacuucuccccgggcacuagcgggagcccgaucguggaccgcaaaggcaaggucguaggucuguaugggaacggaguugugacccggucuggugcguacguuuccgcgaucgcgcagaccgagaaguccaucgaagacaaccccgagaucgaagacgacaucuuccgcaagaaacggcugacgaucauggaccuucaccccggggcaggcaagaccaagcgcuaccucccggccaucgugcgggaggcgaucaaacgcggacuucgaacucugaucuuggccccaacccggguaguagcugccgagauggaagaggcccugagaggccuacccauccgguaucagacgcccgcgaucagggccgagcacaccgggagggagaucguugauuuaaugugccacgcaacguucacaaugcgccugcugagcccugugaggguaccaaauuacaaccucaucaucauggacgaggcacacuucaccgaccccgccucaaucgcggcccgcggauacaucagcacgcgcguugagaugggcgaggccgccgggaucuuuaugacggccacuccgcccggcucucgcgacccguucccacaaagcaacgcgcccauaauggacgaggagcgggagauccccgagcgcuccuggaacagcgggcacgaguggguuaccgacuucaagggcaaaaccguaugguucgugcccucgaucaaggcugggaacgacaucgccgcuugccuccggaagaauggcaagaaggugauccagcugagccgcaagaccuucgauucugaguacguaaagacccgggcuaacgacugggacuucguggugacaaccgauaucucggagaugggcgccaauuuccgcgccgaacgggucaucgacccucgucggugcaugaagcccgugauccucacagauggggaggagagagugauccuggccggacccaugcccgucacccacagcagcgcagcgcagagacgcgggcgcguaggccgcaacccuaagaacgagaacgaccaguacauauauaugggcgagcccuuggagaacgaugaggacugcgcacacuggaaggaggccaagaugcuccuggauaacauaaacacccccgagggcaucaucccguccauguuugagcccgagcgcgagaagguggacgccauagauggggaguauagacugcgcggggaggcucgcaaaaccuuuguugaucucaugcgcagaggggaccugccuguguggcuagcguacaggguagcggccgaggguauuaacuacgccgaucgucgcuggugcuuugaugguaucaagaauaaccagauccucgaagaaaauguggagguggagaucuggacgaaggagggggagcggaagaagcugaagccccgcuggcuugacgcccgcaucuacagcgaccccuuggcgcugaaggaauuuaaggaauuugccgccgggcgcaaaucgcuaacgcugaaucucaucaccgagaugggccggcugcccaccuucaugacucagaaggccaggaacgcgcuagacaaucuggccguacugcacaccgcugaagcugggggaagggccuacaaucacgcgcucagcgagcugcccgaaacgcuggagaccuugcugcugcucacgcugcucgcaaccgucacagggggcauauuccucuuucucaugucgggcaaggggaucggcaagaugacucugggaauguguugcaucaucaccgcaagcauucuacuaugguacgcccagauucaaccccacuggauagccgcgucaauaauccuggaguuuuuccuaauagugcugcuuauccccgaaccugagaagcagcgcacgccccaggauaaccagcucacguaugucgugauagccauccugacgguggucgccgccaccauggccaaugagaugggguuucuggagaagacaaagagagaccucgggcuuggcucgaucacuacacaggagucugagucaaacauccuggacauagaccuccgccccgcuagcgccuggaccuuguaugccguugcuacgacauucgugacccccaugcugagacauucuaucgaaaacuccagcgucaacguuagccucaccgccauugcgaaucaggccacugugcugauggggcugggaaaagguuggccccuuuccaaaauggauaucgggguuccccuuuuagccauaggcuguuacagucaggugaacccgaucacgcucaccgccgcguuacugcuccugguggcccacuacgccaucaucgggccuggacugcaagccaaggccacccgggaggcacagaagcgcgccgcugccggcaucaugaagaacccgacgguagacgguaucacgguaaucgaccucgagccaaucccguacgaccccaaguucgagaagcagcugggacaggucaugcugcuuauccugugugucacccaggugcucaugaugcggaccacgugggcacucugcgaggcgcugaccuuggcaaccggcccaaucagcaccuugugggaaggaaacccagggcgcuuuuggaauacgacgaucgcagugagcauggccaacauauuccgggggucguaucuggcgggcgcggggcuccuguucuccaucaugaagaacaccaccaacacgcgccggggcacagggaacaucggcgagacccugggagagaaguggaagucaagacuaaacgcccucgggaagucagaguuccaaaucuacaagcggagcggaauacaggagguagaccgcacccuggccaaggaggggaucaaacguggcgagacggaccaccacgccgugagccggggcucugccaagcugcggugguucguagagcgcaacauggucaccccagaaggcaaaguuguagaccucggcugcgggcggggcggguggagcuacuauuguggcggccuuaagaacguaagagagguaaagggccugaccaagggaggccccggacacgaggagccuauaccuauguccaccuacggguggaaccucgugcggcugcagucuggugucgacgucuucuucacaccgcccgaaaagugcgauacccugcuaugcgauaucggggaaagcucucccaacccaaccauagaggccggccguacccugcgggugcugaaucuggucgagaacuggcugaacaacaacacccaguucugcaucaaaguucugaauccguacaugccaagcgucaucgaaaagauggagacguugcagaggaaguauggcggggccuuagugcgcaacccucuaucccggaacagcacccaugagauguacugggugucgaacgccaccggcaauaucgugagcuccgugaacaugaucucucgaaugcugauuaaucgauucaccaugaagcacaagaaggccacguacgagccagacguagaccucggaucggguaccagaaacaucgggaucgagucugagauacccaaccuggcgaucaucggcaaacggaucgagaagaucaaacaggagcacgagacguccuggcacuacgaccaagaccaccccuacaagaccugggcuuaccacggcaguuacgagacaaagcagacuggaagugccucguccaugguaaacggggucgugcgccugcucacaaagcccugggacguuguccccaugguaacacaaauggccaugacugacacaaccccuuucggucaacaacggguuuuuaaggagaaagucgauaccagaacccaggagccgaaagaaggcaccaagaaacugaugcggaucaccgccgaguggcuguggaaggagcucggcaagaaaaagacgccgcgcaugugcacgcgggaagaguucaccaggaaggugcggagcaacgcggcauugggggccaucuucaccgacgagaauaaguggaaauccgcccgcgaagccguggaggacagccguuucugggaacuugucgaucgcgagcggaaccuccaccuggaaggcaaaugcgagaccugcguuuauaauaugauggggaagcgugagaagaagcugggcgaguucgggaaggcgaagggcuccagagccaucugguacauguggcucggugcccgguucuuggaguuugaagcucuuggguuccucaaugaggaucacugguuuucacguggcaacagccucucuggugucgagggagaagggcugcacagacucggauauauccuucgcgacgugagcaagaaggagggcggggcgauguacgccgacgauacggccggcugggacacccggauuacgcucgaggaccucaaaaaugaggagauggugacgaaccacaugaagggcgaacauaagaaguuagccgaggccgucuuuaagcugacuuaccaaaauaagguggugaggguccagcggccgacaccccgcggcaccgugauggacauaauaucgcggcgcgaucaacguggcagcggucagguggguaccuaugggcucaacacuuucacaaauauggaggcgcaacugaucaggcaaauggagggcgaggggaucuucaagaguauacagcacuuaaccgccaccgaggagauugcaguccagaacuggcuggcaagggugggccgggagcggcugagucgcauggccauaagcggagacgauugcguggucaagccccucgaugaccgguuugcguccgcacucacggcgcuaaacgacauggggaaggugcgcaaggacauacaacagugggagccuucucgcggauggaaugacuggacccaagugccuuucugcagccaccacuuucaugagcugguaaugaaggaugggcgcguguuggucgugcccugccgcaaucaagaugagcugaucggucgagcacggaucucccaaggagcaggcuggagccugaaggagacggccugccucggaaaguccuacgcccagauguggacgcuuauguacuuccaccguagggaucugcggcuagcagcaaacgccauaugcagcgcggugcccucccacugggugccaaccagccgcacaaccugguccauacacgccaagcacgaguggaugacaacugaagacaugcuggcaguauggaaccgcguguggauacaggaaaacccauggauggaggauaaaacgcccguagagagcugggaggagguacccuaccucgggaagcgcgaggaucaguggugcggcagccucaucgggcuaaccuccagagccaccugggcaaagaacauccaaacugccauaaaccaaguuagaucccugaucgggaaugaggaguacacggacuacaugcccuccaugaagcgguuccggcgcgaagaagaagaggcggggguuuugugguga

SEQ ID NO: 25115 - RNA, 9876 nt, Artificial Sequence
  derived and/or modified CDS sequence (opt11) from DENV-2__KC294218__SS-prME
accgccggcgugaucgucaugcugauccccaccgcaauggcguuccaccucacgacccgcaacggcgaaccccacaugaucguuggacggcaggagaaagggaagucccugcuguucaagaccgaggauggugugaacaugugcacacucauggccaucgauuugggggagcucugcgaagacacaaucacguacaagugcccauugcugcgccaaaacgaaccggaggacaucgauugcuggugcaacagcaccagcaccuggguaacauaugggaccugcaccaccacgggggagcaucgacgcgagaagcgguccguggcccuggugccacacgucgggaugggccucgagaccagaacggagacauggaugagcagcgagggugcauggaagcacguccagcguaucgagaccuggauucugagacacccgggcuucaccauuauggccgcaauacuugccuacaccaucgggacuacucacuuucaacgggcccucauucugauccugcucaccgcaguugcgccuagcaugacuaugcgaugcaucggcauauccaaccgggauuuugucgagggugugucgggcggcuccuggguggacaucguccuggagcacgggucuugcgugaccacgauggccaaaaauaagcccaccuuagacuucgagcucauaaagaccgaggcgaagcaacccgcaaccuugcggaaguacuguaucgaagccaagcugacgaacaccaccaccgagucaagguguccgacgcagggcgagcccucacucaacgaagagcaagacaaacgcuucaucugcaagcacuccaugguggaccgggggugggggaacgguugcggucuguucgggaagggagggaucgugaccugugccauguucacaugcaagaagaacauggagggaaagauugugcaaccugagaaccucgaguauaccaucgugaucacgccacacagcggugaggagcacgccgugggcaaugauaccggaaagcacggcaaagaaaucaagaucaccccgcagagcagcaccaccgaagcugagcucacgggguauggcaccgugacaauggaguguaguccccggacaggccuggacuucaaugaaauggugcugcuccaaauggaggauaaggccuggcugguucaccggcagugguuccuggaccuaccccugcccuggcugccgggggcagacacgcagggcaguaacuggauccagaaggagacacuugugacauucaagaacccacaugcuaaaaagcaggauguagucguguuagggucucaggagggggccaugcacaccgcccugacgggggcaaccgaaauccagaugagcucugguaaccuguuguuuaccggccaccugaagugccgccuccggauggacaagcuucaacugaaggggauguccuacuccaugugcaccggcaaauucaagaucgucaaagagaucgccgagacccaacacgguacaaucgugauucgcguccaguacgaaggcgauggcuccccaugcaagauccccuucgaaaucaccgaccucgagaagcggcacguucuggggcgacucaucaccguuaauccgaucgugacagagaaagacuccccggucaacaucgaggcagagccgcccuucggagacucuuacaucaucgugggaguugagccgggccaauuaaagcugaacugguucaagaaggggagcuccaucggccaaauguucgaaaccacuaugcgcggagccaagcggauggccauccugggggacaccgccugggacuucgguucccucgggggagucuucacgucuaucggaaaggcacugcaccagguguuuggcgcaaucuacggcgcugccuucagcggcgucuccuggaccaugaagauauuaaucggcgucaucauuaccuggaucgguaugaacagucgcucgaccucacuguccgugagccuugugcuagucggaguggugacccuguaccucggggccaugguacaggcggacagcggcuguaucgugagcuggaagaacaaggagcugaaaugcggcucagguauuuucaucacugacaacguucauacauggacagagcaguacaaguuccagcccgagucccccagcaagcucgccagcgcaauccagaaagcgcacgaggaggggaucugcgggauccggagcgucacgagacucgagaaccugauguggaagcagaucaccccugagcucaaccacauacuguccgagaacgaggugaagcuaaccaucaugaccggggacauuaagggaaucaugcaggcuggcaagcgcagccugaggccucagcccaccgagcucaaguacuccuggaagaccuggggcaaggcgaagaugcugagcaccgaaagccacaaucagaccuucuuaaucgauggaccggagaccgccgaaugcccgaauaccaaccgggccuggaauagcuuagagguggaggacuacggcuucggggucuucaccaccaacaucuggcugaaacugcgcgagaagcaggacguguucugcgauaguaagcucaugagcgccgccaucaaggacaaccgggcugugcacgccgacaugggcuacuggaucgaauccgcucugaaugauaccuggaagauggagaaggccagcuucauagaggucaaauccugccacuggcccaagagccacacgcugugguccaauggaguccucgagagcgagaugaucaucccaaaaaacuuugccgggccagugucccagcacaacuacaggccgggcuaccacacccagaccgcggggcccuggcaucugggcaagcucgagauggacuucgacuucugcgaggggaccacggucguugugaccgaggacugugguaaccggggccccucacuccgcacaaccaccgcaagugggaagcugaucacggaguggugcugccgguccugcacgcuaccuccgcuccgguaccggggcgaggacggcugcugguacggcauggaaaucaggccccuaaaggagaaggaggagaaucuggugaacagccuggucaccgccgggcauggccaaaucgacaacuucucccugggaguucuggguauggcccucuuccuggaggagaugcugcggacgcgagucggcacuaagcacgcaauccuccuuguggcccugagcuucgugacccuuauaaccgggaacauguccuuccgggaccucggccgcguaaugguuauggugggcgccacaaugaccgacgacaucggcaugggcgucaccuaccuggcccugcuggccgcguucaaggugcgcccaacuuuugccgcagggcuccugcugcggaagcugaccagcaaggaacuuaugauggccacgaucgggaucgcccugcugucccagagcacccugccggagaccauccuggagcugacagacgcgcucgcccugggcaugauggcccugaagaucgugcgcaacauggaaaaauaccagcucgccgucaccaucauggcgaucuccugcgugccgaacgcggugauccugcaaaacgcguggaaggucagcugcaccaucuuggcggccguguccguaagcccccuccuccugacuucgucccagcagaaggcggauuggaucccucucgcccugacuaucaagggccucaaccccaccgcuauauuccucacuacccugucccggacaagcaaaaagcgcuccuggccucugaacgaagccauaauggcugugggcauggugagcauccucgcguccagccugcuaaagaaugacaucccaaugaccgggccacucgucgcaggcgggcugcugaccgugugcuacgugcucaccggccgcagcgccgaccuggagcuggagcgugccgccgaugucaagugggaggaucaggcggaaaucuccgggagcagucccauccucagcaucacgaucuccgaggauggcagcauguccauuaagaaugaggaagaggagcaaacguuaaccauccugaucaggaccggccuccuggugaucagcggaguauucccggucuccauccccauaaccgccgcugccugguacuugugggagguuaagaagcagcgugccggagugcucugggacguccccagccccccgccugugggcaaggcggagcuggaggacggcgcguaccggaucaagcaacgcgggaucuugggcuacucacagauuggcgcggggguauacaaggagggcacguuccauaccauguggcacgucacccgcggggccguccucaugcaccgcggcaagcggaucgagcccagcugggccgauguaaaaaaggaccucaucucuuacgggggcggcuggaagcuggagggggaguggaaggaaggagaggagguccaggugcucgcacuggagcccgguaagaacccacgagccgugcagaccaagcccggcauuuucaagacgaacaccgguaccaucggcgcuguaagccuggacuuuucacccggaaccagcggguccccgaucguggaccggaagggcaagguggucgggcucuacggcaacggcguugugacacgcagcggugccuacgucuccgcgaucgcucagaccgagaaguccauugaggacaacccagagaucgaagacgacaucuuccggaagaagcgucugacuaucauggaucugcaucccggcgcugggaagaccaagcgguaccucccugccaucgugcgagaggcgaucaagcggggacuccgcacguuaauccuggcgccgacccgcguggucgccgcggagauggaggaggcccuacggggccugcccauccgcuaccagacucccgccauccgggcggaacauacgggccgugagaucguggaccugaugugccaugccacguucacgaugcggcuccugagucccgugcgcguacccaacuacaaccugaucaucauggacgaggcccacuuuacugaccccgccuccaucgccgcgagaggauacaucagcacucgcguugagaugggggaggccgccggcaucuucaugacggccacuccgcccgggucccgggaccccuuuccccagucgaacgcacccaucauggacgaggagcgagaaauccccgagcgguccuggaacagcggccacgagugggugaccgacuucaaggguaaaacagucugguucgucccguccauaaaagcgggcaacgacaucgccgcuugccuccgcaagaacggaaagaaagugauccaguugucucggaagacguuugacagugaguacgugaagacucgcgcaaacgacugggacuucguggugacaaccgacauuagcgaaaugggugcgaacuucaaggccgaaagaguaauagacccccgccggugcaugaagcccgugauacugacggauggcgaggagcgcguuauccucgccgggcccaugccggucacccacuccagcgccgcccaacggcgcggccgcaucgggaggaacccaaagaacgagaacgaccaguacaucuacaugggggagccccuggaaaacgaugaggacugcgcgcacuggaaagaagccaagaugcugcucgacaacaucaacacccccgagggcaucaucccguccauguuugagcccgagcgcgagaagguugacgccauagacggggaguaccggcugcgcggcgaggcacggaagacauucguggaccugaugcgccguggggaccuaccggucuggcucgccuacaaaguugcggccgaggggaucaacuaugccgaccguaaguggugcuucgacggaaucaagaacaaccagauccucgaagagaacguggagguggaaaucuggacgaaggagggcgagcggaagaaacucaagccgcguuggcuggacgccagaaucuacucugacccccuggcgcucaaggaguucaaggaguucgccgccggccgcaaaucccugacccuaaaccucauuacagagaugggccgccuucccaccuucaugacccagaaggcgcgcaacgcucuggacaaccucgcggugcugcacaccgccgagguaggcggcaaagccuacacccacgcccugagcgagcuccccgagacccucgagacguuacuccugcugacacuccuggccgcggucaccggcgguaucuuccuguuccucauguccgggaagggcaucgggaagaugacgcugggcaugugcugcaucauuacggccagcauccugcucugguacgcgcagauccagccgcacuggaucgcagcguccaucauuuuagaguucuuccugaucgugcuccugauccccgagcccgagaagcagagaacgccgcaggauaaccagcugaccuacgucgugaucgcgauccuuaccguggucgccgccaccauggccaacgaaaugggguuccuggagaagacgaagaaggaccugggcuuuggcaguauaaccacccaggaaagugaguccaauaucuuggacaucgaccuucggccggccagcgcauggacacuguacgccguggccacgacguuugugaccccuauguugagacacucuaucgagaauucgagcgucaacgugagccucaccgcuaucgcgaaccaggccaccgucuuaauggggcucggcaagggguggccucuguccaagauggacaucggcguccccuugcuggcuaucgggugcuacagccaagugaaccccaucacccucaccgccgcccuguuacugcugguggcgcacuacgcaaucaucgguccuggccuccaagcaaaggcaacccgagaggcccaaaagcgugcggcggccgggaucaugaagaacccgacggucgauggcaucaccguuaucgacuuggagcccaucccguaugaccccaaauucgagaagcaguuaggccagguuaugcucuuaauccugugcguuacccagguacucaugaugcgcaccacgugggcccugugcgaggccuugaccuuagcgaccgguccaaucuccaccuuaugggaaggcaaccccggcagauucuggaacacgaccaucgccgugagcauggcaaacaucuuccgcggcagcuaucuggcaggggcgggacuccuuuucagcauuaugaaaaacaccaccaacacgcgccgggggacuggaaacguuggcgagacccugggggaaaaguggaagucccgccucaacgcccugggcaagagcgaguuucagaucuauaagaagagugggauccaggagguggaccggaccuuagccaaggaaggcaucaagcgcggggagacugaccaccacgcaguuucucggggcuccgccaagcuccgcugguucgucgagcggaacauggucaccccagaagggaaggucgucgacuuagguugcgggcgcggaggguggagcuacuauugcgggggcuugaagaacgugcgggaggugaagggccucaccaagggcgggcccgggcacgaggaaccuauccccaugucuaccuacggcuggaacuuaguacgccugcagagcgggguggauguguuuuucaccccucccgaaaagugcgacacccuccugugcgacaucggcgagagcucccccaacccaaccauugaagcgggucgcacccugaggguccucaaccugguggaaaauuggcuuaacaacaacacccaguuuugcaucaagguacucaacccuuacaugccaagcgucaucgaaaagauggagacgcugcagcggaaguacgggggcgcucuggugagaaacccuuuaucccggaacuccacccacgagauguacuggguauccaacgcuaccgggaacaucgucagcucugugaauaugaucagccgcaugcucaucaaccgguucaccaugaagcacaagaaggcgacguaugagccagacguagaucuaggcuccgguacccgcaacauuggcaucgagagugagaucccgaacuuggacauugucggcaagagaaucgaaaagaucaagcaggagcaugagacuaguuggcacuacgaccaagaccaucccuacaagaccugggccuaccacgggagcuacgagacuaagcagaccggcuccgcgagcuccauggugaacgggguggucaggcuccuuaccaagccuugggacguggugccgauggugacacagauggccaugacggacaccacgcccuucggccaacagcgcguguucaaagagaagguggacacccggacgcaggagcccaaagagggcaccaagaaguugaugaagauuaccgccgaauggcuuuggaaggagcuggggaaagagaagacgccacggauguguacgcgagaggaauucacccgcaagguccggaguaacgccgcccugggcgcgguguucaccgaugagaacaaguggaaguccgcccgcgaggccguggaggacgggcgcuucugggagcucgucgaccgugagcggaaucugcaccuggaggggaagugugagaccugcguguauaacaugauggguaagagagaaaagaagcuaggcgaauucggcaaggccaaggggagccgggcgaucugguacaugugguugggcgcccgcuuccuggaguucgaagcccucggguuccugaacgaggaccacugguucagucgggggaacagccucagcggggucgaaggcgagggccuccaccgccugggauacauacugcgggaagucggcaagaaggagggcggagcaauguacgcggacgacacggcggggugggacacucgcaucacccucgaggaccucaagaaugaggagauggugaccaaccacaugaaaggcgagcacaagaagcuggccgaggccaucuucaagcucacguaccaaaauaaggugguaagagugcagcgcccgacgccuaggggcaccgucauggacaucaucucccgcaaggaccagcgggggagcggccagguugggacguacggacuaaacacguucaccaacauggaagcccagcugauacgacagauggagggcgaggggaucuucaaguccauucagcaccucacugcuaccgaggaaaucgcggugcaaaacuggcuggcccgcgucggccgggaacgccuuagccggauggccaucaguggggaugacugcguagucaaaccaaucgacgaccgcuuugccagcgcgcucacggcucuuaacgacaugggaaagguccggaaggacauccagcaaugggagcccucacgcggguggaaugacuggacacaaguaccguucugcagccaccauuuucacgagcuggugaugaaagacggccggguccuuguggugcccugccgcaaccaagacgagcugaucggccgggcucgcaucagccagggggccggcuggagcuuaaaggagacugccugccucgggaagagcuacgcccagauguggacccugauguauuuucaccggcgcgacuuacgccuagcggcuaacgccaucugcagugccgucccuucccauugggugcccaccagccgcacgaccugguccauacacgcgaaacacgaauggaugaccaccgaggauauguuaguggucuggaaccggguguggauccaggagaaccccuggauggaagauaagacgccagucgagagcugggaggaaguccccuaccugggcaagcgcgaggaccaguggugcggaucgcugaucggccugaccagccgggccaccugggccaagaauauccagaccgccauaaaccaggugagaagccugaucggcaacgagggcuacacggacuacaugccgucuaugaagcgguuccgcagagaagaggaggaggccggagugcuuugguaa

SEQ ID NO: 25116 - RNA, 9876 nt, Artificial Sequence
  derived and/or modified CDS sequence (opt11) from DENV-2__KC294220__SS-prME
accgccggcgugauagucaugcugaucccuacggccauggccuuccaccucaccacgcgcaacggggaaccucacaugaucguuggccggcaggagaagggcaagucccuguuauucaagacggaggacggcgugaacaugugcacccucauggccaucgaccugggggagcugugcgaggacaccaucacguacaaguguccccugcugcgucagaacgagcccgaggauaucgacugcuggugcaauuccaccucaacaugggucacguacgggacuugcaccacuacgggcgagcaucggcgcgagaagcgguccguggcccuggugccccacgucgggaugggcuuggaaacgcgcaccgagaccuggaugagcuccgagggggccuggaagcacguucagcggaucgagaccuggauccuccgccacccgggcuucaccaucauggccgcgaucuuagccuacaccaucgggaccacgcacuuccagcgggcccucaucuucauacugcugaccgccguggcgcccagcaugacgaugcgcugcaucggcaucuccaaccgggacuucgucgagggcgugagcggaggcuccuggguggacaucgugcucgagcacgggagcugcgugacgacgauggcuaagaacaagcccacccuggacuucgagcugaucaaaaccgaggccaaacaaccggccacccuucgcaaguacuguauugaagccaagcugacgaacaccaccaccgaaucccgaugcccgacgcagggcgaacccagccugaaugaggagcaagacaaacgcuucaucugcaagcacuccaugguggaccgagggugggggaacggcugcggcuuauuuggcaagggcggcaucgugaccugcgcgauguucacgugcaagaagaacauggaggggaagaucgugcagcccgagaaccuggaguacaccaucguaaucacgccucacagcggagaggagcaugccgucggcaacgacaccgggaagcacgggaaggagaucaagaucaccccgcagucgagcacuaccgaggccgaacugacgggguacggcacugugaccauggagugcagccccaggaccggccucgacuucaaugagaugguguuacugcaaauggaggacaaggccuggcuuguccaccgacagugguucuuggaccugccccucccuuggcugccgggggccgacacgcagggcagcaacuggauccagaaagagaccuuggugaccuucaaaaacccccacgccaagaagcaggacguaguuguauuggggucccaggagggcgccaugcacaccgccuugacgggagccaccgagauccagaugagcagcggcaaccuccuguuuaccggccaccuuaagugccgccuacggauggacaagcuccagcugaaggguaugucuuacucuaugugcacuggcaaguucaagaucgucaaggagaucgccgaaacacagcacgggaccauuguuauccgcgugcaguacgagggcgacgguucgcccugcaaaaucccuuucgagaucaccgaccuggagaaacggcauguccucgggcgccugaucaccguaaacccgaucgugacggagaaggacaguccggucaacaucgaggcggaaccgcccuuuggagacuccuacaucaucguggggguggagccgggccaacugaaacucaauugguucaagaaggggaguaguauagggcaaauguucgagaccaccaugcgcggcgcgaagcgaauggcgauacugggggacaccgcgugggacuucggcagcuuaggcggggucuucacguccaucgguaaagcccuccaccagguguucggggcgaucuacggcgcugccuucagcgggguguccuggaccaugaagauccucaucggggucaucaucaccuggaucgggaugaacucccgcucuaccagccuguccgugagcuuaguucucgucggcguggugacgcuguaccugggggccaugguccaggcggauuccggcugcaucgucagcuggaagaacaaggaacucaaaugugguuccggcaucuucaucaccgacaacguccauaccuggaccgagcaauacaaguuccagcccgaaucucccucuaagcuggcuucagccauacagaaagcccacgaggagggcaucugcgguauccggagcgucacgcgccuggagaaccucauguggaagcagaucacacccgaguuaaaccacauccuguccgagaacgaggugaagcucacuauaaugaccggcgacaucaaggggaucaugcaggccggcaagcgcagccuccgaccacagcccacggagcugaaguacuccuggaagaccuggggcaaggcaaagaugcucaguaccgagucacacaaucagaccuuccugaucgacgggcccgagacggcagagugcccgaacaccaaccgggcauggaacucgcuagagguggaagacuacggauucggggucuucaccaccaacaucuggcucaaacugcgcgagaagcaggauguguuuugcgacuccaaacugaugagcgccgccaucaaggacaaccgggcggugcaugccgacaugggcuauuggaucgaguccgcgcucaacgauaccuggaaaauggagaaggccagcuucaucgaggucaaguccugccacuggcccaagagccacacgcugugguccaauggcguucuggagagcgagaugaucaucccuaaaaacuucgccgggcccgugucccagcacaacuaccgcccgggcuaccacacgcagaccgcuggaccuuggcaccugggcaagcuggagauggacuucgauuucugcgaggggaccacagucguggugaccgaggacugcggaaaccgaggccccagcuuacgcaccacaacggccagcgggaagcucaucaccgaauggugcugcagaucuugcaccuugcccccgcugcgcuacagaggggaagacgguugcugguacggaauggagauccgcccgcucaaggagaaggaggaaaaccuggucaacagccuggugacggccgggcacggccaaauugacaacuucucacucggcgugcuggggauggcccucuuccucgaggagaugcugcggacgagagucgguaccaaacacgcgauccugcucguggcccugucuuucgugacccugauaaccgggaacauguccuuccgggaccucggccggguaaugguuauggucggggccacgaugaccgaugacaucggcaugggcguuaccuaccuggcccugcucgccgcauucaagguacgccccaccuuugccgccgggcugcugcuccggaagcugacguccaaggaguuaaugauggcgaccaucggcaucgcccuucugucccagucuacccugccagagacgauccucgaacugacggacgcccuggcccucgggaugauggcucugaagaucguacgcaacauggagaaguaccagcuggcugucacgauaauggccaucuccugcgugcccaacgcagugauucuccagaaugcguggaagguaaguugcaccaucuuggccgccguguccgugagcccucugcuccugaccucuagccaacagaaggccgauuggaucccccuggcccucaccaucaagggccugaaucccaccgcgaucuucuugaccacacucucccggacgucuaagaagcgcucuuggccgcugaacgaagccaucauggcuguuggcaugguaagcauccuggcguccagcuuguugaagaacgauauacccaugaccgggccgcuggucgccggaggacucuugacgguguguuacgugcugaccggucguucugcggaccucgagcuggagcgcgccgccgacgucaaaugggaggaccaggcggagaucuccgggagcucccccauuuugagcaucacuaucuccgaggauggaagcauguccaucaagaacgaggaggaggagcagacccucaccauccugauaagaacgggccugcucgugauuagcgggguauucccggucuccauuccuaucaccgcagccgccugguaccugugggaggugaagaagcagcgcgccggugugcugugggacguccccucuccgccgccaguagggaaggcggagcucgaggauggagccuaccggauaaagcagcgcgggauuuuaggcuacucgcagauaggggccgggguguacaaggagggcaccuuccacacaauguggcaugucaccagaggggcagugcugaugcaccgcggcaagcggaucgaacccagcugggcugacgucaagaaggaccucauaucguacgggggcggcuggaagcuggagggggaguggaaggaaggcgaggagguccagguguuggcgcucgagcccgggaagaaccccagagccgugcagaccaagccaggcaucuucaagacgaacaccgggaccaucggcgcggucagccuggacuucucccccggcacuagcgggucuccuauuguagaccggaaggggaaggucgucgggcuguacgggaacgguguagugacgaggagcggggccuacgucuccgcgaucgcccagaccgaaaagucgaucgaggacaaccccgagauugaggacgauaucuuccggaagaagcgccucaccauuauggaucuacaccccggcgccgggaagacuaagcgguaccugcccgccaucgugagagaggccaucaagcggggccugcguacgcucauccuggcgccgacccgugucgucgccgccgagauggaggaggccuugcgaggucuccccauccgcuaccagacccccgccauccgggcggagcacaccggccgcgagauaguggaccugaugugccacgccacguucaccaugcggcuacuaagccccgugcgugucccaaacuacaaccucaucauaauggacgaggcccacuuuaccgaccccgcaaguaucgccgcgcgggguuacaucuccacccgcguggagaugggggaggccgccggcauuuucaugacggccacgccgccugggagccgggacccguucccacagaguaacgcgcccauuauggaugaggagcgcgagauccccgaacguuccuggaacagcggccacgaguggguaaccgacuucaaggggaagaccgucugguuugugccgucaaucaaggccgggaacgacauagccgccugccugcgcaagaacggcaagaaagucauccaacuuagccggaagacguucgacuccgaguacgucaagacucgggccaacgauugggacuucguagugaccaccgacaucuccgaaaugggggccaauuucaaagccgagcgggucaucgacccacgccggugcaugaaacccgugauccugacggacggggaggagcgggugauccuggcugggcccaugccggucacccacuccagcgccgcgcagcgccgcggccgcauagggcggaaccccaagaacgagaacgaucaguacaucuacaugggggagccccuggagaacgacgaggacugcgcgcacuggaaggaggccaaaauguugcuggacaauaucaauacacccgaggguaucauaccaucaauguucgaacccgagagggagaagguagacgccaucgacggggaguaucggcuccgcggcgaggcccggaagaccuucguugaccugaugcgccgcggugacuugccagucuggcucgcuuacaaaguggccgccgagggcauaaacuacgcugaucggaaauggugcuucgacgguauaaagaacaaccagauacuugaggagaacguagagguggagaucuggacgaaggagggcgaacggaagaagcugaagccgagauggcucgaugcccgcaucuacucagacccccuggcccugaaggaguucaaagaguucgcagccgggcgcaagucccucacacugaaccugaucaccgagauggggcggcuccccaccuucaugacgcaaaaggcgcgcaacgcucuugacaacuuagcggugcuccacacugccgagguaggcgggaaggccuacacccacgcccugagcgaguugcccgagacccucgagacgcugcugcuucugacccugcucgccgcggucaccggaggcaucuuccuguuccugaugucugggaagggcaucgggaaaaugacccucggcaugugcugcaucaucaccgccagcauccuguuaugguaugcccagauccagccucauuggaucgcugccuccauaauccucgaguucuuccugaucguacugcucauccccgagcccgagaagcagcggacuccccaagacaaucagcugaccuacgucgucaucgcgauucugacaguggucgccgcaacgauggccaacgagaugggguuccucgagaagacgaagaaggaccugggguucggcagcaucaccacccaggagucugaauccaacauucuggacaucgaccuucguccggccagcgcguggacccuguacgccguggcaacgacauucgugacccccaugcugcggcacuccaucgagaacagcuccgucaacgugagccucacggccaucgcaaaccaggcgacggugcugauggggcuggguaagggguggccccucuccaagauggauaucggggucccccuguuggcuaucggguguuacucgcaagugaacccgaucacccucacggccgcccuucuguugcugguggcgcacuacgcaaucaucgggcccggccugcaggcaaaggccacccgcgaggcccaaaagcgggcggccgcggggaucaugaagaaucccacagucgacggaaucaccgugaucgaucucgagcccaucccguacgaccccaaguucgagaagcagcucgggcaggucaugcugcucauccugugcgucacccagguauugaugaugcgcacgacgugggccuuaugugaggcccugacccucgcgaccggccccaucuccacgcucugggaggguaaccccggccgguucuggaacacaaccaucgccgugagcauggccaacaucuuucgcggcuccuaccuggccggggcgggccuccuauucaguaucaugaagaacaccacaaacacgcgccgggggaccggcaacgucggcgagacgcuuggagagaaguggaagucccgccuuaacgcccucggcaaaagcgaguuccagauuuacaagaagucaggaauccaggagguggaccggacccuggccaaggaagguaucaagcgcggggaaacagaccaccacgccgugagccggggcuccgcuaagcugcgcugguucgucgaacggaauauggugacgccagagggcaaggugguugaucucggaugcggccgcgggggcuggagcuauuauugcgguggccugaagaacgugcgggaggugaaaggccugaccaagggcggccccgggcacgaggaaccaauccccaugagcacauacggcuggaaccucguccgccugcagagcgggguggauguauucuucacgccgcccgaaaugugcgacacucugcugugcgacauuggcgagagcucccccaaucccaccaucgaggcggggcggacccugcgcguacuaaaccucguagagaacuggcugaacaacaacacgcaguucuguaucaagguguugaacccguauaugccguccgucaucgaaaagauggagacgcuccagcggaaguacgggggcgcgcucgugcgcaacccccugucccggaacagcacccacgagauguacuggguguccaacgccaccggcaacaucguaagcuccgucaauaugaucagccgcaugcuuaucaaucguuucaccaugaagcacaagaaggccacguacgagccugacgucgacuuggggucggguacgcgcaacauuggaaucgagagcgagauccccaaccuggacauagucggcaagcgcaucgagaagaucaagcaggagcacgagaccuccuggcacuacgaccaggaccaccccuauaagaccugggccuaccacgggagcuacgagacgaagcagaccggcuccgcgagcuccauggugaacgggguaguaaggcuucucaccaagcccugggauguggugccuauggugacccagauggccaugacggacacuacccccuucggccagcagagaguauucaaggagaagguggauacccggacgcaagagcccaaggaaggcaccaagaaacugaugaaaauuacagccgaguggcuguggaaggaguugggaaaggagaagacgccccgaaugugcacccgcgaagaguucacccgcaagguacggagcaacgccgcccuuggcgcgguguucaccgacgagaacaaguggaagucugcccgcgaggccguggaggacgggcgguucugggagcuggucgaccgcgagcggaaccuccaccuggaggguaagugcgagaccugcguguacaacaugauggggaagcgcgagaagaagcugggcgaguucggcaaggccaaggguagccgggcaaucugguauauguggcucggcgcccgguuccuggaguucgaggcccugggcuuccucaaugaggaccacugguucucccggggcaacuccuugagcggggucgagggcgaaggccugcaccgccucggguacaucuuacgggaggugggcaagaaggagggcggcgccauguaugccgacgacacggccgggugggacacccgcaucacccuggaggaccugaagaacgaggagauggucaccaaccacaugaagggcgaacacaagaagcuggccgaagcgaucuucaaacugacauaccagaacaaggucgugagagugcagagaccaacgccucgcggcaccguuauggacaucauaucccguaaggaccagcgggggagcggacagguggggaccuacgggcucaacacguucaccaauauggaggcccagcugauccgccaaauggagggugaggggaucuuuaagucaauccagcaucugaccgccacggaggagaucgcggugcaaaauuggcucgcccgcguaggccgggagcgcuugagccguauggccaucuccggggacgacugcgucgucaagcccaucgacgaccguuucgccagcgcccugacggcgcucaacgacaugggcaaaguccggaaagauauccagcagugggagcccucccgcggauggaacgauuggacccaggugccguucugcagccaccacuuccacgaguuggugaugaaggacgggcguguccugguagugcccugccgcaaucaggacgaacucaucggccgggcucgcauuucucagggggcgggcuggagccugaaggagaccgcaugccucgggaaguccuacgcccagauguggacccucauguacuuccaccgcagagaccugcggcuggcggccaaugccaucugcuccgcugucccuucacauugggugcccaccucgcgcacgaccuggucaauacacgcgaagcacgaguggaugaccacagaggacaugcucguugucuggaaccggguguggauccaagagaacccguggauggaggacaagacgccaguggagagcugggaggagguccccuaccugggcaagcgagaggaccaguggugcggcucccugaucggccucacgaguagagcuacuugggccaagaacauucagaccgccaucaaccaggugcgcagcuuaaucgguaacgaggguuacacugacuacaugccauccaugaagcgauuccgcagagaggaggaggaggcaggcgugcugugguga

SEQ ID NO: 25117 - RNA, 9876 nt, Artificial Sequence
  derived and/or modified CDS sequence (opt11) from DENV-2__KC294221__SS-prME
accgccggggugaucgucaugcugaucccuaccgcuauggcguuucaccucacgacccggaauggugaaccgcacaugaucgugggccggcaggaaaaaggcaaaucccuguuguuuaagaccgaggacggcguaaacaugugcaccuugauggccaucgacuuaggggaacugugcgaagacaccaucaccuauaagugcccucucuugcgccaaaacgagcccgaggacaucgacugcugguguaacucgacgucgaccugggucacuuacgggacauguacgacaacgggggagcaucggcgagagaagcggagcguggcccugguuccccacguugggaugggccucgagacccggacugaaaccuggaugagcucagaaggggccuggaagcacguacagcguauagagacuuggauccugcgucauccgggcuucacaaucauggccgcgauucuggccuauaccaucggaacaacgcacuuccagcgggcccucaucuucauccugcugaccgccguggcgccaucgaugaccaugcgaugcauaggcaucaguaaccgggacuucguugagggcgugagcgggggcagcuggguggacaucguccuggagcacgggagcugcgugaccacgauggccaagaacaagccaacccuggacuucgaauugaucaagacagaggcuaaacagccugccacccuccgcaaauacugcaucgaggcgaagcugacgaacaccacgacugaaagccggugcccuacgcagggcgagcccucgcugaacgaggaacaggacaagcgcuucaucugcaagcacagcaugguggaucggggcugggguaacggcugcggguuauuuggcaaggguggcaucgugaccugcgcgauguucacgugcaagaagaacauggagggcaagauagugcagcccgaaaaccuggaguacaccaucgugauaacgccucacucaggagaggagcacgcagucggcaacgacaccgggaagaggggcaaggagaucaagaucaccccgcaguccagcaccaccgaagccgagcugacgggguacggcaccgugacgauggagugcagcccacgaaccggccucgacuuuaacgaaauggugcugcugcagauggaggauaaggccuggcucgugcaccgccagugguuucuggaccugccccuccccuggcugccgggggccgacacgcagggcagcaauuggauccagaaggagacccugguaaccuucaagaacccucacgcuaagaagcaagacguggugguguuggggucccaagaaggcgccaugcacaccgcgcugacgggagccaccgagauucagaugucgagcggcaacuugcuguucacaggccaccugaagugccggcugcgcauggacaaacuccagcuaaaagggauguccuauagcaugugcacugguaaauucaagauagucaaggagauugccgagacgcagcacgggaccaucgugauccgagugcaauacgagggcgauggcucccccugcaaaauccccuucgagaucaccgaccuagagaagcgccacgucuugggacgccuuaucacagugaacccuauaguaacggagaaggacucuccugucaacaucgaggcggagccgcccuucggggacuccuacauuauuguggggguggagccgggacagcuaaagcucaacugguucaagaaggggagcuccaucggccagauguuugagaccaccaugaggggcgccaagcgcauggccauccugggugacaccgccugggacuucggaucgcuaggaggggucuucacauccaucgggaaggcucuccaccagguuuucggagcgauuuacggagccgccuucuccgggguguccuggacuaugaagauccucauaggcgucaucaucaccuggaucgggaugaacagcagaucgaccagucuguccguaagccuagugcucgugggcguggugacgcucuaccuaggggccaugguccaggcggacuccggcuguaucgucagcuggaaaaauaaggagcucaagugcggcaguggcaucuuuaucaccgauaacgugcacaccuggaccgagcaauacaaguuccagcccgagucacccuccaagcuggcauccgcuauccagaaggcccacgaagaggggaucugugggauucggagcguuacgcggcuggagaaccucauguggaaacaaaucacccccgagcugaaccacauccuguccgaaaaugaggugaagcucacgaucaugaccggcgacaucaagggaauuaugcaggccggcaagcgcagccugcggccacagcccacagagcugaaguacagcuggaagaccuggggaaaggcgaagaugcugucuacugagucccacaaccagaccuuccugaucgaugggcccgagacugccgagugcccgaacaccaaccgcgccuggaacucucuggagguggaggauuauggauucggggucuucuccacuaacauauggcucaagcuccgggagaagcaagacguguucugcgauagcaaacugauguccgccgccaucaaggacaaccgcgcggugcacgcggacauggguuacuggaucgagagcgcccucaacgauaccuggaagauggagaaagccucguucauagaaguaaagagcugccacuggccuaagagccacacccuguggagcaacggcgugcuugaguccgagaugaucauccccaagaacuucgccgggcccgugucgcaacauaacuaccggccgggauaccacacucaaacggccgggcccuggcauuugggaaaacuugagauggacuucgacuucugcgaggguacgaccgucguggugacggaggacugcggcaaccgcggccccucacugcgaaccaccaccgccuccgggaaacucaucacggaguggugcugccgcuccugcacccugccucccuuaagguaucgcggcgaggauggauguugguauggcauggagauccggccgcuuaaggagaaggaggaaaaucuggucaacucauuggucaccgcagggcacggccagauagacaauuuuucauugggcgugcuggggauggcuuuguuuuuggaggagaugcugcgcacacgggucggaacgaagcaugcgauacugcucguggcacuguccuucgugaccuuaauaaccgguaacaugucauuccgcgaucucggccguguaauggugauggugggggcgaccaugacggacgauaucggcaugggcgucacguaccuggccuuacucgccgcguucaaggugcggccgaccuucgccgcgggacugcugcuacgcaagcugaccuccaaggagcugaugauggccaccauugggaucgcacuccugagccaaaguacccugccagagaccauccuagagcugaccgacgcacuggcucucgguaugauggcucugaaaauuguccggaacauggagaaauaucagcuggccgucacgaucauggcuaucuccugcguuccgaacgcgguaauccuccagaacgccuggaaggucucuugcacgaucuuggccgcagugagcguuagccccuuauuauugacuuccucccaacagaaggcggauuggauuccccuggcucucaccauaaagggccugaacccgacggccaucuuccugaccacucucucccgcacgucgaagaagcggagcuggccgcugaacgaggccaucauggccgugggcauggugucaauccuggcgucgagucuucugaagaacgacauacccaugacggggccccuggucgccggcgggcucuugaccgugugcuacguccuuaccggcagauccgccgaccucgaacuggaacgggccgccgacguuaagugggaggaccaagccgaaaucuccgguuccaguccuauccucuccauuaccauuagcgaggacggauccaugagcaucaaaaacgaggaggaggagcaaacgcucacaauccugaucaggacgggguugcucgugauuagcggcguguucccggugagcauuccgaucaccgcagccgccugguaccugugggaggugaaaaagcagcgggcgggggugcugugggauguacccagcccgccgcccguugguaaggcggagcucgaggacggcgccuaucgcaucaagcaacgggggauccugggauacucgcagauaggcgccggcguguacaaggagggcaccuuccauacuauguggcacgucacccgcggugccgugcugaugcaccguggcaagaggaucgagcccuccugggccgacgugaagaaggaccucaucagcuacggcggaggguggaagcuggagggggaguggaaagagggcgaggagguccaggugcuagcgcucgagcccgggaagaacccccgggccgugcagaccaagcccggcauuuucaaaacuaacacggggaccaucggcgccgucucccuggacuuuucgcccggcaccuccgggagccccaucguggaccgcaagggaaagguggucgggcuguacggcaacgguguggugacacggucgggggcuuacgucucugcaaucgcccagacggaaaagucgauugaggacaaucccgagaucgaggacgacaucuuccgcaagaaacggcucacuaucauggacuuacacccgggcgccgggaaaacgaagcgcuaccugcccgcgauagugcgagaagccaucaagagaggucugcgcacccucauccuggcgccgacgaggguggucgcggccgagauggaagaggcccugcgcgggcuccccauccgguaccagacccccgcaauccgggcagaacacacuggacgggagaucguggaccugaugugccacgccacguucacaaugcgccugcucagcccugugcggguaccgaacuacaaccugauuaucauggacgaggcccacuucaccgaccccgccagcaucgccgcgaggggcuacaucuccaccagaguggagaugggggaagcagcgggcaucuucaugaccgcaacaccgccagggucgcgcgaccccuucccccaguccaaugcgcccaucauggacgaggaacgggagaucccggagcgcucauggaacuccggucacgagugggugacugacuucaaagggaagaccgucugguuugugccgucgaucaaggccggcaacgauaucgcggccugccuacgaaagaacggcaagaaagugauccagcucucccgcaagaccuucgauagcgaguacgucaagacgcgggcaaacgacugggacuucguggucaccacagacaucuccgagaugggagcgaacuucaaagcagagagaguuaucgacccccggcgcugcaugaagccaguuauccugaccgacggugaggaacgagugauccuggcugggcccaugccugucacacacagcuccgcugcacagcgacgcggccggauaggucgcaaccccaagaacgagaacgaccaguacaucuacaugggcgagccccuagagaaugacgaggauugcgcgcauuggaaggaggccaagaugcuccuggauaauaucaacacacccgagggcaucaucccgucaauguucgagcccgaacgggagaagguggacgccaucgauggggaguaucgccuccgcggcgaggcccgcaagaccuucguagaccugaugcggcgcggggaccugccugucuggcuggccuacaaggucgcggcggagggcauuaacuacgcagaccggaaguggugcuuugacgggaucaagaacaaucaaaucuuagaggaaaacguagaggucgagauuuggaccaaggaaggcgaacgcaagaaguugaagccgcgguggcucgacgcccgcaucuacuccgacccccuggcccugaaggaguucaaggaguucgcagcgggccggaagucccuuacucugaacuugaucaccgagauggggcgccuccccaccuucaugacccaaaaggcucggaaugcccuggacaaccuggcggugcuccacacggccgaaguaggagggaaggcguacacgcacgccuuauccgaguugcccgagaccuuggagacccuuuugcuccugacgcuucucgccgcggucaccggcggcaucuuccuguuccugaugucagggaaaggcaucggaaaaaugacccucggcauguguugcauuaucaccgccuccauccugcugugguacgcgcaaauccagccgcauuggaucgccgccagcaucauacuagaguuuuuccugauuguccugcucauucccgaacccgagaagcagcgaacgccacaggauaaccagcugacguacgucgugauagcaauccuuacuguggucgccgccaccauggccaacgagaugggguuucucgagaagaccaagaaagaccugggcuucggaucuauaacgacccaggaauccgaguccaacauccuggauauagaccuccggccggccuccgcguggacccuguaugccguggcaacuacuuucguuacccccaugcugcgccacagcauugagaacuccagcgucaacgugucccucaccgccauagcgaaccaagccaccgugcugauggggcugggaaaggguuggccgcucagcaagauggacauaggcgucccccuguuagcuaucggauguuacucccaggugaacccaauaacgcucacagccgcccuguugcuacugguagcgcacuaugccaucaucggccccggguuacaagccaaggcgacucgugaggcgcagaaacgugcggcggccgggaucaugaagaaucccaccgucgacggcaucacgguuauugaccucgagccuaucccguacgacccaaaguucgagaagcagcuggggcagguaaugcugcucauccugugcgugacacaggugcugaugaugcggaccaccugggcccuaugcgaggccuuaacgcuggcuaccggcccaaucagcacccuaugggaagguaaccccggccgcuucuggaauaccacgauagcuguguccauggccaacaucuuccgcggaagcuaccuggccggggcgggccuccuuuucuccaucaugaaaaacacuacgaacacccgucgcgggacaggcaacguaggcgagacccucggggagaaguggaaaucccggcugaacgcgcucgggaaaucggaguuccagaucuacaagaagucuggcauccaggagguggacagaacccuggccaaagagggcaucaagcgcggggaaaccgaucaccacgccguuucccgcggcagcgcaaagcugcggugguuugucgagcgcaauauggugacuccggagggcaagguggucgaucucggaugcggcaggggcggguggucuuauuacugcggcgggcugaagaacgucagagaggugaagggauugacuaagggcggcccaggucacgaggagcccauucccaugucaaccuacggcuggaaccucguacgccugcagagcggcguggacguguucuucaccccgcccgagaagugcgacacccugcucugcgauaucggcgaguccagccccaacccgaccaucgaggccggccgcacccugagagucuugaaccucguggagaacugguugaacaauaacacccaguucugcaucaagguacugaacccguacaugccguccgucaucgagaagauggagacacuacagcgaaaguacgggggcgcccugguaaggaacccucugagccgcaacuccacgcacgaaauguacugggugagcaacgcaaccggcaacauagucuccagcguuaacaugaucucccggaugcugaucaaccgcuucaccaugaagcacaagaaggcuaccuaugaaccugacguagaccucggcagcggcacgcggaauauaggaaucgaguccgagauccccaacuuagacauugucggcaagagaaucgagaagauuaagcaggagcacgagaccuccuggcauuacgaccaggaccaccccuauaagacgugggccuaucacggguccuacgagaccaagcaaacggguagcgcgucaaguaugguaaacggggugguccgccugcuuaccaagcccugggacguggugccuauggucacucaaauggccaugaccgacaccacccccuucggccagcaaaggguguucaaagagaagguggacacccgcacccaggagccuaaggagggcacgaagaaacuaaugaagauaaccgccgagugguuauggaaagagcucgguaaggagaagacgccccgcaugugcaccagggaggaguucacgcggaagguccgcucaaaugcagcccugggcgccguguucacugacgagaacaaauggaaguccgcccgcgaggcuguggaggacggacgcuuuugggagcuggucgaccgggagcgaaauuuacacuuagagggcaagugcgaaaccugcgucuacaacaugauggggaagcgugagaagaaacuuggcgaguucggcaaggcuaaggggucccgcgcgaucugguacauguggcucggcgcccgguuccuggaguucgaggcccugggguuccucaacgaggaccacugguucagccgcggaaacagccuguccgggguagagggggagggucugcaccgacucggguacauccucagagagguaggcaagaaggagggcggcgccauguacgcggaugacaccgcagggugggauacgcggaucacccuggaggaccucaaaaacgaggagauggucaccaaccacaugaagggagagcacaagaagcuagccgaggccaucuucaaacugaccuaccagaacaagguugugcgcgugcagcgcccgacgccccgcgggacgguuauggacaucaucagccgaaaggaucagcgcggguccggccagguugggacuuacggccucaacacguucacgaauauggaggcccagcugaucaggcagauggaaggcgaagggaucuucaagagcauccagcaccugaccgccaccgaggagauagcgguacagaauugguuagcccggguuggccgcgagcgacugucucgcauggccaucagcggggacgacugcguggugaaacccauugaugacagauucgccuccgcccucaccgcgcucaacgacauggguaaagucaggaaagacauccaacagugggagcccagccguggguggaacgacuggacccaggugccguucuguucccaccacuuccacgagcugguaaugaaggacggccgcguuuugguggucccaugucggaaccaggaugagcucaucggccgugcccggaucagccagggggcuggcuggagccugaaagagaccgcgugucugggcaaguccuacgcccagauguggacacucauguacuuccaccgccgugaccugcggcuggcggccaaugccaucugcuccgccgucccaagccauuggguacccaccucccggaccacguggucuauccacgcgaagcacgaguggaugaccacggaggacaugcucgugguguggaaucguguuuggauccaggagaauccguggauggaggacaagacccccguggagaguugggaggagguccccuaucugggcaagcgugaggaucaguggugcgguagucugaucggccucacuagccgcgcgacuugggccaagaacauccagacagccaucaaccagguucggucccugaucggcaacgagggguacacagauuacaugcccagcaugaagcgcuuccgccgggaggaggaagaagcgggagugcugugguaa

SEQ ID NO: 25118 - RNA, 9876 nt, Artificial Sequence
  derived and/or modified CDS sequence (opt11) from DENV-2__KC294223__SS-prME
acagccggugugaucgucaugcugauccccaccgccauggcauuccacuugaccacccgaaacggagagccccacaugaucgugggucgccaagagaaagggaagucacugcucuuuaagacugaagacggggucaacaugugcaccuuaauggcuaucgacuuaggggaguuaugcgaagacacuaucaccuauaaaugccccuugcugaggcaaaacgagcccgaggauauagacugcuggugcaacucaacaagcacaugggugaccuacgggaccugcaccaccacgggugaacaucggcgcgagaaacgcagcguggccuuggugccccacgucgggauggggcucgagacgcgaaccgagacauggaugucgucggagggggccuggaaacacgugcagcgcaucgagacauggauccugcgccacccgggguuuaccaucauggccgcgaucuuggcguacaccaucgggaccacccacuuucagcgggcccucauauucaucuuauugaccgcaguggcgccgagcaugacaaugagguguauaggcaucucgaaccgggacuucgucgagggggugagcggggguagcuggguugacaucguuuuggaacacgguuccugcgugaccacgauggccaagaacaaacccacacuugauuuugaauugaucaaaaccgaagccaaacagcccgccacccuccgcaaguacugcauagaagccaaguugaccaauacaacaaccgagucccggugcccgacacagggcgagcccucucuaaaugaggagcaggacaagcgcuuuaucuguaagcacagcaugguggaccguggaugggggaacggcugcgggcuuuuuggcaagggcggaaucguuacgugcgcuauguucaccuguaagaagaauauggaggguaagauuguucagccagaaaacuuagaauacaccaucgugaucacgccucacucuggugaggagcacgcagucggcaacgauaccgguaagcauggcaaggagauaaaaaucacaccacaaucaagcaccaccgaggcggagcucacggguuacgguacgguuacaauggaguguagcccccggaccggccuagacuuuaacgagaugguacugcuucagauggaagauaaagccuggcucguacaucggcagugguuccuggaccugccccuaccuuggcugccuggggccgacacacaaggcucgaacuggauccagaaagaaacauuagucaccuuuaaaaacccgcacgcuaagaagcaggauguggucguguuagggucccaagaaggcgcgaugcacacggcacugacgggggcuacggaaauccagauguccucaggcaaccuacuguucacaggccaucucaagugucgccuucggauggacaagcugcaacugaaggggaugucguacucgaugugcaccgguaaguucaaaauugucaaggagaucgcagagacgcaacaugggacaauuguuauccggguccaguaugagggcgacggcucacccuguaagauccccuucgagauuacggaccuggaaaagcgccauguccucgggcgccugaucaccguuaacccuaucguuaccgaaaaggacaguccuguaaacaucgaagcggagccgccguucggcgauagcuacaucaucguggggguggagcccggucaacugaaacuuaacugguuuaagaagggguccuccauuggacagauguuugagaccaccaugcgcggcgccaagaggauggccauccugggggacacagccugggacuucggcagccucggcggaguauucacauccaucgggaaagcguuacaccaaguguucggugcaauuuacggugcugccuucagcggggugaguuggacaaugaagauuuugaucggagugaucaucaccuggaucggaaugaacagccgcuccaccucacugucagugagccugguacuggugggcguuguuacgcuguaccugggggcuaugguccaggcugacuccggcuguauagugucguggaagaacaaggagcugaaaugugguagcgggaucuucaucacugacaacgugcauacguggacggagcaguacaaauuccaacccgagagucccagcaaacuugccuccgccauacagaaggcccacgaggaaggcaucugugggauucgcuccgugacgcgacuggagaacuugauguggaagcaaaucacaccggagcugaaccacauucuguccgagaaugaggugaaacuuaccaucaugacaggcgacauuaagggcaucaugcaggcuggaaagaggagcuuacgcccgcagcccacggagcugaaguacuccuggaagaccugggggaaggcgaagaugcucagcaccgagucccacaaccagaccuuccucauagacggccccgaaacagcugaaugcccgaacaccaaccgggcuuggaacagccuugaggucgaagacuauggguucggaguguucaccaccaauaucugguuaaaguuacgcgagaagcaggacgucuucugugauuccaaacugaugagugccgcaauuaaggauaaucgggcaguacaugccgacaugggcuacuggaucgaaucugcccuuaacgacacuuggaaaauggagaaagcgucauucauagaggucaagucgugucacuggcccaaaagucacacgcuauggagcaacggggugcuagagucugagaugaucauccccaagaauuucgcggggccggugagccagcacaacuaccgcccgggauaccacacacagaccgcagggccuuggcaccugggcaaauuggagauggacuuugacuuuugugaagguaccacuguggucgugaccgaggauugcggcaaccgggguccuucucugcgcacgacgacggccuccgggaaacuuauuaccgaauggugcugccguaguugcacccugcccccacugcgauaccggggcgaggauggguguugguacgguauggagaucaggccccucaaggagaaagaggagaaccuggucaauagccuggugaccgccgggcacggccagaucgacaauuuuucgcucggcguacugggaauggcccuuuucuuggaggagaugcuacgaacgcguguugggaccaagcacgcaauccugcucguugcccugagcuucgugacccugaucaccgggaauauguccuuucgagaccuuggucgcgugauggucauggugggggcgacgaugaccgaugacaucgguaugggggucaccuaccuagcacuucucgcagcguucaaggugcguccaacuuucgcagccggccuguuacuccggaagcugaccaguaaggaacuaaugauggccaccaucggcauugccuugcucucccagagcacucugcccgaaaccauccucgagcucacggaugcacucgcgcuagguaugauggcccugaagaucgugcgcaacauggagaaauaccagcuggcagucaccaucauggccauaaguugcgucccgaacgcggucaucuugcaaaaugcguggaaggucagcugcaccauccucgcggcugugucagucagcccgcugcucuugacauccucgcaacagaaggcggacuggauucccuuagcacucacgauaaagggacucaauccgacugccauauucuugacgacucucucacgaaccucgaagaagcgcuccuggccgcugaacgaggccaucauggcggucggcaugguguccauccuggccuccagccucuuaaagaacgacaucccaaugacggguccccuggucgccggcgggcuccucacuguguguuacguccucaccggcagaucagcugaccucgagcuggagcgcgcggccgaugucaaaugggaggaccaggcggaaauauccgggagcucccccauucucagcauaacgauaagugaggauggcucaauguccaucaagaaugaggaggaagaacaaacucucaccauccuaauaaggacaggucuacugguuaucagcgggguguuccccgucuccauccccaucaccgccgccgccugguaucugugggaggugaaaaagcaacgcgcgggcguccuuugggacgucccuagcccuccgccugugggcaaagcggaauuggaggacggcgcuuaccggaucaagcaacgcgggauccugggcuacucccagauuggggccgggguguacaaagaagguaccuuccauaccauguggcaugucaccaggggcgccguucugaugcaccgcggcaagcggauugagccuuccugggcggacguaaagaaggaccucaucuccuaugggggcggcuggaaauuggaaggcgaguggaaggagggugaagaaguacaggugcucgcucucgagccggggaaaaacccacgugcuguucagacgaagcccgguauauucaagacuaacaccggcaccaucggagcugucagucuggacuucuccccgggcaccagcgggucccccaucguggaccguaaagguaaaguugucgggcuuuacggcaacggugugguuacgcgcagcggugccuacguguccgcgaucgcccaaaccgagaagaguauugaggacaaccccgagauagaagaugacaucuuccggaagaaacgccucacgaucauggaccugcacccuggagccggcaagaccaagcgguaucugccagccauagugcgcgaggcuauaaagcggggccugcgcacgcucauccucgcaccgacccgggugguggccgcagagauggaggaggccuugcggggacucccuauucgcuaccagacgcccgcgauccgggcagaacacaccggccgcgagaucguggaucuaaugugccacgccacguucacgaugcggcuccuaagcccagugcgcgucccgaacuacaaccugaucauuauggaugaagcccacuucacggaccccgcauccaucgccgcaaggggguacaucucgacgcggguggagaugggggaagcggccggcaucuucaugacggccacuccgccgggguccagggaccccuucccccagucgaacgcacccaucauggacgaagaacgcgagaucccagagcgguccuggaacucaggacacgaauggguaaccgacuucaaggguaagaccgucugguucgugccuuccauuaaggccggcaaugacauagcagcgugcuuacgcaagaacggcaagaaggugauccagcucagccggaagacguucgauagcgaauacguaaagacgagagcuaacgacugggacuuuguggucaccaccgacaucucugagaugggagccaacuucaaggccgagagaguaaucgacccgcgccgcugcaugaagcccguuauccugacggacggggaggaacgggugauucuggccggcccaaugccagucacgcacaguagcgccgcccagaggcgcggucgaaucgggcggaaccccaagaacgagaaugaucaguacaucuacaugggcgaaccucucgaaaacgaugaagacugcgcgcauuggaaggaagcgaagaugcuuuuggauaacaucaauacacccgagggaaucaucccaucgauguuugaacccgaaagggagaagguagaugccauugacggggaguaccgacuccgcggagaagccagaaagaccuucguggaccugaugcgcagaggggaccuuccggucuggcuagccuacaaggucgcagcugaagguaucaacuacgcagacaggaaguggugcuucgacgggaucaagaacaaucagauucucgaggagaacguagagguagagaucuggacgaaggagggcgagcggaagaaacugaagcccaggugguuagacgcccggauuuacagcgacccuuuagcucuuaaagaguucaaggaguucgccgcaggccgcaaguccuugacccuaaaucuuauuaccgagaugggcagacuacccacuuucaugacgcagaaggcccguaacgcccucgacaaucucgccguucuccauaccgccgaagugggcggcaaggccuacacucacgcccucagcgagcucccagaaaccuuagagacacugcugcuccuaacucuucuagccgcgguuaccggcggaaucuuccuguuccucaugagugggaagggcauagggaagaugaccuugggcauguguugcauuauaacugcgucgauacuucuaugguaugcccagauccaaccacacuggaucgcggccuccaucauccuggaguucuuucugaucgugcuguuaaucccugagcccgaaaagcagaggacgccacaggauaaccagcugaccuacgucguuaucgcuaucuuaaccgugguugccgcuaccauggcuaacgagaugggguuccucgagaaaacgaagaaagaucugggauucggaagcauaacgacucaagagucggaauccaacauccuggacaucgaccuccggccggcgagcgcguggacccucuacgcuguggccacuaccuucgugacccccaugcugcgucacucuaucgaaaacagcagcgucaacgugagccugaccgcaauagcgaaucaagcgacggugcucaugggauuaggaaaggguuggccccugucuaagauggacauaggugugccacuccuggcuaucggcugcuacucucaagugaauccgauaacgcucaccgccgcucugcugcuucucguggcgcacuacgcgauuauaggaccgggccugcaagcaaaggcuacccgagaggcccagaagagagcugccgccgguaucaugaaaaaccccaccgucgaugguaucaccgucauagaccucgagccaauuccguacgaucccaaguucgaaaagcagcuaggccaggugaugcuauugauucucugcguaacucaggugcugaugaugaggacgacgugggcccucugcgaggccuuaacccuugcgaccggacccaucaguacccucugggaggggaaccccggccgguucuggaauacgaccauagcgguauccauggccaauaucuuccgcggcuccuaccuggcuggagcgggcuugcuguucagcauuaugaagaacacgaccaacacucgcagggggaccggcaacgucggugaaacacugggggaaaaguggaagucccgacugaaugcucugggcaagagcgaguuccagaucuauaagaagucggggauccaagagguggaccgcacccuggcuaaggaaggcauuaagagaggggagacggaccaccacgcggucaguaggggguccgcgaaguuaagaugguucgucgaacgcaacaugguaacuccggaggguaaaguuguagaucucggcugcggcagagggggauggagcuacuauuguggcggccugaagaacgugagagagguuaagggucuaacaaaagggggaccaggccacgaggagccuaucccaauguccaccuacggcuggaaccuggugcgccugcaguccggaguggacguauucuuuaccccaccugagaagugcgacacccugcucugugacaucggcgagucaucgccuaaccccacaaucgaggcgggccggacucugcgcgugcuaaauuugguggaaaacuggcugaauaacaacacucaguucuguaucaaggugcugaacccguauaugcccagcgucaucgagaagauggaaacacuccagagaaaguacggcggggcucugguuaggaacccgcuuucccgaaauagcacccacgaaauguauugggugucuaaugccaccggaaacaucgucucuucugucaacaugaucagccgcaugcugaucaaccgguuuaccaugaagcacaagaaggccacauaugagccggacguagaccucggaagugggacacgcaauauaggcauugagagcgagauucccaaucuagauaucgucggcaagcgaaucgagaaaaucaaacaggaacacgagacuuccuggcacuacgaucaggaccacccuuauaagaccugggccuaucauggcucguacgagacgaagcagaccggcuccgcgaguuccauggugaacggggugguccgacuacucaccaagccgugggaugucgugcccauggucacccaaauggcuaugacggauaccacucccuucggacagcaacggguguucaaggagaagguugauacccggacgcaagagccgaaagaggggaccaagaaguuaaugaagaucacagccgaguggcuguggaaagagcucgggaaggagaagaccccaagaauguguacaagagaggaguucaccagaaagguccgaucuaacgccgccuuaggcgcgguauucacggacgagaacaaguggaaaagcgccagggaggccguggaagacggaagguucugggaacuuguagaucgugagcggaaccuacaccuggagggcaagugcgagaccugcguauacaacaugauggguaagcgagagaaaaaguuaggcgaauuuggcaaggccaaagggagucgggcgaucugguacauguggcuaggcgccagguuccuagaguucgaggcccugggguuccuaaacgaagaccacugguucucccgggguaauucgcucagcgggguugagggcgaaggccuucacaggcucggauacauucugcgagaggugggcaagaaggaggguggcgcaauguaugccgacgauacggcugggugggacacccgcauaacccuagaggaccucaaaaaugaggagauggugacgaaccauaugaagggcgagcacaagaaacuugccgaggccaucuucaaacugacguaucagaauaagguugugcgggugcaacggccuacuccgcgggguaccgugauggacaucauaucccguaaagaccagcggggaagcggccagguaggaacauacggccucaacacguucacuaacauggaggcacaacuuauccgccagauggagggcgaagggaucuucaaguccauccagcaccugaccgccaccgaagagauagcuguacaaaacuggcucgcacgcgucggucgggagcgccugagccguauggccauuaguggggaugacugcguggugaaacccaucgacgacagauucgcuucugccuugacggcgcucaacgacaugggaaagguucgaaaggacauacaacagugggaacccucccgcggguggaacgauuggacccaagugccguucugcagccaucacuuccacgagcuggugaugaaagacggccggguuuuaguggugccaugccgcaaccaagacgagcucaucggucgcgccagaaucucccagggggcaggcuggagccuaaaggagacugcgugcuuagggaagaguuaugcccagauguggacacuaauguacuuucaccgccgcgacuugagacuagccgcuaacgccauaugcagcgccguaccaucacacugggugccgaccucuagaacaaccugguccauccacgcgaagcacgaguggaugaccaccgaggacaugcugguggucuggaaccgcgucuggauccaggagaacccguggauggaggacaagacgcccguggagagcugggaggaaguuccguaccugggcaaaagggaagaccaguggugugggucccucaucggccucaccagcagagccaccugggccaagaacauccaaacagccauuaaccaggugaggagccugaucgguaacgagggguacacugacuauaugccgagcaugaagcgguucaggcgcgaggaagaggaggccggcgugcugugguga

SEQ ID NO: 25119 - RNA, 9876 nt, Artificial Sequence
  derived and/or modified CDS sequence (opt11) from DENV-2__FJ906959__SS-prME
accgccggcaugaucaucaugcugauucccacugugauggccuuccaccucaccacccgaaacggggagccucacaugaucgucagccggcaggagaagggcaagucgcuccuguucaagaccgaagacggugucaacaugugcacccucauggcgauggaccugggcgagcugugcgaggacaccaucaccuacaagugcccauucuugaagcaaaacgagcccgaggacauagacugcuggugcaacagcaccuccaccugggugacguaugggaccugcaccaccacgggcgagcaccgccgggagaaacgcagcgucgcccucgucccccacgugggcauggggcuggaaacgaggaccgaaaccuggaugucgucagagggcgcuuggaagcacgcccagcggauugagacuuggauccuccggcacccgggguucaccaucauggccgcgauccucgcguacaccaucggcaccacucacuuccaacgcgcccugauauucauucuccugaccgccgucgcucccuccaugaccaugcggugcauugggauuagcaaucgagacuucguggagggaguauccggcgggucaugggucgacaucgugcuggagcacggcuccugcgugacaacgauggccaaaaacaagcccacccucgauuuugagcugaucaagaccgaagccaagcaacccgccacacugcggaaguacugcaucgaggccaaacucacaaauacgaccaccgacucgcgcugcccgacccagggugagcccucccugaacgaggagcaggacaagcgguucgucuguaagcacagcaugguggaccggggcuggggcaacgguugcggcuuguucgguaagggggggauuguuaccugcgcgauguucacguguaagaaaaacaugaagggcaaggucgugcagcccgagaaccucgaguacaccauuguaaucacgccccauuccggcgaggagcacgccgucgggaacgacaccggcaagcaugggaaggaaauaaaaaucaccccgcagagcuccaucaccgaggccgagcuuaccggcuacgggacggugaccauggagugcagcccccguaccggccuggacuucaacgagauggucuuacugcaaauggaaaacaaggcuuggcugguccaccgccagugguuucucgaccugccccugcccugguugccgggcgccgacacucagggaucuaacuggauccagaaggagacgcuggugaccuucaagaacccccacgcgaagaagcaagacgucguggugcuuggaagccaggagggggccaugcacacggcccucaccggugccacggagauccagaugagcucggggaacuugcuguucaccggccaucucaagugccggcugcgcauggacaagcugcagcucaagggcaugagcuacuccaugugcaccgggaaguucaaggucgugaaagagaucgccgagacccagcacggcacuaucgugauccggguccaguaugagggagauggcagccccugcaagauccccuucgagaucauggaccucgagaagcgccacguccugggccggcugaucaccguuaacccgaucgucaccgagaaggauucccccgugaauauugaagcggagccgcccuucggggacagcuauaucaucauuggcguggagcccgggcaacugaagcugaacugguucaaaaagggauccagcaucgggcagaugaucgagaccacgaugcguggcgccaaacgcauggccauacucggagacacggcgugggacuucggaucccucgggggugucuucaccucuauaggcaaggcccugcaccagguguucggggccauuuacggcgccgcuuucuccggcguaagcuggaucaugaagauccugaucggggucauuauuaccuggauaggcaugaacucccggagcacgucccugagcgugucgcuagugcugguagggguggugacccuguaccuuggagucaugguacaggccgauagcgggugcguggucagcuggaagaacaaggaguuaaagugcggcagcggcaucuucaucaccgacaacguccacaccuggacggagcaauacaaguuccagcccgaaagucccucgaagcuggcaucggcuauccagaaggcccacgaggaggggaucugcggaauccgcuccgugacccgccuggagaaccugauguggaagcagaucacccccgagcuaaaccacauucugagcgagaacgagguaaaguuaacaaucaugacgggggacauuaagggcaucaugcaggccgggaagagaucccuccaaccccagcccacagagcugaaguacagcuggaagaccuggggcaaggccaagaugcucuccaccgagagucacaaccagacguucuugaucgacggccccgagacugcagaguguccgaacaccaaccgggccuggaacucccuggaaguagaggauuacggcuuuggcguguucaccacaaacaucuggcugaaguuacgcgagaagcaagacguauucugcgacagcaagcugauguccgccgccaucaaagacaaccgggccguucacgcggacaugggguacuggaucgaaucggcccucaaugacaccuggaagaucgaaaaagccuccuucaucgaggugaaaagcugccacuggcccaaaucccacacccucuggaguaacggugugcuggaguccgagaugaucaucccaaaaaacuuugccggccccgugagccagcacaacuaccgccccggguaucacacccagacggcaggcccuuggcaccuggguaagcucgagauggacuucgacuucugcgaggggacgacggucgucguuaccgaggacugcgggaaccggggcccaagccugcguaccacgaccgcuuccggcaagcuaaucaccgaguggugcugccggagcugcaccuugccgccccugagguaucgcggggaggauggcugcugguacgggauggagauccgcccgcugaaagaaaaggaagagaaccucgugaacucccuggucacggccggccacgggcagauagacaacuucagccugggcgugcucggcauggcgcuguuccuggaggagauguuacggacgcguguggggaccaagcacgcuauccugcugguggcgguaagcuucguuaccuuaaucacaggcaacaugagcuuccgggaccuggggagagugaugguaauggugggcgccaccaugaccgacgauaucgggaugggugucacguaucuggcccuccucgcagccuucaaagugcggcccacguuugcugccggccuccuccugcgcaaacucacguccaaagagcucaugaugaccaccaucgggaucguccugcugagccagucaacgauccccgagaccauccucgagcugacagaugccuuggcccugggcaugaugguccugaaaauggugcgcaagauggagaaguaccaacuggccgugaccaucauggcgauccugugcgugccuaaugccgugauccugcagaacgcauggaaggucagcugcacgaucuuagccgucgugucagucagcccccucuucuugaccuccagccaacagaaagccgacuggauccccuuggcgcucaccauaaaggggcuaaaccccaccgccaucuuucugacaacccuaucccggaccaauaagaagcguagcuggccgcugaacgaggcaaucauggccgugggcaugguguccauacuggcgagcucccuccucaaaaacgacauccccaugaccgguccccuggucgccgggggccucuuaacagugugcuacguguugaccgggcggagugccgaucucgagcuggagcgcgccgccgacgucaagugggaggaccaagcggagaucagcggcuccagccccauccuguccauaacuaucagcgaggacggguccaugaguaucaagaacgaggaggaagagcagacccugacgauccugaucaggaccggccugcuugugaucagcggccuguuccccgugagcauccccaucaccgccgccgccugguacuugugggaggucaagaagcagcgcgccggggugcucugggacgugcccagcccgccuccggucggcaaggcagagcuggaggacggagcguaccggaucaagcagaagggcauccugggguacagccagaucggugcggguguguacaaggaggggaccuuccacacgauguggcacguaacgcgcggcgccguccuaaugcacaaagggaagcgaaucgaaccauccugggccgacgugaagaaggaccugaucagcuacggcgggggguggaaacuggagggcgaguggaaggaaggagaggaggugcagguccucgcgcuggagcccggaaagaacccccgcgcugugcagaccaagcccgggcuauucaagaccaaugccgggacgaucggggcggugucgcucgacuucagccccggcacauccggcagccccaucauagacaagaaggggaaggucgugggccuguacggcaacggcguggucacccgcuccggcgcuuacgucagcgcgaucgcccagaccgagaaguccaucgaggacaaccccgagaucgaggacgacaucuuccgcaagcggaagcugacaaucauggaucuccaccccggggccggaaaaacgaagcgguaucugcccgccaucgugcgggaggcgaucaagcgcggguugcggacccugaucuuggccccgacccgugucguggccgcagagauggaagaggcccugcggggccugcccauccgcuaccagacccccgcgauccgugccgagcauacggggagggagauuguagaccucaugugccacgcgaccuucaccaugcgccugcuuagucccguccggguaccgaacuacaaccucaucaucauggacgaggcccacuucaccgacccagccuccaucgcagcccguggcuacaucucgacgcguguagaaaugggcgaggccgcugggaucuucaugaccgcuacuccgcccggcagccgcgacccguuuccacagagcaacgcgcccaucauggacgaggagcgggagauccccgagcguagcugguccagcgggcacgaguggguaacagacuuuaagggcaaaacggucugguucgugccguccauuaaggccggcaacgacauugcggccugccugcggaaaaacggcaagaaggucauccagcugagccgcaaaacuuucgacuccgaauaugugaagacccggaccaacgacugggacuucguggucaccacggacauuagcgaaaugggcgcgaacuucaaggccgagcgugugaucgacccccggcguuguaugaagccugugauccucacggauggugaggagcgggucauccucgccggucccaugccggucacccacuccagcgccgcgcagcgccgggggcgcaucggccggaaccccaagaacgagaacgaccaguacaucuacaugggggagccgcucgagaacgacgaggacugcgcacacuggaaggaggccaagaugcuccuggacaacaucaacacgcccgagggcaucaucccguccauguucgagcccgagcgcgagaagguggacgcaaucgacggcgaguaccggcugcgcggagaagcccgcaagacuuuuguagacuugaugcggcgcggggaccugcccgucuggcuugcguaucggguggcggcagagggcaucaacuacgccgaccgcagguggugcuucgacggcaucaagaacaaucagauccucgaggagaacgucgaaguggagauuuggaccaaggagggggagcgcaagaagcugaaaccgcgguggcuggacgcccgcaucuacucggacccccuagcccugaaggaguucaaggaguucgcggcaggccggaagucccugaccuugaaccugaucaccgaaaugggccgccuccccacuuucaugacccaaaaggcucgggaugccuuagacaaccuggcgguccugcacaccgccgaggcugggggccgcgcuuacaaccacgcccugagcgagcuaccugagacacuggagacccucuugcugcucacccugcuggcgaccgucacaggagggaucuuccucuuucugauguccggccgugguauagggaagaugacccuggggaugugcuguaucaucacugccagcauucuccugugguaugcacagauccagccccacuggaucgccgcuuccaucauccuggaguucuuccucaucgugcugcugauucccgagcccgagaagcagcgcacgccccaggauaaccagcugaccuacgucgugaucgcgaucuuaacggucguagcugccaccauggcuaacgagaugggcuuccucgagaagaccaagaaagaccucgggcuuggcagcaucaccacacagcagccggagagcaacauacuagacaucgaccuccggcccgccuccgcguggacccucuacgcugucgccaccaccuucgugacgcccaugcuacgccacagcauagagaacuccagcguuaauguuucccucacggcgauagccaaccaggcgaccgugcugaugggccuggggaagggcuggccccucagcaagauggauaucggcgucccgcugcuggcuaucgguugcuacucccaggugaauccuaucacccucacggccgcgcuauuccugcucguggcccacuacgcgauaaucgggccaggccugcaagccaaggccacacgggaggcccagaagcgggcggcugccggcaucaugaagaauccuaccgucgacgguaucacagucaucgaccuggaccccauccccuacgaccccaaguuugagaaacagcucggccaggugaugcugcugguucugugcgugacucagguguuaaugaugcggaccaccugggcucugugcgaagcccucacccuggcgacugggccaauaagcacccugugggaaggcaacccggggcgcuucuggaauaccaccaucgccgucuccauggcaaacauuuuccgcgguagcuaccuagccggugcugggcugcuguucuccaucaugaagaacacgaccaacacccgcagaggcacggggaacauuggggagacucucggcgagaaauggaagagccgacugaacgcguugggcaagagcgaguuccagaucuacaagaaauccgggauucaggagguggaccgcacacucgccaaggaggggaucaagcggggagagaccgaccaucacgccguaucccgcgggagcgcuaaacugcggugguucgucgagcguaacauggugacgcccgagggcaagguugucgaccuggggugcgggcgggggggguggucuuacuacugcggcggguugaagaacguccgcgaggugaaaggccugacgaaaggcggucccggccacgaggagcccauuccaaugaguaccuacggguggaaccugguccggcuccaguccgggguggacguguucuucacgccacccgagaagugcgacacccugcugugcgauaucggagagagcagcccaaacccuacggucgaggcgggccgcacccuccggguguugaaccugguggagaacuggcucaacaacaauacccaguucuguaucaaggugcuaaauccguacaugcccagugugaucgagaaaauggaagcgcugcagcgcaaguacgguggggcacucguccgcaauccgcugucacgcaacuccacccaugaaauguacugggucagcaacgccuccggcaacauugugagcuccgugaacaugaucucccggaugcugaucaaccgcuuuaccaugcggcacaaaaaggccacguacgagccagacgucgaccugggauccggcacccgcaacauagggaucgagagugagauacccaaccucgacaucauaggcaagcggauagagaagaucaagcaggagcacgagaccuccuggcacuacgaccaggaucaucccuacaagaccugggccuaccacggcagcuacgaaacgaaacagaccggguccgcgagcuccauggugaacggagugguccgccugcugaccaagccgugggauguggugcccauggucacccagauggccaugacggacacuacgcccuucgggcagcagcgcguguucaaggagaagguagacacccguacucaggagccaaaggaagguacuaagaagcucaugaagaucaccgccgaguggcucuggaaggaacuuggcaagaagaagacaccucgcaugugcacgcgggaagaguuuacccgcaagguccguucgaacgcugcgcucggggccauauucacagaugagaacaaguggaaguccgcccgcgaggcuguugaggacagcagguucugggagcugguggacaaggagcgcaaucugcaccucgaaggcaagugcgagacgugcguguauaacaugaugggcaaacgugagaagaaacugggcgaguucgggaaggccaaggguucccgcgccaucugguacauguggcugggcgcccgguuccucgaguucgaggcccugggguuccugaacgaggaccauugguucagccgcgagaacagccucuccgguguggaaggagaaggucuacauaagcugggcuacauccuccgagacgucagcaagaaggagggaggcgccauguacgcggacgacacggcggggugggacacccgcauaacccuggaggaucugaagaacgaggagauggugaccaaccacauggagggcgagcauaagaagcuugccgaggccaucuuuaagcuuacguaccagaacaagguggugcgggugcagcgccccacgccccgggggaccgugauggacaucauuucucgccgugaccagcgcggcagcgggcaagucggaaccuacggacugaacaccuuuaccaauauggaggcccagcucauccggcagauggagggggagggcgucuuuaaauccauccagcaccugacugugaccgaggagaucgcgguccagaacugguuggcccgcguggggcgcgagcggcucagccgaauggcaauuuccggcgaugacuguguggucaagccucuggacgaccgguuugccagcgcccugacggcgcucaacgacaugggcaaggugcgaaaggacauccagcaaugggagccuucccggggguggaacgacuggacgcaagugcccuucugcagccaccacuuccacgagcugaucaugaaggacggcagggucuuagucgugccaugccggaaccaggacgagcucauagggcgcgcccgcaucucccaaggcgccggcuggagccugcgcgaaaccgccugccuaggcaaguccuacgcucagauguggucgcugauguacuuccaccggagagaccugcgucuggcggcuaacgccaucugcucagccguccccagccacugggugccuacuuccagaaccacguggagcauccacgcuaagcacgaguggaugaccaccgaggacaugcucaccguguggaaccgggucuggauacaggaaaacccguggauggaagacaagacgcccguggagaguugggaggagaucccauaccugggaaaacgggaagaccaguggugcgggucccugaucggguugaccagccgggcgaccugggccaagaacauccagaccgccaucaaccaggugcgcucccugauagggaacgaagaauacaccgacuacaugccgagcaugaaacgguuccgccgcgaggaagaggaagccggcguccugugguag

SEQ ID NO: 25120 - RNA, 9876 nt, Artificial Sequence
  derived and/or modified CDS sequence (opt11) from DENV-2__KF360005__SS-prME
accgccggggugaucaucaugcgaauccccacugccauggcuuuucacuugacgacccgaaacggggagccccacaugauagugagcaagcaggagaagggcaagucccuccucuucaagacugaggacggggugaacaugugcacccucauggcgauggaccucggcgagcugugcgaggauaccaucaccuauaacugucccuuacuccggcagaacgagcccgaagacaucgacugcuggugcaacagcaccuccaccugggucacuuacgggaccugcaccgccaccggcgagcaccggagggagaagcggagcguagcccuggugccccaugucggcaugggccuggaaacccgcaccgagaccuggauguccagcgagggcgcguggaagcacgcgcagaggaucgagaccuggauucuccggcaucccgguuucaccauaauggcugccauccuggccuacaccaucgggaccaccuacuuccagcgggugcuuauauuuauuuuacugacggcgguggcacccucgaugacaaugaggugcaucgggauaagcaaccgggacuucguggagggcgucuccggugggagcugggucgacaucguacuggagcacggcuccugugucaccaccauggcuaagaacaagcccacgcucgacuucgagcuuauuaaaaccgaagccaagcagcccgcaacccugcgcaaguacuguaucgaggcgaagcucaccaacacgaccaccgccucccggugcccgacacagggggaaccuucccugaacgaggagcaggacaagcgcuucgugugcaagcacagcauggugggccggggcuggggcgacggcugcggacuguucggcaagggcgggauagucacgugcgcuauguucacgugcaagaaaaacauggaggguaagaucguucagcccgagaaccucgaguacaccaucguugucacgccacauuccggggaggagaacgccgugggcaaugacacggggaagcacggcaaggagaucaaggugaccccgcaguccucuaucaccgaggccgagcuaaccggguacgguacugucacgauggagugcucaccccgcaccggauuagauuucaacgagauggugcuccuccagauggagaacaaggcguggcuggugcaccggcagugguuccucgaccugccccugcccuggcucccgggggccgacauccagggcuccaauuggauccagaaagagacguuggucaccuuuaagaacccccacgcgaagaaacaggacguggucgugcuggggagucaggagggcgcacuccacacggcccugacuggggcgaccgagauccagaugucaucuggcaaccugcuguucaccggccaccugaagugucgcuuacggauggauaaacuccagcugaagggaaugucguacuccaugugcacgggcaaguucaagguggucaaggaaaucgcggagacccagcacggaaccaucgucgugcgcauccaguacgagggagacggcagccccuguaagauucccuuugagauuauggaccuggaaaaacggcacguccucgggagacugaucaccgugaaccccaucgugacggaaaaggacucaccaguaaacaucgaggcugagccgccuuuuggggacaguuacauuaucauugggguagagccgggccaacugaaacucuccugguuuaagaaggguucgucaaucggacagauguucgagaccacuaugcgcggcgccaagcggauggcgauauuaggggacaccgcgugggauuuuggcucucucggugggguuuuuacguccauagggaaggcucuucaucagguguuuggggccaucuacggcgccgcguucagcggagugagcuggaccaugaagauccugaucggaguggucaucaccuggaucgggaugaacucgcgcuccaccagccuguccgugagccuggugcucgucggcguugugacacuguacuugggggucauggugcaggccgauuccggcuguguagucagcuggcggaauaaggaguugaaguguggaagcggaaucuucaucaccgauaacgugcacacauggacugagcaguauaaguuccaacccgagucccccagcaagcuggccuccgccauccagaaggcccacgaggagggcaucugcgggauccgcagcgugacccggcuggagaaccucauguggaagcagaucacuccggagcuaaaccauauccucuccgagaaugaggucaaguuaagcaucaugaccggcgacaucaagggaaucaugcaggcgggcaagcgcucccuacggccgcagcccaccgagcuuaaguacuccuggaagacguggggcaaggcaaagaugcucuccaccgagccacacaaccagaccuuccugaucgacgggcccgagaccgcagaauguccuaacaccaacagggcauggaacagccuggagguggaggacuacggcuuugggguguucacaaccaauaucuggcucaagcugaaagagcggcaggacgucuucugcgacuccaagcugaugagcgccgcgauuaaggacaaccgcgcaguucacgccgacaugggcuacuggauagagucggcacucaacgacaccuggaagaucgagaaggccagcuuuaucgaggugaaguccugccacuggcccaaaagccacacguuaugguccaacggcgugcuagagagcgagaugaucauccccaagaacuucgcaggccccguuagccagcacaauuacagacccggguaccauacccagaccgccgggcccuggcaccucggcaaacuggagauggauuucgacuucugcgaagggaccaccguggucgugacggaggacugcggcaaucgcggucccucccugagaaccacuaccgccagcgggaagcugaucacagaguggugcugccgcuccugcacccuaccuccauuacgguaucgcggcgaggacgggugcugguacggaauggaaauccggccucucaaagagaaggaggagaaucuggugaacagccucguaaccgccgggcauggccagauagacaacuucuccuuaggcgugcuggggauggcgcuguuucucgaggagaugcugcgcacccggguggggacgaagcacgccgugcugcucguggccgugagcuucaugacccugauaacagguaacaugucguuccgggaccugggacgggucauggugaugguaggggcugccaugaccgacgacaucggcaugggagugacguaccucgcucuucuggccgccuuuaagguccggcccaccuucgccgccgggcuccugcugcgcaaacucacaagcaaggagcugaugaugacaacgaucggaaucgugcugcuaucccaaaguacgacccccgaaaccauccucgaguuaacggaugcgcuagcccuggggaugaugauccugaagaucguccggaacauggaaaaguaccaauuggccgugaccauuauggccauccugugcgucccgaacgccgugauacugcagaaugcguggaaggugucgugcacuauccucgcggccgugucugugucgcccuugcugcucaccaguagucagcagaaagccgacuggaucccccuggcccugacgaucaagggccucaaccccaccgccauuuuccucacuacccugagccgcacgaauaagaagcggagcuggccccucaacgaggccaucauggcagugggcauggucagcauccuggcaucuagccuacugaagaaugacauccccaugaccgggccccucguugcuggagggcugcucacaguauguuacguccugaccggccgcagcgcugaucuggagcucgaaagggcugccgacgugaggugggaggaccaggcggagguguccgguagcagcccgauucugagcauuacgaucuccgaggauggcagcauguccauaaagaacgaggaggaggaacagacccugaccauccucauccggacuggccugcugguaaucagcggccucuuccccgugucuaucccaauuacugcagcggcaugguaccugugggagguaaagaagcagcgggccggaguacugucugccgugcccaguccgccucccgucgggaaggcggagcucgaggacggcgcguaccggaucaagcagaagggcauccuggguuacagucagaucggggcugggguauacaaagaaggaacguuccacaccauguggcacgugaccagaggugccgugcugaugcacaagggcaaaagaaucgagccguccugggccgaugucagaaaggaccuaaucagcuacggagggggccguaaguuggaaggcgaguggaaagagggcgaagagguccaggugcuggcucucgagcccggcaagaacccccgcgccgugcagaccaagccgggccuguucaaaacaaacaccgggaccauuggggccguuucccuugacuucucacccggcgcauccgggagccccauuguggauaagaagggcaagguuguugggcucuauggcaacggcgugguuacgcgguccgggacguacgucagcgcgaucgcccaaaccgagaaauccaucgaggauaaccccgagaucgaagacgacaucuuuagaaagaaacggcugaccauaauggaccugcaccccggagcagggaaaaccaagcguuaccuuccggccaucgugcgggaggccauuaaacggggccuccgcacgcugauccuggcgcccacccggguuguggccgcugagauggaggaagcccuccgcgggcuacccaucagauaccagaccccagccauucgugcggagcacaccggccgcgagaucguagauuugaugugccacgcaacuuucacuaugcgccuccuauccccgguccgggugccaaacuacaaccugauaaucauggacgaggcgcauuucaccgaccccgccucaaucgccgcgagaggcuauaucucuacccggguagagaugggggaggcugccggcaucuuuaugacggccacgccucccgggucaagagaccccuucccccaguccaacgcgcccaucauggacgaggaacgggagauccccgagcgaagcuggaauuccgggcaugagugggucacggacuucaagggaaagaccgugugguuugugcccagcaucaaggcaggcaacgauauugccgccugccuccgaaagaacggcaagaaggucauccaacuguccaggaagacguucgacagcgaauacaucaagacccggacaaaugacugggacuucguggugaccacggauauuucugagaugggcgcaaacuucaaagccgagcgcgucaucgacccacgacgguguaugaaacccgugauccugaccgacggcgaagaacggguuauccucgccgggccgaugccagucacucauagcucggccgcucagcgccgcggccggaucgggcgcaaccccaaaaacgagaacgaccaauacaucuacaugggcgagccccuggagaacgacgaggacugcgcccacuggaaggaggcgaagaugcugcuggacaacauaaacaccccggaggggaucauccccucgauguucgaacccgagcgagagaagguagacgccauagacggggaguacaggcugcggggcgaggcgcgcaagacuuucguggaccugaugcggcgcggggaccuccccgucuggcucgccuaccggguggccgcggagggcauuaacuacgccgaccgacgguggugcuucgacgguaucaagaacaaucagauccuggaggagaacgucgagguggagaucuggaccaaggagggcgagcgcaagaagcucaagccccgguggcuagacgcuagaauuuacuccgacccccuggcccuaaaagaauuuaaagaauucgcagcaggccgaaaaaguuugacccugaaccucaucacagagaugggccgccugcccacguucaugacccagaaggcccgaaacgcccuggacaaccuagccgugcuacacaccgcggaggccgggggucgcgccuacaaucacgcccuguccgagcucccggagacucuggagacgcugcuccugcugacucuccuggccaccgucaccgggggcaucuuccuguuccugaugagcgguaagggcauugguaaaaugaccuugggcaugugcugcaucaucaccgcuucuauucugcucugguacgcccagauccagccccacuggaucgccgcaucuaucaucuuggaguucuuccugaucgugcuccugauccccgagccagagaagcagcggacaccucaggacaaccagcucacuuauguggucaucgccauccucaccgugguggcggccacgauggccaaugagaugggguuccuggagaagaccaagaaggacuucggccugggcagcauugccacccaacagcccgagagcaacauccucgacaucgaccugcgccccgccagcgcguggacccuguacgccgucgccacgaccuucaucacacccauguugcggcacagcaucgagaacucauccgugaacgugagccugaccgcaaucgcaaaccaggccacgguccugaugggccucggaaagggguggccgcugaguaagauggacaucggcgugccguugcucgccauagggugcuauagccaggugaaccccaucacccugaccgccgcccuguugcugcucgucgcccauuaugccaucauuggcccgggccuccaggcaaaggccacgcgcgaagcccaaaagcgcgcggccgccgggaucaugaagaacccgacggccgacggcaucaccgucaucgaccuggauccuauccccuaugaucccaaguucgagaaacagcugggccaggucaugcuccucguacugugugugacccagguccucaugaugcggacuacaugggccuuaugcgaggcgcugacccucgccaccgguccuaucuccaccuugugggaggggagcccaggcagauucuggaauacgacaaucgccgucuccauggccaacaucuuccggggcuccuacuuggcgggggcuggccucuuguucuccauaaugaagaauaccaccaacacgcgacgggggaccggcaauaccggugagacacugggugaaaaguggaagaaccgcuuaaacagcuugggcaagagcgaguuccaaaucuacaagcggucagggauccaggagguggaccgcacgcuggccaaggagggcaucaagaggggugagaccgaccaccacgccguaucccgcggcagcgccaagcuccggugguuuguggaacgcaaccuggugaccccagagggcaagguggucgaccugggaugcggccgcggcgggugguccuacuacugcggcgggcucaagaacguccgcgaggugcgggggcugacgaagggugggcccggccacgaggagccgauccccaugucaacguacggcuggaaccugguccgccuccagagcggaguggacguauuuuucacuccgcccgagaagugcgacacccugcuuugcgacaucggcgaguccagcccgaaccccaccgucgaggcgggccggacgcugcgugugcugaaucuuguggagaacuggcucaacaacaacacccaguucuguaucaagguccuuaaccccuacaugccguccguuauugaaaagauggagacucuccagcgaaaguauggcggggcucuggugcguaacccccucagccgcaacuccacccacgagauguacugggucuccaacgcauccgggaacaucguuucuucugugaacaugaucagccggaugcugaucaaccgcuucacgaugcggcacaagaaggccacguacgagcccgacgucgaccugggcuccgggacccgcaacaucggcaucgagagcgagacuccgaaccucgacauaaucgggaagcguaucgagaagaucaagcaggagcacgaaacguccuggcauuacgaccaagaccacccguacaagacgugggccuaccacggcagcuacgagaccaagcaaaccggauccgcgagcuccguggucaacggugucgugcgccuucuuacgaagccgugggauguaaucccuauggucacgcaaauggccaugaccgauaccacccccuucggccagcaaagaguguucaaggagaagguugacacgagaacccaagagccgaaggaaggcacaaagaagcucaugaagaucaccgccgaauggcuguggaaggagcuggggaagaagaaaacgccccggaugugcacccgagaagaauucgcccggaaggugcgcagcaaugccgcccucggcgccaucuucaccgaugagaauaaguggaaguccgcccgggaggccguugaggacagccgcuuuugggagcuuguggacaaggagcggaaucugcaccucgagggaaagugugagaccugcguguacaacaugauggggaagcgcgagaagaaaauaggggaguucggcaaggccaagggcagccgagcugugugguacauguggcuaggggcccgcuuccuggaguucgaagcacucggcuuccugaacgaggaccacugguucucccgggagaacucucuguccgggguggagggagagggacugcacaagcugggcuacauccugcgggaagugagcaagaaggagggcggggccauguacgcggacgacacggccgguugggacacccgcaucacccucgaggacuugaagaaugaggagauggugaccaaccacauggagggcgaacacaagaagcuggcagaggccaucuucaaguuaacauaccagaacaaggucgugcgcguacagcgccccacgccaaggggcaccgucauggacaucaucucccgccgggaccagcgcagcucuggccaggugggcaccuacggcuuaaacacguucaccaacaugggggcccagcugauccggcaaauggagggcgaggggguuuucaaaggcauccagcaccugaccgcaacugaggagguggccgugcaagacuggcuagcccgcgugggucgggagcgccuuagccguauggcaaucuccggggacgacugcgucguuaagccccucgacgaccgcuucgcaagcgcgcucacggcgcugaaugauaugggcaaggugcggaaggauauccagcagugggagccuucccgcggcuggaacgacuggacucaggucccauucugcagccaccacuuccacgagcuaauuaugaaggacggucggguucugguggucccgugucgcaaccaggaugagcugauuggucgggccaggaucucacaaggcgcuggguggucccuccgggaaacagccugccugggaaaguccuacgcucagauguggucucugauguacuuccaccgccggggccuucgccuggccgccaaugccaucugcuccgcgguccccagccacugggugccuaccagccgcaccaccuggaguauucacgcgaggcaugaguggaugaccacggaagacauguuaaccgucuggaaccgcguguggauccaggaaaauccauggauggaggacaagacgcccgucgagagcugggaggagauuccguaccucgggaagcggggcgaccaguggugcgggucccugaucggccuuaccagccgcgccaccugggccaggaauauccagaccgccauuaaccgcguccgaucccuuaucgggagugagggguacacggacuacaugcccuccaugaagcgguuccgacgcgaggaggacgaggccggcguguuaugguga

SEQ ID NO: 25121 - RNA, 9876 nt, Artificial Sequence
  derived and/or modified CDS sequence (opt11) from DENV-2__KJ010185__SS-prME
acggcgggcgugaucaucaugcugauccccaccgccauggcguuccacuugaccacccgcaauggggagccccacaugaucgucagcaagcaggagaagggcaagucccugcuguucaaaaccgaggauggugugaacaugugcacccugauggccauggacuuaggcgaacucugcgaggacacaaucaccuacaacuguccucugcugcggcagaacgaacccgaggacaucgacuguugguguaacgccaccuccaccugggugacguacgggaccugcaccgccaccggggagcaucgccgggagaagcgcuccgucgcccuggugccacacguggguaugggccucgagacccggaccgagaccuggauguccucagagggagcuuggaagcacgcccaaaggauugagaccuggauccugcgccacccagguuucacgaucauggcugccauccuggcguacaccaucggcaccaccuauuuccaacgcguccucaucuucauccugcuaaccgccguggcccccucaaugacaaugcggugcauuggaauauccaaccgagacuucguggagggcgucagugggggcuccuggguggauaucguccucgagcacggcaguugcgucaccacgauggccaagaauaagcccacgcuggacuucgaacuaauuaagaccgaggccaagcaaccugcuacacuacggaaguauugcaucgaggcgaaacugaccaacacgaccaccgcgucccgcugccccacacagggggaacccagccugaaugaggaacaagacaaacgcuucguguguaagcacuccaugguggaccgcggcuggggcaacggaugcggccucuucgggaagggcggcaucgucacgugugccauguucacaugcaagaaaaacauggagggcaagauugugcaacccgagaaucuggaguacacgaucguaguaaccccgcauagcggggaggagaacgccguggggaacgacacggguaagcacgggaaggagaucaaggugacaccccaguccagcaucaccgaggcggagcugaccggcuacgggacaguaacuauggaguguucgccccggaccggccucgacuucaacgagauggugcuacugcagauggagaauaaggccuggcuugugcaccgccagugguuucuggaccugccucuucccuggcugcccggcgccgacauucaggggagcaauuggauccaaaaggagacccuggucaccuuuaagaacccccacgccaagaagcaggacguagucguguugggcucccaggagggagcgaugcacaccgcgcugacuggagcuaccgagauacagaugagcucugggaacccccucuucacuggccaccugaaaugccgguuacgcauggacaagcugcagcuaaaaggcaugaguuacagcauguguacagggaaguucaagguggucaaagagauugccgaaacacagcauggcaccaucgugguucggauccaguacgagggagacgguucccccugcaagauuccuuuugagauuauggaucuggagaagcgccacgugcugggccggcucaucaccgucaaucccaucgucacugagaaagacagccccguaaacaucgaggccgagccaccuuucggugacuccuacauaaucauuggcguggagccaggacagcugaagcucagcugguucaaaaaggguuccucuaucgggcaaauguuugagaccacuaugcgcggugccaagcgcauggcgauacucggagacaccgccugggauuuuggaucacuaggagggguguucacgucaaucggcaaggcccuucaucaggucuucggggccaucuacggugcggccuuuuccggggugagcuggaccaugaagauccuuaucgguguggucauaacauggaucggcaugaacagcagaagcacaucccugagcguaucgcugguauuaguagggguggugacucucuaccuaggcgucauggugcaggcggacagcgggugcguggucuccuggaagaacaaggagcucaagugcggcagcgggauuuucuucacagacaacguccacaccuggaccgagcaguacaaguuccaacccgaguccccguccaaguuggccagcgccauccagaaagcucacgaagaggggaucugcgggauucgcuccaucacucggcuggacaaccugauguggaagcagauuaccccggagcucaaccauauccugucggagaaugaagugaaacuguccaucaugacgggggacaucaagggcaucaugcaggccgggaagcgcagcuugcggccccaaccuaccgagcucaaguacuccuggaagacguggggcaaggccaagaugcugucgacggagccccauaaccagacauuccuaaucgacggccccgagaccgcccagugccccaacacgaaccgugccuggaacucccuggagguagaggacuacggguucggcguguucaccaccaacaucuggcugaagcucaaggaacggcaggacgucuucugugacuccaagcugauguccgcggccaucaaagacaaucgcgccguacacgcagacaugggguacuggauugaaagugcgcugaacgacaccuggaagaucgagaaagcguccuucaucgaaguuaaaagcugccacuggccuaaaucccauacguuauggucgaacggaguauuagaauccgaaaugauuaucccgaagaacuucgccggccccgugagccagcacaacuaccggccgggguaccacacccagaccgccggccccuggcaccuggggaagcucgagauggacuucgacuucugugaaggcacaaccgugguggucacggaggacugcgggaaccgcggcccgagcuuacggaccacaacugcaucggguaaguugauaacggaguggugcugccgcuccugcacacugccgccgcuccgguauagaggggaagacggcugcugguacgggauggagaucagaccacugaaggagaaggaggagaaccucgugaacucccuggugacggcgggucacggccagauugacaauuucucuuuggguguccuugggauggcccuuuuccuggaggagaugcuccgcacccggguggguacgaagcacgccgugcugcuggucgccgucuccuucaugacccuaauuacggguaauaugagcuuucgcgaucuugggcgggucauggugaugguaggagcagcgaugacggacgauaucggcaugggcgucacuuaucuggcguuacucgccgcguuuaaagugcgcccgaccuucgcugcgggucugcuccugcgcaagcuaaccuccaaggagcucaugaugacuacgaucgggaucguguuacuaagccaguccaccacuccagagacaaucuuggagcugacugacgcccuggcccucggcaugaugauacugaaaaucgugcggaacauggagaaguaccagcuggccgucacaaucauggccauucucugcgugcccaacgcggucauucuacagaaugcuuggaaaguuuccugcaccauauuggccgccguguccguuagcccccuccuguugaccuccagccagcaaaaggccgauuggaucccccucgcccugacgauuaagggauuaaaccccacagccaucuuucucaccacguuaucgcgcacuaacaagaaacggagcuggccgcuuaacgaggcaauuauggccgugggcaugguguccauccuagcgucuucccugcuaaagaacgacauccccaugaccggcccccucgucgccgggggccugcugaccguuugcuacgugcugaccggucgcagcgccgaccuugaguuagagagagccgccgaugucagaugggaggaccaggcugagauaagcggguccagcccaauucucucaaucacgaucagcgaggacgggucgaugagcauaaagaaugaggaggaagaacagacccuuaccaucuugauucggaccggccuccuggugaucucuggguuauuccccguuagcauacccaucacagcggccgcaugguaccucugggaggucaagaaacagcgggcgggugugcuaugggacguaccauccccuccgcccgucggcaaggccgagcuggaagauggagccuaucggaucaagcagaagggcauccucggguacagccagauuggcgccgguguauacaaggaggguaccuuccacaccauguggcacgugacuagaggcgccguccugaugcauaagggaaaacggaucgagcccagcugggcagauguucgcaaggaccugaucaguuauggagggggcuggaagcucgagggcgaguggaaggagggggaggaggugcaaguucuggcgcuggagcccggcaagaacccccgggcagugcagacgaagcccgggcuguucaagacgaacacuggcaccaucggggccgugucccucgacuucagccccgguacauccggcucucccaucgucgacaagaaggguaagguggugggccuguacgggaacggggucgugacgcgcuccggaaccuacgugucagcaaucgcgcagacggaaaaauccaucgaggacaaccccgagauagaggaugauaucuuccggaagaagcgccuaaccaucauggacuugcauccuggggcaggcaagaccaaacgguaccugccagccaucguccgcgaagccaucaaacgcggacugcgcacacugauacucgcccccacccggguuguggcggccgagauggaggaggcgcugcguggccuccccauuagauaucagaccccugcaauccgggccgagcauacggggcgcgagauugucgaccuuaugugccacgcgaccuucaccaugcggcuguuaucuccugugcgagugcccaauuacaaucugauaaucauggacgaagcccacuucacagaccccgcaucuauagcggccaggggguacaucagcacgcgcgucgagaugggagaggcggcggggaucuucaugacugcuacaccgcccggcagccgggaccccuucccccaguccaacgccccgauaauggacgaagaacgcgagaucccagaaaggagcuggaacuccgggcaugaguggguuaccgacuuuaagggcaagacggugugguuuguucccagcaucaaggcggggaaugacauagcugcaugccugagaaagaacggcaagaaggugauccagcucucccggaaaacuuuugacucugaguacaucaaaacccgcaccaacgacugggacuuugucgucacgacagacaucuccgagaugggagccaacuucaaggcugagcgcgugaucgacccacgccgguguaugaagccugugauacucacagacggagaggagcgcgucauccuggcgggccccaugcccgugacccacucaagugcagcucaaaggagagggcggaucggccgcaacccuaagaacgagaacgaccaguacauauauaugggcgagccgcucgagaacgacgaggacugcgcccacuggaaggaagccaagaugcugcuggacaacauuaauacccccgagggcaucaucccguccauguucgagccggaacgcgagaaaguggacgcgaucgacggcgaguaccggcucagaggggaagcgcggaagaccuucguggaucuaaugcgucgaggagaccugcccguguggcuugcuuaccgcguggccgcagaggggaucaacuacgcggaccggcgaugguguuuugacgggauaaagaacaaccaaauccuggaagagaacguagaaguggaaaucuggaccaaggagggagagcggaagaaacugaaacccagguggcucgacgcccggaucuacucagacccccuugcccugaaggaguucaaggaguuugccgccggucguaagucacuuaccuuaaaccugauaacggagaugggccgacucccgacguucaugacccagaaggccaggaacgcguuggauaaucuugcaguccuccacaccgcggaggccggcgggcgggccuauaaccacgcauuguccgaacugccggagacacuagaaacccuacugcuacugacacugcucgccaccguaacgggcggcauuuuccuguuucugaugucagggaaggggaucgguaagaugacccugggcaugugcugcaucaucacggccuccauccuacugugguacgcccagauccaaccccacuggaucgccgccagcauaauccucgaguucuuccugaucguacuguuaaucccagagccggaaaagcaacgcacaccccaggacaaccaacuuaccuaugucgugauugcaauccugacugugguggcugcgaccauggccaacgaaaugggguucuuagagaagaccaagaaggacuucggguugggcucaaucgcuacccagcagcccgaaagcaacauacuggauaucgaucucaggccggcgagcgccuggacgcucuacgcgguggccaccaccuucaucaccccgauguuacggcacagcaucgagaacagcucugugaacgucagccucacggccaucgccaaccaggccaccguccugaugggccuggggaagggcuggcccuuguccaagauggacauaggggucccacugcuugccaucggaugcuacagucaaguuaaccccaucacccucacugccgcucugcuucuccugguggcccacuacgcgaucauagggccgggccugcaggcuaaggcaagccgggaggcccaaaagagagccgcggccggcauaaugaagaaucccacgguggacgggaucacagucauagaccucgaccccauccccuacgacccaaaauucgagaagcaacugggucaggugaugcugcucauccugugcgugacccagguucugaugaugcguacaacaugggccuugugugaagcccugacccuggccaccgggcccauuagcacgcucugggagggcaaccccgggcgcuucuggaacacgaccauugcgguauccauggccaacaucuuucgcggcucuuacuuagccggcgcaggucuucuguuuuccaucaugaagaacaccaccaacacccggcgcggcacggggaacaccggagagacccugggcgagaaauggaagaaucgggugucacugcugggaaaguccgaguuccagauuuauaaaagaagcgguauacaggaggucgaccguacgcuggcgaaggaggggaucaagcgcggggagacagaucaccacgccgucagccgaggcagcgccaagcugcgcugguucguggagcgcaaccucgucacgcccgaaggcaaggugguggaucugggcugcggucgcggcggguggucuuacuacugcggcgggcugaagaacguccgggagguuaagggccucaccaagggcgggccgggccacgaggaacccaucccaaugucgacguauggguggaaccuagugcgccugcucaccggcgcagacguauucuucacgcccccugagaagugcgacacccuacugugcgauaucggggaaucgagcccgaacccaacuguggaagccggccggacccuccgcgugcugaaucuggucgaaaacugguugaacaacaacacccaguucuguaucaagguacugaacccuuacaugcccagcguaaucgagaagauggagacccuucagcggaaguacggcggggcgcugguccgaaacccucucagucggaacagcacgcaugaaauguacuggguguccaacgcguccgggaauauugugucaagugucaacaugaucagucgcaugcugaucaauagguucacgaugaggcauaagaaggccacuuacgaccccgauguugaccuggggagcggcacccgcaauaucgggaucgaguccgagaccccaaaccucgacauuaucggcaagcggaucgagaagauaaagcaggaacaugagacgagccgccacuacgaucaggaccaccccuacaagaccugggcuuaccacggcucauacgagaccaagcaaacugggucagccucgagcacagugaauggcguugugcggcugcugaccaagcccugggacguaaucccuauggucacccagauggcgaugaccgauacgaccccguucggccagcagcgcguguuuaaggagaagguagacacucgcacgcaagagcccaaggagggcacgaagaaacuuaugaaaaucacugccgaguggcuguggaaggagcuggguaaaaagaagacgccccguaugugcacccgagaagaguucgcucgcaagguccgguccaacgccgcccucggggccaucuucacagacgagaacaaauggaaguccgcacgugaagcagucgaggauucacgguucugggaauugguggacaaggagcggaaucugcaccucgagggcaagugcgagaccugcgucuacaacaugauggggaagcgggagaaaaagauuggcgaguucgggaaagcgaagggaagccgcgcaaucugguacauguggcugggcgcgagauuccuggaguucgaggcucucggguuucugaaugaggaccacugguucagcagggagaacagccucagcggcguggaaggcgagggacuucacaagcugggguacauacugagggagguauccaagaaggagggcggcgcuauguacgccgacgacaccgcuggcugggacacccgcaucacccuugaagaccugaagaacgaggagauggucacuaaucacauggagggcgagcacaagaagcucgcagaggccaucuuuaagcucaccuaccaaaacaaggugguccgggugcagcgccccaccccucgggggacuguuauggacaucaucagccgccgcgaucaacgggguuccguccagguggggacuuacggccuaggcacuuucacaaacaugggcgcccagcugauccgccaaauggagggcgaggggguguucaaggggauccagcaucugacagccacagaggaaguggcagugcaggacuggcuggcgcgcgucggucgggagcgguuaucgcgcauggccaucuccggggaugauugcgucgucaagccucuggacgaccgguucgcauccgcucucaccgcgcugaacgacaugggaaaagugcgcaaggauauacagcaaugggagccgucccgcgguuggaacgacuggacccagguccccuucugcucucaccacuuucacgagcucaucaugaaggacggccgaguguugguuguuccgugccggaaccaggaugaacugaucgggagggcccgaaucucccagggcgccggcuggucacucagggagacggccugucuggggaaaucguaugcucaaauguggagccugauguacuuucaccgacgcgaccuccguuuagcggcgaacgccauuugcuccgccgugcccagccacugggugccaacuucccgcaccacauggucgauccacgcgggccacgaauggaugaccacggaggacaugcugaccgucuggaaccggguauggauccaggagaacccguggauggaggacaaaaccccgguggaguccugggaggagauucccuaccuggggaaacgcgaggaucaaugguguggcagccugaucggucugaccagccgcgcaacgugggcccggaacauccaaaccgccaucaaccaggucagaagucucaucggcagcgaggaauacacggauuacaugcccuccaugaagcgguucggccgcgaggaggaggaagccggcgugcugugguga

SEQ ID NO: 25122 - RNA, 9876 nt, Artificial Sequence
  derived and/or modified CDS sequence (opt11) from DENV-2__KJ010186__SS-prME
accgcaggcgugaucaucaugcugauccccaccgccauggcguuccaccucaccacccgcaauggugagccgcacaugauagucuccaagcaggagaaaggcaagucccuacuguucaagacugaggauggcgugaacaugugcacucucauggccauggaccuaggcgagcugugcgaggacacgaucaccuacaauugcccccuccugcggcaaaacgaacccgaggacaucgacugcuggugcaacgccaccagcaccugggugacuuacgggaccugcaccgccaccggcgagcaccgccgggagaagcgcagcgucgcccuggugccacacgugggcaugggucucgagacccgaaccgagaccuggaugagcuccgagggcgcguggaagcacgcccagcggaucgagaccuggauccugcggcaccccggguucaccaucauggccgccaucuuagcguacaccaucgguaccaccuacuuccagcgcguccucauauucauccugcugacagcgguggccccuagcaugaccaugaggugcauugggaucuccaaccgagacuucguggagggggucagugguggguccuggguugacaucguucuugagcacggcagcugcgucacgaccauggccaaaaauaaacccacgcuggacuucgagcuaaucaagaccgaggcaaagcagcccgccacgcuccggaaguacugcaucgaggcgaggcuaacuaacacgaccaccgccucccggugcccgacccaaggcgagcccagccucaacgaggagcaggacaaaagauucgugugcaagcauucuaugguggacagaggcugggguaacgggugcggccucuucgggaagggcgggaucgugacgugcgccauguucacguguaaaaagaacauggaggguaagauagugcagcccgagaaccuugaguauaccaucgugguaacgccccacucgggcgaggagaacgccgugggaaacgacacggguaagcacgguaaggaaauuaaggugaccccgcaguccagcaucaccgaggcggagcuaaccggguacgggacgguaacgauggagugcagcccccggacuggccucgacuucaacgaaauggugcugcugcagauggagaacaaggcguggcucguccaccggcagugguuccucgaucugccccuccccuggcugccgggugccgacauccaggggagcaacuggauccagaaagagacccuagucaccuucaagaagccccacgccaaaaagcaggauguggucguacuaggcucccaggagggggcaaugcacacggcguugacuggagcgaccgaaauccagaugagcagcgggaaccucuuguucaccggccaccugaagugucgacugcggauggacaagcuccaacugaagggcaugucauacucgaugugcaccgguaaguucaagguggucaaagagaucgccgagacccagcacggcaccaucgucgugcgcguccaguacgagggggacggcuccccgugcaaaauccccuucgagaucauggaccuggaaaagcggcaugugcucggccgucugaucacugugaauccgaucguuacggagaaggacagcccagugaacaucgaggccgaaccacccuucggggacuccuauaucaucaucggcguggagccgggacagcugaagcucagcugguuuaagaagggcuccuccauugggcagauguucgagaccaccaugaggggagccaagcggauggcgauccugggcgauacggccugggacuucggcucccuggguggggucuucacgagcaucggcaaagcccuccaccagguguucggggcuaucuacggcgcggcauucuccggcgucagcuggaccaugaagauccugaucgggguaguuaucaccuggaucggcaugaacucccgcucgacuucccuaagcgugucacuggucuuaguggguguggucacccuguaccugggcgugaugguacaggccgacagcgggugcgucguuuccuggaagaauacggcccucaagugcggcucagggauuuuuaucaccgacaacgugcacacguggacggagcaguacaaguuccaacccgaguccccauccaagcuggcuagcgcgauacagaaggcccacgaggagggcaucugcggcauccgguccgucacacgucuugagaaccucauguggaagcagaucacccccgagcugaaccauauucugagcgagaacgaagugaagcucucuaucaugaccggggacaucaagggcauauuacaggccgggaagcggagccugcgcccgcaacccacggaguugaaguacucuuggaagaccuggggcaaggcgaagaugcugucuaccgagucgcacaaccagaccuuccuuaucgacggcccagagacggccgaguguccgaacacaaaucgggcauggaacucucucgaaguggaggacuacgguuucggggucuucaccacaaacaucugguugaagcugaaggagcgccaagauguuuucugcgacuccaagcucaugagcgcugccaucaaggacaaccgggcggugcaugccgacaugggguacuggaucgagagcgcgcuaaacgacacguggaagaucgagaaggccagcuucauagaagucaaauccugccauuggcccaaaagccacacccugugguccaacggagugcucgagagcgagaugaucauacccaagaacuuugccggcccggugucgcagcacaacuaccgcccuggguaccacacccagacggcgggccccuggcaccuggggaaacuggagauggacuuugacuucugugagggcacuacagucguggucaccgaggacugcgggaaccggggccccucccuccguaccaccacggcgagcgguaagcugaucaccgaguggugcugccgguccugcacccuaccgccccuacgcuacagaggggaagauggaugcugguaugggauggaaauccguccccugaaagagaaggaggagaaccugguuaacagccuggucacggcaggccaugggcagaucgacaacuuuucccugggcgugcugggcauggcacucuuccuggaggagaugcugcggacgcgcgucgggaccaagcacgccgugcuccugguggccgucucguucaugacccugauuaccggcaacaugucuuucagggaccucgggagagugauggucaugguaggcgcggcaaugacggacgacauugggaugggcgugaccuaccuggcgcuccucgcggccuucaagguacgccccaccuucgcggccggccuacuucuccggaagcugacgaguaaggaacuaaugaugaccacgaucgguaucguccuccuaucccaaagcacuacgcccgagacgaucuuagagcucacggaugcccuagcuuugggcaugaugauccucaagaucgugcgcaacauggaaaaguaccagcucgccguuaccaucauggcgauccugugcgugccgaacgcgguuauccuccagaacgccuggaaggucuccugcacuauacuggcagcggugagcguuagcccccugcugcuuacgagcucccagcagaaggccgacuggaucccacuagcccucaccaucaaggggcugaaccccaccgccaucuuccugaccacccucagccggacuaacaagaagcgcuccuggccgcugaacgaggccauaauggcggucggcaugguuuccaucuuagccuccagccuucugaagaaugacaucccaaugaccggcccucuuguggcuggcgggcuccugaccguuugcuacgugcugacggggcgcagcgcggaccucgaacucgagcgagcggcggacguacggugggaggaccaagcagagaucuccgggaguucccccauacugagcaucaccauuuccgaggacgggagcauguccaucaagaacgaggaggaggagcagacccucaccauccugauccgcacggggcugcucgucaucagcgggcuguucccggugucgauccccaucaccgccgccgccugguaccucugggaggugaaaaagcagcgagcgggugucuuaugggacgugcgcagcuacccgccagugggaaaggccgagcuggaggacggggcauaccggaucaagcagaaagggauccugggguacucccagaucggcgccggggucuacaaggaggggaccuuccauaccauguggcacgugacccgcggagcugugcucaugcacaaagggaagcggaucgaaccuagcugggcagacguccguaaggaucuaaucuccuacggcggcggcuggaagcuggagggcgaguggaaggagggcgaggagguucaggugcuugcucuggagcccggcaagaacccucgggccguccagacgaagccgggccuguucaaaaccaauacggggacuaucggggccgugagucuugacuucucccccggcacgagcggcagccccaucguggacaagaaagggaaggucgugggccuguacggcaacggaguggucacccgcagcggcacguacguaucugcgauugcccagaccgagaagucgaucgaagacaaccccgagaucgaggacgacaucuuuaggaagaagcgccugacgaucauggaccugcaccccggugccggcaagaccaagcgguaccucccggcuaucguuagagaggccauaaagcgggggcugcgcacccugauccucgcgccgacccgcguuguggccgccgagauggaagaggcacugcggggccugcccauccgcuaccagacgccggcuauccgggcggagcacaccgggcgcgagaucguggacuuaaugugccaugcaaccuucaccaugcggcugcugucacccguccgcgucccgaacuacaaccucaucauaauggacgaggcucacuucaccgaccccgccuccaucgcggcgcggggcuacaucagcacacgcguggagaugggcgaggccgccgggaucuucaugaccgccaccccgcccggcucccgggaccccuucccccagagcaacgcgccaauaauggacgaggagcgggagaucccggagagguccuggaacagcgggcacgaguggguuacggacuucaagggcaagaccgugugguucgugcccaguaucaaggccggcaacgacaucgccgcgugccugagaaagaacggcaagaagguuauccagcugagccggaagaccuuugacuccgaguacaucaagacccguacgaaugacugggacuucguggugaccaccgacauaagcgagaugggcgccaacuucaaggcugagcgugucaucgacccccggcggugcaugaagccgguaauuuugaccgacggggaggagcgcgugauucuagcaggcccgaugcccgucacgcacuccagcgccgcccagcggcgcgggaggaucggccggaacccuaagaaugaaaaugaccaguacaucuacaugggggagccgcuagagaacgacgaggacugugcacauuggaaggaggcgaagaugcuccuggacaauaucaacacucccgagggcaucauuccauccauguucgagcccgagcgcgagaagguagaugcgaucgacggggaguaccggcugcgaggggaggccagaaagaccuucgucgaccucaugcgccgcggcgaccugccggucuggcuggccuaccgcguggcugcggaggggaucaauuacgccgacagacgcuggugcuucgauggcaucaagaacaaccagauccucgaggagaacgucgagguggagaucuggaccaaggagggggagcggaagaagcugaagccacgcugguuagacgcccggaucuacagcgacccccucgcacugaaagaguucaaggaguucgcggccggccgcaagucccucacgcuaaaucugauaaccgagaugggccggcugccuaccuucaugacacagaaggcccgcaacgcccucgauaaccuggcagugcugcauacggcagaggcagggggccgggccuauaaccacgcucucagcgagcuucccgaaacccuggagacccuccugcugcuuacccugcuugccacggucaccgggggcaucuuccucuuccucaugagcggcaagggaaucggcaagaugaccuuagggaugugcugcauaaucacugcgagcauccuccugugguacgcccaaauccagccccacuggaucgccgcguccaucauccuggaguucuuucucaucgugcugcugauccccgagccggagaagcagcgcacgccccaggacaaccagcucacguacguggucaucgccauccugacggugguugcggccaccauggcgaaugagaugggcuuccuggagaagaccaagaaggacuucgggcucggcucaaucgccacucagcagccggaaaguaacauccuggauaucgaccugcggccugccuccgcauggacccucuacgcuguugccacaaccuuuaucacgccgaugcugcgccauagcauagagaacuccagcgugaacgucucccugaccgccaucgcgaaccaggccaccguccuuaugggucuggggaaaggcuggccccugagcaagauggauauuggggugccccucuuggccauaggcugcuacucccaggugaacccaaucacgcugacugccgcacugcuacuguuaguggcgcacuacgccaucaucgguccggggcugcaggccaaggcaacucgagaggcccagaagcgcgcggccgcaggcaucaugaagaaccccaccgucgacgggaucaccgugaucgaucuggaucccauccccuacgacccuaaauucgagaagcagcucggccaagugaugcugcuagugcucugcgugacucagguccuaaugaugcgcaccaccugggcccugugcgaggcccucacccuggcgacagggcccaucagcacccugugggagggcaacccugggcgguucuggaacaccaccaucgccgugaguauggccaacaucuuccgcggcucuuaccucgccggcgcugggcuacucuucuccaucaugaagaacacgaccaacacacggcgcggcacggggaacacgggugagacccucggggagaaguggaagaacagacugaacucgcuggggaagagugaguuccagauuuauaagcgcucgggcauccaggagguugaccggacccucgccaaggaagggaucaagcgcggagagaccgaccaccacgccgucucccgggggucugccaagcugcgcugguucguugagcggaaccugguuacgcccgagggcaaagucguggaccucggcugcggucgaggcggguggucguauuacugcggcgggcugaagaaugugagggaggucaagggccugaccaagggcgggccugggcacgaggaaccgauccccaugucgacuuacggcuggaaccucgugcgccugcagucagguguggacgucuucuucacgccgcccgagaagugcgacacgcugcucugugacaucggggagagcagccccaacccuaccguggaggcaggccggacccugcgcgugcugaaccuaguugagaacuggcugaacaacaacacucaguucugcaucaagguucugaaccccuacaugccguccgugaucgaaaagauggagacccugcagcggaaauacggaggggcgcuggucagaaacccccugagccggaacucgacgcacgaaauguauuggguaagcaacgcguccgggaacauugugagcuccgucaacaugaucagcagaaugcugaucaaccgcuucaccaugcgucacaagaaggccaccuacgagcccgacgucgaccucggguccggcaccagaaacaucgggaucgagagcgagacgccgaaucuggacaucaucggcaagcggauugagaagauuaagcaagagcaugaaacguccuggcacuaugaccaagaccaccccuauaagaccugggccuaccacggcagcuacgagacaaaacagacggguagcgccucuuccauggugaacggugucgugaggcuucucaccaagcccugggacgugauccccauggucacccagauggcgaugaccgacacgacaccguucgggcagcagcggguguucaaggagaaaguugauacccgcacccaggagcccaaggagggcacgaagaagcugaugaagaucacagccgaguggcuguggaaggagcucggcaaaaagaaaacaccccggaugugcacccgcgaggaguucgcgcggaaggucagaaguaacgccgcccugggggcaaucuuuacugacgagaacaaguggaaguccgcccgggaggccguggaagacagccgcuucugggagcuggucgacaaggagcguaaccuccaucuagagggcaagugugagaccugcguguacaauaugaugggcaagcgcgaaaagaagauuggcgaguuugggaaggccaaaggcucccgcgcgaucugguacauguggcugggcgcccgauuccucgaguucgaagcccugggguuucugaacgaggaccacugguucagccgggagaacagccucucaggcguggagggggaaggccugcacaagcugggcuacauccuccgcgaggucucuaagaaagaaggaggggccauguacgccgaugacacagcggggugggacacucggauaacgcuggaagaccugaagaacgaggagauggugaccaaccacauggagggcgagcacaagaagcucgccgaggcgaucuucaagcugaccuaccagaauaaaguuguccgagugcagcggcccacuccgcgggggacugugauggacaucaucuccagacgggaucaacgaggcagcggccaggugggcaccuacggacugaacacuuucaccaacaugggagcccaguugauccgacagauggagggcgaggggguguucaagggaauacaacaucugacugcuaccgaggaaguagcgguacaggacuggcucgcccgcgugggcagagagcgccucuccagaauggccaucagcggggacgacugcguggugaagccccuagacgaccguuucgccaacgcccucaccgcgcucaacgacaugggcaaggugcguaaggauauccagcaaugggaaccaucacgcggguggaacgacuggacccaggugccauucugcagccaccauuuccacgaguugaucaugaaggacggccggguccugguagugcccugccgcaaccaggacgagcucaucgggagagcccgcaucucccagggugccggcuggagccugcgggaaacggccugccugggaaagagcuacgcccagauguggagccucauguacuuccaccgccgggaccugcgccucgcggccaaugccaucugcuccgccgugccaagccauuggguucccacaucccggaccacauggagcauccacgcgcgccacgaguggaugaccacggaggacaugcucaccguuuggaacagggucuggauccaggagaaccccuggauggaggauaagaccccgguggaaagcugggaggagaucccuuaccugggcaagcgggaagaccaguggugcgggagccugaucggacucaccagccgagccacgugggcccggaacauccagaccgcgaucaaccaggugcgcucccugaucggcagcgaagaguacaccgacuacaugccguccaugaagcguuuccgccgggaggaggaggaggccggcguccugugguaa

SEQ ID NO: 25123 - RNA, 9876 nt, Artificial Sequence
  derived and/or modified CDS sequence (opt11) from DENV-2__KF955364__SS-prME
accgccggggugauaaucaugcugauccccaccgccauggccuuccaccucaccacccggaacggcgagccgcauaugaucgucgggcgccaagagaaggggaagucccuccuguucaaaaccgaggacggcguuaacaugugcacccugauggcuaucgaccugggggagcugugcgaggacacgaucaccuacaagugcccuuuacugcgccagaaugagcccgaagacaucgauugcuggugcaacagcaccagcaccugggugaccuacgggaccuguacaaccacgggcgagcaucggcgcgagaagcggagugucgcccuggugccccacguagggaugggguuagaaacucgcaccgaaaccuggaugucgagcgagggggccuggaagcacguucagcggaucgagacauggauccugcgccacccgggcuucaccaucauggccgcgauccuggcauacacgaucgggaccacgcacuuccaacgggcccucaucuucauccuguuaaccgccguggcgcccucuaugacaaugcggugcauagggaucagcaaccgggacuucguggaaggcguuagcgggggcuccuggguugacaucgugcucgagcacgggagcugcgucaccacgauggccaagaacaagcccacccuggacuucgagcugaucaagaccgaggcaaagcaacccgccacccuccgcaaguacugcaucgaggccaagcugacgaacaccaccaccgagucccguugcccgacucagggcgaacccagccugaacgaggagcaggacaaacgguucaucugcaaacacaguaugguggaccguggcugggggaacggcugcggccucuucggcaagggugguauuguuaccugcgcgauguuuacgugcaagaagaacauggagggcaaagucguacugccagagaaccucgaguacaccaucguaauuacgccccacagcggggaggaacacgcugucggcaacgacaccgggaagcacggcaaggaaauuaagaucaccccgcaauccagcaucaccgaagccgaacucaccgguuacggcacggugaccauggagugcagcccacggacuggccuggacuucaacgagaugguguuacugcagauggaggacaaggccugguugguccaccgucagugguuccuggacuuaccccuccccuggcugccgggagccgacacccagggcaguaacuggauccagaaggagacgcuaguuacguucaagaacccccacgcuaagaagcaagacguggucgugcuggggucacaggagggcgccaugcacacagcccugaccggggccacggagauccagaugagcagcggcaaccucuuauucaccggccaucugaagugccgccugcggauggacaagcuacaacucaaggggauguccuacagcaugugcaccggcaaguucaagaucgucaaagagaucgccgagacccagcacgggaccaucgugauccgcguacaguacgagggcgacgguucccccugcaagauccccuuugagauaauggaucucgagaagcggcaugugcuggggagacugaucaccgugaacccgauugugaccgagaaagacagccccgucaacaucgaggcggagccacccuucggugacuccuauauuaucaucgggguggagccuggucagcucaagcugaacugguucaagaaggggagcucuauaggccaaauguuugaaacuacgaugcgaggggccaagcggauggcaauccugggggacacagccugggacuucggcagucuagggggcguuuucacguccaucgggaaagcccugcaucaggucuuuggcgcgaucuacggggcagccuucagcgggguuuccuggaccaugaagauccugaucggcgugaucaucacguggauagggaugaacagccgcaguaccagccucuccgucagucucguguuagugggcguagugacccuguaccucggggugaugguccaggccgacaccgguugcguugugucauggaagaacaaggaacuuaaaugcgguagcgguaucuucauuacggacaaugugcauaccuggaccgagcaauacaaguuucagccggagagucccucaaagcuagcgagcgcgauccagaaagcucaugaagaaggcaucugcgggauucgguccgucacacgacucgagaaccugauguggaagcagauuacgcccgagcugaaccacauccuuagcgagaacggcgugaagcugaccaucaugacuggggacaucaagggcauuaugcaggccggcaagcggucccugcgcccgcagccgaccgagcucaaguacagcuggaagacgugggggaaggccaagaugcuguccacugagagccacaaccagacguuccugaucgacggcccugaaacggcggagugcccgaacacgaaccgggcuuggaacucccucgaaguugaggacuacggguucgguguguucagcaccaauaucuggcugaagcugcgcgagaagcaggacgugcuaugcgacuccaaacugaugagcgcggccaucaaggacaaucgagccguccacgcggacaugggcuacuggaucgaguccgcccugaacgacaccuggaagauggaaaaagcgagcuucauagagaucaaauccugccacuggccuaagucccacacucucugguccaacggcgugcuggagucggagaugaucauccccaagaauuuugcaggccccguaucccaacacaauuaccgcccgggguaccauacccaaacggcaggccccuggcaccuggguaaacuugaaauggacuucgacuucugcgagggcacuaccgucguggugaccgaggacugcggcaaucgggggcccagucugcgcacgaccaccgcgagcggcaagcugaucacggaguggugcugccgguccugcacguugccgccccugagguaccgcggggaagacggcugcugguacgggauggaaauccggccacugaaggagaaagaggagaaucucgucaacagccuggugaccgccggccacggacagaucgauaacuucucauugggagugcuagggauggcgcuguuccuagaggaaaugcuucgaacgcgcgucgggacgaaguaugccauccuguuaguggccgugucauuugucacgcucaucaccggaaacaugucuuuccgggaccuggggcgcgugauggugauggucggcgcuacuaugacagacgacauaggcaugggugugacguaucuggcccuccuggccgccuucaaggugcgcccuacuuuugcggccggccugcuccuacguaagcugaccagcaaagagcucaugauggcgacgauagggaucgcccuccugucccagagcacgauucccgaaacuauacuagagcucacugacgcccuggcgcucggcaugaugguccuaaagaucgugcgcaacauggagaaguaccagcuggccgugaccaucauggccaucaguugugucccuaacgcggugauccuucaaaacgccuggaaggugagcugcacaauccuggcggcggucuccgugagcccccugcuccugaccucgagccagcagaaggccgacuggauuccgcuggcauuaaccauuaagggccucaacccgaccgcgauuuuucugacuacccucucccggacaagcaagaagagguccuggccgcugaacgaggcggucauggccguggggauggugagcauccuugcauccagccuccugaagaacgacauacccaugaccgguccccuggucgccgggggacuccuuacggugugcuacguacugaccgggcggucggcggaccuggagcuggagagggccgccgacgugaagugggaggaccaagccgagaucuccggaagcucgcccauccuguccaucaccaucuccgaggacggcagcauguccaucaaaaacgaggaagaggaacacacccucaccauccugauccggaccgggcugcucgugaucagcggcguguucccggucuccauucccaucaccgccgcggccugguaccugugggaggugaagaagcagcgugccggggugcuuugggacgucccuaguccgccgccugugggcaaggccgagcuggaggacggagccuaccgaaucaagcagcgcggcaucuucggcuacucccagaucggcgcggggguguacaaggaggggacuuuccacaccauguggcacgucacgagaggggccguucugaugcaccgggggaagcggaucgagcccagcugggccgaugugaagaaggaccugaucucauacgggggcggguggaaacucgagggcgaauggaaggaaggugaggagguccagguauuggcccuggagccaggcaagaacccccgcgccgugcagacaaagcccggccucuucaagaccaauaccggcacgauuggcgcggucagccuggauuucucccccggaaccagugggucccccaucgucgaccggaagggaaaggucgugggccuuuaugguaacgggguggugacccgaagcggcgcguacguauccgccaucgcccagaccgagaaguccaucgaggauaaccccgaaaucgaggaugacaucuuccggaagaagcgccucaccaucauggaccugcaccccggagcgggcaaaaccaagcguuaccugcccgccaucguucgcgaggccauuaagcgggggcugcgcacacuaauccuggcgccgaccagaguggucgccgccgaaauggaggaggcccugcggggccucccaauccgcuaccagacccccgccauccgggccgagcauacagggcgcgagauuguggaccugaugugucacgccaccuucacuaugcggcugcugagcccgguacgcguuccgaacuacaaccugauuaucauggacgaggcgcacuuuacggacccugcuuccauagccgcacggggguacaucagcacccgcguggagaugggcgaagccgccgggaucuucaugaccgcaacaccgccgggcucccgggacccguucccgcagagcaaugcccccaucauggacgaggaaagggagauccccgagcgguccuggaacagcgggcacgagugggugacggacuuuaagggcaagacgguuugguucgugccuucuauuaaggccggcaacgacaucgcggccugcuugaggaagaacgggaagaaggugauccaguugagccggaaaaccuucgacuccgaguacguuaagacacgcgccaacgacugggauuucguggugacgaccgauauuagcgagaugggugccaacuuccgggccgagcgcgugauagacccccggcgauguaugaaacccgucauccucaccgauggugaggaacgggugauccuggcgggccccaugccgguaacccacuccucggcagcccaacgacgcgggcguaucggccguaaccccaagaacgagaaugaucaguacauauacaugggcgagccccucgagaacgacgaagacugcgcccacuggaaggaggccaagaugcugcuggacaacaucaacacgcccgagggaaucaucccguccauguucgagccggagcgggagaagguggacgccauagacggcgaguaccgccuccguggcgaggccagaaagaccuucguggaccugaugcggcgcggcgaccuccccgucuggcuagccuaccguguggccgccgaggggaucaacuacgcugaccgucgguggugcuucgacggcauuaagaacaaccagauccucgaagagaacguggaggucgagaucuggacaaaggagggugagcgcaagaagcuaaagccgcggugguuggacgcccgcaucuacagcgacccccuggcccugaaggaguuuaaggaguucgccgcggggaggaaaucccucacccugaacuugauaacggagaugggcagacucccgacuuucaugacgcagaaggcucgggacgcccuggacaacuuggccgugcuacacaccgccgaggucgguggacgagcguacaaccacgcccugucagagcugcccgaaacccucgagacccugcuguuacugacccugcucgccaccgugacaggggguauuuuccuguuccugauguccggcaagggaaucggcaagaugacccucggaaugugcugcaucaucaccgccagcaucuuacugugguacgcccagauccagccgcacuggaucgcggccuccaucauccucgaguucuucuuaauuguucugcucauccccgagccagagaaacagcgcacuccacaggacaaccaacugacuuacgucgugaucgcgauccugacgguggucgcggccaccauggcgaacgaaaugggcuucuuagaaaagaccaagaaggacuugggccuggggagcaucacuacgcaggaaagcgaguccaacauccucgacaucgaccuccgcccggcaagcgccuggacccuguaugcgguggccaccaccuucgugacgcccaugcuccggcacuccaucgagaauagcuccgugaacgucagccugaccgcuaucgcgaaccaagccaccgugcugaugggccucgggcgcggcuggccccucaguaaaauggacaucggggucccccugcucgccaucggcugcuacagccaggugaacccgaucacacugacggcggcccugcuccugcugguugcccacuaugcuauaauaggccccggucuccaagccaaagcgacccgcgaggcucagaagaggaccgccgccggcaucaugaagaaucccaccgucgacgggaucacggugaucgaccuggagcccaucccguaugauccaaaguucgagaagcaacugggccaggugaugcugcugguccuguguguuacccaggugcugaugaugcgcaccaccugggcccugugcgaggcacugacgcucgcgacugggcccaucuccacccugugggaggguaaccccggccgguuuuggaacaccacgauugcuguuucaauggcgaacaucuuccgcggauccuaccuggccggcgcggggcuccuguucagcaucaugaagaacaccaccaauacccggcgcggcacggggaacauaggggaaacccucggcgagaaguggaagucccgacucaacgcucugggcaagagcgaguuccaaauauacaagaaguccggcauccaggagguggaccgaacccuggccaaagaggggaucaagcggggugagaccgaccaccacgcaguuagcagagggagugcgaagcuccggugguucgucgaaagaaacaugguuacgccggaggggaagguggucgaucugggcugcgggcguggcggguggucguauuacugcggcggccugaagaacgugagagaggugaaggggcucacuaaaggagggcccggccacgaggagcccauccccaugagcacauacggguggaaucugguacggcuacagagcgguguggacguauucuuuacgccgcccgagaagugcgauacgcucuugugcgacauuggagagucaucccccaaccccaccaucgaagccgggcgcacccugcgcguccucaaccugguggagaacugguuaaauaacaauacccaguucugcgugaaaguacucaacccguacaugcccucgguaaucgagaagauggagacccugcagcgcaaguacggcggugcacucgugcggaauccccucucccgcaacucaacgcacgagauguacugggucuccaacgccaccggcaacaucgugagcucagugaacaugaucagcaggaugcucaucaaccgguucaccaugaagcacaagaaggccaccuacgagccggacgucgaccugggguccggcacgcgcaacaucggaaucgagaaugagauucccaaccuggacaucaucgggaagcggaucgagaagaucaagcaggagcaugaaaccagcuggcacuacgaccaggaccaucccuacaagacuugggcauaccacggcuccuacgagacaaagcagacggggagcgccagcagcauggugaacggcguggucaaauuguuaaccaagcccugggauguggugccgauggucacccagauggccaugaccgacacgaccccuuucggccaacagcgcguguucaaggaaaagguggacacccguacccaggaacccaaggaggggacgaagaagcugaugcgcaucacugccgagugguuauggaaagagcugggcaagaagaagacgccccggaugugcacccgcgaggaguucacuaggaagguccgcuccaacgccgcgcugggggcgauauucaccgacgagaacaaauggaaguccgcucgggaggccguggaagacagucgcuucugggagcucgucgacagggagcgcaaccugcaucuggagggcaagugugagacaugcguauacaacaugauggggaagcgggagaagaaacucggcgaguucggcaaggcuaaggggagccgcgcgaucugguacauguggcugggcgcccgguucuuggaauuugaagccuuaggguuucugaacgaggaucacugguucucucgcgguaacagccugagcggggucgagggcgagggccuccacaagcugggguacauucugcgggaugugucaaagaaggaaggaggggccauguaugcggacgacaccgccgguugggacacgcgcaucacccucgaagacuuaaagaaugaggagauggugaccaaccacaugaagggggagcauaaaaagcuggccgaggccauauucaagcucacguaccaaaacaaggugguacguguacagcgcccgacgccucgcgguaccgugauggauaucauuagccggaaggaccagcgcggauccgggcaggucggcaccuacggguugaacacguucacgaauauggaggcccaguugauccggcagauggagggcgagggcaucuucaagagcauacagcgccuaaccgugacugaggaaaucgcuguucagaacuggcucgcacgagucgggcgcgagcggcuguccagaauggccauuucaggcgacgacugcgucgugaagccccucgacgaucgguuugcguccgcccugaccgcgcuuaacgacauggggaagguccgcaaggacauccagcagugggagccaagccggggcuggaacgacuggacccaggugccuuucugcucgcaccacuuccaugagcucgugaugaaggacgggcgcguccugguugugcccugccggaaccaggacgaguuaaucggccgcgcaaggaucagccagggcgccggauggucccucaaggagacagccugccugggcaagagcuacgcacagauguggacccuuauguauuuucaccgccgggaccuacgccuggcggccaacgccaucugcucggccguucccagccacugggugcccaccucccggaccaccuggagcauccacgccaagcaugaauggaugaccacugaggacaugcucgcgguguggaaccgggucuggauccaagagaacccuuggauggaggacaagaccccuguggagucuugggaggaggugcccuauuuagggaagcgcgaggaccaguggugcggaagccugaucgggcugacgagccgggccaccugggcaaagaacauccagaccgccauaaaucaggucagauccuuaaucgguaacgaggaguacacagacuauaugcccucuaugaagcgguuccgcaaggaggaagaagaggcuggcgugcugugguga

SEQ ID NO: 25124 - RNA, 9876 nt, Artificial Sequence
  derived and/or modified CDS sequence (opt11) from DENV-2__KF955372__SS-prME
acagcaggcgugaucaucauguugauccccacagccauggccuuccaucucaccacccgcaacggggagccccacaugaucguuggccgucaggagaaggggaagucccuacuguucaagaccgaggacggcgucaauaugugcacccucauggccaucgaccugggggagcugugcgaagacaccaucaccuacaaaugcccccuccugcggcagaaugagccagaggacauagacugcuggugcaacagcaccucgaccugggugaccuacgggaccugcaccaccacuggcgagcaccggcgagagaagcgguccgucgcacuggugccucauguggggaugggucucgagacccgcacagagacguggaugagcagcgagggggccuggaagcacguccagcggaucgagaccuggauacugcgccaccccggcuucaccaucauggcggcgauacuggcauauaccaucgguaccacgcacuuccagcgggcauugauuuucauccugcugacugccguugcgccuagcaugacuaugcgcugcaucggcaucuccaaccgggacuucguggagggggucagcggcggcaguuggguggacaucgugcucgagcacgggucuugcgucacaacuauggccaaaaacaagcccacacuagacuucgagcugaucaagacagaggccaaacagcccgccacccuccgcaaguacugcaucgaggccaagcugacgaacaccaccaccgagucccgaugcccgacgcagggcgagcccucguugaacgaagagcaggacaagcgcuucaucugcaaacacuccaugguugaccggggcugggggaacggcuguggccuuuucggcaagggcgguauugugaccugcgcgauguucacgugcaagaagaacauggagggcaagguuguacugccagagaacuuagaguacaccaucgugaucacgccccacagcggggaggaguacgccguuggcaacgacacggggaagcacgggaaggagaucaagauuaccccgcaguccagcauaaccgaggccgagcucacgggguacggaacugugaccauggagugcagcccccggacagggcuggacuucaacgagaugguucuucuccagauggaggacaaggccuggcugguccacagacagugguuccuggauuuaccucugccuuggcugccgggggccgacacccagggcagcaacuggauccaaaaggagacgcucgugaccuucaagaacccccacgccaaaaaacaagacguggucgugcugggcagucaagagggcgccaugcacaccgcgcugaccggggccacugaaauccagaugagcagcggcaaccucuuauucaccggccaccugaaaugucgccuccggauggacaaauugcagcugaaggggauguccuacagcaugugcaccggcaaauucaagaucgugaaagagaucgccgagacccagcacggcacgaucgugauacgcgugcaauacgagggggacggcucccccugcaagauccccuucgagaucauggaccucgagaagcggcacguccuggggcgccugaucaccgugaacccgaucgugacggagaaggacagcccggugaacguggaggcggagccuccguucggagacucauacaucaucaucgggguggagccgggccagcucaagcugaacugguucaagaaggggagcuccauaggccaaauguuugagaccaccaugcgcggagccaagcggauggccauccugggggacacugcgugggacuucggcucgcucggaggcgucuucacuaguauaggaaaggcccugcaccagguguuuggcgccaucuacggcgcugccuucagcgggguguccuggaccaugaagauccugaucggcgucaucaucacguggaucgggaugaacagcagauccaccagccuguccgugagccucguuuuggucggcguggugaccuuauaccuaggcgucauggugcaggccgauaguggcugcguagugagcuggaagaauaaggagcugaagugcggcuccgggaucuucaucacggacaacgugcacaccuggaccgagcaguacaaguuucaaccggagagccccagcaaguuggcguccgccauccagaaggcccacgaggagggcauauguggaauacggucagugacccggcucgagaaccugauguggaaacagaucacccccgagcugaaccacauucucuccgagaacgaagucaagcugacgaucaugacaggcgauaucaaggggaucaugcaggccgggaaaagaagccugcgcccgcagcccaccgagcucaaguacuccuggaagaccuggggcaaggcuaaaaugcugagcacggagucccauaaccagaccuuccugaucgacgggcccgagaccgcggaguguccgaacaccaaucgggccuggaauagccucgagguggaggacuacggcuucgggguguuuuccacgaacauauggcugaagcugcgcgagaagcaggacgucuuuugcgacagcaagcucauguccgcagcgaucaaagacaaccgggccgugcacgcggacaugggcuacuggaucgagagugcccugaaugacaccuggaagauggagaaagccaguuucaucgaggucaagagcugccauuggcccaagucccacacacuguggucuaacggggugcucgaguccgagaugaucaucccuaagaacuucgccgggcccgugagccagcacaauuaccgccccggcuaccacacccaaaccgcugggcccuggcaccuugggaagcuggagauggacuucgacuucugcgaagggacgaccguggucgugaccgaggacugcggcaaccggggcccaagccugaggaccacgacagcguccggcaagcugaucaccgaauggugcugccgguccugcacccugcccccgcuccgcuaccgaggcgaggacgggugcugguauggaauggagauccgcccccuaaaagagaaggaggagaacuuaguuaacucccucgucacggcggggcacggccaaaucgacaacuucagucugggcgugcuggggauggcccuguuccuugaggagaugcugcggacccgcgugggaaccaagcacgccauccuacuggucgcagugucuuucgugacacugaucacggggaacaugagcuucagggaccucggcagggugaugguuauggugggggccacgaugaccgacgacaucggcaugggcgucacuuaccuugcccugcucgccgccuucaaagugcgcccgacguucgcggccgggcugcuguuacggaagcugaccucgaaggaacugaugauggccacuaucggcauagcucuccugagccagucgaccauccccgagacgauccuggaacucacagacgcccuggcgcuggggaugaugguucucaagaucguccgcaacauggaaaaguaccagcuggccgugaccaucauggccaucagcugugugccgaacgccgucauccugcaaaacgcguggaaggucuccugcaccauccucgcggccguaagcgugagcccccugcugcucacgagcucccagcagaaggcugacuggaucccccuggcacugaccaucaagggcuugaaccccaccgcuauuuuccugacuacgcugagccgcaccuccaagaagcggagcuggccacuuaacgaggccguuauggccgucggcauggugucgauccuggccucuagccugcucaagaacgacauccccaugaccgggccccuuguugcuggagggcugcuaaccguuugcuacguccucacgggacgguccgcggaccuggagcucgagagagccgcagacgugaagugggaggaccaggccgaaaucuccggguccucacccauccuguccaucaccaucagcgaggauggcuccaugagcaucaagaacgaagaagaggagcaaaccuuaaccauccucauccggacuggccuacugguaaucuccggaguguucccggugagcaucccgauuacggccgcagccugguaccucugggaggucaaaaagcagcgcgcgggcgugcugugggacgugcccucuccaccgcccguagggaaggcugagcuggaggacggcgccuaccggaucaaacagcgcgggaucuucggcuauucccagaucggcgcggggguguacaaggaaggcaccuuccacaccauguggcacgugacccguggggcaguucucaugcaccgcggcaagcggauagaacccuccugggccgacgugaagaaggaucugaucagcuacgggggugguuggaagcuggagggggaauggaaggagggagaggaggugcaggugcucgcccuggagccgggcaaaaacccacgcgccgugcagacgaagcccggccuguuuaagaccaacaccgggacuauuggcgcggucucccucgacuucucgcccggcaccuccgggagccccaucgucgaucggaagggaaaggucguggggcuguacggcaacggcgucgucacccgcuccggggccuacgugagcgccaucgcacagacugagaaguccaucgaggacaacccagagaucgaggacgauaucuuucggaagaagcgccugaccauuauggaucuccaccccggcgcggggaagacgaagcgguaccugcccgccaucguucgcgaggccaucaagcggggucugcgcacccuuauccucgccccgacccgcguaguggccgcugaaauggaggaggcccugcgcgggcugccaauccgcuaccagacccccgccauccgggccgagcacacgggcagggagaucgucgaccucaugugccacgcgaccuucaccaugcgacugcuguccccuguccgcgugcccaacuauaaccucaucaucauggacgaggcgcacuucacagaucccgcuagcacagccgcgcggggcuacaucuccacgcgcgucgagaugggggaggccgcgggaaucuucaugacagccacgccgcccgggagccgggacccguucccccaauccaacgccccgauuauggacgaggagcgggagauucccgagcgcagcuggaacuccggucacgaaugggugaccgauuucaagggaaaaaccgugugguucgucccgagcaucaaggcuggcaacgacaucgccgccugccugaggaaaaacgguaagaaggugauccagcuguccagaaagaccuucgauagcgaguacgucaagaccagggccaaugacugggacuucgucgugacgaccgacaucuccgagaugggggccaacuuccgggccgaacgcgugaucgacccccggcgcugcaugaagccaguuauccucacggacggugaggagcgggugauacuggcggggcccaugccagugacccacucgagcgcggcccaacgccgcggccggaucggacgcaaccccaagaacgagaacgaccaguacaucuacaugggcgagccccuggagaacgacgaggacugcgcccacuggaaggaagccaagaugcuccuggacaacaucaacacgcccgagggcaucauuccgagcauguucgagccggagcgggaaaaggucgacgcgaucgauggggaguaccgccuccggggcgaagcacgcaagacguucgucgaccucaugcggcgcggggaccuuccgguguggcuggccuaccgggucgccgcggagggcaucaauuacgcagaccgccgguggugcuucgacgggaucaagaacaaccagauccucgaggagaacguggaggucgagauauggaccaaggagggcgagcgcaagaagcugaagccgcggugguuggaugcccgcaucuacucagacccuuuggcucugaaggaguucaaagaguucgcugcgggccgcaaguccuuaacccucaaccugauuacggagauggggcgacugcccaccuuuaugacccagaaggcccgggaugcgcucgacaaccuggccgugcugcacaccgccgaggugggcgggcgagcguacaaccacgcccucuccgaguuacccgagacccuggaaaccuugcuccugcucacucugcuggccaccgucacuggcggaaucuucuuguuucugaugagcgggaagggcaucgggaagaugacccucggcaugugcuguaucaucaccgccuccauccuccuaugguacgcccagauccagccgcauuggaucgcggccagcaucaucuuagaguucuuucucaucguucugcugauucccgagccagagaagcaacggaccccccaagacaaccagcucaccuacguaguuaucgccauccugacgguuguggccgccaccauggcgaacgagaugggguuccuagaaaagaccaagaaggaccucggccuggggagcaucacaacucaggaguccgagucaaacauucuugacaucgaccuccgccccgccuccgccuggacccuguacgccgucgccacaaccuucgugacgcccaugcugcggcacagcaucgagaacucuucgguuaacguaucccuaaccgcgauagcgaaccaggccaccgugcugaugggucugggccgcggguggccccucagcaagauggacaucggcgugccccugcuggcaauagggugcuacucgcaagucaaccccauuacccugacugcggcccuucuucucuugguggcccacuaugccauaauaggcccuggccugcaagcgaaggcgacccgggaggcccagaagcgggccgcggccgggaucaugaaaaaccccaccguggacgguaucaccguaaucgaccucgagcccaucccuuacgacccaaaguuugagaagcaacugggccaggugaugcugcuagugcugugcgucacccagguguuaaugaugaggacaaccugggcguugugcgaggcccugacccuggcuacaggccccaucagcacccucugggaggggaaccccggccgguucuggaauaccaccaucgccgugagcauggcuaacaucuucaggggcagcuaucuggcgggggccggccuccuauucuccaucaugaagaacacgaccaauacccgacgggggaccggcaacaucggcgagacgcugggggagaaguggaagucccggcugaacgcccucggcaagagugaauuucaaaucuacaagaaguccgggauccaggaggucgaccgcacucuagccaaggaggguaucaagcgcggggaaaccgaucaucacgcggugucgaggggcagcgccaagcugcggugguucguggagcgcaacauggucaccccggagggcaaggugguggacuuggggugcggcagaggcggcuggucauacuacuguggcggguugaagaacguccgcgaagugaagggacuaacaaagggcggacccgggcacgaggagccaauccccaugagcacguacggcuggaaccucgugcgucuacagagcgggguggauguguucuucaccccgcccgagaagugcgauacccugcuaugcgacauaggcgaguccagcccuaaucccacgaucgaggccggccgcacccugcgcguguuaaaccuugucgagaacuggcuaaauaauaacacacaguucugcaucaagguuuugaacccauacaugcccagugugaucgagaagauggagacccuccagcggaaguacgggggagcccuggugcggaacccccugucgcgcaauuccacucacgagauguacugggugaguaacgccacggggaacauaguauccagugucaacaugaucucccgcaugcugauaaaccgguucaccaugaagcacaagaaggcaaccuacgagccggacguggaccucggcagcgggacccgcaacaucgggaucgagaacgagauccccaaccuggacaucaucggcaagcggaucgagaaaaucaagcaggaacacgagacguccuggcauuacgaccaagaccaccccuauaagaccugggcauaucacgggagcuacgaaaccaagcagaccggguccgccagcuccauggugaacggggucguuagguuauuaacgaagcccugggacguggucccgaugguuacccagauggccaugacggacaccacgcccuucggccagcaacggguguucaaggaaaaggucgacacgcgcacccaggagccaaaggagggcaccaagaagcugaugcggaucacggccgagugguuauggaaggagcucgggaagaagaagacgccccggaugugcaccagagaggaguucaccaggaaggugcguucgaacgcggcccugggagccauuuucaccgacgagaacaaauggaaguccgcccgcgaggccgucgaggauucucgguucugggagcuuguggaccgcgagcggaaccuccaccuggaaggcaagugcgagaccugcguguacaacaugaugggcaagcgcgagaagaagcuaggggaguucggcaaagcgaagggcucacgagcgaucugguacaugugguugggggcacgguuucuggaguucgaggcccugggcuuccuaaacgaggaccacugguucagccgaggaaauagccucuccggcguggagggagagggccugcacaaguugggcuauauccuucgcgacgugucaaagaaggagggcggugcgauguacgcggacgauaccgcugggugggacacccggaucacgcuggaagaccugaagaacgaagaaaugguuacuaaccacaugaagggcgagcacaaaaaguuggccgaggcgaucuucaagcugaccuaucagaacaaagucgugcgcgugcagcgcccgacgccccgggggacggucauggacauaaucuccaggaaggaccagagaggcagcggccagguagggaccuacggccucaacaccuucaccaacauggaggcgcagcugaucagacagauggagggggaggggaucuuuaaguccauccaacggcugacgguuacagaggagaucgcuguccagaacuggcucgcucgcgugggccgggagcgucuuagccggauggccauauccggggacgacugcguggucaagccccuggacgaucgcuuugccagcgcgcuaaccgcccugaacgacaugggaaaggugcguaaggacauccaacaaugggagccaucucgcggguggaacgacuggacccaagugccauucuguagucaccacuuccacgagcugguuaugaaggauggucggguccucguugugcccugccgcaaccaggacgagcugaucgggcgggccaggaucucccaaggcgccgguuggagcuugaaggagacggccugcuuggggaaauccuacgcacaaauguggacccugauguacuuccaccgccgcgaccuucggcucgccgccaacgccaucugcuccgcagugcccucccacugggugcccaccagccgcaccaccuggagcauccacgcaaagcaugaauggaugaccaccgaggacaugcuggccguuuggaaccgcguguggauccaagagaacccguggauggaggacaagacucccguggagucuugggaggagguccccuaccugggcaagcgagaggaccaguggugcgggucucucaucggccugaccagucgcgccacgugggcuaaaaauauacagaccgcaaucaaccagguucggagucuaauagggaacgaggaguacaccgacuauaugcccuccaugaagcgcuuccggaaggaggaggaggaggccggcgugcucugguga

SEQ ID NO: 25125 - RNA, 9876 nt, Artificial Sequence
  derived and/or modified CDS sequence (opt11) from DENV-2__KF955373__SS-prME
accgccggcgugaucaucaugcugaucccaacugccauggcguuccaccucaccacgcgcaauggggaaccccauaugaucgugggccgacaggaaaaagggaagagucugcuguucaagaccgaggacggugugaacaugugcaccuugauggccauugacuugggggaacugugcgaggauaccauaaccuacaaauguccccuccugcgacagaacgagcccgaggauauugacugcuggugcaacagcaccucgaccuggguaaccuaugggacuuguaccaccacgggcgagcaucggcgugagaaacggucgguagcccucgugccccacguggggaugggccucgagacgcgcaccgagaccuggaugagcuccgagggggccuggaagcacguacagcggaucgaaaccuggauccugcgccacccgggcuucaccaucauggccgcgaucuuagccuauaccaucggcacuacgcauuuccagcgggcucucaucuucaucuuacugacggccguugcgcccucuaugaccaugcgcugcaucggaauauccaaccgggacuucguggagggcgucagcgggggauccuggguggacaucgugcucgagcauggguccugcgugaccacgauggccaagaacaagccuacccuggacuucgagcugaucaagacagaggccaaacagcccgccacccucagaaaauauugcauugaggcaaaacugacgaacacaaccaccgaguccaggugucccacgcagggcgagcccagccugaaugaggaacaagacaagagauuuaucuguaaacacuccaugguggaccggggcugggggaacggguguggacuguuuggcaagggcgggauagugaccugugcaauguuuacguguaagaagaauauggagggcaaggucguucugcccgaaaaccuggaguacaccauugugaucacgccucacagcggggaggagcacgccgucggcaaugacaccgggaagcacgguaaagagaucaaaauaacgccccaguccagcaucacagaggcggagcucaccgguuacggcacggugaccauggagugcucuccucguacuggcuuggacuucaaugagauggugcugcuccagauggaggacaaggcuuggcucguccaucggcaaugguuucucgaccucccccucccuuggcugccgggggccgacacccagggcucaaacuggauccagaaggagacgcucgugaccuucaaaaacccccaugcuaagaagcaggacguggucgugcucggcucccaggaaggugccaugcacaccgcccugaccggggccacggagauccagaugaguagcggcaaccuuuuguucaccggccaccugaaaugcagauugaggauggacaaacugcaacugaaggggauguccuacucaaugugcaccggcaaguucaagauagucaaggagaucgccgagacccagcacgggacgaucguaauccgcguacaauacgagggcgacggcuccccaugcaagauccccuucgagaucauggacuuagagaagcggcacguccuggggagacuaaucaccgugaacccgaucgugaccgaaaaggacagccccgucaacaucgaagcggaaccgccauucggcgacucauacaucauaauagggguugaaccgggucagcucaagcugaacugguucaagaaggggagcuccauaggccagauguucgagacuacgaugcgcggcgccaaacggauggccauccugggggacacggcuugggacuucggcagccuagggggcguguucacaucgaucgggaaagcccugcaccaagucuucggcgcgaucuacggcgcggccuucagcgggguguccuggacgaugaagauccugaucggcgucaucaucacguggaucggaaugaacucgcgguccaccagccuaucagucagccucgugcuagugggcgucgugacccuuuaucucggggucaugguccaggcggacuccggaugcgugguguccuggaagaacaaggaguuaaaaugcggcuccgggauauuuaucaccgacaacguccacacguggaccgagcaguacaaguuucaacccgagagcccuucaaagcuggcguccgcuauccagaaggcccacgaggagggcauaugcgggauccgguccguuacccgccucgagaaucucauguggaagcagaucacccccgaguugaaccauauacucuccgagaacgaggucaagcugacgaucaugaccggcgacauuaaggggaucaugcaggccgggaagcggucucugcgcccgcagcccaccgaguugaaguacuccuggaagaccuggggcaaagccaagaugcugucaacggagucccacaaccagaccuuccugauagacgggcccgaaaccgcggagugcccgaacaccaaccgggccuggaacagccucgaagucgaggacuauggcuucgguguguucuccacgaacaucuggcugaagcugcgggaaaaacaggauguuuucugcgacagcaagcucauguccgccgccauaaaggauaaccgggccguucacgcggauaugggcuacuggaucgagagcgcccugaacgauaccuggaagauggagaaggcguccuucauagaggucaagagcugccacuggcccaaaucucacacccuguggagcaauggcgugcuugaauccgagaugaucauccccaagaacuucgccggucccgugagccagcacaacuaccgcccgggcuaccacacucagacggccgggcccuggcaccugggaaaauuggagauggacuucgacuucugugaggggacuaccgucguggucaccgaggacugcgguaaucgcggacccucucuaaggacaacgaccgcgaguggaaaauugaucaccgaguggugcugccgguccugcacccuacccccacuucgauacagaggcgaagacgggugcugguacggcauggagauccgcccccugaaggagaaggaggagaaccuggugaacucccuggugaccgcggggcacggucaaaucgacaacuuuucucugggaguuuuagggauggccuuguuccuggaggagaugcugaggacccgagugggaacgaagcacgccauccuccugguggcugucucauucgugacccuaaucacggggaacaugagcuuccgggauuuggggcgcgucauggucauggugggggcgacaaugaccgacgauaucgggaugggagugaccuaucuggcccuguuagccgcuuucaagguccggccgacguucgcagccggucuguuacuccggaagcugaccuccaaggagcuuaugauggccaccaucgguaucgcccuccugagccaguccacuaucccugagacgauccuggagcucaccgacgcccuggcacuggggaugauggugcucaaaaucgugaggaacauggaaaaguaccaacuggccgucaccauuauggccaucagcugcgugccgaacgccgugauccugcagaacgcguggaaggucuccuguacaaucuuagcggccgugucugucagcccccugcugcucacgagcucccagcagaaagccgacuggaucccccuggcccugaccaucaagggucucaaccccacggcaaucuuccugaccacccucucacggaccaguaagaagcgcagcuggccgcucaacgaggccgugauggccguaggcaugguuuccauccucgccagcagccugcucaagaacgacauuccaaugaccggcccccugguggccggcgggcugcucaccguuuguuacguccugacgggccgcuccgcugaucuggaacuggagcgcgcugccgaugugaagugggaggaccaggccgagaucagcggguccagcccaauccugucaaucaccaucucggaagacggcucaaugagcaucaagaacgaggaagaggaacacacccugaccauccucauucggacuggccugcuggugaucuccggagucuuuccgcugagcauuccuaucaccgccgcggccugguaccuaugggaggugaagaagcagagagccggcgugcuuugggacgugcccagcccgccgcccguggggaaagccgagcucgaggacggcgccuaccgcaucaagcagcgcgggauauucggcuacagccagaucggugccgggguguacaaggagggaaccuuccacacaauguggcacgugacuagaggggccguguuaaugcaccgcggcaagcggaucgagccaucaugggcggacgucaagaaagaccugaucucguacgggggcggcuggaaacucgagggcgaguggaaggagggcgaagagguccagguucuggcccuggagcccgguaaaaacccccgcgcagugcagaccaagccuggccucuucaagaccaacacggggacuauaggcgcgguaucccuggauuucagcccuggcacguccgguagccccaucguggaccggaagggcaaaguggucggucuguacggcaacgggguggucacccgcucuggggccuacguuagcgccaucgcccagaccgagaaaagcaucgaggauaauccggaaauugaagacgacaucuuccggaagaaacgguugacuaucauggaccuacaccccggcgcggggaagacgaagcgguaccuacccgcuaucguacgcgaggccaucaagcggggccugcgcacccucauucuagccccgacacggguggucgcugcggaaauggaggaggcacuccgggggcuccccauucgcuaucagacccccgccauccgcgccgaacacacgggccgcgagaucguggaccugaugugucaugcuaccuuuacuaugcggcugcucuccccugugcgcguuccaaacuauaacuuaaucaucauggacgaagcucacuucaccgaccccgccuccaucgcagccagaggcuauaucuccacgcgcguggagaugggggaggccgccggcaucuucaugaccgccacgccgccugggagccgggauccuuucccccaguccaacgcccccaucauggaugaggaacgcgagauacccgagcggagcuggaacuccggccacgaguggguuaccgacuucaagggcaagacgguuugguucgugccuagcaucaaagccggcaacgacaucgcggccugccuacgcaaaaacgguaagaaagugauccaguugucgcggaagacuuucgacucugaguauguuaaaacccgcgcuaacgacugggacuucguggucaccacggauauuuccgagaugggugccaacuuccgggccgagagagucaucgacccgagacgcuguaugaaacccgugauccugaccgacggggaggagcgggugauccuggcgggccccaugccgguaacccauagcucugccgcccagcggcggggccggauuggucgcaacccgaagaacgaaaacgaccaauacaucuacaugggcgagccgcucgagaacgacgaggacugcgcucacuggaaagaggccaagaugcuucuagacaauaucaauacccccgaggggaucaucccuagcauguucgaacccgaacgggagaaaguggacgccaucgacggggaguaccgccuccguggcgaggcacgaaaaacguucguggaccugaugcggagaggggaucuacccguuuggcuggccuaccggguggccgccgagggcaucaacuacgcggaccgccgguggugcuucgaugggaucaagaacaaccagauacuugaggagaacguagagguagagaucuggacaaaggagggcgagaggaagaaacuuaagccgcgguggcuagacgcccgcaucuauuccgacccccuggcccugaaggaguucaaggaguucgccgcaggacggaagucccugacucugaaccugaucaccgagauggggcgauuacccacguucaugacccagaaggcucgcgacgcacuggacaaccuggccgugcuccacaccgcugagguaggcgggcgcgcguacaaccacgccuuauccgaacugcccgagacccucgagacucugcuguuacugacccugcucgccacagugaccggugguaucuuccuauuccuuaugagcgggaagggcaucggcaaaaugacgcucgguaugugcugcaucauaaccgccuccauucugcugugguacgcccagauucagccucacuggauagcggccagcaucauccucgaguuuuuccuaaucgugcugcucauccccgaacccgagaaacagcggacaccccaggacaaccaacuuacuuaugucgugauagccauacugaccguggucgccgcgacgauggcgaacgagaugggguucuuagagaagacaaagaaggaccugggccugggcagcauaaccacacaggaauccgagucgaacaucuuagauaucgaucucaggccugccuccgccuggacgcuguacgccguggccaccaccuucgugacccccaugcugaggcauagcaucgagaacagcucggucaacgucagccugacugcgaucgccaaucaggcgacugugcugauggggcuuggccgggguuggccccugagcaagauggauaucggcgucccgcugcucgccaucgggugcuacucccaagugaauccuauuacccugaccgcugcccugcuccugcugguggcccacuacgcaaucauaggacccggccuccaggccaaggcgacucgugaagcccagaagcgugccgcggccgggauuaugaagaaucccaccgucgacggcaucacggugauugaccuugagccaauuccguacgacccuaaguuugagaagcagcugggccaggugaugcuccuggugcuuugcgugacccaagugcucaugaugcgcacgaccugggcgcuaugugaggccuugacucucgcuaccggucccauaagcacacugugggagggcaaccccggcagauucuggaauaccaccaucgccgucuccauggccaacaucuuccgcgggagcuaccuagcgggggccggguugcuguuuuccaucaugaagaacaccacgaacacgagacgcgggaccggaaacaucggcgagacacugggggagaaguggaagucgaggcucaacgcccugggaaagucagaguuccaaaucuacaaaaaguccgggauccaggagguagaucgcacgcuggccaaggagggaauaaagcgaggggagaccgaucaccacgcgguguccaggggaagcgccaagcuccggugguucgucgagcgcaacauggucaccccggagggcaaggugguagaccuggggugcggucgcggcggaugguccuacuacuguggcgggcugaagaacguucgcgaggugaaggggcuuaccaagggcgggccugggcacgaggagccuauacccaugagcacauacggcuggaaccugguccgguugcagucuggaguggacguguucuucaccccgccugagaagugugauacccuccugugcgauaucggcgaauccagcccgaaccccaccaucgaggcuggccguacccugcgggugcucaaucugguggagaacuggcugaacaacaauacccaguucugcaucaaagugcucaacccguauaugcccuccgucaucgagaagauggaaacccugcagcgcaaguacgggggugcccugguucggaacccgcuaagccgcaacuccacccacgaaauguacugggugagcaacgccaccggaaacaucgucuccucggugaacaugaucagccgcaugcucaucaaccgguucacgaugaagcacaagaaggcuaccuacgaaccggacgucgaccugggcucaggcaccagaaacaucggcauugagaacgagaucccgaauuuggacaucaucgguaagcggauugagaaaauaaagcaggagcaugagaccuccuggcacuacgaccaggaccauccauacaagacgugggcguaccauggcucauacgagaccaagcaaaccggcuccgccagcucuauggucaacgggguggugaagcuccugaccaaacccugggacguggucccaauggucacgcagauggccaugaccgacaccaccccuuucggccagcagcgggucuucaaagagaaaguggacacacggacccaagagcccaaggaaggcacuaagaagcuaaugcggaucaccgccgaguggcucuggaaggagcugggcaagaaaaagacgccccguaugugcacccgcgaggaguuuacccguaaggucagaagcaaugccgcccugggcgccaucuucaccgacgaaaacaaguggaaguccgcccgggaggccguggaggacagcagguucugggaguugguggaccgggagcgcaaccugcaucuggaagggaagugcgagaccugcgucuacaauaugaugggcaagcgggagaagaaacucggggaguucgggaaagcgaagggcucccgcgcaaucugguauauguggcuuggggcgcgguuccuggaguucgaggcccucggcuuucugaacgaggaucacugguuuagccgcgggaacagcuuauccggaguagagggagagggccuccacaaacucggcuacauccugcgggacgugagcaagaaggaagguggagcgauguacgccgacgacaccgccgggugggacacccgcauuacacucgaggaucugaagaacgaggagauggucacgaaucauaugaagggcgagcacaaaaagcuggccgaggccauauucaagcucacuuaccagaacaaggugguacggguacagcgaccgaccccuagaggaaccgugauggacaucaucuccagaaaggaucagcgcggcaguggacagguggggacuuacggccugaacacauucacaaauauggaggcgcaguugauacggcagauggagggugaaggcauuuucaaguccauucagcgccucaccgucacggaggagaucgcugugcagaacuggcuggcccgggugggccgggagagacugagccgcauggccaucuccggcgacgacugugucgucaagccccucgacgaccguuucgcgagcgcgcucacagcucugaacgacaugggcaagguucgcaaggauauucagcagugggagccaagccggggcuggaaugacuggacccagguccccuucuguagccaccacuuccacgagcucgugaugaaagauggcagggugcuggucguaccuugccggaaucaggacgagcugaucggucgcgcccggaucagccagggcgccggcuggagccucaaggaaaccgccugccuggguaaguccuacgcgcagauguggacgcuaauguacuuccauaggcgggaccuccgccuggccgccaacgccauuuguagcgcugugcccucacacuggguccccacaagccggacgacauggucuauccacgcgaagcacgaauggaugacuacggaggacaugcuggccguguggaaccggguguggauccaagaaaacccguggauggaggacaagaccccaguagagagcugggaggaggugcccuaucucggcaagcgggaggaccaauggugcggcagccuaaucggccugaccucaagggcuaccugggccaagaacauccaaacggcgaucaaccagguucgcagccucaucgguaacgaggaguauacggacuacaugcccaguaugaaacgauuccgcaaagaggaggaggaggcuggcguccucugguga

SEQ ID NO: 25126 - RNA, 9876 nt, Artificial Sequence
  derived and/or modified CDS sequence (opt11) from DENV-2__GQ868600__SS-prME
accgcgggcaugaucaucaugcugauccccacgguuauggcuuuucacuuaaccacccgcaauggugaaccccacaugauagugagucggcaggaaaagggcaaaagccuccuguucaaaacaaaagacggaacuaauaugugcacccuaauggcaauggaccugggcgaguugugugaggacaccaucacguacaaaugucccuuucucaagcagaacgagcccgaggacaucgacugcugguguaauagcaccuccacgugggucaccuaugggaccugcaccacgacgggcgagcaccgacgcgagaagcgaucgguggcccuggucccccacguuggcauggggcuggagacacgaaccgaaacguggauguccagcgagggcgccuggaagcacgcccagcgcauagagaccuggauacuccggcaccccggcuucaccauaauggcagccauacucgcauacaccaucgguacgacccacuuccagcgcgugcucauauucauacuccugaccgccaucgcccccuccaugacaaugcggugcaucgggauaagcaaccgcgacuuugucgagggcguguccggcgggucauggguggacaucguccuggagcacggcucgugcgugaccaccauggccaagaacaagccaacccuagacuucgagcugaucaagaccgaggccaagcagccagccacccugcgcaaguacugcaucgaggcuaaacuuaccaacaccaccacggacagccgcugccccacacagggggagccaacccucaacgaggagcaagacaagagauucgugugcaagcacuccaugguggaccgcggcuggggaaacgggugcggccuguuuggaaagggcgggaucguaacgugcgcaauguucacgugcaagaaaaacauggaaggcaagaucguacaacccgagaaucuugaguacacagucgugaucacgccacacagcggcgaagagcacgcgguggguaacgacaccgguaagcacgggaaggaggucaaaaucaccccgcaguccagcaucacagaggccgaguuaaccggcuacggaaccguuaccauggaaugcucuccacggacaggccuggauuucaaugagaugguucuccugcagauggaggacaaggccuggcucguccaccgccagugguuccucgaccugccccugcccuggcucccgggggccgacacccagggaagcaacuggauccaaaaggaaacccuggugacuuucaagaacccccaugcuaagaagcaggaugugguggugcuagggucccaggagggggcgaugcacacagcccucaccggcgccacugagauccagaugagcucagggaaccuacuguuuaccggucaucucaagugccgguugcggauggacaaacugcagcucaagggcaugagcuacucgaugugcacggggaaguuuaagaucguaaaggagaucgccgagacccaacacgggaccauagugauccgugugcaguacgagggggacgggucccccugcaagauccccuucgaaauaauggaccuggaaaagaggcacguccugggcaggcucauaaccgugaauccgauagugacggaaaaggacuccccgguuaacauagaggccgaaccgcccuuuggggacagcuacauaauaaucgggguggaacccgggcagcugaagcuggacugguucaagaaggguagcuccaucggccaaauguuugaaacaacuaugcgcggcgccaaacgcauggcaauccucggcgacaccgccugggacuucgggagccugggcgggguguuuacuuccaucggcaaggcccugcaccaggucuucggagccaucuacggcgcggcguucagcggcgucuccuggaccaugaagaucuuaaucggggugaucaucacguggaucggcaugaacagucggucgaccagccuauccguuagccuggugcugguggggauugucaccuuguaucugggcgugauggugcaggcugacuccgggugcgucgugaguuggaaaaacaaggagcugaagugcggauccggaaucuuuguaaccgacaacguccauaccuggaccgagcaguacaaauuucaacccgagaguccgucuaagcucgcgagcgcgauccagaaggcacacgaggaggguaucugcggcaucagaucugugacgaggcuggaaaaccugauguggaagcagauaacauccgaacucaaccauauccugagcgagaacgagguaaagcugaccauuaugaccggggacaucaagggcauaaugcaagugggcaagcgcucccuccggccccagccaacugaguuacgcuacucuuggaagaccuggggaaaagcuaagaugcucuccaccgagcuccacaaccagacguuccucaucgacggcccagaaacggcugaaugccccaacaccaacagagcauggaacagcuuagagguggaagacuacggguuuggcguguuuacgacuaacaucuggcuccgcuugcgcgagaagcaggacgcguucugcgacuccaagcuaaugagcgcggccaucaaagacaaccgggccguucacgccgauaugggguacuggaucgagucggcgcucaacgacacauggaagaucgagaaggccagcuucaucgaaguaaaaaguugccacuggcccaagucgcacacgcuguggucaaacggcgugcuagagucagaaauggucauacccaagaacuuugccggccccguuucccagcauaacaaccggcccggguaccacacccagaccgcagguccguggcacuuagguaagcuggagauggacuuugacuucugcgagggcaccacgguggucgugacagaggacugcgggaaccgcggccccagccugagaacuacuacggcaagcggcaagcucaucacggaguggugcugccgcucaugcacuuuaccgccgcugcgguaccgcggcgaagacggcugcugguacgggauggagauccggccguugaaggagaaggaggagaaucugguaagcucccuagucaccgcggggcauggacagaucgacaauuucucauugggaauccugggcauggcucuguuccucgaagagaugcugcgcacgcgcgucgggaccaagcaugccauccuguugguggccgucucuuucgucacccugaucaccggcaacaugucuuuuagggaucuggggcgcgugaugguaauggugggugcgacgaugacagacgauaucgggaugggcguaaccuaccuugcccugcuggcagccuucaaaguccggcccaccuucgcggccggccucuugcugcgcaagcuaacguccaaggagcugaugaugaccaccaucggaaucgugcuguugagccaauccaguauccccgaaacaauccuggagcugacggacgcccucgcccugggcaugaugguuuugaagaugguccggaacauggagaaauaccagcucgcagugacgaucauggcaauucugugcgugcccaacgcggucauccugcagaacgcuuggaaggugagcugcaccauacucgcagucguguccguaagcccuuuguugcucacauccucgcagcagaaggccgacuggaucccuuuagcccugacaaucaaggggcucaacccgaccgcgaucuuccugaccacgcucagccgcacgucaaagaaacggucguggccccucaacgaagcgaucauggccgucggcauggucucgaucuuggccucgagccuccuuaaaaacgacauaccaaugaccggcccacugguggcgggcggacugcucaccgucugcuacgugcuuaccgggcguuccgcagaccuagaacuugaacgggccaccgacgugaagugggacgaccaggccgaaaucucggguucuagcccuauccuguccaucacaauaagugaggacgguucaaugagcaucaagaacgaggaggaagagcagacccugacgauccugauccgcacuggccugcuuguuaucagugggcucuuccccgugagcaucccgauaaccgccgcggcgugguaucugugggaggucaagaagcagagggccgggguucugugggauguaccgagcccgccgcccguuggcaaggccgagcuagaagauggggccuauagaaucaagcagaaaggcaucuuagguuacucucagaucggugcgggcguauauaaggagggaaccuuccacacgauguggcacgugacacggggcgccguauugaugcacaagggaaagagaaucgagcccuccugggccgacgucaagaaggaccucaucucauauggcgggggguggaagcuggagggcgaguggaaggagggugaggagguacaggugcuggcacucgagcccggcaagaacccccgggccgugcagacaaagcccggacuuuuccgcacuaacacgggcacuaucggggcgguaucccuggauuucagccccggaacgucuggcagcccaauagucgacaagaaagggaagguugucgggcucuacgggaacggggucgucacgcggagcggagccuacgugagugccaucgcccagaccgaaaaguccauugaggacaacccggagaucgaggacgacaucuuccgcaagcggcgccuaaccaucauggaucugcaccccggugccgguaagaccaaacgauaccugcccgcgaucguccgcgaggccaucaagcgggggcuccgcacacugauccuggcgcccacgcgcgucguugcagcggagauggaggaggcccuccggggccugccgaucagguaccagacgcccgccauccgggccgagcacacgggacgcgaaaucguggaucucaugugucacgcaacuuucaccaugcgacuacugagccccaucagggugccgaacuauaaccugaucaucauggacgaagcgcacuucaccgacccugccagcaucgccgccagaggcuacauuuccacccgcguggaaaugggagaagcggcggggaucuucaugaccgccacaccgcccggcagccgggacccauucccgcaauccaaugcccccaucauggacgaggagcgcgagauccccgagcgaaguuggaacagugggcacgaaugggugaccgacuucaagggcaagacggucugguucguccccagcaucaagaccgggaacgacaucgccgcuugucuccgcaaaaacggcaagcgggugauccaacugucccgcaagacauucgauagugaguacguuaagaccaggacgaacgacugggacuucguggugaccaccgacaucagugagaugggcgcgaacuucaaggccgagcgagucaucgacccgcggcgaugcaugaagccugugauccugaccgacggugaggaaagggugauucucgccggccccaugcccgucacgcacagcucggccgcucaacgccgcgggcggaucggacgcaacccucggaacgagaaugaccaguauaucuauaugggggagccgcuggagaacgacgaggauugcgcccacuggaaagaggccaagaugcuguuggacaauauaaacacgcccgaggguaucauccccagcauguuugaaccagagcgcgaaaaggucgacgccauagacggcgaguaccgguuacgcggugaggcucggaagaccuucguugaccugaugcgccguggggaccuccccguguggcuggcguauaagguggccgccgagggcauaaacuacgccgacaggcggugguguuuugacggcacacgcaauaaccagauccuggaggagaauguggagguugagaucuggacgaaggagggcgaacggaagaaacucaagcccagguggcuggaugcccgaaucuacuccgacccgcuggcgcucaaggaguucaaagaguucgccgcggggcgcaagucacugacucugaaccuaauuacagagaugggccggcugccaacauuuaugacgcagaaggcgcgcgacgcgcuggacaaccucgcggugcugcauacagccgaggccgguggcaaagcguauaaccacgcgcuguccgaacuccccgagacuuuggagacgcugcuccugcugacccuuuuggccacggucaccgggggcauauuucuguuccucauguccggcagagggauuggcaagaugacacugggaaugugcugcauuaucaccgcguccaucuuacucugguacgcacagauccaaccccauuggaucgccgcgaguaucauccuggaguuuuuucugaucgugcuccugauuccggagccagagaagcagaggacgccccaggacaaccaguuaaccuacguaaucaucgccauucucaccgugguggccgcaacgauggcgaacgagaugggcuuccuggagaaaacgaagaaggaccuggggcucggaaacaucgcgacucagcaacccgagagcaacauccuugacaucgaccugcggccagcauccgccuggacgcucuacgccguggcaaccacauuuaucaccccaaugcuucgccauagcaucgagaacucuagcgugaaugugucccugaccgccaucgcaaaucaggcgaccguacuuaugggccucgggaagggcuggccccugagcaagauggacauuggggucccgcuccuggccaucggcugcuauagucaggugaacccuaucacacuaacagccgcgcuccugcugcucguggcgcauuacgccaucaucgggccgggccuccaggccaaggcgacccgagaggcccagaagcgggcagcagccggaaucaugaagaaccccaccguggacgggaucacggugaucgaccuggacccaauccccuacgaucccaaguucgaaaagcaguugggccagguuauguuacugguucucugcgugacccaggugcugaugaugcgcaccaccugggcgcugugugaagcccucacgcuggcgaccggacccguuagcacccucugggagggaaacccaggucguuucuggaacaccacaaucgccgugagcauggccaacaucuuccgcggcagcuaccuagcuggcgccggguugcuguucuccauuaugaagaauaccaccucuacccggcgcggcacgggcaacaucggcgaaacgcucggggaaaaguggaagagcaggcuaaaugcccuagggaaguccgaguuccagaucuacaagaaguccggcauccaggagguggaccgcacccuugccaaggaagggaucaagcggggggagaccgaccaccacgccgucucgcgcggguccgcgaagcugcgcugguucgucgaacgcaaccucgugacgcccgaaggcaagguaguggacuuggguugcgggcggggcggguggagcuacuauugcggagggcugaaaaacguucgugaggucaagggccugacaaagggcggaccagggcaugaagagccuaucccuauguccacuuacggguggaaccucguacggcugcagagcgggguugacgucuucuuugugccgccugagaagugugacacucugcucugcgacaucggggagaguucccccaaucccacaguggaggcgggccgcacgcugcgggugcugaaccugguagagaacuggcuuaacaacaacacacaauucuguguuaaggugcucaacccguacaugcccagcgugauugagcguauggagacccugcagcgaaaguacggcggggcuuuggugcgcaacccccugucgaggaacagcacccacgagauguacugggucuccaaugccagcggcaacaucgugucuagcguaaauaugauaucccggaugcugaucaaccgcuuuacgaugcggcauaagaaggcgaccuacgagccggacguggaucucggguccggcacacgcaacaucgggauagaauccgagacccccaaccuagacauuauaggcaagcgcauugagaagauaaagcaggaacacgagacgagcuggcacuacgaccaggaccauccauacaagacaugggccuaccacggcucuuacgagaccaagcaaaccgggucggccuccagcauggugaauggcgugguccgccugcucacaaagccgugggacguagugccgauggucacccaaauggcuaugaccgauaccacccccuuugggcaacagcggguauuuaaggaaaagguggacaccaggacccaggagcccaaggagggcacaaaaaaguugaugaagaucacggccgaguggcuguggaaggagcucggcaagaaaaagacgccgaggaugugcaccagagaggaauuuaccaaaaaggucagauccaaugcagccuuaggggccaucuucacggaugagaauaaguggaaguccgcacgcgaagcaguggaggauucacgguuuugggagcuggucgacaaggagcgcaaccuccaccuugagggcaagugcgagacgugcguauauaacaugaugggcaagcgcgagaagaagcugggcgaguucggaaaggcgaagggcagccgggccaucugguacauguggcucggagcccguuuccuugaguucgaggcccucggcuuccugaacgaggaccauugguucagcagagagaacuccuugagcggcguggagggggagggccugcacaagcuaggguacauccuacgggaggucaguaagaaggaaggcggugccauguacgcggacgacaccgccgggugggauaccaggauuacgaucgaggaucugaagaacgaggaaaugauaaccaaucacauggccggagagcacaagaaacuggccgaggcgaucuuuaaacugaccuaccaaaacaaggucgugcgggugcagagaccgacuccccgcgggaccgugauggauauaaucagucggcgcgaccagagaggauccggccaggugggcaccuacggacugaacaccuucaccaauauggaggcccaacucauucggcagauggagggugaaggcaucuucaagagcauccagcaccugacggccuccgaggagauagcgguccaggacuggcugguacgggugggacgcgagaggcucagccgcauggccaucuccggagacgauugcgucguaaagccccuggacgauagauucgcacgcgcccugaccgcccucaacgacaugggcaagguacguaaggacauccagcaaugggagcccucacgcggcuggaaugacuggacccaagucccguucugcagucaccacuuccacgaacugaucaugaaggacggacggaccuuggugguuccaugccgcaaccaggacgaacugauaggucgugcccgcaucagucagggcgccggguggucccugcgggagaccgcgugccuggguaaaagcuacgcccagauguggagccucauguacuuccaucgccgggaccugcgccuggccgccaaugcaaucugcuccgcggucccuucccacugggugcccacgagccgaaccacauggagcauccacgccucccaugaguggaugaccacggaggacaugcucaccguguggaacaaggucuggauacuggagaacccauggauggaggacaagaccccaguggagagcugggaggagauccccuaucugggcaagcgggaggaucagugguguggguccuugaucggccugaccagccgcgccacgugggcgaagaauauccaaaccgccaucaaucaagugaggucacugaucgggaacgaggaguacacagacuacaugcccagcaugaaacgcuuccggcgcgaagaggaggaggcggguguccucugguga

SEQ ID NO: 25127 - RNA, 9876 nt, Artificial Sequence
  derived and/or modified CDS sequence (opt11) from DENV-2__KF955359__SS-prME
accgccggggugauuaucauguuaauccccaccgccauggcguuccaccuuaccacccgcaauggggaaccccacaugauugugggccggcaggaaaaggggaagucccugcuguuuaagaccgaggacggcgugaauaugugcacccucauggccaucgaucugggggagcugugcgaggacaccaucacuuacaagugcccccuccugcgacagaacgagccagaggacaucgacugcuggugcaacagcaccucaaccugggugaccuacgggaccugcacgacaacuggcgagcaccggcgugagaagcggagcgucgcccuggugccucacguuggaaugggccucgagacccgcaccgaaaccuggaugagcagcgagggggccuggaagcacguccagcggaucgagacguggauccugcgccacccgggcuucacuaccauggccgcgauccuggccuacaccaucgggacgacccacuuccagcgggcccucaucuuuauccugcugaccgcgguagcccccagcaugaccaugcgcugcaucggcauuucaaaccgggacuuuguggagggcgucagcgggggcuccuggguggacauagugcucgagcacgggagcugcguaacgacgauggccaagaacaagcccaccuuagacuucgagcucaucaagaccgaggccaagcagcccgccauccucagaaaguacuguaucgaggccaaacuuacgaacaccacgaccgaaucccgguguccgacucagggcgagcccagccugaacgaggaacaggacaagcgcuucaucugcaagcacuccaugguggaccggggcugggguaacggcugcggucuauucggaaagggcgggaucgugaccugcgcgauguucacgugcaagaagaacauggaaggcaaggucgugcuucccgagaaccuggaguacaccauugugaucacgccccacucaggggaggagcacgccgugggcaacgacaccgggaagcacgguaaggagaucaaaaucacgccgcaguccagcaucaccgaggccgagcucaccggguacggcacgguuaccauggagugcagcccccguaccggcuuagacuuuaacgagauggugcugcuccagauggaggacaaggccuggcugguccaucgucagugguuccucgaccucccccugcccugguuaccgggggccgacacccagggcagcaacuggauccagaaggagacgcuagugaccuucaagaacccccacgcgaaaaagcaggacguggucguccuggggagccaggagggugccaugcacaccgcccugaccggcgccacggagauccagaugagcucuggcaaucuccuguuuacugggcaccucaaaugccgccuacguauggacaagcugcagcuaaaggggauguccuacagcaugugcaccggcaaguuuaagaucguuaaggagaucgccgagacccagcacgggacgaucgugauccgcgugcaguacgagggcgacggcucccccugcaagauccccuucgagaucauggaccuugagaagcggcacguccuggggcgccugaucacggugaacccgaucgugaccgagaaggacagccccgucaacauugaagcggagccgcccuucggcgacuccuacauuauuaucgggguggagcccggccaguuaaagcugaacugguucaagaaggggagcucuaucggccagauguucgagaccacgaugcguggcgccaagcggauggccauccugggggacaccgccugggauuuuggcagccucgggggcguguucaccuccauagggaaggcccugcaccaggucuuuggcgccaucuacggugccgccuucuccgggguguccuggaccaugaagauccugauuggcgugaucaucacguggaucgggaugaacagccgcuccaccagccuguccgccagucucguccucguugguauagugaccuuauaccucggggucauggugcaggcggacaccggcugcguggucuccuggaagaauaaagagcugaaguguggcucugggaucuucaucacagacaacguacacaccuggacggagcaguacaaguuucagccagagucccccagcaaacuggccucugcaauucagaaggcacacgaagagggcaucugcggcauccgguccgugacccgccucgagaaucugauguggaagcagauuacccccgagcugaaccacauccucucagagaacgaagucaagcuaacaaucaugaccggagacauuaaggggaucaugcaggccggcaagcggucccuacggccgcagcccaccgagcucaaguacagcuggaagacguggggcaaggcgaagaugcuguccaccgagagccacaaccagaccuuccucaucgacgggccugagaccgccgagugcccgaacacgaaccgggccuggaacucccucgagguggaggacuacggcuucgggguguucagcaccaacaucuggcugaagcugcgcgagaaacaggacguuuucugugauucaaaauugaugagcgccgcuaucaaggacaaccgggcgguacacgccgauaugggcuacuggaucgagucugcccugaacgacaccuggaagauggagaaggccagcuucaucgagaucaaguccugccacuggcccaagagccacacacuuuggucuaacggagugcucgagucugagaugaucauccccaagaacuucgccgggcccguuucacaacacaacuaccggccgggcuaucacacccagacggcggggcccuggcaccugggcaagcuggagauggacuucgacuucugcgaggggaccaccgugguggucacggaagacugcggcaaccggggccccagccuccgcacaaccacggccagcgggaaguuaauuacggaauggugcugucgguccugcacgcuaccaccccuccgcuaccggggcgaggacgggugcugguauggcauggagauccgcccccugaaggagaaggaggagaaccuggugaacagccuggugaccgccgggcauggacagaucgacaacuucucccugggcguccuggggauggcccucuuccuggaagagaugcugcggacacgcgugggcaccaagcaugcgauccuccugguggccgucagcuuugucacgcugauaaccggcaauauguccuuccgggaccucggcagagugauggucauggugggcgccaccaugaccgaugacaucggcaugggcgugacguaccuggccuugcucgcugcguucaagguccgccccaccuuugccgccgggcugcuacuccgcaagcugaccagcaaggagcugaugauggccaccaucggcaucgcccuccugucccaaagcacgauccccgagacgauccuggagcucaccgacgcacuggcccugggcaugauggugcucaagaucguucgcaacauggagaaguaucagcuggccgucaccaucauggccaucuccugcgugccgaacgccgugauccugcagaacgcuuggaaggucagcugcacgauccucgccgccguguccgugagcccucugcugcuuaccuccagccagcagaaggccgacuggaucccccuggcucugaccaucaagggccucaaccccacagccaucuuccuaacgacccugucccgaaccagcaaaaagcgcagcuggccgcucaacgaggccgucauggccgugggcauggucagcauccuggcuaguagccuucucaagaacgacauccccaugaccgggccguuaguagcaggcgggcuguugacgguuugcuacguccugaccggccggucggccgaccucgagcucgagaaggccgccgacgugaagugggaggaccaggcggagauuagcggcagcucccccauccuaagcaucaccauaagugaggacggcagcauguccaucaagaacgaggaagaagaacacacccugacgauccucauacgcaccggccugcuggugaucagcggggucuucccgguguccaucccgaucaccgcagccgccugguaccugugggaggugaagaagcaacgggcuggcgugcugugggacgugcccagcccgccgcccguggggaaggcagagcuggaagacggcgcguaccgcaucaagcagcgggggauuuucggauacucucagaucggcgccggggucuacaaggagggcaccuuccacacuauguggcacgugacgcgcggggccgugcucaugcaccgggggaagcgcaucgagccgagcugggccgacgucaagaaggaccucaucaguuauggcggcggcuggaagcuggaaggggaguggaaggaaggcgaggagguccaggugcucgcucuggaacccgggaagaauccccgggcgguccagaccaaacccgggcuauucaagacuaacaccgggacgauuggcgccgugucgcucgacuucucccccggaacgagcgggagccccaucguggaucgcaagggcaaggucguggggcuguacggcaacggaguggucacccgaagcggggccuacgucuccgcaaucgcgcagaccgagaaguccauugaggacaaccccgagaucgaagacgacaucuuccgcaagaagcggcugacgaucauggaccuccaucccggcgccgggaaaaccaagcgauaccugcccgccaucgugcgggaggccaucaagaggggccugcggacgcugauccucgccccgacccgagucguggcggccgagauggaggaggcacugcgcggacuccccauucguuaccagacucccgcgauccgcgccgagcacaccggacgggagaucguggaccucaugugccacgcgacguucacgaugcgccugcugagccccguccggguaccgaauuacaacuuaaucaucauggaugaggcccacuucacggaccccgccuccaucgccgccaggggcuacaucagcacccggguggagaugggugaggcggccggcaucuucaugacggccacuccacccgggucccgcgacccguucccccaaagcaacgcccccaucauggacgaggagcgggagaucccggagcgcuccuggaacucaggccacgaguggguaacggacuucaaggggaagaccguuugguuugugccuuccauuaaggcgggcaaugacauugccgcuugccugcggaagaacgguaagaaggucauccaacugagcaggaagacauucgauucggaauacgugaagacccgggccaacgacugggauuucguggucacgaccgacaucagcgaaaugggcgccaacuuccgcgcggagcgggugaucgacccccgaaggugcaugaagcccgugauccucaccgauggcgaggagcgcgucauccuggccgggcccaugccggugacccacuccagcgccgcccagcgucgcggccgcaucgggcggaaccccaaaaacgagaacgaccaguacaucuauaugggcgagccccuggagaacgacgaggacugcgcccacuggaaagaagcgaagaugcuccuggauaacaucaacacgcccgagggcaucaucccgucaauguucgagcccgagcgcgagaagguggacgccaucgacggggaguaccggcugcgcggcgaggcccgaaagaccuucgucgaccuuaugagacgaggcgaccugcccguguggcuagccuaccgcguggccgcggagggcaucaacuacgccgaccgucgcuggugcuucgacgggaucaagaacaaccagauccuugaggagaacgucgagguggagaucuggaccaaggaaggcgagcggaagaaacuuaaaccgcgcuggcuggaugcacggaucuacagcgacccccucgcccugaaggaguucaaggaguucgcggccggcaggaagucucugacccucaaccugaucacggaaauggggcggcugccaaccuucaugacccaaaaggcgcgcgacgcccucgacaaccuggccguucuccauacggcggaggucggcgggcgggcauacaaccacgcccucagcgagcugcccgaaacgcuggagacccuccuguuacugacucugcuggccaccgugacaggcggcaucuuccucuuucugaugucagggaagggcaucggaaagaugacccugggcaugugcugcaucauaaccgccagcauucucuugugguacgcgcagauccaaccgcacuggaucgccgccagcaucaucuuagaguucuuccuaaucguccugcugauccccgaacccgaaaagcagcgcacgccccaggacaaccaguugacguacguagugaucgccauccucacggucguggccgccaccauggccaacgagaugggcuuccuggagaagaccaagaaagaucucggccugggcaguaucaccacucaggagagcgagagcaacauauuggacaucgaucuccggccugccagcgccuggaccuuauacgccguggcgaccaccuucgucacacccaugcugcgccacuccaucgagaacagcuccgugaacgugagccugaccgccaucgccaaccaggcaaccguccugaugggucuuggccgcggguggccccucuccaagauggacauuggcgugccccugcuggcgauuggguguuauucacaggugaacccgaucacccucacggccgcccuacugcuccuugucgcacacuaugccaucaucggccccggccugcaggcgaaggccacccgcgaggcccagaagcgcaccgccgccgggaucaugaagaacccaaccguggacggcaucacggugaucgaccuagagcccaucccguaugauccuaaguuugagaagcaguuagggcaggucaugcugcucguguuaugcgugacccaggugcugaugaugcggaccaccugggcgcucugcgaggcccugacgcuggccaccggccccauuucuacccucugggagggaaaucccggccgcuucuggaacacaacgaucgccgugagcauggccaacaucuuucggggcuccuaccuggcgggggccggccuucucuucagcaucaugaagaacaccacgaacacacgccgggggacgggaaacaucggggagacccugggggagaaguggaaaucccgccugaacgcccucggaaagagcgaguuccagaucuacaagaaauccggaauacaggagguggaccggacccuggccaaagagggcaucaagcgcggggagacagaucaccacgcggucagccggggcuccgccaagcugcgcugguucguugagcggaacauggugacgccggagggcaaggucguagaccucgggugcgggcgcgggggcuggagcuacuacugcgggggucugaagaacgugcgggaaguuaagggccucaccaagggcgggcccgggcacgaggagcccaucccaaugucuaccuacggcuggaaccucguucgccugcagagcggaguggacgucuucuucaccccgcccgagaagugcgacacgcugcucugcgacaucggcgaaaguucccccaaccccaccaucgaggccggccggacccugcgcgugcugaaccucguggagaacuggcugaacaacaacacccaguucugcgucaaggugcuuaacccguacaugccgagcgugauagagaagauggaaacccuccagcggaaguacgggggcgcccuaguccgcaacccacugucccggaacagcacgcacgagauguacugggugucaaacgccaccgggaauaucgugagcuccguaaacaugaucucuaggauguuaauaaaccgcuucaccaugaagcacaagaaggcgaccuacgagccggacguggaccucggcuccgggacgcggaacaucggcaucgaaaacgagauccccaaccuggacauuaucggcaagcgcaucgagaagaucaagcaggagcacgagaccagcuggcacuaugaccaagaccaccccuacaagaccugggccuaucacggguccuacgagaccaagcagacaggaagcgccuccagcauggugaacggggucgugaagcugcucacaaagccaugggacguggucccgauggugacccaaauggccaugaccgacacuacccccuuuggccagcagcggguguucaaggagaaggucgacacccgcacccaggagcccaaggagggcacgaagaagcugaugcggaucaccgcggaguggcuguggaaggaguuggggaagaagaagacgccacgcaugugcacccgggaggaguuuacgcgcaaggugcguuccaacgcggcgcugggcgccaucuucaccgacgagaacaaguggaagucagcucgcgaggccguggaggacagccgguucugggaacuggucgaccgcgagcguaaucuccaccuggaggggaagugcgagaccugcguguacaacaugauggggaagcgcgagaagaagcugggggaguuuggcaaggcgaagggcagccgggccaucugguacaugugguugggugcacgcuuccuggaguucgaggcccuggguuuccucaacgaagaccacugguuuucccgggggaacagucugagcggcgucgaaggggagggucuacauaagcucggcuacauccuucgcgacgucaguaagaaggaaggcggggcgauguacgccgaugauaccgcugggugggacacacggauaacccucgaagaccucaagaacgaggagauggucaccaaccacaugaagggcgagcacaagaagcuggccgaggccauauucaagcugaccuaccagaacaaggucguucgcgugcagcggccgacgccgcgcgggaccgucauggacauuauaagccgcaaggaccagagaggauccggccagguggguaccuacggccucaacaccuucacgaauauggaggcgcagcugauccgccagauggagggggagggcaucuucaaaucgauucagcggcugaccgugaccgaggagaucgcaguccagaacuggcucgcccgcguggggcgggagcgccugucccggauggccauuagcggugacgacuguguggucaagccccuggacgaccguuucgccucugcgcucaccgcgcugaacgauaugggcaaggugcggaaggacauccagcagugggagcccagcaggggauggaacgacuggacacaggugccguucuguagccaucacuuccacgagcugguuaugaaggacggccggaugcucguggugcccugccgcaaccaggacgagcucaucgggcgggcccgcaucagccagggggccggcuggucccugaaggaaaccgccugccucggaaagaguuacgcgcagauguggacccugauguauuuccaccggcgcgaucugcggcucgccgcgaacgccauuugcuccgccgucccuagccacugggugccuaccucucgcaccacguggagcauccacgcgaagcacgaguggaugaccaccgaggacaugcuggccguguggaaccgggucuggauccaggagaacccguggauggaggacaaaacccccguggaguccugggaggaggugcccuaccuuggcaagcgcgaggaccaguggugugggucgcucauuggccucaccagccgcgccaccugggccaagaacauccaaaccgcgaucaaccaaguccggagccugaucgggaacgaggaguauaccgacuauaugccgagcaugaagcgcuucagaaaggaagaggaggaggccggcgugcugugguag

SEQ ID NO: 25128 - RNA, 9876 nt, Artificial Sequence
  derived and/or modified CDS sequence (opt11) from DENV-2__KF955360__SS-prME
acagccggcgugaucaucaugcuuaucccgacagccauggcguuccauuugacuacccgcaacggggaaccccacaugaucgucggccggcaggagaaggggaagucccugcuuuucaagaccgaggacggcgugaacaugugcacccucauggccaucgaccugggggaacugugcgaggacaccauuacguacaagugcccccuacuucggcaaaaugagcccgaggauauugacugcuggugcaacuccaccagcaccugggugacauacggaaccugugccaccaccggcgagcacagaagggagaagagauccguagcauuggugccccacgugggcaugggacucgagacccggaccgagacguggaugagcagcgagggggccuggaagcacguucagcggauugaaaccuggauacugcgccacccgggauuuaccaucauggcggccauccuggccuacaccaucgggaccacccauuuccagcgggcacuaauuuucauccugcugacagcgguggcccccagcaugaccaugcgcugcauuggcaucuccaaccgggacuuuguggagggugucucugggggcaguuggguggacauaguucucgagcacgggucaugcgucaccaccauggccaaaaauaagcccacguuggacuucgagcugaucaaaaccgaagcaaagcagccugccacucuccggaaguacugcaucgaggcgaagcugaccaauacgaccaccgagucccggugcccgacccagggcgagccaucgcugaacgaggagcaggacaaacgcuucauuugcaagcauuccauggucgaccggggguggggcaauggcugcgggcuguucggaaagggugggaucguaacuugugcuauguucacaugcaaaaagaauauggagggaaaggucgugcugcccgagaaccuggaguacaccaucgugaucacgccccacaguggggaggagcacgccgugggcaacgacacggguaagcacggcaaggagauaaagaucacgccgcaguccagcaucaccgaggccgaguuaaccggauacgggaccgugacgauggaaugcagcccccguacgggccuggacuucaacgagauggucuugcuccaaauggaggacaaggccugguugguucaucggcagugguuucuggaccucccccugcccugguugcccggugcggacacacagggcagcaacuggauccagaaggagacucucgugacauucaagaacccccaugccaagaaacaggacguugucguccuggggucccaggagggggccaugcacaccgcucugaccggagccaccgagauccagaugucaaguggcaaucuccuguucacgggccaccugaaaugucgccuccggauggauaaauugcaguuaaaggggauguccuacagcauguguaccgguaaguucaagaucguuaaggagauagcggagacccaacaugggaccaucgucauacgggugcaauacgagggcgacggcucccccuguaagauccccuucgagauuauggacuuggaaaagcgucacguauuaggacgccugaucacggugaacccgaucguuaccgagaaggacucuccagugaacaucgaggcggagccacccuucggcgacuccuacauaaucaucgggguagagccgggacaguuaaagcuuaacugguucaagaaagggucauccaucggccagauguucgagaccacgaugcgcggcgccaagcggauggccaucuuaggggacacggccugggacuucgggagccucgguggcguguucacguccaucgggaaggcgcuccaucaagucuuuggcgccauuuacggcgcggcguucagcgggguuuccuggacgaugaaaauucugaucggcguuaucaucaccuggaucgggaugaacagccgcaguacuagcuugucugucagccucgugcuggugggcgucgugacccuguaccugggugugaugguucaagcggacuccggauguguggugucuuggaaaaauaaggagcugaaguguggcuccggcauauucaucaccgacaacgugcacaccuggacugagcaguacaaguuccagccagaaagcccgagcaaacuugccuccgccauccagaaagcacacgaagagggcaucugcggaauccggucugugacccgcuuagagaaucucauguggaaacagaucaccccugagcugaaucauauccucucugagaacgaggugaagcuaacgauaaugacgggggacaucaaggggaucaugcaggcuggcaagcggucgcugcgcccgcagcccacggaguuaaaguacucguggaagaccuggggcaaggcuaaaaugcugagcaccgagucccauaaccaaacauuccugaucgacgggcccgagaccgcagagugcccgaacaccaaucgggccuggaacagccuugaagucgaggauuacggcuucgguguauucaguaccaacauauggcucaagcuucgcgagaagcaagacguuuucugcgacaguaagcucaugagugccgccauuaaggacaaccgugcuguccacgccgacauggguuacuggauagaaagcgcucuuaaugacacguggaagauggagaaggcauccuucaucgagaucaagaguugucacuggcccaagagccacacgcuguggucuaaugguguccucgaauccgagaugauuauccccaaaaacuucgcaggccccguaucacagcacaacuaccggcccgguuaccacacccagaccgcggggcccuggcaccugggcaagcuggaaauggacuucgacuucugugagggcaccacugucguugugaccgaggacugcggcaaccgagggccgagccuccgcaccacuacugcuuccgggaaacucaucacugaauggugcugccggagcugcacccugcccccgcuccgguacaggggcgaggacggguguugguacggcauggagauaagaccccugaaggagaaggaggagaacuuggucaacucccucguuaccgccgggcacgggcagaucgacaacuucagcuugggcgugcuggggauggcccucuuucuggaagaaaugcugcggacucgcgucggcaccaaacacgccauccugcugguggccgugucuuuugucacgcugaucaccgggaacaugucuuuccgggaucucggccgcgugaugguaaugguaggugccacgaugacugacgacaucgggaugggcgugacauaccuggccuugcuggcggcguucaaggugagacccaccuucgcugccgggcugcugcucaggaaguuaacguccaaggagcugaugauggccacaaucggcaucgcccuccugagccaguccaccauacccgaaaccauccuggaacucacagaugcgcuggcccuugguaugaugguccuaaagaucguuagaaauauggagaaauaccagcuggcuguaaccaucauggcgauaagcugcgucccaaacgccgugaucuuacagaaugcguggaagguguccugcacgauccucgccgccgucucagugucuccccuucuucucaccagcucgcagcagaaggcggacuggaucccucuugcgcugacuaucaaaggccucaaccccaccgcuaucuuccugaccacccuaagcagaacgucuaagaagcgcagcuggccacucaaugaagccguaauggccguuggaaugguauccauucuggcgucaagccuucucaagaacgacauacccaugacagggccccuggucgcgggagggcugcuuaccgugugcuacgugcucaccggucgguccgccgaccuggaacuagaaagggccgcugacgucaagugggaggaccaggccgagaucucagguuccucgccuauucuguccauaacgauaagcgaggacggcuccaugagcaucaagaacgaggaggaggagcacacccuaacuauccucauccggaccggccugcugguaauuucugggguuuucccggucagcauucccauuacugcggccgccugguaccuuugggaggugaaaaagcagcgcgcuggcguucugugggauguccccagcccuccgcccguugguaaggcugaguuggaggacggggcauacaggauuaagcagcgcggcaucuucggguacagccaaaucggcgccgggguguacaaggagggcacuuuccacaccauguggcaugugacgcgcggggccgugcuuaugcaucgcggcaagagaaucgagcccuccugggccgacgugaagaaggaucugaucagcuacggugggggauggaagcuagagggggaauggaaagagggcgaggagguccagguucucgcucuggagccagggaagaacccucgcgcugugcagaccaagcccgguuuauucaagacgaacacggggacgaucggcgcuguuagucucgacuucucucccgggacgagcgggagccccaucguggaccguaagggcaaaguggucgggcuguacggcaacggaguggugacgcgcuccggcgccuaugucagcgccaucgcucaaaccgagaagucaaucgaagauaaccccgagaucgaggaugacauauuucggaagaagaggcugaccauuauggaccuccauccaggcgccggcaagacaaagcgguaccugccugcaauuguccgcgaggccaucaagcguggccuacgcacacucauuuuggcccccacacgcgugguagcggccgagauggaggaggcacugcggggucuucccauaagguaccagaccccggccaucagagcggagcacaccggcagggagaucguugaccugaugugccacgcaaccuuuaccaugcggcugcugaguccaguacgcguuccgaacuacaaccucauuauaauggacgaggcgcauuucacggaccccgccucgaucgcugcccgcggguacaucuccacacgcguggagaugggcgaggcagccggcauuuucaugacggccacgccgcccggguccagggaucccuuuccccaguccaacgcccccaucauggacgaggagcgcgagauccccgagcguuccuggaauuccggccacgagugggugaccgacuucaaggggaagacggucugguucgugcccagcaucaaggcuggcaacgacauagccgcuugucugcgcaagaacggcaagaaggugauccagcuguccaggaagacguucgacucugaguacguaaagacccgcgccaaugacugggacuucguggugaccaccgacaucagugagaugggugccaacuuccgggcggagcgugucaucgacccccggcgcugcaugaagcccgucauccugacugauggcgaagagcgcguaauccuagccgggccuaugcccgucacccacaguucggcggcccaacgccgcggccggaucggccgcaaccccaaaaacgaaaaugaccaguacauuuacaugggcgagccccuggaaaacgaugaggauugugcccacuggaaagaggcaaagaugcuccuggauaacauuaacacccccgaaggcaucaucccguccauguucgagcccgagagggagaaaguagacgccauugacggcgaguaccgccuacguggagaggcccgaaagaccuucgucgaccuaaugcggcgcggggaccucccuguuuggcuggccuaucggguggcugcggaagguaucaauuaugccgaccgacgguggugcuuugacgggaucaagaacaaccaaauccucgaggagaacguggaaguugaaauuuggacgaaggagggggagcgcaagaagcugaagccgcgguggcuggacgcccgcaucuacuccgacccucuagcccugaaagaauucaaggaauucgcggccggaaggaagucccugacgcucaacuuaauaaccgagaugggcagacugcccacuuucaugacgcagaaggcccgagacgcccuggacaaccuggcgguguugcacaccgcggaaguuggcgggcgagcauacaaccaugcccucuccgagcugcccgagacgcuggagacccugcugcugcucacucuguuagccacggugacgggcggcaucuuucuauuccuuaugucggggaagggcaucgggaagaugaccuuaggcauguguuguauaaucacagcuucaauacuucugugguacgcgcaaauccagccgcacuggaucgccgcuaguaucauccuggaauucuuccucaucgugcuccugauacccgagccggagaagcagagaacgccgcaggacaaccagcugacguacgucgugaucgccauuuuaacuguggucgcggcgaccauggccaacgagaugggauuccuggagaagacaaagaaagaucucgggcugggcagcaucacgacccaagaguccgagucgaacauccuggacaucgaccuccgcccugcgucggccuggacccuguacgcuguggcgacgaccuucgugacccccaugcugcggcacaguauagaaaacuccucggugaacgucucccucaccgcuaucgccaaccaggcgacgguguuaaugggguugggucgcggguggccccucagcaagauggauaucggagucccccugcuggcgaucgguugcuacucccagguuaacccgaucaccuugaccgccgcccugcugcucuugguggcccacuacgccauaaucggacccggacuacaagcgaaggccacccgcgaggcacaaaagcggacggccgcugggaucaugaagaaccccaccguugacggcaucacgguaaucgaccucgagcccaucccguacgaucccaaguuugagaagcagcuaggccaagugaugcuuuuaguccugugcgugacccaggugcugaugaugcgcacgaccugggcgcuuugcgaggcccugacccuggccaccggccccaucuccacgcucugggaggggaaucccgggcgguucuggaacaccaccauugcagucuccauggcgaacauauuccgcggcucauaucuggcgggugcuggccuccucuuuucaauuaugaagaauaccacuaacacccgucgcgggaccgguaacaucggcgagacucugggcgagaaguggaaaucccgucugaacgcccuggggaaguccgaguuucagauauacaagaagagugggauucaagagguggaccgcacgcuggccaaggaggggauaaaacgcggggagaccgaucaccaugcggugucccgcggcagcgcaaaguugcggugguucgucgagcgcaacauggugacucccgaaggcaaggugguggaccuggggugcggccgcggcggguggucauauuacugcggcgggcugaagaacgugcgagagguuaagggucugaccaaaggcgggcccgggcacgaagagccgauccccauguccacuuacggcuggaaccucguacggcugcaaagcgggguggacguguucuucacuccgcccgaaaaaugugauacucugcucugugacaucggggaguccucccccaaccccaccaucgaggccggaagaacacugcggguccugaacuugguugagaacuggcugaacaauaacacccaguuuugcaucaaggugcuaaacccguacaugcccuccgucauagagaagauggaaacccuccagcgaaaauaugggggcgcccucgugaggaacccccugagccgcaacuccacccacgagauguacugggucagcaacgccacugggaacauagucucauccgugaacaugauaucccgcaugcugaucaaucgguucacgaugaagcauaagaaggcgacguacgagccggauguggaccucggcagcgggacgcgcaauauagggaucgagaacgagauccccaaccuggacaucauuggaaagcggaucgagaaaauaaagcaggagcaugaaaccuccuggcacuacgaucaggaccaccccuacaagacgugggccuaccacggcagcuacgagaccaagcagaccggcucagcuagcaguauggucaacggaguggugaagcuucucaccaaacccugggauguggugccuauggugacgcagauggccaugaccgacaccacccccuucggccagcagcgugucuucaaggagaaggucgacacgcggacccaggaacccaaggagggaaccaaaaaauugaugagaauaaccgccgaguggcuguggaaggagcucgggaagaagaagacaccccggaugugcacgcgcgaggaguucacccggaagguccgcagcaacgcggccuugggcgccaucuuuaccgacgagaacaaguggaagagugcucgggaggcugucgaggacagccgcuucugggagcuggucgaccgggaacgaaaccuccaucuggagggaaaaugugagacgugcguuuacaacaugaugggcaagagggagaagaaacugggugaguucggcaaggcaaaagguuccagagccauaugguacauguggcucggggcuagauucuuggaguucgaagcccuaggauucuuaaacgaagaccacugguucucgcgcggcaacagccuguccggcguggagggugagggacugcacaagcucggcuacauccugcgggacgugagcaagaaggagggcggggcgauguacgccgacgacacggccgggugggacacgcgcauuaccuuggaagaccucaagaacgaggagauggucacgaaccacaugaagggcgagcacaagaaguuagccgaggccaucuucaaacugaccuaccagaacaagguggugcgcguccagcgcccgacaccccgggguacagugauggauaucaucagcagaaaggaccagcgcggcagcggccaggugggcacuuacggccugaauacuuuuaccaacauggaggcgcaacugauacggcagauggagggggagggaaucuuuaagagcauccagcgacugaccgugacggaggaaauagccgugcaaaacuggcuugcccgggucggccgugagcgucuaagcagaauggccaucuccggggacgacugcguggugaagccuuuggacgaucgguucgccagcgcgcucacagcccugaacgauauggggaaaguccggaaagacauccagcaaugggagccaucccggggcuggaacgacuggacacaagucccguuuugcagccaucauuuccacgagcuagucaugaaggacggccguguguugguaguaccgugccggaaucaggaugaguuaaucgggcgcgcacgcaucucccagggugccggcuggagcuugaaggagacggccugccucggaaaguccuacgcgcagauguggacgcugauguacuuccaccgccgcgaucugagacucgccgcaaacgcgaucugcagcgcggugcccucucacuggguccccaccagccguaccaccugguccauucaugcgaagcacgaguggaugacaaccgaggacaugcuggccguguggaacagaguguggauccaggagaacccguggauggaggacaagacccccguagagagcugggaggaggugcccuaucugggcaagcgagaggaccaguggugugggagccucaucggccugacguccagagcuacaugggcuaagaauauccagacggcgaucaaccaagugcgcagucuaauagggaacgaggaguacaccgauuacaugcccuccaugaagcgguuucguaaggaggaggaagaagcaggcguccucugguga

SEQ ID NO: 25129 - RNA, 9876 nt, Artificial Sequence
  derived and/or modified CDS sequence (opt11) from DENV-2__KF955363__SS-prME
accgcuggcgugaucaucaugcugauccccaccgccauggcuuuccaccuaaccacccgcaacggggaaccccacaugaucgugggcagacaggagaaggggaagucacuacuuuucaagaccgaggauggcguaaacaugugcacccucauggccaucgaccugggggagcugugcgaggacaccauuaccuacaagugcccacuccugcgacagaacgagcccgaggacaucgauugcuggugcaacagcaccucuacaugggugaccuacgggaccugcaccacuacgggcgagcaccggcgcgagaagcggagugucgcuuuggugccgcacgucggaaugggucucgaaacccguaccgagacauggaugucuuccgagggagccuggaagcauguccagcggaucgagacauggauccugcggcacccgggcuucaccaucauggccgccauucuggccuacaccaucgggaccacgcacuuccagcgggcucucaucuucauccugcugaccgccguugcgccgagcaugaccaugcgcugcaucggcaucuccaaccgggacuucguggagggcguuagcgguggcuccuggguggacaucgugcucgaacacgggaguugcgucaccacaauggccaagaauaagccgacccuggacuucgagcugauaaagaccgaggccaaacagcccgcgacccuccgcaaauacuguaucgaagccaagcugacgaauaccaccacagagucccggugcccgacgcagggcgaacccagccugaacgaggagcaggauaagcguuuccucugcaagcacuccaugguggaccgcggcugggguaacgguugcgggcuguucggcaagggcgggauuguaaccugcgcgauguucacgugcaagaagaacauggaggggaaggucguucagcccgagaacuuagaguacaccaucgugaucacgccccacagcggggaggaacacgccgucgggaacgacaccgggaagcacgguaaggagaucaagauuaccccgcaguccagcaucaccgaggccgagcucacuggguacggcacgguuaccauggagugcagcccacggaccggccuggacuucaacgagauggugcugcuccagauggaggauaaggccuggcucguccaucggcaaugguuccuggaucucccccugccguggcugccgggggccgacacccaaggcucgaacuggauacagaaggagacgcucgugaccuucaagaacccccacgcgaagaagcaggacguggucgugcuaggaucccaggagggugccaugcacaccgcccuuacgggggcuacggaaauccaaaugucuuccggcaaucuccuguuuaccggacaccucaagugccgcuugcggauggacaagcugcagcugaaagguauguccuacuccaugugcaccggcaaguucaaaaucgucaaagagauugccgagacccagcacgggacgaucgugauccgcguacaguacgagggcgacggcuccccuugcaaaauccccuucgaaauuauggaccuagaaaagcggcacguccuggggcgccuuaucacagugaacccgauagugaccgaaaaggauagccccguuaacaucgaagcagagccgcccuucggcgacuccuauaucaucaucgggguggaaccgggccagcucaaacugaacugguucaagaagggaagcuccaucggacagauguucgagaccacuaugcgcggcgccaagcggauggccauuuuaggcgacaccgccugggacuucggcagccucgggggcguguuuaccagcauugggaaggccuuacaucagguuuucggcgcgaucuacggcgccgccuucagcgggguguccuggacaaugaagauccugaucggcgugaucauaacguggaucgggaugaacagcagauccaccagccuguccguuagccucgugcuggugggugucguuacccuguacuuaggggccauggugcaggcagacucuggcugcgucgugucauggaagaacaaggaguugaagugcggcuccgguaucuucauaaccgacaacgugcacacguggaccgagcaguacaaguuccaacccgagagccccagcaagcuggcguccgccauccagaaggcccacgaggagggcauuugcgggauacggucugucacccgccuugagaacuuaauguggaagcagguuaccccggagcuuaaucauaucuuaagcgagaacgaggugaagcugacgauaaugaccggggacaucaaggguauuaugcaggccggaaaacggagccugcgcccgcagccaacagagcuaaaguacuccuggaagacauggggcaaggcgaagaugcugagcacggagucccacaaucaaacuuuccugauugacgggcccgagaccgccgagugcccaaacaccaaccgggccuggaacagcuuggagguagaggacuacggcuucggggucuucacgacaaauauuugguuaaagcugcgcgagaagcaggacguguucugcgacaguaagcucaugagcgcugccauaaaggacaaccgggcgguccacgccgacauggguuacuggaucgaguccgcccugaacgauacuuggaagauggaaaaggccagcuucauugaggugaaguccugccacuggcccaagucucacacccuguggagcaacggcguucuggaguccgagaugaucauccccaaaaacuucgccgggccagucucccagcacaacuaccgcccugguuaccacacgcagacggccgggcccuggcacuugggcaaguuagagauggacuucgauuuuugcgaagggaccaccgucguggucaccgaggacugcggcaaccggggccccagccuccgcacgaccaccgccagcgggaagcugaucacagaguggugcugccgguccuguacgcugccuccgcucagguaccggggcgaagaugggugcugguacggcauggagaucaggccccuaaaggagaaggaggagaaccuggugaacagccucgugaccgccgggcacggacagaucgacaacuucucccugggcgugcugggcauggcccuauuucuggaagagaugcugcggacccgcgugggcaccaaacacgcgauucuccuuguggccgucucauucguaacgcugaucaccgggaacauguccuuccgggacuuaggccgcgugauggucauggugggcgcuaccaugaccgacgauaucgggaugggcgucacguauuuagcccuccucgccgcguucaagguccgccccaccuucgcugcugggcugcugcugcguaagcugacuagcaaggaacugaugauggccaccauaggcaucgcccuauugucccaaagcacgauccccgagacuauccuggaacucaccgacgcgcuggcucuggggaugauggugcucaagauagugaggaacauggagaaguaccagcuggcugucaccaucauggccaucaguugcgugccgaacgcggugaucuuacagaacgcuuggaaggucagcugcaccauccucgccgccgucuccgucagcccucugcugcucaccuccagccagcagaaggccgacuggaucccauuagcgcucaccauaaagggccucaaccccacggccauuuuccugacaacccugucccggaccagcaagaagcgguccuggccguuaaacgaagcaaucauggcagugggaaugguuuccauccuggcuuccagccuucucaagaacgacaucccgaugaccgggccccuagucgcgggcggucuguuaacggucugcuacgugcugaccggccggagcgccgaccuggagcucgaacgcgccgccgacgucaagugggaggaccaggcggagauauccggaagcucccccauccugagcaucaccaucuccgaagacggcagcaugucuauaaaaaacgaggaagaggagcagacccugaccauccucauacggaccggccuauuagugauaucggggguguucccgguuuccauccccauaaccgcggcugccugguaccucugggaggugaagaagcagcgagccgggguacugugggacguucccagcccgccgcccguggggaaagcagagcuggaggacggugcguaccggaucaagcagagggggaucuugggcuacucccagaucggcgcaggcguauauaaggagggcacuuuucacacuauguggcacgucacgaggggggccguccugaugcaccgcggcaagcggauagagcccagcugggccgacgugaagaaggaccugaucaguuaugggggcggguggaaacucgagggggaguggaaggaaggcgaggagguccaagugcuggcccuggagcccgggaagaauccucgcgcgguccagaccaagcccggccucuuuaagaccaauaccgguacgaucggcgccgucucauuagacuucucccccggcaccagcgggucccccaucguggaccggaagggcaagguggucgggcuuuauggcaacggcguagugacccgcagcggggccuacgucuccgccaucgcacaaaccgagaaguccauugaggauaacccugagaucgaggacgacauuuuccggaaaaagcgccucaccaucauggaccugcaccccggcgcugggaagacaaagcgguaccugcccgcaaucgugcgcgaggccaucaagcggggccugcgcacgcucaucuuggccccaacacguguggucgcggcagagauggaggaggcguuacggggucuccccauccgcuaccagacacccgccauccgagcggagcacaccggccgcgagaucguggaccugaugugccaugcgacguucaccaugcggcuacucucccccgugcgcguuccgaacuauaaccugauuaucauggacgaggcgcacuucacggaccccgcuuccaucgccgcacggggcuacauuaguacucgcguugagaugggggaggcggcaggcaucuucaugaccgccacgcccccaggcucccgggauccguuuccccagagcaacgccccgaucauggaugaagagagggagauucccgagcgguccuggaacucaggccacgaaugggugacggauuucaaggggaagaccgucugguucgucccguccaucaaggcgggcaacgacaucgcagccugccuccgcaaaaacggcaagaaggucauucaguuaagccggaagaccuucgacuccgaguacgucaagacacgcgcgaacgacugggacuucgugguuacgaccgacauuucagaaaugggcgccaauuuuaaggcggagcgggucaucgaccccagacgaugcaugaagcccgugauccugaccgacggcgaggagcgcgugauccuggccgggcccaugccggucacucacucgagcgccgcgcagcggcgcggccgcauugggcggaaccccaagaacgagaacgaccaguacauuuacaugggggagccccucgagaacgacgaggacugcgcccacuggaaggaggcgaagaugcugcuggacaacaucaacacccccgagggcaucauuccguccauguucgagcccgagagggagaagguggacgccaucgacggagaguaccggcuccgaggcgaggcccggaagaccuucgucgaccugaugcgccgcggggaccugcccgucuggcucgccuaucgaguggccgcggagggcaucaauuacgccgaccggcgcuggugcuucgauggcaucaagaacaaccagauuuuggaggagaacguggaggucgaaaucuggaccaaggagggcgaacggaaaaagcugaagccucgcuggcuagacgcccggaucuacucggacccccuggcucugaaggaguuuaaggaguucgcagccggccgcaagucccucacccuaaaccugauaacggagaugggucggcucccuaccuucaugacacagaaagcacgcgacgcccuggacaaccuggccguucuccacaccgccgaggccggcgggaaggccuacaaccacgcccugagcgaacugcccgagacgcuagagacccugcugcuccugacgcugcucgccacggucacgggcggaauauuucuguuccugaugagcgguaagggaaucgggaagaugacccugggcaugugcugcaucaucacagcaagcauccugcugugguaugcccagauccaaccgcauuggauagccgccaguaucauucucgaguucuuccugaucgugcuucucauccccgagccagagaagcagcggacgccucaggacaaccagcugaccuacguugucauugccauucugacgguggucgcggccaccauggccaacgagaugggguuccucgaaaagaccaagaaggaccuaggacugggcagcaucaccacucaagagagcgaguccaacauccucgacaucgaccugcgcccggccagcgccuggacccuguacgcggucgccaccaccuucgugacgcccaugcuucggcacuccaucgagaauucauccguuaaugucagucuuaccgccauugccaaccaggcgacugugcuaauggggcucggcaagggguggccgcuuuccaagauggacaucggcgugccgcugcucgccaucggaugcuacagccaggucaacccgauuacgcucacggcagcccugcuacugcugguggcacacuacgcaaucaucggccccggccuccaggcaaaagcaacucgcgaggcccagaagcgagccgccgccgggaucaugaagaaccccaccguggacggcaucacagucaucgaccuggagcccaucccguacgaccccaaguucgagaagcaguugggccaggugaugcuccugauccugugcgugacgcagguccucaugaugcgcaccaccugggcccugugcgaggcucugacccucgcgacgggccccaucucaacccucugggaggggaaccccgggcgguucuggaacaccaccaucgcggucagcauggccaacaucuuccggggcuccuaucuggcuggggccggcuuacuauucagcaucaugaaaaacacgacaaacacucgccggggcacgggcaacauaggcgagacgcugggggagaaguggaagucccgccucaacgcgcuuggcaagagcgaguuccagaucuacaagaagagugguauucaggagguggaccguacacuggccaaggagggcaucaagcgcggggagacagaccaccacgccgucagccggggcucugccaagcuacgcugguucguggagcggaacauggugaccccggagggaaagguuguggacuuggggugcggccgagggggcuggagcuacuacugcgggggccugaagaacgugcgggaggucaagggccucacgaagggcgggcccgggcacgaggagccuauacccaugucaaccuauggcuggaaccuagugcggcuacagagcgggguggacgucuucuucaccccgcccgagaaaugcgacacccuccuuugcgacaucggcgagagcagcccuaaucccacgaucgaagccggccggacccugcgcgugcucaaucugguggagaacugguugaacaacaacacccaguucugcauaaagguccucaacccguacaugcccagcgugaucgagaagauggaaacguuacagcggaaguaugggggcgcguuagugcgcaacccccuauccaggaacagcacacacgagauguacugggucuccaaugccacggggaacaucgugagcucagugaacaugaucagccgcaugcucauuaaccgguucaccaugaagcacaagaaggccaccuaugagccggauguugaccugggcuccgggacgcgcaacaucggcaucgaauccgagauacccaaucuugacaucaucggcaagcguaucgagaagaucaaacaagagcacgagacgucauggcauuacgaccaagaccaccccuacaaaaccugggccuaccacgggagcuacgagaccaagcagaccggcucagccagcuccauggugaauggggugguucggcuccugacgaagcccugggacguggugccuauggucacucagauggcgaugaccgacaccacgccauuuggccagcagcgcgucuucaaggagaagguggacacacgaacccaagagccaaaggaggggacgaagaagcugaugaagaucacggcugaguggcucuggaaggagcuaggcaagaagaagacgccccgcaugugcacccgggaagaguucacccgaaagguucgguccaaugccgcccugggcgccaucuuuacggacgagaacaaguggaaguccgcgcgcgaggccgucgaggacagccgguucugggagcucguggaccgcgagcgcaaccugcaccuggaggggaaaugcgagacgugcgucuacaacaugaugggcaaacgugagaagaaguugggggaguucgguaaggccaagggcucgcgggccaucugguacauguggcugggcgcgcguuuccuggaguucgaagcccucggauuccucaaugaagaccacugguuuucuagggggaauagccuguccggcguggagggggagggccuccaccgccugggguacauuuugcgugacgucuccaagaaggagggcggggcaauguaugccgacgacaccgccgggugggacacccgcauaacgcucgaggaccugaagaacgaggagauggugacgaaccacaugaagggcgagcacaagaagcuggcagaggcgaucuucaagcucacuuaccagaacaaggugguccgggugcagcgcccgacgccccgcgggacggugauggacauaaucucacgccgggaccagcgggggagcggccagguuggaacuuaugggcugaacaccuuuaccaacauggaggcccaguuaauccgccagauggaaggggagggaaucuucaaaaguauccaacacuugacugugaccgaggagaucgccguucagaauuggcuggccagaguaggccgcgaacggcugucgcgcauggugaucucuggggacgacugcguggucaagccccucgacgaccgguucgccagcgcccugaccgcccugaacgacaugggcaaggugcgcaaagacauacagcaaugggagcccucccggggguggaacgacuggacccaaguaccguucuguagccaccacuuccacgaacucgucaugaaggacggcagaguccuggugguccccugcaggaaccaggacgagcuuaucgggcgcgcccggaucucccagggcgcaggcuggagccucaaggagaccgcgugccuggggaaguccuacgcccaaauguggacccugauguacuuccaccggcgggaucuccgccucgccgcgaaugccaucugcagcgcggugccgucccacugggugcccacaucccggacaacaugguccauccacgccaagcaugaauggaugacgacagaggauaugcuggccguuuggaaccgcguuuggauccaggagaacccauggauggaggacaaaaccccgguggagucaugggaggagguccccuaccucggcaagagggaggaccaauggugcgggagccugauuggccugacaucccgcgccacgugggcgaagaacauccagaccgccauuaaccaagucagaucucucaucggcaacgaggaguacaccgacuauaugcccaguaugaagcgguuccgccgggaggaagaggaagcgggcgugcugugguga

SEQ ID NO: 25130 - RNA, 9876 nt, Artificial Sequence
  derived and/or modified CDS sequence (opt11) from DENV-2__EU726767__SS-prME
agcgcgggcaugaucaucaugcuuauccccaccgugauggccuuccaccucaccacccgcaacggggaaccccacaugaucgugucccggcaggagaagggcaagucgcugcuguucaagacugaggacgggguuaacaugugcacccucauggcgauggaccuaggcgaguuaugcgaggacacuaucaccuacaagugccccuugcuccgccaaaacgagcccgaggacaucgacugcuggugcaauuccacuagcaccuggguaaccuacgggacgugcgccaccaccggcgagcaccggcgcgagaagcgguccguggcccugguuccccacguaggcauggggcucgaaacccgcaccgagaccuggaugagcuccgagggcgcuuggaagcacgcccagcggaucgaaaccuggaucuuacgccacccgggguucaccauaauggcggcgauccuggccuacacuaucgggaccacccauuuccagcgggcgcucaucuucauacucuuaaccgccgucgcccccagcaugacgaugcgcuguauagggauauccaacagggacuuuguggagggcguuuccggcgguuccugggucgacaucgugcucgagcacggcagcugugugaccaccauggccaagaacaagccaacccuggacuucgagcugaucaagacagaggccaagcagccggccacccuccgcaaguacugcaucgaggcgaagcucaccaacaccacgaccgagucccggugccccacccagggggagccgagccuaaaggaggaacaggacaagcgcuucguuugcaagcacuccaugguggaccggggcuggggcaacggaugcggccucuucgggaaaggggguauagugaccugugccauguucacgugcaagaagaacauggagggcaagaucguccagcccgagaaccuggaguacaccaucguggucacgccccacuccggcgaggagcacgccgucgggaaugacaccggaaagcacgggaaagaaaucaagguuacgccgcaguccagcaucaccgaggccgagcugaccggcuacgggacuguaaccauggagugcagcccuagaacgggccuugacuucaacgagaugguccugcugcagauggagaacaaggcauggcucguacaucggcagugguucuuggaucuuccacuccccuggcugccgggcgcggacacacaggguagcaacuggauucagaaggagaccuuggugaccuucaagaacccccaugccaagaagcaggauguggugguccuuggcagccaggagggggccaugcauacggcccugacuggcgccaccgaaauucagauguccuccgggaaccuccucuuuaccggccaccugaagugccgccugcggauggacaaacuccaguugaagggcaugaguuacucuaugugcacagggaaauucaagguggugaaggaaaucgcagagacucagcacggcaccaucgugauccgcgugcaauacgagggcgacggcucccccugcaagauccccuucgaaaucauggaucuggagaagcgguaugugcucggccgccugaucaccgucaacccgaucgugacggaaaaggauagccccgugaacaucgaggcggagccuccauucggagacuccuacaucaucauaggugucgaaccggggcaguuaaagcucaacugguucaaaaaggggucguccaucgggcaaauguucgagaccaccaugcgcggugccaagcgaauggccauccugggagacacugcaugggacuucgggagccugggcggugucuucacguccauuggcaaggcgcuccaccagguguucggggccaucuacggcgccgccuucagcgguguauccuggaccaugaagauccugaucggggugaucaucacguggaucgggaugaacagccgcuccaccucccuguccgucagccugguccucguagguaucgugacacuguaccugggggucauggugcaggcggacuccgggugcguggucucuuggaagaauaaggagcucaagugcgggucgggcaucuucaucaccgacaacgugcacaccuggacggagcaguacaaauuccagccagagucccccagcaaguuagccuccgccauacagaaggcacaggaggaggggaucugcggcaucagaagcguuacccgccuggagaacuugauguggaagcagaucacuccagagcugaaccacauccuggccgagaacgaagucaagcucacuaucaugacaggggacgugaagggcaucaugcaggcgggcaaacggucccuucgaccgcagcccacggagcugaaguacagcuggaagacgugggggaaagccaaaaugcucuccaccgagagccacaaccagaccuucuugaucgacggccccgagacggccgagugcccgaacaccaaccgggccuggaauucccuggagguggaagauuacgguuucggcgucuuuacuaccaacauauggcucaagcugaaggagaagcaggacgccuucugcgacagcaagcuaauguccgcggccaucaaggacaaccgcgccgugcacgccgauaugggguacuggaucgagucugcccucaacgacacguggaagaucgaaaaggcguccuucaucgagguuaagaacugccacuggccuaagagccacaccuuaugguccaauggcgugcuggagagcgaaaugaucauccccaagaauuuagccggacccgugucccagcacaauuaucggccgggguaucacacccagaucgccgggcccuggcaccuggggaagcuggagauggauuucgacuucugcgaaggcaccacaguggucguaacggaagacugcgggaaccgaggccccagucuucggaccaccaccgccagcggcaaacugaucaccgagugguguugcagguccugcacccugccgccgcuccgguaccguggagaggacggcugcugguacggaauggagaucaggccccugaaggagaaggaagagaaccuggugaauagccucgucacagcgggccacggccagguugauaacuuuuccuuggguguccugggcauggcccucuuuuuggaggagaugcuccgcaccagggucggaacgaagcacgcuauacuccugguggcaguaagcuucaugaccuugaucaccggcaacauguccuucaaggaccucggucgcguuguggugauggugggcgccgcgaugaccgaugacauugguaugggcgugacguaccuggcccugcucgccgcuuucaaggucaggcccaccuucgccgcgggccugcugcuccgcaagcugaccaguaaggagcugaugaugaccacgauugggaucgcucuccugucccagucuaccauccccgagaccaucuuggagcucacugacgcgcuggcgcugggcaugaugguccucaagauggugagaaacauggagaaguaccagcuggccgugacaaucauggcgauccuaugcgucccgaaugccgugauacuccaaaacgccuggaaggucuccugcaccauauuagccgugguuagcguaagccccuugcuacugacaagcucccagcaaaagaccgacuggauuccccuggcccucacaaucaaggggcugaauccgacugccaucuuccuaaccacccucagccggacguccaagaagcgcagcuggccgcuuaacgaggccaucauggccguagggaugguaaguauacuggccagcucucugcuuaaaaacgacaucccgaugaccggcccucuugucgccggcgggcuccugaccgugugcuacgugcugaccgggcggagcgccgaccucgagcuggaacgcgccacggacgucaagugggaggaccaagcggagaucagcggauccagccccauucuuuccauaaccaucucagaggacgggucgaugagcaucaagaacgaggaggaggagcaaacccucaccauccugauccggacgggccuguuagugaucuccggcuuauucccggugagcaucccaaucaccgccgcggcuugguaccugugggaggucaagaagcagcgagcagggguucugugggaugugcccagcccgccacccaugggcaaagccgagcuugaggacggggccuaccguaucaaacagaagggcauccugggguacucucaaaucggcgcaggcgucuacaaagaagggaccuuccacaccauguggcacgugacccguggggccgugcucaugcauaagggcaaacggaucgagcccuccugggccgacgucaagaaggaccugaucagcuacggcgguggcuggaagcuggagggagaguggaaggaaggugaggagguccaggugcucgcccuggagcccggcaagaacccccgcgcaguccagacgaagcccggucuguucaaaaccaacgcgggcacgauaggugccgugucgcucgacuuuagccccgguacaagcggcagccccaucaucgacaagaaggggaaaguggucggucuguacgggaacgguguagugacacgcuccggggccuacgucagcgccaucgcccagaccgagaagucaaucgaggacaaccccgagaucgaagacgacaucuuccgcaagcggcgucugaccaucauggaccugcaucccggggccggcaaaaccaagcgguaccuccccgccauaguccgcgaggccaucaagcgcgggcugagaacgcugauacucgccccuacacggguggucgcugccgagauggaggaagcgcuccgcggccugcccauccguuaucagaccccggccauccgcgccgaacauacaggccgcgagauuguggaucucaugugccacgcgacguucaccaugcgguugcugaguccagugaggguuccgaacuacaaccuuauaaucauggacgaggcccacuucacugaucccgccagcaucgccgcgcggggcuauaucucuacccgaguugagaugggcgaggcggcgggaauuuucaugacagccacgccgcccgguagccgggacccguucccucaguccaacgcccccaucaucgacgaggagcgcgagauucccgagcggagcuggaauucggggcacgagugggugacagacuuuaagggcaagaccgucugguucguuccgagcaucaaggcugggaacgacauugcugccugccugcgcaagaacggcaagaaggugauucagcugucccggaagacguucgacagcgaguacgucaagacccggacgaacgacugggacuuuguggugacaaccgacaucuccgaaaugggggcaaacuucaaggccgagcggguaauagacccccgccggugcaugaaaccagugauccucaccgacggugaagagcgcguuauccuggcgggccccaugccggucacccacagcuccgccgcccagcggcgcggaaggaucgggcgcaaccccaagaacgaaaacgaccaguacaucuacaugggggagccccuagagaaugacgaggacugcgcccacuggaaggaagccaagaugcucuuggacaacaucaacacccccgagggcaucauuccgucgauguucgagcccgaacgggagaagguggaugcuaucgacggcgaguaccgccugcgcggggaggcacggaagacauuuguggaccucaugcgccgaggcgaccugcccguuuggcucgcauacaagguggccgccgaggggaucaacuacgcggaccgacgguggugcuucgacggcaucaagaauaaucaaauccucgaggagaacguggagguagagaucuggaccaaggagggggagcguaaaaagcugaagccgcgguggcuagacgcgcgcaucuacagugauccccucgcuuugaaggaguucaaggaauuugccgccggccggaagucccugacucucaauuugauaaccgagaugggacgccugcccacguucaugacccaaaagacaagggacgcacucgacaaccuugccgugcugcacaccgccgaggccggggggcgcgcguacaaccacgcgcucuccgagcugcccgagacguuagagacccuccugcugcuaacccugcucgccacugucacgggggggaucuuccucuuccugaugagcggccggggaaucggcaagaugacccuggggaugugcugcaucaucaccgccuccauacuccugugguacgcccaaauacaaccgcacuggaucgcggccagcaucauuuuggaguucuuccucauugugcuacugauccccgagcccgaaaagcagcgcacgccccaggauaaccagcucaccuacguggucauugccauccugacugugguggccgccacuauggcgaacgagaugggcuuccuagagaaaacgaagaaggaccucggacuaggcuccaucgucacccagcagccggagagcaauauccuggacaucgaccuccggcccgccagcgccuggacccuguacgcuguggccaccaccuuugucacccccaugcugcgccacuccaucgagaacagcagugucaacgugagccucacggcgauagccaaccaagccaccgugcugaugggccucgggaagggcuggccccucuccaagauggacauaggcgucccgcugcuggccaucggcuguuacucccaggugaacccaaucacccucaccgcugccuuacugcuccuggucgcccacuacgccauuauugggcccggccugcaggccaaggcgacucgggaggcccagaagcgcgcagccgccggcaucaugaagaacccgaccguugacgggaucaccgucauagaccuagacccgaucccuuacgacccuaaguucgagaagcagcugggccaaguuaugcugcucguccucugcgugacccaggugcugaugaugcggacgaccugggcacucugcgaggcccugacgcuggcaacagggcccaucuccacgcucugggagggcaaccccgggcgcuucuggaacaccaccaucgccgucagcauggcuaacauuuuccggggcuccuaccuggcgggcgccgggcuccuguucagcauuaugaagaacaccacgaacacccggcgcgggacugggaacaucggcgagacgcugggcgagaaguggaagucccggcugaacgcccuagggaaauccgaguuccagaucuacaagaaguccgggauccaggaaguggaccgcacccuggccaaagaggggaucaagaggggcgagaccgaccaccacgcaguaagccgcgggagcgccaagcugcggugguuuguugagcgcaacauggugacccccgaaggcaaaguggucgaucucggaugcgggcggggcggguggagcuacuacugcggcggacugaagaauguucgugaggugaagggccugaccaagggcgggccuggccacgaggaacccaucccgauguccacguauggguggaaccugguccggcugcagaguggcguggacguguucuucaucccccccgagaaaugcgauacccugcucugcgacaucggggaguccagucccaacccaaccgucgaggcgggcaggacucugcggguucugaaccucguggagaacuggcugaacaacaauacgcaauuuugcaucaagguccugaacccuuacaugcccuccgugauugagaaaauggaggcccugcagcgcaaauacggcggagcccucgugcggaacccgcuuucccgcaauagcacccaugagauguacugggucagcaacgcgagcggcaacaucguauccagcgugaacaugaucucccggaugcucaucaaccgcuucaccaugcgccauaagaaggccaccuacgagccggauguagaccucgggagcggcacccgcaauaucgggaucgagucugagaucccaaaccuggacaucauaggcaagcggaucgagaagaucaagcaggaacacgagacgaguuggcacuacgaucaggaccacccguacaaaaccugggccuaccacgguucuuacgagacaaagcagaccgggagugcuuccagcauggugaacggcgugguccgccugcucaccaagccgugggacguguuaccuacugugacccagauggccaugaccgacacaacccccuucggccagcagcgcgucuucaaggagaagguggacacccggacccaggagcccaaggagggcacgaagaagcugaugaaaaucaccgccgaguggcucuggaaggagcuaggcaagaagaagaccccgcggaugugcacccgggaggaguuuacacgcaaggugcggucgaacgccgcgcuuggggccgucuucacugacgagaacaaguggaaaucugcccgagaggcgguggaagacucacgguucugggaacucgucgauaaggagagaagccugcacuuggagggcaaaugcgagaccuguguguauaacaugaugggcaagagggaaaagaaacuuggcgaauucgggaaggccaagggcucccgcgccaucugguacauguggcugggagcccgguucuuggaguucgaggcgcucggguuccugaacgaggaccacugguucagccgagagaacagccuguccggagucgagggggagggacuccacaaguugggguacauucugcgggaugucagcaagaaggagggcggcgccauguacgcugacgacaccgccgggugggauacucgcaucacccucgaggaccugaagaacgaggagauggugaccaaccacauggagggcgagcacaagaagcuggcggaggcgauuuucaaacucacauaccagaacaaggugguccggguucagcgccccacgccccgggggacggugauggacaucaucucccgccgggaccagcgcggcucaggucaggucggaaccuauggccugaacaccuucacgaacauggaagcucagcugauccggcagauggagggggagggcguguucaagaacauucagcacuugacggugaccgaggaaaucgccguucagaacuggcuggcucgcguggguagagaacggcucucccggauggccauaucuggugaugauugcguggucaagccccucgacgaccgguucgcgagugcucugaccgcucugaaugacauggguaagauccgcaaggauauccaacaaugggagccgagccggggguggaacgauuggacgcagguacccuucuguucccaccacuuccacgagcucaucaugaaggacggccgcgugcuggucgugcccugccggaaccaggacgagcugaucgggcgugcccggaucagccagggcgccggguggucccuccgcgagaccgcgugccugggcaagagcuaugcgcagauguggucccugauguacuuccaccggcgcgaccuccggcuggccgccaacgccaucuguagcgcggugccgucccauuggguccccaccagccgcaccacuugguccauccacgccaagcaugaguggaugaccaccgaagauaugcugacuguguggaaccggguguggauccaggagaaccccuggauggaggacaagacgccgguugagagcugggaagagauccccuacuugggaaagcgcgaggaccaauggugcgggagccugaucggccugacguccagagccacuugggccaaaaacauucaggcugcaaucaaccaggugcgcagccugauaggaaacgaggaauauaccgacuacaugccguccaugaagcgcuuccgccgcgaggaggaggaggccgguguccugugguga

SEQ ID NO: 25131 - RNA, 9876 nt, Artificial Sequence
  derived and/or modified CDS sequence (opt11) from DENV-2__EU687246__SS-prME
agugcgggcaugaucaucaugcugauccccaccgugauggcguuccaucucaccacccgaaauggggaaccccacaugaucgugagcauccaggagaagggcaagucccugcuguucaagaccgaggacggggugaacaugugcacgcucauggcgauggaccugggcgagcugugcgaggacaccaucaccuacaaaugcccccuccugcggcagaacgaacccgaagacauagacugcuggugcaacagcaccagcaccugggugacguacgguaccugcaccaccaccggcgagcaccgccgggaaaagcgcuccguggcccuagucccccacgugggcaugggguuggagacccggacagaaaccuggaugucauccgagggcgccuggaaacacgcccagcgcaucgagacguggauucugcgucacccgggguucacgauaauggcagcgauccuggcuuacaccauugguaccacccauuuccagcgcgccuuaaucuucauccugcugacggccgucgcgcccagcaugacgaugagaugcaucgggaucuccaaccgcgacuucguagagggcgugagcggcggguccugggucgauaucgugcucgagcacggcagcugcgugaccaccauggccaagaauaagcccacucuggauuucgagcugaucaagaccgaggccaagcagcccgccacccuccgaaaguacugcaucgaagccaagcugaccaacacgaccaccgagucccgcugccccacccagggggagccgagccugaaggaggagcaggauaagcgguucgucugcaagcacuccaugguagaccgcggcuggggcaacgggugcggccuauucgggaagggcgggaucgugacgugcgcgauguucacgugcaagaagaacauggagggcaagaucguccagccagagaaccuggaguacaccaucguagugacgccccacucuggcgaggagcacgccgucgggaacgacacgggcaagcacgggaaggagauuaagguuaccccacaguccuccaucaccgaggcggagcugacgggcuaugggaccgucacaauggagugcuccccccggaccggauuagacuucaacgaaaugguccugcugcagauggagaacaaggccuggcucgugcaucggcagugguuccuggaccugccccuccccuggcugccgggggccgacacccaagggagcaacuggauacagaaggaaacccuggugacguuuaagaacccgcacgcgaagaaacaagaugucgugguccucggcagccaggagggggcaaugcacaccgcccugaccggcgccaccgagauccagauguccagcgggaaccuccuguucacgggccaccuuaagugccggcuuagaauggacaagcuucagcugaagggcauguccuacagcaugugcaccgggaaguucaagguuguaaaagagaucgccgagacccagcacggcaccaucgucauccgugugcaguacgagggggacggcucccccuguaagauccccuucgagaucauggaccucgagaaacgcuacgugcucggccggcugaucacggucaacccgaucgugaccgagaaggacagcccugugaacaucgaggcagagccgcccuucggugacucguacaucaucaucggggucgagccggggcagcugaagcucaacugguucaagaaaggcagcagcaucgggcagauguucgagaccaccaugcgcggugccaagagaauggccauccugggcgacacugccugggauuucgggagccugggagggguguuuaccuccaucggaaaggcccuccaucagguguucggggcgaucuacggggccgcuuucucgggcgucuccuggaccaugaagauacuaaucggggugaucaucaccuggaucggcaugaauagccgaagcacuagccuguccgugagccuaguccucguugggauugucacccucuaccugggcgucauggugcaggccgacuccggcugcguggucagcuggaagaacaaggagcucaagugcgggagcggcaucuuuaucaccgacaacgugcauaccuggacggagcaguacaaguuccagcccgagucccccucaaagcuggcauccgcgauccagaaggcccaggaggaggguaucugcggcauccgcagcguaacccggcuggagaaccuuauguggaagcagaucacgcccgagcuuaaccauauccuggccgagaacgaggucaaacucaccaucaugacgggggauauuaagggcauuaugcaggcggggaaacgaucccugcggccacagcccaccgaacucaaauacucguggaagaccuggggcaaggcuaagaugcucucaaccgagucgcacaaccagacuuuccugaucgacggccccgagaccgccgagugcccgaauaccaacagggccuggaacucccuggaggucgaagacuacggguucggcguguucaccacgaauaucuggcucaagcugaaggagaaacaggacgccuucugugacagcaaguugaugagugcggcgaucaaagacaaccgggccguccacgcggacaugggguacuggauagagagcgcucuaaacgacacuuggaaaaucgagaaggccuccuucaucgaggugaagaacugccauuggcccaagagccauacccugugguccaacggcguccuggagagcgagaugaucauccccaagaaccucgcgggccccgucucccagcacaauuaccgaccgggguaccacacccagauagccggcccauggcacuuagggaagcuggaaauggacuucgacuuuugcgacggcaccacggugguggucaccgaggacugcgggaaccgggguccuagccucaggaccacuacggccagcggcaagcugaucaccgaguggugcugccgguccugcacucugcccccgcuccgcuacaggggggaagacggcugcugguacgggauggagauccgcccccugaaggagaaggaggagaaccugguuaacagccucgugacagccggacacggucaagucgacaacuuuucccugggcgugcugggcauggcccucuuccuggaggagaugcugcggacccguguggggaccaagcaugccauccuccuugucgcccugucguucgugaccuuaaucaccggaaacauguccuucaaggaccuggggcgggugguggugauggugggcgccacgaugaccgacgacaucgggaugggcgucaccuaccucgcccugcuggcggccuucaaggugcggcccaccuucgccgccgggcuacuccugcggaaacugacgagcaaggaacucaugaugaccaccaucgggauuguguugcugagucagagcaacaucccagagacaauccucgagcugacggacgccuuggcgcucggcaugaugguacugaagaucgugagagacauggagaaguaccagcuggcugugaccaucauggccauccucugcgugccgaacgcggugauccugcagaacgcauggaaggucuccugcaccauccuggcgguggucagcgucagcccccuccugcugaccagcagucagcaaaagacggacuggaucccccucgcgcugaccaucaaggggcugaacccuaccgcaaucuuccucacgacgcuaagucgcaccaacaagaagcggagcuggccguugaacgaggccaucauggcgguggggaugguuagcauccucgccuccagccuccugaagaacgacauccccaugaccggcccccucgucgccgggggguuacugaccgucugcuacgugcucacugggcgcuccgccgaucuggagcuggagcgagccaccgacgucaaaugggaggaucaggcggagaucucaggcuccucccccauccucagcaucaccaucuccgaggacggguccauguccaucaagaacgaggaggaggagcagacccugacgauccugauccgcaccggccuccuggugaucagcggccuguuuccgguguccauccccaucaccgccgccgccugguaucuuugggaggugaagaagcagcgggccggugugcugugggacgugcccuccccgccgcccaugggcaaggcggaacuggaggacggagccuaccgcaucaagcagaagggcauccucggguacucucaaaucggcgcaggcguauacaaggaggggaccuuccacacaauguggcacgugacgcggggagcuguccugaugcacaaggggaagcgcaucgaacccagcugggccgacgucaagaaggaccugaucuccuacggcgggggcuggaagcucgagggcgaauggaaggagggggaggagguccaggugcuggcgcuggaaccaggcaagaacccccgggccguccagacgaagccaggccucuucaagaccaacaccgguacgauaggggccgugucacuggacuucucacccggcacaagcggcucaccuaucauagauaagaaggggaagguggucggccuuuacgggaacgguguggugacccgcagcggcgccuaugucuccgccaucgcucagaccgagaaauccaucgaggacaacccggacaucgaggacgacaucuucagaaagcgccggcugacuaucauggaccuccaccccggggccggcaagaccaaacguuaccugccggcuaucgugcgggaggccaucaagcgcgggcuacggaccuuaauccuggcgccuacucgcguggucgccgcagagauggaggaggcccugcggggccucccaauccgcuaccaaacgcccgccauccgggcggagcacaccgggcgcgagaucguggaucugaugugucaugccaccuucaccaugcgccuguugucccccguccgggucccgaacuacaacuugaucaucauggacgaggcacacuucacggaucccgccagcaucgccgcccggggcuacaucagcacccggguggagaugggcgaggcugccgggaucuucaugaccgcuaccccgcccggcucucgcgacccguuuccccaguccaacgcccccauuaucgacgaggagcgcgaaauccccgagcgcuccuggaacagcgggcacgagugggugacggacuucaagggcaagaccgucugguucgugccguccaucaaggcggggaacgacaucgccgcaugccugcggaagaacggcaagaaggugauacagcucagccgcaagaccuucgacagcgaguacaucaagacccggaccaacgacugggacuucguugugaccaccgacaucagcgagaugggcgccaacuucaaggcggagcgcgugaucgacccccggaggugcaugaagcccgucauccugaccgacggggaggagagggugauccuggccggccccaugccugugacgcacuccagcgccgcccagcgccgggggcgcaucgggaggaaccccaagaacgaaaacgaucaguauaucuacaugggggagccccucgagaacgacgaggacugcgcccacuggaaggaggccaagaugcuguuggacaauaucaacacccccgagggaaucaucccuuccauguucgaacccgagcgcgagaagguggacgccaucgauggcgaguaccggcuccgcggagaggcccgcaagaccuucguggaccugaugcggcgcggcgaccuucccgucuggcucgccuacaaggucgccgcggaggggaucaacuacgccgaccggcgcuggugcuucgacggcaucaagaacaaccagauacuggaggagaacguggagguggagaucuggaccaaggagggggagcggaagaagcugaagccgcguuggcucgacgcccggaucuacagcgacccccuggcccuaaaggaguucaaggaauucgccgcaggcagaaagaguuuaacacugaaccugaucaccgagaugggcagacuccccaccuuuaugacgcagaagacgcgggacgcccucgacaacuuagccguccuccacacggccgaggccggagggcgggccuauaaccacgcccugagcgaguugcccgagacccucgagacccugcugcuccugacgcugcucgccaccgugaccggcgggaucuuccuguuccugauguccgggcgcgggaucggcaagaugacccucgggaugugcugcaucauaaccgccagcauauuacugugguacgcgcagauacagccgcacuggaucgccgccuccaucauacuggaguuuuuucugaucguccugcuuauucccgaaccggagaagcagcguacgccucaagacaaccagcugaccuacguggugauagccauacuaaccgucguggcggcgaccauggccaacgagaugggcuuccucgagaagacgaagaaggaccuaggucugggaagcaucgccacccagcagccggaguccaacauccucgacaucgaccugcgccccgccagcgccuggacgcuguacgcgguggcgaccacauucaucacccccaugcuccggcacagcauugagaacucaagcgucaacgugucccugaccgccaucgccaaccaggccaccgugcugaugggccucgggaaaggcuggccccuaucuaagauggacaucggggucccccugcucgcuaucggaugcuacucccaggugaaccccauaacgcugacugccgcccuauuacugcugauugcccacuacgcuaucaucggucccggccuccaagccaaggccacccgcgaggcccagaaacgggccgcggccgggaucaugaagaaccccaccguggacgggaucacggucaucgaccuggacccgauccccuacgacccuaaauucgaaaagcaacugggccaggugaugcuccugguuuugugcguaacccaaguucucaugaugcgcaccacuugggcccugugcgaggcccugacgcucgccaccgggcccaucagcacccugugggagggcaauccgggacgguucuggaacaccacgaucgcgguguccauggcaaacaucuuccgcggcagcuaccuggccggcgccgggcuccuguucuccaucaugaagaacaccaccaacacccggcgcggcaccgggaacaucggcgagacccugggcgagaaguggaagucccgccuuaacgcccuggggaagagcgaguuccagaucuacaagaaguccggcauccaggaagucgaccggacccuggcgaaggaggggaucaagcgcggcgagaccgaccaccaugccgugucccgggggagcgccaaguuaaggugguucguggagcggaacauggucacgcccgagggcaaggucguggaccugggcugcgggcgcgggggaugguccuacuacugcggcgggcugaagaacguccgagaggugaagggacucaccaagggcgggccuggccacgaggagcccaucccgaugagcaccuacggguggaaccuggugcgccugcaguccggcgucgacgucuucuucaucccccccgagaagugugacacccuccugugcgacauuggggagagcucccccaacccgacaguggaagccggccggacccugcggguccucaaccugguggagaacuggcugaacaacaauacccaauucugcaucaaggugcugaacccauacaugcccagcguaaucgagaaaauggagacccuccagcggaaguacgguggagcgcuggugcgcaacccgcuaagccggaacuccacacacgagauguacugggugagcaacgccuccggcaacaucgucaguuccgugaacaugaucagccgcaugcucaucaaccgguucacgaugcgccacaagaaggccaccuacgaacccgacguugauuuaggcuccggcacccggaauauuggaaucgagagcgagauucccaauuuagacaucauugguaagcgcauagagaagaucaaacaggagcaugagaccuccuggcacuacgaccaggaccaccccuacaagacgugggccuaccauggaagcuaugagaccaagcaaacgggguccgccagcuccauggugaacggcgugguccggcuccugaccaagccuugggacguccugccaacggugacacagauggcgaugacagacaccacgcccuucggucaacagcgcguguuuaaggagaaggucgacacccgcacccaggagcccaaggagggcaccaagaagcucaugaagaucacggccgaguggcuguggaaggagcugggcaagaagaaaaccccgcggauguguacccgcgaggaguucacccggaaggugcgcagcaacgccgcccucggggccaucuucacggacgagaacaaguggaaguccgcgcgggaggccguagaggacagccgcuucugggaacuggucgacaaggagcgcaaccugcaccucgagggcaagugcgagaccugcguguauaacaugauggggaagcgcgagaaaaagcugggcgaguucgguaaggccaagggcucccgggccaucugguacauguggcugggcgcacgcuuccucgaguucgaggcguuaggauuccugaacgaggaccacugguucagccgggagaacucccuaagcggcguggagggggagggccugcacaagcuaggguacauccuccgcgacgucagcaagaaggagggcggcgcuauguacgccgacgacacagccgggugggacacccggaucacgcuggaggaccugaagaacgaggagauggugaccaaccacauggaaggagagcacaagaagcucgcggaggccauauucaagcugaccuaccaaaacaaagucgugcgcgugcaaaggccgacgccccgugggacugucauggacauuauuucccggcgcgaucaacggggcagcggccagguggggaccuacggccugaauaccuuuaccaauauggaggcccagcuaauccgucagauggagggcgaaggcguguucaagaacauccagcaccugacggucaccgaggagaucgccguucagaacuggcuugcccgggugggucgcgagcgccucucccggauggcgaucagcggggacgacugcgucgugaagccccuggacgaccgcuuugccuccgcccucacugcccucaacgacauggguaagauccggaaggacauacagcagugggagccgagccgcggauggaacgauuggacccaggugcccuucugcucgcaccacuuccaugagcugaucaugaaggacggccggguccugguggugcccugucgcaaccaggacgaguuaaucgggagggccagaaucucccagggcgcggguuggucccugcgggagacggccugccucggcaagaguuacgcccagauguggucccucauguacuuccaucgccgggaccuucgccuggccgccaacgcuauuugcagcgccguccccucccacugggugccuaccaguaggacaaccugguccauccacgccaagcacgaguggaugaccacggaagacaugcucaccguauggaaccgagucuggauucaggaaaacccauggauggaggacaagaccccaguggagucaugggaggagauccccuaccugggcaagcgggaggaccaguggugcgggucccugaucggccucaccucccgcgccacgugggcaaagaacauucaagcggccaucaaccaggugcggagccugaucggcuccgaggaguacaccgacuacaugccgagcaugaaacgcuuccggcgcgaggaggaggaagccggcguccugugguga

SEQ ID NO: 25132 - RNA, 9876 nt, Artificial Sequence
  derived and/or modified CDS sequence (opt11) from DENV-2__FJ639828__SS-prME
aguguuggcaugaucaucaugcugauccccaccgugauggcguuucaucucacaacccgcaacggggaaccccacaugaucgucagcauacaggagaagggcaagucgcuguuauucaaaacugaggacgggguuaacauguguacccucauggcuauggaucugggcgagcuuugcgaagauaccaucaccuacaaaugcccccuccugcggcagaacgagcccgaggacauugacugcuggugcaacuccaccucaacaugggucaccuauggcaccuguaccacgaccggcgagcauagacgggagaagcguuccguggcguuagugccccacgugggcaugggccuggagacccggaccgagaccuggaugagcuccgaaggcgccuggaaacacgcccaacgcauagagacuuggauccugagacaccccggcuucacgauuauggccgcuauccucgcguauacuaucggcacuacccacuuucaaaggacgcuuaucuucauuuugcugacggccguugcccccuccaugaccaugcgguguaucgggaucuccaaucgagauuucguugagggcgucagcggcggguccuggguggauaucgugcuugagcacggcuccugcgucaccacgauggcgaagaacaagccgacccuagacuucgagcugaucaagaccgaggcgaagcagcccgcaacccuccguaaauauugcaucgaggccaaguuaacgaacaccaccaccgaaucccgcugcccuacucagggggagcccagccucaaggaggagcaagacaaacgguucgugugcaagcacuccaugguggauaggggcuggggcaauggguguggcuuauucgggaagggcgggauagugaccugcgccauguucacgugcaaaaaaaacauggagggcaagauagugcagcccgaaaaucuggaauacaccauagugguuaccccgcauagcggcgaggagcacgccguggggaacgacacuggcaagcacgguaaggagaucaagguaaccccgcaguccuccaucaccgaggcagaguuaacaggcuacgggaccgucaccauggagugcagcccucgcaccggccuagacuuuaacgagauggugcugcugcagauggagaacaaggcuuggcucgugcaccgucaaugguuccuggaccugccgcucccauggcugccuggugccgacacucaagggagcaacuggauccagaaggagacgcuaguuaccuucaagaacccccacgccaagaaacaggacguggucgugcugggcagccaggagggggccaugcacacugcgcugaccggagcgacugagauccagauguccagcgguaaccuccuguucacuggccaucugaagugcagguugcgcauggauaagcuccagcugaaggggauguccuacagcaugugcaccgggaaguuuaaggugguuaaggaaauugccgaaacccagcacggcaccaucgugauccggguucaguacgaaggggacggcuccccuugcaagauaccguuugaaauaauggaccuggaaaagcgcuacguccucggccgguuaauaacggucaacccaauugccaccgaaaaagacagcccugugaacauagaggcugagccgcccuucggggauucguacaucauuauaggcgucgagccggggcagcugaaguugaauugguucaagaaaggaagcuccaucgggcagauguuugagacuacgaugcgcggcgcgaagcgaauggcgauccugggcgacaccgccugggacuucgguagccugggcgggguuuucacguccaucggcaaggcgcuccaccaggucuucggugcgauuuacggcgcggccuucucaggcgucuccuggacuaugaagauccugauuggggugaucauuacguggaucggcaugaacagcagaaguaccagccugucagucucgcuuguucucgugggaguagucacacuguaccugggagugauggugcaggccgacucggggugcguggugagcuggaagaacaaggagcucaagugcggcagcggcaucuucaucaccgacaauguucacacguggaccgagcaguacaaguuccagccagagucccccuccaaacuggcgucagcgauccagaaagcccaggaggaggggaucugcggaauacgcagcgucacccggcucgagaaccucauguggaaacaaauuacccccgagcugaaccacauacuggccgagaacgaggugaaacucacgaucaugaccggggacaucaaaggcauaaugcaggccggaaagcgcucccugcggccgcaacccaccgagcugaaguacagcuggaagaccuggggcaaagccaagaugcucuccacggagucucauaaccagaccuucuuaaucgauggcccugaaaccgcggagugcccgaacaccaaccgggcguggaacagccuagagguggaggacuacggcuucggcgucuucacgaccaacauauggcucaaauugaaggagaagcaagacgcuuucugcgacaguaagcugaugagugccgccaucaaagacaaccgcgcgguucacgccgacaugggguacuggauugagagcgccuuaaacgacaccuggaaaaucgagaaggccuccuucauagaggugaaaaauugucauuggccaaaaagccacacacuguggucgaacggcguccuggaaagcgagaugaucaucccuaagaacuuggcgggucccgugucccaacacaauuaucgcccgggguaucacacccagaucgcgggucccuggcaucuggggaaguuggagauggacuucgacuuuugcgacggcacgaccgugguggugaccgaggacugcggcaaccgcggccccagccuacgaaccaccaccgcuagcggcaagcugaucacagaguggugcugccggucuuguaccuugcccccgcuccguuaccggggggaagauggcugcugguacgggauggaaauccgcccguugaaggagaaggaggagaaccugguuaacucgcucgucacggcaggccacgggcaagucgacaacuucaguuuaggaguccuaggcauggcccucuuuuuggaggagaugcugcggacccgcgucggcacgaagcacgcuauuuuacugguggccgucagcuucgucacucugaucacgggcaacaugucauucaaagaucucggucguguuguggucauggugggugccacuaugaccgaugacaucgggaugggcgugacauacuuagcucuguuggccgcauucaagguccgccccacguucgccgccgggcuguuccugaggaagcuuacgaguaaggagcugaugaugacgaccauugggaucguacuguuaucccaaagcacgcuccccgagacaauccuggagcucacagacgccuuggcccugggaaugaugguguugaaaaugguaagagacauggagaaauaccaguuagcggugacgaucauggcgauccugugugucccgaacgccguaauacuccaaaacgccuggaagguguccugcacgauccuugcagucguaagcgugagcccccuacuccugaccagcagccagcagaagaccgacuggaucccccuggcucucacgaucaagggguugaaccccacggccaucuuccugaccacccucucacggaccaacaagaagcgguccuggccgcugaaugaagcuaucauggccgugggcaugguuuccauccuggcguccuccuugcugaaaaacgacauccccaugacggguccccuaguugccgggggccuccuaaccgucugcuaugugcugaccgggcgcagcgcggacuuggagcucgagcgggccacggaugugaagugggaagaccaggccgagaucagcggcuccucacccaucuugucaaucacgaucuccgaggacgggagcaugaguaucaagaacgaagaagaggagcagacccucaccauccugaucagaaccgggcugcucguaaucuccggccuguucccaguauccauccccauaacggcggccgccugguaccugugggaagugaagaaacagcgggcuggggugcucugggacgugccguccccgccgcccaugggcaaagccgagcuggaggauggcgcauaccgaaucaaacaaaggggcauccugggguacucccagauaggggccggcguguauaaagaagguacguuccauaccauguggcaugucacccgaggcgccguccuuacccacaaggggaagcggaucgaacccuccugggcagaugugaaaaaggaccugaucuccuauggaggaggcuggaagcuggagggcgaguggaaggaaggcgaggagguccaaguacucgcccucgagcccggcaagaacccccgcgcgguccagacgaagcccgggcuguucaagaccaacaccgggaccaucggggcagugagccuggacuucucccccggcacaagcgguucuccaaucaucgacaagaagggaaagguggugggacuuuacgggaacggcguggucacccggagcggcgcguacguguccgccauagcccagaccgagaaguccaucgaggauaaccccgacaucgaagacgacaucuuucgcaagagacgucuaaccauaauggaccuccacccgggggcgggaaagacgaagcgauaccuccccgcaaucguucgcgaagccaucaagcgcggccuacgcacccugauccuagccccgacccgcguaguggcggccgagauggaagaggccuugcgaggcuugccgauacgguaucagacccccgccauucgcgccgagcacacggggcgcgaaauuguggaccucaugugccacgcuaccuucaccaugcggcugcugucccccgugcgcguaccgaacuacaaccugaucauuauggaugaggcccacuucacagaccccgcaagcauagccgccagggguuacaucagcacgcgggucgagaugggcgaggcugccggcaucuucaugacggcgacgccgcccggcucgcgggacccguucccucagagcaacgcucccauuauugacgaggagcgcgagaucccggagcggucguggaacagcggacaugaaugggucaccgacuucaagggcaagacggugugguucgucccguccauuaaggccgggaacgauaucgcggcgugccugcgcaagaacgguaagaaagucauccaacugagccggaagaccuucgauuccgaauacgugaagaccaggacaaacgacugggauuucgucgugacgacugacauaucagagaugggugcgaauuucaaggccgagagaguaaucgacccccgucgaugcaugaagcccgugauucucacugacggggaggagagagugauccuggcgggccccaugccggugacccacucuagcgccgcccagcgccgcggccggaucggccggaaccccaagaacgagaacgaccaguacaucuauaugggggagccccuggagaacgacgaggacugcgcccacuggaaggaggccaagauguuacucgacaacaucaacacgcccgagggcaucaucccguccauguucgagcccgagcgggagaagguugacgcgaucgauggggaguaccgccuucgaggggaggcccggaagaccuucgucgaccucaugcggcggggugaccugccagugugguuagccuacaaagucgccgcagaggggauuaacuacgcagaccgccgauggugcuucgacggcaucaagaacaaucagaucuuggaagagaacgucgagguugagaucuggacgaaagagggcgagcgcaagaagcugaaaccgcgguggcuggacgcccgcaucuacagcgacccccuugcccuuaaagaauucaaggaguucgccgccggcagaaagucccuuacucucaaccuuaucacggagauggggcgccugcccaccuuuaugacccagaaaacacgggacgcgcucgacaaccuggccguacugcacacggcagaggccggaggucgcgccuauaaccaugcccucucugagcugccagagacccucgagacccucuuguuacucacucugcucgccaccguaaccggagggaucuuccucuuccuaaugucagggagaggaaucggcaagaugacgcuugggauguguuguaucguuaccgccagcauccucuugugguacgcccaaauccagccgcacuggauagcugcuuccaucaucuuagaguucuucuugaucguucuucugauuccggaacccgagaaacagcggaccccucaggacaaccagcucaccuacguagugaucgcgauacugaccgugguggcugccacgauggcgaacgagaugggcuuccucgaaaagaccaagaaggaccucgggcugggcagcaucgccacgcagcagccugaguccaacauccucgacauagaccuccggcccgccagcgccuggacccuguacgcuguggcgacuacuuucgugacaccaaugcuacgccacagcaucgaaaauuccagcguuaacgucucccucacggccaucgcgaaccaggcaacagugcuuaugggacucggaaagggguggccccucagcaagauggacaucggggcaccacuccuggcgaucggcugcuauucccaaguuaaccccaucacccuuacggccgcccugcuacuccuggucgcccacuacgcaaucaucgggcccggccugcaggcgaaggccacaagagaggcccagaagcgcgcggcggccggcauuaugaagaaccccacaguggacgggaucacuguuaucgaccucgauccgauccccuacgacccuaaguucgagaagcagcucggccaggucaugcuguuggugcugugcgugacacagguccugaugaugcguaccaccugggcccucugugaagcgcugacccuugccacgggacccaucagcacacucugggagggcaacccggggcgcuucuggaacacaaccaucgcggucuccauggccaacaucuuccgggguaguuaucuggccggcgcgggguugcuguucucaaucaugaagaacaccaccaacuccagacgcggcacgggcaacaucggcgagacccugggcgaaaaguggaagucccggcucaacgcccuaggaaaaagcgaguuccagaucuacaagaagaguggcauccaggagguggaccgcacgcuggcgaaggaaggcaucaaacggggcgaaaccgaucaccacgccgugucucggggguccgccaaacuacggugguucgucgagagaaacauggugacacccgagggcaagguuguggaccucggcugcgggcgcggaggguggagcuacuacugcggcgggcugaagaacgugcgcgagguuaagggccuaacuaaaggggggccagggcacgaggaacccaucccgauguccacguacggguggaaccucgugcggcuucagagcggcguagacgucuucuuuauaccgcccgagaagugcgacacgcugcucugugacaucggggaguccucucccaacccaaccguggaggcuggcagaacccugcggguauuaaaccucguggagaacuggcugaauaacaacacgcaguucugcauuaaggugcugaaucccuacaugcccagcguaauagagaagauggagacccugcagcgcaaguacggcggggcgcuagucaggaacccgcugucccgcaauagcacccacgagauguacugggugagcaacgccagcggcaacauaguguccagcgugaauaugaucuccagaaugcugaucaaucguuucaccaugcgucacaaaaaggcaaccuacgagcccgacgucgaucucgggagcggcacgcgcaacauagggaucgaguccgagauccccaauuuagacauaauuggcaagcgcauagaaaagaucaagcaggagcaugagaccaguuggcacuaugaccaggaccacccguauaagaccugggccuaucauggcuccuacgagacuaaacagacggggagcgccagcagcauggugaacggcgucguacgccugcuaacgaaaccgugggacguucugcccaccgucacccagauggcgaugacggacaccacccccuucgggcaacaaagaguguuuaaggaaaagguggauacccggacccaggagcccaaagagggcaccaagaagcugaugaagauuaccgcagaguggcucuggaaggagcuaggcaagaagaaaaccccgcgaaugugcacucgggaggaguuuacccgcaagguccgguccaacgccgcccugggggccauuuucaccgacgagaacaaguggaagucugcgcgcgaggcggucgaggauucucgguucugggagcucgucgacaaggagcgcaaccugcaccucgagggcaagugcgagacuugcguguacaacaugauggggaaacgggagaagaagcuaggggaguucggcaaagccaagggcagccgggccauaugguacauguggcugggugcacgauuucuggaguucgaggcgcugggguuccugaacgaggaucacugguucuccagggagaacagccugagcgguguggagggagagggacuccaccggcugggguauauccugcgcgaugucagcaagaaagagggcggcgccauguacgcagacgauacggccggaugggacacccguauuaccuuagaggaucugaagaacgaggagauggugacuaaccacauggagggggaacacaagaagcuggcggaggccaucuucaaacucaccuaccaaaacaaggugguccgcgugcagcggcccacgccccgcgggaccguaauggacaucauaucgcggcgggaccagcggggcuccgggcaagucggcacauauggccuaaauaccuucaccaacauggaggcccaauugauccgccaaauggagggggaaggcgucuucaagaacauccaacacuuaaccgucacugaagagauugcgguccagaacuggcuggcacgcgucgggcgagaacgucugagucggauggcgaucagcggugaugacugcguagucaagccgcucgacgacagguuugccagcgcccucacugcccuaaacgacaugggcaaaauccggaaggauauccagcaaugggagccgucucgaggguggaaugauuggacccaagucccauucugcagccaccacuuucacgaauugaucaugaaagauggccggguguuagucgugcccugucgcaaccaggacgagcugaucggccgagcucgcauuagccaaggggcaggguggagucucagggagacugccugccugggcaaguccuacgcacagauguggucucuuauguacuuccaccgacgggauuuacgccuggcugcaaacgccauuugcucagccguacccucgcacuggguaccgacgucgcgaaccacguggagcauucacgccaaacacgaguggaugaccaccgaggauaugcugacaguguggaacagaguauggauccaggaaaaccccuggauggaggacaaaacgcccgucgaguccugggaggaaaucccauacuuaggcaagcgggaggaccaguggugugggagccuuaucggccugacaagcagagccaccugggcuaaaaacauccaggcggcgaucaaccaggugaggucccucaucggcaacgaggaguacacugacuacaugccgucuaugaagcgcuuccggagggaggaggaagaggccggcguucugugguaa

SEQ ID NO: 25133 - RNA, 9876 nt, Artificial Sequence
  derived and/or modified CDS sequence (opt11) from DENV-2__FJ639829__SS-prME
ucugugggcaugaucaucaugcugauccccaccgugauggcguuccaccucaccacccgcaacggggagccucacaugaucgugucgauacaggagaagggcaagucucuucuguucaagaccgaggacggggugaacaugugcacacucauggccauggaccugggcgagcugugugaagacacaaucaccuauaaauguccccuccugcggcagaacgagcccgaggacaucgacugcuggugcaacuccaccaguaccugggucaccuauggaacguguaccaccaccggcgagcaccgccgggagaagcgcagcguggcgcuggugccgcacgucggaauggggcucgagacgaggacugagaccuggaugucguccgaaggugcguggaagcaugcccagcgcaucgagacuuggauccugcggcacccgggguucacaaucauggccgccauucucgcguacaccaucggcaccacccacuuccagcggacgcucaucuucauccugcugaccgcuguggccccaagcaugaccaugcgguguaucgggaucagcaauagggacuucguggagggcgucagcggcggguccuggguggacaucgugcucgagcacgggagcugcgucaccacgauggccaagaauaagcccacccuggacuucgagcuaaucaagacggaggcgaagcagcccgccacccuccggaaguauugcauagaggccaagcugacgaacaccaccacggagagucggugccccacgcagggggaacccagccugaaggaagaacaggacaagcgauucgugugcaagcacuccaugguagaccgcggcuggggcaacgguugcggccucuucgggaagggcgggaucgugaccugcgcuauguucacgugcaaaaagaauauggagggaaagaucgugcagcccgagaaccuggaguacacaauuguggucacgccccacagcggcgaggagcacgccguugggaacgacaccggcaagcaugggaaggaaaucaaggugaccccacaauccagcauuaccgaggcggagcuuaccggcuaugggacggucaccauggagugcuccccccggaccggccuggacuucaacgagauggugcugcugcagauggagaacaaggccuggcucgugcaccgccagugguucuuagaccugccccucccaugguuaccgggcgccgacacccaggggagcaacuggauccagaaggaaacgcuggucaccuuuaagaacccccacgccaaaaagcaggacguggucguguugggcagccaggagggggccaugcacaccgcgcugaccggcgccacagagauccagauguccagcggaaaccuccuguucaccggccaccugaagugcagacugagaauggauaagcuccagcugaaaggcauguccuacagcaugugcaccgggaaguucaaaguggucaaggagaucgccgaaacccagcacggcacgaucgugauccgggugcaauaugagggugacggcucccccugcaagauccccuucgaaaucauggaucuggagaagcgcuauguccucggccgucuaaucaccguuaaccccaucgucaccgaaaaggacucgcccgucaacaucgaggccgaaccgcccuucggggacuccuacauaaucaucggcguggagccgggacaauugaagcucaauugguucaagaagggcagcuccaucggucagauguucgagaccacuaugcgcggcgccaaacgcauggcaauccugggcgacacagccugggacuucgggagccugggggguguguucaccuccaucggcaaggcccuccaccaggucuuuggggccaucuacggcgccgcguucucgggcguaaguuggaccaugaaaauacugaucggggugaucaucacguggaucggcaugaacucucgguccacuagccuguccgucagccuggugcucguggggguugucaccuuguaccugggcgugauggugcaagccgacuccgggugcguggugagcuggaaaaacaaggagcucaagugcggcagcggcaucuucaucaccgacaauguccauacguggacugagcaguacaaauuccagcccgagagcccaagcaagcuggccuccgcuauccagaaggcgcaggaggaggggaucugcgguauccgaagcgugacccggcuagagaaccucauguggaagcagaucacccccgagcugaaucacauucuggccgagaacgagguuaagcucacgaucaugaccggggacaucaagggcaucaugcaggccgggaagcgaucccugcggccgcaacccaccgagcuaaaauacagcuggaaaaccugggggaaggccaaaaugcuguccacggagagccauaaccaaacauuccugaucgacggcccagagacugccgagugcccuaacaccaacagagcguggaauucccuggaaguugaagacuacggguuuggugucuucacgaccaacauuuggcuaaaacucaaggagaagcaggacgccuuuugcgacagcaaguugauguccgccgccaucaaggauaaccgggcugugcacgcggacaugggauauuggaucgagucggcccucaacgacacguggaagaucgagaaggccuccuucaucgaggugaaaaacugccauuggcccaagagccacacccugugguccaacggcgugcuggagucagagaugaucauccccaagaaccucgcaggccccgugucccagcauaauuaccgcccaggguaccacacccagaucgccggccccuggcaucuggggaagcuggaaauggacuucgacuucugugacggcacgaccgucguggugaccgaggacugcgggaaccguggccccagccuccgcacgacgaccgccagcggcaaguuaauuaccgaguggugcugucgguccugcacccugcccccgcuucgcuaucgcggggaggauggcugcugguacgggauggagauccggccccugaaggagaaggaggagaaccuggucaacucucuggugacggcaggccacggacaggucgacaacuucagccugggaguacugggcauggccuuguucuuggaagagaugcugcggaccaggguagggaccaaacacgcgauccuccugguggcggucagcuuugugacucugaucacgggcaauaugaguuucaaggaccucgggcgcguggucgugauggugggggccaccaugaccgacgacauagguaugggggucacuuaucuggcccuucucgcagccuuuaaggucaggcccacauucgcggccggauuguuccugcggaaacucaccucuaaggagcugaugaugaccaccauaggaauagugcugcucucccagagcacgauccccgagacaauucuggagcuuaccgaugcccucgcacugggcaugauggugcugaagauggugcgcgacauggagaaguaccagcucgcggucaccaucauggcgauccuuugugugccgaacgccgugauacugcagaacgcuuggaaggucaguugcacgauacucgccguggugagcguaagcccccugcuguuaaccagcucccagcagaagacugacuggaucccccucgcccugaccaucaaggggcucaaccccacggcgaucuuccucaccacccugagccgcacuaauaaaaaacggucguggccgcucaacgaagccaucauggcaguugggauggugucgauccuugccuccagucugcucaagaacgacauccccaugaccggcccgcuggucgcgggcgggcuacucaccgucugcuacguacugacugggcgcagugccgaccucgagcucgaaagggccaccgacguuaagugggaggaucaggccgagaucagcgggagcuccccuauucucagcaucacgaucuccgaggacggcagcauguccaucaagaaugaggaggaggagcagacccuuaccaucuugauccguacaggccugcuggugaucagcggucucuucccuguuuccauccccaucacagcggccgcaugguaucugugggaggucaagaagcaacgggccggggugcugugggacgugcccucaccgccgccgaugggcaaggccgaacucgaggacggggccuaccgcaucaaacagcgggggauccugggauacucccagaucggcgcgggcgucuauaaggaggggacguuccacaccauguggcacgugacccgcggcgccgugcugacccacaaggggaagcggaucgagcccagcugggccgacgugaaaaaagaccuaaucuccuacggagguggguggaagcuggagggcgaguggaaagagggggaggagguccaggugcuagccuuggagcccggcaagaacccccgcgccguccagacgaagcccggguuguucaagacgaacaccggcaccaucggggcggugagccuggacuuuuccccagguacgagcggguccccuaucaucgacaagaaggggaagguggucggcuuguacgggaacggcguggugacccggaguggcgccuacgucuccgccauagcccaaacggagaaaucgaucgaagacaaccccgacaucgaggacgauaucuuccgcaagcggcggcugaccaucauggaccugcacccgggggccggcaagacgaagcgguaccugcccgcgauugugagggaagcuauuaagcgugggcuccgcacucuuauccuggcaccgacccggguggucgccgcugagauggaggaggcgcugcgcggucugcccauacgguaccagacccccgccauccgcgcagaacauacugggcgcgagaucguagaucugaugugucacgccaccuucaccaugcggcuccuuucccccgugcgcguuccgaauuacaaccugauuaucauggacgaggcgcacuucaccgaccccgcgagcaucgccgcccggggcuacaucagcacgcgcguagaaaugggcgaggccgcagggauuuuuaugaccgccaccccgcccggcucccgggacccuuucccccagagcaacgccccaaucaucgacgaagagcgcgaaauccccgagcgauccuggaacagcgggcacgagugggugacagacuucaagggcaagacggucugguucgugccguccaucaaggccgggaacgacauagccgcgugucucaggaagaacggcaagaaggugauccagcugucucggaagaccuucgacuccgaauacguaaagaccaggaccaacgacugggacuucguugugacgaccgacaucagcgagaugggcgccaacuucaaggccgagcgggucaucgacccccgccggugcaugaagcccgugauccugacggauggagaggaacgcgugauccucgccggacccaugccggucacccacuccagcgcggcccagcggcggggccggaucggccguaaccccaaaaacgagaacgaccaguacaucuauaugggggagccccuagagaacgacgaggacugcgcccauuggaaggaagccaaaaugcuucuagacaacauuaacacgccagagggcaucaucccguccauguucgagcccgaacgcgagaaaguggacgcaaucgacggcgaauaccgucugcgcggggaagcgcggaagaccuucguggaccugaugcgccggggcgacuuacccgucuggcuggccuacaaaguggccgccgaggggaucaacuacgccgaucgccggugguguuucgacggcaucaagaacaaccagauccuggaggaaaacgucgagguggagaucuggacaaaggagggggagcguaagaagcucaaaccgcgguggcuggacgcgcgcaucuacagcgauccucucgcccucaaggaguuuaaggaguucgcugccggccggaagucccugacccugaaucuuaucacggagaugggccgccuucccacauucaugacccagaagacccgggacgcacuggacaaucuggcagugcugcacacggcugaggcggggggucgcgcuuacaaccacgcgcugucugagcuccccgagacgcuggagacccugcuccugcugaccuugcuggccacggucaccggcggcaucuuccuguuccucauguccggacgggggauaggcaagaugacauugggaaugugcuguaucgugacggccucaauccugcucugguacgcccaaauccagccgcacuggaucgccgcaucaaucauccuggaguucuucuuaaucguguuacugauucccgagcccgagaaacagcgcacgccccaggacaaccagcugacguacgucgucaucgccauccucaccguggucgccgccacaauggcgaacgagaugggcuuccuggagaagaccaagaaagaccuggggcucggcagcaucgcuacucagcagcccgaaucaaacauccuggacaucgaccuccggcccgccagcgccuggaccuuauaugcuguggccaccacauuugugacgcccaugcugcgccacagcaucgagaacagcagcgucaacgugucgcugacggcgauugcaaaucaggccaccguucugaugggccuggguaagggcuggccucugagcaagauggacauaggagccccgcuccuggccaucggaugcuacagccagguaaaccccaucacacugacggcggcucucuuacuguugguugcccacuacgccaucaucggacccggacugcaagcgaaggccacccgggaggcccagaagcgcgccgccgcgggcaucaugaagaaccccaccguagacggaauaacugucaucgaucuggacccaauuccuuacgacccuaaguucgagaagcagcucggccagguaauguuauuggugcuuugugucacccaggugcugaugaugcggaccaccugggcccugugcgaggcacucacccuggcgacagggcccaucaguaccuugugggaaggcaacccugggcgcuuuuggaauaccacuaucgccguauccauggcuaacaucuuccgggggagcuaccucgcgggugccgggcugcuguucuccaucaugaagaacacgacgaacaguagacgcgguacugggaacaucggcgagacccucggcgagaaauggaagucccgacugaacgcccuggguaagagcgaguuccagaucuacaaaaaauccggcauccaagaggucgaccgcacgcucgccaaagaagggaucaaaagaggggaaaccgaccaccaugcggugagccgugggagugccaagcugcggugguucguggaacgcaacauggucacccccgaagggaaggugguagaccugggcugcgggcggggcggguggagcuacuauugcggcgggcucaaaaacguccgcgagguuaagggccugaccaagggggggccugggcacgaggagcccaucccgauguccacguacggguggaaccugguucgacuccaaagcggcgucgacguguuuuucaucccgcccgaaaagugcgacacacuccugugugacauuggggaauccagucccaacccgaccguagaggccggccguaccuugcggguccugaaccugguggagaacugguugaacaacaacacccaauucugcaucaagguauuaaaccccuacaugcccagcgucaucgagaagauggagacccugcagcgcaaguacggcggggcgcuggugcggaacccgcucucacgcaacagcacccacgagauguacuggguguccaaugcaagcggcaacaucgucuccagcgugaacaugaucuccagaaugcugaucaaccguuucacgaugcggcacaagaaagcgacuuacgagcccgacguggaccuggggucgggcacucgcaacaucggcaucgaguccgagauccccaaccucgacauaaucggcaagcggaucgagaagauaaagcaggagcacgaaaccagcuggcacuacgaccaggaccacccguacaagacgugggccuaucacggcuccuacgagaccaagcagacggggagcgccuccagcauggucaauggaguggugcgccugcugaccaagccgugggacguccuccccaccgugacccaaauggcaaugaccgacaccacccccuucgggcagcaacgcguguucaaggagaaggucgacacgcggacgcaggaacccaaggagggcacaaagaagcugaugaagaucaccgcggaauggcuguggaaggaguugggcaagaagaagaccccgcgcaugugcacgagagaggaauucacccgcaaggugcgguccaacgccgcucugggggccaucuucaccgacgagaacaaguggaaguccgcccgugaggcggucgaggacucccgauucugggagcuaguggacaaggagcguaaccuccaccuggagggaaagugcgagaccuguguguacaacaugauggggaaacgggagaagaagcugggcgaguucgggaaggcgaagggcucaagggcgaucugguacauguggcucggcgcccgguuccuggaguuugaggcucuaggauuccucaacgaggaccacugguucucucgcgagaacagccugagcggcgucgagggggaagggcuccaccggcucggguacauacugcgugacguguccaagaaggagggcggcgcaauguacgccgacgacacagccgggugggauacacguauaaccuuggaggaccucaagaaugaggagauggugaccaaccacauggagggagagcacaaaaagcuagccgaggccaucuucaagcugacguaccagaacaaagucguucgcgugcaaaggcccacgccacgggggaccgucauggacaucaucagccggcgggaccaaaggggcuccggccaagugggaacguacggccucaacacguuuaccaacauggaggcccagcugauccgccaaauggagggggagggcguguucaagaacauccagcaccugaccgucaccgaagaaaucgccgugcagaacuggcucgcccgcguggggcgggagcggcugagccgcauggcuauauccggcgaugacugcgucgugaagccccuggacgaccgcuuugcgagcgcccucacggcccugaacgacaugggcaagauccggaaggacauccagcagugggagcccucccgcggguggaacgauuggacccaggugcccuucugcucucaccauuuccacgagcugaucaugaaggacggccgaguccucguggugcccugccgcaaccaggacgagcugaucgggagagcccgcaucucccaaggagccgguuggagcuuacgggagaccgcgugucucggcaaauccuacgcccaaauguggagccuaauguacuuccaucgccgggaccuacgccucgcggccaaugccaucugcucggccguccccagccauugggucccuaccucccggaccacguggagcauccacgccaagcaugaauggaugaccaccgaggacaugcugaccguguggaaccgcgucuggauccaggagaaccccuggauggaggacaagacgcccgucgaguccugggaggagauccccuaccugggcaagagagaggaucaguggugcgggagccucaucggccugaccucucgcgcgaccugggcuaaaaacauccagguggccaucaaccagguccggucccugaucgggaacgaggaguacaccgacuauaugccgagcaugaagcgcuuccgccgagaggaggaagaggcaggcgugcucugguag

SEQ ID NO: 25134 - RNA, 9876 nt, Artificial Sequence
  derived and/or modified CDS sequence (opt11) from DENV-2__FJ639831__SS-prME
agcgcgggcaugaucaucaugcuaaucccgacagugauggcauuccacuugacgacccgcaauggagagccccacaugaucgugucuauacaggagaagggcaagagccugcuguucaagacugaggauggggugaacaugugcacccucauggcgauggaccuuggggaacugugcgaagauaccaucaccuacaagugcccccuccugcggcagaacgaacccgaggauaucgacugcuggugcaacuccaccagcaccugggugacguacgggacgugcaccaccaccggcgagcaccggagggagaagaggucggucgcccuggugccccacgugggaaugggucuggagacccggaccgagaccuggaugagcagcgagggcgccuggaagcacgcccaacgcaucgagacguggauccugcggcacccgggguucacgaucauggccgcgauccuggccuauaccaucggcaccacccacuuccaacgggccuuaaucuucauccugcugacggccgucgcgcccagcaugaccaugcggugcaucgguaucuccaaucgugacuucguggagggcgugagcgguggauccuggguugauaucgugcucgagcacggcagcugcgugaccaccauggcgaagaacaagcccacgcuggauuuugaacugauaaagaccgaggccaagcagcccgccacucuccggaaguauugcaucgaggccaagcugaccaacacgaccaccgagucccgcugccccacucagggggagcccucgcugaaggaggagcaggacaagcgguucguuugcaagcauuccaucguggaccgcggcuggggcaauggauguggccucuucgggaagggcggcauugugacaugcgcgauguucacguguaagaagaacauggaagguaaaaucguccagcccgagaaucuggaguacaccaucguggugacgccccacagcggugaggagcacgcugucgguaaugauacgggcaagcacgggaaggagaucaaggucaccccucaguccagcgugacggaggcugagcugaccggcuaugggaccgucacgauggagugcagccccagaaccggccucgacuucaacgaaaugguacugcugcaaauggagaacaaggccuggcuuguacaccgccagugguuccuggaccugccccuucccuggcugccgggcgccgauacccaggggucuaacuggauccagaaggaaacccuggucacguucaagaacccccaugcgaagaagcaggacgucguagugcucggaagccaggagggagccaugcauaccgcccugaccggcgcuacugagauccagaugaguagcggcaacuuacuguucacgggccaucugaagugccggcugagaauggacaagcuacaacucaaggggauguccuacagcaugugcacagggaaguucaagguggucaaggagaucgccgaaacacagcauggcacuaucgugauccggguacaguacgagggagacggcuccccuugcaagauucccuucgagaucauggaucuggagaagcgcuaugucuuaggcagacucaucacggugaauccgaucgugacggagaaggacagccccguaaacaucgaggcggagccgccguucggggauuccuacaucaucaucggcgucgagccggggcagcuaaaacucaacugguucaagaaggggagcaguauagggcagauguucgagaccaccaugcgcggcgccaagcgcauggccauccugggcgauacggcaugggacuucgggagccuaggcgggguguuuaccuccaucggcaaggcccuccaccaggucuucggggcgauauacggcgccgccuucaguggcgugucuuggaccaugaagauccugaucggggugaucaucaccuggauugggaugaacucacggucuacuagccuguccgucucucuggugcucgugggaaucguuacccuguaccugggcgugauggugcaggcagacuccgggugcguagucagcuggaagaacaaggagcucaagugcggcagcggcauauucaucaccgacaacgugcacacguggacggagcaguacaaguuccaacccgagucccccagcaaacuugcgucugcgauccagaaggcccaggaggaagggaucugcgguauacgcagcgucacccgacuggagaaccucauguggaagcagaucacgcccgaacuuaaccacauccuggccgagaacgaggugaaacucaccaucaugacuggggacaucaaggggaucaugcaagccgggaaacgcucucugcggccacagcccacagagcugaaguacucauggaagaccuggggcaaggcgaagauguuguccacagagucacauaaccagacguuccugaucgacggacccgagaccgccgagugccccaacaccaacagggccuggaacucccuggaaguggaagacuacggguuuggcgucuucaccacgaacaucuggcucaagcugaaggagaaacaggacgcguucugcgacagcaagcugauguccgccgcgaucaaggacaaucgggccgugcacgcugacaugggguacuggaucgagagcgcccucaacgacacguggaagaucgaaaaggccuccuucauugaggugaagaacugccacuggcccaagagccacacucugugguccaauggcgucuuggagagcgagaugaucauccccaagaacuuggcgggccccgugucgcagcacaacuaccgcccgggguaccacacccagaucgccggccccuggcaccugggcaagcuggagauggacuucgacuucugcgacggcaccacggugguggugaccgaggacugcgggaacagaggccccagccuccgcaccacaaccgccagcggcaaacugauuaccgaguggugcugccgguccugcacacugcccccacuccgguaucgcggggaggacggguguugguacgggauggagauacgcccucugaaggagaaggaggagaauuuagugaacagccucgucacagccggccacgggcagaucgacaacuucucccuuggcgugcugggcauggcccucuuccuggaggaaaugcugcggacgcgcguggggaccaagcacgccauccuccuggucgccgugagcuucguaacacugauuaccggcaacaugaguuucaaggaccucgggaggguugucguaauggucggcgccacgaugacugacgacaucgggaugggcgugaccuaccuggcccuccucgcggccuucaaaguucgccccaccuucgucgccggccuacuacuacggaaauuaacgagcaaggagcuuaugaugaccacaaucgggaucgugcuccugucccagagcaccaucccugaaacgauccuggaacuaacugaugcccuggcccugggcaugaugguacuuaaaaucguccgcgacauggagaaguaccagcuggcgguuacaaucauggccauccugugugucccgaacgccguuauccugcagaacgccuggaaaguuuccuguacuauccuggccgucgugagcgugagcccccuguugcugacgagcucccagcagaagaccgacuggaucccccuggcgcucaccaucaagggccugaaccccaccgccaucuucuugacgacccucagucgcacgaauaagaaacgguccuggccguugaacgaggccauaauggccgugggcaugguaagcauccucgcgaguagccuccugaagaacgacauccccaugaccgggccccugguggccggcggcuugcugacggucuguuacgugcugaccggucgcuccgccgaucuagagcuggagcgggccacagacgugaagugggaggaucaggccgagaucagcggcucgucccccauccugagcaucaccaucuccgaggacgggagcauguccaucaagaacgaggaggaggagcagacgcucacaauucugauacgaaccggacugcucgugauaagcggcuuguucccuguguccauccccaucaccgcggccgccugguaccugugggaggucaagaagcagcgggcugggguccucugggacguacccuccccaccgcccaugggcaaggccgaacuggaggacggggcguaccguaucaagcagaagggcgugcugggguacagucagauuggagccggugucuacaaggaggggaccuuccacacaauguggcacgugacccggggcgccgugcucaugcacaaggggaaaagaaucgaacccagcugggcagacgucaagaaggacuuaaucuccuacggcgggggcuggaagcuggagggcgaguggaaggaaggggaggagguccaggugcucgcucucgagcccggaaagaacccccgggcgguucagaccaagcccgggcuguucaagacgaacacggguaccaucggggccgugagccucgauuuuucccccggcaccagcggcucccccaucaucgacaagaaggguaagguagucggacuguacgggaacggcgugguaacgcgcucaggcgcauacgucuccgcaaucgcccagacggagaaguccaucgaggacaaccccgacaucgaggaugacauauuccggaagcgccggcugaccauuauggaccugcacccaggggcgggcaagacaaagcgcuaccuccccgccaucgugcgggaggccauaaagcgcgggcugcggacccugauccucgccccuacgcgcguggucgcggccgagauggaggaggcauuacggggccugcccauacgcuaucagacgcccgccauccgggccgagcacaccgggagagaaaucguggaccucaugugccacgcgaccuuuacgaugcgccugcuguccccaguucgggucccgaacuacaaccucaucaucauggacgaggcccacuucaccgacccugcaagcauugcugcccgcggcuacaucagcacccggguggagaugggggaagcggccgggauuuucaugaccgccacgccgcccggcucccgagacccguucccgcaaagcaacgcccccaucaucgaugaggagcgagagauccccgagcgcucuuggaauagcggacacgaguggguuaccgacuucaagggcaagacaguaugguucguuccauccaucaaagccggcaaugacaucgcggccugccuucggaagaacggcaagaaggugauccagcugucucgcaagaccuuugacuccgaguacgucaagacgcggaccaacgacugggacuucguggugaccaccgacauuagcgagaugggcgccaacuucaaggccgagcgcgucaucgaccccagacggugcaugaaaccugugauacucacggacggcgaggagcggguuauccuugcuggcccuaugccgguaacucacuccagcgccgcccaacgccggggacgcaucggccggaauccuaagaacgagaacgaccaguacaucuacaugggggagccccuggagaacgaugaggacugcgcccacuggaaggaggcaaagaugcuccuggacaacaucaacacccccgagggaaucaucccgucuauguucgagcccgagcgcgaaaagguagacgcaaucgauggcgaguaucggcugcgcggggaggcccgcaagacauucguagaccugaugcgucgaggcgaccuacccgucuggcuggccuauaagguugccgccgagggaauuaacuacgcagaccggcgcuggugcuucgacggcaucaagaacaaccagauccucgaagagaaugucgagguggagaucuggacgaaggagggggagcggaaaaagcugaaaccgcgcuggcucgacgcccggaucuacagcgacccccucgcccugaaggaguucaaggaguucgccgccggccgcaagucccuuacccucaaccugauuaccgagaugggucggcugcccaccuucaugacccaaaagacccgcgacgcacucgacaaccuggccgugcugcacacugccgaggccgggggccgggccuacaaccacgcacucagcgaacugcccgaaacccuggagacacuccugcuguugacccugcuggccaccguaaccggaggcaucuuccuauuccuuauguccggaagagggaucggcaagaugacccugggcaugugcuguauuauuacugccucuauacuucugugguacgcgcaaauccagccucacuggaucgcugccuccaucauccuggaguucuuucucaucgugcugcugauccccgaaccagaaaagcagcgcacgccgcaggauaaccagcucaccuacguggucaucgccauccugaccgucguggccgcgacgauggcgaacgaaaugggauuccuggagaagaccaagaaggaccucgggcugggcagcauaaccacccagcagccggaauccaacauacuggacaucgaccuucgucccgcgagcgccuggacgcuuuaugccguggcgaccaccuucgucacccccaugcugcggcacaguaucgagaacuccucuguuaacgucucccucacggcgaucgccaaucaggccaccgugcugaugggccuaggcaagggcuggccgcucagcaagauggacaucggggugccgcuucuggcaaucggcugcuacucccaggucaaccccaucacccuuacggccgcguuacugcuccugguugcccacuacgccaucaucgggccaggcuugcaggccaaggcgacgcgcgaagcccagaagcgggccgccgccggcauuaugaagaaccccaccgucgacgguaucaccgucaucgaccucgacccuaucccguacgaccccaaguucgaaaagcagcucggucaggugaugcugcucgugcugugcgucacccaggugcugaugaugcgcacuaccugggccaugugcgaggcacucacucuggccaccgggcccaucagcacgcugugggagggcaauccggggcgcuucuggaacacaaccaucgccgugucuauggccaacaucuuccggggcagcuaccuggcgggugccgggcugcuguucaguaucaugaagaacacaacuaacacacggcgcggcaccggcaacaucggcgagacccuaggagagaaguggaagucccgacugaacgcccuggggaaauccgaguuccagaucuacaaaaaguccggaauccaggaagucgaccgaacgcuagcaaaggaggggaucaagcgaggcgagaccgaccaccaugccguuucccgggggagcgcgaagcucaggugguuugucgagcggaacauggucacccccgagggcaaagugguggaccugggaugcgggcguggcgggugguccuacuacugcggcgggcucaagaacguccgagaggugaaaggacugaccaagggagggcccggccacgaagaacccauuccgaugagcacguauggguggaacuuaguacgccuccaaagcggcgucgacguguucuuuaucccgcccgagaagugcgacacccugcugugcgauaucggcgagagcucccccaacccgaccguggaggccggccguacccuccgcguccugaaccugguugagaacugguuaaacaacaacacccaguucugcauaaaagugcugaaccccuacaugcccagcgucaucgagaagauggagacgcugcagcggaaauacggcggggcccuggugcgcaacccauuaagccguaacuccacccacgagauguacugggucagcaacgccuccggcaauaucgucagcuccguaaauaugaucagccgcaugcugauuaaccguuucaccaugcgacacaagaaaaccacguaugagcccgacguggaucuaggguccgggaccaggaacaucgggaucgagagcgaaauacccaaucucgacaucaucggcaagcgcaucgagaagaucaagcaggagcaugagacuuccuggcacuacgaccaggaccaccccuacaaaaccugggcguaccacggcagcuacgagacgaagcaaaccggguccgccagcuccauggugaacgguguggugcggcugcugaccaaaccaugggacguccuccccaccgugacgcagauggcaaugaccgacaccacccccuucgggcagcagcgcguguuuaaggagaaggucgacacgcgcacccaggagcccaaggaggguacaaagaagcugaugaaaauuaccgccgaguggcuguggaaggagcucggcaagaaaaagacgccgcggaugugcacccgcgaggaguucacccggaaggugcgcagcaacgcggcgcugggagccaucuucaccgacgaaaacaaguggaagucugcccgggaggccgucgaggacucccgcuucugggaacugguggauaaggagcggaagcuccaccuggagggaaagugcgaaacaugcguguacaauaugauggggaagcgagagaagaagcugggcgaguucgggaaagccaagggcucacgggccaucugguacauguggcugggggcccgcuuccuggaguucgaggcccugggguuccucaacgaggaccacugguucucacgcgagaacucccugaguggcgucgaaggggagggcuuacacaagcucggguacauccugcgcgaugugagcaagaaggaagggggcgccauguaugccgacgacacagccgggugggacacgcggaucacgcuggaggaccucaagaacgaggagauggugacgaaccacauggaaggcgaacacaagaagcuggcagaagccauauucaagcugaccuaucagaacaaggucgugcgcguacaacgucccacgccccgggggaccgucauggacaucaucucccggcgcgaccaacgaggcagcggccagguggguacguauggccucaacaccuucaccaacauggaagcccagcuuauccgccagauggagggggagggcguguucaagaacauucagcaucugaccguuaccgaggagauugcugugcagaacuggcucgcccggguggggcgcgagcgccugucccggauggccaucucuggcgacgacugcgucgugaagccacuagacgaccguuucgcuuccgcccucacugcgcugaacgauaugggcaagauacggaaggacauccagcagugggagccgagccgcggauggaaugacuggacgcagguucccuucugcucccaucacuuccacgaacugaucaugaaggauggccgagugcucguggugcccugccgcaaccaggacgagcugaucgguagggcccggaucagucagggcgccggguggucccugcgggaaacggcuugccuaggcaagucguacgcacagauguggucccucaucuacuuccaccgccgggaccugcgccucgccgccaacgccaucugcucugccguccccucccacugggugccgacgagccggacgacguggucgauccacgccaagcaugaguggaugaccacagaagacaugcugacuguauggaaccgggucuggauucaggagaaccccuggauggaggauaagacacccgucgaaaguugggaggagauccccuaccuggggaagcgggaggaucagugguguggaucccuuauaggccugaccagccgcgcuacgugggccaagaacauccagaccgcuaucaaccaggugcggagccugaucgggaacgaggaguacaccgacuacaugccauccaugaagcguuuccggcgcgaggaggaggaggccggcgugcucugguga

SEQ ID NO: 25135 - RNA, 9876 nt, Artificial Sequence
  derived and/or modified CDS sequence (opt11) from DENV-2__FJ639832__SS-prME
agcgccggcaugaucauaaugcugaucccaacagugauggcguuccacuuaacaacccguaauggagagccucacaugauugucgggauucaggaaaaggggaagucuuuacuguucaaaacagaggacggugugaauaugugcacacucauggcaauggaccuaggggagcugugcgaagacaccaucaccuacaaguguccccucuugagacaaaacgaacccgaggacauagauugcuggugcaacaguaccagcaccugggugaccuaugggaccugcaccaccacuggggaacaccgccgagagaaacgaagcguggcccuagucccccacguaggaaugggccuugagacccggacugagacauggauguccagcgaaggagccuggaaacacgcccaacguauugagacguggauccugcggcacccgggguucacgaucauggccgcaauccuagcguacacaaucggcacaacccacuuccagcgggucuuaauuuucauacuguugacggccgucgccccguccaugaccaugcggugcaucgggaucuccaauagggacuuuguggagggcgucuccggaggcagcuggguugacaucguguuagagcauggguccugcgucaccacgauggcuaagaauaagcccacgcuagacuucgaacuuaucaaaaccgaagcuaagcagcccgccaccuuacggaaguauugcaucgaagcgaagcuuaccaauacgaccacggagagccgcugucccacccagggcgagccuucucuaaaggaagagcaggacaagagauucgugugcaagcacagcaugguggaccgaggcuggggcaacggcugcggccuguucgggaagggagguauuguaaccugugcuauguuuacguguaagaagaacauggaaggcaaaauagugcagcccgagaaccucgaguacaccaucguggucacgccacacucgggugaggagcacgcugugggcaaugacacggggaagcauggcaaggaaaucaaggugacuccccagagcucgaucaccgaggccgaauugacggguuacggcaccgucacaauggagugcagcccucggacugggcucgauuucaaugagaugguguugcugcagauggagaacaaggccugguuagugcaccgccagugguuccuugaccugccgcuaccaugguuaccaggagcagauaagcaggagucuaauuggauucagaaagagacccuagugaccuucaagaacccucacgccaaaaagcaggacgucgucguucucggaagucaggagggcgcaaugcauacugcccugaccggcgccacugagauccagaugagcucagggaaccuccuuuuuaccggucaucugaagugcagacuccgcauggacaaacuccagcugaagggaaugagcuacuccaugugcacagggaaauuuaagguggucaaggagaucgcugagacccagcacggcaccaucgugaucagaguucaguaugagggggauggcaguccaugcaagauccccuucgaaauaauggaccuggaaaagagguacguccucggccgguugaucacagugaacccaaucgugacggagaaggacagcccggugaacaucgaggcggagccgccguucggggacagcuauaucaucaucggcguggaaccagggcagcuaaagcuaaacugguuuaaaaagggcucgagcaucggucaaauguucgagaccaccaugcguggcgcaaaacgcauggccauccugggcgacaccgccugggacuucgggucccugggcgguguguucacgagcauaggcaaagcccuacaccaaguuuuuggcgcuaucuacggugcggcuuucuccggcgugucguggaccaugaagauccuuaucggcgugaucaucaccuggaucggcaugaacucgcguagcaccucccuuagcgucucacugguccuuguggguauaguuacacuguaccuaggcgugauggugcaggcggauagugggugugucguguccuggaaaaacaaggagcuaaaguguggcagcggcaucuucaucaccgacaacgugcacaccuggacggaacaguauaaauuccagcccgagagccccucaaagcucgcgucggcaauccaaaaggcucaggaggaggggauaugcggcauacgguccguuacgcgccuggagaaccucauguggaagcaaaucacgcccgagcucaaccacauccuggccgagaacgaggugaaacuaaccaucaugaccggggacaucaagggaauuaugcaggccgggaagagaucccugcggccucaacccaccgaauuaaaguauaguuggaagaccuggggcaaggccaagaugcugagcaccgaaucuuacaaccagacauuucucauagacggucccgagacggcugagugcccuaacacgaaccgcgccuggaauucccuggaaguagaggacuauggcuuuggaguguucaccaccaacauaugguugaaguuaaaggagaagcaggacgccuucugcgauuccaagcugaugagcgcggcgaucaaggacaaccgggccgugcaugccgauaugggguacuggaucgagucggccuugaacgacacauggaaaaucgagaaagccagcuucaucgaaguuaagaacugucacuggccuaagucucacacgcugugguccaacggugugcuggaaagcgagaugauaauccccaagaaccucgccggcccaguaagccagcacaacuaucgcccgggguaccacacgcagaucgcggggccguggcaucuggggaaguuggagauggauuucgacuucugugacgggacaaccgugaucgucacggaggacuguggcaaucggggcccgucucuccguacuaccaccgcuucaggaaagcugauaacggagugguguugccggaguugcaccuuaccgccgcuacguuaccgcggggaagacggcugcugguaugggauggagauucgcccccugaaggagaaggaggagaaccuagugaacagucucguuaccgccggccacgggcaggucgacaacuucagccugggcgugcugggcauggcccucuuccucgaggagaugcugcguacccgcguuggaacgaaacacgccauccuccuggucgccguguccuuugugacguuaaucacuggcaacaugucauucaaggacuuagggagagucguggugauggucggcgcgacuauggcagacgacaucgggauggguguaacauacuuggcccuucucgcagccuucaaagugcgccccacguuugcagccggucugcugcuccggaaguugaccuccaaggaauugaugaugaccacgaucgggaucguacuacucucgcaaucuaccauuccagaaaccguguuggaacucaccgacgcacuggcgcugggaaugauggugcucaaaauaguucgcaacauggagaaguaccaacuggccgugacuaucauggccauucuaugcgugccgaacgccgugauccuccagaaugcauggaaggucagcuguacaauacuggcugucguguccguuuccccccugcuccugaccuccagccagcagaagaccgacuggauaccucuggcccugacgaucaagggguuaaacccgaccgccauuuuuuugaccacccuguccaggacgaacaagaagcggucguggccccugaaugaagccaucauggccgucggcauggucuccauccuggccagcucgcucuugaagaaugacauacccaugacgggcccccugguggccgggggccuucugaccgucuguuaugugcugacugggcguagugcagaccucgagcuugaacgggccacggacgugaaaugggaggaccaggccgagaucuccgguagcagccccauccuguccaucacuauaagcgaggacggguccaugagcaucaaaaacgaagaggaggagcaaacucugaccauuuugauccgcaccggauuguuagucauuaguggccuauuuccuaucagcauccccauuaccgccgcugccugguaccucugggaagugaaaaaacagcgggcggggguucucugggacgugcccuccccgccuccgaugggcaaggcggagcuggaagacggggccuaccgcaucaaacaaaaaggcauccugggguauucacagauaggggcuggcguguacaaggaggggaccuuccauaccauguggcacgugacccggggagcaguccucaugcauaagggcaagcgcaucgagcccucgugggccgacgugaagaaggaccuuauuaguuacggcgggggcuggaagcuggagggcgaauggaaagagggggaagaggugcaaguacuggcucuggaaccuggcaagaauccccgggcagugcagacgaagccagggcuguucaaaacgaacaccggcaccauuggggcugugagcuuggacuuuucucccggcacauccggcagccccauaauagauaagaaaggcaaggucgugggccuguaugggaacggagugguuacacguuccggcgccuacgugagcgccaucgcacagaccgagaagagcaucgaggauaaccccgaaaucgaggaugauaucuucagaaagagacgucugaccaucauggacuugcaucccggugcuggaaaaacgaagcguuacuuacccgccaucgucagggaggccaucaagcgcggccuacggacccugauccucgcaccgacacgagucguggcugccgagauggaggaagcccuccguggucugccgauucgcuaccagacccccgccauacgggcagagcacacggggcgcgagauaguggaccucaugugccacgccaccuucaccaugcgucuguugagcccgguucgggugccaaacuacaacuuaauaaucauggaugaggcccauuuuaccgaccccgcgucuauagccgcccgcggcuauaucuccacgcggguggagaugggcgaagccgcugggaucuucaugaccgcuacaccccccgguagccgggaccccuucccgcaguccaacgcucccauuaucgacgaagagcgggaaauacccgagcgcucguggaacucagggcacgaauggguaacagacuuuaaaggcaaaaccgugugguucgugccuagcaucaaggcuggcaaugacaucgccgccugccuuagaaaaaauggcaaaaaagucauucagcugucccggaaaacauucgacucagaguaugugaagacccggacuaacgauugggacuucgugguuacgacggacaucucggagaugggggcaaacuucaaggcggaacggguaauugacccccgccgcugcaugaagcccgugauccucacugacggugaagagaggguaauucuggcgggacccaugccagucacccauagcucagccgcccagaggcgcggacggaucggccggaauccgaagaacgagaacgaccaguacauauacaugggggagccccuugagaaugaugaggacugcgcccacuggaaagaggccaagaugcugcuggacaauauaaacacgccugagggcaucaucccgaguauguuugagcccgagcgagagaaaguggacgccauagacggcgaguaccggcugcgcggggaggcccggaagacguucguugaccucaugaggagaggcgaccugccuguguggcuggccuacaagguggccgcugaggguauuaauuacgccgaccgucgcuggugcuucgacgguaucaagaacaaccagauucucgaggagaacgucgagguugaaauauggaccaaagagggggagcggaagaagcugaagccucgcuggcuggacgcaagaauauauuccgauccccuagcuuugaaggaauuuaaggaauucgccgcgggccgcaagucacucacguuaaaccugaucacagagaugggccgacugcccaccuucaugacccaaaagacccgcgaugcacuggacaaccucgccguccuacacacagccgaagcgggcgggcgggcuuauaaccaugcccucagugagcugccugaaacguuagagacgcucuugcugcucacccugcuugccaccgugaccggggggauuuuuuuguuccucaugaguggccgugggaucgggaagaugacccuugggauguguuguaucauuaccgccuccauccugcugugguaugcgcagauacagccacauuggaucgccgccagcauaauccuugaauucuuccucaucguacugcugauccccgaacccgagaagcagaggacuccucaggacaaccaacuaacguacgugguuauugcuauucuuaccgugguggcggcgaccauggccaacgaaaugggguuccuggagaagaccaagaaggaccuggggcugggcuccaucgcaacgcagcagccggagagcaauauccuggacauagaccuucgaccggccucagccuggacucuguacgcugucgccacgacauucguaacccccaugcugcggcacagcauugagaauagcucugucaaugugucacucaccgcaaucgcuaaucaagccacagugcuuaugggacuggggaagggcuggccccuaaguaaaauggauaucggggucccgcuccuggcgaucggcugcuacagccaggugaaccccaucacccugacagcugcccuucugcuccuggucgcgcacuaugcgaucauagggccugggcugcaggccaaggccacccgcgaggcgcagaagcgggccgccgcuggaaucaugaagaauccaaccgucgacggcauaaccgugaucgaccuugacccgauccccuacgacccaaaguucgagaagcagcuagggcaaguuaugcugcugauucugugugucacucaagugcugaugaugcguacgaccugggcccucugugaggcccuaacccuggcaacggggcccauaucuacgcucugggagggcaacccuggccgcuucuggaacacaaccaucgcgguuucuauggccaauaucuuccgcgggucauaccuggccggcgcugggcuucuauucaguauaaugaagaacacgaccaauacccggaggggcacggggaacaucggggaaacuuuaggcgaaaaauggaagagcagacugaacgcacuagggaaguccgaguuccaaauuuacaaaaaguccggcauccaagaggucgaccggacccuggcgaaagaggggaucaagcggggcgaaaccgaccaccaugcgguaucccgugguucggcaaagcugcgcugguuuguggagcggaacaugguuacccccgagggcaaaguuguggaucuugguugugguagaggcgggugguccuacuacugcgggggucugaagaauguccgggagguaaaggggcugacuaaaggcgggcccggucacgaggaaccaauaccuaugaguacuuacggguggaaucucgugcgucugcagagcggcguggacguauucuucaucccccccgagaagugcgacacccuucucugugacauuggggagucuagccccaacccgacuguggaagccggucgcacgcugcgcguccuuaaccucguggagaacuggcugaauaacaauacccaguucugcauaaaaguguugaaccccuauaugccuagugucauagagaaaauggaggcgcuucagcggaaguacgguggggcacucgugaggaauccucucagcaggaacagcacacacgagauguauuggguuuccaacgcgagcggcaacauuguaucuagcgugaacaugaucagucgaaugcugaucaaccgcuuuacaaugcgacacaagaaagccacuuacgaacccgacguggaccuaggaagcggaacgcgaaacauuggcaucgagagcgaaguccccaaccuggacaucauaggcaaacgcaucgaaaaaauaaagcaggagcacgagacaaguuggcacuacgaucaggaccaccccuacaagaccugggccuaucacggcaguuacgagacuaaacagacggggucggcuucaagcauggugaacggcgugguccggcugcucaccaaaccgugggacgugcugcccaccguuacccagauggccaugacggacaccacccccuucgggcagcaacggguuuucaaggagaagguagacacccgcacacaggagccuaaagagggcacgaagaagcugaugaagaucaccgcagagugguuauggaaggagcuggggaagaaaaagacgccacggaugugcacgagagaggaguucacgcggaaaguccgcucuaacgcugcccucggggcgaucuucaccgacgagaacaaguggaagucagcucgcgaggccguggaggacagccgauucugggagcuuguggacaaagagcgcaaucugcaccuggaggggaagugugagacaugcgucuacaacaugauggggaagcgcgaaaagaaauugggcgaguucgggaaggcgaaaggcucccgggccaucugguacauguggcucggcgcgcgcuuucuagaguucgaggcgcuagguuuccuaaacgaggaccacugguucucccgggagaacucccuguccggcguggagggggaaggccuccacaaguuaggguacauacuccgggacgugagcaagaaagaggguggggccauguacgccgaugauacggcuggaugggacacaaggaucacguuggaggaccuaaagaacgaggagauggucacgaaucacauggaaggggagcauaaaaaacuggccgaggccaucuucaagcucacguaccagaacaagguagugcgcguccagcggccgacgccccgggggacagugauggacaucauuagccgccgagaccaacguggcuccggacagguggggaccuacgggcugaauacguuuacuaacauggaagcgcagcugauccgccaaauggagggggagggagucuucaaaaacauccaacauuuaacugucacagaggaaguggccguccagaacuggcucgcccggguggggcgcgaaaggcugucucgaauggccaucuccggggacgacuguguggucaagccacucgacgaccgcuucgccaacgccuugaccgcgcugaacgacaugggcaagauaaggaaggacauccaacagugggagccuagcaagggcuggaaugacuggacucaggucccauuuugcagccaucacuuccacgagcucauaaugaaagauggccgaguguuagucgugcccugccggaaccaggacgagcugaucgggcgcgcgcggauuagccagggcgcagguugguccuugcgugaaacagcuugucugggcaagagcuacgcccagauguggucucuaauguacuuccacagacgcgaccucagacuagcagccaacgcuauaugcucagccgugccgagccacugggugccgaccagccgcacgaccuggucaauacacgccaagcaugaauggaugacgacagaggacaugcugaccguauggaaccgaguguggaucagagagaaccccuggauggaggacaaaacgccuguggagagcugggaggaaauacccuaccuugggaagcgggaggaccaguggugcgguagccugauagggcuaacgagccgcgcaaccugggcuaaaaacauccaggcggccaucaaccaggugcgaucccucauugggaacgaggaguacaccgauuacaugccgagcaugaagcgguuccggcgcgaggaggaggaagccggcguucugugguga

SEQ ID NO: 25136 - RNA, 9876 nt, Artificial Sequence
  derived and/or modified CDS sequence (opt11) from DENV-2__FJ687434__SS-prME
agcgugggcaugauaauaauguuaauacccaccgucauggccuuccauuuaaccacccgcaauggggagccccacaugaucgucuccauccaggagaagggcaagagccugcuuuucaagaccgaggacggcgugaacaugugcacccucauggccauggaccugggcgaacugugcgaggacaccaucaccuacaagugcccccuccugcgucagaacgaacccgaggacaucgacugcugguguaacuccaccagcaccugggucaccuacgggacgugcaccaccaccggcgagcaccgaagagaaaagcgcuccguggcgcuggucccucacgucgguauggggcuagaaacgaggaccgagaccuggaugagcuccgaaggcgccuggaagcacgcccagcgcauagagaccuggauccuacgccacccgggguucacgaucauggcugccaucuuagcguacaccaucggcaccacccacuuccagcgcacgcucaucuucauccugcugaccgccgucgcccccagcaugaccaugcggugcaucgggaucuccaaccgcgacuucguggagggcguuagcggcggguccuggguggauaucguccucgaacacggcagcugcgugaccacgauggccaagaacaagcccacccuggacuucgagcugaucaagacagaggcgaaacagcccgccacccuccggaaauacugcauagaggcccgucugacgaacaccaccaccgagucccguugccccacgcagggggagcccagucuuaaggaggagcaggacaagcgcuucgugugcaagcacagcauggucgaccggggguggggcaacgggugcggccucuucgggaagggcgggauugugaccugcgccauguucaccuguaagaagaacauggagggcaagaucguccagcccgagaaccuggaguacaccaucguggucacgccccacagcggcgaggagcaugccgucgggaacgacaccggcaaacacgggaaggagaucaaggugaccccgcagaguagcaucaccgaggcagagcugaccggcuacggaacggucaccauggaaugcagcccaagaaccagccuggauuucaaugagauggugcuccugcagauggagaauaaggccuggcucgugcaucggcagugguuccuggaccugccccuccccuggcugccaggcgccgacacccagggcagcaacuggauucagaaggagacgcuggucacauucaagaacccccacgccaagaagcaggacgucgucguccucgggucccaggagggcgccaugcacaccgcgcugacgggggccacggagauccagaugagcuccggcaaccuucuguuuaccgggcaccuaaagugccgccuucggauggacaagcuccaacugaagggcaugucauacuccaugugcaccggcaaguucaaggugguaaaggagaucgccgaaacgcagcacgggacgaucgugauccgcguccaguacgagggcgacggaagccccuguaagauccccuucgagaucauggacuuagagaagcgguauguccucggccgccuaaucaccgugaacccgauugugacggagaaggacuccccugucaacaucgaggccgagccgcccuucggcgacagcuacaucaucaucgggguggagccgggccagcugaagcucaacugguuuaaaaaggggagcagcaucggccagauguucgagaccacgaugcgcggggcgaagagaauggcgauccugggcgacaccgccugggacuucgggucccucggcgggguguuuaccagcaucggcaaggcccuccaucaggucuucggugcgaucuacggggccgcuuucuccggcguaagcuggaccaugaagauccugaucggcgugaucaucaccuggaucggaaugaacucccgcagcaccucucugucugucucgcuggugcucgugggcgucgugacccuguaucugggggugaugguccaggccgacagcggcugcguagugagcuggaagaacaaggagcucaagugcgggaguggcauauucaucacagacaacguccacacauggacggagcaguacaaguuccagccugagagccccuccaagcuggccucugccauucagaaggcgcaggaggaggguaucugcgggauccgguccgugacccgcuuggagaaccucauguggaagcagaucacccccgaacugaaccacaucuuggccgagaacgaggugaagcucacgaucaugacgggcgacaucaaggggaucaugcaagccggcaagcggagccugcgcccgcagcccaccgagcugaaguacucguggaagaccuggggaaaggccaaaaugcucagcacggagucccacaaccagaccuuccugauugacggccccgagaccgccgaaugcccgaacaccaaccgggcguggaacagcuuagaggucgaggacuacggcuucggcguguucacgaccaacaucuggcugaaguugaaggagaagcaggacgcguucugcgacuccaagcugaugagcgccgccaucaaggacaaccgcgccgugcacgcugauaugggauacuggaucgaguccgcccuuaacgacacguggaagaucgagaaggcuagcuucaucgaggugaagaacugucacuggccgaagucccacacccuuuggucaaacggggugcuggaguccgagaugauuauccccaagaaccucgccggcccugugagccagcacaacuaccggcccggcuaccacacccagaucgccgggcccuggcaccugggcaagcuagagauggacuucgacuucugcgaugggacgaccgucguggugaccgaggacugcggcaaccgugggcccucccugcggaccacgaccgcguccgggaagcugauaacagaguggugcugccgcagcugcacccugcccccgcuccguuaccggggcgaggacgggugcugguacggcauggagauccggccccugaaggagaaagaggagaacuuagucaacucccucgugacagccgggcacggccaggucgacaacuucagccuggggguccugggcauggcccucuucuuggaggagaugcugcgcacccggguggggaccaagcacgccauccuccugguggcggugucauucgugacccugaucacggggaacaugagcuucaaggaccucggccggguggucguuauggucggggccacuaugacggacgacaucggcaugggugucaccuaccuggcccugcucgccgcuuucaaggugcggcccacguucgcggcgggacugcugcuccgcaagcuaaccuccaaggagcugaugaugaccaccaucgggaucguguuacugagccaguccacgaucccagaaaccauccuggagcucaccgacgcauuagcacuggggaugaugguccucaagauggugcgcgacauggagaaguaccagcuggccgucaccaucauggcgauccugugcgugcccaacgccgugauccuccagaacgccuggaaggucagcugcacgauccuggccgugguguccgucagcccccuccuccugaccuccucccagcagaagacagacuggauaccccuggcccuaacgaucaagggucugaaucccacggcuaucuuucugaccacccucuccagaacaaacaaaaagcgcagcuggccguuaaacgaggcgaucauggcgguggggauggugucgauccuugccagcucccucuugaagaacgauaucccaaugacggguccccuggucgcgggcgggcuccugaccguaugcuacgugcuaaccggccggagcgcggaccucgagcuagagcgcgccacugacgucaagugggaggaucaggcggagaucagcggauccagccccauccucucaaucacuaucuccgaggacggcuccaugagcaucaagaacgaggaggaggagcagacccucaccauucugauccggacugggcuguuggugaucaguggucuguucccggugagcauacccaucaccgcugcagccugguaccugugggaagucaagaagcagagggccggcguucucugggacgugcccagcccaccgcccauggggaaggccgagcuagaagacggugccuaccggaucaagcagcgcgggauccugggcuacagccaaauuggggcaggugucuacaaggagggcacguuccauaccauguggcauguaaccagaggggcugugcucaugcacaagggcaagcgcaucgagccguccugggccgacgucaagaaggaccugaucagcuacggggguggguggaagcuggagggcgaguggaaggagggcgaggagguucaggugcucgcccuggagcccggcaaaaacccccgggccgugcaaaccaagccaggccuguucaagacgaacaccgggaccaucggcgcggucucucucgacuucagcccggggaccuccggcagccccaucauugacaagaagggcaagguugucgggcuguauggcaacggaguggugacgcgcuccggcgccuacguuagcgcaaucgcccagaccgagaagagcauagaggacaaccccgacaucgaggacgacauauuccggaagcgccggcugaccauaauggaccugcaccccggcgccggcaagaccaagcgcuaccugcccgcgaucgugcgggaggccaucaagcgcggccugcggacgcugauccucgccccgacccgcgugguggcagcggagauggaggaggcccugcgggggcugcccaucagguaccaaacccccgccauccgggccgagcacaccggccgggagaucguagaccucaugugccacgccacguucaccaugcgccugcugagcccaguucgggucccgaacuacaaccucaucaucauggacgaggcgcauuucacggaccccgccagcaucgccgcccgcggguacaucuccacacggguggaaaugggcgaggccgcggggaucuucaugacggccacgccgcccgggagccgcgacccguucccccagucgaacgcccccaucauagaugaagagcgggagauccccgagcgcagcuggaacuccggucacgaguggguuaccgacuucaaggguaagaccguuugguuugugccgagcauuaaggcaggcaacgacauagccgcgugccugcguaagaacgggaagaaggucauccagcugucccgcaagacguucgacucugaguaugucaagacccggaccaacgacugggauuucguggugaccacggacaucuccgagaugggcgccaacuucaaggccgaaagagucaucgaccccagacgcugcaugaagcccgugauccucaccgacggcgaggagagggugauacuggccgggcccaugccuguuacccacagcucggcggcccagcgccggggcaggaucgggaggaaccccaagaacgagaacgaccaguacaucuacaugggugagccccuggagaacgacgaagacugcgcccacuggaaggaggccaagaugcuccuggacaacaucaacacacccgaggggaucaucccgagcauguucgagcccgagagggagaaagucgaugccaucgacggcgaguaccgccugcggggcgaggcgcgcaagacguucguagaccucaugcgacgaggggauuugccugucuggcuggccuacaagguggcggccgagggcaucaacuaugcagaccggcgcuggugcuucgaugggauuaagaacaaccagaucuuagaggagaacgucgaggucgaaaucuggaccaaggagggagagaggaagaagcugaagccgcgcuggcucgacgcgcggaucuacuccgauccccucgcccugaaggaguuuaaggaguucgccgccgggcgcaagagccugacccucaaccugaucaccgagaugggccgacugcccacguucaugacccagaagacacgugacgcccucgacaaccuggcgguacugcacaccgccgaggccggcgggcgggccuauaaccaugcgcucuccgagcugcccgagacacuugagacccuccugcugcucacccugcuggccaccgucaccggcgguaucuuccucuuccugaugagcggccgcggcaucgggaagaugacgcugggcaugugcuguaucguaaccgcauccauccuccugugguaugcccagauccagccgcacuggauagccgcgucaauuauccuggaguucuuccucauuguguuauuaauccccgagcccgagaagcagcggaccccccaggacaaccaguugacuuacgucgugaucgccauccugacggugguugcggccaccauggcaaacgagaugggguuccuggagaagaccaaaaaggaccucggucuaggcuccauagccacccagcagccggagagcaacaucuuggacaucgaccuccgacccgccagcgccuggacgcuauacgcuguggccaccacuuucgucaccccaaugcugcggcacuccauugagaacagcuccgucaacgugagccucacggccauugccaaucaggccaccgugcugaugggucucggcaagggcuggccccucagcaagauggacaucggcgccccgcugcuggccauugggugcuacagccaggucaaccccaucacccucacggccgccuugcugcuccuaguggcccacuacgccauuaucggccccggguugcaggccaaagcgacgcgagaagcccagaaacgggccgccgcgggcaucaugaagaaccccaccguggacggcaucaccgucaucgaccucgacccgauccccuacgaccccaaguucgagaaacagcuugggcaggccaugcugcucgugcugugcgugacccagguccugaugaugcgcacgaccugggcacucugcgaggcccugacccuagccaccggacccaucaguacgcucugggaggggaacccgggccgguucuggaacaccaccaucgcggugagcauggcuaacaucuuccgcggguccuaccuggcgggcgccggccuccuguucagcauaaugaagaacaccaccaacucucgucgggggaccggcaacaucggagagacccugggcgagaaauggaagucccgccugaacgcccucggcaaguccgaguuccagaucuacaagaagucagggauccaggaaguggaccggaccuuggcgaaggagggcauuaagcgcggggagacggaccaccacgccgucucacggggaagcgcaaaguuacgaugguucguggagagaaacauggugacucccgaggggaaggucguggaccucgguugcggccgcgggggcugguccuacuacugcgggggccuuaagaacgugcgggaggucaaaggucugacuaagggggggccggggcacgaggagcccaucccgaugagcaccuacggcuggaaccucgugcgccugcagagugggguggacgucuucuuuaucccccccgagaaaugcgacacguuacucugcgacaucggcgagagcagcccaaacccgaccguggaggccgggcggacccugcgcgugcugaaccuggucgagaacuggcugaacaacaacacacaguuuugcaucaagguacugaaccccuacaugcccuccgugaucgagaaaauggagaccuugcagagaaaguacgguggagcgcucgucagaaacccgcugagccggaacuccacccacgagauguacugggugagcaaugcauccgggaacauugugagcuccgucaacaugaucucucgcaugcugaucaaccgguucaccaugcgccacaagaaggcaaccuacgagccggacguagaucucggcuccgguacccggaacaucggcaucgagagcgagauccccaaccuggacauuaucgggaagcggaucgagaagaucaagcaggagcacgaaacguccuggcacuacgaccaggaccaucccuacaagacaugggcauaccacggcucuuacgagaccaagcagaccggcuccgccagcuccauggugaacggggucgugcgccugcucacgaagccgugggacguucugcccaccguaacccagauggcgaugacagacaccacccccuucggccagcagcggguguucaaggagaagguagacacccgcacccaggagcccaaggaggggacuaagaagcugaugaaaaucaccgcggaguggcucuggaaggagcugggcaagaagaagaccccgcguaugugcacccgcgaggaguucacgcggaaaguccgcagcaacgccgcccugggggcgaucuucacggacgagaacaaguggaaguccgcacgggaagcuguggaggacagccgcuucugggagcucguagauaaggagcgcaaccugcacuuagaggggaagugcgagaccugcguguacaacaugauggggaagcgcgagaagaaguugggggaguucggcaaggcuaaggggucccgggccaucugguacaugugguuaggcgcucgcuuccuggaauucgaggcgcugggcuuccucaacgaggaccacugguucagccgggagaacagccuguccgggguggaaggcgaagggcuccacaagcugggcuauauccugcgcgaugugagcaagaaggaaggcggggccauguacgccgacgacaccgccgggugggacacuaggaucacccucgaagaucugaagaacgaggagauggugaccaaccacauggagggggagcauaagaagcucgcggaggcgaucuucaagcucaccuaccagaacaagguuguacgcgugcagcggcccaccccccgcggcaccgugauggacaucaucucccggagggaccagcggggcagcggccaggucgggaccuacgggcugaacaccuucacgaacauggaggcccagcugauccgccagauggaaggggaggguguauucaagaacauccagcacuugaccgugacugaggagaucgccguccaaaacuggcuggcacgcgugggccgggagcgccugucccggauggcgaucagcggggacgacugcguggucaagccccucgacgaccgcuucgcuuccgcccugaccgcccugaacgauauggggaagauacgcaaggacauccaacagugggagccgagccgcggcuggaacgacuggacucaggugcccuucugcucgcaucauuuccacgaguuaaucaugaaggacgggcgggugcuugucguacccugucgcaaucaggacgagcugaucggccgagcccggaucagccagggggcgggcuggucccuccgggagaccgccugucuggggaagucguacgcccagauguggucccugauguacuuucaccgccgcgaccuccgccuggccgccaacgcaaucugcagcgccgugccuucgcacugggucccgaccagcagaaccaccugguccauccacgccaagcacgaguggaugacgaccgaggacaugcugaccguguggaaucgaguauggauccaggagaacccauggauggaggacaagacacccguggagaguugggaggagauccccuaccucggcaagagggaggaccaguggugcggcucgcugaucggccugacgucgcgcgccaccugggccaagaacauccaggcggccaucaaccagguucggagccucaucggcaaugaagaguacaccgacuacaugccguccaugaagcgcuuucgacgggaggaggaggaagccggggugcugugguaa

SEQ ID NO: 25137 - RNA, 9876 nt, Artificial Sequence
  derived and/or modified CDS sequence (opt11) from DENV-2__FJ687439__SS-prME
ucagccgggaugaucaucaugcuuauucccaccgugauggccuuucaucuuaccacacgcaacggggagccccacaugaucguaggcauacaggagaaaggcaagagccuguuauucaaaacugaggacggcgugaacaugugcacccucauggcgauggaucuuggugagcugugcgaggacaccaucacguacaagugcccccuccuacgacagaacgaacccgaggacaucgacugcuggugcaacagcacauccacuugggugaccuacgggaccugcaccaccacgggcgagcaccgccgggagaagcgcagcguugcccuugugccccacguggggaugggcuuggagacccggaccgagaccuggauguccagcgagggggccuggaagcacgcccagcgcaucgagaccuggauccugcggcaccccggcuucacgauuauggccgcgaucuuagcuuacaccaucgggaccacccauuuccagcgcgcccucaucuucaucuugcugacggcgguugcccccuccaugaccaugcggugcaucggcaucagcaaucgcgauuucguggagggcguguccgggggcagcuggguugacaucgugcucgagcacggaaguugugugacaaccauggccaaaaauaaacccacguuggacuucgaacugaucaaaaccgaggcuaagcaacccgccacucuccgaaaguacugcaucgaggccaagcucacaaacacgaccaccgagagccgcugccccacgcagggcgagcccagccugaaggaggagcaggacaagagauucgucuguaagcacagcaugguggaccgcgguugggggaauggcugcggacuguucggcaagggcgggauagugacgugcgcgauguucacuuguaagaagaacauggagggaaagauugugcagcccgagaacuuggaguacaccauuguggugacgccccacuccggugaggagcacgcugucggcaacgacacggggaagcacgggaaggagaucaaggugaccccgcagagcucuaucaccgaggcggagcugacgggguacggcaccgugacgauggagugcagcccccggaccggccucgacuucaacgagaugguccugcugcagauggagaacaaggcauggcucgugcaccgccagugguuccuggaccugccccuccccuggcucccgggggcggacaagcaagaguccaauuggauccaaaaggagacgcuggucacauuuaagaacccccaugcgaagaagcaggacgucgugguccucgggagucaggagggggcuaugcacaccgcccugaccggugcaacugagauccagaugagcuccgggaaucuccuguucaccggccaucugaagugccgucugcgcauggacaagcuccagcugaagggcaugagcuacucaaugugcacuggaaaguucaagguugugaaggagaucgccgagacccagcacggcaccauugucauccggguucaguacgagggggauggcagccccugcaagaucccuuucgagaucauggauuuagagaagcgcuacgugcucggccggcugaucaccguaaauccgauugcgacagagaaggacucccccgugaacaucgaggcagagccgcccuucggggacagcuacaucaucaucggcguggaaccaggccagcugaagcucaacugguucaagaaggguucauccaucggccaaauguucgagaccaccaugcguggggccaagcgcauggccauccugggcgacacagccugggacuucggaucacuuggcgggguguucacgagcaucgguaaggcgcuccaccagguguuuggggccaucuacggggccgccuuuuccggcgugagcuggaccaugaaaauccugauaggggucaucaucaccuggaucggcaugaacucccgaagcaccucucugagcgugucccuggugcucgucgggaucgugacgcuguacuugggcguaaugguacaggcggauagcgguugcgugguguccuggaagaauaaggagcucaagugcggcucggguaucuuuaucaccgacaacguucacaccuggaccgaacaguacaaguuccaaccagagagccccuccaagcuggccagcgccauucagaaggcccaggaggaagggaucugugguauacgcuccgugacgcggcuggaaaaccucauguggaagcagaucacccccgagcuaaaccacauccuggccgagaacgaagugaagcucaccaucaugacgggggacaucaagggcauuaugcaagcggggaagcgcucgcugcguccgcagcccacugaacugaaguacaguuggaagaccuggggcaaggccaaaaugcucagcaccgaguccuacaaccagaccuuccuaaucgacggucccgagacggccgagugcccgaacaccaaccgcgccuggaacucgcuggaggucgaagacuauggguucggcguguucacgacuaacaucuggcucaagcugaaagaaaaacaggaugccuucugugacucaaaacugaugucggcggcaaucaaggacaaccgggcgguacacgccgacaugggguacuggaucgagucggcccucaaugacacguggaaaaucgagaaggcgucuuucauugaggugaagaacugccauuggcccaagucccacacccuauggagcaacggcgugcuggaguccgagaugaucauacccaagaaucucgccggccccgugagccagcauaacuaucguccuggguaccacacgcagaucgccggcccauggcaucuggggaagcuggagauggacuucgacuucugcgacgggaccaccgucaucgugacggaggacugcgggaaccgaggccccuccuugcgcaccaccacggcgagcggcaagcucaucaccgaguggugcugccggagcugcacccuccccccgcuccguuaccgaggggaggacgguugcugguacgggauggagauccggccccugaaggagaaggaggagaaccuggugaauucccucgucacggcagggcacggacagguggacaauuucucucuggggguucugggcauggcgcucuuccuggaggaaaugcugcggacccgcgucgguacgaagcaugccauccuacugguggccguguccuucgucacccugaucaccggcaacaugagcuuuaaagauuugggucgggugguggucauggugggugccacaauggcggaugauaucgggaugggcgugacauaccuggcucuacucgccgccuucaagguucgcccgaccuucgccgcgggccuguugcuccggaagcugaccuccaaggagcugaugaugaccaccaucggaaucgugcuccugagccaaagcaccauccccgagaccauccuggagcucaccgacgccuuagcccugggaaugauggugcucaagauaguccgcaacauggaaaaguaccagcucgccguaacgaucauggcaauucugugcgugccgaacgcggucauccuccagaacgcauggaaagucagcugcaccauccuggccgucguguccgugagcccccuauugcugaccucgagccagcagaagacugacuggaucccccuggcgcucaccaucaaggggcugaacccgacugcuauauuucugaccacccucuccaggacgaacaagaagcggagcuggccgcugaaugaggcuaucauggccgucggcauggugucuauacuagccuccucccucuugaagaaugacauaccuaugaccggcccccugguggccgggggccuccugaccgucugcuacgugcugacugggcgcucugccgaccucgagcuggagcgggcgacggacgugaagugggaggaccaggccgagaucuccgguagcagccccauucuauccaucacgauaagcgaggacggguccaugagcauuaagaaugaggaggaggagcagacccucaccauccugauccgcaccggccuccucgucaucuccggccuguucccgauaagcauccccaucacagccgcggcgugguaccugugggaagugaagaaacagcgggccggggucuugugggacguccccaguccaccgcccaugggcaaggccgagcuggaggauggggccuaccgcaucaaacagaagggcauccugggguacagccaaaucggcgcgggaguguauaaggagggcaccuuccacaccauguggcacgugacucgcggcgccgucuugaugcacaagggcaagcggaucgagccaucgugggccgacgugaaaaaggaucugaucucguacggagggggcuggaagcuggagggcgaguggaaggagggggaggaggugcagguccucgcccucgagccaggcaagaacccccgggccguucagacgaaacccgggcuguuuaagaccaacacgggcaccaucggggcagugucccuagacuucagccccggcacgaguggcagcccgaucaucgacaagaaggggaaggucguaggacuguacgggaacggcguggucacccgcuccggggccuaugucagcgcuaucgcccagacagagaaguccaucgaggauaacccugagaucgaggacgauaucuuucguaagcgcagacuuacaaucauggaccuacauccaggggccggcaagacgaagcgcuaucuccccgcgaucguacgggaggcgaucaagcgcgggcugcggacccugauucucgcgccgacccgcgucguggccgccgagauggaggaggcgcugcggggccugcccauccgguaccagacacccgccauccgggcugagcacacggggcgcgagaucguggaucugaugugucacgcuacauucacuaugcggcugcuuucacccguacggguaccgaacuacaaccucaucgugauggaugaggcccacuucacugaccccgcguccaucgccgcccguggcuacaucagcacccgggucgagaugggcgaagcggcugguaucuuuaugaccgcgacgccgcccggcagcagagacccuuucccccaguccaacgcccccaucaucgacgaggagcgggagauccccgaacggucguggaacagcgggcacgaauggguuaccgauuucaagggcaaaacggugugguuugugccuagcaucaaggcggggaaugacaucgccgcauguuuacggaaaaacggaaagaagguaauccagcugucucgcaagaccuucgacuccgaguacgugaagacccguaccaacgacugggauuucgucgugacgacggacaucuccgagaugggugccaacuucaaggccgagcgcgugaucgacccccggcguugcaugaagcccgugauacucacagacggggaggagcgggugaucuuggccggccccaugccggugacucacucauccgccgcgcagaggcgcgggcgcaucggccggaaucccaagaaugagaacgaucaguauaucuacaugggagagccccuggaaaacgacgaggacugcgcccauuggaaggaggcgaaaaugcuccuggacaauaucaacacgcccgagggcaucaucccgaguauguucgagcccgagcgcgagaaggucgacgcgaucgauggcgaguaccggcugagaggggaggcccgcaagaccuucguggaccucaugcggcgcggcgaccugccggugugguuagcguacaaggucgccgccgaggggaucaacuacgccgaccggcguuggugcuucgacggcauaaagaacaaccagauacuugaagagaacguggaaguggagauuuggacuaaggagggggagcggaagaagcuuaaaccgcgcugguuagacgcccgcaucuacuccgacccccucgcguuaaaggaguucaaggaguuugccgcgggccgcaagagccugacccucaaucugaucacggagaugggccgguugcccacauucaugacccagaaaacccgagacgcccucgacaaucuggcgguucugcacacggcugaggccggcggccgggccuacaaccacgcccucuccgaacugccugagacccuggagaccuugcugcuccucacccuucuagcgacgguuaccgggggcaucuuccucuucuugauguccgggcgcgggaucggcaagaugacccuuggaaugugcugcaucaucaccgccuccauccuuuugugguacgcccagauccagccgcacuggaucgcagcauccaucauccuggaauucuuucuaauugucuuauugauccccgagcccgagaagcagcggacaccccaggacaaccagcucacguacguugugaucgcgauccuaacggucguggcugccacaauggccaaugaaauggguuuccuggagaagacgaagaaggacuuagggcugggcucgaucgccacgcagcagccggaguccaacauccuggacaucgaucuccgccccgcgucggccuggaccuuauacgccguggccaccaccuucgucacgccaaugcugcggcacuccaucgagaauuccuccgugaacaucagccucaccgcaauagccaaccaggccacugugcuaaugggccuggggaagggauggcccuuauccaagauggacaucggcgucccgcugcuagcgaucggcugcuacagccaggugaaccccaucacccucacggccgcgcugcugcugcugguggcccacuacgccaucaucgguccgggcuugcaagcuaaggccacccgcgaagcgcaaaagcgugccgccgccggcaucaugaagaaccccaccguggacgguaucaccguuaucgaccuggacccaauacccuaugacccuaaguucgagaagcaacugggccaggugaugcuguuaauccugugcgucacccaagugcucaugaugcggaccaccugggcccuuugcgaggcgcugacuuuggccacagggcccaucuccacccucugggagggcaacccggggcgguuuuggaauaccacgaucgccgugagcauggccaacaucuuucgaggcuccuaccuggccggcgcugggcuccuguucagcaucaugaaaaacacgacgaauacccggcgcggcaccggaaacaucggcgagacguugggcgagaaauggaagucccgccucaacgcccuggggaagucggaguuccagaucuacaaaaagagcggcauccaggaggucgaucggacccuggccaaggaggggaucaagagaggcgagaccgaccaucacgccgugucucggggguccgcgaaguuacgcugguucguagagcgaaacauggucacccccgagggcaaagugguggacuuaggaugcgggcgcggcggguggucguacuacugcggaggacugaaaaacguccgagaggugaaaggcuuaacgaagggcggccccggccacgaggagcccaucccuaugaguacguacggguggaacuuagugcggcugcagagcggcgucgacguguucuucaucccgcccgagaagugcgacacacugcucugcgacaucggggagucaagcccaaauccgacuguggaggccggccggacgcugcggguccucaaccucguggagaacuggcugaacaacaacacacaguuuugcaucaagguguuaaaccccuacaugcccuccgugaucgagaagauggaggccuuacagcggaaguacggcggggcgcucguccgcaacccucugagccggaauagcacccacgaaauguacuggguguccaacgcguccggcaauaucgucuccucuguuaacaugaucucgcgcaugcucaucaacagauucaccaugcgccacaagaaggcgaccuacgagccggauguggacuuggggagcggcacgcggaacauagguaucgaguccgagaucccgaaccuggacaucaucggcaagaggaucgaaaagaucaaacaagagcacgagaccagcuggcacuacgaccaggaucaccccuacaagacgugggcauaccacggcagcuaugagacgaagcagacggggucugcauccagcauggugaacggcguuguacgacugcucaccaagccgugggacgucuuaccaacggugacccagauggccaugacggacacgacccccuucggucagcaacgcguguucaaggagaagguugacacccgcacccaggagcccaaggagggcacuaagaagcugaugaaaaucacggccgaguggcuguggaaggaguuaggcaagaagaagacaccaaggaugugcacgcgcgaggaguucacccggaaggugcgcuccaacgcggcccugggggccaucuucaccgacgagaacaaguggaaguccgcuagggaggcuguggaagacucacguuucugggagcucgucgacaaggagcggaaccugcaccuagagggcaagugcgagaccugcguguacaacaugaugggcaagcgcgagaagaaguugggcgaguucgggaaggcgaagggcagcagggccaucugguacauguggcuuggagccagguuccuagaguuugaggcccucggguuccugaacgaggaucacugguuuucccgagaaaacucguuauccggcguggagggggaaggccuccacaagcugggguauauccugcgcgacguaagcaagaaggaaggcggcgcgauguacgccgacgacacggccgggugggacacccggauaacccucgaggaucugaagaacgaggagauggugaccaaucacauggagggcgagcacaagaagcuggccgaggcgaucuucaaguuaacguaccagaacaaagucgugcgcguucagcgaccaacuccccgggguaccgugauggacauaaucagccggcgcgaucagcggggcuccggacagguggggaccuacggccugaacaccuucaccaacauggaagcgcaacugauccgccagauggagggggagggcguauucaagaacauccagcaccucaccgucacugaggagguggcgguucagaacuggcuagcccgggucgggagagaacgccugagccggauggccaucuccggcgacgacuguguggugaagccucuugacgaccgcuucgccaacgcgcugacggcccugaacgauaugggcaagauucggaaggacauccagcagugggaaccaagcaagggguggaacgacuggacccagguccccuuuugcagucaccacuuccacgagcucaucaugaaagacggucgcgugcuggugguccccugccguaaccaggacgagcugaucgggcgcgcccggaucagucaaggcgccggcuggucccuccgcgagacugccugccugggcaagagcuacgcgcaaauguggucccugauguacuuccaucggagagaccuccggcuggccgcaaacgccaucugcuccgccgugcccucccacugggugccgacaucgcgcacgacuuggaguauccaugcaaaacacgaguggaugaccaccgaggacaugcugacgguauggaaucggguguggauccgcgagaaccccuggauggaggacaagacgcccguggagagcugggaggagauccccuacuugggcaagcgggaggaccaguggugcgguucccugaucggccugaccagccgcgcuacaugggccaagaacauccaagccgcgaucaaccagguccggucccucaucgggaacgaggaguacacagacuacaugccgagcaugaagcgcuuccggcgagaggaggaagaggccggcgugcuuugguag

SEQ ID NO: 25138 - RNA, 9876 nt, Artificial Sequence
  derived and/or modified CDS sequence (opt11) from DENV-2__FJ687440__SS-prME
agcgccggcaugauaaucaugcugauccccaccgugauggccuuccaccuaaccacccgcaauggcgagccucacaugaucgucggcauccaggagaagggcaagucccugcuguucaagaccgaggacggcgugaacaugugcacguugauggcgauggaucugggggagcugugugaagacaccaucaccuacaagugcccacuccugcggcagaacgagcccgaggacaucgacuguuggugcaacuccacuuccaccuggaucacguacgggaccugcacgaccaccggcgaacaccgccgagagaagaggucgguggccuuagucccacacguggggauggguuuggagacccgcaccgaaaccuggaugaguucagaaggggcuuggaagcacgcccagcggaucgagaccuggauccuccggcauccgggcuucacuaucauggccgcgauccuggccuacaccauugggaccacccacuuucagcgcgccuugauauucauccugcucacggccgucgcgccauccaugaccaugcggugcaucgguaucucgaaccgcgacuucguggaggguguuuccggagggagcuggguggacauugucuuagagcauggauccugcgucacuaccauggccaaaaauaagcccacgcuggacuuugagcucauaaagaccgaggccaaacaaccggccacccuccgaaaguauugcaucgaggcuaagcugacaaacacgaccaccgaaagccggugccccacccagggcgaacccucccucaaggaggagcaggacaagcgguucgucugcaaacacagcauggucgaccgcggcugggguaacggcugcggacucuuuggcaagggcgggaucgugacgugugcgauguucacuugcaaaaagaauauggaaggcaagauugugcaacccgaaaaccuagaguacaccaucguggugacuccccacuccggcgaggagcaugccguggguaacgauacagggaagcacggcaaagagauaaaggucaccccacaaagcuccaucacggaggccgagcugacugguuacggcacuguaacgauggagugcagcccgcggaccggacucgacuucaacgagaugguacuguugcagauggaaaauaaggcguggcucguccaucgccagugguuccuagaccugccccucccauggcugcccggggccgacaagcaaggcagcaacuggauucagaaggagacccuugucaccuucaaaaauccccacgcgaaaaagcaggacguggucguccucggaagccaggagggggccaugcauacggccuugaccggugccaccgagauccaaaugagcuccggcaaccuccuuuucacaggacaccugaagugccggcugcgcauggacaagcuccaguugaaggggaugucguacuccauguguacgggcaaguucaaggucguuaaggagaucgccgagacccaacaugggaccaucgugauacggguccaguacgagggcgauggcagcccgugcaagaucccauuugagaucauggacuuggagaaacgguacgucuuagggcgccugauaaccgugaacccgaucgucacagagaaagacuccccgguuaacauugaggcagagccacccuucggcgacagcuacaucaucaucgggguagagcccggccagcuaaagcucaacugguucaagaagggauccagcaucggccagauguucgagaccacuaugcgcggagcuaagcgcauggccauucugggggacaccgccugggauuucggcagccucggcggggucuucacgagcaucggaaaggcacuccaucaagucuucggcgccaucuacggggcugccuucagcggggugagcuggaccaugaaaauccuaaucgguguaaucauaacguggaucggcaugaacucccggagcaccagccugucggugucccugguacucgucggcaucgugacgcuguaucugggagugaugguccaggcagacaguggcugcguggucucuuggaagaacaaggagcucaagugcggcagcgggaucuucauuacggauaacgugcacaccuggacagagcaguacaaguuccagcccgagucgcccucuaagcuggcgucagcuauucagaaggcccaggaagaggguaucugcgggauccgcuccgugacgcgccuugaaaaucucauguggaagcagaucacgcccgaguugaaccacauacucgcugagaacgaggugaaacuaaccaucaugacgggcgacauaaaggggaucaugcaggcuggcaagcgaaguuuacggccccaaccgacggaguugaaguacaguuggaagaccuggggcaaggcgaagauguugagcaccgaaucccacaaucaaaccuuccugaucgacggacccgaaacagccgagugcccgaacaccaaucgggcguggaacucucuggaggucgaagacuacggcuuuggaguguucacuaccaacauauggcucaagcuaaaggagaagcaagacgccuuuugugauuccaagcugaugagcgccgccaucaaagacaaccgggccguucacgccgacaugggcuacuggaucgaguccgcccucaacgacacguggaagaucgagaaggcgucuuucaucgaagugaagaauugccacuggcccaagucgcauacacuguggagcaacggcgugcuggagucagagaugaucaucccgaagaaccucgcggggcccgugucccaacacaacuaccgccccggguaccacacccagauagcaggccccuggcaccugggcaaacuggagauggacuuugauuucugcgauggaaccaccgucauaguuacggaggacugcggcaaccggggccccucccuuaggaccaccaccgccuccgggaaacugauuacugaguggugcugccggagcugcacccugcccccgcuccgauaccggggcgaggacgggugcugguauggaauggagauucggcccuugaaggaaaaggaagagaaccugguaaauucccucgucacggcagggcacggccagguagauaacuucagucuggguguacugggaauggcccuguucuuagaggagauguugcguacacgggucggaacgaagcaugccauuuugcuaguggcugucagcuucguaacccugauaaccggaaauaugagcuucaaggaccucggacgagucgugguaauggugggcgccaccaugacugacgacaucggcaugggcgucaccuacuuagcgcucuuagcggcguuuaagguccguccuaccuucgcggcaggacugcuuuuacggaaacuuaccuccaaagagcuuaugaugacaaccaucgggaucgugcuccugagccaguccaccaucccugagaccauacuggagcucacugacgcccucgcccugggcaugauggugcucaaaaucguccgcaacauggaaaaauaccaguuagcugugacaauaauggcuauccugugcgugccgaaugccguuauucugcaaaacgcauggaaggugagcugcacaaucuuggcgguaguguccgugucuccccuacuacugaccuccucacagcagaagacggauuggauccccuuggcccugaccaucaagggccugaauccgaccgcuaucuuucugacaacguugucucgcaccaacaagaagaggucuuggccgcugaacgaggccaucauggcggugggaaugguuagcauucucgccagcagucuccugaagaacgacauuccuaugaccgggccucugguggcaggagggcuccuaaccgucugcuacguuuugacgggccgcagcgcugacuuggagcuggagcgagccacggacgugaagugggaggaccaagcggagaucucggguagcagccccauccuguccaucacgaucagcgaggauggguccaugagcauuaaaaaugaggaggaggagcaaacccucacgauccuaauccgcacaggucugcuagugaucuccgggcuguucccggugagcauaccgaucacugccgcagcuugguaccugugggagguuaagaagcagagggccggcgugcucugggacgugcccucaccgccgcccauggggaaagcggagcuagaggacggagccuaucgcaucaaacaaaaggggauccugggcuacagccagauuggcgccgggguguacaaggagggcaccuuucacaccauguggcacgugacgcguggggccgugcucaugcacaaggggaagcgcaucgagcccuccugggccgacgugaagaaggacuuaaucaguuacgguggaggguggaagcucgaaggugaguggaaggagggagaggagguccaggugcuugcgcuggagcccgggaagaacccgcgagccgugcagaccaaacccggccuguucaagacgaacaccgggacgaucggugcagucucccucgacuucucaccuggaacauccgggucaccaauaaucgacaagaagggcaagguugugggccuguacggaaacggcguggugaccaggucaggggccuacguaucagcgaucgcgcaaacugagaagaguaucgaggauaaccccgaaaucgaggacgauauuuuccggaagagaaggcugacgauaauggaucuacaccccggcgcggggaaaaccaagcgcuaucuccccgccauuguccgggaagccaucaagcgcggccugcgcacuuuaaucuuggcgccgaccaggguuguggccgccgagauggaggaagccuuacggggucuacccauucgcuaccagaccccggccauucgggcggaacacaccgggcgcgagaucgucgaccucaugugccacgccacauuuaccaugaggcugcugagccccguccgggugcccaacuacaaccucaucaucauggacgaggcacacuucaccgauccagccuccaucgcagcgcgcggcuauaucucuacgcgggucgaaaugggggaagcugccggcauuuucaugacagccacgccucccgguagccgcgauccguucccucaauccaacgcccccaucauugacgaagaacgcgaaauucccgaaagaucauggaacuccggccacgaguggguaacggacuucacggggaaaacugugugguucguuccaagcaucaaggcgggcaaugacaucgccgcaugucugcggaagaacgggaagaaggugauccaacugucacgcaagacguucgacucagaguacgucaaaacacggaccaacgacugggauuucguaguaaccaccgacaucuccgagaugggagccaacuucaaggcagagcgugugaucgacccccggcgcuguaugaagccugugauccucacggauggcgaagaacggguuauacuggccgggccaaugccggugacccacucgucagccgcgcagcgccggggccgcaucggucgcaaccccaagaacgagaacgaccaguacauauacaugggcgagccccuggagaacgaugaagacugcgcccacuggaaagaggcaaagauguuacuggacaacaucaacaccccugagggcaucauaccaagcauguucgaaccagaacgcgagaaagucgaugccaucgacggugaguacagauugcgcggcgaggccaggaagaccuucguggaucucaugcggcgaggggaucugcccguguggcuggcauacaagguugccgcggaaggcaucaacuacgccgaccggcgcuggugcuucgaugguaucaagaacaaccagauccucgaagagaacguggaggucgagaucuggacgaaggagggggaacggaagaagcugaagccucgcuggcucgacgcccggauuuauuccgacccgcucgcccugaaggaguucaaggaguucgccgcggggcgcaagagucugacccucaaucugaucaccgaaauggggcgccuuccgaccuucaugacgcagaagacccgggacgcccucgacaaccuggcaguccugcauaccgcggaggcaggcgggcgggccuacaaccacgcccucucggagcuccccgagacacuggagacgcuccugcugcucacccugcucgccaccguaaccggcgguaucuuucucuucuugaugaguggccgcggcauuggcaagaugacucucggcauguguugcaucaucacggcguccauuuugcugugguacgcgcaaauccaaccgcacuggaucgccgccaguauaauucucgaauuuuuccucaucguucuccugauacccgagcccgagaagcagcggacgccccaagacaaccagcucaccuauguggugaucgccauccugacggucguggccgccacaauggccaacgagaugggguuucuggagaagacaaagaaggaucucggccugggcuccauagccacccaacagcccgagagcaauauccucgacaucgaccuccgcccagccagugccuggacacuguacgcgguggccacgaccuucgucacgccaaugcugaggcacucaaucgagaacagcuccguaaaugugagccucaccgcaaucgccaaccaagccacgguccugaugggguuggguaagggguggccauuguccaagauggacauaggcgugccgcuucuggcgaucgguuguuacagccaagugaaccccaucacgcucacagccgcucugcuacuccuugucgcgcacuaugccaucaucggcccgggccuacaggccaaggccacccgcgaggcccagaagcgugcggcggccgggaucaugaagaaccccacgguggacgguauaacuguaaucgaucucgacccgaucccguacgacccgaaguucgagaagcagcugggacaggugaugcucuuaauccuauguguaacacaggugcuuaugaugcgaaccaccugggcccuaugcgaagcacugacccuggcgaccggccccaucuccacccucugggaggggaacccgggccgguuuuggaacaccaccauagcggucaguauggcuaacaucuuccgaggcuccuacuuagcuggggccggccuccucuuuagcaucaugaaaaacaccacaaacacucggcgcgggaccggcaacaucggcgagacacugggagaaaaguggaaaagccgccuaaaugccuuaggcaagagcgaguuccagaucuauaagaaguccgggauccaagagguugaccggacccuggcgaaagaaggcaucaaacgcggggagacggaccaccacgccguuagccggggcucggcgaagcugcgcugguucguugagcggaauauggugacccccgagggcaagguggucgaccucggcuguggcagagguggguggagcuacuacugcgggggcuuaaagaaugugcgggagguaaagggccugacgaaggguggacccgggcacgaggagccgauuccuaugucaaccuacgguuggaaccucguccgcuuacagagcgggguggacgucuucuuuauuccgccagagaagugugacacgcugcuuugcgacaucggcgaguccucucccaacccgaccgucgaggccggacgcacucugcgcgugcugaaccuaguugagaacuggcugaacaacaauacccaguucugcauuaagguccugaaccccuauaugccaagcguaaucgagaagauggaggcgcuucagcgcaaguacgggggcgcccucgugcggaauccucugagucggaacagcacccacgagauguacugggucuccaacgccucagggaacaucgugagcagcgugaacaugaucagucgcaugcugaucaaccgguuuacgaugcgccacaaaaaggccacuuacgagcccgacgucgaccucggcagcgggacacggaacauaggcaucgagagugagauacccaaccuggacauaauuggcaagcgcaucgagaagaucaagcaagagcaugagacgucuuggcacuacgaccaggaccaccccuacaagacgugggccuaucacggcuccuacgagacgaagcagacugggagcgcauccagcauggugaacggagugguccggcugcucaccaagccgugggauguucugccuacggugacccagauggccaugaccgacacuacgcccuucggccaacagcgcguguuuaaggagaaagucgacacgcggacucaggagccgaaggagggcaccaagaagcuaaugaaaauuacggccgaguggcucuggaaagagcuggggaaaaagaagaccccgcggaugugcacccgugaggaguuuacccggaaggugcgcuccaacgccgcccugggcgcaauauucacggacgagaacaaguggaagucagcgcgggaggcggucgaggauuccagguucugggagcuaguggauaaggagcggaaucuucaucuggaggggaagugcgagaccugcguguauaacaugauggguaagcgggagaagaagcucggggaguucggcaaggccaagggcagcagggcaauuugguacauguggcugggggcacgcuuccuggaguuugaggcucucggcuuccuaaacgaagaccacugguucucccgggagaacagccugagcgggguugagggagaaggucugcacaaacuuggcuacauccugcgcgaugugagcaagaaggaaggcggggccauguaugccgaugacacagcgggcugggacacccggaucacgcucgaagaccugaagaacgaggagauggucaccaaccacauggagggggagcacaagaagcuggcagaggcuaucuuuaagcugaccuaccagaauaaggugguacgcguccagcgccccacgccacgggguaccguuauggacauuaucagccggcgcgaccagcggggaucgggucaggugggcacguacgggcugaacacguucaccaacauggaggcgcagcugauccggcagauggaaggagaggggguuuucaaaaacauucagcaccucacggccaccgaagagaucgcgguacagaauugguuagcucggguggggcgggagcgccugagccggauggccaucucuggcgaugacugcgucguaaagccgcucgacgacagguucgccaaugcccuaaccgcgcugaacgacauggggaagauacguaaggauauacagcagugggagccaagcaaaggcuggaacgauuggacccaggugcccuucugcucccaccauuuccacgagcugaucaugaaagacgggcgcgugcugguggugcccugccggaaucaggacgagcugaucggccgggcccgcaucagccagggagccgguugguccuugcgugagacggccugcuuaggcaagaguuacgcucagauguggucucugauguauuuccaccggagagaccucaggcuggcggccaacgccauauguagcgccguaccgucccacugggugccaaccagccgcaccaccuggucuauucacgccaagcacgaguggaugaccacggaggacauguuaaccguguggaacagagucuggauaagggagaacccguggauggaggauaaaacccccguggagucgugggaagaaauccccuaccucgggaaaagagaggaucaguggugcggcucccugaucgggcugaccucucgcgccacgugggccaagaacauucaggccgccaucaaccaggugcggagucucaucgggaacgaggaauacaccgacuacaugccgagcaugaagcgcuuccggcgagaggaggaggaggcggggguccugugguga

SEQ ID NO: 25139 - RNA, 9876 nt, Artificial Sequence
  derived and/or modified CDS sequence (opt11) from DENV-2__FJ687441__SS-prME
ucggccggcaugaucaucaugcugaucccgaccgugauggccuuccaccucaccacccgcaacggggagccccacaugauugugggaauccaggagaaggggaaaucccuacuguucaagaccgaggaugggguaaacaugugcacccucauggcgauggaccugggggagcugugcgaagacacgauuacauacaaauguccccuccugcggcagaacgagccugaggacaucgacugcuggugcaacagcaccuccaccuggaucaccuacgggaccugcaccaccaccggcgagcaccgacgggagaagcgcagcguggcacuggucccccacguggguaugggccucgaaacccggacagagaccuggauguccagcgagggggccuggaagcacgcccagcgcaucgagaccuggauccugcgccacccuggcuuuaccaucauggccgcgauccuggcguacaccaucgggaccacacacuuccagcgcgcgcucaucuucauccuacugacggcaguggcacccuccaugaccaugcgcugcaucgguauaagcaacagggacuucgucgagggcgucagcgggggcagcuggguggacaucguccucgagcacggauccugcguuaccaccauggcaaagaacaagcccacacucgacuucgaacucaucaagaccgaagccaagcagcccgcaaccuuaagaaaauacugcauugaggccaagcuaaccaacacgaccaccgagagccgcugucccacccagggcgagcccuccuuaaaggaagagcaggacaagcgcuucgugugcaagcacagcauggucgaccgcggcugggggaacggcugcggacuguucggaaagggcgggaucgugaccugcgcgauguucacgugcaagaagaacauggaggggaagaucguacagcccgagaaucuggaguacaccaucgucgugacgccccacuccggagaggagcacgcaguggguaacgauacggggaaacacggcaaggagaucaaggucaccccgcagagcuccaucaccgaggccgagcugacgggguacggcaccguaacgauggagugcagcccccgaaccggccuagacuucaacgagauggugcugcugcaaauggaaaacaaagccuggcucguacaccgccagugguucuuggacuugccccuccccuggcugccgggggccgacaagcaggguuccaacuggauccagaaggagacccuggugaccuucaagaacccccacgccaagaagcaggacguggucgugcucgggagccaggagggcgccaugcacacggcccugaccggggccaccgagauucagaugagcucuggaaaccucuuauucacgggccaccugaagugccggcugcgcauggacaaguugcagcugaaggggaugagcuacuccaugugcacuggcaaguucaaggucgugaaggagaucgccgagacucagcacgggaccaucgugauacgggugcaguaugagggcgacggcagccccugcaagauccccuucgagauuauggaccuggagaagagauacgugcucgggcggcugauuacagugaacccgaucgucacggagaaagacucccccguaaacaucgaggcggagccgcccuucggcgacagcuacaucauaaucgggguggagccgggccagcugaagcucaacugguuuaagaaaggcuccuccauuggccaaauguucgagaccaccaugcgcggcgccaagagaauggcaauccugggggacaccgccugggauuucggcucccuaggcggggucuucacgucuauugguaaggcucuccaccagguguucggcgcaaucuacggcgccgccuucuccgggguaagcuggaccaugaagaucuugauaggcgucauuaucaccuggauaggcaugaacucccggagcaccucccugagcgugucccuggugcuuguaggcaucguuacgcuguaccugggggugaugguccaggccgacagcggaugcgugguguccuggaagaauaaagagcucaaaugcgguagcgggauuuucaucacagacaacguccacaccuggaccgagcaguacaaguuccagcccgagagccccuccaagcuggcgagcgccauccagaaggcccaggaggaaggcauuugcgggauccgcuccgugacgcggcuggagaaucucauguggaagcaaaucaccccggagcugaaccacauccuggccgagaacgaggugaaguuaaccaucaugaccggcgacaucaaggggaucaugcaggccggcaagcgcucacugcggccgcagcccacggagcugaaguacuccuggaagaccuggggcaaagcgaagaugcucagcaccgagucccacaaccagaccuuccugaucgacgggccagagacggccgagugcccgaacaccaaccgcgccuggaacucccuggaggucgaggacuacggcuucgggguguucaccacuaacaucuggcucaagcugaaggagaagcaagaugccuucugcgacuccaaguuaaugagcgccgcgauuaaggacaaucgggccgugcacgccgacaugggcuacuggaucgaguccgcccucaacgauacguggaagaucgagaaggccagcuucaucgaggucaagaacugccacuggcccaagucgcacacccuguggaguaacggagugcucgaguccgagaugaucauccccaagaaccucgcggggcccgugagccagcacaacuaccgcccaggcuaccacacccagaucgccgguccauggcaccugggcaagcuggagauggacuucgacuucugcgacgggaccacagucaucgugacggaggacugcggcaaccggggccccuccuugcgcaccaccaccgccagcgggaagcugauaacggaguggugcugucggagcugcacccuacccccgcuccgcuaccggggcgaagacgggugcugguacggcauggagauccgcccccugaaggagaaagaagaaaacuuagugaacucccucguuaccgccgggcacggccagguggacaacuucagccugggcgugcuggggauggcacuguucuuggaggagaugcugcggacgcgcguggguacgaagcacgcaauacuccugguggccguguccuucguuacccucaucaccgggaacaugaguuucaaggaccucggcagggucguggucauggugggugccacaaugacggacgacaucggcaugggcgugaccuaccuagcccugcuugcggcuuucaagguucgccccacauucgccgccgggcugcugcuucggaagcugaccagcaaggaauuaaugaugacgaccaucggcaucguccuccugagccaguccaccaucccugagaccauccuggagcucacggacgcccuggcgcuugggaugauggugcucaagaucguccgcaacauggagaaguaccagcuggccgugaccaucauggccauccugugcguuccgaaugcaguuauccuccagaacgccuggaaggugagcugcaccauacuggcggucguguccgugagcccccugcuccugaccuccagucagcagaagacggacuggaucccccuggcccucaccaucaagggccugaaucccaccgccaucuuccugaccacgcucuccaggacaaacaagaagcggagcuggccccugaacgaggccaucauggcggucggcaugguguccauucuagccagcucccuccucaaaaacgacauacccaugacugggccccucguggccggcggccucuuaaccgugugcuacguccugacgggccgcagcgccgaccucgagcuggagagagcuaccgaugugaagugggaggaccaggcggagaucuccgggagcagccccauccuguccaucaccaucucugaggauggcuccaugagcaucaagaacgaggaagaagagcagacucucacgaucuugauccgcaccgggcugcuagucaucuccgggcuguucccggugagcauccccaucaccgccgccgcuugguaccugugggaggucaagaaacaacgggccggcguccuaugggaugugccaucuccgccgcccauggggaaggcggagcuggaagacggcgccuaccgcaucaagcaaaaggggauccugggcuacagccagaucggcgccgggguguacaaggaaggcaccuuccauacaauguggcacgucacgcgcggggcagugcuuaugcacaagggcaagcgcaucgagcccucuugggccgacgugaagaaggaccucaucucauacgggggggguuggaagcuggagggcgaguggaaggagggcgaggagguccaggugcucgcacuggaacccgggaagaaccccagagccgugcagacuaagcccggccuguucaagacaaacaccgggacgaucggcgccgucucacucgacuucucgcccggcaccuccgggagcccaaucaucgacaagaaagggaaggugguggggcuguacggcaacggcgucgugacccguuccggggcuuacguaagcgccaucgcgcagaccgagaagucgaucgaggacaaccccgagaucgaggacgacaucuuccggaagcgccggcugacgaucauggaccugcaccccggagccgggaagaccaagcgcuaccuccccgccaucguccgggaggccaucaagcgcggauugcggacccugauccucgcuccgacccgcgugguggccgccgagauggaggaggcccuccggggacugcccauccgauaccaaacccccgccauccgggcggagcacaccggccgcgagauagucgaccuuaugugccacgccaccuucacaaugcgccugcugagccccgucagagugccgaacuacaaccucauuaucauggaugaggcgcauuucacugaccccgcuuccaucgccgcgcgcggcuacaucagcacccgggucgagaugggggaggccgccggcaucuucaugaccgcgacgccgcccgggagccgcgauccguucccgcaguccaacgcccccaucaucgacgaggaaagggagauccccgagcgcuccuggaacuccggccacgagugggugacggauuucaaggguaagacagugugguucgucccgucgaucaaggcgggcaaugacauugcagccugccuccggaaaaacggcaagaaggugauccagcuguccaggaagaccuucgacagcgaguacgugaagacccggacgaacgacugggacuucgucguaaccaccgacaucucggagaugggggccaacuucaaggcagagcgggucaucgauccccggcggugcaugaagcccgucauccucaccgacggcgaagagcgcgugauccuggccgggcccaugccggugacccacagcucggccgcccagcgacggggucgcaucgggcggaaccccaagaacgaaaacgaccaguacauuuacaugggagaaccccuggaaaacgacgaggacugcgcgcacuggaaggaggcgaagaugcuccuggacaacaucaacacgcccgaggguaucaucccuagcauguuugagcccgagcgcgagaaggucgacgcaauugacggggaauaccggcugcguggcgaggcgcgcaagaccuucguggaccucaugcgacgcggggaccuccccguguggcucgccuauaaaguugccgcggaggggauaaacuacgccgaccgacgcuggugcuucgacggaaucaagaauaaccagauccucgaagaaaacguggaaguggagaucuggacgaaggagggagagcggaagaagcugaagccgcgcuggcuggacgcacggaucuacuccgaccccuuagcccugaaggaauucaaagaguucgccgcgggccgcaaaucacugacgcucaaucugaucacugagauggggcggcucccaaccuucaugacccagaagacgcgggacgcccucgauaaucuggccguacugcacaccgccgaggcgggggggcgggccuacaaucacgcccucuccgagcugccggaaacccuggagacccuccugcuguugacgcugcuggccaccgugaccgggggcaucuuccucuuccuaaugagcggucgcggcaucgguaagaugacccugggcaugugcugcauuaucacggcguccauucuccucugguacgcacagauccagccgcacuggaucgccgccagcauaauucuugaguucuuccucaucguucugcugaucccagagcccgagaagcagcggacgccccaagacaaccagcucaccuacguggugaucgccauccugacagucguggccgcgaccauggccaacgagaugggcuuuuuggagaagacgaagaaggaccucggccugggcuccaucgccacccagcagccggagagcaacauccuggacaucgaccuccgccccgccuccgcguggaccuuguacgcgguggccaccacguucguaacccccaugcuucggcacucgaucgagaauagcuccgugaaugugagccucaccgcaaucgccaaccaggccacugugcugauggggcugggcaagggcuggccccucuccaagauggacaucggcgugccgcuguuggcgaucgggugcuacagccaaguaaaccccauuacgcucaccgcagcccugcugcuccuggucgcccacuacgcgauaaucggccccggccugcaggccaaggccacccgggaggcccagaaacgggccgcggcggggaucaugaaaaaccccacgguggauggcaucacggugaucgaccucgacccaauucccuacgaccccaaguucgagaagcagcuggggcagguuaugcugcucauccugugugugacccaggugcugaugaugcgcaccaccugggcccuaugcgaggcacugacgcuggccaccggccccaucuccaccuugugggaggggaacccgggucgguuuuggaacacuacgauugcgguaagcauggccaacaucuuccggggcuccuaccuggccggcgccggccuccucuucagcaucaugaagaacacaaccaacacccgucgcgggacgggaaacauaggcgagacccugggggagaaguggaaguccaggcugaacgcccucggcaagagcgaguuccagaucuacaagaagagcggcauucaggagguggaccggacccuggcgaaggagggcauuaagcgcggggagaccgaccaccacgccgugagccggggcagugccaagcuacgcugguucgucgagcggaacauggugacgcccgagggcaagguggucgaccucgggugcggcagggggggcuggagcuacuacugcgggggccugaagaacgugcgagaggugaagggccugaccaagggcggccccgggcacgaggagcccaucccgauguccaccuauggcuggaaccucgugcgccugcagagcgggguggacguuuucuucaucccgcccgagaagugcgacacccugcucugcgacauaggcgaguccagccccaacccgacggucgaggcgggccggacccugcgcgugcugaaccucguggagaacuggcugaacaauaacacccaguucugcaucaagguccugaaccccuacaugcccuccgugaucgagaagauggaggcgcugcagcggaaguacgggggcgccuuagugcgcaacccguugagccggaacaguacccacgagauguacuggguuucaaaugcuagcgggaacaucgugucuagcgugaacaugaucucccgcaugcugauuaacagguuuaccaugcgccacaagaaggcaacguacgaaccggacgucgaccucggcagcgggacccgaaacauugggaucgaguccgaaauccccaaccuggauauuaucggcaagcgcauugagaagauaaagcaggagcacgagaccucguggcauuacgaucaggaucacccguacaagaccugggccuaucacggguccuacgagacgaagcagaccgguagugcguccagcauggugaacgggguuguccggcugcugaccaagccgugggacgugcugcccacaguuacgcagauggccaugaccgacaccacaccauucggucagcagcgcgucuucaaggagaagguggacacgcgcacccaggagcccaaggagggcacgaaaaagcugaugaagauaacagcagaauggcuauggaaggagcuggggaagaagaaaaccccgcggaugugcacccgcgaggaguucacuagaaaagugcgcuccaacgccgcccugggcgcgaucuucacagacgagaacaaguggaaguccgcucgggaggccgucgaggacucccgcuuuugggagcucguggauaaggagagaaaccugcaccuggaggggaagugcgagacgugcgucuacaacaugaugggcaagcgcgaaaagaaacucggggaguucggcaaggccaaagggagccgugccaucugguacauguggcugggggcgcgcuuccucgaguucgaggcucucggcuuccuuaacgaagaccacugguucucccgggaaaacagccuuuccggggucgagggcgaagggcugcacaaacugggcuauauccugcgcgacgugagcaagaaggagggcggggccauguaugccgaugacaccgcggguugggacacccggaucaccuuagaggaucugaagaacgaggagauggucacgaaccacauggagggggagcacaagaaacuggccgaggccaucuucaagcucaccuaccagaauaagguggugcguguccagcggcccacgccccggggcacggugauggacaucaucagccggcgcgaccagcggggguccggccaggugggcacguacggacugaacaccuucacuaauauggaggcacaacugauccgccagauggaaggcgagggggucuucaaaaacauccagcaccucaccgccacggaggagaucgcggugcagaacuggcuggcccgggugggccgcgagcgcuuaagccggauggccauauccggcgacgacugcgucgugaagccccuggacgaccguuucgccaacgcccugaccgcucugaacgacauggggaagauccggaaggacauccagcagugggagccgagcaaaggauggaacgacuggacccaggugcccuuuugcucccaccauuuccacgagcuuaucaugaaggacgggcgcguccugguggugcccugccggaaccaggacgaacugaucggccgcgcgcggaucagccagggggcgggcuggucccucagagagaccgccugucugggaaaguccuacgcccagauguggucacugauguacuuccaccggagggaucuccggcuggcggccaacgccaucugcagcgccguccccucccacugggugccgaccagucgcaccaccugguccauccacgccaaacacgaguggaugacuacugaggauaugcugacgguguggaaccgggucuggauacgugagaaccccuggauggaggacaaaaccccggucgagagcugggaggagauacccuaccucggcaagagggaggaccaguggugcggcucccugaucggacugaccucgcgagcgaccugggccaagaauauccaggcagccauaaaccagguuaggucccucaucggcaacgaggaguacacggacuauaugccgagcaugaagcgcuuucggcgcgaggaggaagaagcggggguccuuugguga

SEQ ID NO: 25140 - RNA, 9876 nt, Artificial Sequence
  derived and/or modified CDS sequence (opt11) from DENV-2__FJ687445__SS-prME
agugucggcaugauaaucaugcugauccccaccguuauggccuuccaccucaccacgcgcaacggggagccccacaugaucgugagcauccaggagaaaggcaaaagccugcuguucaagaccgaagacggggugaacauguguacccugauggccauggaccugggcgaguuaugcgaggauaccaucaccuacaagugcccccuccugcggcaaaacgagcccgaagacaucgacugcuggugcaacuccacaaguaccugggucaccuacgguacgugcaccaccaccggggagcaccgccgugagaagaggucaguggcgcuggugccccacgucggcauggggcuggagacacggaccgagacuuggaugagcucugagggcgccuggaagcaugcucagcgcaucgagacuuggauccugcgucacccgggguucacgaucauggccgccauccuggcguauaccaucggcaccacccacuuucagcgcacgcugaucuucauccuacugaccgccguggcccccagcaugaccaugcggugcaucgggaucuccaaccgcgacuucguggagggcgucucaggcggguccuggguugacaucguccucgagcacggcagcugcgucaccaccauggccaagaacaagcccacccuggacuucgagcugaucaaaaccgaggccaagcagcccgcuacccugcggaaguacugcaucgaggccaagcucacgaacaccaccaccgagucccgcugccccacccagggggagcccagccugaaggaggagcaagacaaacgguucgugugcaagcacuccaugguugaccgcggcuggggcaaugggugcggccuguucgggaagggugggauagugaccugcgccauguuuacgugcaagaagaacauggagggcaaaaucgugcagcccgagaaucuggaguacaccaucgugguuacgccccacagcggggaggagcacgcugucgggaacgacacgggcaagcaugggaaggagaucaaggugaccccgcagucaucaaucaccgaggcugagcucaccggcuaugggaccgucaccauggagugcagcccccggaccggccucgacuucaacgagauggugcugcugcagauggagaacaaagcuuggcucgugcaccgccagugguuccuggacuuaccccuccccuggcugccgggcgccgacacccagggaagcaacuggauccagaaggagacgcuggucaccuucaagaacccccacgccaagaagcaagacguggucgugcucggcagccaggagggggccaugcauaccgcgcugaccggcgccacggagauccagauguccagcgggaaccuccuguucaccggccaccugaagugccggcuacgcauggacaaacuccagcugaagggcaugagcuauaguaugugcaccgggaaguucaagguugucaaggagaucgcggagacccagcacggcacgaucgugauccgggugcaguacgagggugacgguucccccugcaagauacccuucgagaucauggaccuagagaagcgcuauguccucggccggcucaucacugugaacccgaucgugaccgagaaggacagccccguaaacaucgaggccgagccgcccuucggagauuccuauauuaucaucgguguggagccggggcagcugaagcucaacugguucaagaagggcagcucuaucgggcagauguucgagacgacgaugcgcggcgccaagcgcauggcgauccugggcgacaccgcaugggacuucgggucccucggcgggguguuuacauccauaggcaaagcucuccaccagguauucggggccaucuacggcgccgcguucuccggcgugaguuggaccaugaagauccugauuggagugaucaucacguggauaggcaugaacagccgguccaccagccuguccgucagccuggugcuagugggggucgugacccuguaccugggcgugaugguccaggccgacuccgguugcguggugagcuggaaaaacaaggagcugaagugcggcagcggcaucuucaucaccgacaacguccacacguggaccgagcaguacaaguuccagcccgagucucccagcaagcuggccuccgccauccagaaggcccaggaggaggggaucugcggcauacgcagcgugaccaggcuggagaaccucauguggaagcagaucaccccugagcucaaccacauccuggcagagaacgaggucaaacuuacgaucaugaccggcgacaucaagggcaucaugcaagccgggaagcgcucccugcggccgcagcccaccgagcuaaaauacagcuggaagaccuggggcaaggcuaagaugcucuccacagagucucacaaccagaccuuccugaucgauggcccggagacggccgagugcccgaauaccaaucgcgcauggaacucccuggaagucgaagacuacgguuucgguguguucacuaccaacaucuggcucaagcugaaagagaagcaggacgccuucugcgacucaaagcugauguccgccgccaucaaggacaaccgggcgguccacgcggacauggguuacuggaucgagagugcccuaaacgacaccuggaagauagagaaggccuccuucaucgagguaaagaacugccacuggcccaagagccacacccuguggucgaacggcguccuggagagcgagaugaucauccccaagaaccucgccggccccgugucccagcacaacuacaggccgggguaucacacccagaucgcuggccccuggcaccuugguaagcuggagauggacuucgacuucugcgauggaaccaccguuguggugacugaggacuguggaaaccggggccccagccuccgcaccacgaccgcaagcgggaagcugaucaccgaguggugcugccgguccugcacccugccgccguuacgcuaccgcggugaggauggcugcugguacgggauggagauccgcccccugaaggagaaggaggagaaucuggucaacagccucgugacggccggccacggucagguagacaacuucucccugggcguccugggcauggcccucuuccuggaggagaugcugcggacucgcgugggcaccaagcaugcgauccucuugguggcggucagcuucgugacccugaucacaggcaacauguccuucaaggaccucgggcggguggucguaauggugggggccacuaugaccgacgacauugguaugggcgucaccuaccuggcccugcucgccgccuuuaaggugcgccccacguuugcggccggccuguuucugcggaagcucacgagcaaggagcugaugaugaccaccaucgggaucguccuuuuaucccagagcacgauccccgagaccauccuggaguugaccgacgcccucgcccuggguaugaugguccugaagauggugcgcgacauggagaaguaccagcucgccgucaccaucauggcgauacugugcgugcccaaugccgugauacuacagaacgccuggaagguauccugcacgauccucgccgugguguccgucagcccccugcuucucaccucuucccagcagaagaccgacuggaucccccuggcccugacgaucaaggggcucaaccccacggcgaucuuccugaccacccugagccgcaccaacaagaagcgguccuggccgcuuaacgaagccaucauggccgugggcauggugagcauccuggcauccagccugcucaagaaugauaucccaaugacgggcccgcuggucgccggcgggcugcucaccgugugcuacguucugaccgggcgcuccgccgaccuugagcucgagcgggccaccgacgucaagugggaggaucaggccgagaucagcgggagcucccccauacugucgaucacuaucuccgaggacgggagcauguccaucaagaacgaggaagaggagcagaccuugaccauccucauccgcaccggccugcugguuaucaguggccucuucccgguuuccaucccuaucaccgccgcggcgugguaccuuugggaggucaagaagcagcgggccggggugcugugggaugugccguccccgccgcccaugggcaaagccgagcucgaggacggggccuaucgcaucaagcagcggggcauccugggguauagccagauaggcgcgggugucuauaaggaggguacguuccacaccauguggcacgugacucggggcgcagugcugacccacaaggggaagcggauagagcccagcugggccgacgucaaaaaagaccucaucuccuacggcgggggcuggaaacuggagggcgaguggaaggagggggaggagguccaagugcuggcccuagagcccgggaagaacccccgcgccgugcagacgaaacccgggcuauucaagaccaacaccggcaccaucggggcggugagccuggacuucuccccaggcacaagcggcucccccaucaucgacaagaaagggaagguggucggccucuacgggaacggcguggugaccagaagcggcgccuacgucuccgccaucgcucagaccgagaagaguaucgaggauaaucccgacaucgaggacgacaucuucagaaagcgucgccugaccaucauggaccugcaucccggggccggcaaaacgaagcguuaccugccugcgaucgugcgugaggccaucaagcgggggcuccgcacacugaucuuggccccgaccaggguggucgcggcggagauggaggaggcgcuucgcggucugcccauccgcuaccagacccccgccauccgcgccgagcacacgggacgcgagaucguggaccugaugugccaugccaccuuuacuaugcggcuccugucccccguacgcgucccgaauuacaaccugaucaucauggaugaggcgcacuucaccgaccccgccagcauagcggcccggggauacaucagcacgcgcguagagaugggugaggcugcggggaucuuuaugaccgccacgccgcccggcucccgggacccauuuccccagagcaacgcccccaucaucgacgaagagcgggagauacccgagcgcuccuggaacagcgggcaugagugggucaccgacuucaagggcaagacggucugguucguuccgucgaucaaggccgggaacgacauugcagcgugucuccgcaagaacggcaagaaggugauccagcugagccggaaaaccuucgauuccgaauacgucaagacccgcaccaaugacugggacuucguggugaccaccgauaucagcgagaugggcgccaauuucaaggccgagcgagugaucgacccccgccggugcaugaagcccgugauccuuaccgacggugaggagcgcgugauccucgccgggccaaugccagucacccacuccagugcggcacagcggcgcgggaggaucggccgcaacccuaagaacgaaaaugaccaguacauauacaugggggagccucuggaaaacgacgaggacugcgcccacuggaaggaggccaagaugcugcucgauaauaucaauacgcccgagggcaucaucccgaguauguucgagccagagcgggagaagguggacgccaucgacggggaguaccgccugaggggugaggcgcggaagaccuucguggaccugaugcgcaggggcgaucuccccgucuggcuggccuacaagguggccgccgaggggauuaacuacgccgaccgcagauggugcuucgauggcaucaagaacaaccagauccuggaggaaaacguugagguggagaucuggaccaaggagggggagcgcaaaaagcucaagccgcgguggcuggacgcgcgcaucuacucggauccccuggcccucaaggaguucaaggaauucgccgccggccggaagucccugacccugaaccucaucacggagaugggccggcugcccacauuuaugacccagaagacccgggacgcccuggacaaccucgcggugcugcacacugccgaggccggaggccgcgccuacaaccaugcgcugagcgaacuccccgagacccuggagacccuucuccugcugacccuccuggccaccgucaccgggggcaucuuccuguuccucauguccggccgggggaucggaaagaugaccuuagggaugugcugcaucguuaccgcaagcauccugcucugguacgcccagauccagccgcacuggaucgccgcguccaucauccuggaguucuuccugaucgugcucuugauccccgagcccgagaagcagcgcacuccccaggacaaccagcugacguacgucgugaucgccauccugaccguggucgccgccaccauggccaacgaaaugggcuuccuggagaaaaccaagaaggaccuggggcucggcucaaucgcgacgcagcagccggagucuaacauucuggacaucgaccugcggcccgccagcgccuggacccucuacgccguggccaccaccuucgugacacccaugcuacgccacuccaucgaaaacuccagcgucaacgugucccugaccgcgauagccaaccaggccaccgugcucaugggccuagggaagggcuggccccugagcaagauggacaucggggccccgcuccuggccaucggcugcuacucccaaguaaaccccauuacacugacggcggcccucuugcugcuaguggcgcacuacgcuaucauaggucccggucugcaggcgaaagccacccgggaggcccagaaaagagccgcggcaggcaucaugaagaaccccaccguggacgggaucacugucaucgaccuggacccgaucccccacgaccccaaguuugagaagcaacuuggacaggugaugcugcuggugcucugugucacgcaagugcugaugaugagaaccaccugggcccugugcgaggcccucacccuggccacgggccccaucagcacccugugggagggcaauccggggcgcuucuggaacaccaccaucgcugucucgauggcgaacaucuuccggggaagcuaccucgccggugcagggcugcuguucuccaucaugaagaacacgaccaacagccgccgcggaaccgggaacaucggcgaaacccuaggcgagaaguggaagucccggcuaaacgcccuggguaagagcgaguuucagauauacaagaaguccggcauccaggaggucgacaggacgcucgcgaaggaggggaucaagagaggcgagaccgaccaccacgcgguuagccguggguccgccaaguugcggugguucguggagcgcaacauggucacccccgagggcaaggugguggaucugggcugcgggcggggcggguggagcuacuacugcggagggcucaaaaacguucgcgaggugaagggcuugaccaagggcgggcccggccacgaggagcccaucccgauguccacguacggauggaaccugguacgguugcagagcggcgucgauguguucuucaucccgcccgagaagugcgauacacugcugugcgacaucggggaguccagccccaacccgaccguggaggccggccgcacccuccggguccucaaccugguagagaacuggcucaacaacaacacccaguucuguaucaagguguuaaaccccuacaugcccagcgucaucgagaagauggaaacgcugcagagaaaguauggcggggcccuggugcggaacccgcucucccgcaacaguacccacgagauguacuggguauccaacgcgaguggcaacaucgucuccagcgugaacaugaucucccgcaugcuaaucaaucgcuucaccaugcggcauaaaaaggccaccuacgagcccgacguggaucuggggagcggcacgcgcaacauugguaucgaguccgaaauccccaaucucgacaucaucgggaagagaauugagaagaucaagcaggagcacgagaccagcuggcacuacgaccaggaccacccauacaagaccugggccuaccacggcaguuacgagacgaagcagacggggucagccucaagcauggucaacggcguggugcgccugcugaccaagccgugggacguccuccccaccgugacccaaauggccaugacugauaccacccccuucgggcagcagcguguguucaaggagaaggucgacacccggacgcaggagcccaaagagggcaccaagaagcugaugaagauaaccgccgaguggcuguggaaggagcucggcaaaaagaagaccccgcgcaugugcacgcgggaggaguucacccgcaaagugcguuccaacgccgcgcugggagccaucuucaccgacgaaaacaaguggaaguccgcccgcgaggcggucgaggacucgcgguucugggagcugguggacaaggagcgcaaccuccaccuggagggcaagugcgagaccugcguauacaacaugauggggaagcgggagaagaagcugggcgaguucgggaaggccaagggcagcagagccaucugguauaugugguugggcgcccgguuccuggaguucgaggcccuuggguuccucaacgaagaccacugguucagucgcgagaacagccugucuggcgucgagggggagggcuugcaccgccuuggguacauccugcgcgacguguccaagaaggagggcggcgcgauguacgcagacgacacggccgguugggauacaaggauaacccuggaggaccucaagaacgaggagauggugaccaaucacauggagggcgagcacaagaagcuggccgaggccaucuuuaagcugacguaccaaaacaaggucgugcgcgugcagcgccccacgccccgggggaccgucauggacauaaucagccggcgagaccagcggggcuccggacagguggggacauacggccucaacaccuucacaaacauggaggcccagcuuauccgccagauggagggggaaggaguauucaagaacauacagcaccugaccguuaccgaagagauugccgugcagaacuggcucgcccgcguaggacgggaacgccugucccggauggccaucucgggcgacgacugcgucgugaaaccgcuggaugaccgcuucgcgagcgccuugacggcccuuaacgacaugggcaagauccggaaggacauccagcagugggagccgucacgcggguggaacgacuggacccaggugcccuuuugcucacaccacuuccacgagcugaucaugaaggacggcagaguucucguggugcccugccgcaaccaggacgaacugauagggcgggcccgcaucucccaaggcgccggauggagccugcgggagaccgcgugccucggaaaguccuacgcgcagauguggagccugauguacuuccaccgcagagauuugcgccucgccgcaaacgccaucuguuccgcggucccgucccacugggugccgaccucccggacaacguggagcauccacgccaagcacgaguggaugaccaccgaggacaugcugaccguguggaaucgugucuggauccaggagaaccccuggauggaggacaagacgcccguagaguccugggaggagauacccuaccucggcaagcgggaagaccaguggugcgggagccucaucggucugaccagccgcgccaccugggccaagaacauccagguggccaucaaccaggucaggucccugaucgggaacgaggaguacaccgauuacaugccgagcaugaagcgcuuccgccgggaggaggaggaggcgggcguccucugguga

SEQ ID NO: 25141 - RNA, 9876 nt, Artificial Sequence
  derived and/or modified CDS sequence (opt11) from DENV-2__FJ687447__SS-prME
uccgccggcaugauaaucaugcugaucccuacagugauggccuuccaccucaccacccggaacggagagccccauaugauugucggcauucaggaaaagggaaagucucugcuauucaagaccgaggacggaguaaacaugugcacucucauggcgauggaccugggggagcugugugaagacacuaucacguacaagugcccccuccuaagacaaaacgagcccgaggacaucgacugcuggugcaauucgaccagcaccugggugaccuacgggaccugcacgaccaccggcgaacacagacgggagaagcgaucagucgcccuggugccccacguuggcauggggcuugaaacccggaccgaaaccuggaugagcagcgagggggccuggaagcacgcccagcgcauagagaccuggaucuuacggcacccuggguucaccaucauggcagcgauccuugcauacaccaucgggaccacccauuuccagcgcgcucuuaucuucauccuacuaacggccguggcaccauccaugacuaugcgguguauaggcaucagcaaccgcgacuucguggaggguguguccggggguagcugggucgauaucgugcucgaacacgggucgugcgugaccaccauggcgaagaacaagcccacgcuggacuucgagcugauuaagaccgaggccaagcaaccggcuacccuucguaaguauugcaucgaagcaaaacugaccaacaccacuaccgagucacgcugcccaacccagggcgagcccuccuugaaggaagaacaggacaagcgguucguuugcaaacacagcaugguggacagagggugggggaacggcugcgggcuguucggcaaaggcgggaucgucacgugcgcgauguuuaccugcaagaaaaacauggaggguaagaucguccaaccagagaaccuggaguacaccaucgugguaacgccgcacuccggggaggagcacgccgucgguaaugacacagggaagcacggcaaggagaucaaagugacgccgcaaucuuccauuacagaggccgagcuuacuggauacggaaccgucacaauggagugcagcccccguaccucccucgacuucaacgagaugguacugcugcagauggagaacaaggccugguuaguucaccgacagugguuucuggauuuaccccuaccguggcugccgggcgccgauaagcaggagagcaacuggauucaaaaggaaacucucgugaccuucaagaacccccaugcgaagaagcaggaugucguggugcuugggucccaagagggcgccaugcacaccgcccugaccggggcgacagagauacagauguccagcgggaaucuccuguucaccgggcaccugaagugccgacugcgcauggauaaauuacagcugaagggcauguccuacucgaugugcaccggcaaguucaaaguugugaaggagaucgccgaaacacagcacgggaccaucgugauaagagugcaauaugaaggcgacgggucccccugcaagauccccuuugagaucauggaccuggagaaacgcuacgugcuaggucgccugaucaccgucaauccgauaguuaccgagaaggacuccccggugaauaucgaggcggagccgccuuucggcgacuccuauaucauaaucggcgucgagccgggccagcugaaacucaauugguucaagaaggggagcuccaucggacagauguucgagaccaccaugcggggagcgaagcgcauggccaucuuaggcgacaccgcgugggacuucggcagccucggugggguguucacguccauugggaaggcccuacaccaagucuucggggcgauuuacggggcagccuucagcggcguaucguggacaaugaagauccugaucggcgugaucauaacauggaucgggaugaacagccgauccaccucacuauccgugucauugguucucgugggcauagucaccuuauaccuaggugugauggugcaggccgacuccggcugcguagucuccuggaagaacaaggagcucaaauguggcucuggcaucuucaucaccgacaacgugcauaccuggaccgagcaguacaaauuccagcccgagucccccucgaagcuggcguccgccauccagaaagcacaggaggaaggcauuugcgggauuagaucggugacccggcucgaaaaccucauguggaagcagauaacccccgagcucaaccacauucuggccgagaaugagguaaagcugacgaucaugaccggcgauaucaagggaaucaugcaggccggaaagcgcucccuacggccacagcccacggaacugaaguacuccuggaagaccuggggaaaggcuaagaugcucaguaccgagagcuauaaccagacguuucuuaucgacggccccgagacggccgagugccccaacaccaaccgggccuggaacucccuggagguugaagacuacggauuuggggucuuuaccaccaauauauggcucaagcugaaggagaagcaggaugccuucugcgauagcaagcugaugagcgccgcgauuaaagacaaccgggcaguccacgcagacaugggcuacuggaucgaaagcgcccucaacgacacguggaagaucgagaaggccuccuucaucgaggugaagaacugucauuggccaaaaagccacacgcuuugguccaauggggugcuggagagcgagaugauaauacccaagaaccuugcgggccccgucucgcagcacaacuaccgcccgggcuaccacacccagaucgccgggcccuggcacuuggguaagcuggagauggacuucgacuucugcgacggaaccacgguaaucgugacggaggacugcggcaaccggggacccucucucaggaccaccaccgccagcggcaagcugaucacggaauggugcugccgcuccugcacucugcccccucuccgcuacaggggcgaggacggguguugguauggcauggaaauccgcccgcugaaggaaaaggaagagaaucugguuaauagcuugguuaccgccggccacggccagguggauaauuucucucucgguguccuggggauggcgcuuuuccuggaggagaugcugcggacacgcguaggaacuaagcacgccauccuucugguggccgucuccuucgugacccuaaucacugggaacauguccuucaaagaccucgggcggguaguagugaugguuggggccacuauggcagaugauaucggaaugggagucacguaccuggcguugcucgccgcguuuaaggugcgccccacauucgcagccggccuguuacuccggaagcugaccagcaaggagcugaugaugaccacuaucggcaucguacuccugucacagaguaccaucccagagaccaucuuagagcucacagacgcgcuugcccuggguaugaugguccucaaaaucguucgcaauauggagaaguaccaguuagccgugacgaucauggcuaucuugugcgucccuaacgccgugauccugcaaaaugcguggaaggucucaugcacaaucuuggccgugguaagugucagucccuugcuccugacuagcagucagcagaagacagacuggauaccccuggcccucacgauuaagggccugaaccccaccgccaucuuucucacaacauuaagccgcacgaauaagaagcgguccuggccgcuaaacgaggcgaucauggccguggggauggugagcauacuggccaguucgcuccugaagaacgacauccccaugaccggcccccuggucgccggcggacuauuaaccguaugcuacgugcugacuggucgcucugcugaccuagagcuggaacgggcgacggacgucaaaugggaggaucaggccgagaucuccgggucgucccccauccugucaaucaccauauccgaggacggcagcaugagcaucaaaaaugaggaagaggaacagacccuuaccauccugauccgcacagggcugcuggugauuagcgggcuguucccaaucucaauacccaucaccgccgccgcuugguaucuuugggaaguaaagaagcagcgggcgggcgucuuaugggacguacccucuccgccucccaucggcaaggccgaguuggaggauggcgccuaccgaauaaagcagaagggaaucuugggcuacagucagaucggggccggcguuuacaaggagggaacauuccacaccauguggcacgucacccgcggggcggugcucaugcacaaggggaagcgcauugagcccucgugggccgacgugaagaaggaucugaucucuuaugggggcggguggaaacuugaaggcgaguggaaggaaggcgaagagguccagguccucgcacuggagcccggaaagaauccccgggccgugcagacgaaaccggggcuauucaaaaccaacaccgguaccauaggugccgucagccuggacuucuccccggguacgagcgguucccccaucaucgacaagaagggaaagguaguggggcuguauggcaacggcgucgugacccguagcggcgccuacguguccgcgaucgcccagacagaaaaguccaucgaggauaacccagagaucgaggacgacauauuucggaagcgccgacugaccauuauggaccugcaucccggagcugggaagacgaaacgcuaucucccagccaucguccgggaggcgauaaagcgcggccuucggaccuugauucuugccccgacgcgcgugguggcugccgagauggaggaggcgcugcgggggcugcccauccgauaccagacccccgcgauacgggccgagcacaccggccgcgaaaucgucgaccucaugugucacgcuacuuucaccaugcgccugcuuucccccguacgagugccgaauuacaaccucauuaucauggacgaagcccauuucacggaucccgccagcaucgcggccaggggguacaucagcacgcgggucgagaugggcgaggccgccggcaucuucaugaccgcaacgccacccgguucccgcgaccccuucccccagagcaacgcgccuaucaucgacgaagagcgggagauacccgaacgcuccuggaacagcggccacgagugggugaccgacuucaaggggaagaccgugugguucgucccguccauuaaagccggcaacgacauagccgccugucuucggaagaacgggaagaaaguuauacagcugagccgcaagaccuucgacucugaguacgucaagacgcggacuaaugacugggacuuugucgugacgaccgauaucucggagaugggagcgaacuucaaggccgagcgcguaauugacccgcggcgcugcaugaagcccgucauccugaccgacggcgaggagagggugauccucgcagggcccaugccggugacccacaguagcgccgcccagcgccgggggcgcaucgggcgcaaccccaagaacgaaaacgaccaguacaucuacaugggugaaccccuugaaaacgacgaggacugcgcgcacuggaaggaggccaagaugcucuuggacaacaucaauacaccggaggguaucaucccguccauguucgagcccgagcgugaaaaagucgacgccaucgacggcgaguaucggcuacgaggcgaagcacgcaagacguucguugaccucaugcgccgcggggaccuuccgguguggcuggccuucaagguugcggccgagggaauaaacuacgccgaucggcgcuggugcuucgacgggaucaagaauaaccaaauccucgaggagaauguagagguggagaucuggaccaaggaaggcgaacggaagaaguugaagccgagguggcuagacgccaggaucuacagcgacccccuggcucugaaggaguucaaggaguucgcggccgggcgcaagucacugacccucaaccugaucacugagaugggccgccugcccaccuucaugacccaaaagacccgcgacgcgcuugauaaccucgccguccugcauacggcggaagccggaggucgggccuauaaccaugcccucagcgaacucccggagacgcucgagaccuuguuacugcucacccugcuugccacagugaccggaggaaucuuccucuuccugaugaguggacgcgggaucgggaagaugacccugggaauguguugcaucauuaccgccagcaucuugcugugguacgcacagauucaaccucacuggaucgccgcguccaucauacuggaguucuuucucaucgugcugcugauccccgaacccgagaagcagcggacgccucaggacaaccaacucacuuacguggugauugcaaucuuaaccgucgucgcggccaccauggccaacgagauggguuuccuggaaaagaccaagaaggacuugggccucggaagcauugccacgcaacagccggagucuaacauacucgauaucgaccuccgucccgcuagcgcguggacacuauaugccguggcaacgaccuuugucacgccuaugcugcggcacagcauugagaauucaagcgugaacgucucccugaccgcuauugcaaaccaggcgacugugcugaugggguuaggcaagggauggccauuaagcaagauggacaucggcgucccgcugcuggccaucgggugcuauucccaggugaauccuaucacccucacggcugcgcugcuccuccugguggcgcacuacgccauuaucggcccagggcugcaggccaaggcgacccgcgaggcccagaagcgggcggccgcaggcaucaugaagaacccuaccguugacggcauuaccgugauagacuuggaucccauacccuaugaucccaaguuugagaagcagcuggggcaagucaugcugcuaauacugugcgugacccaggugcugaugaugcgcaccaccugggccuugugcgaggccuuaacauuggcaaccggccccaucagcacccucugggagggaaaccccggccgguucuggaacacuaccaucgccgucuccauggcgaacauuuuuagaggaagcuaccuggcuggcgccggccuccucuucucaaucaugaagaacacgacuaacacccggcgcgggaccggcaacaucggggaaacacugggcgagaaauggaaauccaggcugaacgcacucgguaaguccgaauuccaaaucuacaagaaguccgggauccaggaaguugaccggacgcuggccaaggaagggaucaaacgcggggagaccgaccaucacgccgugucccguggcagcgccaagcugcgaugguucguagagcggaacauggugacaccggaggggaaagugguagaccucggcuguggccgcgggggcugguccuacuacugugggggccugaagaacgugcgggaagucaaaggacuuaccaagggaggucccgggcaugaggagccaauaccaaugagcaccuacggcuggaaccucguccgccugcagucggggguggacguauucuucaucccgcccgagaagugcgauacccuccucugugauaucggcgagagcagucccaacccuacuguagaagcggggaggacgcugcgcgugcugaacuuaguggagaacuggcuaaacaacaacacccaguucugcaucaagguccugaacccauauaugcccagcguuaucgagaagauggaggcccugcagcggaaguacgguggcgcccucgugcgcaacccgcugagcagaaacuccacucacgagauguauugggucucgaacgccuccgggaacaucgugagcucggucaacaugauuagccgcaugcugaucaaccgcuucaccaugcgccacaagaaggcuacuuacgagcccgacguugacuuagguuccgggacgcggaauaucgggaucgagucagaaauccccaaccuggacauaaucgggaagcgcaucgagaagauuaaacaagagcacgagacguccuggcauuacgaucaagaucaccccuacaagacgugggcguaccacgguaguuacgaaaccaagcagacgggcagugcaagcuccauggugaacgggguuguccgucuucucaccaagccgugggacguucugcccaccgugacccaaauggccaugacggacaccacccccuucgggcagcagcgcgucuucaaagagaagguagacacccgaacgcaagagcccaaggaagggaccaagaagcugaugaagaucaccgcugaguggcucuggaaggagcugggaaaaaagaagaccccgagaaugugcacgcgcgaggaguucacuaggaaggugcgcucaaaugccgcauugggcgccaucuucaccgacgagaacaaguggaaguccgcuagagaggcaguagaggacagccguuucugggaauugguggacaaggagcggaacuuacaccuggagggaaagugcgagaccuguguuuacaacaugaugggaaaacgcgagaagaagcucggggaauucggcaaggccaagggcucccgggcgaucugguacauguggcugggcgccagguuccuagaguucgaggcccucgguuuucugaacgaggaccauugguucagccgggagaacucccuguccgggguagagggcgaggggcuccauaagcugggauauauccuacgugacgugaguaagaaggagggcggcgccauguacgccgacgacacggccgggugggacacccggaucacccuugaagaucugaaaaaugaggagauggucaccaaccacauggagggggagcacaagaagcuggccgaggcaauuuucaaacucacguaccagaacaaggugguacgaguccagagaccuacgccccggggcaccgucauggacauuauuucccggcgugaccagcgggggaguggccagguggggacauacggccugaacacguucaccaacauggaagcccagcugaucagacagauggagggagagggggucuuuaagaacauucagcaccucaccgugaccgaggagguggcgguccagaacuggcuggcccggguuggcagagaacgccugucgcggauggccauuucuggggaugacugcgucgucaagccccucgacgaccgcuucgcgaaugcgcugacugcguugaacgacaugggcaagauucggaaggauauccagcaaugggagcccuccaagggcuggaacgacuggacgcaggugcccuucugcucacaccacuuccaugagcuuauaaugaaggacgggcgugugcucgucgugcccugccggaaccaggaugagcucaucggucgcgcaagaaucucccagggggcagguuggagucucagagaaaccgccugccuagggaaaucauacgcccagauguggagccucauguacuuccaccgccgcgaccuccgcuuggcggcgaacgccaucuguuccgcugugccaagccacugggucccgaccucacgcacgaccuggagcauccacgcgaagcacgaguggaugaccaccgaggacaugcugaccguguggaaccggguguggauccgcgagaaccccuggauggaggacaagacacccgucgagucaugggaggagaucccguacuugggcaagagagaggaccagugguguggcagccugaucggucuuaccucccgcgcgacuugggcgaaaaacauccaggccgccaucaaccagguacggagccuuauagggaacgaggaguacacagacuauaugccauccaugaagcgcuuuaggcgcgaggaagaggaggcaggggugcugugguaa

SEQ ID NO: 25142 - RNA, 9876 nt, Artificial Sequence
  derived and/or modified CDS sequence (opt11) from DENV-2__FJ810411__SS-prME
agcgccggcaugaucaucaugcugauccccacggugauggcuuuccacuuaaccacccggaacggcgagccccacaugaucguuggcauccaggagaaggguaagucucugcuguucaaaaccgaggacggcguuaauaugugcaccuugauggcgauggaccugggugagcugugcgaagacaccaucaccuacaagugcccccuccugagacagaacgagccagaggacaucgacugcuggugcaauagcaccagcaccuggguaacuuacgggaccugcaccacgaccggcgagcaccggcgggagaagcgguccgucgcccuggugccccacguuggcaugggccucgagacccggaccgagacguggaugagcucggaaggcgccuggaaacacgcacagcgcaucgagaccuggauccugcggcauccgggcuucacgaucauggccgcgauccuggcguacaccauagggacaacccauuuccaacgcgcacucaucuucauccuccugacggcugucgcgccguccaugacaaugcggugcaucggcaucuccaaucgcgacuucguggagggggugucugggggguccuggguugacaucgugcucgagcauggguccugcguaaccacuauggccaagaacaaacccacucuggauuucgagcugaucaagaccgaggcaaagcagcccgccacccuacggaaguacugcaucgaggccaagcugacgaacacgaccaccgagagcagaugccccacacaaggcgagcccucccuuaaagaggaacaggauaagcgguuugucugcaagcacucaaugguggaccgcggcuggggcaacggcugcgggcuguuuggcaagggcggcaucgucacgugcgcgauguucacgugcaagaagaacauggaggguaagauaguccagcccgagaaccuggaguacaccaucguggucacuccgcacucgggggaagagcacgcagucggcaacgacacaggaaagcauggcaaggaaaucaaggugaccccgcagagcuccaucaccgaggccgagcugacgggguacggcaccgugaccauggagugcagcccgcggaccagccucgacuucaaugagaugguuuugcugcagauggagaacaaagccuggcuggugcaccgccaaugguuccuggaucugccucuccccuggcugccgggugccgacaagcaggagagcaacuggauccagaaggagacccuggugaccuucaagaacccacacgccaagaaacaggacguugugguccucgguagccaggagggcgccaugcacacggccuugaccggggccacggagauccagauguccagcggcaaccuccuguucacuggccaccugaagugccggcugcgcauggauaaacuccaguuaaagggcauguccuacuccaugugcacggggaaauuuaagguggugaaagagaucgccgagacccagcacgguaccauuguaaucagaguacaguacgagggcgacgguagcccaugcaagauacccuucgagaucauggaccuggaaaaacgauacgugcucggccggcugauaaccgucaacccgauugugacggagaaagacagcccagugaacaucgaggcggagccuccguuuggugacagcuacauuaucaucgggguagagccgggacagcugaagcucaacugguucaagaaagggagcaguaucggccagauguucgagaccaccaugcgaggugccaaacgcauggccauccugggggacacugccugggacuuugguucuuuaggcggaguguucacguccaucgggaaggcccuccaccagguguucggggcgaucuacggggccgcauucagcggcgucuccuggaccaugaaaauccucaucggcguaaucaucaccuggauagggaugaauagcagguccaccagccuguccgugucccucguccucgugggcaucgucacgcuguaccugggggugauggugcaggcagacuccggcugcguggucagcuggaagaacaaagagcucaagugcgggagcggcaucuucaucaccgacaaugugcacacauggaccgagcaguacaaguuccagccggagucccccucuaagcuggcguccgccauccagaaggcccaagaggagggcaucugcgggauccgcuccguuacgaggcuggagaacuuaauguggaagcagaucacgcccgagcugaaccauauccuggccgagaacgaggucaaguuaaccaucaugacuggcgacaucaaggggaucaugcaggccgggaagcguucccugcggccgcagcccacggagcuaaaguacagcuggaagacuugggggaaggcaaagauguuguccacggagucuuacaaccagaccuuucuaauugauggccccgagacggcggagugcccgaacaccaaccgcgccuggaacucccuggagguggaggacuacggcuucgggguguucaccaccaacauuuggcucaaauuaaaggagaagcaggaugcuuucugcgacagcaagcugauguccgccgcgaucaaggacaaccgagccguccaugccgacaugggcuacuggauagagagcgcgcucaacgacacguggaaaaucgagaaggccuccuuuauagagguuaagaauugccacuggccaaagagccacaccuuaugguccaacggggugcuggagucugagaugaucauuccuaagaaucucgcgggccccguuucccagcacaacuaucgcccggguuaccacacccagaucgccggucccuggcacuuaggcaagcuggagauggacuucgacuucugcgacgggaccaccguaauagugacggaggacugcgggaaccgugggccgagccuccgcaccaccacagcgagcggcaagcugaucacggaguggugcugccgguccugcacucugcccccguuacgcuacagaggcgaggacggguguugguauggcauggagaucaggccccugaaggagaaggaggagaaccuuguuaacucgcuugugacagccgggcacggccagguggacaacuucucucucgggguccuggguauggcccuguuccucgaagagaugcuccggacccgcgugggcacgaagcacgccauuuuauugguggccgucagcuucgugaccuugauaacggggaacaugucauucaaggaucucggccgugucguugugauggugggggccaccauggcagaugacaucggcaugggcgucacguacuuagcgcugcucgccgccuucaaagugcgccccaccuucgccgccggccugcuucuccggaagcugacuagcaaagagcugaugaugacuacgaucggcaucgugcugcugucccagagcacuaucccugaaacaauccuggagcucaccgacgccuuggcccuggggaugaugguucuaaagaucgugcgcaauauggagaaguaccaacuggcugugaccaucauggccauucugugcgucccgaacgccgucauccuccaaaacgcguggaaggucuccugcacgauccuggccgucgugagcgucagccccuuacuacugaccagcagucagcagaagaccgauuggaucccccuggcccucacgaucaaaggccugaaccccaccgccaucuucuuaaccacacucucccgcacgaacaagaagcgguccuggccgcugaacgaagcgauuauggccguggguaugguaucaauccuggccuccagccuccugaagaacgauauacccaugaccggcccccuuguagccggcggccuccugaccgugugcuacgugcuuaccggcagguccgccgaccucgagcuggagcgggcaacggacgucaagugggaagaccaggccgaaaucucugggucuucccccauccuaucgaucacgaucuccgaggacggauccauguccauaaagaacgaggaggaggagcagacccucaccauccuuauccgcaccggguugcucgugaucagcggccuguuuccgaucuccauucccauaaccgccgccgccugguaccuaugggaggucaaaaagcagcgggcgggcguacucugggacgugccguccccaccucccauagggaaggccgagcuggaggauggcgcuuaccgcaucaagcagaaggggauccugggcuacucccagauuggagccggcguuuacaaggaggggaccuuccacaccauguggcacgucacccgcggggcggugcucaugcacaagggcaagcgcaucgagcccucuugggcagacgugaagaaggaccugaucuccuacgggggcggguggaagcuggagggcgaguggaaggagggcgaggaaguccaggugcucgcccuagagcccggaaagaacccccgggccguccagacgaaacccggccuguucaagacuaacaccgggaccaucggggcugucagucuugacuucucccccgggacgagcggcagcccgauuaucgacaagaagggcaagguggugggguuguacgggaacggcgucgucacccgcagcggagcauacgugucagcaaucgcccagaccgagaaauccaucgaagacaaccccgagaucgaagaugacaucuuccggaagcgcaggcugaccaucauggaucugcaccccggugccgguaagacgaaacgcuaccucccggcaaucguccgggaagcuauuaagcgcggccugaggacgcugauccucgcaccgacccgcgugguagccgccgagauggaggaggcacugcggggacuucccauccgcuaccagacccccgcgauaagggccgagcauacgggccgcgagauugucgaccucaugugccacgccaccuucaccaugcgccugcugucgcccgugagaguucccaacuacaaccucaucaucauggacgaggcccauuucaccgaccccgccaguaucgcggcccgcggguacauuagcacgcgugucgagaugggcgaggcagccggcauauucaugaccgccacuccgcccggcucccgcgacccguucccccagucuaacgcgcccauuauagacgaagagagagagauccccgagcgauccuggaauucuggucacgagugggugaccgacuucaaggggaagacagugugguucgucccguccaucaaggccggcaacgacaucgccgcaugccugcggaagaacgggaagaaaguuauccagcugagucgcaagacuuuugauagcgaguacgugaagacccguaccaacgacugggacuucgucgugacgacggacaucagcgagaugggcgcgaacuucaaggccgagcgcguuaucgacccacggcgcuguaugaagcccgucauccuuaccgacggcgaggaacgggugauccuggccgggccaaugccggugacccacaguagcgccgcacaacgccggggccgcaucggacggaacccgaagaacgagaacgaccaguauaucuacaugggcgaaccucuggagaacgacgaggacugcgcgcacuggaaagaggccaagaugcuccuggauaacauaaacacgcccgaggggaucaucccgucaauguucgagcccgagcgcgagaaggucgacgccaucgacggcgaguaucggcuccgcggcgaggcccgcaagacuuucgucgaccucaugcgccgcggugaccugcccguguggcuggccuucaaggucgcggccgagggcauaaacuacgccgaccggcgcuggugcuucgaugggauuaaaaauaaccagauucucgaggagaaugucgagguugaaaucuggaccaaggagggcgagcggaagaagcugaagccgcgcuggcuggacgcacggauauacagugacccccuagcccugaaggaguucaaagaauuugcggcaggccguaagucucugacucuaaaccugauaacagagaugggccggcugccaaccuucaugacccaaaagacccgcgacgcgcucgacaacuuggccguacugcauacggcggaggccggcggacgggccuacaaccacgcacucagcgagcugcccgagacccuggagacguugcuucugcucacacugcuggccacggucaccggugggaucuuucuuuuccuaauguccggccgcgguaucgggaagaugacucugggaaugugcugcaucaucaccgcguccauucuccugugguacgcccaaauccagccgcauuggaucgccgccuccaucauacuugaguucuuccucaucguucugcuaauccccgagccagaaaaacagcgcacgccacaggacaaccaacucacauacguugugaucgccauccugacggucguggccgccaccauggccaacgagaugggguuccuggagaagaccaagaaggaccucgggcuggggucgaucgccacgcagcagccggaguccaauauacuggacauagaccuccgccccgcauccgcguggacguuauacgcgguugcuaccaccuucgugacgcccaugcugcgacacucuaucgaaaacuccagcgugaacgugucccugaccgccaucgccaaccaggccaccguccugaugggccucgggaaaggcuggccgcucagcaaaauggauauaggcgucccgcuguuagcaaucgggugcuacucccaggugaaccccaucacccucaccgccgcccugcugcuccucgucgcgcacuaugcaaucauaggccccgggcugcaggcgaaggccacccgggaagcccaaaagcgggcggccgccggcauuaugaagaaccccaccguugacggcauuaccguuaucgaccucgacccgauccccuacgaccccaaguucgagaagcaguuagggcaggugaugcuguugauccuuugcgugacucaggugcugaugaugcgcaccacgugggcccucugcgaagcuuugacccuggcgacgggccccaucagcacccucugggaggggaacccgggccgguuuuggaauaccacgauagccgucuccauggccaacaucuuccgcggcagcuaccuugccggcgccggccuccuguucuccaucaugaagaacacgaccaacacccggcgagggaccggcaacaucggggaaacgcugggcgagaaauggaagucccgccugaacgcucucggcaaguccgaauuccagauuuacaagaaauccgguauucaggaagucgaccggacacuggccaaggaggguaucaagagaggcgaaacugaccaucacgccgucucccggggcagcgccaagcuccgcugguucgucgagcguaacauggucaccccggaggggaagguggucgaccucggcugcggccgcgguggcugguccuacuacugcgguggccugaagaauguccgggaagugaagggcuuaacaaaaggaggcccagggcaugaggagcccaucccgaugagcacuuacggauggaaccucguccgccuacagucgggggucgacguauucuucaucccgccggagaaaugugacacacuucucugcgacauuggugaaagcucucccaacccgacggucgaggccgggcggacguuacgcgugcuaaaccucguggaaaacuggcugaacaauaacacccaguucuguaucaagguacugaaccccuacaugcccagcguuauugagaagauggaagcccugcagcggaaguacggcggcgcgcucgugcgcaauccgcuuagcagaaacuccacccacgagauguacuggguaagcaacgccagcggaaacaucguuagcagcguaaacaugaucagccguauguugaucaaccguuucacgaugaggcauaaaaaggccaccuaugagcccgacgucgaccucggcuccgggacucggaacaucggcauugagagcgaaauccccaaccuggacauaauagggaagcgcauagagaagaucaaacaggagcacgagacauccuggcauuaugaccaggaucaccccuauaagaccugggcguaucacggcagcuaugagaccaagcagacgggcagugccagcucaauggugaacgggguuguacgucuacucaccaagccaugggacgugcugcccacuguaacccagauggcaaugacggacaccaccccuuucggccagcagcgcgucuucaaagagaagguggauacucgcacucaagagcccaaagaggggaccaagaaacugaugaagaucaccgccgaguggcucuggaaggagcugggcaagaagaaaaccccgcggaugugcacccgcgaagaguucaccaagaaggugcggagcaacgccgcgcugggugccauuuucaccgacgagaacaaauggaaguccgcccgcgaggccgucgaggauagccgguuuugggaguuaguugacaaagagcggaaccuccaccucgaggggaagugcgagacuugcgucuacaacaugaugggcaaacgggagaagaagcucggggaguucggcaaggccaaagggagccgcgcgaucugguacauguggcugggcgcccgcuuccuggaguucgaggcccugggcuuccugaacgaggaccacugguuuagcagggagaauucccugucuggugucgaaggggaagguuuacacaaacugggcuacaucuuacgggacgugagcaagaaagaaggcggcgcuauguacgcggaugacacggccggcugggacacccgcaucacccucgaagaccugaaaaacgaggagaugguuacgaaucacauggagggggagcacaagaagcuagccgaggccaucuucaagcucacguaccagaacaaggucguucggguccaaagacccacgccccggggcacugugauggauaucaucucacgcagggaccagcgcgggucuggucaagucgggacauauggccuaaauacguucaccaacauggaggcccagcugauccggcagauggagggcgaaggagucuucaagaauauacagcaccucaccguuaccgaggagguagcgguccagaacugguuagcccgggugggccgggagcgauuaucucgcauggcgaucagcggugaugacugcgugguuaagccccucgacgaucgguucgccaacgcccugaccgcgcugaacgacaugggcaaaauccgcaaggauauccagcagugggaaccguccaagggcuggaaugacuggacacagguccccuucugcagccaccacuuccacgagcucaucaugaaggacggucgggugcugguaguacccugccgcaaccaggacgaacugauuggccgugcucgcaucucccagggggccggcuggucucuccgggagaccgccugccuggggaaauccuacgcacagauguggagccugauguacuuccaccgacgagaccuccgacuggcagcaaacgccaucugcuccgccgugcccucacauuggguccccaccucccggacgaccuggagcauccacgccaagcacgaguggaugaccaccgaggauaugcugaccgucuggaaccguguguggauccgggagaaucccuggauggaggauaagacgcccguagagucgugggaggagauaccuuaccucgggaaacgcgaggaccaguggugcggaagccugaucgggcugaccucccgggcgaccugggcaaagaacauccaggccgccauaaaccaggugagaucgcucaucggcaacgaagaguauaccgacuacaugccaucgaugaagcgguuuaggcgggaggaggaggaggcugggguacuuugguga

SEQ ID NO: 25143 - RNA, 9876 nt, Artificial Sequence
  derived and/or modified CDS sequence (opt11) from DENV-2__FJ744713__SS-prME
uccgccgguaugaucaucaugcugauacccaccguaauggccuuccaccuuaccacccgcaacggggagccccauaugauugucgguauacaggagaaaggcaagagccugcuguucaaaaccgaggacggcguuaacaugugcaccuugauggcuauggaccugggggaacugugcgaggauaccaucaccuauaaauguccacuuuuacggcagaacgagcccgaggacaucgacugcuggugcaacagcaccucuaccugggugaccuacgggacgugcacuacuaccggugaacaccgccgggagaagcgcucugucgcgcuggugccccacguggguaugggccuugagacgaggaccgaaaccuggaugagcagcgagggggcuuggaagcacgcccagcguaucgaaaccuggauccugcggcacccgggcuucacgauuauggcagcgauccuggccuacaccaucgggacgacccacuuccagcgcgcccucaucuucauccugcugacggcagucgcgcccagcaugacgaugcgcugcaucggcaucagcaaccgcgacuucguggaggggguaucuggggguaguugggucgauaucgugcucgagcacggcucuugcgugaccaccauggcgaagaacaagcccacccuggacuucgagcuaauaaagaccgaagccaagcaaccagccacccuccgcaaguacuguauagaagccaagcugaccaacacuaccaccgagagccgcugccccacccagggcgagcccucccucaaggaggagcaggacaagcgguucgucuguaagcauagcaugguggaccguggcugggggaacggcugcgggcuauucgggaaaggugggaucguuacgugugcgauguucacguguaagaagaacauggagggcaagaucguccagcccgagaaccuggaguacaccauaguggugacgccccacuccggagaagagcacgccgucggaaacgauacggggaagcacggcaaggagaucaaggugacgccgcaaagcuccauaaccgaggccgagcugacggguuauggcacagugacuauggagugcagcccccggaccucccuagauuuuaacgagauggucuugcugcagauggagaacaaagccuggcucgugcaccgacagugguuccuggaccugccccuccccuggcucccgggcgccgacaaacaagaguccaacuggauccaaaaagagacccuagucaccuucaagaauccccacgcgaagaagcaagacguagugguccucgggagccaagagggcgcuaugcacacggcccuuaccggggccaccgaaauccaaaugagcagcggcaacuugcuguucacugggcaucugaagugccgacugagaauggacaagcugcaacugaaaggcaugucguacagcaugugcacggguaaguucaaggugguaaaggagaucgccgagacccaacacgggaccauugucauucgggugcaguacgagggcgacgggucccccugcaagauccccuucgagauuauggaccucgagaaacguuacgugcugggccggcugauaaccgucaauccgaucgugacggaaaaggacagccccgugaacauugaggcugagccccccuucggugacucuuacaucauaaucggggucgagcccggccagcugaaacucaacugguuuaagaaggggagcucaaucgggcaaauguuugagaccaccaugcgcggggccaaacgcauggccaucuugggcgacaccgcgugggacuuugggagccuaggcgggguuuuuacgucgaucgggaaggcgcuccaucagguguuuggggcgauuuacggggccgccuucagcggcgugaguuggacuaugaagauccugauaggcgugauaaucacuuggaucgggaugaacagccguagcaccagccuguccgugagccugguauuagucgguaucgugacgcucuaccuaggggucauggugcaggccgauuccggaugugugguaucguggaagaacaaggagcuuaaaugcgggagcgggaucuuuaucaccgacaacgugcacaccuggaccgagcaguacaaguuccagcccgagucccccagcaaguuagcgagcgcuauccagaaggcccaggaggaaggcaucugcgguauccgcucagugacucggcucgagaaccucauguggaagcagaucacacccgaacucaaccauauccuggcggagaacgaagucaagcucacuaucaugacuggagacaucaagggcauuaugcaggccgguaagcgcucccugcggccgcagcccacggagcugaaguacucauggaagaccugggggaaagcuaaaaugcucuccaccgaaaguuacaaccagaccuuccugaucgacggccccgagacggccgagugcccgaacaccaaccgcgcauggaacucccuggaagucgaggauuacggcuucgggguuuucacgaccaacaucuggcucaagcugaaggagaagcaagacgcuuuuugcgauuccaaacuaauguccgccgcaaucaaggacaaccgagccguccacgcagacaugggauauuggauugagagcgcccuuaaugacacguggaaaauagagaaggcguccuuuaucgaggugaagaacugccacuggccuaagagccacacccucugguccaacggggugcuugagagcgagaugauuauccccaaaaaccuugcgggcccugucucccaacacaacuacagaccgggcuaccacacgcaaaucgccgguccauggcaccugggcaagcuggagauggacuucgacuucugcgacgggacaacggugaucguuacagaagacugcggcaaucggggcccuucucuccggacaaccaccgccuccggcaagcugaucacggaguggugcugucgguccugcacacugcccccgcuccgcuaucggggcgaggacgggugcugguacgggauggaaauccgcccccucaaggagaaggaggagaaccuggucaauagcuuaguaaccgccgggcacggccaaguggauaacuucaguuuggggguccuggguauggcccuguuccuggaggagaugcugaggacccgcgucggcacgaagcaugccauccuacugguggccgucagcuucguuacccuaaucaccggcaacaugucguucaaggaccucggucgggugguugugauggugggcgcuaccauggccgaugauauuggaaugggggucaccuaccucgccuugcuagccgccuucaaagugaggcccaccuucgccgcaggccuccugcuccggaagcugaccagcaaggagcugaugaugacuacgauaggcaucgugcuucugucgcagagcaccauccccgagaccauccuagagcuuaccgacgcacuugcccuggggaugaugguccucaagaucgugcguaauauggagaaguaccaguuagccgugacgaucauggccauucugugcgucccgaaugcugugauccuccaaaaugcuuggaagguguccugcaccauccuggccguggugagcguaagcccccuauuacugacuagcucacagcagaagaccgacuggauaccucuggcauugacgaucaaaggccugaaucccaccgcgaucuuccuuacgacccucagccguacgaacaagaagcgauccuggccgcugaaugaggcaaucauggcuguggggaugguguccauucuggcgucaucacuccugaagaacgacaucccgaugacgggcccccuggucgccggcggccuccugacugugugcuacguccuaaccggccgcagugcugaccucgagcuggagcgggcgacggacgucaaaugggaggaccaggccgagaucagcgggagcucccccauccugucaaucaccaucucagaagacgguagcauguccaucaagaacgaggaagaggagcagauucucacuauccugauacgcaccggucuguuaguaauaaguggccuguucccuaucuccauccccauaacggccgccgcaugguaccuuugggaggugaagaagcagagagcgggcguguugugggacgucccaucaccgccgcccauugggaaggccgagcuggaggauggugcguaccgcaucaaacagaaggggauccugggguacucucaaaucggugccggcguauacaaggaggggaccuuccacaccauguggcacguuacgcgcggcgcggugcucaugcacaagggcaagcgcauagagcccagcugggcggacgugaagaaggaucugaucuccuaugggggcggauggaagcuggaaggugaguggaaagagggcgaggagguacagguguuagcccuggagccugggaagaauccgcgggccguucagaccaaacccggccuguucaaaacaaacaccgggaccauaggcgccgucagccuagacuucucccccggaacuagcgguagcccuauuaucgacaagaagggcaaggugguggggcuguacggcaacggcguugugacgcgcagcggagccuacguuucagccauagcccagacggagaaguccaucgaggacaaccccgaaaucgaggaugacaucuucaggaaacgucggcugaccaucauggaccuccaccccggggccggcaagaccaagcgcuaccuucccgcgaucguucgggaggccaucaagcgcggucugcggacccucauccucgcgccgacccgcgugguggccgccgagauggaagaagcccugcggggucugcccauccgcuaccagacgcccgcgauucgggccgagcacaccggacgcgagaucgucgaccucaugugccacgccacuuucacgaugcgcuuacugucccccguucgggugccgaacuacaaccucauaauuauggacgaagcgcacuucaccgacccggccagcaucgcggcccgcggguacauuagcacccggguagaaaugggcgaggccgcuggaaucuucaugacggccacgccgcccggcucccgugaccccuucccccagagcaacgcaccgaucaucgacgaggaacgggagaucccggagcgcagcuggaacagcggccacgagugggucacagacuucaagggaaagaccgugugguuuguuccguccauuaaggccgggaaugacaucgccgccugccugcggaagaacgggaagaaggugauccagcugagccgcaagacuuucgacuccgaguacgugaagacccggacgaacgacugggacuucgucgugaccacggacaucagcgaaaugggcgcgaacuucaaggccgaacgcguaaucgauccacgccgcugcaugaaacccgugauccucaccgacggcgaagagaggguuauccuagcgggacccaugccugugacccacaguagcgccgcucagcgccgggggcgcaucgggcggaacccgaagaacgaaaaugaccaguacauuuacaugggugaaccccucgagaacgacgaagacugcgcgcacuggaaagaagcgaagaugcuccuggacaauaucaacacccccgaggggaucaucccgucuauguucgagcccgaaagagagaaggucgaugcaaucgacggcgaguaccggcugcgaggcgaggcgcggaaaacauucguugaucucaugcggcgcggggaccuacccguguggcuggccuucaaggucgcggccgagggcaucaauuaugcugaccggcgcuggugcuucgacgggauuaagaacaaccagauccucgaggagaaugucgaagucgagaucuggacuaaagagggcgaacggaagaagcugaagccccgcugguuggacgcacggaucuacagcgacccccuugcacugaaggaguuuaaagaguuugcggccgggagaaaaagucuaaccuugaaucugauaaccgagaugggccggcugccuaccuucaugacccaaaagacccgcgacgcccucgacaaccuggccguccugcauaccgcggaagccggcgggcgggccuacaaucacgcccucuccgagcugcccgagacucuggagacacuccugcugcucacgcugcuggccaccgugacgggcgggaucuuccucuuucugauguccggccgcggcaucgggaaaaugacguuggggauguguugcaucauaacugccagcauccuccucugguacgcccagauccagccucacuggaucgccgccucgauuauccuggaguucuuccucaucguccugcugauccccgagcccgagaagcaacggaccccccaggacaaccagcucaccuacguggucaucgccauacucacggucguggcggcuaccauggccaacgaaaugggguuccuggagaagaccaagaaggaccuaggucucggguccaucgccacccagcagccggaguccaacauccuggacaucgaccuccggcccgccuccgcguggacgcuguacgcaguggccacaacauucgucacccccaugcugcggcacagcauugagaacucuagcgugaacgugucccucacggccaucgccaaccaggcuaccguccugauggggcucggcaagggauggccccuaagcaagauggauaucggcguuccgcuacuugccauugguugcuauucccaagucaacccgaucacccuaaccgccgcccugcugcugcuggucgcgcacuacgccauuaucggccccgggcuacaggccaaggcaacgagggaggcccagaaacgggcggcugccggcaucaugaagaaccccacaguugacggaaucacugugaucgauuuggacccgauccccuaugaccccaaguucgagaagcagcuggggcaggucaugcuccucauacugugcgugacacagguacugaugaugcgcacgaccugggcgcucugcgaggcccucacccuggcgaccgggcccaucagcacgcugugggaggggaacccggguagauucuggaacaccaccaucgccgucuccauggccaauaucuuccgcggcagcuacuuagccggcgccggcuuguuguucucgaucaugaagaacaccacgaacacccgucgagggacaggcaacaucggggagacccugggcgagaaauggaagucccgccugaacgcgcucgggaagucggaguuucagauuuacaagaaguccgggauccaggagguggaucggacccuggccaaagagggcaucaaacgaggggagacugaccaucaugccgugagccggggcagcgccaagcugcgcugguuuguagaaaggaacauggugacccccgaggggaagguggucgacuuaggcugcggccgcggcggguggucguacuacugcgguggacugaaaaacgugcgggaggugaaggggcugaccaagggcggccccgggcacgaggaaccaaucccgaugagcacguacggguggaaucucguacgccugcaguccggaguggacguguuuuuuaucccgcccgagaagugcgacacgcuucucugugacauuggggaaucuuccccuaacccgaccgucgaggcggggcggacccugcgcgugcugaaccucguggagaauuggcuaaacaacaacacgcaguucugcaucaagguccucaacccuuacaugcccucugugauugagaagauggaagccuugcagcggaaguauggcggcgcacucguccgcaacccgcugagccggaacuccacccacgaaauguacugggucucgaacgcuuccggaaauaucguaucguccgugaauaugaucucuagaaugcuuaucaaccgauucaccaugcgccacaagaaggcaacguacgagccggacgucgaccucggcuccgggacccggaacaucggcauagagucagagauccccaacuuggacaucaucgggaaaaggauugaaaagauaaagcaggagcacgagaccuccuggcacuaugaccaggaccacccuuacaagaccugggcguaccacggcagcuacgagaccaagcagaccggcuccgcuagcuccauggugaauggaguggugcgacugcucacgaaaccaugggauguguuacccaccguuacccagauggccaugacagacacgacgcccuucgggcagcagcgcgucuucaaggagaagguugacacgcgcacccaggaaccuaaggagggcaccaaaaagcuaaugaagaucaccgccgaguggcucuggaaggaacugggcaagaagaagacaccaaggaugugcacccgcgaggaguucacgcggaaaguucgcagcaaugccgcgcuaggcgccauauucaccgacgagaacaaauggaaguccgcccgggaagccgucgaggacucacgcuucugggagcucguggacaaggagagaaaccugcaccuagaggggaagugcgagaccugcgucuacaacaugauggggaagcgcgagaagaagcuaggggaguucggcaaggccaagggcucccgggcgaucugguacauguggcugggcgcacgcuuccucgaauucgaggcccucggcuuccugaacgaggaucacugguucagccgggaaaacucccucaguggggucgagggugaagggcuucacaagcugggcuacauucugcgagaugugagcaagaaggagggcggcgccauguacgcggaugacacggcuggcugggacacgaggauuacccucgaggaccugaagaacgaagaaaugguuaccaaccacauggagggggagcacaagaaacuggcggaggcuauauucaagcucaccuaucaaaacaaaguggugcggguccagaggcccacaccccgcggcaccguaauggacaucauuucccggcgcgaccagcggggcucuggccagguggggaccuacggccugaacaccuucacgaacauggaggcgcagcugauccggcagauggagggcgaggggguguuuaaaaacauacagcaccucacugugacugaggaaguggcgguucaaaacuggcuggccagggugggccgcgagcgccugucccggauggccaucagcggcgacgauugcguggucaaaccccucgacgaccgcuucgccaacgcccuuaccgcucugaaugacaugggcaaaauccggaaggacauccagcaaugggagccguccaagggcuggaacgacuggacucaggugccguucugcagccaccacuuccacgagcucaucaugaaggacgggagagugcugguugugcccuguagaaaccaagacgagcugaucggccgagcccggaucagccagggggccggcuggagccuccgcgaaacagccugccuggggaaguccuacgcccagauguggagccugauguacuuccaccggcgcgaccuccggcuggcggccaacgccaucugcagcgccguacccagccauuggguuccgaccucccgcacuacuuggagcauacacgccaagcacgaauggaugacaaccgaagacauguuaaccguguggaaucguguuuggauccgcgagaauccauggauggaggacaagacccccgucgaguccugggaggagaucccauaccucggcaagcgcgaggaccaguggugcgguucacugaucgggcugacgucccgcgcuaccugggcaaagaacauccaggccgccaucaaccaagugcggucucucauuggcaacgaggaguacaccgauuacaugccgagcaugaagcgcuuucggcgcgaggaggaggaagcggggguuuuaugguga

SEQ ID NO: 25144 - RNA, 9876 nt, Artificial Sequence
  derived and/or modified CDS sequence (opt11) from DENV-2__FJ744714__SS-prME
agcgccgggaugaucauaaugcugauccccaccgugauggccuuccaccucaccacccgcaauggggagccccauaugaucguagggauucaggaaaaggggaagagccugcuguucaagaccgaagacggcgugaacaugugcacucucauggcgauggaccugggagagcugugcgaggacaccaucaccuacaaaugcccacuccugcggcagaacgaaccugaggacaucgauugcuggugcaauagcacuagcaccugggugaccuacggcacuugcaccacuacuggcgagcaucggcgggagaaacggagcguggcacuggugccccauguugggauggggcuggagacccggaccgagacuuggauguccagcgagggggcuuggaagcacgcccaacgcaucgagaccuggauccugcgccacccgggcuucacgaucauggccgcaauucuagccuacacaaucgggaccacccacuuccagagggucuuaaucuucauccugcuaacugccguggcccccuccaugaccaugcguugcauaggcauuagcaaucgcgacuucguagagggcgucuccggcggcagcuggguugacauagucuuagagcacggcucuugcgucaccaccauggcgaagaacaagccuacgcuggacuucgagcuaaucaagaccgaggcuaaacagcccgccacccuucgcaaguacuguaucgaggccaagcugacaaacacgaccacggagucacgcugccccacccagggggagcccucacugaaagaggagcaggacaaaagguucguguguaagcacuccaugguagaccgcggcugggggaacggaugcggccuguucggcaagggcgggaucguuacaugcgccauguucacguguaagaagaacauggaggguaagaucgugcagcccgagaaccuggaguacaccauugucgucaccccacacuccggagaagaacacgcgguuggaaacgacacggguaaacauggcaaggagaucaagguaaccccgcaaucauccaucaccgaggcugaacugaccggguacggcaccgucacgauggagugcucgccacgcacgggucuugacuucaacgagauggugcuguugcagauggaaaauaaggcauggcucguacaccgccagugguuccuggaccugccccuccccuggcugccgggggcggauaagcaggaguccaacuggauccagaaggagacucuggucaccuuuaagaacccucaugccaagaaacaagacgucgucgugcucggcucgcaggaaggggccaugcacacggcccugacuggcgcaaccgagauccagaugagcuccgggaaccuccuguucacuggccaucugaagugcaggcugcgcauggacaaguuacagcugaaaggcauguccuacagcauguguacaggaaaauucaagguggucaaggagaucgccgaaacccagcacggcaccaucgugaucagggugcaguacgagggcgacggcagccccugcaagauccccuuugagaucauggaccuggagaagcgcuacguccuuggcaggcugaucaccgugaauccuaucgugacggagaaggacuccccugucaacaucgaggccgaaccgccauucggagacagcuauaucauuaucggcguggaaccgggccagcugaagcucaacugguucaagaagggauccucuaucggacagauguucgagacaacgaugcgcggugcgaagcguauggccauccugggagacaccgcgugggacuucgguagccugggcgggguguucacgucgaucgggaaggcgcuccaccaaguauuuggggcaaucuacggagcggccuucucuggggugagcuggaccaugaagauccugaucggggugauuaucaccuggaucggcaugaacucccggagcaccucgcugagcgucuccuuaguguuagugggaaucgucacguuauaucugggugugauggugcaggccgacagcgggugcgucguuuccuggaagaauaaggagcuuaagugcggcagcggcaucuucaucacugacaacgugcacaccuggaccgagcaauacaaguuccaacccgagagccccagcaaguuagccagcgccauacagaaggcucaagaggaggggaucugcggcauccgcuccguaacgcggcuggagaaucuuauguggaagcagauuaccccugagcugaaccacauacuggcagagaacgaggugaagcugaccauaaugaccggggacauuaaagguaucaugcaggccggaaagcgcagcuugcggccgcagccaacggagcugaaguacuccuggaaaaccugggggaaggccaagaugcucagcaccgaguccuacaaccaaaccuuccugauugauggacccgaaacagcggagugcccgaacacgaauagggccuggaauagccuggagguggaggauuauggguucgggguauucaccaccaacaucuggcucaagcuaaaggagaagcaagacgccuucugugacuccaagcugaugagcgcugccaucaaggacaacagagcagugcacgcagauauggguuacuggaucgagucugcucucaacgauaccuggaaaauagagaaagccagcuucaucgaggugaaaaacugccacuggcccaaaucccauacauuguggagcaacggcguccuggaguccgagaugaucauaccuaagaaucuugccggccccgugagccagcacaacuaccgccccggguaccacacccagaucgccgggcccuggcaccuggggaagcuggagauggacuuugauuucugcgauggcaccaccguuaucguuacagaggauugugggaaccggggccccucccucaggacuacuaccgcuucaggcaagcugaucacggaaugguguugccgaagcugcaccuuaccacccuuacguuaccggggagaggauggauguugguauggaauggagauucgcccccugaaggaaaaagaggagaaccuggugaacucccuugugacagccggucacggccaggucgauaacuucagccuggggguucugggcauggcccucuuucuggaagagaugcuacggacccgcguggggacgaagcacgcgauccuacugguagcugugaguuucgugacccugauaaccggcaauaugagcuuuaaggaucuagguagaguaguugugaugguuggcgccaccauggccgacgacaucgggaugggcgucacguaucuugcucugcuggccgccuuuaaaguacgccccaccuucgcugccggccuucugcuucggaagcuaacgagcaaggaguugaugaugacuacaauagggaucgucuugcucucccaguccaccauacccgagacgguacuggagcucaccgaugcccuggcacuggguaugauggugcucaagaucgucaggaacauggagaaguaccagcuggccgugacaaucauggccauccugugcguccccaacgccgugauccuccagaacgccuggaaggugagcugcacaauuuuagccgucguauccguuagcccgcugcugcuaaccuccucacagcaaaagacagacuggaucccccuggcccuaacaaucaaaggacugaacccuaccgccaucuuccuuacgacacucucccgcacgaauaagaagcgaucguggccgcugaacgaggccauaauggcggucggcaugguguccauccuggcaagcuccuuacugaagaacgacaucccgaugaccggcccccucguggcugggggcuugcugaccgucugcuaugucuuaaccggacgcucagcugaccucgagcuggagcgugccacggacguaaaaugggaagaccaggcggagauuuccggcagcagcccuauccuguccauaaccaucagcgaggacgggagcaugagcaucaagaacgaggaggaggaacagacccucacgauacugauccgcacgggccugcuggugaucuccggccuguucccgaucagcauucccauuaccgcugccgccugguacuuaugggaggugaaaaagcagcgggccggggugcucugggacguccccucgccaccgcccauggggaaagcugaauuagaggacggggccuaccgaaucaagcaaaaacggauacugggcuauagucagaucggcgccggcgucuacaaggagggcaccuuucacaccauguggcacgugacccgcggagccguccucaugcacaagggcaagcgcaucgagcccuccugggcggaugugaagaaggaccugauaucguacgggggcggguggaaacuggagggagaguggaaggagggagaggaggugcagguccuugcgcuggagcccgggaagaacccgcgcgcagugcagacaaagcccggccuguucaagacuaacacugggaccaucggcgcggugucccucgacuucagccccgggaccucgggcucacccaucaucgacaagaagggcaaggucguggggcuguauggcaauggaguggucacgcggucgggugccuaugugagcgccaucgcgcagaccgagaaaucaaucgaagacaauccugagaucgaggacgacaucuuccgaaaacgccgccugaccauuauggaccugcaucccggcgcagggaagacaaaacgguaccuccccgcuauuguacgcgaggccauuaagcggggccuccgcacccugauccuggccccgacccgggugguggccgccgagauggaggaggcacugcgcggccugccaauccgguaucagacucccgccaucagagcggagcauacgggcagagagauuguugaccucaugugccacgcgaccuucaccaugagguugcuaagccccguccgcguaccuaauuacaaucucauuaucauggacgaggcccacuucaccgaccccgccuccauugccgcccggggguacaucagcacucgcguggagaugggcgaggccgccggcauauucaugaccgcgacgccgcccgggucccgugacccguucccacaguccaacgcccccaucauugaugaggagagagaaauacccgaaaggagcuggaacuccggccacgaaugggucacagacuucaaggggaagaccgucugguuugucccuagcauuaaggcgggaaacgacauugccgcaugccugcgcaagaacggaaagaaggucauccagcugucacgcaagacauucgacagcgaguaugucaagacccgcaccaacgacugggacuucgugguaacgaccgacauuuccgaaaugggcgcaaacuucaaggcugagcgugucaucgaccccagaaggugcaugaagcccgucauccugaccgacggcgaggagcgcguuauccuggcagggccaaugccggugacccacuccucagcagcccagcggcgcggucgaauuggccgcaaccccaagaacgagaacgaccaauacauauauaugggcgaaccccuugagaaugaugaggacugcgcccauuggaaggaggcuaagaugcuccucgauaacaucaauacucccgaagggauaauaccuucgauguucgagcccgagcgcgagaagguggacgcuaucgacggcgaguacaggcuaaggggcgaggcgcgcaagaccuuugucgaccucaugaggcggggggacuuaccaguguggcuggccuacaagguggccgcagaggggaucaauuacgccgaucgccgguggugcuucgacgggaucaagaacaaccagauccucgaggagaacguagagguggagaucuggaccaaagagggcgagcguaagaaguugaagccgcgguggcuggacgcccgcaucuacuccgacccccuugcauugaaggaguucaaggaguucgccgcggggcggaaguccuuaacccuuaaccugauuacggaaauggggcgccugcccaccuuuaugacccagaagacgcgagacgcccuagauaaccuggccguccugcauacggccgaggcuggcgggcgagcauauaaccacgcguuauccgagcugcccgagacacuggaaacccuucugcugcucacccuguuagcuacagugaccggcgggaucuuuuuguuccugaugagcggccgagggauagguaagaugacccugggcaugugcugcaucaucaccgccuccauucuccugugguaugcgcagauacaaccgcacuggauugcugccagcaucauccuggaguucuuccucauuguguugcugauucccgagcccgagaagcaacgcacgccccaagacaaucagcuuacauacgucgugauagccauccugaccgugguggccgccaccauggcuaacgagaugggguucuuagagaagacgaagaaggaccucggccuggggagcaucgcgacacagcaaccggaaagcaacauccuggauaucgaccuaagacccgccuccgccuggacuuuguacgcgguugccaccaccuucgugacgcccaugcugaggcacucuaucgaaaacagcuccgucaacguuucacucaccgcuaucgccaaccaggccaccguguugaugggccugggaaagggcuggccccucagcaagauggacauuggcgucccacugcuggcgaucgggugcuauagccaggugaaucccaucacauuaacugcagcccugcuucuucucguggcccacuacgcgaucaucggccccggccugcaggccaaggccaccagggaggcacaaaagagagccgcggcgggcaucaugaaaaacccaaccgucgacgguaucacaguuaucgaucucgaccccauucccuacgaucccaaguucgagaagcagcugggucaggugaugcugcucaucuuaugugucacccaggugcucaugaugcggaccaccugggcccucugcgaggcccugacccuggccacuggccccaucuccacacugugggaagguaacccgggccgcuucuggaacaccaccauagccgugagcauggcgaacaucuuccgggggucauaccuagccggagcaggccucuuauucagcauuaugaagaacacgaccaacacccgccgcgggacaggcaauaucggggagacgcugggcgaaaaguggaaaucccggcugaacgcccuagggaagagugaguuucagaucuacaaaaagucagggauccaggaggucgaccgcacccuagcgaaggagggcaucaagagaggggagaccgaccaccacgccgugagccgcggcagcgccaaguugcggugguucguggagagaaauauggucacccccgaggggaaggugguggaccucggcugcggccgcggaggguggagcuacuacugcgggggccugaagaacguacgggaggugaaagguuugacgaaagguggcccugggcacgaggagcccauaccgauguccaccuacggcuggaacuuggugcggcugcaaucuggcgucgacguguucuucauccccccggagaaaugcgacacguuacuaugugacaucggcgagucgucgcccaaccccacuguugaggccggacgcacgcugcggguauuaaaucucguggagaacuggcugaacaauaacacacaauuuugcauaaaggugcugaaccccuacaugcccuccgucauugaaaagauggaggcgcugcaacguaaauacgggggcgcccucgugcguaacccgcugagccgaaacaguacgcacgagauguacugggugagcaacgcuagugggaacauuguauccagcgugaacaugaucucaagaaugcuuauaaaccgcuucaccaugcggcauaagaaggcgaccuacgagccagacguagaucugggcagcgggacgcgcaacaucggcaucgagagugaggucccaaaucuggacauuaucgggaaacggaucgaaaagaucaagcaggaacacgagacuagcuggcacuacgaccaagaccaccccuacaagaccugggcuuaccacggcuccuacgagaccaagcaaacggggucggcgucaagcauggucaacgggguaguccgcuuacucacuaaaccgugggacgugcuacccacggugacacagauggccaugacggacaccacucccuuuggccagcagcgggucuucaaagagaaaguggacacccggacgcaggaaccuaaggaggggaccaagaaguugaugaagaucacggccgaguggcuuuggaaggagcugggcaagaagaagacgccacgcauguguacgcgggaggaguucacucgcaaggugcgguccaacgcugcccugggcgcgaucuucaccgacgagaacaaguggaaguccgcccgugaggcgguagaggacucucgguucugggagcucguggacaaggagcgcaaccuucacuuagaggggaagugcgaaaccugcgucuauaauaugaugggaaagcgggaaaagaaacucggugaguucgggaaagccaaagggucucgcgcuaucugguacaugugguuaggugcgcgguuccucgaguucgaggcccucggcuuccugaacgaggaucacugguuuagccgcgagaacucccuguccgggguggagggugaggggcugcauaagcugggcuacaucuugcgugacgugucuaagaaggagggcggggcgauguacgccgacgacacggcuggcugggacacccguauaacgcuagaggaccugaagaacgaggaaauggugaccaaccacauggagggggagcauaagaagcuggccgaggccauuuuuaagcucacguaccagaauaaggucguacggguccagcgccccacgccccgggggacggugauggacaucauuagccgccgggaccagcgcggauccggccaaguugggaccuauggccugaacacguucacaaacauggaggcccaacugauccgucagauggagggugagggggucuuuaaaaauauccagcaccucaccgugaccgaggagguggcgguccagaacuggcucgcgagggugggacgcgagcggcugagccgaauggccaucuccggggaugauugcguugucaagcccuuagacgaccgguucgcaaacgcgcugacggcucugaacgauaugggcaagauacgcaaggacauacagcagugggagccuagcaagggcuggaacgauuggacucaagugccguucuguucgcaccacuuucaugagcucaucaugaaggacgggcgggugcuggucgugcccugcagaaaucaggacgaguugaucggccgagcgcgcauuucccagggagcuggauggucccuucgggagacugcuugccugggcaagagcuacgcccaaauguggucccucauguacuuccaccgccgcgacuuaagauuagcugcgaacgccaucugcucggcgguccccagccacugggugccgaccagccggacuaccugguccauccacgccaagcaugaguggaugaccaccgaagacauguuaaccguguggaaccguguguggauccgggagaaucccuggauggaggacaaaacucccgucgagucuugggaggagauccccuaccucggaaagcgcgaggaccaguggugcggcucucugaucgggcugaccagccgggccacuugggcgaagaacauccaggccgccaucaaccagguccgcucccucauaggcaaugaggaguacaccgacuacaugccguccaugaagcgguuccgccgcgaagaggaggaggcaggcgugcugugguag

SEQ ID NO: 25145 - RNA, 9876 nt, Artificial Sequence
  derived and/or modified CDS sequence (opt11) from DENV-2__FJ744716__SS-prME
ucggccgggaugauuaucaugcugauccccaccguuauggccuuucaccucacaacacggaacggggagccccacaugaucguugggauucaggaaaagggcaagagccuucuguucaaaaccgaggacgggguaaacauguguacccucauggcgauggaccugggggagcugugcgaggacaccaucacauacaagugcccccuucugcggcagaacgagcccgaggacaucgacuguugguguaacaguaccuccaccugggugaccuacgggacuugcaccaccaccggugagcaccgccgcgagaaacgcuccgucgcccuggugccucacguggggaugggccuggagaccagaacugagacauggauguccagcgaaggggccuggaagcacgcccagcggaucgaaacauggauccugcggcacccgggcuucaccaucauggcggcaauucuagcguacaccaucgggacuacccacuuccagcgcguccucaucuucauccuacugacggccguagcccccuccaugaccaugcggugcauuggcaucaguaacagagauuucguggagggagucuccgggggauccuggguggacauugugcucgagcacggcuccugcgucaccaccauggcgaagaacaagccgacacuggacuucgaacugauaaaaaccgaagcgaaacagcccgccacgcuccggaaguacuguaucgaggcuaagcugacaaacacgaccaccgaaagccgcugccccacccaaggcgaaccaucccugaaggaggagcaagacaagcgguucguuugcaagcauagcaugguggaccgcggcugggggaauggcugcggccuuuucggcaagggcgggaucgucacgugugccauguucacgugcaaaaaaaacauggagggcaagauagugcagcccgagaaccuugaguauaccaucgucgucacgccccauaguggagaagagcacgcgguaggcaaugauacggggaagcacggcaaggaaaucaaggugaccccgcagagcuccauaaccgaggccgagcuaacuggcuacgggaccgucaccauggagugcagcccccggaccgggcucgacuucaacgaaauggugcugcugcagauggagaauaaggccuggcuggugcaucgccagugguuccuggaccugccccugcccuggcugccgggggccgacaaacaggaguccaacuggauucagaaggagacccuagucaccuucaagaacccccacgccaagaagcaggacguuguggugcucggcagccaggaaggggcgaugcauacggcguugacaggcgccaccgagauccagaugagcuccgggaacuuacuauucaccggccaucucaaaugccggcuucgcauggauaaacuccagcugaaggggaugucuuacuccaugugcacgggaaaguucaagguggucaaggagauagcggagacgcagcacggcacuaucgugauaagaguacaguacgaaggggacggcagccccugcaagauccccuucgagaucauggaccucgagaaacgcuacguccucggccggcugauaacggugaacccgaucgugacggagaaggacuccccagucaacaucgaggcggagccacccuucggggacucguacaucaucaucgguguggagcccgggcagcugaaguugaacugguucaagaagggguccagcaucggucagauguucgagaccaccaugcgcggcgcgaagcggauggccauucugggugacaccgccugggacuuugggucacugggugggguauucacgagcaucgguaaggccuuacaccaggucuuuggggccaucuacggcgcggcauuuuccggcguaagcuggaccaugaagauccuaauuggggugauaaucaccuggaucggcaugaacuccagaucaaccucccugucugucucccuggugcuaguggggauugucacgcuguacuuaggugucaugguucaagccgacagcggcugcguggugaguuggaaaaacaaagagcugaagugcgggagcggcaucuuuaucaccgacaacgugcacaccuggaccgagcaauacaaguuccagcccgagagccccuccaagcuggccagcgccauucagaaggcacaagaggaggggaucugcggcauccgcuccgucacgcggcuagagaauuugauguggaagcaaaucacucccgagcucaaccauauucuggcagagaacgaagugaagcucacaaucaugacuggagauauaaagggcaucaugcaggccgggaaacgcuccuuacggccccaaccgacggagcugaaguacuccuggaaaaccuggggcaaggccaagaugcucagcaccgaauccuacaaccagaccuuccugaucgacgguccugagacggcggaguguccgaacaccaaccgagccuggaacucacuggagguggaggacuacggguucggggucuucacaaccaacauauggcucaaguuaaaagagaagcaagacgcuuuuugcgacuccaaguuaaugagcgccgcuaucaaggacaaccgggcggugcacgccgacauggguuauuggauagaguccgcccucaacgacacguggaaaaucgagaaggccagcuucaucgaagugaagaauugccacuggccuaagagucacacccuuuggagcaacggcguccuggaaagugagaugaucauccccaagaacuuagccggacccgugagucagcacaacuaccgcccgggguaucacacccagauagcgggccccuggcaccuggggaagcuggagauggacuucgacuucugugacgguacaacuguaauagucaccgaggacugcgggaaccggggucccucccugagaacgaccaccgccagcggcaagcugaucacggaguggugcugccggucaugcacacugcccccccucagauaucgcggcgaggacgguugcugguacgggauggaaauccgcccacugaaagagaaggaggaaaaccuggugaacucacucguaaccgcaggucacggacaggucgacaauuucagucugggcgugcugggcauggcccucuuccuggaggagaugcuucggacucgcguggggacgaagcacgcgaucuugcuggucgccgugucauuugucacccugaucaccggaaacaugagcuucaaggaucucggucgggucgucgugauggugggcgccaccauggccgacgacaucgggaugggcgugacguaccuggcccugcucgcugcguucaaagugaggcccaccuucgccgcagggcugcugcugaggaagcugaccucgaaggaacugaugaugaccacaaucgggaucguccuccugucacaguccacaaucccugagacggugcuggagcucaccgacgcccuggcgcugggcaugauggugcucaagauuguccgcaacauggagaaguaccaacuggccgucacgaucauggcgaucuugugcgucccgaacgccgugauccuccagaacgccuggaaggugagcugcaccauucuggcggucguauccgugagccccuuacuccugaccucaagccaacagaagacggacuggauuccccuggcccucacgaucaaggggcuuaaccccaccgcuaucuuccugaccacccuaucccgcaccaacaagaagcggucuuggccgcugaaugaggccaucauggcggucggcauggugaguauccuugcaagcucccuccugaagaacgacauccccaugaccggcccccugguggcugggggccuccugacggucugcuacgugcugaccgggcgcagcgccgacuuagagcuggagcgggccacugaugugaagugggaggaccaggcggagauuagcggcagcagcccuauccuguccaucaccaucucugaggacggguccaugagcauaaagaacgaggaggaggagcagacccucacaauucugauacgcacgggccuucucgucaucuccggccuguucccgaucagcaucccuaucaccgccgccgccugguaccugugggaggugaagaagcagcgggccggggugcuaugggauguccccagcccgccgcccaugggcaaggcggagcuugaggacggagccuaucgcaucaagcaaaagaggauccugggcuacagccagaucggggccggcguguauaaggagggcaccuuucauaccauguggcacgugacccgaggggccguccucaugcacaagggcaagcggaucgagccguccugggcugacguuaagaaagaccugauuucauauggcggcggguggaagcuggagggcgaguggaaggaaggggaggagguucagguccucgcucuggagcccggaaagaacccuagagccgugcagacaaaaccuggccuuuuuaagaccaacaccgggaccaucggcgccgugucgcuugacuucucccccgggacgucuggcagcccuaucaucgacaagaagggcaaagucgugggccuguacggcaaugggguagucacccgguccggcgcguacguaagcgccaucgcgcagacugagaaauccaucgaggacaaccccgagaucgaggacgacauuuuucgcaagcggcgccugaccaucauggaccugcacccaggagccgggaagacgaaacgguacuugcccgccaucguacgcgaagccaucaagcguggucugcgcacucugauccucgcaccaacccgagucguggcagccgagauggaagaggcccuacgaggacugcccauuagguaucagacccccgccauacgcgcggagcacacgggccgcgagaucguggaccucaugugccacgccacauuuaccaugcggcugcucucucccgucagggugccgaacuacaaccucauaaucauggaugaggcucacuucaccgaccccgccagcaucgccgcgcggggguauaucucgacacgcguggaaaugggugaggcggccggcauauucaugaccgccacuccgcccgggagccgggauccguucccccagaguaacgcccccaucaucgacgaagagcgcgagauccccgagcggagcuggaacaguggccacgagugggucaccgacuucaagggaaagacgguuugguucguacccagcaucaaagcuggcaacgacaucgccgccugcuuacgcaaaaacggcaagaaggucauacaacuguccaggaagaccuucgacagcgaauaugugaaaaccagaacuaacgacugggauuucguggucacgaccgacaucuccgagaugggagccaacuucaaggccgaacgggugaucgacccccgccgguguaugaagcccgugauacucaccgacggagaggagcgcguaauccuggccgggccaaugccgguaacccacucuagugccgcacagagacgcggccgaauugggcgcaaccccaagaacgagaacgaccaguauaucuacaugggggagccucuagaaaacgacgaggacugugcgcacuggaaggaagcgaagaugcucuuggacaacauaaauacgcccgagggaaucauccccagcauguucgagcccgagcgggaaaaggucgacgccaucgacggagaguaccgccugcgcggcgaagcgcggaagaccuucgucgaccuaaugcgccgcggggaucugcccguguggcuggcguacaagguggccgcagagggcaucaacuacgcagaccgccgguggugcuuugacgggaucaagaacaaucagauccucgaagagaacgucgaaguugagauuuggaccaaggagggcgagcgcaagaaguuaaagccgcgguggcuggacgcccgaaucuacuccgacccccucgcccucaaggaguuuaaggaguuugcggcggggcggaagucccugacccucaacuugaucacggagaugggccgccucccuaccuucaugacccagaagacccgggaugcccucgacaauuuagccgucuugcgcacggccgaggcgggcgggcgggcauauaaccacgcccuuucggagcugcccgagacucuggagacccuccugcugcucaccuugcuggccacgguuacuggcgggaucuuucuuuuucugaugagcggucgcgguauaggaaagaugacgcucgguaugugcugcaucaucaccgccucgauccuccugugguacgcgcaaauccagccgcacuggauugccgccaguaucauccuagaauucuuccucaucgugcugcugauaccagagcccgagaagcagcggacgccccaggacaaccagcucacguaugucgugauugcuauucugacuguagucgccgcgaccauggcaaacgagaugggguuucuggagaagaccaagaaggaccucggacugggguccaucgcuacucagcaaccggagucaaacauccuggacaucgaccuccgcccugccucagccuggacccuguacgcaguggcuacaaccuucgugacgcccauguuaagacacagcaucgagaauagcuccguaaauguaagccucacugccaucgcgaaccaggccacggugcugaugggacugggcaagggguggcccuuguccaagauggacaucggcguaccguugcuagcgaucgggugcuacagccagguaaaccccaucacccucacggccgcccugcugcuacuaguggcucacuacgcgaucaucggccccggacugcaggccaaagccacacgcgaggcccagaagcgggcagcagcuggcauuaugaagaaccccaccgucgacggcaucacagugaucgaucuggaccccaucccguaugaccccaaguuugagaagcagcugggccaggugaugcugcucauccugugcgucacgcaggugcugaugaugcggaccaccugggcccucugcgaggcccucacccuggccacgggccccaucuccacccucugggaaggaaacccgggccgcuucuggaacacuacgauagccgugagcauggccaacaucuuucgggggaguuaccuggccggcgccggccuccucuucucuaucaugaagaacacgaccaacacacgacgggggaccggcaacaucggggaaacgcugggcgaaaaguggaagucccgccugaacgcccucggaaagagcgaguuccagauuuacaagaagucggggauccaggaggucgaccggacucuugcgaaagagggaaucaaacgcggggaaaccgaccaccacgccguaagccggggcuccgccaagcugagaugguucguggagaggaacauggucacccccgagggcaaggucguggaccugggcuguggucgcgggggcuggaguuacuauugcgguggucugaagaacguccgggagguaaaggggcugacgaagggcggccccgggcacgaggaacccauaccgauguccaccuacgguuggaaccucgugcgccuucagagcgggguugacguguucuucaucccgcccgaaaagugugacacccugcuuugcgauaucggugaguccagccccaauccuaccguggaggcagggcggacgcugcgcguccugaaccucguggagaacuggcugaauaauaacacccaguuuugcauaaagguguuaaaccccuacaugcccuccgucaucgagaagauggaggcucugcagcggaaguaugguggcgcccucgugcgcaacccgcugagcagaaauucuacccacgagauguacugggugagcaacgccagcgggaacaucguaaguagcgugaacaugauaucccgcaugcugaucaaccgguucaccaugcgccacaagaaggcgaccuacgaaccagacguggaucucggauccgggacucggaacaucggcaucgaguccgagguccccaaccuggacaucaucggcaagcgcaucgagaaaauuaaacaggagcacgagaccaguuggcacuacgaccaggaccaccccuacaagacuugggccuaccacggcuccuacgagaccaagcagacgggcagcgcuuccagcauggugaacggggugguccgccuacucaccaaaccgugggacguccuucccaccgugacccagauggccaugacggacaccaccccuuucgggcaacagcgggucuucaaggagaagguggacacccgcacgcaggagcccaaagaggggacaaagaagcuaaugaagaucaccgcugaguggcuauggaaggagcugggcaagaagaagaccccgcggaugugcacgcgagaagaguucaccagaaagguccgaaguaacgcagcccuaggagcgauuuucaccgacgagaauaaguggaaguccgcacgggaggccguugaggacucgagauucugggagcucguggauaaggaacggaaccugcaucuggaggggaaaugcgagaccugugucuacaacaugauggguaagcgagagaaaaagcuaggugaguucgggaaggccaaggggagccgggccaucugguacauguggcuuggugcgagguuucuagaguuugaagcccucggcuuccugaacgaggaccauugguucucucgggagaacagcuuauccggaguggagggagagggucuacacaaguugggcuacauccuacgggacgugagcaagaaggagggcggggccauguacgccgaugacaccgcgggcugggacaccaggauaacccuagaagaccugaagaacgaggagauggucacuaaccacauggagggggagcacaaaaagcuggcggaggccaucuucaagcucacguaccagaacaagguggugagaguccaacggcccacgccccgaggcaccguaauggacaucaucagccggcgugaccaacgggggagcgggcagguuggaaccuauggccugaacacguucaccaacauggaggcgcagcugauucgccaaauggagggcgagggugucuucaagaacauccagcaccucaccguuaccgaagagguggccguccagaacuggcuggcgcgcgugggccgcgagcgccugagccggauggccauuuccggggaugacugcguggucaaacccuuggacgaccgcuucgccaacgcauuaacggcccugaacgacaugggcaaaauccggaaagacauccagcagugggaaccgagcaagggcuggaacgauuggacucagguccccuucugcucccaccacuuccacgagcugaucaugaaggacgggcgcguccuggucgugcccugccggaaccaggacgaguuaaucggccgugcgcggauuagccaaggggccggcuggucccugcgagagacugccugccuggguaagagcuacgcucaaauguggucccucauguauuuccaccggcgcgaccuccggcuggcagcgaacgccaucugcagcgcugugcccagccacugggucccuaccucacgcacgacgugguccauccaugccaagcacgaguggaugaccaccgaggacaugcuuaccguguggaaccgggucuggauccgugagaaccccuggauggaggacaagacgcccgucgagaguugggaggagaucccguaccugggcaagcgggaggaucagugguguggcuccuugaucgggcugaccucccgggccaccugggcgaagaacauacaggcagccauaaaucaaguccggucccucauuggcaacgaagaguacaccgacuacaugccgagcaugaaacgcuuccgucgggaagaggaggaggccggggugcucugguga

SEQ ID NO: 25146 - RNA, 9876 nt, Artificial Sequence
  derived and/or modified CDS sequence (opt11) from DENV-2__FJ744718__SS-prME
agcgcgggcaugauuaucaugcuuauccccaccguaauggccuuccaccucacuacccgcaacggggagccccacaugauaguggguauccaggagaaggggaagucccugcuauucaagacggaggacggcgugaacauguguacccucauggcgauggaccugggggagcugugcgaggacaccaucaccuacaagugcccccugcugcggcagaacgagccagaggacaucgacugcugguguaacagcacaagcacgugggugaccuacgggacaugcaccaccaccggcgaacaucgccgggaaaagagaagcgucgcccuugugccccacgugggcaugggccucgagacccgaacagagacguggaugucgucugagggggccuggaagcacgcccaacgcauagagaccuggauccugcggcacccgggcuucacgaucauggcagcgauacuggccuacaccaucggcacgacgcacuuccagcgcguccucauauucauccugcugacggccgucgcacccucaaugacaaugcggugcaucgggauaucaaaccgcgauuucguugagggcguauccgggggcagcuggguggacaucgugcucgagcauggcaguugcgucaccaccauggcaaagaacaaacccacgcuagacuucgagcugauuaagaccgaggccaagcagccugccacgcuccggaaguacugcaucgaggcaaagcugaccaacacgaccaccgaaucccgcugccccacccagggcgaacccagucugaaggaagagcaggacaagcgguuugugugcaagcacucaaugguggauaggggcugggggaauggcugcggccuguucggaaagggcgggauugucacuugcgccauguucacguguaagaaaaacauggaggguaagaucgugcagcccgaaaaucucgaauacaccaucgugguaacgccacauuccggugaggagcacgcgguggguaacgacacggggaagcacggcaaagagaucaaggugaccccacaaagcuccauuaccgaggccgagcugacaggauacggcacggucacgauggagugcagcccucggaccggccucgacuucaaugagauggugcuguuacaaauggagaacaaggcauggcucgugcacaggcagugguuccuggaccugccccuccccuggcugccaggagccgacaagcaggaauccaacuggauacagaaggagacccugguaaccuucaagaacccacacgccaagaagcaagacgucgucgugcucggaagccaggagggugccaugcacacggcgcugaccggcgccacugagauccaaaugagcuccgggaaccuacucuucaccgggcaccugaagugccggcugcgcauggacaagcuccagcucaaaggcaugagcuacucuaugugcacggggaaguucaaaguagugaaggagauagccgagacccaacacggcacgauugugauccgggugcaguacgagggggacggcagccccuguaagaucccauucgaaaucauggaccuggagaagcgcuacguccugggccggcugaucaccguuaacccuaucgugacggagaaggacucccccgucaacaucgaggcagagcccccguucggagauagcuacauuauaaucggaguggagccggggcaacugaagcucaacugguucaaaaagggguccagcauugggcagauguucgaaacgacuaugaggggcgcgaagcgcauggccauccuaggcgacaccgccugggauuucggcucccugggcgggguguucacgucgaucggcaaagcccuucaccaggucuucggggcgaucuacggggcugccuucuccggggugagcuggaccaugaagauccugaucggggugaucaucacguggaucggcaugaacuccagguccacuucccuaagcgucucccugguguuaguggggaucgucacacucuaucuaggagugauggugcaggccgacagcgggugcgucgugucuuggaagaacaaggagcucaagugcggcagcgggaucuucaucacagacaaugugcacaccuggaccgagcaguacaaguuccagcccgagucaccaucuaagcuggccagcgcgauucaaaaggcccaggaggaggggaucuguggaauacgcuccgucacgcggcuggagaaccuuauguggaaacagaucaccccggaacugaaucacauccuggccgagaacgaggugaagcuuaccauuaugaccggggacaucaagggcaucaugcaggcggggaaacgcucccugcggccgcaacccacggagcugaaguacuccuggaagacuuggggcaaggccaagaugcucagcaccgagucauacaaccagacauucuugaucgacggccccgaaacagcggagugcccgaacaccaaccgcgccuggaacagccuggaagucgaggacuacggauucggagucuucaccaccaacauuuggcucaaguuaaaggagaagcaagacgccuucugcgauuccaaauuaaugagcgcggccaucaaggacaaucgggcggugcacgccgacaugggguacuggaucgaguccgccuugaacgacacauggaagaucgagaaagccucguucaucgaagugaagaacugccacuggcccaaaucccacacucuguggagcaauggcguccuggaauccgagaugaucauacccaagaaccucgcgggccccgugagccagcacaacuaucgcccgggguaccacacccagauagcgggccccuggcaccuggggaagcuugagauggacuuugacuucugcgacggcaccaccgugaucgucacggaggacugcgguaaccgcggcccauccuugcgcacgaccaccgcgucuggcaaacugauuacggaguggugcugucggagcugcacccugcccccgcuccgcuaccguggggaggacggcuguugguacggaauggagauccgcccucugaaggaaaaagaggaaaaucugguuaacucccucgugacagccggccacgggcagguagacaacuucagucucggggugcugggcauggcucucuuccuugaagagauguugcggacaagagugggaacgaagcacgccauccuccugguagccgugucguucgugacccuuaucaccggcaacaugucauucaaggaucucgggcgagucgugguuaugguuggcgccaccauggcggacgauaucggcaugggcgugacauaccuagcccuguuagcggcguucaaagugcgccccaccuucgccgcaggccugcugcuccggaagcugaccucuaaggaacugaugaugaccaccaucgggauagucuuacugagccagaguaccauccccgagaccgugcuggagcucaccgacgcgcuugcuuuaggcaugaugguccucaaaauaguacgcaacauggagaaguaccaacucgccgugacgaucauggccauccugugcgucccgaaugccguaauccuccagaacgccuggaaggugucuuguaccauccuggcgguuguguccgugagcccccugcuucugacgucuucucagcagaagacggacuggaucccccuggcccucacgauaaaggggcugaaucccaccgccaucuuccugacuacccucucccguacgaauaagaagcggagcuggccucugaacgaggccauuauggcagucggaaugguguccauccuagccucguccuugcugaagaacgacaucccgaugaccggcccucugguggccgggggccuccugaccgucugcuacgugcugaccgggcgcagcgccgaccuagaacuggagcgggcaacggacgugaaaugggaggaccaggcggagaucucaggcagcagccccauccugaguaucaccaucagcgaagacggauccaugagcaucaagaaugaggaggaagagcaaacccucaccauccugauccgcacggggcugcucgucaucucuggucuguucccgaucaguaucccgaucaccgccgccgcuugguaccucugggaggugaagaagcagcgugcgggggugcucugggacgugcccagcccgccucccaugggcaaggcggagcuggaagacggggccuaccgcaucaagcagaaaggcauccugggguacagccagaucggagccgggguguacaaggaggggaccuuccacaccauguggcacgugacccgaggggccguccuuaugcacaagggcaagcguaucgagcccuccugggccgacgugaaaaaggaccugaucuccuacggcggggguuggaaacuugagggcgaguggaaggagggcgaggaagugcagguccucgcacuggagcccggcaaaaaucccagggcugugcagacgaagcccggccuguucaagaccaauaccggcacgaucggcgccgucagcuuagacuuuagccccggcacguccggcagcccuaucaucgacaaaaaggggaaggucgucggccuguacgggaacggcguggucacccgcuccggcgccuaugugagcgccaucgcgcagacagagaaguccauugaggacaaccccgagaucgaggaugauaucuuccggaagcgccggcugaccauaauggaccugcacccaggggccgguaaaacaaaacgguaccuccccgccaucguucgggaagccaucaagcgcggccugcggacccugauccuagcgcccaccagggucguggcggccgagauggaggaagccuugcgggguuuacccauccgcuaccagaccccagccauccgggcggagcacaccgggcgcgagaucguggaccuuaugugccacgccaccuucacaaugcgccugcugagccccguucggguaccgaacuauaaucucaucaucauggacgaagcccacuucaccgaccccgccuccauugccgcacggggcuacauuagcacgcggguggagaugggcgaggcugccgggauauucaugaccgccaccccgccaggaagccgugacccguucccccaguccaacgcccccaucauagacgaggagagggagauccccgagcgcucguggaauucagggcacgaguggguaacagacuuuaagggcaagacggugugguucgugccgucaaucaaagcggggaacgauaucgccgccugccugcgaaagaacggcaagaaggucauccaacugucccgcaagaccuucgacagcgaguaugugaagacccggaccaacgacugggacuucguaguuacuaccgauaucuccgagaugggcgccaacuucaaggcagagcgagugaucgacccccgucgcugcaugaagcccgugauucucaccgacggggaggagcgugugauccuugccggcccaaugccggugacccacagcagcgccgcccagcgccgggggcgaaucggacggaaucccaagaacgagaaugaccaauacauauauaugggggagccccuggagaacgacgaggacugcgcccauuggaaggaggcgaagauguuacuagacaacaucaauacgccagagggcaucauaccgucaauguucgagccggagcgggagaagguagaugcaaucgacggcgaguaccggcugcgcggggaggcccgaaagaccuucgucgaccucaugcggcggggggaccugccgguauggcuggcauacaaaguggcugcggaagggauaaacuaugccgaccgucgauggugcuuugacggcauaaagaacaaccaaauacucgaggagaacgucgaggucgagaucuggacuaaggagggagaacggaagaaauuaaagccgagguggcuggaugcccguaucuacucugauccccuagcccugaaggaguucaaggaguucgccgccggucgcaagagccugacccucaacuuaaucacggagaugggccgccugcccaccuucaugacccagaagacgcgcgacgcccucgauaaccuggccguucugcacacggcugaggcaggcgggcgggccuauaaucacgcccucuccgaacugcccgagacgcuggagacccuccugcuguugacucugcuggcuacggugacugggggcauuuuccucuuccugaugucgggccgaggaaucggcaagaugacccuaggcaugugcugcaucauaaccgcguccauccuccugugguacgcgcagauccagccgcacuggauagccgcaagcauaauccuggaguucuucuuaaucgugcugcugauucccgagcccgaaaaacagcggacgccccaagauaaccagcucacguaugucgugauagccauccugacaguggucgcagcgaccauggccaacgagaugggcuuccuagagaagaccaaaaaagaccuagggcuggguuccauugccacgcaacagcccgagagcaacaucuuagacauagaucuccgacccgccuccgccuggaccuuauacgcuguggccacaaccuucguuacccccaugcugcggcacucgaucgagaacucguccgucaacguuagccucaccgccaucgcaaaucaggccaccgugcuuaugggccuggggaagggcuggcccuuaaguaagauggacaucggggucccgcugcuggcuaucggcugcuacagccaggugaaccccaucacacucacggccgcccugcuguugcuagucgcccacuacgcgaucaucgggcccggcuugcaagccaaggccacccgagaggcacaaaagcgcgcagccgccgguauaaugaagaaccccacuguugauggcauaaccgugaucgaccucgauccgauucccuacgaccccaaguucgaaaaacaguuaggccagguuaugcugcucauccugugcgucacccaggugcugaugaugcguaccaccugggcccucugcgaagcccugacccuggccacugggcccaucuccacacucugggagggaucuccagggcgguuuuggaacaccaccaucgcgguguccauggccaacaucuuccgcgguagcuaccuggcaggagccgggcuacucuucuccauuaugaagaacacaaccaacacgcguaggggcaccgggaauaucggcgagacgcugggugagaaguggaaaucccgccugaacgcccuggggaaguccgaguuccaaaucuacaaaaaauccggcauccaggaagucgaccggacccuagcgaaggaggggaucaagcgaggagagaccgaccaccacgcuguguccagagggagcgcuaagcuccggugguucguggagcggaacauggucacccccgaggggaaggugguggaccuaggcugcgggcgcggcggguggucauacuacugcggcgggcugaagaacguccgggaggugaaaggccuaacuaagggcggacccggccaugaagagcccaucccgaugagcaccuacggguggaaccucgugcgccugcaguccggcgucgaugucuucuuuaucccgcccgagaagugcgacacccugcuuugcgacaucggagagucaucccccaacccgacgguggaggcuggccggacgcugcgcguucugaaccucguugaaaauugguuaaacaauaacacccaguucuguaucaagguccugaacccuuacaugcccagugugaucgagaagauggaggcgcugcagcggaaguacggaggggcccucgugcgcaacccccugucucggaacuccacccacgagauguacuggguaucaaaugccucuggcaacaucgucuccuccgugaacaugauaagccgaaugcugaucaaccgcuucaccaugcgccauaagaaggccaccuacgagccagacguggaccucggguccggcacgcggaacaucgggaucgagagcgaggugccgaaccuggacaucaucgguaagcggaucgagaagaucaagcaggagcacgagacauccuggcacuacgaccaggaccacccuuacaagacaugggccuaccacgggagcuacgagaccaagcagacuggcuccgcaagcucgaugguuaacgguguggucagacugcucaccaagccgugggacguacugcccaccgugacccagauggccaugacggacaccacacccuuugggcagcagagggucuucaaggagaagguggacacacgcacgcaggagcccaaggagggcaccaagaagcugaugaagauuacggccgaguggcucuggaaggaguugggcaagaagaagaccccgcggaugugcacgcgcgaggaguucacccggaagguacgcucuaacgcagcccugggggcgauauucaccgaugagaacaaguggaaguccgcccgggaagccguagaggacucgcgguucugggagcucguagauaaggagcggaaccugcaccucgagggcaagugcgaaaccugcgucuacaacaugauggguaagcgcgagaaaaagcucggcgaguucgggaaggccaagggcucccgggcaaucugguauauguggcugggagcacgcuuccuggaguuugaggcauuaggcuuccucaaugaggaccacugguucagcagagagaacucccucagcgguguggagggggagggccuccacaagcugggguacauucugcgcgaugugagcaagaaggagggcggcgcuauguacgccgaugauacggccggaugggacacccggauuacacuugaggaccucaagaacgaggagaugguuaccaaccauauggagggcgagcacaagaagcuggcggaggccauuuucaagcuuacguaccagaacaagguggugcgcguacagcgacccacgccgcgggggacgguaauggacauaaucuccaggcgcgaccaacggggcucaggccagguugggaccuacggauuaaacacguucaccaacauggaggcccagcuaauccgccaaauggagggagagggcgucuuuaaaaacauccagcaucucacggucacggaggagguugccguucagaacuggcuggcaaggguggggcgagagagacugucccgaauggcaauuagcggcgacgacugcguggucaagccccucgacgaccgcuucgcaaacgcccugacggcccugaacgacaugggcaagaucaggaaagacauacagcaaugggaaccguccaagggauggaacgacuggacacaggugcccuuuuguagccaccauuuccacgagcucauuaugaaggauggccgcgugcuggucgugcccugccggaaccaggacgagcugauagggcgcgcccggaucucccagggcgccggguggagccuccgugaaaccgccugccugggcaaguccuacgcccagauguggucacugauguauuuucaccggcgcgaccuccggcuggcugcgaacgccaucugcucagcggugccuucacacugggucccgacuucgcgcacgaccuggagcauccacgccaagcaugaguggaugaccacagaggacaugcucacagucuggaacagagucuggauaagggagaacccauggauggaggacaaaacgccggucgagucaugggaagagaucccauaccucggcaagagagaggaccagugguguggaagccugaucggccugaccucccgcgccaccugggcgaaaaacauccaggccgccaucaaccaggugcgcagcuuaaucggcaacgaggaguauaccgauuacaugccgagcaugaagcgcuuccggcgcgaggaggaggaggccggcguucugugguaa

SEQ ID NO: 25147 - RNA, 9876 nt, Artificial Sequence
  derived and/or modified CDS sequence (opt11) from DENV-2__FJ744722__SS-prME
ucggugggaaugaucaucaugcucauacccaccguuauggcguuccaucugaccacccgcaacggggaaccccacaugaucgugagcauccaggaaaaagguaaaagccuacuuuucaagaccgaagacggggucaacaugugcacacucauggccauggaccugggcgaacugugcgaggacacuaucaccuacaagugcccccuccuucggcagaaugagcccgaggacauagacugcuggugcaacagcaccucuaccuggguaaccuacggaacuuguaccaccaccggcgagcaccgccgggagaaacgcuccguagcuuuagugccacacgucggaaugggccucgagacucggacugagacguggauguccagcgagggugccuggaagcacgcccagcgcaucgagacguggauccuucggcacccuggguuuaccaucauggccgccauacuggcguacacuauuggcaccacccacuuccagaggacuuuaaucuucaucuugcucaccgccguggcuccuaguaugaccaugcgaugcaucggcaucuccaaccgcgacuucguugaagguguauccggcggaaguuggguggacaucgugcucgaacacggcucaugcgucaccacgauggccaagaacaagcccacgcuggacuucgagcugauaaaaacugaggcgaagcaacccgccacgcuacgcaaguauugcaucgaggccaagcugacaaacaccaccaccgaaucccgcugucccacgcagggugaacccaaccugaaagaggagcaggacaagcgguucgugugcaagcacagcaugguggaccgcggcuggggcaauggaugcggccucuucgggaagggcgggauuguuacgugugcgauguucacgugcaagaagaacauggagggcaagaucgugcagcccgagaacuuagaguauacgaucguggucacgccccacucuggugaggagcacgccguugggaacgauacaggcaagcauggcaaggagaucaaagucaccccucagagcaguauuaccgaggcggagcugaccggcuauggaacggucaccauggagugcagcccccgaacuggccucgacuucaaugaaauggugcugcuccagauggagaacaaagccuggcucguucaccgccaaugguuccuugaucugccgcuacccuggcugccgggcgcagauacccagggcuccaacuggauccaaaaggaaacgcuggucaccuuuaagaacccgcacgccaagaaacaggacgugguggugcuaggcagccaggagggggccaugcacaccgcucuuaccggcgcgacggagauccagaugagcuccgguaaccuccuguucaccggucaccugaaaugccggcugcgcauggacaagcuccagcugaagggcauguccuacuccauguguaccggaaaguuuaagguggucaaggaaaucgccgaaacgcagcacggcacgaucgugauccgugugcaguacgagggagacggcuccccuugcaagauucccuucgagaucauggacuuagagaagcgcuacguccuaggccgguugaucaccgugaacccgaucguaaccgaaaaggacuccccuguuaacaucgaggcggagccgcccuucggggauagcuacaucaucaucggcguagagccggggcaacugaaguugaacugguucaagaaaggcuccagcauagggcaaauguucgagaccacaaugcgcggcgcaaagcgcauggcaauccugggcgacaccgccugggacuuugggucccuggguggcguuuucaccagcaucggcaaggccuuacaucaagucuucggugccaucuacggcgccgccuucuccggcguuaguuggacgaugaagauccugaucggggugaucaucacguggauaggcaugaacucucggagcacuuccuuaucugucucucugguacucgugggaguugugacacuguacuuaggcgugaugguacaagccgacagcgggugcgugguguccuggaagaacaaggagcuuaagugcggcagcggcaucuuuaucaccgauaacguccacacguggaccgagcaguauaaauuccaacccgagagcccuuccaagcuggcgagcgcaauucagaaagcgcaggaggaagguaucuguggcauucgcuccgugacccgcuuagagaaccucauguggaagcagaucaccccggagcugaaucacauucuagccgagaacgaggugaagcucacgaucaugaccggggacauaaagggcaucaugcaggccgggaagcgcagcuuacgcccgcaacccaccgaacugaaguauuccuggaagaccuggggcaaagccaagaugcucagcaccgaaucccacaaucagaccuucuuaaucgacggucccgagacugccgagugcccaaacacgaaccgcgcauggaauagcuuagaggucgaggacuacggguucggcguguucacuaccaacaucuggcucaagcugaaggagaagcaggaugccuucugcgacaguaagcugaugucugccgcuaucaaggacaacagggccgugcaugcggacaugggguacuggauagaguccgcccucaaugacaccuggaagaucgagaaggccuccuucauugaggucaagaacugucacuggcccaagucccauacccuauggucuaacggcgugcuggagagcgagaugauuauccccaagaaccucgcaggccccgugagccaacacaacuaucgcccgggguaccauacccagaucgccggcccauggcaccuugggaagcuggagauggauuucgacuucugcgacggcacgaccgucgugguaaccgaggauugugggaaccgcggccccucccuccggacuacaaccgcaucaggcaagcugaucaccgaaugguguugccggagcugcacucugcccccgcuccgauaccgcggggaagacggcuguugguacgggauggagauccgcccccugaaagaaaaggaggagaaucuggucaacucccucguuacggccggccauggacagguggacaacuucagccucggcguccugggcauggcucucuuucuggaggagaugcugcggacccgcguagggaccaagcacgccauacuccugguggcgguuucuuucgugacccuaaucaccggcaauaugagcuucaaggacuugggccgaguggucgugauggugggggccaccaugacugacgauaucgggaugggcgucaccuaccuggcccugcuagccgccuucaaagugcgccccacguucgcggccggccuuuuccuucggaagcuaaccucgaaggagcugaugaugacgaccauagggaucguucuccucagccaguccacuauccccgagaccauuuuagagcuuaccgacgcccucgcccugggcaugauggugcugaagauggugcgcgacauggagaaguaucagcuagcggucacuaucauggcgauccuuuguguuccgaacgccgugauccuccagaacgccuggaagguaagcugcacgaucuuggcgguggucuccgucucgccccuguuauugaccuccagccagcagaagaccgauuggaucccccuggcccugaccaucaaaggguugaaccccacggcgaucuuccuuaccacccugucccgcaccaacaagaagagaucauggccgcucaacgaggccauuauggccgugggcauggucuccauccuggccucgagucucuugaagaacgacauccccaugacgggcccccuggucgccgggggccugcucacugugugcuacgugcugaccgggcgcagcgcagaucuggaacucgaacgggccacagacgucaagugggaggaccaagccgaaauuuccggcagcucaccaauacuaucuaucacgauuagcgaggacgggucgaugagcaucaagaacgaggaggaggagcagacccugacuauuuuaauccgcaccggucugcuggugauuuccggccucuuccccguguccauacccauaacugcugcggccugguaucuaugggaggucaaaaagcagcgggcuggcgugcugugggaugugccgagcccgccgccaaugggcaaggccgaacucgaggacggggccuaccgcaucaagcaacgcggcauccuggguuacagucagaucggcgcgggcgucuacaaggagggcacguuucacaccauguggcacguaacccgaggcgccgugcugacucacaagggcaagcggauagagcccagcugggccgacgucaaaaaggaccuuauaucuuacggcggcggcuggaaauuggagggcgaguggaaggagggggaggaaguccaggugcuggcccucgagcccggcaaaaacccccgcgccguccaaacgaaacccggguuauuuaagacuaacaccggaaccaucggggcggugagccuggacuucaguccggguacguccggcucgcccaucaucgauaagaaagggaagguggugggccucuacggcaacggcguugugacccggucuggcgccuacgucagcgccauagcucaaaccgagaagaguaucgaagacaaccccgacaucgaggacgacaucuuucgcaagcggcgccugaccaucauggaccuccaccccggggccggcaagacuaaacgguaccugcccgcaauagugcgcgaagccaucaagcggggacucaggacucugauccuggccccgacgcggguugucgccgcggaaauggaggaggcccuccgcggcuuacccauacgguaccagacccccgcgauccgcgccgagcacacagggcgagaaauuguggaccugaugugucaugcuacauucaccaugcgucuccugagccccgugcgcguuccgaacuacaaccugauaaucauggacgaggcgcacuucaccgaccccgccuccaucgccgcccguggcuacaucagcacgcgcguggagaugggcgaagccgcagggaucuucaugacagcgacuccgcccggcagccgggacccuuucccccaguccaacgcacccaucaucgaugaggagcgcgagauccccgagcggagcuggaacuccgggcacgagugggugacggacuucaagggcaagacgguuugguucgucccuuccaucaaggccgggaacgacaucgccgcgugccuccgcaagaauggcaagaaagugauccagcugucccgcaagaccuucgacagugaguacgucaaaacacgcaccaacgacugggacuucguggucacgaccgacauuuccgagaugggagcuaacuucaaggccgagcggguuaucgacccccgccgcugcaugaagcccgugauacugaccgacggggaggaacgcguuauccucgccggccccaugccggucacccacagcuccgcggcccaacggcgggggaggaucggcaggaacccgaagaacgaaaacgaccaguacaucuauaugggggagccucuagagaacgacgaggacugcgcccacuggaaggaggccaagaugcugcucgacaacaucaacacaccagagggcauaaucccgagcauguucgagccggagcgggaaaagguggaugccaucgacggggaauaccgccugcgcggggaggcucggaagaccuucguggaccugaugcgccggggcgaccuccccgucugguuagccuacaagguggccgcagaggggauaaacuacgccgauagaaggugguguuucgacggcaucaagaacaaccagauccuggaggaaaacgucgagguggaaauauggacuaaggagggggagcgcaaaaagcucaagccacggugguuagacgcgcggaucuacuccgacccccuggcucucaaggaguucaaagaguucgccgccggucggaaaucccugacuuugaaccucaucaccgagaugggcaggcugccgacuuucaugacccagaagacccgggacgcucuggacaaucucgcggugcugcacacggccgaggcugggggccgcgccuacaaucacgcguuguccgagcuccccgagacccuggagacccuccuccuucugacccuccuugcgacggucaccgggggcaucuuccuguucuuaaugaguggacgcgggauuggcaagaugacccuagggaugugcugcaucgugaccgccuccauccugcucugguaugcucagauucagccgcauuggaucgcggcgucuaucauacuggaguucuucuuaaucgugcuucugauccccgaaccagagaagcagcgcacgccacaagacaaccaguugacguacguggugaucgccauccuuaccguggucgcagccaccauggccaacgaaaugggcuuccuggagaagaccaagaaggaucugggguuaggcuccaucgcgacgcagcagccggagucaaacauacucgauaucgacuugcggcccgccuccgccuggacccucuacgccguggcgacaacuuuugugacgcccaugcuucgccauuccaucgagaacagcuccguaaacgugagccuaaccgcgaucgccaaccaggcuaccgugcucauggggcuggggaagggcuggccccuguccaagauggauaucggagccccgcuccuggccaucggcugcuacucccaggucaaccccaucacccuaacugcggcacuucugcugcucgucgcgcacuaugccaucaucgggcccggccugcaagcgaaagccacacgggaggcucagaaacgcgccgccgcgggcaucaugaagaaccccaccguugacgggaucaccgucaucgaccuggacccgaucccguacgacccaaaguuugagaagcaguugggccaggugaugcuucugguguugugcguaacccagguguugaugaugcggaccaccugggcccugugcgaggcccucacacuugccacuggucccaucagcacgcucugggagggcaacccggggcgcuucuggaacaccaccauagcggugagcauggcgaacaucuuccguggcagcuaccucgccggcgcugggcugcuguucagcaucaugaagaacacgaccaacucccgcaggggcaccgggaacaucggcgagaccuuaggcgagaaguggaagucccgguugaacgcccuggggaaguccgaguuucagaucuacaagaagucaggcauccaggaggucgaccgcacacucgccaaggaggggaucaagcggggcgagacagaccaccacgcgguaucucgcgggucagccaaacuccggugguucguggagcggaauauggucacucccgagggcaaagugguggaccuagggugcgggcggggcggcugguccuacuacugugguggcuugaagaauguccgcgaggugaagggccugaccaagggcgggcccggccacgaggaacccauaccgaugagcacguaugguuggaaccuggugcggcuccaguccggcgucgacguguucuuuaucccgccggaaaaaugugacacucugcugugcgacaucggggaaucuucccccaauccgaccguggaggccggccgcacgcuccgcguccugaaccucguggagaacuggcucaacaacaacacccaguucugcaucaagguucugaauccauacaugcccagcgucaucgagaagauggagacgcuacagcgcaaguacggcggggcccuggugcgaaacccccuaagccgcaauucaacccacgagauguacugggugucuaacgcgucgggcaacaucgucagcucggugaauaugaucagccggauguuaaucaaucgguucaccaugcggcacaagaaggccaccuacgagcccgauguggacuuaggguccggcacgagaaauauugggaucgagagcgagauacccaaucuagacauaaucgggaagaggaucgagaaaaucaagcaggagcacgaaaccuccuggcauuaugaccaggaucaucccuacaagaccugggccuaccacggcagcuacgagacgaagcagacagguuccgccagcuccauggucaacggcguggugcgccuccugaccaaaccgugggacguccuccccacggugacgcagauggccaugacggacaccacccccuucggucaacagcgcguguucaaggagaaggucgacaccaggacgcaggagcccaaagaaggcacgaagaagcugaugaagaucaccgcggaguggcuguggaaggagcuaggcaagaagaaaaccccgcgcauguguacuagggaggaguucaccaggaaggugcggagcaacgccgcccugggcgcgaucuucaccgacgagaacaaguggaaaagcgcccgagaagcggucgaggacagccgcuucugggagcugguggacaaggaacgcaaccuccaccuggagggcaagugcgagaccugcguuuacaacaugaugggcaagcgggagaagaaacucggcgaguucgggaaagcaaagggguccagagcgauuugguacauguggcucggugcccgcuuccuugaguucgaggcccugggguucuuaaacgaggaccacugguuuucucgugagaacuccuuaagcggcgucgagggggagggccugcaccggcuaggguacauccugagagacgugagcaagaaggagggcggggcgauguacgccgaugacacggcugggugggauacccggauaacccuggaggaccucaaaaacgaagagaugguaaccaaccacauggagggcgagcacaagaagcuggcugaggcgauauucaaacuuacauaccagaacaagguagugcgcgugcagcggccaacaccgcggggcaccgucauggacaucaucucccggcgggaccagcggggaagcggccagguggguaccuacggucucaacacguuuacuaauauggaggcccagcugauccgucagauggagggggagggcguguuuaagaacauccagcacuuaaccguaacugaggagaucgccgugcaaaauuggcucgcccgcguagggagggagcgccugucccggauggccaucagcggcgacgacugcguggugaagccucuugacgaucgcuucgcgucggcccucacggcccugaacgacaugggcaagauacggaaggacauccagcagugggaaccgagucgcggguggaacgacuggacucagguaccuuucugcucccaccacuuccacgagcugaucaugaaagauggucgggucuugguggugcccugccgcaaccaggaugagcucauagggcgggcacgcaucagccagggugccggguggucccugcgggagacggcgugccuaggaaagaguuacgcccagauguggucccugauguauuuccaccgccgagaccugcgccucgcggcaaacgccaucugcagcgcggucccaucccacugggugccgacaagccggacaacguggucgauccacgcaaagcacgaguggaugacaaccgaggacaugcugaccguguggaaccgcgucuggauccaggaaaacccguggauggaggauaagacgccaguggaguccugggaggagauuccuuaucucggcaagcgggaggaucaguggugcgguaguuuaauuggccugaccagccgcgcaaccugggccaagaacauccaaguggccauuaaccaaguccggagccugaucgggaacgaggaguacaccgacuacaugccguccaugaagcguuuccgccgggaagaggaggaagcgggugugcuaugguga

SEQ ID NO: 25148 - RNA, 9876 nt, Artificial Sequence
  derived and/or modified CDS sequence (opt11) from DENV-2__FJ744723__SS-prME
agcgucggcaugauuauaaugcugauccccaccgucauggcguuccaccucaccacccgcaacggugagccccacaugaucgugucgauucaggagaagggcaaaagucuguuguucaaaacagaggacggggucaacaugugcacacucauggccauggaucugggcgagcugugcgaggacacaaucacuuacaagugcccccuacugcggcagaaugagcccgaggacaucgacugcuggugcaacucaaccagcaccugggucacguacgggacgugcaccacgaccggugagcaccgcagggagaagcgcuccguggcccugguuccccacgucggcauggggcucgaaacgcggaccgagaccuggaugagcuccgagggugccuggaagcacgcccagcgcaucgagaccuggauccugcggcacccgggguucacgaucauggccgcaauucuggcauacacgaucggcacaacucacuuccagcguacguuaaucuucauccuucucaccgcuguggcgcccagcaugacuaugcgguguauaggaaucucgaaccgggacuucguggagggcgucuccgggggguccugggucgacauuguacuugagcacggaucuugcgucaccacgauggccaagaacaaaccaacccuggacuucgagcugaucaagaccgaggcgaaacagcccgcaacucuccggaaguacugcaucgaggccaagcugacgaacaccacgaccgagucccgcugcccaacgcaaggugagcccagucugaaggaggagcaggacaagcgguucguguguaagcacuccaugguggaccgcggcuggggaaacggguguggccucuucgguaagggugguauagugaccugugccauguucacgugcaaaaaaaacauggagggcaagaucgugcagcccgaaaaccuagaguauaccaucguggucacgccacacagcggcgaagagcacgccgugggcaaugacacagggaaacacggcaaggagauuaagguaaccccgcaguccagcaucacggaggcagaacugaccggcuaugggacggucaccauggagugcucgccccggaccggccucgacuucaacgagauggugcugcugcaaauggagaacaaggccuggcucguccaucgccagugguuccucgacuugccccugcccuggcugccgggcgcggacacccaggggagcaacuggauucaaaaggaaacgcuggucacauucaaaaacccccacgcuaagaagcaggacgugguggugcucggaagccaggagggggcuaugcacaccgcgcugaccggagccacggagauccagaugucuagcgggaaccucuuguuuacaggccaccugaaaugccgacugcgcauggacaagcugcaguuaaagggcauguccuacagcaugugcaccgggaaguucaagguuguuaaggagaucgccgagacccagcacggcaccauuguaauccgggugcaguacgagggggauggcucccccugcaagauccccuucgagaucauggaccuggagaagcgauacguacugggcagauuaaucacugugaauccgaucgugaccgaaaaggacagccccgugaacaucgaggccgaaccccccuucggggacuccuauauuaucaucggcguggagccggggcagcugaagcuaaacugguuuaagaagggaagcaguaucgggcagauguucgagaccaccaugagaggcgccaagagaauggcgauccugggcgacacggccugggacuuuggcagcuugggcggaguguucaccucaaucggcaaggccuuacaccaagucuucggggccaucuacggcgccgcguucuccggcguguccuggacgaugaagauacugauagggguaauaaucacguggaucggcaugaacagccguuccaccagccugagcgucucgcuggugcucgucggggucgugacccuguaccugggugugaugguccaggcugauagugggugcguugugagcuggaagaacaaggagcugaagugcggcucgggaaucuucaucaccgacaacguccacacguggaccgagcaguacaaguuccagcccgaauccccgucaaaacuggccuccgcaauacagaaagcacaggaagaggggaucuguggcauccgcagcgucacccgguuagagaaccucauguggaagcagauuacccccgagcuuaaucacauccuggccgagaacgaggugaaguugacgaucaugaccggggacaucaagggcauaaugcaggccgggaaacgcucccugaggccucagcccaccgagcugaaauauagcuggaagacuuggggcaaagccaaaaugcucucuaccgaaagccacaaccaaaccuuccugauagauggccccgaaacugccgaaugcccuaacaccaaccgugcguggaauucccuggaagucgaggauuacggguucggcguguuuacgaccaacaucuggcucaaacugaaggagaaacaggaugccuucugcgacagcaagcugauguccgccgcgaucaaagacaacagggccguccacgccgauaugggguacuggaucgaaucagcccucaacgacaccuggaagaucgagaaggccuccuucauugagguuaaaaacugccacuggcccaagagccacacccugugguccaacggagugcuggagagcgagaugauuauuccaaagaaccucgcgggccccgucucgcaacacaacuaccgcccgggguaccacacucagaucgcuggccccuggcaccugggaaagcuggaaauggacuuugauuucugugauggcacgaccgucguggugaccgaggacugugggaaccgggguccaagccuccgcacaacgaccgcaagcggcaagcugaucacagagugguguugccgguccugcacccuaccaccgcuccgauaccguggggaggacggcugcugguacggaauggagaucagaccccugaaggaaaaggaagaaaaccuggucaauagccucgugacggccggccacgggcaaguagacaacuucucacugggcguccuaggcauggcccuguuccuggaggagaugcugcggacccgcguggggacgaagcacgccauccuccugguggcggugucguucguuaccuuaaucaccggcaacaugagcuucaaggaccucggccggguggucguuauggugggcgcgaccaugaccgaugauauugguaugggcgucacguaccuggcccugcuagccgccuucaaggugcgccccacguucgcggcuggccuguuucuccggaagcucaccuccaaggagcugaugaugaccaccauagggaucgugcuguuaucccagagcacaauacccgagaccauccuggaacugaccgacgcacuugcccugggaaugauggucuuaaagauggugcgcgauauggagaaguaccagcucgcggucacaaucauggcaauccuuugcgugcccaaugccgugauauuacagaacgcguggaaggugaguugcacgauucucgccguggugagcgucagcccccugcuuuuaaccucaucccagcaaaagaccgacuggauacccuuagccuugacaaucaaaggucucaacccaacggcgaucuuucugaccacacugagccgcacuaacaagaagcgguccuggccccuaaaugaggccauuauggccguaggcauggugagcauccuggcaucuucccugcuuaaaaacgacauccccaugacgggaccacuggucgccggcggacugcucaccguguguuauguguuaaccgggcgcuccgccgaccuggagcucgagcgagccacugacgucaagugggaggaucaggcagagaucucggggucuucccccauucugucgauuacgauaucugaggacgggagcauguccaucaagaacgaggaggaggagcagacgcugacaauuuuaauccgcacuggccugcugguaaucagcggccucuuuccgguguccauacccaucacagccgcggcaugguaccugugggaggugaagaagcagcgggccggggugcugugggauguccccucgccgccgcccaugggcaaggccgagcucgaggacggugcauaccgaaucaagcagaggggcauccuaggguacucgcagauuggcgcgggcguguacaaggaggggacguuccacaccauguggcacgugacccgcggcgccgugcugacgcacaaggggaagcggaucgagcccagcugggccgaugugaaaaaagaucucaucuccuauggcgggggcuggaaacuggagggugaauggaaggagggggaggagguccagguacuggcgcucgagcccgggaagaacccacgcgcaguccagacuaagcccgggcuguucaagaccaacaccggcaccauuggggcggugagucuggacuucuccccuggcacgagcgggucccccaucaucgauaagaaggggaaaguggucggccuguacgggaacggaguggugaccaggagcggggccuacgucuccgccauagcacaaaccgagaaguccaucgaagacaacccagauaucgaggacgacaucuuccgcaagcggcgcuugaccaucauggacuuacaccccggggccgguaagacgaagcgguaccugcccgcaauaguucgcgaagccaucaagcgcgggcuccguacgcuuauccuggccccgacccgggucguugccgccgagauggaagaggcccuccgcggccuccccauccgguaccagacccccgccauccgcgccgagcacaccgggcgcgagaucguugacuuaaugugccaugccacauucaccaugcgauuacugucgcccgugcgcgucccgaacuauaacuuaauaaucauggacgaggcgcauuucacggaccccgccagcaucgccgcccgggguuauaucagcacgcgaguggagaugggcgaggccgccgggauuuucaugaccgccacgccgccagggucccgggacccguucccccagagcaacgcccccauaaucgacgaggagcgcgagaucccggagcggucguggaacagcgggcacgagugggugaccgacuuuaaggggaaaacggugugguucguaccaaguaucaaggccggcaacgacaucgccgcgugucuccgcaagaacggcaagaaagugauacaacuaagccgcaagaccuucgacuccgaguacgucaaaacccgcacaaacgacugggacuucguggugacaaccgauaucagcgagaugggugccaacuucaaggccgagcgggucaucgacccccgcaggugcaugaagccgguaauccuuacggacggggaggagcgcgugauccucgccggccccaugccggucacucacaguagcgcagcgcagcggagagggcgcauaggccgcaacccaaagaacgagaaugaucaguauauuuauaugggagaaccgcuugagaacgacgaggacugcgcccacuggaaggaggcgaagaugcugcucgacaacaucaacacaccggagggcaucaucccguccauguucgagcccgagagggagaagguugacgccaucgacggcgaguaccgucuccgcggugaggcgcggaagaccuucgucgaccugaugcgccggggagaccucccagucuggcuagcguacaagguugcggccgaggggaucaacuaugccgacagacgguggugcuucgauggcaucaagaacaaucagauacuagaggagaacgucgagguggagauauggaccaaagagggggagaggaagaagcuaaaaccccgguggcuggacgcgcgcaucuauagcgauccucuagcguuaaaggaguuuaaagaguucgccgcaggucggaagucucugacccuaaaccucaucacggaaaugggacgccugcccaccuucaugacccagaagacccgggacgcccucgauaaucucgcaguucugcacacggccgaggcggggggccgcgccuacaaccacgcacugagcgagcuccccgagacgcuggaaacccugcugcugcugacccuccuggcuaccgucacggggggcauuuuccuuuuucucauguccggcagggggaucggcaagaugacccuggggauguguugcaucgugaccgcuagcauccuacucugguacgcccaaauccagccacacuggaucgccgcguccaucaucuuggaguucuuccugaucgugcuccugauucccgagcccgagaaacagcgcacgccccaggacaaccagcugaccuacguugugaucgcuauccucacaguggucgcugccaccauggcgaacgagaugggcuuucuggagaaaaccaagaaggaccuggggcucggcagcaucgccacgcagcagccggaguccaacauccuagacaucgaccugcgaccggccucagcguggacgcucuacgccguggccaccaccuucgucacgcccaugcugcgccacucaauugagaacucaagcgucaacgugucccugaccgcgauugccaaccaggccacagugcucaugggccuugggaaaggcuggcccuugagcaaaauggacaucggggccccgcuccuggccaucgggugcuacucucaggucaaucccaucacccugacugcggcgcuccuguuguuaguggcccacuacgccaucauugggcccggcuuacaggcgaaggccacacgggaggcccagaagagggcugcggcggggaucaugaaaaaccccaccguggacgggauaaccguuauagaccuggacccgauccccuaugacccuaaguuugagaagcagcugggccaggugaugcugcuggugcucugcgucacccaggugcugaugaugcggaccaccugggcccugugcgaggcacucacccuggccacggggcccaucagcacucuaugggagggcaacccggggcgcuucuggaacacgaccaucgccgucucuauggcgaauauauuccggggcagcuaccucgcuggcgcuggccuguuguuuuccaucaugaagaacacuaccaacucgcgccgggggaccgggaauaucggugagacccucggcgagaaguggaagucccgccugaaugcucucggcaagagcgaguuucagaucuauaagaaguccgguauacaggagguggaccgaacgcucgccaaggaggggaucaaacguggcgagacugaccaccacgcggugagucgcggguccgccaaacuacgcugguuuguggagcgcaacauggucacccccgaggguaagguuguggaccugggcugcgguaggggcggguggucuuacuacugcggcggguugaagaacgucagagaggugaaagguuuaaccaagggugggccaggccacgaagagccuaucccuauguccacguacggguggaaccuaguccgccuccagucaggcgucgacguguucuucauaccgcccgagaaaugcgacacccugcugugugauaucggugagucuagccccaacccgaccguggaggccggccgcacccuccggguccugaauuuaguugagaacuggcucaacaacaacacccaguucuguauuaagguguugaacccauacaugccuucugucaucgagaaaauggagacgcugcagcgcaaguacggcggugcccuggugaggaacccucucucccgcaacucuacgcacgagauguauuggguguccaacgcaagcggcaacaucgucuccagcgugaacaugaucuccagaaugcuuaucaaccgcuucaccaugcggcacaagaaagccaccuaugagcccgauguggaccuggggagcggaacgcgcaacauugggaucgaguccgaaauucccaaucucgacaucaucggcaagcggauugagaagaucaagcaggagcacgagacuagcuggcacuacgaccaggaccaccccuacaagaccugggccuaucacggcuccuacgagaccaagcagacggggagcgccuccagcaugguuaacggcguaguucgccuccugaccaaaccgugggacgucuugcccacgguuacacaaauggccaugacggacaccacccccuucgggcaacaacgcguguucaaggagaagguugauaccaggacucaggagcccaaggagggcacgaagaagcugaugaagauuaccgcggaguggcuguggaaggagcucggcaagaagaagacuccccgcaugugcacgcgggaggaguucacucgcaaagugcgguccaacgccgcccugggcgccaucuucaccgaugagaauaaguggaaauccgccagggaggcggucgaggacucccgcuucugggaacugguggacaaggagcggaaucuccaccuggagggcaagugcgagacuugcguguacaacaugaugggaaagcgggagaagaagcugggcgaguucgggaaagccaagggcagccgggccaucugguacauguggcucggggcccgcuuccuggaguucgaggcccuuggguucuuaaacgaggaccacugguucagccgcgaaaacucacuaagcgguguagagggagaaggucugcaccggcucggauauauccuucgcgauguguccaagaaagagggcggcgcgauguacgcggacgacacggcugggugggacaccagaaucacccuggaggauuugaagaacgaggagauggugaccaaccacauggagggcgagcacaagaaacuggccgaggccaucuuuaagcugacguaucaaaacaaagucgugagaguacaacgacccacgccccgcgggaccguaauggauauaaucagccggcgcgaucagcgaggcagcggucagguggggaccuacggacuuaacacauucaccaauauggaagcgcaguuaauccgccaaauggaaggagagggcguguucaaaaacauccagcaccucaccgucaccgaggagacggcggugcagaacuggcucgcccgcguggggcgggaacgccucagcagaauggccaucuccggcgacgacugcgucgucaagccccuggaugacagauucgcgagcgcccucaccgcccugaacgacaugggcaaaauucggaaggacauccaacagugggagccgagccgcggguggaacgacuggacccaagugcccuucugcagccaccacuuccacgagcugauaaugaaggacgggaggguacucguggugcccugccgcaaccaggacgaacugaucgggagagcccgcaucucccagggcgccgguuggagccugcgggaaaccgcuugccuaggaaaauccuacgcccagauguggagucucauguacuuccacagacgggaccugcgccucgccgccaacgccaucugcuccgcaguccccagccacugggugccgacgucccgcacgaccugguccauccaugcgaagcacgaguggaugaccacugaggacaugcuuacgguguggaacagagucuggauccaagagaaccccuggauggaggauaagacccccguggagucuugggaagagauccccuaccugggcaagcgggaggaccaguggugcgggagccuaaucggccugacuagccgcgcgacuugggccaagaauauccagguagccaucaaucagguacggucccuaauugguaacgaggaauacacagacuacaugccgagcaugaagcgcuuccgccgggaggaggaggaagcgggcgugcucugguga

SEQ ID NO: 25149 - RNA, 9876 nt, Artificial Sequence
  derived and/or modified CDS sequence (opt11) from DENV-2__FJ744724__SS-prME
ucagcagggaugaucaucaugcucauucccaccgugauggcauuccaucuuaccacgaggaacggcgagccgcacaugaucgucggcauucaggagaaagggaagucccugcuguucaagacagaggacggugugaacaugugcacuuuaauggcaauggaccugggggagcugugugaggacaccauaaccuacaaaugcccccuccugcggcagaacgaacccgaggacauugacugcuggugcaacucgaccucuacuugggucacuuacgggacuuguacaacgaccggggagcauaggcgggagaagcgcuccguugcucuggugccucacguggggauggggcucgagacgcgcacugaaacguggaugucaagcgaaggugcauggaagcacgcccagcgaaucgagaccuggauccugcgccauccggguuucacuauuauggccgcuaucuuggccuacacaaucgggacaacccacuuccagcgcguacugaucuucauacugcugacggccguggcucccuccaugaccaugcggugcaucgggauaucgaaccgcgacuucguugagggcguuuccgggggcucguggguagauauuguccucgaacacggguccuguguuaccacgauggcgaaaaacaagcccacgcuggacuucgaacugaucaaaaccgaagccaagcaacccgcaacccuccggaaguacugcaucgaagcgaagcugaccaacacgaccaccgagagccgaugcccaacacagggagagccgucccugaaagaggagcaggacaagcgguucgugugcaagcacuccaucguagaucgaggcuggggcaacggcugcggccuguucggcaaaggugguaucgucacgugugccauguucacaugcaagaaaaacauggaaggcaagaucguccagcccgaaaaccuggaguacaccaucgugguuacgccccacuccggugaggaacacgcggugggcaacgacacagggaaacauggcaaggagaucaaagugacaccgcagagcuccgucaccgaagccgagcugaccggguacggcacugucacgauggaaugcagcccccggaccggccuggauuucaaugagaugguucugcugcaaauggagaacaaagccuggcucguccaccgccagugguuccuagaccugcccuuaccuuggcugccuggggcugauaagcaggaguccaacuggauccagaaggagacccuagugaccuucaagaacccucacgccaagaaacaggaugucgugguucuaggcagccaggaaggggccaugcacacggcccucaccggugccaccgagauccagaugagcuccggcaacuugcuauucaccgggcaucugaagugcaggcugcgcauggacaagcuacaauugaagggcaugagcuacuccaugugcaccgggaaauucaaggucgugaaggaaauugccgaaacccaacacggcaccaucguuauccggguccaguacgagggggacggcagccccugcaagauccccuuugaaaucauggaucuggagaagcgcuauguucucggacggcugaucaccgugaacccuaucgucaccgaaaaggacuccccugugaacaucgaagccgaaccacccuuuggggacagcuacauaauaauugggguagagccggggcagcuaaagcucaacugguucaagaagggaucaagcaucgggcaaauguucgagaccacgaugcgcggcgcgaagcgcauggccauccucggggacaccgccugggacuucgggucccugggcgguguuuucacgagcaucgggaaggcccuucaccagguguuuggugccaucuauggcgcggccuucuccggcgugagcuggaccaugaaaauccugaucggggucauuaucaccuggaucggcaugaacucccgcagcaccucccugagcguaucccuagugcuagucgggaucgucacacuguauuugggaguaaugguccaggcugauagcgguugcguggugucauggaagaacaaggagcuaaaaugugguagcggcaucuucauaaccgauaacguccacaccuggaccgaacaguauaaguuccagcccgagagcccuuccaagcuggccagcgcuauccagaaagcccaggaggaggggaucugcggcauccgauccgugacacggcuggagaacuugauguggaaacagauuacccccgagcugaaccacauccuggccgagaacgaagugaagcucaccaucaugacuggggacaucaaagguauuaugcaagcggggaaaagaagccuacggccacagcccacagaacugaaauacuccuggaagaccugggggaaagccaagaugcucagcaccgagucauauaaccagacuuucuugauagauggccccgaaacggcggagugcccgaauaccaacagggccuggaacagccuggagguagaagacuacggcuucggcgucuucacaaccaacauuuggcucaagcugaaggagaagcaagacgcguucugcgacucuaagcucaugagcgccgccaucaaggacaaccgagcagugcacgccgacauggguuacuggauugaguccgcccuaaacgacacguggaagauugagaaggccagcuucaucgaggucaagaacugccacuggcccaagucccauacccucuggagcaacggggugcuggagagugaaaugaucauccccaagaaccucgcaggucccgugagucagcacaacuacagaccgggguaccauacccagauagcuggcccguggcaucuggguaagcucgaaauggacuucgacuuuugcgacggaaccacgguggucguuacggaggacugcgggaaucggggcccaagucuaaggaccacuacagccagcggcaaacugauaacagaguggugcugccggagcugcacgcuuccaccgcuccgcuaccgcggggaggacggcugcugguauggcauggaaauccgcccccugaaggagaaagaggaaaaccuggucaauucccucguuacggcaggccacgggcaaauugacaacuucagccuaggcgugcugggcauggcacucuuccuugaagagaugcugcggacccgcguggggacaaaacacgcuauuuuguugguggccgucucauucgucacucugaucaccgguaacauguccuucaaggaccucgggcgggugguggucauggugggugccacuauggcagacgacaucgggaugggagucacguaccuggcccuucucgcagcuuuuaagguacgccccaccuucgccgcgggcuugcugcucaggaaguuaaccuccaaggagcugaugaugaccacgaucgggauagugcuccugucucaguccaccaucccagagaccguucuugaguugaccgacgcccuggcgcugggcaugaugguucugaagaucguucgcgacauggaaaaguaccaacuugccgucacgaucauggcaauccuuugcgucccuaacgcugugauccuccaaaacgcuuggaagguaagcugcaccauccuggcggugguguccguaagcccccuucuucugacauccagccagcagaagaccgacuggaucccgcuggcccucacgauaaaggggcugaaccccaccgccaucuuccucaccacccucucccgcacgaacaaaaagcggagcuggccgcucaacgaggcuaucauggcggugggcaugguguccauccuugccagcucccuccucaaaaaugacaucccaaugaccggccccuuggucgcgggagggcugcugacaguguguuacgugcugacagggcguucugcagacuuggaguuagagcgggccacugacgucaaaugggaggaccaggcagagaucucuggcagcagccccauccuguccaucaccaucagcgaagacgggucaaugagcauuaagaacgaggaggaagaacagacucuuaccauccugauucgcacggguuuacuugugaucaguggccuguuuccgauaagcaucccaaucaccgcagccgcgugguaccuuugggaagugaagaaacagcgggccgggguccucugggauguccccagcccgccgcccaugggaaaggcggaacuggaggacggggccuacagaauuaagcagaagggaauccucggcuacagccagauuggagccggcguguacaaggaggggacguuucacacuauguggcacgucacccggggcgccguguugaugcacaaggggaagaggaucgagcccuccugggccgacgugaaaaaggaccugaucagcuacggagggggcuggaagcuggaaggcgaguggaaggagggcgaggaaguccaggugcucgcucucgagccuggcaagaacccucgggccguucagacgaagcccggucuauucaagaccaacaccggaaccaucggggccguuucccucgacuucucgcccggcacguccgguucucccaucaucgacaagaaggggaagguggucgggcuauacgggaacggcguagucaccagaagcggugccuacgugucugccauugcgcagacggagaagucaaucgaggacaaccccgagaucgaagacgacauauuccggaagcgccggcugaccaucauggaccuucaucccggggcuggcaaaacgaaacgcuaccucccagccaucguccgggaggcgaucaaaaggggucuucggacccugauccucgcaccuacaagaguaguggccgccgagauggaggaggcccuaaggggccugccaauccgcuaccagacuccugccauccgggcugagcacacggggcgggagauaguggaccucaugugccaugcuaccuuuaccaugcgccugcugagucccgugcgggugcccaacuacaacuugaucaucauggacgaggcacauuucacagacccugccuccaucgccgcgcgcggguacaucucgacgcggguagagaugggcgaggccgccgggauuuucaugacagccacgccacccggcagccgagacccauucccacagucuaacgcccccaucaucgaugaggagcgggagauccccgaaaggucguggaacucgggucacgagugggugaccgauuucaaggggaagacaguuugguuugucccgagcaucaaggcagggaacgacaucgccgcaugccuacggaagaacgggaaaaaggucauccaacuaucacgaaagacguucgacagugaguaugugaagaccaggaccaaugacugggacuuugucgugacuacggauaucuccgagaugggcgccaacuuuaaggcggagcgcgugaucgacccgcggcgcuguaugaagcccguaaucuugaccgacggggaagaaagagucauucuggcaggccccaugccgguaacacacucauccgccgcccagagacgggggcgcaucggccggaaccccaaaaaugagaacgaccaguauauuuacaugggggagccucuagagaacgacgaggacugcgcacacuggaaggaggcaaagauguuguuggacaauauaaacacgcccgaaggcaucaucccgagcauguucgagcccgagcgcgagaagguggaugcuaucgacggugaguaccgauuaagaggugaggcgcggaagaccuucguggaccucaugcgccgcggcgauuugcccguguggcucgccuacaaaguugccgcggaggggaucaacuacgcugaucggcgauggugcuucgacggcaucaaaaacaaccagauacucgaggagaacguggaggucgagauuuggacuaaagagggggagcgaaagaagcucaagccgcgcuggcuggacgcccggauuuacuccgacccccucgcucuuaaggaguucaaggaguucgccgcaggacguaagagcuuaacucucaaccugauuacggagaugggcagguuacccacguucaugacgcagaaaacacgcgaugcgcuugacaaucuggcugugcugcacaccgccgaagccggcgggagggccuacaaccacgcccucuccgaguuaccggagacccuagaaacacuccuacugcucacgcugcuugcuacgguuaccgggggcaucuuccucuuccucaugagcggccgcgggauuggcaagaugacgcugggaaugugcugcaucauaaccgccucaauacuccugugguacgcgcagauccaaccgcauuggauugcagcgagcauaauccuggaguucuuccuuaucguccuuuugauacccgagcccgagaagcagcggacuccccaagauaaccaguugacauauguagugauugccauucugaccguuguggccgcgaccauggcuaacgagaugggcuuccuggaaaagaccaagaaggaccucgggcuggggagcaucgccacgcagcagccggaaagcaacauccuggacauugacuuacgcccagccucugccuggaccuuguaugcuguggccaccaccuucguuacacccaugcugcggcacucaaucgagaacucauccgugaacguaagccuaacggcgaucgcgaaccaagccaccguacucaugggccuggguaagggcuggccccucaguaagauggacaucgggguuccgcugcuggcgauuggcugcuacucacaggugaaccccaucacccucacggccgcccuuuuguugcugguggcacacuaugcgaucaucgggcccggucugcaggcaaaggccacccgugaggcccagaagcgagcugcggcggggaucaugaaaaaccccacgguugaugggaucaccgucaucgaucuugacccgauucccuacgaccccaaguuugagaagcaacuggggcaggucaugcuccucauucucugcgugacccaggugcugaugaugcgcacgaccugggcacucugcgaggcgcugacccuggccacgggucccauuuccacccucugggaaggcaacccgggccgguucuggaacaccaccaucgcugucagcauggccaauaucuuccgcggcuccuaucuggcgggcgccgggcuccucuucuccaucaugaagaacacaaccaacacacggcggggaaccgguaacauuggcgagacacucggugagaaguggaaguccagacugaacgcgcuaggaaaauccgaguuccagaucuacaagaaauccggcauccaggaaguugaccgcacccuggcgaaggaggguauaaagcgcggcgaaacggaccaccacgccgugagccggggguccgcaaagcugcguugguucguggaacgaaacauggugacccccgaagguaagguugucgaccucggaugcggucgcgguggaugguccuacuauugcggcggccugaagaacguacgggaggugaaaggccucacuaagggcgggcccggccacgaggaacccauaccgaugucaacguacggguggaaucucguccgacuacagagcggcgucgacguguucuucaucccaccagaaaagugcgacacgcugcucugcgacaucggggagagcucucccaacccgaccgucgaggcaggacgcacccugcgaguguugaaucugguggagaacugguuaaacaacaacacccaguuuugcaucaagguccugaaccccuacaugccgagugucaucgagaagauggaggcguuacagcgaaaguacgggggcgcccucgugcgaaacccucuaagccgcaacucgacucacgagauguauugggucagcaaugccuccggcaacaucgucucuucugugaacaugauaucccgcauguuaaucaaccgguucaccaugcgccacaagaaggcgaccuacgagcccgacgucgaucucgggagcggcacgcggaacaucggaaucgagucugaggugcccaacuuagacaucaucggcaagcgcauagaaaagaucaaacaggagcaugagacaagcuggcacuacgaccaggaccacccauacaagaccugggccuaccacgguuccuacgagacaaagcagacggggagcgcgucgagcauggugaacggggucgugcggcugcucacgaagccgugggauguucugcccaccgucacccagauggcuaugacugauacgacccccuucggucagcagcgcguguucaaagaaaagguagacaccaggacgcaggaaccaaaggagggcaccaagaagcugaugaagauaaccgccgaguggcuauggaaggaguuggggaagaagaagacaccucggaugugcacgagggaagaguuuacccguaaggugcgcuccaaugcugcguuaggcgcgauauucaccgacgagaacaaauggaaguccgcucgggaagcuguggaggacucccgguuuugggaguuggucgauaaggagcguaaccugcaucuggaaggaaagugugagaccugcguguauaauaugaugggcaagcgcgagaagaaguugggggaauuugggaaggccaaggguagccgggccaucugguacauguggcugggagcgagauuccuggaguucgaggcacucggguuccugaacgaggaccacugguucucccgggagaacucacucaguggcguggagggugaagggcuccacaaacuuggguacauucugcgcgacguaagcaaaaaggaaggcggcgccauguacgcugacgacacggcugggugggauacucggaucacccucgaggaccugaaaaacgaggagauggugacuaaucacauggagggcgaacacaagaagcuagccgaggcgaucuucaagcucacauaccagaacaaggucgucagagugcaaaggcccacgccccggggcaccgugauggacauuaucagccggagagaccagcgggguucugggcaagucggaaccuacgguuugaacacauuuacaaauauggaggcccaacugauccgucagauggagggggagggcguguucaaaaacauccaacaccucacgguaaccgaggaagucgccguccagaacuggcuggcgcggguggggagggaacgccugagccggauggccauuuccggugacgacugcguggugaagcccuuagacgaucgcuucgcaaacgcucugacggcucuaaacgacaugggcaaaauccggaaagacauccaacaaugggagccaagcaaaggguggaacgacuggacacagguuccauuuugcucccaucacuuucacgagcucaucaugaaggacgggcggguguuaguggugcccugccggaaccaggacgagcugauugggagagcacggauaucacaaggcgcgggguggagucucagagagacggccugccugggcaaaagcuacgcucagauguggucccugauguacuuccaccgccgcgaccucagacuggcugcgaacgccaucugcuccgccguccccagccacugggugccaaccagucgcacgacaugguccauccaugccaagcacgaauggaugaccacagaagauaugcugaccguuuggaaccgggucuggauccgcgagaauccguggauggaagacaagacgccgguggaaagcugggaggagauccccuaccucggcaagcgcgaggaccaguggugugggucccuaaucggacugacaagccgcgccaccugggcgaagaauauccagaccgccaucaaccaggugcguuccuuaaucgguaaugaggaguauacagacuauaugccuagcaugaaacguuuccggcgcgaggaggaggaggccggcguccugugguga

SEQ ID NO: 25150 - RNA, 9876 nt, Artificial Sequence
  derived and/or modified CDS sequence (opt11) from DENV-2__FJ906957__SS-prME
agcgcgggcaugaucaucaugcugaucccuacggugauggccuuccaccucaccacccggaacggggagccgcacaugaucguuagcauacaggaaaagggcaagucucuucuguucaagacugaggauggugugaacauguguacccucauggcgauggaccugggcgaacugugcgaggacaccaucaccuacaagugccccuuacugcgccaaaacgaaccugaggacaucgacuguuggugcaacaguacgagcaccuggguaaccuacggaaccugcacaaccaccggggagcaccgucgggaaaagcgguccguggccuuagugccccacgugggcaugggccucgaaacccggaccgagaccuggaugagcucggagggcgcguggaagcacgcucagcgaaucgagacuuggauccuucggcacccgggauucacgaucauggcagcgauacuugccuacaccaucggaaccacccauuuccagcgcgcccucauuuucauccuucugacggcggucgcgccauccaugaccaugagaugcaucgggaucucuaaucgcgacuucguggagggugugucgggcggauccuggguagacaucgugcucgagcauggaagcugcgugaccaccauggccaagaacaaacccacacucgacuuugagcugaucaaaacagaggcuaagcagcccgccacacugcgcaaguacugcaucgaggccaaacugaccaacacgaccacugagagucgcugcccaacucaaggggagcccagccugaaggaggaacaggacaagagguucgucugcaagcacucaaugguggaccgcggguggggcaacgggugcggccucuuuggcaaggguggcaucguuacuugcgcgauguucacguguaagaagaauauggagggcaagauuguccagccggaaaacuuggaguacaccaucguaguaacgccccacagcggcgaggaacacgcagucgggaacgacacgggcaagcacgggaaggagauuaaaguuacgccgcaguccagcauuaccgaggccgagcugacaggcuacgggaccgugacgauggagugcagcccccggaccggacucgacuucaacgagaugguguugcugcagauggagaauaaagccuggcucgugcaccgccagugguucuuggaccucccccuccccuggcugccgggugcagauaaacaggggagcaacuggauccagaaggaaacccuggugaccuucaagaacccccaugcgaaaaagcaggacgucguaguccucggcagccaggagggagcaaugcauacggcccugaccggcgccaccgaaauucagauguccucgggaaaccuuuuauucacaggccaccugaagugccggcugcgcauggauaagcugcagcugaaggguauguccuauagcaugugcacggggaaauucaaaguggugaaggagaucgccgagacccaacacgguaccaucgucauucgaguucaauacgagggggacggcuccccaugcaagauuccguuugagauaauggaccuagaaaagcgcuacgugcucggccggcugaucaccguaaauccgaucgucacggaaaaggacagucccgugaacaucgaggcugagccaccuuucggagacuccuacaucaucaucggcguagaaccggggcagcugaagcugaacugguucaaaaagggaucuuccaucgggcaaauguuugagacaacaaugcguggggccaaaagaauggccauacuuggagacaccgccugggacuucggaagccuaggaggggucuuuaccuccaucggaaaggcacuccaccagguuuucggggcgaucuacggcgccgccuucagcggcgugagcuggaccaugaagauccugaucggggugaucaucacuuggaucggcaugaacucacggaguaccagccuuucuguuagucugguucucguggggaucgugacauuauacuuaggcguaauggugcaggcagacagugguugcguagucucuuggaagaacaaggaguugaagugcggcagcggcauauucauaaccgacaauguucauaccuggaccgagcaguacaaguuccagcccgagucgcccuccaaacuggcguccgccauccagaaggcacaagaggagggcaucugcggcauacgcagcguaacgagacuugagaaucugauguggaaacagaucacccccgaacugaaucacauccuggccgagaacgaagucaaguugaccaucaugaccggggacaucaagggcaucaugcaggccggcaagcggucucugcggccacagcccacugagcugaaguacucguggaagaccuggggcaaggcgaagaugcucuccacugaaagccacaaccagaccuucuugaucgauggucccgagacggccgaguguccgaacaccaaucgcgcuuggaacucauuagaaguggaggauuacggguucggcguguucaccaccaacaucuggcucaagcugaaggagaagcaggaugccuucugcgacuccaagcugauguccgccgcgaucaaggacaaccgggcaguccacgcugacauggguuacuggaucgagagcgcccucaacgacaccuggaaaaucgagaaagcauccuuuaucgaggugaaaaacugucacuggcccaagucacacacacucugguccaacggcguauuagagagugagaugaucauucccaagaacuuggcggggccagucucccaacauaacuaccgcccaggguaccacacccagaucgccggccccuggcaccucgggaagcucgaaauggacuucgauuucugcgacggcaccaccgugguggucacugaggacugcgguaaccggggacccagccuccgcaccaccacagcuagcggcaaguugaucacggaguggugcuguagguccugcacccugcccccauuaagguaccgcggggaggacggcugcugguacggaauggagauuagaccccuaaaagagaaggaggagaaucuggucaacagucucgugacugccggccaugggcaagucgauaauuucucccuuggcgugcucggaauggcccuguuccuggaggagauguugcgaaccagagugggcaccaagcacgcuauccuccuggucgccgccagcuucguaacccugaucacggggaacaugaguuucaaggaccucgggagagugguugugauggugggcgccacgaugacggacgacaucgggaugggcgucacuuacuuggcgcuguuggccgcguuuaagguacgccccaccuucgccgccggccugcuccuccguaagcugaccagcaaagaguugaugaugacgaccaucgguaucgugcuccugucccagucuaccauacccgagaccauccuggagcugacggacgcgcuggcccugggcaugaugguccucaagaucgugcgcaacauggaaaaguaccagcuggccgugaccaucauggcuauccugugcguccccaacgcggugauccuccagaacgcguggaaagucagcugcaccauucuggccgugguuagcgucagcccucuguuacugacuucgucccagcaaaagacugauuggaucccccuagcuuugaccaucaagggacucaaccccaccgcuauuuuccugaccacgcucagccggacaaacaagaagcgcaguuggccgcugaacgaagcgaucauggccgugggcauggucuccauccuggcaucuagccuccugaagaacgacauucccaugaccgguccccuuguugccgggggcuugcugaccgugugcuacgugcugacggggcgcagcgccgaccuagagcuggagcgugcgaccgaugucaagugggaggaccaagccgagauauccggcucgucccccauccuuuccaucaccauuuccgaggacgggagcaugaguaucaaaaacgaggaggaggagcagacccucacgauccugauccgcacgggccugcucgugaucagcggcuuauucccuguguccauccccaucaccgcggccgcuugguacuuaugggaagugaagaagcagcgggcggggguacucugggacgugcccuccccgccgcccauggggaaggccgagcuggaggacggugccuaccgcaucaaacagaaaggcauccugggguauucccagaucggcgccggcgucuauaaggaggggaccuuccacaccauguggcacgugacgcgcggcgcugugcucaugcacaaagggaagcgaaucgagcccuccugggcggacgucaaaaaggaccugaucuccuacggugggggcuggaagcuggagggagaguggaaagagggggaagaaguacaggugcucgcccuagagcccgggaaaaacccacgggcuguccagaccaaacccggucuuuucaagacgaacaccggcacuauuggggccgucagucuugacuucucgcccggcaccagcggcucgcccaucaucgauaagaaggguaagguggucggcuuauacgggaacggcguugugacccgcagcggcgcuuacgucagcgcgaucgcccagaccgagaaguccaucgaggacaaucccgagaucgaggacgacaucuuccggaagaggcggcugacgauaauggaccuucaccccggagccggaaagaccaagcgauacuuacccgccaucgugcgggaagcgaucaagagagggcugcguaccuuaauccucgccccgacccgcguuguugccgccgagauggaggaagcccuccggggccuccccauaagguaccagacgcccgcuauacgagccgaacacaccggucgcgagaucgucgaucucaugugucacgccaccuucaccaugcgccugcugagccccguacggguccccaacuacaaccucaucauuauggacgaggcacacuucacugaccccgccagcauagcggcacguggguacaucagcacgcggguagagaugggcgaggcggccgggaucuuuaugaccgccacgccgccuggcucucgcgacccguucccccaauccaacgcccccaucauagaugaggagcgggaaauccccgagcgcaguuggaacucggggcacgagugggugacggacuucaagggcaagaccgucugguucgugccguccaucaaggccgggaaugacaucgcagccugccuacggaaaaacggcaagaaggugauccagcuaagccgcaagaccuuugacagugaguacgucaagacccggacgaacgauugggacuucguggugacaaccgauauuagcgagaugggugccaacuucaaggccgagagggucaucgacccccgucgcugcaugaagcccgugauccucacagacggggaggagagaguaaucuuggccggccccaugccggucacucauuccagcgccgcccagcgccgcgggcgcauaggcagaaaucccaagaaugagaaugaccaguacaucuacaugggggagccccuggaaaacgacgaagacugcgcgcacuggaaggaggccaagaugcuccuggacaacaucaacacgccagaggguauuaucccgaguauguucgagccggagcgagagaaggucgacgcuauugacggcgaguaucggcugcgcggggaagcccgcaaaaccuucguugaccucaugcggcguggcgaccugccgguauggcuugccuacaaaguggcagccgaggguaucaacuacgcagaucgucgaugguguuucgacggcauaaagaacaaccagauccucgaggagaacguggagguagagaucuggaccaaggagggugaacggaagaaguuaaagccacgcuggcuggaugcucggaucuacagcgauccccuugcccugaaggaguucaaagaguucgcagcuggcagaaaaucccuuacucuuaacuugauuaccgagaugggucggcuacccaccuuuaugacgcagaagacgcgcgacgcccucgacaaucuggccgugcugcacaccgcggaggcgggagggcgagcguacaaccacgcccucagcgagcugccagagacccuggagaccuugcuacuguuaacgcugcuggcaacugucacaggugggaucuuccucuuucugauguccgggcgggggaucggcaaaaugacucugggaaugugcugcaucaucacggcgucgauccuccugugguacgcccaaauccagccgcacuggaucgccgccaguauaauccuugaauuuuuccucaucguacugcuuaucccugagcccgagaagcagcggacgccccaggacaaccagcugaccuacguggugaucgccauacugacggugguggcagccaccauggccaacgaaaugggauuccuggagaagacgaagaaagaccuggggcugggcucaaucgccacccagcagccggagaguaacauccuugacaucgaccuccgcccugcuagugcguggacccucuacgccgucgcaaccacauuuguaacccccaugcugcggcacucgaucgaaaacuccucagucaaugugucacucaccgccauagcaaaccaggcgacaguacugaugggccuggguaagggcuggccacuaagcaagauggauaucgggguaccguugcuggccaucggcugcuacucgcaagucaaucccaucacgcucaccgccgcgcuacugcuucuugucgcgcacuacgccaucaucggucccggccuacaggccaaggccacacgcgaggcccagaaaagagcggccgccggaauaaugaaaaacccgaccguggacgggaucacgguaaucgaccucgacccgaucccuuacgacccgaaguucgagaagcagcuuggccagguuaugcugcucauccugugcgugacacaggugcucaugaugcguacgaccugggccuugugugaggcccugacguuagcgacggggcccaucagcacccucugggagggcaacccugggcgguuuuggaacacuacgaucgcuguuuccauggcaaacaucuuccggggaagcuaccuggccggcgcugggcucuuguucuccaucaugaagaacaccaccaacacccgccgcggcacggguaacauuggcgagacccuuggcgagaaauggaaaagcagacugaacgcccucgggaaauccgaguuccagauauauaagaaguccggcauccaagaaguagaccgcacccuggcaaaagaggggaucaagcgcggcgagaccgaccaucacgcggucucccgggggagcgccaaacuacgaugguucgucgagcggaauauggugaccccggagggcaagguaguggaccucggcugcgggcgcgggggcugguccuacuauugcggaggucugaagaacgugcgcgaggugaagggccugacuaaaggagggcccggccacgaggagcccaucccgaugagcaccuacggguggaaccuggugcggcugcaguccggcgucgacgucuucuuuaucccgcccgagaagugcgauacccugcucugcgacaucggggaaucuucgccgaaucccacgguggaagccggccggacccuccgaguccugaaccucgucgagaauuggcuuaauaacaacacgcaguuuugcaucaaagugcugaacccuuacaugcccagcgucaucgagaagauggaggcccugcaacggaaguacggcggggcccucguccggaacccgcuguccagaaauuccacccaugagauguacuggguaagcaacgcuuccgggaauaucgucaguuccgucaacaugaucucccgcaugcugauuaaccgguucacaaugcgccacaagaaagcaacguacgagcccgacgucgaccuagggucuggaacccgcaacaucgguaucgaaagcgagauccccaauuuggacauuaucgggaaacguaucgagaaaaucaaacaggagcacgagaccuccuggcacuaugaccaagaccaccccuacaagaccugggcuuaccacggcagcuacgagacgaagcaaacgggguccgcgucuagcauggugaacggagucguacggcuucucacaaagccgugggacguccugcccacaguaacacagauggccaugaccgacaccacccccuucggucagcagagaguguucaaagaaaagguggacacgcgcacccaggagcccaaggaggggaccaaaaagcuaaugaaaaucaccgccgaguggcucuggaaggaacuggguaaaaagaagacgccucggaugugcacccgcgaggaguucacccguaagguucgcaguaacgccgcgcugggagccaucuucaccgacgagaacaaguggaaguccgcgcgggaggccguggaggacagccgguucugggagcucgucgacaaggaacggaaccugcaucuggagggcaagugcgagacgugcgucuacaacaugauggggaagcgcgaaaagaaauuaggcgaguucgggaaggccaagggcucccgggcgaucugguacauguggcugggagcacgcuuucuggaguuugaggcccucggcuuuuugaacgaagaucauugguucucucgggagaacucccugucaggcguggaaggggagggcuuacauaaguuaggguauauucucagagaugucagcaaaaaggagggcggugcgauguacgccgacgacaccgcagggugggacacaagaaucacccucgaggaccugaagaacgaagagauggugaccaaccacauggagggcgaacauaagaagcuggccgaggccaucuucaagcucacguaccagaacaaggugguccgcgugcagcgaccaacgccccguggaaccgucauggauaucaucagucggagagaccagagaggcucagggcaggucgggacguauggacugaacacuuucaccaacauggaggcucagcugauccgccaaauggagggggagggaguauucaagaacauccagcaccucaccguuacggaggagauugcaguccagaacugguuagcccggguugggcgcgagaggcugucgcgcauggccaucucaggugacgacugcguagucaagccguuagacgaccgcuuugccaacgcccugaccgcgcugaaugacaugggcaagauacggaaggauauccagcagugggagccguccaaagguuggaacgacuggacccaagucccauuuugcucgcaucauuuccaugagcucauuaugaaagacggacgcgugcuggucguacccugccggaaccaagaugaguuaauagggcgcgcccgaauaucccagggcgccggauggagccugcgcgagacugccugccuuggcaaguccuaugcccagauguggagccugauguacuuucaccggcgggaccuccgccuggcggcgaaugcgaucugcucagcuguacccagccacugggucccaacguccaggaccaccuggucgauccacgccaagcacgaguggaugacgacagaggacaugcugacgguguggaaccgaguguggauccaagaaaaccccuggauggaggacaagacccccgucgaguccugggaggagauccccuaucucggcaagcgcgaagaucaguggugcggcagccugaucggccuaacgucccgugcgaccugggccaagaacauccaggcugccaucaaccaggugcgcagccucaucgggaacgaagaauacacggauuacaugccgagcaugaagcgauuccggcgggaagaggaagaggccgguguucugugguga

SEQ ID NO: 25151 - RNA, 9876 nt, Artificial Sequence
  derived and/or modified CDS sequence (opt11) from DENV-2__FJ906958__SS-prME
agcguggggaugauuaucauguuaauccccacagugauggcauuccaccucacgacccggaacggggaaccccacaugaucguuagcauacaagaaaaggguaagagccuacucuucaaaaccgaagacgggguuaacaugugcacccucauggccauggaucucggggagcugugcgaggacaccaucacuuacaagugcccccuccuccggcagaacgaaccggaagacauagacugcugguguaacuccaccagcacuugggugacauacgggaccugcaccacgaccggugaacaccgccgggagaaaaggaguguggcguuggugccgcacgucgggaugggguuagagacacgcaccgagaccuggaugagcuccgagggugcuuggaagcacgcgcagcgcauugaaacuuggauccugcggcacccagguuuuacgauaauggccgccauacuggcguacaccaucggaaccacccacuuccagcgcgcccucaucuucauccugcugacagccgucgcccccuccaugacgaugcggugcaucgguaucuccaaccgcgauuucgucgagggcgugagcggcgggagcuggguggauaucgugcucgagcacggcagcugcgugaccacaauggcgaagaacaagccuacguuggauuucgagcugaucaaaacagaggcaaagcagcccgccacccucagaaaguauugcaucgaggccaagcugaccaacacuaccaccgagucccgcugccccacgcagggggagcccagccugaaggaggagcaagacaagcgauuugugugcaagcacuccaugguggaccguggaugggggaaugggugcggccuguucgggaagggcggcauugucaccugugcaauguucacguguaagaaaaacauggaaggcaagauagugcagccugagaaccuggaguacaccaucguggucacgccccacucuggcgaggagcacgcuguggggaacgacacggggaaacacgguaaggagaucaaggugacaccucaguccagcaucacggaggcugaacugaccggguacggcaccgugacgauggaguguagcccccggaccggccucgacuucaacgagauggugcuccugcagauggagaacaaggcauggcuagugcaccgccagugguuccuagacuugcccuuacccuggcugccuggcgccgacacgcagggaucgaacuggauccagaaggaaacccugguuacguucaagaacccucacgccaagaaacaggacgucguggugcucggcucacaagagggcgcgaugcacacagcguugacaggcgccaccgagauccagauguccagugggaaccuucuauucacugggcacuugaagugucggcugcgcauggauaaauugcagcugaagggcaugucguauagcauguguaccgggaaguucaagguggucaaggaaaucgcagagacccagcacgguacgaucgugauccgggugcaguacgagggugacggcagcccgugcaagguccccuucgagauaauggaccuggagaaacgcuacgugcucggccgacugauaaccgugaacccgguggucaccgagaaagacagccccgugaacaucgaggcugagccgcccuuuggcgacuccuauauuauuaucggcguggagccagggcagcugaagcugaacugguuuaagaagggcucgucaaucgggcaaauguucgaaaccaccaugcgcggcgccaagcggauggccauccuaggcgacacggccugggacuucgggaguuuaggugggguguucaccuccauaggaaaggcccuccaccaggucuucggugcuauuuacggcgcggccuucagcggcgucuccuggaccaugaagauccugauaggagugauaauaaccuggauaggcaugaacucccgcagcacgagccugagugugagccugguccuugucgggaucgugacauuauaccugggaguuauggugcaagcagacaguggaugcguggucuccuggaagaacaaggagcugaaaugcggauccggcaucuuuauaaccgauaacgugcacacuuggaccgagcaguacaaguuucaacccgagucccccuccaaacucgccucggccauucagaaggcacaggaagagggaaucugcgguauccgcucgguuaccaggcuggaaaacuuaauguggaagcagaucaccccggagcugaaccacauccuggcagagaaugaggugaaguuaacaauaaugacgggggacaucaagggcaucaugcaggcggggaagcgcucccugcggccccaacccaccgagcugaaguauaguuggaaaacuugggguaaggccaagauguugucuacggagagccacaaccagacguuccuaaucgacggaccggaaacagcggaguguccgaauaccaaccgugccuggaacucccuggagguagaagacuauggguucggcguauucaccacaaacauuugguugaaguuaaaggagaagcaggacgcuuuuugcgacagcaaauugaugucugccgccgucaaggacaaucgggcugugcacgcagacaugggguacuggaucgagagcgcacuaaacgacaccuggaagaucgagaaggccuccuucaucgaaguuaagaauugccacuggccaaagagccacacuuugugguccaacggaguacuggagagcgagaugaucauuccgaagaaccucgccggcccaguuucacagcacaacuaccgucccggguaccacacccagauagcgggucccuggcaccuggggaagcuagaaauggacuuugauuucugcgacggcaccacgguggucgugacugaggacugcgggaauagaggcccgucgcuccgcaccacaacggcauccggcaagcugaucaccgaguggugcugucggagcugcacuuugcccccgcugcgcuaccgcggggaagacgggugcugguaugggauggagauccguccccucaaggagaaagaggagaaccugguaaauucacucgucaccgccggccaaggccaaguggacaacuuuucccucggugugcugggcauggcguuauuccuggaggagaugcuccggacgcgugucgggacgaagcacgcgauccuccucguggccgugucguuuguaacacuuaucaccggcaacauguccuucaaggaccucgggcgggucguaguaauggugggcgcuacaaugaccgacgacauugguaugggcgucaccuaucuggcccugcucgcggcguucaaggugcgacccaccuuugcagccggccuucuccugcguaaacucacgaguaaggaguugaugaugaccaccaucgggauuguguugcugucgcagaguaccauacccgaaacgauucuggagcuaaccgacgcucuggcccugggcaugaugguccugaaaaucgugagggauauggagaaguaucaacucgcgguaaccauuauggcgauccugugcgucccaaacgcggugauucuccaaaacgccuggaaggugucgugcaccauacuggcggucgucagugugagcccacuccuccugacuagcucccagcagaagaccgacuggauuccccuggcgcuuaccaucaaggggcuuaauccuaccgccauuuuccugacaacgcucagucgcaccaauaagaaacggucguggccgcugaacgaggcuauuauggcugucggcauggugucgaucuuagccucuucucuccugaagaaugauauccccaugaccggcccgcuaguggccggggguuuacugacgguauguuacgugcuaaccgggcgcuccgccgaucucgagcuggagcgcgcuacagacgugaagugggaggaccaagccgagaucagcggcucaucccccauccugagcauaacaaucuccgaggauggaaguauguccauuaagaacgaggaagaggagcaaacguugacuaucuuaauccgcaccggccuacucgucaucagcggccuguuuccgguguccauccccaucaccgcggcggccugguaccugugggaggugaaaaagcaacgugccggggugcucugggacgugccuucaccgccgcccauggggaaagcggaguuagaggauggcgcauaucgcaucaagcagaaaggcaucuuaggcuacagucaaaucggcgccggcguguacaaggagggcaccuuccacacgauguggcacgucacccggggcgcggugcucaugcacaaggggaaacgaaucgaacccuccugggcggauguaaagaaggaccugaucuccuacggcgggggcuggaaguuggagggagaguggaaggagggggaggaaguccagguacucgcguuggagccaggcaagaacccccgugcggugcagaccaagcccggacucuucaagaccaacacggggacgauaggggccgucagccuagauuucuccccuggcaccagcggaucccccaucaucgauaagaaggggaagguggugggacuauacgggaacggcgucgugacccgcagcggugcuuacgucucugccaucgcccagacggagaaaucaaucgaggacaaccccgacaucgaagaugacauauuccggaagcgcagacugacuaucauggaccugcaccccggggcgggcaagaccaaacgcuaccucccggccaucgugcgggaggcgaucaagcguggguuacggacccugaucuuggcgccgacucgcgugguugcugccgagauggaggaggcccuccggggccuacccauccgcuaccaaaccccggcaauccgggcggagcacacgggccgcgagauagucgacuugaugugucaugcgacuuucacgaugcggcugcugucccccgugcgggugccgaacuacaaccucauuaucauggacgaggcccacuucaccgaccccgccagcauagccgcccgcggcuacaucagcacccgggucgagaugggagaggccgccgggaucuucaugaccgccacaccgcccgguagucgagauccguucccccagagcaaugcccccaucaucgacgaggagcgggagauacccgagcgcuccuggaacucgggacacgaguggguaacggauuucaagggcaagaccguaugguucguuccguccauuaaagccggaaacgacaucgcagccugccuucgcaaaaacggcaagaaggucauccagcugagccguaagaccuucgauucggaguaugcaaaaacucggacgaacgacugggauuucguggucacgacggauaucagcgagaugggcgcgaacuucaaggcggagcgcguaauagaucccaggcgcugcaugaagcccguaauccucacggacggggaggaacgggucaucuuggcugggcccaugcccguuacccauuccagcgcugcccagcgccgggggaggaucgggcggaaccccaagaacgagaacgaccaguacauauauaugggggaaccccuggaaaaugacgaggacugcgcucauuggaaggaggcaaagaugcugcuggacaacauaaacaccccagagggcaucauucccagcauguucgagccggagagggagaagguggacgccauagauggggaauaccggcugcgcggggaggcgaggaaaacguucgucgaucucaugcggcgcggcgaccuacccguaugguuggccuacaagguggcugcugaggggaucaacuacgcggaucggcgauggugcuuugauggcaucaaaaacaaccagauccuugaagagaacguggaaguggagaucuggacgaaggagggggagcggaagaaauuaaagccgcguuggcuggacgcccggauauacagcgacccccuagcccugaaggaguucaaggaguucgccgcaggccgcaagucccugacgcucaacuuaauuacagagaugggccggcugcccaccuucaugacucagaaaacgcgcgacgccuuggacaaccuagcaguccugcacacagccgaggccggaggacgggccuacaaccacgcccucagcgagcuaccugagacuuuagagacccucuugcugcugacccugcuggcgacgguuaccggagggauauuucuguuccugauguccggccgcggcaucggaaagaugacccucgggaugugcuguaucgugacagccagcauauugcucugguacgcgcagauccaaccacauuggauugcggccucaauaauucuggaguucuuucucaucguccuucuuauacccgaacccgaaaagcaacggacgccucaggacaaccaacucaccuacguggugaucgccauccuaaccgucguugcagcgacuauggccaaugaaaugggcuuccuggagaaaacuaaaaaggaccuaggauugggcagcaucgccacccagcagccggagucuaacaucuuagauaucgaccuccguccggccucugccuggacuuuauaugcgguagccacuaccuucgucaccccaauguugcggcacagcaucgaaaauucuagcgugaacgucucccucaccgcuaucgccaaccaggccacgguacugaugggguuggguaagggcuggccccucucgaaaauggauaucgggguuccucugcuugcgauaggcugcuacucccaggugaaccccaucaccuuaacugcugcccugcugcugcucguagcacacuacgcaaucaucggaccgggguuacaagcaaaagccacccgggaggcgcagaagagggccgccgcgggcauaaugaagaaccccacagucgauggaaucaccgugaucgaccucgacccgauuccauacgaccccaaguucgaaaaacagcugggccaagucaugcuucucgugcucugugugacccaagucuuaaugaugcgcaccacgugggccuuaugcgaggcucugacccuggcaacgggccccaucucgacauugugggagggcaacccagggcgguucuggaacacgacgaucgcgguguccauggccaacaucuuccguggaucuuaccuggccggcgccgggcucuuauucuccaucaugaagaacacgaccaacacgcggcgcggcaccgggaauaucggagagacccuuggcgaaaaauggaagucccgucugaacgcccucgggaaguccgaguuccagaucuacaagaaguccgggauccaggagguggaccggacacuugcgaaagaggguaucaagcguggcgaaacagaccaccacgcggucucccgggggagcgcaaagcugcguugguucguggagcggaacauggugacccccgagggcaaggucguggaccucggaugugggcgcggugggugguccuacuacugcggcggacucaagaaugucagggaggugaaggggcuaacgaagggcgggcccggccacgaggagcccaucccgaugagcaccuacggguggaaccucgugcggcugcagucugguguggacgucuucuucaucccgcccgagaaaugcgacacucugcucugcgacaucggcgagucuucaccgaauccgacaguugaggcuggccggacccugcgcgugcuuaacuugguagaaaacuggcugaacaacaauacacaauucuguauuaaggucuuaaaccccuacaugccuagcgugaucgagaaaauggagacccugcagcggaaguacggcggggcgcucguccgcaacccucugucccggaacuccacgcacgagauguacugggugaguaacgccucuggcaacaucguaucuuccgucaauaugaucagccgcaugcugauaaaccguuucaccaugaggcacaaaaaggcgacguacgagccggacguggaccuuggcucagguacccggaacauugggaucgagagcgaaaucccaaacuuggacauaauaggcaagcgcaucgagaaaauaaagcaggaacacgagacguccuggcauuacgaccaggaccaccccuacaaaaccugggccuaccacgggagcuacgaaaccaagcaaaccggcuccgcaagcaguaugguaaacggcgucgugaggcugcucacgaagcccugggaugugcugcccaccgucacccaaauggcgaugaccgacacgacccccuucggccagcagcgcguguucaaggagaaagucgacacacguacacaggaacccaaggagggaacgaagaagcugaugaagauaacggccgaguggcuauggaaggaacugggaaagaagaagacaccgcggauguguacgcgcgaggaguucacgcggaaaguacgcaguaacgcugcccugggggccaucuuuaccgacgagaacaaguggaaguccgcacgggaggccguggaagauagccgcuucugggagcucgucgacaaagaacgaaaccugcaccuggagggcaagugugaaacgugcguguacaauaugaugggcaaacgcgaaaagaaguugggcgaguucgggaaggccaagggcucccgagcuaucugguacauguggcugggcgcccgguuccuggaguuugaggcgcucggguuucugaacgaggaccauugguucagccgggagaacuccuugagcggcguggagggggagggccuccacaaacucggguauauauugcgcgacgucagcaaaaaggagggcggcgcuauguaugcugacgacaccgccgggugggacacgcgaaucacccuggaggacuuaaagaacgaggagauggugaccaaccauauggagggagagcauaaacgccuggccgaggcaaucuucaagcuaacauaccagaacaaaguuguccgggugcaaaggcccacaccacggggaaccgucauggauaucaucuccaggagagaccaaaggggcagcgggcaagugggcacuuacggcuugaacaccuuuacgaacauggaagcgcagcucauccggcagauggagggggaaggcguguucaagaacauucagcacuuaacagugacagaggagauugccguccaaaacuggcuagcacgcguggggcgugagagacucagccguauggcgaucagcggcgacgacugcgugguuaagccgcucgacgaccguuucgccuccgcccugacugccuuaaaugacauggggaagauccgcaaggacauccagcagugggagccuagccggggguggaacgacuggacgcaggucccguucugcucgcaccauuuccacgagcucauaaugaaggauggccgcgugcuggucguucccugucggaaccaggacgaacuaauagggcgggcccgaaucagccaaggugcggggugguccuuacgugaaacagcgugccugggcaagagcuaugcccagauguggagccuaauguauuuccaucggcgcgaccuccggcuggccgcuaacgcgaucugcucggccgugcccucccauugggucccgaccagcaggacuaccuggagcauccacgccaaacacgaguggaugacaacagaggacaugcugaccguauggaaccggguguggauacaggaaaauccguggauggaggacaagaccccagucgaaucaugggaggagaucccguaccucggcaaacgagaggaccaguggugcggguccuuaaucgggcugaccagcagggcaacuugggccaagaauauacaggcggccaucaaucaggugaggucucucauuggcaaugaggaauacaccgacuacaugccguccaugaaacgguucaggcgcgaggaggaggaggcuggugugcugugguga

SEQ ID NO: 25152 - RNA, 9876 nt, Artificial Sequence
  derived and/or modified CDS sequence (opt11) from DENV-2__FJ898452__SS-prME
ucggccggcaugaucaucaugcugauccccacggugauggccuuccaucucaccacccgcaauggggaaccccacaugauugucggcauucaggaaaaagggaaaucccuucuguucaaaaccgaagacgguguaaacauguguacccucauggcgauggaccugggagagcucugcgaggauacgauaaccuacaaauguccccuccugcgucaaaacgagccugaggacauugacugcuggugcaacagcacuagcaccuggguuaccuacgguaccuguacgaccaccggcgagcaccgccgggagaaacgcagcguagcccuuguuccccaugugggcaugggcuuggaaacccgcacugagaccuggauguccucugagggggccuggaaacaugcccaacgcaucgagacguggaucuugcggcacccgggauucaccauuauggcagcgauccuggccuacacuaucgguacgacccacuuucagagggucuugauauuuauacugcugacggcugucgccccguccaugaccaugcgcuguaucgguaucucgaaccgcgacuucguggagggugucagcgggggcagcugggucgacaucguccucgagcacggguccugcgucacgaccauggcgaaaaacaagcccacccucgacuuugagcugaucaaaacugaagcgaaacagccugccacccugcggaaguacugcaucgaggcaaagcugacuaacacgacgaccgagagccgcugccccacacagggagagcccucgcugaaggaagaacaggacaagcgguucgugugcaagcauucgaugguugaccgcggcugggggaacggcuguggguuguucggcaagggcgggauugugacgugcgcaauguucacguguaagaaaaacauggaggggaagaucgugcagccagagaacuuagaauauacgauagugguuacgccccacuccggugaggagcaugcagugggaaacgacaccgggaagcauggcaaggaaaucaaggugacgccgcagagcagcauuacggaggccgaacugacggguuacggcacggucacgauggagugcucuccucggaccggcuuggacuucaacgagaugguccugcugcagauggagaacaaagccuggcucgugcaucggcagugguuucuggaccugcccuuacccugguuaccgggggcggacaagcaggaguccaauuggauccagaaggagacccuggucaccuucaaaaacccucacgccaagaaacaggacgugguggugcucggaagccaggagggggcgaugcacacggcucugacgggagccacggagauccaaaugagcagcggcaaccuccuguuuaccgggcaccugaagugccgguugcggauggacaagcuccagcugaaggggaugagcuacuccaugugcaccgguaaauuuaagguggucaaggagaucgcagagacccagcacggcaccaucguaauccgggugcaauacgagggggaugggagucccugcaagauucccuucgagaucauggaucuggagaagcguuacguucugggccggcucaucaccgugaacccgaucgugacggaaaaagacucccccgucaacauagaggccgagccgcccuucggggauucguacaucaucauaggcguugagccgggacagcugaaguuaaauugguuuaagaagggauccuccaucgggcagauguucgagaccaccaugcgcggcgcgaagcgcauggccauccuuggagauaccgccugggauuuugggucccuaggcgggguguucacuucaaucggcaaggcucuccaccagguguucggugccauuuacggcgcggccuuuuccggugugucguggaccaugaagaucuuaaucgggguaaucaucaccuggaucggcaugaacucccggucgacaagucucuccguaucuuuggugcucguggggaucgucacgcuguaccugggugugauggugcaggccgauagcggaugcguagugucguggaagaacaaagagcucaagugcggcagcggaauauucauaaccgacaacguucauaccuggacugagcaguacaaauuccaacccgaaaguccuaguaagcuggccagcgcaauucagaaagcucaagaggaggggaucugcggcaucagaucagucacacggcuggaaaacuugauguggaagcagaucacacccgagcugaaccauauccuggcggaaaacgaggugaagcuaaccauuaugacaggggacaucaaaggaaucaugcaggccgggaagcgcucguugcgcccucagccuacggaacucaaguacuccuggaagaccuggggcaaggccaaaaugcucucgacggaguccuacaaucagaccuuccugauagauggccccgagaccgcggaaugcccgaacaccaaccgagcauggaacucccuggagguggaggacuacggguucggcgucuucaccacgaacaucuggcucaaguugaaggagaagcaggacgccuucugcgauuccaagcugaugagcgccgccauaaaagacaaccgagcuguucacgccgacauggguuacuggauagaguccgcgcucaacgacacguggaaaaucgaaaaggccaguuuuaucgaggugaagaacugucauuggcccaagucccacacccuuuggagcaauggaguccuggagagcgagaugauuauccccaagaaccucgcaggccccguaagccagcauaauuaucggcccggguaccacacccaaaucgcgggccccuggcaccuggggaaacuugaaauggacuucgauuucugcgacgguaccaccguuaucgucacggaggacugcgggaauagaggcccuuccuuaaggacaacuaccgccagcgggaaacugaucacugaguggugcugucgguccugcaccuuaccgccgcuccgcuaccgcggcgaagauggcugcugguacgggauggaaaucaggccccucaaggagaaggaagagaaccuggugaacucccuggugaccgccggccacggccaggucgacaacuucucacuggggguucugggcauggcccuguucuuggaagagaugcugcgaacgcgggugggcaccaagcacgcgauccuccucgucgccguguccuucguaacgcuuaucaccggcaacaugagcuucaaggaccuaggacgggugguggugauggucggugccaccauggccgaugacaucgggaugggcguuacguauuuagcccuguuggcggccuucaaggugcggccuaccuuugccgccggccugcuauugcggaagcugaccuccaaggaguugaugaugaccacgaucgggaucgugcugcugagccaguccacaauuccugagaccgugcuggagcucacugacgccuuggcgcuuggcaugauggugcuuaagaucgucagaaacauggagaaguaccaauuggcuguuacgaucauggcaauccugugcgucccgaacgccguuauauuacagaacgcuuggaagguaaguugcaccauccuugcggucguuuccgucucaccacugcuccuaacgaguagccaacaaaagacggacuggaucccccuugcacucacaaucaaagggcugaacccuacagcaauauuccugacgacgcuaucccgcacgaacaagaagcgaagcuggccucuaaacgaggccaucauggcggucggcaugguguccauauuagccucgucccuccuaaagaacgacauaccgaugacagguccccugguugcugggggcuuguuaaccguuugcuacgugcugacaggaaggucugccgaccuugaauuagagagagccaccgacgugaagugggaggaccaggcugagauaucggguuccagccccauccuguccauuaccauaagcgaggacggaucuaugagcaucaaaaacgaagaagaggagcagacccuaacaauccugaucagaaccgggcuccugguuauaaguggacuguucccgaucagcauccccaucaccgccgccgccugguaccugugggaggugaagaagcaacgggcagggguacucugggauguccccagcccuccgcccaugggaaaggcggaacuggaggacggggccuacaggauuaaacaaaagggcauacugggauacagucagaucggugccggcgucuacaaggaggggaccuuccacaccauguggcacgugacucgcggcgccguccuaaugcacaaaggcaagcggaucgagcccuccugggcagaugugaagaaggaccugaucagcuauggcgggggcuggaaacuugagggcgaguggaaggagggggaagaggugcaggucuuggcgcuggagccgggaaagaauccccgggcaguacagacgaaacccgggcuguucaagaccaacacaggaacgaucggggccguuucacucgacuuuucaccgggcacgagcggcucacccauuauugauaagaaggggaaggucguggggcuguacgggaacgguguugucacacgcagcggggcuuacgugagcgcgauagcccagaccgaaaagaguaucgaggacaaccccgaaaucgaagacgauauuuuccggaagcgucggcugaccaucauggaccugcaccccggggccgggaagacaaaacgcuaccuacccgccaucgugagggaagccaucaaacgcgggcugaggacucugauccucgcgcccaccagggucguggccgccgagauggaggaggcccuucggggauuacccaucagauaccagaccccggccauccgcgcggagcacacuggacgcgagaucguggacuugaugugccacgccacguuuaccaugcgccugcugucacccguccgggugccaaacuacaacuugauaaucauggacgaagcgcauuucaccgaccccgccuccaucgcagcgcgcggcuacaucagcacgcggguggagaugggcgaggccgccgggauuuucaugaccgccacgccaccaggcagccgagacccauucccgcaguccaaugcuccgauuaucgaugaggagcgcgagauaccagagagaagcuggaacuccgggcaugaguggguaacugauuucaagggaaaaacggugugguucgugcccagcauaaaggcggggaaugauauugcugccugucugcgcaagaacggaaagaaagucauccagcugagccgcaaaacguuugauagcgaguacgugaagacccguaccaacgauugggauuuuguggucacgaccgauaucuccgagaugggcgccaacuucaaggcggagcgcguaaucgacccccggcgcugcaugaagccaguaauacucacugacggggaagaacggguaauucuggccggccccaugccggugacccacagcucagcugcucagcgucgggggcgcauagggcggaaccccaagaaugaaaacgaccaauacaucuacaugggugagccacuggagaacgacgaggauugcgcccacuggaaggaggcgaagauguuacuggacaauaucaacacucccgaggggauaauaccgagcauguuugagccugagagagagaagguggacgcaaucgacggcgaguaucgguugcgcggggaagcuaggaagaccuucguggacuugaugcggcguggcgaucuucccguguggcuggccuacaagguugccgcggagggaaucaacuaugccgaccggcgcugguguuuugacgguaucaagaacaaccagauccucgaggagaacgucgagguggagauauggaccaaagaaggggagcggaagaaacugaagccucgcuggcuggacgccaggauauacagugacccccuugccuugaaggaguucaaggaguucgccgcaggccgcaagucucugacucucaaccugauaacugagaugggccggcugcccaccuucaugacccagaagacgagggacgcuuuagacaaccuggccguccugcauacggcugaggccggcgggcgugccuacaaucacgcucucuccgaacugcccgagacccuggagacccuccuguugcucacgcugcuggccacggugacagggggcaucuuucuguucuugaugagcggucgugggaucggcaagaugacccuggguaugugcugcaucaucaccgccucgauccuccugugguacgcgcagauccagccccauuggaucgcugccaguaucauccucgaguucuuccucaucgugcugcuaaucccagagcccgagaagcagcgaacaccucaggacaaccaguuaacguacguugugaucgccauccugaccguggucgccgcgacuauggccaaugaaaugggcuuccucgagaagaccaagaaagacuuagggcuaggcuccauagccacgcagcaacccgaaagcaacauccuggauaucgaccucagaccugccagugccuggacccucuacgcgguggcgacgacuuucgugaccccuaugcugcggcauaguaucgagaauaguuccgucaaugugagcuuaaccgcgaucgccaaucaggccacgguacuaaugggccuggggaaaggcuggcccuuauccaagauggacaucgguguaccgcugcuggcgauagggugcuauagccaggugaacccaauaaccuugacggccgcccugcuguuacugguugcccacuaugcaaucaucggcccgggacugcaggccaaggccacacgcgaggcccagaaacgggccgccgccggcaucaugaagaaccccaccgucgaugggauuaccgugauagaccucgacccgauccccuacgacccaaaguucgagaagcagcugggccaaguuauguuacucauucugugcgucacucaggugcugaugaugaggacuaccugggccuuaugcgaggccuuaacccuugccacggggcccaucuccacacucugggagggcaacccggggcgguucuggaauacaaccaucgccguaagcauggccaauauauuucgcggcuccuaccuggccggugcggguuuauuguucucaaucaugaagaacacgacaaauacccguaggggcacugguaauaucggcgagacacuuggagaaaaauggaagucccgccugaacgccuuaggcaaguccgaguuccaaaucuacaagaaaagcggcauccaggaggucgaucggacacuggcuaaagaagggaucaagcgcggcgagacagaccaccaugccgugagccggggcagcgccaagcugcguugguucgucgagcguaacauggucacccccgaaggaaaaguaguggaccucggcugugggcgcggagggugguccuacuacuguggaggguugaagaacguuagggaagugaaaggccuaacgaagggagggcccggccacgaggagcccauacccauguccaccuacggguggaacuugguaaggcuacagagcggcgucgacguguucuuuaucccgccagagaagugcgauacguuacucugugauaucggggaguccagucccaaccccaccguggaggcuggccggacgcugcgcguccugaaucucguggaaaacuggcuuaauaacaacacccaauucugcaucaaagugcuuaaccccuacaugcccagugucaucgagaagauggaggcacugcagaggaaguauggaggggcucucguucggaacccacugucucggaacagcacccacgagauguacugggugaguaacgcuagcggcaacaucgucuccagugugaauaugaucucccgaaugcucaucaaccgguuuaccaugcgccacaagaaagccaccuacgagcccgacguggaucucgggucuggcacucggaacaucgggaucgagucggaaauccccaaccucgauaucaucggcaagcgcaucgagaaaaucaagcaggagcaugagaccaguuggcacuacgaucaggaccaccccuacaaaacgugggccuaccacggcuccuacgagaccaagcagacuggcagcgccuccucuauggucaacggagugguacggcuccuaacuaagccgugggauguucugcccacagugacccagauggccaugacggacacgacccccuucggacagcagcggguauucaaggagaaggucgacacgcgcacgcaggagcccaaggagggcaccaagaagcugaugaagaucaccgccgaguggcucuggaaggaacugggcaagaagaaaaccccgcggaugugcacgcgcgaggaguucacccggaaggugcgauccaacgccgcccugggggccaucuuuacggacgagaacaaguggaagucugcccgggaggcagucgaagacucacgauuuugggaguuggucgacaaagagcggaaucugcaccuggagggcaagugugagaccugcguguacaacaugaugggcaagcgcgaaaagaagcucggggaguucggaaaggccaaaggcagccgggccaucugguacauguggcuuggagcgcgcuuccuggaguucgaggcccucggcuuccugaaugaggaccauugguucagucgggagaauagucugucggggguagaaggcgaaggccuccacaagcugggguacauacugagagacguaagcaagaaggagggaggcgccauguacgccgaugacacggcggguugggacacccggaucacuuuggaggaccugaagaacgaagagaugguaaccaaucacauggaaggagagcauaaaaagcuggcggaggcaaucuucaaacucacuuaccaaaacaaggucgugcgcguccaacggcccacaccccgggguaccgucauggauaucauaagccgccgcgaccagcgcggcuccggccagguggggacauacggacugaacacguucacuaacauggaggcccaauuaauccgucagauggagggggaggggguguuuaagaacauacaacaucucaccgucaccgaggagguggcaguacagaacuggcuggcgcgggucggacgcgagcgccugagccggauggcuaucuccggcgacgauugcguggucaagccacucgacgacagauucgccaacgcccugacagcccugaaugacauggguaagauccggaaagauauccaacagugggaaccgagcaaaggguggaacgacuggacccagguacccuucugcucccaccacuuccacgaacucaucaugaaggacggacgcgugcugguuguucccugccggaaucaggaugagcugaucgggcgcgcgcguauaagccagggagccgguuggucccuccgcgagacagccugccucggcaagagcuaugcccagauguggagccugauguauuuccaccggcgcgaccuccggcuagccgcaaacgccaucugcucagcugugcccucacacugggugccuacaagccgcacaacuuggaguauccacgcaaagcacgaguggaugacuacagaggacaugcugacugucuggaaccggguguggauccgcgaaaaucccuggauggaagacaaaacucccguggagucaugggaggagaucccauacuugggcaagcgggaagaucaguggugcgggucccugauagggcugaccucucgcgccaccugggcgaagaacauccaagccgccauuaaccaggugcgaucgcucauagggaacgaggaguacaccgauuacaugccgagcaugaagcgcuuucggagagaggaggaagaggcgggugugcugugguga

SEQ ID NO: 25153 - RNA, 9876 nt, Artificial Sequence
  derived and/or modified CDS sequence (opt11) from DENV-2__GQ868591__SS-prME
agugcaggcaugaucauuaugcuaauccccacgguuauggcauuccaccugaccacccguaacggggaaccccacaugauaguaagccgucaagaaaaaggcaaaagccuucucuucaaaacggaagacggcgucaauaugugcacccuaauggccauggaucuaggcgaacugugcgaagacacaaucacguacaaaugcccacuacuacgccaaaacgaaccugaagacaucgacugcuggugcaacucuacuagcacguggguaacauauggcacgugcaccacgaugggagaacaccggcgagagaaaagaagugucgcacucgucccacacguaggcaugggccuagaaacgaggacagaaacguggaugagcagugaaggggcguggaaacacguccaaagaaucgagacguggauauuaagacaccccggauuuacaaugauggcagcaauauuagccuauacaauagguacaacgcacuuccagcgggcccugaucuucauccuucuuaccgcggucacgcccagcaugacaaugcguuguauaggaauguccaaccgcgauuucguagagggagugucuggcggcuccuggguagauaucguucucgagcaugggucaugcgucaccacgauggccaaaaacaaaccgacccucgacuucgaacugaucaaaaccgaggcaaaacaaccggccacgcuuaggaaauacugcaucgaagcaaaacuuacaaacaccaccacagagucgaggugcccaacacaaggcgaaccaagccuaaacgaagaacaagacaaaagauucguauguaagcauaguaugguagaccgcggauggggcaacggcugcggauuguucggcaaaggagggauugucaccugugccauguuccgauguaaaaagaauauggaagguaaagucguccaaccggaaaaccuggaauacaccaucguuaucacgccacauuccggggaagaacaugccguaggaaacgacacugguaagcacgggaaggaaauaaaaaucacaccccaaucgaguaucaccgaggcggaacuuaccggguauggcaccguaacgauggagugcagcccccgaacgggccuggacuucaacgagaugguauugcuacaaauggaaaauaaggcauggcuagugcaccgacaaugguuccucgaccuaccccuaccauggcugccuggagcagacacccaaggcagcaacuggauacaaaaagagacacucgucaccuuuaagaacccgcacgcgaagaaacaggacguuguaguauuagguucccaagagggagcaaugcacaccgcacugacuggcgcgacagagauacagaugaguaguggcaaccugcuguuuaccggucaccucaaaugccgccuccgaauggacaaacuacaacucaaaggcaugucguacagcaugugcacagguaaguucaagguagugaaggaaaucgcugaaacucaacacggaaccauaguuauccggguacaauacgaaggagacggcagcccguguaagauucccuucgagaucauggaccuagaaaagcgucacgugcugggcagauuaauaaccgucaauccgaucguaacugaaaaggauagcccggugaacauagaggcggaacccccauucggagacagcuacaucaucauaggcguugagcccggccagcuaaaacucaauugguucaaaaagggaucgucaauaggacagauguuugaaacaacgaugcguggcgccaaacgaauggcaauccucggcgacacagcuugggacuuuggcagccuggguggaguguucacaagcaucggcaaagcacugcaucagguguuuggcgcgaucuacggagccgcuuuuucgggcgucucguggacaaugaagauauuaauaggcguuauaaucacguggauaggaaugaacucgcggaguaccaguuuaagcgucacacuuguacuggugggaaucgugacacuguacuugggagugaugguccaggccgacuccggaugcgucguguccuggaaaaacaaggaauuaaaaugcggcuccgguaucuucauaacggacaacguccacacauggacagaacaguacaaauuccaaccagaaagccccagcaaacucgcaucagcaauccaaaaagcccacgaagaaggcaucugcgggaucagauccgugacucggcuagagaaccugauguggaagcagauuacgccggaauugaaucacauacuaagugaaaacgaagucaaacucaccauaaugacaggcgauaucaaaggcaucaugcaagccggaaagcgaagccuacggccacagcccacggagcucaaauacagcuggaaaacauggggaaaagccaagaugcugagcacagagucucacaaccaaacguuuuuaauagacggaccggagacugcagagugcccuaauaccaaucgggccuggaacagccucgaggucgaggauuacggauucggaguauucacaacaaacaucuggcuaaagcuaaaagaaaagcaggacgucuuuugcgacagcaaacuaaugagcgcagccaucaaggacaacagggcgguccacgcggacaugggcuacuggaucgaaucagcauuaaacgacaccuggaagauagagaaggcaucauucauagaggugaaaaacugccacuggcccaaaagccacacgcuaugguccaauggugugcucgaaucagaaaugaucauccccaaaaaccuggcagguccagugagccagcacaacuaccgaccgggcuaccacacccaaauaaccgggcccuggcaccugggaaagcuagagauggacuucgacuucugcgacggaacgacgguggucgugacagaagauugcggaaaccgagggcccagcuugcggacgaccacugcuucaggcaaguuaauuacggaaugguguugccgcagcugcacuuuacccccauugagauauagaggcgaggauggcugcugguacggcauggaaauaagacccuuaaaagagaaagaggagaaccuaguaaacucacucguuaccgccggacacggacaaguggacaauuucagucucggaguccucgggauggcacucuuucuggaggagauguugcggaccagaguaggaaccaagcacgcaauacuccucguagccgucagcuuuguaacccucaucacgggcaauaugagcuuccgcgaucuagggcgugucauggugauggugggagcaacgaugaccgacgauauaggcaugggaguaacguaccucgcgcuccuggccgcauuuaagguacgaccaacuuuugccgcgggucuucuacucagaaaacucacuucaaaggaacugaugaugacaacaaucggaaucguacuacuuucacaguccacgauucccgaaaccauucuagaacuaacagacgcucuugcacucggaaugaugguguugaaaaugguacggaacauggagaaguaccaacuagcaguaacgauaauggccauacuauguguuccaaacgccgucauccuacaaaaugcguggaaagugagcuguacaaucuuagccgugguaagugugagcccacuauuacucaccagcagccaacagaaaaccgauuggaucccccuugcguuaacgauaaaggggcuaaaccccacggccaucuuccuaaccacccucucccggacgaguaagaaacguagcuggccccuaaacgaagccaucauggcaguggggaugguuucaauauuagccuccagucuccucaaaaacgauaucccaaugacggggccuuuaguugcuggcggccuccuuacaguauguuaugugcuaaccgggcggucggcggaucuagaguuggagcgagcagcugauguuaaaugggaagaccaagccgaaauaucuggcucaagcccuauccuuucaaucaccauauccgaagauggcuccaugucgaucaaaaacgaagaggaggaacaaacccugacuauucucauccggacagggcuacuugucaucuccgggcuguucccagugucaaucccaaucacggcugccgccugguauuuaugggaagucaagaaacagcgcgccggagugcugugggacguuccuucaccgccgccgaugggaaaagcagaacucgaagauggggcuuacaggaucaagcaaaaagguauacucggauacucccaaauuggagcgggggucuauaaggaaggcacauuccacacaauguggcacguaacacgcggcgcgguguuaaugcacaaggggaagcggauagagcccucaugggcugacguuaaaaaggaccuaauuaguuacgggggcggcuggaaacuugagggugaauggaaggaaggcgaagaaguucaaguucuugcacuggaacccggcaaaaacccgcgagcaguacaaaccaagccaggacuguucaaaacaaacgcagguacaaucggcgccguauccuuagacuucucaccugggaccagcggaucacccaucaucgacaagaaaggaaaagugguaggacucuacggaaauggcgucguuacgaggagcggagcauacgugagcgcgauagcacaaaccgaaaaauccaucgaggacaauccggaaauagaagacgauaucuucagaaaacgacggcuaacgauaauggacuuacauccgggggccggaaaaacaaagagauacuuaccagcgaucgugcgcgaagccauaaagaggggguuacgaacacuaauccuugcgccaacacgcguuguagccgccgaaauggaagaggcacuaaggggccuaccaauaagguaccagacgccugccauacgggccgaacacacaggcagagaaaucguggaccucaugugucacgcaacuuucaccaugcggcuucuaagucccguuagaguaccaaacuauaaccucauaauaauggacgaggcgcauuucacggauccugcgaguaucgccgcgagaggguauauaucaacacgaguugaaaugggcgaagcagccggcauauucaugaccgccacaccaccagguucccgggacccauuuccucagagcaacgcaccgauaauagaugaggaacgcgaaauaccggaacgguccuggaacucugggcacgaaugggugacugacuuuaaggguaaaaccguaugguucguuccgaguaucaaagcgggcaacgacauagcggcaugucuacguaagaacggaaagaaagucauacaacuaagucgaaagacauucgauagcgaguacgucaagacccgaacgaacgacugggacuuuguuguaaccacggacauaagcgagaugggagcuaacuucaaagcggaacgaguuaucgacccccgaaggugcaugaaaccugucaucuuaacagauggggaggaacgugucauccuggccggaccuaugccagugacccauagcagcgcagcacagcgcaggggcagaaucggccgcaauccgaagaaugaaaaugaucaguacaucuacaugggagagccacucgaaaacgacgaggacugcgcgcacuggaaagaagcaaagaugcugcuagacaauauaaacacgccagaagggauaauaccguccauguuugaaccagagcgagaaaaggucgaugcaaucgacggcgaguacaggcuccgcggugaggcacguaagacguucgucgaccuuaugcggcgcggagauuugcccguauggcuagcguaccgcguagccgcugaaggaaucaacuacgcggaccgccgauggugcuucgacggagucaaaaauaaucaaauccuagaagaaaaugucgaagucgagaucuggacuaaggaaggagagcggaagaaacucaagccgagaugguuagacgcccgcaucuacucagacccgcuagcauuaaaggaguucaaagaguucgcugcaggacgaaaaucgcucacauugaaccugaucacggaaauggggagacucccgacguucaugacacaaaaagcccgggaugcgcuggacaaucuggccguccuacacacagcagaagcgggcggacgagccuauaaucacgcacucuccgaacugccggagacauuagaaacccuacuguuguuaacccuacuagcuacaguuacagggggcaucuuuuuguuuuuaaugagcgggagaggaaucggaaagaugacacuagguaugugcugcaucaucacggcuuccauccuacuaugguacgcgcaaauccaaccacacuggauugcagcaagcauaauucucgaguucuucuugaucguccugcuaaucccagaacccgaaaagcagcgcacgccccaagacaaucaacucacauacguuguaaucgcaauucucaccguaguggccgccacaauggcuaacgaaaugggguuccuagagaaaacuaagaaggacuugggcuuaggcagcaucgcaacucaacaacccgagucuaacauccuugacaucgaccuacggccagccagcgccuggacccuguaugccguagcgacuacauucgucacaccgaugcugcggcacagcaucgaaaauagcucgguaaaugucucguugaccgcaaucgcgaaucaagccacuguauuaaugggccuggggaaaggauggccacucucaaagauggauaucggcgucccccuucuggcaauaggauguuacagccaggucaauccaauaacgcuaacagcggcccuuuucuugcucgucgcccacuacgcaauuauagggccuggacuacaagccaaagcuacgcgggaagcgcaaaaacgagcagcugccggaaucaugaagaacccgacaguagacgggauaacuguaaucgaccucgacccgauaccuuaugaccccaaguucgaaaaacaacucggccagguuaugcugcugguacuaugcgucacccaggugcuaaugaugaggacaacgugggcccucugcgaggcccuuacacucgccacagggccaaucaguacccuaugggaaggaaacccuggaagguucuggaauaccaccaucgcggucucaauggccaacauauuccgugggucauaucuagccggugcaggccuccuuuucaguauaaugaaaaacacaacgaacacacgccggggaaccggaaacaucggagaaacucuuggugaaaaguggaaaucccgauuaaacgcacuaggaaaaagcgaguuccaaauauacaagaaauccgguauacaggaaguagaccgaacacuggccaaggaaggaauaaaacguggcgagaccgaucaccacgcgguauccaggggguccgcaaaacucagaugguucgucgagcggaacauggucacccccgaagggaaaguugucgaccuuggaugcggucggggugguuggucguacuacuguggcggccuuaaaaacguacgcgaagugaaaggucuaaccaaaggaggcccgggacaugaagaaccaauccccaugaguaccuacggcuggaaccucgugcgccuccagucggggguggacgucuucuuuauacccccagaaaagugcgacacguugcucugugauaucggagaaucgagccccaaccccacaguagaagcaggucgcacgcuccgugugcucaaccuaguagagaacuggcucaacaauaacacacaguuuugcaucaagguccucaacccuuauaugccaucaguaaucgagaaaauggaggcacugcaacgaaaguacgggggagcccucgugcgaaacccccuuucacgcaacagcacccaugaaauguacuggguuucaaaugccuccggaaacaucgugucaucugucaacaugauaucacgcaugcugauaaaccguuucacaaugcguuauaagaaggccaccuaugaaccggacguagaccuuggaagcggaacccggaauauagguaucgagagugagaucccaaacuuggauaucauagguaagcgaaucgagaagaucaaacaggaacacgaaaccucguggcacuacgaccaagaccaccccuacaagacgugggccuaccacggcucguaugagacaaaacagacgggaagcgccagcagcaugguaaauggggugguccgacuauuaaccaaacccugggacguagugccaaugguuacacagauggcgaugacagacacaacaccguucggacaacagagaguguucaaagagaaagucgacacgagaacacaagagccuaaagaaggaacuaagaaacucaugaagauaaccgcagaguggcuguggaaggaacuagggaaaaagaagacgccaagaauguguacaagagaagaguucacgcggaagguucgaagcaacgccgccuugggagccauauucgccgaugaaaacaaauggaaguccgcgcgugaggcggucgaagauuccagauucugggaguuaguagauaaggagcgaaaccuacaucuagagggcaaaugcgaaacuugcguuuacaacaugauggggaagcgcgagaagaaacuaggggaauuugggaaagccaaaggcagccgagcaaucugguacauguggcuuggggcgagauuccuagaguucgaagcacucggauuucuaaaugaagaucauugguucucgagagagaacucacucucagggguggaaggcgagggauuacacaaauuaggauauauccuccgcgacgucagcaagaaagagggcggcgccauguaugccgaugacacagcaggaugggauacacgaauaaccuuagaagaccucaaaaaugaggaaaugguuacgaaccauauggaaggagagcacaagaaacucgcggaagcgauauuuaaauugaccuaccagaacaaagucguccggguccaaagaccgacaccacggggaacuguaauggacauaaucagccgccgcgaucagcgugguucgggccaagucggcaccuacggacuaaauacauuuacuaacauggaagcccaacucauacgacaaauggagggcgaaggcguauucaagucaauacaacauuuaacaaucacggaagagaucgcaguccaaaacuggcucgcccgcgucgguagggaacgacuaagccgcauggcaauuuccggagaugacuguguaguaaagccgcuagaugaccgguucgccagcgcacugacggcauuaaaugauaugggcaaaauacgaaaggacauacaacaaugggaaccaucuagaggauggaacgacuggacacaaguaccauucugcagccaccacuuccacgaacucaucaugaaggacggaaggguacucguugugcccugucggaaccaagacgaacucauuggccgagcacggauaagucagggugcgggcuggagucugcgugaaaccgcgugccuaggcaagagcuacgcacaaauguggagccucauguacuuucacaggcgggaccuacgacuggccgcgaacgcaauaugcagcgccgucccaucgcacugggucccaacgagccgcacaacguggucaauccacgcuaaacacgaauggaugacaacagaggauaugcucacaguauggaaccgaguuuggauccaagaaaaccccuggauggaggacaaaacacccguagaaucuugggaggagaucccuuaccuaggcaagagagaagaucaguggugcgggucacugaucggccugacgaguagagcaacuugggccaagaacauacaggccgcgaucaaccagguacgaagucugauagguaacgaagaauacacggacuacaugccaucgaugaagcgguucagaagagaagaagaggaggcgggaguccucugguga

SEQ ID NO: 25154 - RNA, 9876 nt, Artificial Sequence
  derived and/or modified CDS sequence (opt11) from DENV-2__GQ868542__SS-prME
agcgcgggcaugaucaucaugcugauccccaccgugauggcguuccaccucaccaccagaaacggggagccccauaugauugucagcauccaggagaagggcaagagccugcuguucaagacagaggacggggugaacaugugcacccucauggcaauggaccugggcgagcugugugaggacacgaucaccuacaagugcccacucuugcggcagaacgagcccgaagacaucgacugcuggugcaacucaaccagcaccuggguuaccuaugguacgugcacaaccaccggggagcaccgccgagagaagcgcuccgucgcgcuggugccccacgugggcauggggcucgagacgcgcacugagaccuggaugagcagcgagggcgcguggaagcacgcccagcgcaucgaaaccuggauacugcggcacccuggguucacuaucauggcugcgauccuggccuacaccaucggcaccacucacuuucagcgcgcccucaucuucauccucuuaacggccgucgcgcccagcaugaccaugcguugcaucgguaucucuaaccgcgacuucguggagggcgugucaggcggguccugggucgacaucgugcucgaacacgguucaugcgucaccaccauggcuaaaaauaaacccacgcuagacuucgagcugaucaagaccgaggccaaacagcccgccacacuacggaaguauugcaucgaggccaagcucaccaauacaaccaccgagucccgcugcccaacgcagggggagcccagccugaaagaggagcaggacaagcgguucgucugcaagcacuccauggucgaucgcggcugggguaacgggugcggcuuauucggaaaaggcgggaucguaacgugcgcgauguucacgugcaagaaaaacauggagggcaagaucguccagcccgagaaccuagaguacaccaucguggugacgccccacagcggcgaggagcacgccgucgggaaugacacggggaagcacgggaaggagaucaaggugaccccgcaauccagcaucacugaggccgaacugaccggcuacgggaccgugacgauggagugcagcccccggaccggcuuagacuucaacgagaugguccugcugcagauggagaacaaggccuggcucguucaccgacagugguuccuagaccugccucuccccuggcugccgggcgccgacacccaggggagcaacuggauccaaaaggagacccugguaacguucaagaacccccaugcgaagaagcaagacguuguggucuuggggagccaggagggggccaugcacacagcccugaccggcgccacugagauccagauguccucugggaaccuccuauucacgggacaccugaagugccggcugcgaauggacaagcuccagcugaagggaauguccuauagcaugugcaccgggaaguucaagguggugaaggagaucgccgagacccaacacggcaccaucgucauccgggugcaguacgagggggacggcucgcccugcaagauccccuucgagaucauggaccuggagaagcgguacguucugggccggcugauaacggucaacccgaucgugaccgagaaggacagcccggugaacaucgaggcggagccgcccuucggagauuccuacaucaucaucggcgucgagccugggcagcugaagcucaacugguucaagaagggcagcuccaucgggcaaauguucgagacuacgaugcgcggcgccaagaggauggcaauccugggcgacacagccugggacuucgggagccugggcgggguguucaccaguaucggcaaggcccuccaccagguguucggggcgaucuacggcgccgccuucagcggagucucguggacaaugaagauacugaucggcgugaucaucaccuggaucggcaugaacagcagauccacgagccucuccgugagccugguccucguaggaaucgugacccuguaccugggcgucaugguccaggccgacuccgggugcguggucagcuggaagaacaaggaguuaaagugcggcagcggcaucuucaucaccgacaacgugcacacauggacggagcaguauaaguuccagcccgagucgcccagcaaacuggcgucagcaauccagaaagcccaggaggaggggaucugcgggauacgcagcgugacccggcuagaaaaccucauguggaagcagaucacccccgagcugaaccauauccuggccgagaacgaggucaagcucacuaucaugacgggggacaucaagggcauaaugcaggcugggaagcgcucccugcggccgcagcccaccgagcugaaguacagcuggaagaccuggggcaaagcgaagaugcucuccaccgagucccacaaccagacguuccugaucgauggacccgagacggccgagugccccaacaccaaccgcgccuggaacucccuggaaguggaggacuacggguucggcguguucacgacgaacauauggcuuaagcugaaggagaagcaggacgccuucugcgacagcaagcugauguccgcugcgaucaaggacaaccgggccguccacgccgacaugggguacuggaucgagagcgcauugaacgacaccuggaagaucgagaaggccuccuucaucgaggugaagaauugccacuggcccaagagccacacccuaugguccaacggcgugcuggagagcgagaugaucauccccaaaaaccuggcgggccccgucucccagcacaacuaccguccgggauaccacacccagaucgccggccccuggcaccuggggaagcuugagauggacuucgacuucugcgacggcaccacgguggugguaaccgaggacugcgggaaccgggguccgagccugcgcaccaccacggcuagcggcaaacuaauaacagaguggugcugccgguccugcacccugcccccgcuccgcuaccgcggugaagacggcugcugguacgggauggagauccgccccuugaaggagaaggaggaaaaccuggugaacagccucgugaccgccggccacggucaggucgacaacuucucacugggcgugcugggcauggccuuguuccuggaagagaugcugcggacgcgcguggggaccaagcacgccauccuccuggucgccgugagcuucgugacccugaucaccggcaacauguccuucaaggaccucgggaggguaguggugauggucggcgcgacgaugaccgaugacaucggaaugggcgugaccuaccuggcccuacucgcggccuucaaggugcgccccacguucgcugccggccuucugcuccggaagcugacguccaaagagcugaugaugaccaccaucgggaucguccuguuaucacagagcaccaucccugagacgauacuggagcucaccgacgcccuggcccugggaaugauggugcucaagaucguacgcaacauggagaaguaccagcuggccgucacuauaauggccauccugugcgugccuaacgcugucauccuccagaacgccuggaaggucaguugcaccauccuggcaguggucagcgugagcccucuccuccugacgagcucccagcagaagaccgacuggaucccccuugcccucaccauuaagggucugaaccccacagccaucuuccugacgacuuugagccgaaccaauaagaagcgguccuggccgcugaacgaggccaucauggcggugggcauggucucgauccuggccuccagccuccugaagaacgacauccccaugaccgggccccugguggccgggggccuccugacggugugcuacguccucaccgggcgcuccgccgaccucgagcuggagcgggccacagacgugaagugggaagaucaggcggagaucucggggagcucccccauccugaguaucacgaucuccgaggacggcucaauguccaucaagaacgaggaggaggagcagacgcucaccauccuaauccgcacaggcuugcucgugaucucuggccuguuuccggucuccauccccauuaccgccgcagccugguauuuaugggaggugaagaagcagcgggccggggugcucugggacguccccuccccgccgcccaugggcaaggcggagcuggaggacggggccuaccgcaucaagcagaagggcauccugggguacagccagauuggcgccggaguguauaaggaggggaccuuccacacgauguggcacgugacccggggcgccguccucaugcacaagggcaagcgcaucgagccaagcugggcugacgugaagaaggaccugaucuccuacggcgggggcuggaagcuggagggcgaguggaaggagggggaggaggugcagguacucgcgcuggagccaggcaagaacccccgggccgugcagaccaagcccggacuuuuuaagaccaacacgggaaccaucggugccgugagccucgacuucucucccggcacuagcggcucccccaucaucgacaagaaagggaaggucgugggccuguacgggaacggcguggucacccgcagcggcgccuacguauccgccaucgcgcaaacggagaaguccaucgaggacaaccccgagaucgaggaugauaucuuccggaagcgccgccugaccaucauggaccugcaccccggggccggcaagaccaaacgguaccuccccgccaucguucgagaggccaucaagcgcgggcuccggacacugauccucgcgccaacgcgcgucguggccgcggagauggaggaggcccugcgggggcugcccauccgcuaucagacccccgccauccgggcagagcacacggggcgcgagaucguggaccucaugugucacgccaccuucacgaugcgcuugcugucccccguccgggugccgaacuacaaccuaaucaucauggacgaggcucacuuuaccgacccugccagcauugccgcgcgcggcuacauuagcacccggguggagaugggcgaggcugccgguauauuuaugaccgccaccccgcccggcucccgcgacccguucccccagagcaacgcccccaucaucgacgaggagagagagauccccgagcgcuccuggaauagcgggcacgagugggucacugacuucaagggcaagaccgugugguucgugccguccaucaaggcgggaaacgacaucgcugccugucuacggaaaaacggcaagaaggucauucagcugagccgcaaaaccuucgacuccgaguacgugaagacgcggaccaacgacugggacuucgucgucaccaccgacaucagcgaaaugggcgccaacuucaaggcggagcgcgugaucgacccccggcggugcaugaagcccgugaucuugacggacggggaggagcgugugauccuggccgggcccaugccggugacccacuccagcgccgcccagcgacgggggcgcaucggccggaaccccaaaaacgaaaacgaucaguacaucuacaugggggaacccuuagagaacgacgaagauugcgcccacuggaaagaggcuaagauguugcuggacaacaucaauacccccgagggcaucaucccguccauguucgagcccgagcgcgagaagguggacgccaucgauggcgaguaccgguuacgcggggaggcccgcaaaaccuucgucgaccucaugcggcgcggcgaccugcccguguggcuggcauacaagguggccgcggaggggaucaacuacgccgaccggcgcuggugcuucgauggcaucaaaaacaaccagauacuggaagagaacgucgagguggaaauauggacgaaggagggggagcggaagaagcugaagccgcgcuggcuggaugcccggaucuacagcgauccccucgcccugaaggaauucaaagaguucgccgcgggccgcaagucccugacccucaaccugaucaccgagaugggccggcugcccaccuucaugacgcagaagacccgugacgcccucgacaaucuggccguccuucacaccgcugaggccggggggcgggccuacaaucacgcccucagugagcugcccgagacccuggaaacgcuccugcugcucacucugcuugccaccgugaccggcgggaucuuccucuuccugaugagugggcgcgggaucggcaagaugacccuggggaugugcugcaucaucacggccagcauccuccugugguacgcacagauccagccgcacuggaucgccgccuccaucaucuuggaguucuuccucaucgugcugcugauccccgagcccgaaaagcaacggacgccccaggacaaucagcucaccuaugucgugaucgccauacugacuguggucgccgcgacgauggccaacgagaugggcuuccuggagaagaccaagaaggaucucgggcugggcggcaucgccacccagcagccggagagcaacauacuggauaucgaccuccggcccgccuccgccuggacucuguacgcgguggcgacgaccuucguuacccccaugcugcggcacagcaucgagaauaguuccgucaacgugagcuugaccgccaucgccaaccaggccacggugcugaugggguuaggcaagggguggccccuguccaagauggacaucggggucccgcugcuggcgaucgggugcuauagccaagugaaccccaucacuuugacggccgcccugcugcuccugguggcccacuaugcgaucaucggcccgggccugcaagcuaaggccacccgcgaggcgcagaagcgugcugcggccgggaucaugaagaaucccacggucgacggcaucaccgugaucgaccucgacccgauccccuacgaccccaaguucgagaagcaacugggucaggugaugcugcucgugcugugcgugacacaggugcugaugaugcgcacuacgugggcccuaugcgaggcucuuacccuggccaccgggcccaucuccacucucugggagggcaaccccggccgcuucuggaauacgaccaucgcggucagcauggccaacaucuuccggggcagcuaccucgccggggccggccuccucuucagcaucaugaagaacaccaccaacacgcggcgcgguaccggcaauaucggcgagacccugggggagaaguggaagucgcgccugaacgcccucgguaagagcgaguuccaaaucuacaaaaaguccgggauacaagagguagaccggacccuggcgaaggagggaaucaagcgcggggagacggaccaucacgccgugucccggggcagcgcaaagcugcgcugguucgucgagcgaaacauggugacaccggagggcaagguggucgaccucggcugcggccgcgggggcuggucuuauuacugcgggggccugaagaacgugcgggagguaaagggccuaaccaagggcgggcccgggcacgaggaacccaucccgauguccaccuacggcuggaaccucguacgcuugcagagcgggguggacguguucuucaucccgcccgagaagugcgacacgcugcucugcgacauaggcgaguccagccccaacccgaccgucgaggccgggcggacccuccgcgugcugaaccucguggagaacuggcugaacaacaacacccaguucugcaucaagguccucaaccccuacaugccuuccgugaucgagaagauggaggcgcuacagcggaaguacgggggcgcccucguaagaaacccccugagccggaacagcacccacgagauguacugggucucaaacgccucagggaacaucgugaguagcgugaacaugaucucucgcaugcugaucaaccgguucaccaugcgccacaagaaggccaccuacgaacccgacguagaccucggcagcgggacccggaacauuggcaucgaguccgaagugcccaaccuggacaucaucggcaagcggauugagaaaaucaagcaggagcacgagaccagcuggcacuacgaccaggaucaccccuacaagacgugggccuaccacggauccuacgagaccaagcagaccggcagugcguccagcauggugaacggggucgugagacugcucacuaagccgugggauguccugcccacggucacccagauggccaugaccgauacaacgcccuuuggucagcagcgcguguucaaggagaagguggacacccgcacccaggagcccaaggaggggacaaagaaacuaaugaagaucacggccgaauggcucuggaaggagcuggggaagaagaagaccccgcggaugugcacccgcgaggaguucacccggaagguacgcucaaacgccgcccugggcgcgauuuucacggacgaaaacaaguggaaguccgcccgggaggcaguggaggacucccgcuuuugggagcuuguagacaaggagcggaaccugcaccuagaggggaagugcgagaccugcguguacaacaugaugggcaagcgcgaaaaaaagcucggggaguucggcaaggcuaagggcagccgagccauuugguauauguggcugggggcgcgcuuccuugaguuugaggcccucggcuuccugaacgaggaccacugguucucccgggagaacagccuguccgggguggagggcgaggggcuccacaagcugggcuacauccugcgcgacguaagcaaaaaagagggcgggaccauguacgcagacgacaccgccggaugggacacgcggaucacccucgaagaccugaagaacgaggagauggugacgaaccacauggagggggaacacaagaaacuggcggaagccauauuuaagcucaccuaccagaacaaagugguccgggugcagcggcccacuccgcgcggcaccguuauggacaucaucucucgacgcgaucaacggggcuccggccagguugguaccuacgggcuuaacaccuucacgaacauggaggcccaguuaauccgccagauggaaggcgagggggucuucaagaacauccaacaccucaccgugaccgaggagaucgccguucagaauuggcuggcccgggugggccgcgagcgccugagccggauggcgaucuccggcgacgacugcguugucaagccccucgacgaccgcuucgccagcgcccuuaccgcccugaacgacauggggaagauccggaaggacauccagcagugggaaccgucccgcggcuggaacgacuggacucaggugcccuucugcagccaccacuuccacgagcucaucaugaaggacgggcgggugcucgucgugcccugucgcaaucaggacgagcugauuggccgcgcacgcauuucccagggggcgggcuggagcuuacgggagaccgccugucugggcaagucauaugcccaaauguggagccugauguacuuccaucgccgggaccugcgacuggccgccaacgcgaucuguagcgccgugcccagccacugggucccgacgucccggaccaccuggagcauccacgccaagcacgaguggaugacgaccgaggacaugcugaccguguggaacaggguguggauccaggagaacccguggauggaggacaagacgccuguagacuccugggaggagauccccuaccucgggaagcgugaggaccaguggugcggaucucugaucgggcugacgucccgcgcgaccugggcgaagaacauccaggcggccaucaaccagguacggagccucaucggcaacgaagaguauaccgacuacaugccuuccaugaagagguuccggcgcgaggaggaggaggccggcgugcugugguag

SEQ ID NO: 25155 - RNA, 9876 nt, Artificial Sequence
  derived and/or modified CDS sequence (opt11) from DENV-2__GQ868544__SS-prME
uccgugggcaugauuaucaugcugauccccaccguaauggccuuccaccucacaacacggaacggggagccucacaugaucgugucgauccaggagaaaggcaagucgcugcuguuuaagaccgaggacggggugaacaugugcaccuuaauggccauggaccucggcgagcugugcgaggacaccaucaccuacaagugcccccuccugcgacagaacgagcccgaggauauugacugcuggugcaacagcaccaguacgugggucaccuacgggacgugcacuaccacgggcgagcaccgccgggagaagagguccguagcgcuugugccccacgucggcauggggcucgagacucguaccgagaccuggaugagcuccgagggugccuggaagcacgcccagcggauugagaccuggauccugcggcacccgggguucacgaucauggcggcuaucuuggcguauacaauaggcaccacccacuuucaaagagcccucaucuucauccugcugacggccguggcccccagcaugaccaugcggugcauugggauuuccaaccgugauuucguggaaggggucagcggcggguccuggguggacauuguguuagaacacggcagcugcguuaccaccauggcuaagaacaagcccacgcuggauuucgaguuaaucaagaccgaggcaaagcagccugccacccuccguaaguacugcaucgaggccaagcugaccaacacgaccaccgagucccgcugccccacccaaggggagcccucgcugaaggaggagcaggacaaacgguucguuugcaagcacucaaugguggaccgaggauggggcaaugggugcggccucuucgggaaaggcgggaucguaacgugcgccauguucacgugcaagaagaacauggagggcaagaucguucagcccgagaaccuggaguacaccaucguagucacgccgcauagcggcgaggagcacgcgguggggaacgacaccggcaagcacggcaaggaaaucaaggugaccccgcagucuuccaucaccgaggcggagcugacaggcuacgggaccguaacgauggagugcagccccaggaccgggcucgacuucaacgagauggugcuucugcagauggagaauaaggccuggcucgugcacagacaaugguuccuggaccugccccuccccuggcugccgggcgccgacacccaggggagcaacuggauccagaaggagacccugguaaccuucaagaauccccacgccaagaagcaagacguggucgugcucggcagccaggagggggcgaugcauaccgcacugaccggcgccaccgagauccagaugucaagcgggaaccuccuguucacgggccaccugaagugccggcugcgaauggacaaacuucagcugaaaggcauguccuacagcaugugcacggggaaguucaaaguggucaaggagaucgccgagacccaacauggcaccaucgugauccgggugcaguacgagggggacggcagucccugcaaagucccuuucgagaucauggaccuggagaagcgcuacgugcucggucggcucaucacugugaacccgaucguuaccgagaaggacagccccgugaacaucgaggcggagccgccuuucggugacuccuacaucaucaucggcguggagccgggccagcugaagcucaacugguucaagaagggcagcucgaucgggcagauguucgagacaacuaugcggggcgcgaagcgcauggccauacuuggugauacagccugggacuuugggagccugggcggagucuucaccucuaucggcaaagcccuccaccagguauuuggggccaucuacggcgcagccuucucuggcguguccuggaccaugaagaucuugaucggggucaucaucaccuggauuggcaugaacucccggucaacaucucuaaguguaucgcuggugcucgucgggaucgugacccuguaccugggggugaugguccaagccgacuccgggugcguggugagcuggaagaauaaggaauuaaagugcggcagcggcauuuucaucaccgauaacguccacaccuggaccgaacaguacaaguuccagcccgagucuccgagcaagcuggccucagcgauccagaaggcacaggaggaggguaucuguggcauccgcagugucacccgacuggagaaccucauguggaaacagaucacucccgagcugaaccacauccuggccgaaaacgaggugaagcucaccaucaugaccggggacaucaagggcaucaugcaggccgggaagcgcucccugagaccgcagcccaccgagcugaaauauucuuggaagaccuggggcaaggccaaaaugcucuccaccgagagccacaaccaaaccuuccuuauugacggacccgaaaccgcggagugccccaacaccaaucgcgccuggaacucccuggaagucgaggacuacggguucggcguguucaccacgaacaucuggcucaagcugaaggagaagcaggacgccuucugcgacagcaagcucauguccgccgccaucaaggacaaccgugcuguccacgccgacaugggguacuggaucgagagcgcccucaacgacaccuggaagaucgagaaggccuccuuuaucgaggugaaaaacugccacuggcccaagagccauacccucuggucaaacggagugcuggaguccgagaugaucauuccaaagaaccucgccggucccgugucccagcacaauuaccgcccgggguaccacacccagaucgccggccccuggcacuuggggaagcuagagauggacuucgacuucugcgacggcaccacagucguugugacugaggacugcgggaaccggggccccagccuccgcaccaccacggccagcggcaaguugauaacagaguggugcugccgguccugcaccuugcccccgcuccgcuaccgcggggaggacggaugcugguacgggauggagaucaggccccugaaggagaaggaggaaaaccuggucaacagucucgugaccgccgggcagggccagaucgacaacuuuucucuaggcguccugggcauggcccucuuccucgaagagaugcugcgcacgcgagucgggaccaagcacgcaauacuccugguggccgucagcuucguaacccugauuaccggaaacauguccuucaaggaccucgggcgugugguugucauggugggcgcuaccaugaccgacgacaucgguaugggcguaaccuaccuggcccugcuagccgcauucaagguccgccccaccuucgcggccggcuugcugcuacggaagcugacgagcaaggagcugaugaugacaacgauagggaucgugcuucugucccagaguaccauccccgagacgauacuggagcucaccgacgcacuggcucuaggcaugauggugcucaaaaucguccgcgacauggagaaguaccagcuggccgucaccaucauggccauccugugcgucccaaacgccgugauccuacagaaugccuggaaggucucuugcaccauccuagccgucgugagugugagcccccugcuccugacguccucccagcagaagacugauuggauaccacuggcgcucaccaucaagggacugaaccccaccgccaucuuccugacgacccuuagccgcaccaacaagaaacgguccuggccgcucaacgaggccaucauggcugucggcauggugagcauacuugcgucaagccuccugaagaacgacauccccaugaccggcccccugguggccggaggcuuguugacgguaugcuacgugcuuaccgggcgcuccgccgaccucgagcuggagcgggccaccgacguuaaaugggaggaccaggccgaaauuagcggcagcucccccauccugagcaucaccaucucugaagaugggagcauguccaucaaaaacgaagaggaggaacaaacccucaccauacugaucagaaccggccugcucgucaucagcggacuguucccgguguccaucccaaucaccgcggccgccugguaccugugggaggucaagaaacagcgggccgggguucucugggaugugcccagcccgccacccaugggcaaggccgagcuggaggacggggcguaccgcauuaaacagaaggguauucuggguuauucccagaucggagcaggcguguacaaggaggggacauuccauacgauguggcacgucacccggggagccgugcucaugcacaaggggaagcgaaucgagcccagcugggcagacguaaagaaggaccuaauauccuacggcgggggcuggaaacuugagggcgaguggaaggagggggaggagguccaaguguuagcccuggagcccggcaagaauccccgggccgugcagacgaagcccgggcuguucaaaaccaacacaggcacgaucggggcugucagccucgacuucucccccggcaccagcgguucccccaucaucgacaagaaggggaagguggugggccucuacgggaacggcgucgugacccgcagcggcgcauauguguccgccaucgcccagacggagaaauccaucgaggacaacccggacaucgaggaugacaucuuccggaaacgccggcugacgaucauggaccugcaccccggggcgggcaaaaccaagcguuaccugcccgccaucguccgggaggcuauaaagcgcgggcuacggacccugauccucgcucccacgcgcgucguggcggccgagauggaggaggcccugagaggccuccccauccgguaccagacccccgccauccgcgcggagcacacggggcgcgagaucguagaccucaugugccacgcgaccuucacgaugcguuugcuguccccugugcggguaccgaacuacaaccuaauuauaauggacgaggcccacuucaccgaccccgccucuauugcagcccgcggcuacaucagcaccagggucgagaugggcgaggcggccgggaucuucaugaccgccacgccacccggcagccgugacccguucccgcagagcaacgcccccaucaucgacgaagaacgggagauccccgagcgcuccuggaacagcgggcacgaaugggugaccgauuuuaaaggcaagaccgugugguucgucccguccaucaaggccggaaaugacaucgcugccugucugcggaagaacgggaagaaggugauccaguugagccgaaagaccuucgauuccgaguacgugaagacgcggaccaacgacugggacuucgucgugacaacugauaucagcgagaugggcgccaacuucaaggcugagcgagugaucgacccccggcgcugcaugaaacccgucauccucacugauggcgaggagcgcgugauccuggcggguccuaugccggucacccacuccagcgccgcccagcggcggggucgcaucggccgcaaucccaagaacgagaacgaucaguacaucuacaugggggagccccuggagaacgacgaggacugcgcccacuggaaggaggccaagaugcuccuugacaacaucaacaccccagagggcaucaucccauccauguucgagcccgagcgcgaaaaggucgacgccaucgacggcgaguaccggcugagaggggaagccagaaagaccuuuguggaccugaugaggcgcggcgacuugcccguguggcuggccuauaaggucgcagcagaggggaucaacuaugcagaccggcgcuggugcuuugacgggaucaaaaacaaucagauccucgaggagaacgucgaagucgagaucuggacgaaggagggcgagcggaagaagcugaagccgcgcuggcuggacgccaggauauacagcgaccccuuagcccugaaggaguucaaggaguucgcagccggccgcaagucccugacccucaaccugaucacugagaugggccggcugcccaccuucaugacccagaagacccgcgacgcccucgacaaccucgccgugcugcacaccgcggaggcgggaggccgagcguacaaucacgccuugagcgagcugcccgagacccuggaaacguugcuauuacuuacccugcuggcuaccgugaccgggggcaucuuccucuuucugauguccggccgcgggaucggcaagaugacccuagggaugugcugcaucgucacggccagcauacuucugugguacgcccagauccagccucacuggaucgcggccucuaucauacuggaguucuuccucauagugcugcugauacccgagcccgagaagcagcggacaccccaggacaaccaacucaccuacguugucaucgccauucugaccgugguugccgccacgauggcgaacgagaugggcuuccuagagaagacuaagaaggaucucggucuggggagcauagcuacgcagcagccagaaucgaacaucuuagacaucgaccuccgcccugcuagcgccuggacccuguacgccgucgcaacgaccuucgugaccccgauguugcggcacucgauugagaacuccagcgugaaugucucccucacagcuaucgccaaccaggccacggugcugaugggucugggaaagggcuggccccuuuccaagauggauaucgggguaccgcugcuggccaucggcugcuacucacaggucaaucccaucacccucaccgcggcccuacuucuccuuguggcacacuacgccaucaucgggcccggccugcaggcuaaggccacucgggaggcgcagaagcgagccgccgccggcaucaugaagaaucccacgguggacgggaucaccgucaucgaccucgacccgauucccuacgacccgaaguucgagaagcaguuaggccaggugaugcugcucgugcugugugucacccaggugcugaugaugcgcaccacgugggcccuuugcgaggcccucacccuggccaccggccccaucagcacccucugggagggcaacccggggcgguucuggaacacgaccaucgcagugagcauggcgaauaucuuucgcggcagcuacuuggccggggccgggcuccucuucuccauuaugaagaacaccaccaauacgcggcgcggaaccgggaacaucggcgaaacccuuggcgaaaaauggaaaagccgccugaacgcccucgggaaguccgaguuccagaucuacaagaaauccggcauccaggagguagaccggacccuggccaaggaggggauuaaacgcggcgagacggaccaccacgcggugagucgggggucagccaagcugcgcugguuuguggagcggaacauggucacccccgaagggaaggugguggaucugggcugcgggcgagguggguggaguuauuacugcggaggguugaagaacguccgggagguaaaggggcugaccaaaggagggcccggccaugaggagcccaucccgauguccacguacggguggaaccucgugcgccugcaauccggcguggacguguucuucaucccuccagagaagugcgacacgcugcucugcgacaucggggaaagcucccccaacccgacgguggaggccggccggaccuuacgcgugcugaaccucgucgagaacuggcugaacaacaacacucaguuuugcaucaaggugcugaaccccuacaugcccucggucauugagaaaauggagacccugcaacgcaaguacggaggcgcccuugugcgcaacccgcugagccggaacuccacgcacgaaauguauugggugagcaacgcgucgggcaacaucgucagcuccgugaacaugaucagccgcaugcugaucaaccgcuucacgaugaggcacaagaaggccaccuacgagcccgacguggaccucggguccggcacccggaacauugggauugagagcgagauccccaaccuggacaucaucggcaaacgcaucgagaaaauuaagcaggagcacgagacguccuggcacuaugaccaggaccaccccuauaagaccugggccuaccacggcucuuaugaaacaaagcagacuggguccgccagcucaauggucaacggcguggugcgucuucucaccaagccgugggacguacuucccaccgucacccagauggccaugaccgacacgaccccauucgggcagcagcgaguguucaaggagaaggucgacaccagaacgcaggagcccaaggagggcacgaaaaagcugaugaagaucaccgcggaguggcucuggaaggagcuaggaaagaagaaaaccccgcggaugugcacccgcgaggaguucacgcggaagguaaggagcaacgcggcccugggggcaaucuucaccgaugagaacaaguggaaguccgcccgggaggcaguagaggacagccgcuucugggagcucguugacaaggagcggaaccugcaccuggaggggaagugcgagaccuguguguauaauaugauggggaagcgcgagaagaaguuaggcgaguucgggaaggccaaggguuccagagccaucugguacauguggcugggcgcucgguuccuggaguucgaggcccuaggguuccugaacgaggaccauugguucagccgggagaacucccugagcggcguggagggggagggucucuacaaacuuggauacauccugcgcgacgugagcaagaaggagggcggcgcgauguacgccgaugacaccgcugggugggauacgcggaucacccucgaggauuugaagaacgaggagaugguuaccaaccauauggagggcgagcacaaaaagcuggccgaggcgauauucaaacuuaccuaccagaacaaggucgugcgcgugcagcggcccacgcccagggguaccgucauggacauaauuucgcggcgcgaccaaagagguucuggccaaguggggaccuauggccugaacacuuucacgaacauggaggcccaacugauacgucagauggaaggcgagggugucuucaagaacauacaacaccucaccgugaccgaggagaucgccguccagaacuggcuggcgcggguggggcgggagcgccugucccggauggccaucagcggagaugacugcgucgugaagccccucgacgaccgcuucgcgucagccuugaccgcccucaacgacaugggcaaaauccggaaagacauccagcaaugggagccuagccgcgguuggaacgacuggacccaggugcccuucugcucccaucacuuccacgagcuaaucaugaaggacggccggguccugguggugcccugccgcaaccaggaugagcugaucgggcgcgcacguaucagccagggcgcuggguggucccuccgggagaccgcgugucugggcaagagcuacgcccagauguggucccugauguacuuccaccgacgggaccuccguuuggccgccaacgccaucuguuccgcugucccgucccacugggugccgaccagccggacgacauggucuauccacgccaagcacgaguggaugacgaccgaggacaugcugaccguauggaaccgcgucuggauccaggaaaaccccuggauggaggacaagaccccgguagagagcugggaggagaucccauaccucgguaagcgggaggaccaauggugcgggucccugaucggccugaccucccgagccaccugggcaaagaacauccaggcagcgaucaaccagguuaggagccucaucgggaacgaggaauacaccgacuacaugccguccaugaagcgauuccggcgcgaggaagaagaagccggcguccugugguga

SEQ ID NO: 25156 - RNA, 9876 nt, Artificial Sequence
  derived and/or modified CDS sequence (opt11) from DENV-2__GQ868545__SS-prME
agcgcgggcaugaucaucaugcugauccccaccguuauggcuuuccaucucaccacccgcaacggcgaaccccacaugaucgucagcauccaggagaagggcaagagccuguuguucaagacagaggacggggugaacauguguacccucauggcgauggaccugggcgagcugugcgaggacaccaucaccuacaagugcccucuccugagacagaacgagccagaagacaucgacugcuggugcaacagcacaagcaccugggugacguacgggaccugcaccacaaccggggagcaccgccgggagaagcgcuccgucgcccuggugccccacgugggcauggggcucgagacccggaccgagaccuggaugagcucggagggcgccuggaagcacgcucagcgcaucgagaccuggauucugcgccacccgggguucacgaucauggccgccauccuggccuacacgaucgguacaacccacuuccagcgcgcccucauuuucauacugcugacggccguagcgcccucaaugaccaugcggugcaucgggaucuccaaccgcgacuucguggaggggguuagcggcgguuccugggucgacaucguguuggagcacggcagcugcguaaccaccauggccaagaacaagcccacgcucgacuucgagcugaucaagaccgaggccaagcaacccgccacccuccggaaguauuguaucgaggccaagcugaccaacacgaccaccgaaucccgcugccccacccagggggagcccagccugaaggaggaacaggacaaacgguucgucugcaagcacuccaucguggaccgcggcuggggcaacgggugcggccucuucgggaaaggcgggaucgugacgugugccauguucacgugcaaaaagaacauggagggcaagaucguucagcccgagaaucuggaauacaccaucguggugacgccccacagcggcgaggagcacgccgucgggaacgacacgggcaagcacggcaaggagaucaaggucacuccgcagagcagcgugaccgaggcagagcugaccgguuacgggaccgucacgauggagugcagcccccguaccgggcucgacuucaacgagauggugcugcugcagauggaaaacaaggcuuggcugguacaccgccagugguuccuggaccugccccuacccuggcugccgggcgccgacacucaggggagcaacuggauccagaaggagacccugguuacuuucaagaacccccacgcuaagaagcaggauguggucgugcucggcagccaggaaggggcuaugcacaccgcccuaaccggcgccaccgagauccagauguccagcgguaaccucuuguuuacgggccaccugaaaugccggcugcgcauggauaagcugcagcucaaaggcaugaguuauagcaugugcaccgggaaguucaaggugguuaaggagaucgccgaaacccagcacggcacgauagugauccgggugcaguacgaaggggacggcucccccugcaagauacccuucgaaaucauggaucuggagaagcgcuacguuuuaggcagacugauuacgguuaauccgaucgugaccgagaaagacaguccaguuaacauagaggcggagccgcccuucggggacucauacaucauaauaggcguggaaccugggcaguugaagcucaacugguucaagaagggcagcagcaucgggcagauguucgagaccaccaugcgcggagccaaacguauggccauccugggcgacacggcgugggacuucgggagccugggcgguguguuuacgucgaucggcaaagcccuccaucaggucuucggcgcgauuuacggcgccgccuucagcggcguguccuggaccaugaagauccugaucggggugaucaucaccuggauaggcaugaacagccgauccacgagccuguccgucagccuggugcucguggggaucgucacccuauaccugggcgugauggugcaggccgacucggggugcgucgugagcuggaagaacaaggagcucaagugcggcagcggcaucuucaucacugacaaugugcacaccuggacggagcaguacaaguuccagccggaguccccgagcaaguuagcguccgccauacagaaggcccaagaggaagggaucuguggcauccgcagcgucacccggcuggagaacuuaauguggaaacagaucacccccgaacugaaccacauauuagccgagaacgaggugaagcucaccaucaugacgggggauauaaagggcauaaugcaggccgggaagcgaagccugcggccgcagcccaccgagcugaaguacagcuggaagaccuggggcaaggcuaagaugcucuccacagagagccacaaccagacguuccugauagacgggcccgagaccgccgagugcccaaacaccaaccgcgcguggaauucgcuugagguggaggacuacggguucggcguauucacgacgaacaucuggcucaaacugaaggaaaagcaggacgccuucugcgacaguaagcugauguccgccgcuaucaaagacaaccgggccgugcacgccgacaugggguacuggaucgaaagcgcccucaacgacaccuggaaaaucgagaaggccuccuucauugaggugaaaaauugccacuggccuaagagccacacccuaugguccaacggggugcuggagagcgaaaugaucauccccaagaaucucgcagguccugugagccagcacaacuaucgcccaggguaucauacccagauagccggccccuggcaccuugggaagcuugagauggauuucgacuucugcgacggcaccacaguugucgugaccgaggacugcggcaaccgggguccuagccuccgcacaaccacugccagcggcaagcugaucaccgaguggugcugccggucaugcaccuugccaccgcuccgcuaccgcggggaggacggcugcugguacggcauggaaauacgcccccugaaggagaaggaggagaaccuugugaacagccucgucaccgccggucaugggcagaucgacaacuucucccugggcguguugggcauggcccucuuucuggaggaaaugcugcggacaaggguggggaccaagcacgccauccuccuggucgccgucagcuucgugacccugaucaccggcaacauguccuucaaggaccucgggcgggucgucgugauggucggggccacgaugaccgacgacaucgggaugggcgugaccuaucuggcccugcucgcggcguucaaggugcgccccacccuagcggcaggcuuacuccugagaaagcugacgagcaaggagcucaugaugacgacuaucgggauuguccugcugucucagagcaccauucccgagacgauucucgagcugaccgacgcccuggcgcucggcaugaugguguuaaaaauagugcgcgacauggagaaguaccaguuggccguaaccaucauggccacacucugcgugccgaacgccgucauccugcagaacgccuggaaagugaguugcacaauccucgcgguggucagcgugagucccuugcugcugaccagcucccagcaaaagacggacuggaucccccucgcccugaccaucaaggggcugaaucccaccgccauauuccuuacgacccugagccgcaccaauaagaagcggucuuggccguugaacgaggccaucauggcugugggcauggugagcauacucgccuccagccugcucaagaacgacauucccaugacaggcccccucgucgccgggggccugcucacagugugcuauguauuaaccgggcgaucugcugaccuggaacuggagcgggccaccgacgugaagugggaggaccaagcggagaucagcggcagcucccccauccucagcauuacuaucucugaggaugggagcauguccaucaagaacgaggaggaggagcagacccucacgauccugauccgaacagggcuccuggugaucagcggccuguuuccgguauccaucccuaucaccgccgccgccugguacuuaugggaggugaagaagcagcgggcugggguccugugggacguccccagccccccgcccaugggcaaagcggaacuggaagacggggccuaccgcaucaagcagaaaggcauccucggguauucccaaaucggcgcggggguguacaaggaggggacauuccauaccauguggcacgugaccagaggcgccguccugaugcacaaggguaagcgcaucgagcccagcugggccgacgucaagaaggaccugaucuccuacggcgggggcuggaaacucgagggagaguggaaggagggggaggaagugcagguccuggcgcuggagcccggcaagaacccacgggccguucagaccaagcccggccucuucaagacgaacacuggcaccaucggggccgugucacuggacuuuucuccgggaaccagcggcucgcccauuaucgacaagaagggcaagguggugggcuuauacgggaacggcgugguuacgcgcagcggugccuauguuuccgcgaucgcgcagacggagaaguccauagaggacaaccccgacaucgaggacgacaucuuccggaagcgccgccugaccauaauggaccuccaccccggggcaggcaagaccaagcgcuaccugcccgcaaucgugcgagaggccaucaagcgcgggcugcguacgcuuaucuuggcgccgacccgcguaguggcugccgagauggaagaggcccugcggggccuccccauucgcuaccagacccccgccaucagggcugagcacacugggcgcgagauuguggaucugaugugccacgccacguucaccaugcgccuguugucccccguccgggugccgaacuacaaccugaucaucauggacgaagcccacuucaccgacccugccagcaucgcagcgcgcggcuacaucagcacccggguggaaaugggcgaggcugcagggaucuucaugacggccacgccacccggcucccgcgauccguucccccagagcaacgccccgaucaucgacgaggagcgggagauucccgaacguuccuggaacucugggcacgagugggucaccgacuucaagggcaagaccgugugguucgugccgaguaucaaggcugggaacgacauagcggccugccuucggaagaacggcaagaaggucauacagcucagucgcaagacguucgacucagaguacgugaagacccgcaccaaugacugggauuucguggucaccacggauaucucggagaugggagccaacuuuaaggcggagcgcgugaucgacccccggcgcugcaugaagccuguuauacugacugauggggaggagcgggucauccuggcuggccccaugccugugacacauaguagcgccgcgcaacgccgggggcgcaucggccggaaucccaagaacgagaacgaucaauacauauacaugggggaaccccuugaaaaugacgaggacugcgcgcacuggaaggaggcgaagaugcuccuggacaacaucaacacacccgagggcaucauuccguccauguucgaacccgaacgcgagaaaguggacgccaucgacggcgaguaucggcuccgcggggaggcccgaaagacuuucguggaccugaugcggcgcggcgaucugcccguguggcuugcauacaagguggccgcggaggggaucaacuacgccgaccggcgguggugcuucgacgguauaaagaacaaccagauccuggaggaaaacgucgagguggaaaucuggaccaaggagggagagagaaaaaagcugaagccgcgcugguuggacgcacgaaucuacagcgauccccuggcgcugaaggaguucaaggaguucgcagcgggucguaagucccucacccugaaccugauuaccgagaugggucgguuacccacguucaugacccagaagacacgugacgcacuggacaacuuggccguccuccacaccgccgaagccggcgggcgggccuauaaccacgcccugagugagcuucccgaaacgcuugagacccugcugcuccuaacccuacuugccacagugacgggcggcaucuucuuguuccugauguccgggcgcggcauagguaagaugacgcucgggauguguugcaucaucaccgcaagcauccuucugugguaugcccagauacagccccacuggaucgccgcaagcaucauccucgaguucuuccugaucguccugcucauccccgaaccagaaaagcagcggacgccacaggacaaccagcugacguauguagugauagccauccugaccgugguagccgcgaccauggccaaugaaaugggauucuuagagaagaccaagaaggaccugggccugggcagcaucgccacccaacagccggagucuaacaucuuagacaucgaccugcggcccgccucugccuggacacuguacgcgguggcaaccacauucgugacccccaugcucagacauucaaucgagaacucuagcgucaacgugucccugacggcaaucgccaaccaggccaccgugcugaugggccucgggaagggauggccgcugucgaagauggacaucggggucccucugcucgcgaucggcuguuacucccaagugaaccccaucacacuuaccgccgcccuucugcugcugguggcccauuacgccaucaucgggcccgggcuccaggccaaagccacgcgcgaggcccagaagcgggccgcggcgggcaucaugaagaaccccaccgucgacgggaucaccgugaucgaccuggacccgaucccguaugaccccaaguucgagaaacaguugggccaggugaugcuacuaguauuaugcgugacccagguguugaugaugagaacgaccugggcccuaugcgaggcccugacccuugccacugggcccaucagcacccuaugggaggguaacccggggcgguucuggaacaccaccaucgcggucuccauggcuaacaucuuccgaggcagcuaccuggccggggccggacuccucuucucgaucaugaagaacaccacgaacacucgucgcggcaccgguaacaucggcgagaccuugggcgagaaguggaagucccgccucaacgcgcuggggaaaucagaguuccagaucuacaagaaguccggcauccaggagguggaccggacgcuggcgaaagaggggauaaagcgcggagagacugaccaucacgcaguguccagggguagcgccaagcuccgcugguucgucgagcggaacauggugacccccgagggcaaaguggucgaccuuggcugcgggcgcggagggugguccuacuacugcggcggacugaagaaugugcgggagguuaagggccucaccaagggcgggcccggccacgaggagcccaucccuauguccacguacgguuggaaccugguccgccugcagucgggcguggacguuuuuuuuauuccgcccgaaaaaugcgacacccuccugugcgacaucggggagucuucccccaaccccaccgucgaagcgggccgaacccugcgagugcucaaccugguggagaacuggcugaacaacaacacccaguucuguaucaaaguccugaaccccuacaugccgagcgugaucgaaaagauggagacgcuccagcggaaguacgggggcgcgcucgugcgcaacccccugagccggaacucgacccacgagauguacugggucagcaacgccuccggcaacaucgugagcuccgugaauaugaucucucguaugcucauaaaccgcuucaccaugagacacaagaaggcaaccuacgaaccugacgucgaccugggguccggcacgcggaacauagggaucgagagcgagaucccuaaccuggacaucaucggcaagcgcaucgagaagaucaagcaggagcacgagaccuccuggcacuacgaccaggaccaccccuauaagaccugggccuaccacggcaguuacgagaccaagcagacgggguccgccucuagcauggugaauggcgugguccggcuccugaccaaaccgugggacgugcugcccaccguuacccagauggcgaugacggacaccaccccauuuggccagcagcgcgucuucaaagagaagguggacacccgcacgcaggaacccaaggagggcaccaaaaagcucaugaagaucaccgccgaaugguuguggaaggagcugggcaaaaagaagacgccgcggaugugcacgcgcgaagaguucacccggaaggugcgcagcaacgccgcccucggggccaucuucaccgacgagaacaaguggaaguccgcgcgggaggccgucgaagacagccgcuucugggagcugguggacaaggagcggaagcugcaccucgaaggcaagugcgagaccugcgucuacaacaugauggggaagcgcgagaagaagcuaggcgaauucgguaaggccaaaggcucgcgggccaucugguacauguggcugggugcccgcuuccucgaguuugaggcacuaggcuuccugaacgaggaccacugguucucucgggagaacucacucagcggcguggagggggagggcuugcauaagcuggguuacaucuugagagacguuagcaagaaggaggggggcgcuauguacgccgacgacacggccgggugggauacccggaucacacuggaagaccugaagaacgaggaaaugguaaccaaccauauggagggcgagcacaagaagcucgcggaggcaaucuucaagcuuacguaccagaacaaggucgugcgcguccagcggcccacgccacgcgggaccgugauggacaucaucucccgccgugaucaacggggcagcggccaggugggcacuuacggguugaacacguuuaccaauauggaggcccagcucauacgccagauggagggcgagggcgucuucaagaacauccagcaccugaccgugaccgaggagaucgccgugcagaauuggcuggccagaguugggcgcgagcgccucucccggauggcuaucagcggcgacgacugcguggucaagccucuggacgauagguucgccuccgcccucacggcauugaacgauauggguaagauccggaaggacauccagcagugggagccgagcaggggcuggaacgauuggacccaaguccccuuuugcucccaccacuuccaugagcugaucaugaaagacggacggguacuggugguccccugccgcaaucaggacgagcucaucgggcgcgcccguaucucucagggcgcgggguggagccugcgugaaaccgccugucuuggcaagagcuacgcucagaugugguccuugauguacuuccaccgacgggaccugcgccuggccgccaacgcgaucugcagugcaguucccucacacuggguaccgaccagccggaccacgugguccauccacgccaagcacgaguggaugacaaccgaggacaugcucaccguuuggaaucgcgucuggauccaagagaaccccuggauggaggauaaaacccccguggagagcugggaggagauccccuaccugggcaagcgggaggaccaauggugcgguucccucaucggccucaccagccgcgccaccugggccaagaacauccaggcggccaucaaccagguuaggagcuugauagggaaugaggaguacaccgauuauaugccgucuaugaagcgcuuccggagagaggaggaggaggccggcgugcugugguga

SEQ ID NO: 25157 - RNA, 9876 nt, Artificial Sequence
  derived and/or modified CDS sequence (opt11) from DENV-2__GQ868543__SS-prME
agcgccggcaugaucaucaugcugauccccaccgugauggcuuuccaucucaccacgaggaacggggagccccacaugaucgugggaauccaggagaaggggaaaucccugcuauucaagaccgaggauggcgugaacauguguacccucauggcgauggaucugggugaacugugcgaggacacaaucaccuacaagugcccccuucugcggcagaaugaacccgaggacaucgacugcuggugcaauucgaccucgaccuggguaaccuacgggacauguaccacaaccggcgagcacaggcgggagaagcgcagcgucgcgcuggugccacacgugggcaugggccucgagacccggaccgagacauggaugucgagcgagggugcuuggaagcacgcccagcguaucgagaccuggauucugcgacauccgggcuuuacgaucauggcagcgauccuggccuacaccaucgggacgacccauuuccagcgcgcucucaucuucauccugcuuacggcugucgcgcccuccaugaccaugcggugcaucggcaucagcaaccgcgacuuuguggaggggguaucugguggcagcugggucgacaucguacucgagcacggguccugcgugaccaccauggccaaaaacaagcccacgcuggacuucgagcugaucaagacugaggccaagcagccagccaccuugcggaaguacugcaucgaggccaaacuuaccaacacgacaacggagagucgcugccccacgcagggcgagcccucgcugaaggaggagcaggacaagcgguucgucugcaagcacucgaugguggaccguggcuggggaaacggcugcgggcuguucggcaagggcggaaucgugacaugcgcgauguucacgugcaagaaaaacauggagggcaaaaucguccagccugagaaccuagaguacacgauuguggugacgccccacagcggagaggagcacgcggucggcaacgacacggguaagcauggcaaggagaucaaggugacuccgcagagcaguaucacggaggccgaauugaccggguacggcaccgugaccauggaaugcagcccccggaccggacucgacuucaacgagaugguccugcugcagauggagaacaaggccuggcuagugcaccgccagugguuccuggaccugccccucccuuggcugccgggggccgacaagcaggguuccaauuggauccagaaggagacacuagugaccuucaagaacccccacgcgaagaagcaggacgucgugguccucgggucucaggagggcgccaugcacacggcccugaccggugccaccgagauccagaugagcuccggcaaccuccuguucaccggccaccugaagugccggcugcgaauggacaagcuccaguuaaaggggaugagcuauuccaugugcacgggcaaguucaagguggugaaggagaucgcagagacccagcacggcaccaucgucauccgugugcaguaugagggagacggcagccccugcaagaucccguucgagaucauggaccuggagaagcgcuacgugcucgggcgguuaaucaccgucaauccgauugugacggagaaggacuccccagucaauauagaggccgagccgcccuucggggacucguauaucaucaucggggucgaaccaggccagcugaaguugaacugguucaagaaggggagcagcaucgggcagauguucgaaaccaccaugcgcggcgccaaacgcauggccauauugggggacaccgccugggacuucggcucccucggcgguauguucacgagcaucgguaaggcccuucaccagguguucggggcgauauauggggcagccuucuccgggguauccuggaccaugaagauccugaucggcgucaucaucaccuggauagggaugaacucgagaucaacgucccugagcgugucccuagucuuggucgguaucgugacgcuguaccugggggugaugguccaggccgacagcggcugcgugguguccuggaagaacaaggagcucaagugcggcagcgggaucuucaucaccgacaacgugcauaccuggaccgaacaguacaaguuucagccggagucccccuccaaguuggcgagcgccauccagaaggcccaggaagaggguaucugcgggauucgcuccgugacgcggcuugaaaaccucauguggaagcaaaucacccccgagcugaaccacaucuuggcagagaacgaggugaagcucaccaucaugaccggcgacaucaagggcauuaugcaggccggcaagcgcagccugaggccucaacccacggagcugaaauacuccuggaaaacuuggggcaaggcgaagaugcucucgaccgagucccacaaccagaccuuccugaucgaugggcccgagacggccgagugccccaacaccaaccgcgccuggaacagccuggaggucgaggacuacggguucggcguguucaccaccaauaucuggcucaagcugaaagagaagcaggacgccuucugcgauuccaagcugaugucugccgcgaucaaggauaaccgagccgugcacgcagacaugggcuacuggaucgaguccgcccucaacgacacguggaagaucgaaaaggccuccuucaucgaggucaagaacugucacuggcccaaaucccacacccuguggagcaauggcgugcucgaauccgagaugaucauccccaaaaaccucgcggggcccgugagccagcacaacuacagaccgggcuaccacacccagaucgccgggcccuggcaccugggaaagcuagagauggacuucgacuucugcgacggcaccaccgucguggugacggaggacugcggcaaccggggcccgagccuccgaaccaccaccgccagcgggaagcuaaucacggaguggugcugccgguccugcacccugcccccgcuucgcuacaggggagaggacgggugcugguacggaauggagauccgcccccugaaggagaaggaggagaacuuggucaacucccucgugaccgccgggcacggacagguggacaacuucagccugggcguccuggggauggcccuguuccuggaagagaugcugcggacccgagugggcacgaagcaugccauccuccuuguggccguguccuucgugacccugaucaccggcaacaugucguucaaggaccucggaagaguuguagugauggucggagcgaccaugacggacgauaucggcaugggcgucacuuaccuggcccugcuugccgccuuuaaggugcgccccacuuuugccgcugggcugcugcuccgaaagcugacuuccaaggagcugaugaugacgaccaucggcaucgugcuucugucgcaguccaccauccccgagaccauccuggagcucacggacgcccuggcgcuggggaugaugguccucaagaucguucgcaacauggagaaguaccagcuggcgguaaccaucauggccauacugugcgucccgaacgccgugauccuacagaaugcauggaaggucagcugcaccauccuugcggugguguccgucucuccccugcuccugaccuccucucagcagaaaacggacuggaucccccuggcgcucacgaucaagggacugaacccgaccgccaucuucuuaacaacgcucucccggaccaacaagaaacgcagcuggccccugaacgaggccaucauggcggugggcauggugagcauccuggccagcucucuccugaagaacgacauccccaugaccgguccccugguagcaggcgggcuccucacagugugcuacgugcugacgggccgcucugccgaccucgagcuggaacgggccaccgacgucaagugggaagaccaggcggaaaucuccgggagcagcccuauauuaagcaucaccaucagcgaggacggcuccaugagcaucaagaacgaagaggaggagcagacccucacgauccuaauccgcaccggccugcucgugaucagugggcuauucccgguuagcauccccaucaccgcagccgccugguaccugugggaggucaagaagcaacgggccggcgugcucugggacgugcccagcccgccgcccauggggaaggcggaacuggaagauggcgccuaccgaaucaagcagaaggggauccugggcuacucucagaucggugccgggguguacaaggagggcaccuuccauacuauguggcacgugacgcgcggggcgguguuaaugcauaagggcaaaagaaucgagcccucaugggccgacgucaagaaggaucuuaucaguuacgggggcggauggaagcuggagggggaguggaaggagggcgaagagguccaaguacucgcccuggagcccgggaaaaacccccgggccguccagacgaagcccggccuuuuuaagaccaauaccgggacgauaggcgcuguaucgcucgacuucucgcccggcacgagugggagccccauaauugacaaaaagggcaagguggucggccuauacggcaacggcguggugacccgcaguggugccuaugucagcgcgaucgcgcagaccgaaaaaaguauugaggacaaccccgagaucgaggacgauaucuucaggaagcgccgguugacuauuauggaccugcaccccggagcggggaagaccaagcgcuacuugcccgccauagugcgggaggccaucaagcgcggcuugagaacucugauccucgcgccaacccgcguggucgccgccgagauggaggaggcacugcggggucugcccauccgcuaccagacgcccgccauccgggcggagcauacugggagggagaucguagaucucaugugccacgccaccuucaccaugcgcuuauuaagccccgugcgcgugcccaacuacaacuuaauuaucauggacgaggcccacuuuacggaccccgccuccaucgccgcccguggguauaucagcacccggguggagaugggagaggccgccggaauuuucaugaccgcuacgcccccugggagccgcgacccguucccccaguccaacgcccccaucauagacgaggaacgagagauccccgagcgcagcuggaacuccggccacgagugggugacggacuuuaaggggaagacuguuugguucguaccgagcaucaaggcaggcaaugacauugccgccugccuccggaagaacggcaagaaggugauccagcugucccgcaagaccuucgacagcgaguacgucaagacucgcacgaacgauugggacuuuguggugaccacugacaucagcgagaugggggccaacuucaaggcagagcgcgucaucgacccacggcgcuguaugaaacccgugauccucaccgacggcgaggagagagugauccuagccgggcccaugccggucacgcacagcuccgcagcccagcgccggggccgcauaggccggaaccccaagaaugagaaugaccaguacaucuauaugggcgaacccuuggagaacgacgaggauugugcgcacuggaaagaagcgaagaugcuccuggacaacaucaacacccccgaggggaucaucccgagcauguucgagcccgagagagaaaagguggaugccaucgacggggaguaccgguugcgcggugaggccagaaagaccuuuguggaccucaugaggcgcggggaccugcccguauggcuggccuauaagguggccgcggagggcaucaacuacgccgaccggcgcuggugcuucgaugggaucaagaacaaccagauccucgaggaaaacguggaggucgagauuuggaccaaagagggcgagcggaagaagcuuaagccgcgcuggcuagacgcacggauuuacuccgacccccucgcccugaaggaguuuaaggaguuugccgcaggccgcaagagucuuaccuugaacuuaauaacggagauggggagacugccgaccuuuaugacacagaagacgcgcgaugcccucgacaaccuggccgugcugcacaccgcugaagccggcggccgggccuacaaccaugcccucuccgagcugcccgagacccuggagacacuccugcugcuuacgcugcuggccaccgucacuggcggcaucuuccucuuccugaugagcgggcgcggcaucgggaagaugacacugggcauguguugcaucauuacugccuccauccuccugugguacgcgcagauccaaccccacuggaucgccgccagcaucauccuggaguucuuccucaucgugcugcucauccccgaacccgagaagcagcggacgccccaggacaaccagcucaccuauguggucauagccauccugacggucguggccgcgaccauggccaacgagaugggcuuccuggagaagaccaaaaaggaccucggccugggcuccauugccacccagcagccggagagcaacaucuuggacaucgaucugcgcccggccuccgcauggacccuguacgcgguggccaccacguucgugacccccaugcugaggcacaguaucgagaacucauccgugaacgucagccucacugccaucgccaaucaggcgaccguccugauggggcuugguaaaggcuggccacucuccaagauggacaucggggugccguugcuggcgaucgggugcuacagccaaguaaacccaaucacgcucaccgccgccuuacugcuccucguggcccacuacgcuaucaucggccccggccuccaggccaaggccacacgcgaggcccagaaacgggccgcggccgguauuaugaagaaccccaccguugacggcaucaccgucaucgaccucgacccgauucccuacgaccccaaguuugagaagcagcuuggccaggucaugcuguuaauacuuugcgugacucagguccugaugaugcguaccaccugggcccucugugaggcccugacgcuggugaccggccccaucucgacucucugggaggggaauccgggacgauucuggaacacaaccaucgccgugagcauggcuaacaucuuccgcggcuccuaccuggccggggccggcuugcucuuuagcaucaugaaaaacaccaccaacacccggcgcgggacuggaaacaucggcgagacgcugggggagaaguggaagucccgccuaaacgccuuggggaagagcgaguuccaaauauacaagaaguccggcauccaggaggucgacagaacccuugccaaagaaggcaucaagcgcggggagaccgaccaccacgcggugagccggggaagcgccaaacugcgcugguucguggagcggaacauggucacacccgaagguaaggugguagaccucgggugcggccgcgggggauggaguuacuauugcgggggacugaagaacgucagggaggugaagggccuuaccaagggcggccccgggcacgaggagcccaucccgauguccaccuacggcuggaaccuagugcgccugcagucuggggucgacgucuucuuuaucccgcccgagaagugcgacacccugcucugcgauaucggggaguccagccccaauccgacgguggaggccgggcggacccuccgcguacugaaccucguagagaauuggcugaacaacaacacccaguuuugcaucaaggugcuuaaccccuauaugcccuccgugauugagaagauggaagcccugcaacggaaguacgggggggcgcucgugcgcaauccccuaagccggaacagcacccacgagauguacuggguguccaaugcaagcgggaauaucguauccagcguaaacaugauaagccgcaugcugauaaaccgguucaccaugcgccacaagaaggccacguaugaaccggacguggaccuaggaagcgggacccggaauaucggcaucgagagugagauucccaacuuagacaucaucggcaagcgcaucgagaagaucaagcaggagcacgaaaccagcuggcacuacgaccaggaucaucccuacaagaccugggccuaccacggaagcuaugagaccaagcaaaccggcagcgccuccucuauggugaacggaguggugcggcugcucacgaagccgugggacguuuuacccacgguuacacagauggcgaugaccgacacuacacccuucggccaacagcgcguguucaaggagaagguagacacgcgcacccaagagcccaaggagggcaccaagaaguuaaugaagaucaccgccgaguggcuguggaaggaguuagggaagaagaagaccccgcggaugugcacacgagaggaguucacccgcaagguucgcuccaacgccgcccucggcgccaucuucaccgacgagaacaaguggaaguccgcgcgugaggccguggaagacucccgcuucugggagcucguggacaaggagcggaacuuacacuuagaggggaaaugugagacgugcguguacaacaugaugggaaagcgcgagaagaaacucggggaauucggaaaggcuaaggggagccgggccaucugguacauguggcugggggcccgcuuccuggaguucgaggcacucggcuuccugaacgaggaccauugguucucucgggagaauucacuguccggggucgagggcgaagggcuccacaaacugggcuacauccugcgcgacgugagcaaaaaggaaggcggggcgauguacgccgacgacaccgccggcugggacacacggaucacgcucgaagacuugaagaacgaggagauggugacgaaccacauggagggagagcauaagaagcucgcggaggccaucuucaagcucaccuaccagaacaaagucgugcgcgugcagcggccgacgccgcggggcaccgucauggacaucaucagucggcgcgaccagcgggguuccggccaaguuggcacguacgggcugaacacauucaccaauauggaggcgcagcugauacgccagauggaaggcgaggggguauucaagaauauucagcaccucaccgucaccgaggagguggccguccagaauugguuagccagagucgggagagagcgacuuucccggauggcaaucuccggcgacgacuguguggugaagccacucgacgaccgcuucgcaaaugcauugaccgcucuuaacgacauggggaagauucguaaggacauccagcagugggagccaagcaaggguuggaacgacuggacccaggucccuuucugcucccaccacuuccacgagcuaauuaugaaggacggacgcgugcugguggucccgugccggaaccaagacgagcugauuggccgcgcucguaucucacagggggcuggcugguccuugcgcgagaccgccugccuggggaaaucauacgcccagauguggucccugauguauuuccaccggcgggaccuucggcucgccgccaaugcaaucugcagcgccgugcccucucacugggucccaacgagccgcaccaccugguccauccacgccaagcacgaguggaugacuaccgaggacaugcugacggucuggaaucggguguggauucaggagaaccccuggauggaagacaagaccccaguggagagcugggaggagaucccguaccucgggaagcgcgaagaccaauggugcggcucccugauagggcugaccucacgggccaccugggcgaagaacauacaggcggccaucaaccaggucaggucccuaaucggcaacgaggaguacacggauuacaugccgaguaugaaaagauuucgccgggaggaggaggaggccgggguauuaugguga

SEQ ID NO: 25158 - RNA, 9876 nt, Artificial Sequence
  derived and/or modified CDS sequence (opt11) from DENV-2__EU482544__SS-prME
acugccggcgugaucaucauguuaaucccuacggucauggccuuucaccucaccacuagaaacggggagccccauaugaucguggguaggcaggagaaggguaaguccuuacuguucaagaccgaagacggcgugaacauguguacccucauggcgaucgacuuaggcgagcugugcgaggacaccaucaccuauaagugcccccuacugcgccagaacgagcccgaggacaucgacugcugguguaacagcaccagcaccugggucaccuacggaaccuguaccaccacgggcgaacacaggcgcgagaagagaagcguggcgcugguaccccacgucgggaugggccucgagacccggaccgagacauggaugucaagugagggagcguggaagcaugugcagcggauugagacguggauccugcgccacccgggauucaccauaauggcagcgauucuggcguacacgaucgggacuacucacuuucagcgggcucuuaucuuuauccugcugaccgccguggcgccaucaaugaccaugcgcugcauaggcaucuccaaucgggacuucguggagggugugagcgggggcuccuggguugacaucguacuagaacacgggagcugcgugaccacgauggcgaaaaauaagcccacccuggacuucgaguugaucaaaaccgaggccaagcaaccagccacccugcgcaaguacugcaucgaggcuaaacugacgaacaccacuaccgagucccgcugcccgacgcagggcgagccgagccugaacgaggagcaggacaagcgcuucaucugcaagcacuccaugguagaccggggcuggggaaacggcuguggccuguucggcaaaggcgggaucgugacuugugccauguucacguguaagaagaauauggagggcaagguggugcugcccgagaaccuggaguacacgaucgucaucacgccgcacagcggggaggagcaugcggucggcaacgacaccgggaagcauggcaaggagauuaagaucaccccgcagucaagcaucaccgaggcugagcucacaggguacggcacggugaccauggaguguucgccccggaccggccuggacuuuaacgagaugguccugcuucagauggaagauaaggccuggcugguucaccggcaaugguuccuggaccucccccugcccuggcugccgggugccgacacccaggguagcaacuggauccagaaggagacgcucgugaccuuuaagaacccucacgccaaaaagcaggacgucguugucuuggggucgcaagagggcgcgaugcacaccgcgcucacuggugcaacggagauccagaugagcagcggcaaccugcuguucaccggccaccugaaaugccgccuccggauggacaagcugcagcugaaggggauguccuacagcaugugcacggguaaguuuaagauugugaaggagaucgcagagacacaacacgggacgaucgugauccgcguccaguacgagggggacggcucccccugcaaaaucccguucgaaauaauggaccucgagaagagacacgugcuggggcgcuuaaucaccgugaacccgaucgucacugaaaaagacucucccgugaacauugaggccgagccgcccuucggcgacuccuacaucaucaucggcguggagccgggccagcucaagcugaacugguucaagaaagggucauccaucggacagauguuugagaccacgaugcgcggcgcgaagcgaauggcgauacuuggggacaccgccugggacuuuggcagccuugggggugucuucaccucuaucgggaaggccuuacaccaggucuucggcgccauauauggggcggcguucucggggguguccuggaccaugaagauauugaucggcgucaucauuacguggaucggaaugaacagccggucaaccagcuuaagcgugagccucguccuggucgguguugugacgcuguaccucggugucauggugcaagccgacaccggcugcgugguguccuggaagaacaaggaacugaagugcggcagcgggaucuucaucacggacaacguucacaccuggacggagcaguacaaguuccagcccgagucccccagcaaguuagccucugcgauccagaaggcccacgaggagggcauaugcgggauccgcuccgugacgcgccucgagaaccugauguggaaacagaucacgcccgagcugaaccacauacucagcgagaacgaggucaagcugaccauaaugaccggcgacauuaaggggauuaugcaggccggcaagcggucccuucgaccgcagcccacggagcucaaguacagcuggaagacgugggggaaggcuaagaugcuaaguaccgagagccacaaccaaacguuucugaucgacggucccgagaccgccgagugcccgaauacgaaccgggcguggaacucccucgagguggaagacuacggcuucgggguguucagcacgaacaucuggcugaagcugcgcgaaaagcaggacgucuuuugcgacuccaagcuuaugagcgccgccaucaaggacaaccgggccguucaugcagacauggguuacuggaucgaguccgcgcugaacgauaccuggaagauggagaaggccagcuucaucgagaucaagagcugccacuggccuaagagccacacccugugguccaauggcgugcuagagagcgaaaugauaauacccaaaaacuucgccgggccggucucgcagcacaacuaccgcccgggcuaccacacccagacggccggcccguggcaccugggcaagcuggagauggauuucgacuucugugaggggacuaccgugguggugaccgaagacugcggcaacaggggcccaagccuccgcacgaccaccgccagcgggaagcuaaucaccgaguggugcugccggucuuguacucuucccccgcuccgcuaucggggcgaggaugggugcugguacggcauggaaauucgcccccugaaggagaaagaggagaaccuggugaacagcuuagucaccgcggggcacgggcagauagauaauuucuccuuaggaguccuuggaauggcccucuuccuugaggagaugcuacggacccgcgugggcaccaagcacgccauacuacucguggccgucagcuucgugacgcugauaaccgguaacaugucauuccgggaucucggccgcgucaugguuauggugggggcgaccaugaccgacgauauaggcaugggcgugacguaccuggcccugcuugccgcuuucaagguccgccccacuuuugccgcgggguuacuguugcggaagcugaccagcaaggagcugaugauggccacaaucgguaucgcccuccugucccaguccacgauccccgagaccauauuagagcucaccgaugcccuggcucuggggaugaugguccucaagauugugcgcaacauggagaaguaucagcuggcggucacaaucauggccauuuccugcgugccgaacgcuguaauccugcagaacgccuggaaagugagcuguacgauacucgcagcggucuccguuagcccccugcugcucaccuccagccagcagaaggccgacuggaucccccuggcccugaccaucaagggccucaaccccacugccauauuccugacgacccucucccggaccagcaaaaagcgcuccuggccgcucaaugaggcggugauggcuguugguaugguaagcauccuggccuccagccugcucaagaaugacaucccaaugaccggcccccugguggcuggcgguuugcucacggugugcuacguccugaccggccguuccgccgaccuagaguuagaacgcgcggccgacgugaagugggaggaccaggccgagaucucggggagcucccccauccugagcaucaccaucuccgaggaugggucaauguccaucaagaacgaagaggaggaacauacccugacgauccucauccggaccggccugcucgugauaucuggggucuucccgguguccauacccaucacggccgccgcgugguaccuaugggaggugaagaagcagcgcgcuggcguccugugggacgugcccagcccgccucccguggggaaggccgaacuagaggacggcgccuaccggaucaagcagcgcgggaucuucggcuacucccagaucggugccggggucuacaaggaggggaccuuccacaccauguggcaugugacgcguggggcugugcucaugcaccgcggcaagcggauagagcccucuugggccgacgucaagaaggaccugaucuccuacgggggcgguuggaagcuggagggggaguggaaggagggcgaagagguccaggugcucgcccuggaaccaggcaagaacccccgcgcgguccagaccaagcccggccuguucaagaccaacaccggcacgauuggcgccgugagcuuagauuucucccccggcaccuccgggucccccaucguagaucggaagggcaaagucguggggcuguacggcaacggcguggucacucguagcggggcauacguuagcgccaucgcccagaccgagaagucaaucgaagacaaccccgagaucgaggacgacauauucagaaagaagcgccugacgaucauggaccuccacccgggcgccgggaagaccaagcgguaccugccagcgaucgugcgcgaggcuaucaagcggggccuccgcacccugauccucgcgccgacccgcguaguggccgccgagauggaggaggcgcugcgggggcugcccauccgcuaccagacgcccgccauccgggccgagcacaccggccgcgagaucguggaccucaugugccacgccaccuucaccaugcggcugcugagccccgucagagugccgaacuacaaccucaucauaauggacgaggcccacuucacggaccccgcgucgaucgccgcccgaggcuauauuucuacccgcguggagaugggggaagccgccggcaucuucaugaccgcgacgccgcccgggucccgggacccauucccccagagcaacgcgcccaucauggacgaggagcgcgagauccccgaacggucuuggaacagcggccacgagugggucacggacuucaaggggaagaccgugugguucgugcccuccaucaaagccggcaaugacaucgccgcaugccugcgcaagaauggcaagaaaguaauccagcugagccggaagacauucgacuccgaguauguuaaaaccagagcaaacgacugggauuuuguggugacgacagacaucagcgagaugggugccaacuuccgggccgaacgcgugauugaucccaggcgcugcaugaagcccgugaucuuaaccgacggcgaggagcgggucauacuggcagggcccaugccggucacacacuccagcgcggcccagcgccgaggccggaucgggcgcaaucccaaaaaugagaacgaccaguacaucuacaugggcgagcccuuggagaaugacgaggauugcgcccacuggaaagaggccaagaugcuccuggacaacaucaacacgcccgagggcauuaucccguccauguucgagcccgagcgggagaagguggacgccaucgauggagaguauagacugaggggcgaggcgcgcaagaccuucgucgaccuuaugcggaggggggaccuucccguguggcuagcguacagaguggccgcugagggcauuaacuacgccgaccgccgguggugcuucgacgggauuaagaacaaccagauccucgaggagaaugucgagguugagaucuggaccaaggagggagagcgcaagaagcugaaaccgcgguggcuggacgcgcgcauauacagcgauccccucgcccugaaggaguucaaggaguucgcggccggccgcaaguccuugacccucaaccugaucacggagauggggcgcuuaccgacuuucaugacccagaaggcgcgggacgcccucgacaaccuggccgucuuacauaccgccgaggugggcgggagagccuacaaccacgcgcuuagcgagcugcccgagacucuggagacacuccugcugcucacgcugcuagccacggugacgggcggcaucuuucucuuucugaugucggggaagggaaucgggaagaugacccugggcauguguugcaucauaaccgccucaauucuacugugguacgcgcaaauccagccgcacuggaucgccgcgucaaucauccuggaguucuuccuuaucguccugcugauccccgagcccgagaagcaacguacgccacaggacaaccaacucaccuacguggugaucgccauccuaacggucguggccgccaccauggccaacgagaugggauuccuugaaaagacuaagaaggaucucggacuggguagcaucaccacgcaagaaagcgaguccaacauacuggacaucgaucuccgcccggcgagcgcauggacccuuuacgccguggcgacuaccuucguaacgccaaugcugcggcacuccaucgagaacucuaguguaaacgugagccucaccgcaaucgcgaaccaggccaccguacuaauggggcugggccgcggguggccccuguccaagauggauaucggugugccccugcuggccaucgggugcuauagccaggugaauccgauaacccucacggccgcguugcugcucuuggucgcccauuacgccaucauugguccgggccugcaggccaaggcaacccgcgaagcccagaaacgcaccgccgcggggaucaugaagaaccccaccguggacggcaucacugucaucgaccucgaaccaaucccguacgaccccaaguucgagaagcagcugggucagguaaugcugcucgugcugugugugacccagguccugaugaugaggaccaccugggcccucugugaggcccugacgcuagcgaccggccccaucaguacacucugggaggggaacccgggccgcuucuggaacaccaccauagcagugagcauggccaacaucuuccgcggcuccuaccuggcgggggccggccuccuuuucucuaucaugaagaacaccaccaacacccggcgcggcaccgggaacaucggggagacgcugggggagaaauggaaguccaggcugaacgcucucggcaagucggaguuccagaucuauaagaaauccgggauacaagagguggaucgcacccucgccaaggagggcaucaaacgcggggagacagaccaccacgccgucagcagagguuccgccaaacugcgcugguucguugagcggaauauggugacgccggaggggaaagucguggaccucggguguggccgcggcggguggagcuacuacugcggagggcugaagaacgugcgcgaggugaaggggcugaccaagggcgggcccggucacgaggagcccauccccaugagcaccuacggcuggaaccucgugcggcuccaguccgggguggacgucuucuucacgccaccagagaagugcgauacgcugcucugcgacaucggcgagagcagccccaacccaaccaucgaagccggccgaacccugcgcguacuuaaccucguggagaauuggcugaacaacaacacccaauuuugcgucaaggugcugaacccguacaugcccucggugaucgagaagauggagacccugcagcgcaaauacgggggagcucugguccgcaacccccugagcaggaacagcacgcacgagauguacuggguguccaacgccaccgggaacaucgugagcuccgucaacaugaucagccgcaugcugaucaaccgguucacaaugaagcacaagaaggccacguacgagccggacguggaccucggcucugggacccguaacaucggcaucgaaaacgaaauacccaacuuagacaucaucggcaagcggaucgagaagaucaagcaggagcaugagaccagcuggcacuacgaccaggaccaccccuacaagacuugggccuaccacggaucauacgagaccaaacagacgggcagcgcguccucaauggugaacggggucgucaagcugcucacaaaacccugggacguggucccaauggugacccagauggccaugacggacacgacccccuucggccagcagcggguguucaaggagaaggucgacacccggacccaggagcccaaagaaggcacgaagaagcucaugagaaucacggccgaguggcuauggaaggagcuugggaagaagaagacgccccggaugugcacccgugaggaguucacgcggaagguaagguccaacgcagcccugggugcuaucuucaccgacgagaauaaguggaaauccgcccgggaggccgucgaggauuccagguuuugggaauugguggaccgggaacgcaacuuacaccuggaggggaagugugaaacgugcguguauaauaugauggggaagcgggaaaagaagcugggagaguucggcaaggcgaaaggcagcagggcaaucugguacauguggcucggggcacgguuucuggaauucgaggcccugggcuuccucaacgaggaccacugguucuccagagggaacucgcugagcggcgucgaaggagaaggccuccacaagcugggguacauucugcgggacguguccaagaaggaggggggggccauguacgccgacgacaccgcggggugggacacgcgcauuacccuggaggacuuaaagaacgaggagauggucaccaaccacaugaagggcgagcacaagaaguuggccgaggccaucuucaagcugaccuaccagaauaaggucgugcgggugcagcgaccgacgccccgagggaccgugauggacaucaucagccggaaggaccaacggggcuccggccaagucgguaccuacggccucaacaccuuuacgaacauggaggcccaacuaauccggcagauggagggggagggcaucuucaagagcauccagcgucugaccguaaccgaggagaucgccguccagaacuggcucgcgcgagugggccgcgagcggcugucccgcauggccaucagcggcgacgauugcguagucaagccccuggaugaccgguucgccuccgcccucaccgcccugaacgacaugggaaaggugcgaaaagacauucagcaaugggagcccagccggggguggaacgacuggacccaggugccguuuugcucucaccauuuccacgaguuagucaugaaagauggccgcgugcuagugguccccugccggaaccaggacgagcuaaucgggcgcgcgaggaucagccagggcgcgggcuggucucugaaggagacagccugccucggcaaaagcuacgcccagauguggacccugauguacuuccaccgcagagaccugcgccuggccgcgaacgcuaucugcuccgccguccccucgcacuggguucccacaucacggaccacguggagcauccacgccaagcacgaguggaugacgacggaggacaugcuggccgucuggaacagaguguggauccaggagaacccguggauggaggacaaaacccccguggagagcugggaggagguccccuaccugggcaagcgcgaggaccaguggugcgggagcuugaucggcuugacgucgcgggcgaccugggccaaaaacauccagaccgcgauuaaccagguacgcagccugaucgggaacgaggaguacaccgacuacaugcccagcaugaagcgguuccgcaaggaggaggaggaggccggcgugcucugguga

SEQ ID NO: 25159 - RNA, 9876 nt, Artificial Sequence
  derived and/or modified CDS sequence (opt11) from DENV-2__EU482545__SS-prME
accgccggggugauugucaugcugauacccaccgccauggcguuccaccucacaacgcggaacggggaaccgcauaugaucgugggccgacaagaaaaagggaagucccugcuauucaagacagaggacggcgucaacaugugcacccucauggccaucgaucugggggagcugugugaggacaccauaaccuacaaguguccccucuuacgccagaacgagcccgaggacaucgauuguugguguaacagcaccagcacuugggucaccuacgggaccugcacuaccacgggugaacaucggcgcgaaaagcgcuccguggcgcuggugccccacgucggcaugggccucgaaacccggaccgagaccuggaugagcuccgagggggccuggaaacauguccagcggaucgagacuuggauccugcgccaccccggcuucaccaucauggccgccauccuggcguacaccauuggcacuacccacuuucagcgugcccucaucuucauccuguuaaccgccguggcgcccagcaugacgaugcgcuguauagggaucuccaaccgggauuucgucgagggcgugagcggcggcagcugggucgacaucgugcuggaacacgggagcugcgugaccacaauggccaagaauaagcccacacuggacuucgagcugaucaagaccgaagccaagcaacccgcuacccucagaaaguacuguaucgaggcuaagcugacgaauacaaccaccgagucccggugcccaacgcaaggcgagcccagccugaacgaggagcaggacaagcguuucaucugcaagcauaguaugguagaccgaggcugggggaauggcugcgggcuguucggcaagggcggaauugugaccugcgcuauguucacaugcaagaaaaauauggaaggcaaaaucgugcagcccgaaaaccuggaguacaccaucaugauuacgccucacagcggcgaagaacacgccgugggcaacgacaccggaaagcacgguaaggaaaucaagaucaccccgcaaaguucuaucaccgaggccgagcugaccggguacggcacggugaccauggagugcucaccgagaacaggccucgacuucaacgagauggugcugcugcagauggaggacaaggcuuggcuugugcaccggcagugguuccuggaccucccucuccccuggcuaccgggagcugauacccaggggucaaacuggauccagaaggagacccuggugaccuucaaaaacccccacgcgaagaagcaggacgucgugguccucggaucucaagagggcgccaugcacaccgcccugacaggggccacggagauacagaugagcagcggcaaccuccuuuucaccggccaccugaagugccgccuucggauggacaagcugcagcugaagggaauguccuauagcauguguaccggcaaauucaagaucgugaaagagaucgcagagacccagcacgggacgaucgucauucgcgugcaguacgagggagacggcuccccuugcaagauucccuucgagauaauggaccuggagaagcggcacguacucggccgccugaucacugucaacccgaucgugacugagaaggacagccccguuaacaucgaagcagaaccgcccuucggcgacucuuacaucaucaucggugucgagccgggccagcugaagcucaacugguucaagaaagggagcaguaucggccagauguucgagacaacgaugcgcggcgccaagcggauggccauccugggugacaccgcaugggacuucgguucguuagggggcguguucaccucaguuggaaaggcccuccaucaggucuucggcgcgaucuauggugcagcauucagcgggguguccuggaccaugaaaauauugaucggcgugaucauuacguggauugggaugaacagccgcucaaccucgcuaucagugagccuggugcucgugggcgucgugacccuguaucugggagccaugguacaagcugacuccggcugcgucgugagcuggaagaacaaggagcucaaaugcggcucuggaaucuucaucaccgacaauguacauacguggaccgagcaguacaaguuccagcccgagagccccaguaaguuggccagcgccauccagaaggcgcacgaggagggcaucugugguauccguagcgucacccgccuggagaaccucauguggaagcagaucacccccgagcuaaaccacauuuugucagagaacgaggugaaacucacgaucaugaccggugacaucaagggaauaaugcaggcgggcaaacggagccuccgcccgcagccuaccgagcugaaauauuccuggaaaaccuggggcaaggcuaagauguuauccaccgagucccauaaccagaccuuccugaucgaugggcccgagaccgccgagugucccaacaccaaccgggccuggaauagccuggagguggaggacuacggcuuuggggucuucacuaccaacaucuggcucaaacugcgcgagaagcaggacguguucugcgacucgaagcugaugagcgccgccauuaaagacaaccgggccguacacgccgacaugggcuacuggauagagucggcgcuuaacgauacguggaaaauggagaaggccagcuuuaucgaggucaaguccugccacuggcccaaaucgcacacccugugguccaauggcgugcuggagagcgagaugaucauacccaagaacuuugccgggcccgugucucagcacaacuaccgcccgggcuaccacacgcagacggccggucccuggcaccucggcaagcuggagauggacuucgacuuuugcgaggggaccaccgugguugugaccgaggacugcggcaaccguggcccuagccugcggacgacaaccgccucugggaaacuuaucaccgaguggugcugucgguccugcacacugcccccgcugagauaucguggggaggaugggugcugguauggcauggagauccguccccucaaggagaaggaggagaaucuagucaauagucuggugaccgccgggcauggucagaucgacaacuucucccucggcgugcuggggauggcccuauuucucgaggagaugcugcggacccgcgugggcacaaagcacgcuaucuugcucguggcuguuagcuucgucacgcucaucaccgggaacauguccuuccgggaucucgggcgcguaauggugauggucggcgcaacaaugacagacgacaucggcaugggagugacguaccucgcgcugcuggccgcguuuaagguccgccccacguuugcagcgggucuauuguuacguaagcucaccucaaaggaacucaugauggccaccaucggcaucgcucuguugagucagagcacgauccccgagaccauuuuggaacucaccgaugcgcucgcucuagguaugauggcacugaagaucguuaagaacauggagaaguaccagcuggccgugacuauuauggcaaucuccugcgugccgaacgcgguuauucugcagaacgccuggaaggugagcugcacgauccuggccgcgguaaguguaaguccucuucugcucaccuccagccaacaaaaagcggacuggaucccccucgcccucaccaucaagggccugaaccccaccgccaucuuccucacuacccugucccgcaccagcaaaaagcgguccuggccgcucaaugaggccaucauggcugugggcauggugagcauauuagcguccagucugcugaagaacgauauccccaugaccggaccccucguagccggcgggcuccugacgguguguuacguccucaccggccgaagcgccgaccuggagcuugagcgggcggcugaugugaagugggaggaccaggcggagaucagcgggagcucccccauauuaagcauuaccaucuccgaggacgguagcaugucgauccgcaacgaggaagaggagcaaaccuugacgauccugauucggaccggcuuacuggucauaucuggggucuucccggugucuaucccugugaccgcugccgcuugguaucugugggaggucaagaagcaacgugccggaguacucugggaugugccaucgccgccacccgucgggaaggcggagcuggaggacggugcauaccggaucaagcagcgcgggauccugggcuacucgcagaucggcgccgggguguacaaggaggguaccuuccacaccauguggcacgugacaagaggugcgguacugaugcaccgcgguaagcggaucgagcccagcugggcggaugugaagaaagaccuggugucauacgggggcggguggaaacuggaaggggaguggaaggagggggaggagguccagguacucgcgcuggagcccgggaagaacccacgagcgguacagaccaagcccggcaucuucaagaccaacacggggacgauuggcgccgucagccuggacuuuucccccggcacaagcgggagccccauuguggaccgcaagggcaagguggucggacuauacggcaacggcguggugacccguucgggggcuuacgucagugccaucgcucagaccgagaaguccaucgaggacaaccccgagaucgaggacgauauuuuccggaaaaagagacugacgaucauggaccugcacccaggagcagggaagaccaaacgguaccuacccgcaaucgugcgagaggccaucaagaggggucugagaacgcugauccuggcgccuacgcgcguggucgcggccgagauggaggaggcccugcggggacugcccauccgcuaccaaacgcccgccauucgcgcggagcacacuggccgagagaucguggaccugaugugccacgccaccuucaccaugcggcuccugagcccugugcgcgucccgaacuacaaccugaucaucauggacgaggcccacuuuacggaccccgccuccaucgccgcgcggggguacauaucuacccgcguggagaugggggaggccgcaggcaucuucaugaccgcgacgccgcccgggucccgggacccguucccccagucgaacgcgccaauaauggacgaggagcgggaaauuccggagcgauccuggaacucuggccacgagugggugacagacuucaagggcaagacugucugguucgugccguccaucaaagcuggaaacgacaucgccgccugccugcgcaagaacggcaagaaagugauacaguugagcaggaagacauuugacucagaguacgucaagaccagggcuaacgacugggacuuuguggugacgaccgauaucagcgagaugggggcgaacuucaaggccgaacgaguuauugauccacgccggugcaugaagcccgugauccugacggacggcgaggagcgcgucauucucgccggucccaugccggucacccacuccagcgcggcccagcggcgcggccgcauugggcguaaccccaagaacgagaacgaccaguacaucuacaugggggagccccuagagaacgacgaagacugugcgcacuggaaagaggccaagaugcugcuugacaacaucaacacgcccgagggcaucaucccguccauguucgagcccgagcgcgagaagguggacgcuauagacggagaguaucgacuuagaggcgaggcccgaaagaccuucgucgaccugaugcgccgcggggaucucccugucuggcuggccuacaagguggccgcggagggcaucaacuacgccgaccgacgguggugcuucgacgggaucaagaauaaucaaauucuggaagaaaacguagaggucgagaucuggacgaaagagggcgagcgcaagaagcucaagccgcgguggcuggacgccagaaucuacagcgacccccuugcgcucaaagaguucaaggaguucgccgccggccggaagucucugacccuaaaccucaucacugaaauggggcgucugcccaccuucaugacccagaaggcccguaacgcccuggacaaucucgcgguguugcacaccgccgaggccggcgggaaggccuacaaccacgccuuaagcgagcuccccgagacgcuggagacccuucuacugcugacccuccuggcaaccgucacgggcgggaucuuccuguuccucauguccgggaaaggcaucgggaagaugacucugggcaugugcugcauuaucacggccagcauccugcuaugguaugcucagauucagccgcauuggauagcagcuuccauaauccuggaguuuuuccuuauugugcuccugaucccagagcccgagaagcagcggacgccucaagacaaccagcugaccuacguggucaucgcgauccucacgguggucgccgccaccauggccaaugagaugggguuccuggagaagaccaaaaaggaccuuggccucggcuccaucaccacacaggagagcgaguccaacauacuggauaucgaccugcggccggcuucugcguggacacucuacgcagucgcgacgaccuuugugacgccuaugcugcgccacucaaucgaaaacagcagugugaacguaagccuaacugccauagcaaaccaggccaccgugcucauggggcugggaaaaggguggccccugagcaaaauggacaucggcguuccccuccuggccauagggugcuacagccaggucaacccaaucacccugacugccgcccuccugcuccuaguggcgcacuaugcgaucauaggccccggccugcaggccaaggccacucgggaggcccagaaaagggcggcagcaggaaucaugaagaacccuaccguggacggcaucaccgucauugaucuggagccuaucccguacgacccuaaauucgaaaaacaauugggccaggucaugcugcugaucuugugcgucacacagguguuaaugaugcggaccacuugggcccugugcgaggcccuuacccuggcgacggggcccaucuccacccugugggagggcaaucccggaagauucuggaauaccaccaucgccgugagcauggccaacauauuccgcggcuccuaccucgcgggggcggggcugcuguucaguaucaugaaaaacacgacgaacacaaggagggggaccggcaacaucggcgagacgcucggggagaaguggaaguccagacugaacgcgcuggguaagagcgaguuccaaauauacaagaaaucggggauccaggagguggaccgcacccucgccaaggaggggaucaagcgcggugaaaccgaccaccacgccgucucucgcggcuccgccaagcugcggugguucgucgagagaaacauggugacccccgagggcaaggucguagaccuggggugcggccgcgggggcuggagcuacuacugcgggggccucaagaacguccgcgaggucaagggccucaccaaggguggccccgggcacgaagaacccauccccauguccacauacggcuggaaccuggugcgucuacaguccgggguggacguguucuuuaccccgcccgagaagugcgacacccuacugugcgacaucggcgaaaguagccccaaccccacgaucgaggcgggccgaacccugcgggugcuaaaccugguggaaaacuggcugaauaacaacacccaguucugcaucaagguucugaacccguacaugcccucagugaucgagaagauggagacucugcagcgcaaguacgggggcgcccucguaagaaacccgcuaucccgcaacaguacccaugaaauguacugggucucgaacgcaacggggaacaucgugagcuccguuaacaugaucagccggaugcugaucaaccguuuuaccaugaagcacaagaaggccacguacgagccggacgucgaucugggcagcgggacccgaaacaucggcaucgagucggagauucccaacuuagacaucauaggcaagcgcauagagaagaucaagcaggagcacgagaccuccuggcacuacgaccaggaccaccccuauaagaccugggcauaccacggaagcuacgagaccaagcagacuggcucggcgagcuccauggugaacggggugguccgucugcugacgaagcccugggauguugugccaauggucacucagauggccaugacagacaccacgcccuuuggucaacagcggguguucaaggaaaagguggauacgcggacccaggagcccaaggagggcaccaagaagcucaugaagaucacggccgaguggcuguggaaggagcucgggaagaagaagacaccccgcauguguacucgcgaagaguucacucggaagguccgcagcaacgccgcacucggagcaaucuuuacggacgagaacaaguggaaauccgcccgugaggccguugaggacgggcgcuucugggagcugguggaccgggagcgaaaccugcaccucgagggcaagugcgagaccugcgucuacaacaugauggguaaacgggagaagaagcugggcgaguucggcaaagccaaggggaguagggcgauaugguauauguggcucggcgcccgguuccuggaguucgaagcccucgguuuccugaacgaagaccauugguucucgaggggcaacagccucagcgggguggaaggcgagggucugcaccgguuaggguauauccuccgagauguguccaagaaggagggcggggccauguacgccgacgauaccgcgggcugggacacucgcaucacauuagaggaccugaagaacgaggagauggugaccaaucacaugaagggggaacacaagaaacucgccgaagccauuuuuaagcugacuuaccagaacaaagugguccgcguacaacggccuacgccccggggcacggugauggauaucauuagccggcgcgaccagcgaggcuccgggcaagucggcacguacgggcugaacaccuucaccaacauggaggcgcaacucauccggcagauggagggagagggcaucuucaaguccauacagcaccuuacugugaccgaggagaucgccgugcagaacuggcuagcgcgcgucgggcgggaacgccucucacggauggcaaucucuggcgacgacugcguagugaagccuaucgaugaccgcuucgcguccgcccugaccgcucugaacgacauggggaagguccggaaggacauccagcaaugggagcccagccgcggcuggaacgacuggacucaggugccguucugcucgcaccacuuccacgagcucgugaugaaggaugggcggguccuggugguuccaugucgcaaccaggacgagcugauagggagggcgcgcaucagccagggcgccggauggucccucaaggaaaccgccugccuggguaagucuuaugcccagauguggacccugauguacuuccaccggcgcgaucuccggcuggccgccaacgccauaugcuccgcagucccuagucacuggguacccaccucccgcacuacguggagcauccacgccaagcacgaguggaugacgaccgaggauaugcuggcaguguggaaccggguuuggauccaagagaauccguggauggaggacaagacccccgucgaguccugggaggaggugcccuaccucgggaagagagaggaccaauggugcggcagccugaucgggcugaccagccgggccacgugggcuaagaacauccagaccgcgaucaaccagguacgcucccugauugguaacgaggaguacaccgacuacaugccaagcaugaagcgcuuucggcgggaggaggaggaggccggcgugcugugguga

SEQ ID NO: 25160 - RNA, 9876 nt, Artificial Sequence
  derived and/or modified CDS sequence (opt11) from DENV-2__EU482546__SS-prME
acugccggugucaucguuaugcugauccccaccgucauggcguuccaccuuaccaccagaaacggagagccccauaugaucgugggccgccaggagaaggggaagaguuugcuguucaagaccgaggacggcauaaacaugugcaccuugauggcuaucgaccugggggagcugugcgaggacaccauaaccuacaaaugcccucuacuuaagcaaaacgagcccgaggauaucgacugcuggugcaacagcaccagcacauggguaaccuacgggaccugcaccacgacgggcgagcaccgccgcgaaaagagauccgucgcccucgugccccaugucgggaugggucucgaaacccggaccgaaaccuggaugagcucugagggggccuggaagcacgugcaaaggaucgagacguggauacugcggcacccgggguucaccauaauggcggccauccuagcguauacgaucgguacuacgcacuuucagcgcgcccucaucuucauccuguugacagccguagcccccucgaugaccaugcgaugcaucggaaucuccaaccgcgacuuuguggaaggggugagcggcggcucuugggucgauaucguccucgagcacggcucuugcguuaccacgauggcgaagaacaaacccacucuggacuucgaacugaucaagaccgaagccaagcagccagccacccuccggaaauauugcaucgaggccaagcugacgaauaccaccaccgaguccaggugcccgacgcaaggcgagcccagcuuaaaugaggaacaggacaagcgguucaucugcaagcauucaaugguggaccguggcugggggaauggcugugggcuguucggcaagggcgggauagugaccugcgcuauguucacgugcaagaaaaacauggagggcaagguaguccagccagagaaccuggaguacacaauugucaucaccccccacaguggagaggagcaugcagugggcaacgauaccgggaagcacggcaaggaaaucaagaucaccccgcaguccagcauuaccgaggccgagcugacaggguacggcacagugaccauggaaugcagcccccggaccggccucgacuucaacgagaugguccuauugcaaauggaggauaaggcguggcucguacaccgacagugguuccuggaucugccccuccccuggcugcccggagccgacacccagggaagcaacuggauccagaaagaaacgcuggugaccuucaagaacccucacgcuaagaagcaggacgucgugguccucgggucccaggagggcgcgaugcauaccgcccugaccggagccacggagauccagaugucgaguggcaaccuccuguucaccggucaccugaagugucggcugcguauggacaagcuccagcugaaggggauguccuacucaaugugcacugguaaauucaagauugugaaggaaaucgccgaaacgcagcacgggacgauagucauccggguacaguacgagggcgacggcuccccauguaagaucccauucgaaaucaccgauuuggagaagaggcauguacucggucggcuaaucaccgugaacccgauuguuaccgaaaaggacuccccugugaacaucgaggccgaaccaccuuucggcgacuccuacaucaucaucgggguggagccuggccagcuuaagcuuaacugguucaagaaggguagcucgaucggccagauguucgagacgaccaugcgcggcgcgaagagaauggccaucuuaggcgacaccgccugggauuuugggagccucggcggggucuucaccuccaucgggaaggcucuccaccagguguucggggccaucuauggcgcagccuucagcggaguguccuggacgaugaagauccugaucggcgucauuauaacuuggaucgggaugaauagucgguccacuagccuguccgugagcuuggugcucgugggcgugguaacccuguacuugggggccaugguucaggcagacuccggcugcgugguuucauggaagaacaaggaacucaagugcggcuccgggaucuucaucacagacaacguacauaccuggaccgagcaguauaaguuccagcccgagagccccagcaaacuggccuccgccauccaaaaagcgcacgaggaaggcauaugcggaauccgcagcgugacccgacuggagaaccucauguggaagcagauaacacccgaguuaaaccacaucuugagcgagaacgaggugaaauuaacuaucaugaccggcgacaucaaggggaucaugcaggccggcaagcgcagccugcguccacagcccacggagcugaaguacuccuggaaaacgugggguaaagccaagauguuaagcacggagucccacaaccagaccuuccuaaucgauggacccgagaccgcggaguguccgaacacaaaccgcgcauggaacucgcuugaaguagaggacuacgguuucgggguguuuaccaccaacaucuggcuaaaauuacgggagaagcaggacgccuucugcgacuccaagcugaugagcgccgccaucaaggacaaccgcgcggugcacgccgacaugggauacuggauugaguccgcccucaacgauaccuggaagauggagaaggccucguuuaucgaggucaaguccugccacuggcccaaaucgcacacccugugguccaauggugugcuugaauccgagaugaucauucccaagaacuuugccgggccggugucccagcacaaccaccggccuggcuaccauacgcagaccgcggggcccuggcaucucggcaagcuggaaauggacuucgacuucugcgagggaacaaccgucguugugaccgaggacuguggcaacagaggccccagcuuacggacaacaaccgcuuccgggaaacucaucacugaguggugcugccgaucguguacccugcccccgcugcgguaccgcggcgaggacggaugcugguauggcauggagauccggcccuugaaagagaaggaggagaaccuggucaacagucucgugaccgccgggcacggucaaauugauaauuucucccucggcgugcuggggauggcccuguuccucgaggagauguugcgcacccgggugggaacgaagcacgcgauucugcucguggccgugagcuucgucacccugauuaccgggaacaugaguuuccgugaccugggacgagugauggucauggucggggccaccaugaccgacgacaucggcaugggcgucaccuaccucgcccugcuggccgccuucaaggugcgacccaccuucgcagccgggcuacuguuaagaaaauugacuucaaaggagcugaugauggccaccaucgggaucgcccugcucucccagagcaccauccccgagacgauccuggaguuaaccgacgcguuggcucuggggaugaugguccugaagauaguccggaacauggagaaguaccagcuggcggugaccaucauggccaucuccugcgucccgaacgcugugauccugcagaacgcguggaagguaagcugcaccauacuggcggcggucuccgugagcccccuccuguuaaccuccagccagcaaaaggccgauuggaucccucucgcgcugacaaucaagggucuaaaccccacggccauauuccucacuacccuuucccgcacaucuaagaagcgauccuggccgcugaacgaagccaucauggccgucgggauggucagcauccucgccuccagccugcugaagaacgacauucccaugacgggacccuugguggcgggcggguuacugacagucuguuacgugcucaccggccggagcgccgaccuggaacuggagcgggccgcggacgugaagugggaagaucaagcagagauuuccgggagcagucccauccucuccaucaccaucucugaggauggcuccauguccaucaagaacgaggaggaggagcagacgcuuaccauccugauccgcacuggacuacucgucauuagcgggguguucccuguguccauucccaucacagccgccgccugguaccucugggaggucaagaagcagagagccggcgugcucugggauguucccagcccgccgcccgucgguaaggccgaacuggaggacggagcguacaggaucaagcagcggggguuccugggcuauucccagauaggagccggcguguacaaagagggaaccuuccacacgauguggcacguuacccgcggggccguccucaugcaccgcggcaagcgcaucgagcccagcugggccgacgugaagaaagaccuuaucuccuacggcggcggcuggaagcuggagggggaguggaaggagggcgaggaagugcagguccucgccuuggagccugggaagaacccgcgggcggugcaaaccaagcccgggaucuucaaaacaaauacggguaccauaggcgccgucagucucgacuucuccccaggcaccagcgggucccccaucguggaccgaaagggaaaggugguggggcucuacggcaacggcgucgugacccggaguggggcuuacguguccgccaucgcgcagacggaaaaguccaucgaggauaaccccgagaucgaggacgauaucuuucgcaagaagcggcucaccaucauggacuuacaccccggggcugggaagacgaagcgcuaccuccccgccauuguccgggaggccauaaagcggggccugcggacccugauccuggccccgacgcgcguggucgccgcggagauggaggaggcucuccgcgggcugccuauccgguaucagacccccgcaauccgcgccgagcauaccggacgcgaaauaguggaccugaugugccaugcaacauucacgaugcgacuccuuagccccgugagagugccgaacuacaaucugauuaucauggacgaggcucacuucaccgaccccgcauccaucgcugcacgcggcuauaucucaacgcgggucgagaugggggaggcugccggcaucuucaugacugccaccccgcccgggucacgcgauccguuuccucagagcaacgcacccaucauggacgaggagcgggagaucccagagcgcuccuggaacuccggccacgagugggugacugacuucaaggggaagacgguaugguucguuccguccaucaaggcgggcaaugacaucgccgccugccuccguaagaacggcaagaaggugauccagcucucgcgcaagaccuucgacagugaauacgugaagacgcgggcgaacgacugggacuucgucgugacuaccgacaucagcgagaugggcgccaacuucaaagcagagagggugaucgauccccggcgauguaugaagcccguuauccugacggauggcgaggagcgggugauccucgccgggcccaugccgguuacacauucgucagccgcucagcgccgggggcgcaucggccguaaccccaagaacgagaacgaccaguacaucuacaugggcgagccgcuggagaacgacgaagacugugcccauuggaaggaggcgaagaugcugcuagacaacauuaacacacccgagggcaucaucccauccauguucgagcccgagcgggagaaggucgacgccaucgauggggaauaccgccugagaggcgaggccagaaagaccuuuguugaccuuaugagacgcggugaccuccccguguggcuggccuacaagguugcggcugaaggcaucaauuacgcggaccggaaauggugcuucgacgggaucaaaaacaaccagauacuggaggagaauguggaaguggagaucuggaccaaggagggcgaacggaagaagcucaagccgcgguggcuagaugcccgcaucuacucugacccgcuagcacucaaggaauucaaggaguucgcggccgggcggaagucccugacgcugaaccugaucaccgagauggggcgccugcccaccuucaugacucagaaggcccggaaugcucuggacaaccucgccguccugcacacggcggaggccggcgggcgcgccuacaaccacgcccugagcgagcucccggagaccuuagagacgcuacuacugcugacccuucuggccacugugaccggcggcauuuuccuguuucucaugagcgggaagggaaucgggaagaugacucugggcaugugcuguaucauaaccgcuucgauccuccucugguacgcccagauccagccgcacuggaucgccgccuccaucauccuggaguucuuucugaucguccuccugauacccgagccugaaaaacagcggacgccccaagacaaccagcucacuuacguggugaucgccauccugacaguuguggcagcgaccauggcaaacgagaugggguuccuagagaagacgaagaaggaccugggcuuaggauccaucacgacccaagaaagcgagucuaacauccuggacauagacuugcgcccggccagcgccuggacacucuacgcgguugccacgacauuuguuacccccaugcugcggcauucaaucgagaacagcucugugaacgugagccugaccgccaucgccaaccaggcgacagucuuaaugggacuaggcaagggguggccccucagcaagauggacaucggcgugccgcuccuggccaucggguguuacucccaggugaaccccaucacacuuaccgccgcgcuccuacugcucgucgcccacuacgcgauaaucggacccggccuccaggcuaaggccacucgcgaggcccagaagagagccgcggccgggaucaugaagaaccccaccguggacggcaucacugugaucgaccuggagccaaucccauaugaccccaaguucgagaagcagcucgggcaggucaugcugcuaauacuuugcgugacccaggugcuuaugaugcgcacgaccugggcacuuugcgaggcccucaccuuggccaccggcccuauaaguacacuaugggaggggaacccaggccgguucuggaacaccacgauugcggucaguauggccaacaucuuccgcggcagcuacuuggccggggccggccuccuguucagcaucaugaagaacacaacaaacacccgccgggggacaggcaauaucggcgagacccucggagagaaguggaagucccguuugaacgcgcugggaaagagcgaguuccaaauauauaaaaaguccggcauacaagaagucgaccggacccucgccaaggagggcaucaagcgcggugaaaccgaccaccaugcagucagccggggcucugccaaauuacggugguucgucgaacggaacaugguaacuccugagggcaagguggucgacuuagggugcggucgcggggguuggagcuacuacugcgggggacuaaagaacgugcgggaggugaagggauugaccaaaggcggccccgggcaugaggagcccauccccauguccaccuacggcuggaaccuaguccgucugcagagcgggguggacguguucuucaccccgcccgagaagugcgauacguuacugugcgacaucggcgagagcucccccaaccccacgaucgaggcaggccguacccuccgcguccugaaccugguggagaauuggcucaacaauaacacgcaguucugcaucaaggugcugaacccguacaugccaagcguaauugagaagauggaaacacuucagcgcaaguacgggggcgcgcucgugcgcaauccccuuucccggaacagcacucacgagauguacuggguaucuaacgccaccgggaacauugucagcuccgugaauaugaucagcagaauguugaucaaccguuucaccaugaagcacaagaaggcuaccuacgagccggacguggaccugggcuccggaacuagaaacaucggcaucgaauccgaaaucccuaaccucgacauuauugguaaaagaaucgaaaagaucaagcaggagcacgagacaucguggcacuacgaccaggaccaccccuacaagaccugggccuaccacgggucguacgagaccaagcagacgggcagugccagcuccauggucaaugggguggugcggcugcugaccaagccuugggacgucgugccgauggugacccagauggcgaugacugacacgacgcccuucggccagcagcgcguguucaaggagaagguggacacccggacccaggagcccaaagagggcacgaagaaauugaugaaaaucaccgccgaauggcuguggaaggaguuagggaagaagaaaacgccucgggugugcacccgcgaggaguucacgagaaaaguccggagcaaugccgcccucggcgcaauauucacggacgagaacaaguggaagagcgcacgagaggcaguggaggacggccgguucugggaguuaguggaccgcgaacggaaccugcaccuagagggcaagugcgagaccugcgucuauaacaugauggguaagcgcgaaaagaagcuuggcgaauucggcaaggccaaggguucgcgcgccaucugguacaugugguugggcgcgcgcuuccucgaguucgaggcccugggguuccuuaacgaggaccacugguucaguagaggcaauagccucagcgggguggaaggcgagggccugcaccgccugggguauauccuccgagacguaggcaagaaagaggguggcgccauguacgccgacgacacggcggggugggacacgcgcauaacccuggaggaucugaagaacgaggagauggugacgaaccauaugaaaggagagcacaagaagcucgcagaggccaucuuuaagcugaccuaccagaacaaggugguccgggugcagcgcccuacgccgcggggcaccguaauggacaucaucucccgccgggaccaacgcggaucgggacaggucggcaccuacgggcugaacacuuucacuaauauggaggcgcagcuuauccgucaaauggagggggaaggcaucuucaaguccauucaacaccugaccgccaccgaggagauugccguucagaacuggcuugcucgagugggcagggagcggcuuagccgcauggcgaucuccggggacgacugcgucgugaagcccaucgacgaccgauucgccagcgcccugaccgcccugaacgacauggguaaggugcgcaaggauauccaacagugggagcccucccggggguggaacgauuggacgcaggucccguucugcucucaccacuuccacgagcuggugaugaaggacggccguguccuugucgugccaugccggaaccaggacgaacugauaggccgggcgcggaucucccagggagcaggcuggagccucaaggagacggcaugccuggggaaguccuacgcgcagauguggacccugauguacuuccaucgccgggaccuccgccuggcugcaaacgcaaucugcagcgccgugccgucccacugggugcccacaagccggaccacgugguccauccacgcgaagcacgaguggaugaccaccgaggauaugcuggcggucuggaaccgcguguggauucaggagaacccauggauggaggacaagacccccgucgagagcugggaagaggugcccuacuuggggaagcgggaggaccaauggugcggcucccugaucggccuuaccagccgcgccacgugggccaagaauauccagacggccaucagccaaguuagaucccucauagggaacgaggaguacaccgacuacaugccaagcaugaagcgguuccgccgggaggaggaggaggccggcguauugugguga

SEQ ID NO: 25161 - RNA, 9876 nt, Artificial Sequence
  derived and/or modified CDS sequence (opt11) from DENV-2__EU482550__SS-prME
accgccggugugaucaucaugcucauccccaccgccauggcguuccaccucaccacccgcaacggggagccccauaugaucgugggucggcaggagaaagggaagucccugcuguucaagacugaggacggcgugaacaugugcacgcucauggccaucgaccugggugagcugugugaagacacaaucacauacaagugcccccuccuccggcagaacgagcccgaggacaucgacugcuggugcaacagcacaagcaccugggugaccuacgggaccuguaccaccacgggggagcacaggcgcgagaagcguuccgucgcccuggugccccacguugggaugggucucgagaccagaaccgagaccuggaugagcagcgagggggccuggaagcacguccaacguauagagaccuggauccugcgccauccgggcuucaccaucauggccgcgauccucgccuauaccaucgggaccacccacuuccagcgggcgcucaucuucauccugcugaccgccguggcgccaagcaugaccaugcgcugcaucggcaucucuaaccgggacuucguggagggggugagcggaggcuccuggguagauauugugcucgaacacgggucuugugugaccacgauggccaagaacaagcccacccuggacuucgaacugaucaagacagaagccaagcagcccgcaacccuccgcaaguauuguauugaggccaagcugacgaacaccaccacagagucccggugcccgacgcaaggcgaacccagccugaacgaggagcaagacaagcgcuucaucugcaagcacuccaugguagaccgggggugggguaauggcuguggccucuucggcaagggcgggaucgugacaugcgccauguuuacgugcaagaagaacauggagggcaaggugguucuacccgagaaccuggaguacaccaucguaaucaccccacacagcggggaggagcaugccgucggcaacgacaccgggaagcacggcaaggaaaucaagaucacuccgcagucuagcaucaccgaggccgagcucacgggguacggcacugugaccauggaaugcucuccccggaccggucucgacuucaaugagauggugcugcuccagauggaggacaaggcuuggcugguccaccggcagugguuccuagaccucccacugcccugguuaccgggugccgacacccagggcagcaacuggauccaaaaggagacgcucgugaccuucaagaacccccacgcgaagaagcaggacguggucgugcuggggucccaggagggugccaugcacaccgcccugaccggggccacggagauccagaugagcagcggcaaccuacuguucaccgggcaucugaagugccggcuccggauggacaagcugcagcugaaggggauguccuacagcauguguaccggcaaguucaagaucgucaaagagaucgccgaaacccagcacggaacgaucgugauccgcgugcaguacgaaggcgacggaucaccaugcaagauccccuuugagaucauggaccucgagaagcgguacguccucgggcgccugauaaccguuaacccuaucgugaccgagaaagacagccccgucaacaucgaggcggagccgcccuucggcgacuccuacaucaucaucggaguggagccgggccaguuaaagcuuaacugguuuaagaagggcagcuccaucggccagauguucgagaccacgaugcgcggcgccaagcggauggccauccugggagacaccgccugggacuucggcagccuugggggcguguucaccuccauagggaaggcccugcaucaggucuucggagcgaucuacggcgccgcguuuagcgggguguccuggaccaugaagauccugaucggcgucaucaucacauggaucggcaugaauucacgcagcaccagccuguccguuucucucguguuagucggcgucgugaccuuguaccucggggugaugguccaagccgacuccggcugcguggugagcuggaaaaacaaggagcugaaguguggcuccgguaucuucaucaccgacaacguccauacguggaccgagcaguauaaguuccaacccgagagucccucuaagcuggcgagugccauccaaaaggcccacgaagaggguauuugcgguauccggagcgugacccgcuuggaaaaccugauguggaagcagaucacgcccgagcugaaccacauccucagugaaaaugaagugaaauugacgaucaugacgggcgacauuaaagggauuaugcaggccggcaagcggagccugaggccgcaacccaccgagcugaaguacuccuggaagaccugggggaaggccaagaugcuuagcacggagagucacaaccaaaccuuccugaucgacgggcccgaaaccgcggagugcccuaacaccaaccgggccuggaacucgcucgaaguggaggauuacggcuucgggguguucucuacgaacaucuggcucaagcuccgcgaaaagcaggacguguucugcgacaguaagcucauguccgccgccaucaaggauaaccgggccguacacgcugacaugggcuacuggaucgagagcgccuuaaacgauaccuggaagauggagaaggccucauucaucgaagucaagagcugccacuggccgaagucccacacccucuggagcaacggugugcucgagagcgagaugaucauacccaagaacuucgccgggcccgucagucagcacaacuacagaccgggcuaucacacccagaccgccgggcccuggcacuuagguaagcuagagauggacuucgacuucugugaggggacgaccgugguggucaccgaagacugcggcaaccggggccccucccuccgcaccacgaccgcguccgggaagcugaucaccgagugguguugccguagcugcacacuccccccgcuccgcuacaggggcgaggacgggugcugguacggcauggagauucgcccccugaaggagaaggaggaaaaucugguuaacucccuggugacggccgggcacggccagaucgacaacuucagccugggaguccuggguauggcucucuuccuggaggagaugcugagaacucgcgugggaaccaagcacgcuauucuccugguagcggucaguuucgugacccucaucacggggaauaugagcuuccgggacuugggccgcgugauggucauggugggggccaccaugaccgaugauauuggcaugggcgugaccuaccuggccuugcucgccgcguuuaagguccgccccacguuugcggccggccugcugcuccggaaguugaccucaaaggaauugaugauggccacuaucggcauagcacuccucagccagaguaccauacccgaaacgauccuggagcucaccgacgcccuggcguuagggaugaugguauuaaagaucgugcgcaacauggagaaguaccagcuugccgucaccaucauggcuauccugugcgugccgaacgccgugauccuacagaaugccuggaaggucagcugcaccauacucgccgccgugucugucagccccuuacuccugacguccagccaacagaaggcggacuggaucccccuggcccucaccaucaagggccugaacccaaccgcgaucuuccuaacaacacucucccggaccucaaagaagcgcuccuggccgcugaacgaggccguuauggcugugggcauggucucaauacuggccuccagccuccuuaagaacgacauucccaugaccgggccccugguggcuggcgggcuccugacgguuuguuauguccucacgggccggagcgcggaccucgagcuggagcgcgcggccgacgugaagugggaggaccaggccgagaucuccgggagcucccccauccugagcauaacgaucuccgaagacgggagcauguccauaaagaaugaggaggaggagcagacccucaccauccugauacggacgggccugcucgugaucagcggggucuucccgguguccauccccaucaccgcugcggcuugguaccuaugggaggugaaaaagcagcgcgccggcgucuuaugggacgugcccucgccgccgccgguggggaaagccgagcucgaggacggcgccuaccguaucaaacaacgcgggaucuuugguuacucacagauuggcgccggggucuacaaggagggcaccuuucacaccauguggcacgugacccgcggggccgugcugaugcaucgcggcaagaggaucgagcccagcugggccgacguaaagaaggacuugaucuccuacgggggcggcuggaagcucgagggggaguggaaagagggcgaggagguccaggugcuggcccuggagcccgggaagaacccccgcgccgugcagacgaagccgggucucuucaagaccaacaccgggaccauaggagccgugagccuggacuucuccccagggacgucugggucccccauuguggacaggaagggcaaggucguggggcuguauggcaacggcguggucacccgaagcggggccuacguguccgccaucgcccagacggagaaguccaucgaggacaaccccgagaucgaggaugacauauuccggaagaagcgccucaccaucauggaccugcacccaggcgcggggaaaacaaaacgguaccugcccgccaucguacgcgaggccaucaagcggggacugcgcacucugauucuggccccgacccgcgugguggcugcggaaauggaagaggcccugcggggguugccuauccguuaccagacccccgccauacgggcggagcacacgggccgcgagauuguggaccugaugugccacgccaccuuuaccaugagacugcucaguccugugcgcgugcccaacuacaaccugaucauuauggacgaggcgcacuucaccgaccccgccuccaucgccgcccggggauacaucagcacgcgcguggagaugggggaggcggcgggcauuuuuaugaccgccacgccgcccgggucccgggacccguuuccccagucuaacgcacccaucauggacgaggagcgcgaaaucccggagcggaguuggaacagcggccaugagugggucaccgacuucaaggggaagacggugugguuugugccuucuaucaaggcgggaaacgacaucgcggccugccugcguaagaacgggaagaaggucauccagcucucgcgaaagaccuuugacucggaguacgugaagacccgggccaacgacugggacuucguggucacaacggauauuagcgaaaugggggccaacuuccgggcggagcgcgugauugacccccggcgcugcaugaaacccgugauccugaccgacggcgaagagcgugucauccuggcggggcccaugccugugacccacuccagcgccgcccagcgccgcggccggaucggucggaacccaaagaacgaaaaugaccaguacaucuacaugggcgagccccucgagaacgacgaggacugcgcccacuggaaggaggccaagauguugcuggacaauauuaacacaccagagggcaucaucccguccauguucgagccggagcgggagaagguggacgcgaucgauggggaguaccgcuuacggggcgaggcccgcaagacguucgucgaccugaugaggcggggugaccugcccgugugguuggccuaccgaguggccgccgagggcaucaacuacgcggaccgccgguggugcuuugaugggaucaagaacaaccagauccuggaggagaacgucgagguggaaaucuggaccaaggagggggagcgcaagaagcugaagccgagguggcucgaugcccgcaucuacagugauccccuggccuuaaaagaguucaaggaguucgccgcaggucgaaaguccuuaacccucaaccugauuacggagauggggcguuugcccacguucaugacccagaaggcccgagacgcccuggacaaccuggcgguccuucacaccgccgagguuggcgggcgcgcguacaaccacgcccugagcgagcucccggagacuuuggagacgcuccugcuacugacccuucucgccacagugaccggcggaaucuuccuguuccugauguccggaaagggcaucgggaagaugacccucggcaugugcugcaucaucaccgcgagcauccugcuaugguacgcccaaauucagccacacuggaucgccgccucgaucauccucgaguucuuccugaucguccuacucauacccgaacccgagaaacagcggacgccccaggacaaccagcugaccuacguggugaucgccauccugaccgucguggccgcaacgauggcgaacgagaugggguuccucgagaagaccaagaaggaucugggccugggcagcaucaucacucaggagagugaguccaacauccucgacaucgaccuucgcccggccuccgccuggacucuguacgccguugccacgacuuucguuacccccaugcuccgucauaguaucgagaacucuucggugaacguaagccugaccgcgauagccaaccaagcuacgguccugaugggacucggccgcggguggccccuguccaagauggacaucggcgugccccuacucgccauuggaugcuacagccagguuaacccgauuacccugacggcggcccuccuacugcuggucgcccacuacgcaaucaucggacccgguuuacaggccaaggcuacccgcgaggcccagaagcgggcagccgccggaaucaugaagaacccuacgguugacggcaucaccgugauagaucuugagccuaucccguaugaccccaaguucgagaagcaguugggccaggucauguugcuaguccugugcgugacucagguccucaugaugcgcaccacgugggcgcugugcgaagcccugacccuagcaaccggccccaucuccacccugugggagggaaaccccggccgguucuggaacacgaccaucgccgugagcauggcgaacauauucagaggcucguaccuggcgggcgccggccuccuguucagcaucaugaaaaauaccaccaacacacgucgcgggaccggcaauaucggcgaaacccugggggagaaauggaagucccggcucaacgcccucggcaagucagaguuccaaaucuacaagaaguccgggauccaggagguggaccgcacccuggccaaggagggcaucaagcgcggggaaacggaucaccacgccgucagccgugguuccgccaagcuccggugguucguggagaggaacauggugaccccggaagggaaggucguagaccuggggugcggccgcggaggguggagcuacuacugcggcggcuugaagaacguccgcgaggucaagggguuaaccaaaggcgggcccgggcacgaggagcccaucccaauguccaccuacggcuggaaucuggugagacuucagagcgggguggacgucuucuucacuccgcccgagaagugcgacacccuccugugcgacaucggcgagagcucccccaaccccaccaucgaggccggccgcacacugcgugugcuaaaucugguggagaacuggcuaaacaacaacacgcaguucugcauuaagguccugaacccguacaugcccagcgugaucgagaagauggagacccugcagcgcaaguaugggggagcccugguccggaacccucugucccgaaacucuacccacgagauguacugggucuccaacgccaccgggaacaucgucagcuccguaaauaugauuagccgcauguugauaaaccgguucaccaugaagcacaagaaggcaacguacgagccggacgucgacuuaggcuccgggacccgcaacaucgggaucgagaacgaaauccccaaccuugacaucauaggcaagcggaucgagaaaaucaagcaggagcaugagaccaguuggcacuacgaccaggaccacccuuacaagaccugggccuaccauggguccuacgaaacgaagcagaccggcuccgccuccucaauggugaacgggguggucaagcuccugaccaagcccugggauguugugccuauggucacccagauggccaugacagacaccacccccuucggccagcagcgcguguucaaagagaagguagacacacggacucaggagcccaaggagggcaccaagaagcucaugcgcauaaccgccgaguggcucuggaaggagcuggggaagaagaagacgccccgcaugugcacgcgcgaggaguucacccggaaaguccgcuccaaugccgcacugggugccaucuucaccgacgagaacaaguggaaguccgcccgggaagccguugaggacagccgcuucugggagcucgucgaccgggagcgcaaucugcaucuggaagggaagugcgagaccuguguguacaauaugaugggcaagcgcgagaagaagcucggggaauucggaaaggcgaagggcucucgcgccaucugguacauguggcuaggggcccgguuucuggaguucgaagcucucgguuuccugaacgaggaccacugguuuucccgcggcaacucacugagcggcguggagggggagggccuccacaagcugggauacaucuugcgggacguaaguaagaaggagggcggcgcgauguacgcggacgauaccgccgggugggacacccgaauaacccuugaggaucugaagaaugaggagauggugaccaaccacaugaagggcgagcacaagaagcuggcugaggcaaucuucaagcucacauaccagaacaaggucguccgggugcaacgcccaacgccacgggggaccgugauggacaucaucagccggaaggaccagcgcggcuccggccagguugggaccuacggcuugaacacguuuaccaacauggaggcccagcugauccggcagauggagggggagggcaucuucaagagcauacaacaccucaccgugacagaggagaucgccgugcagaauuggcuggcccgcgucggccgggaacgccugucccggauggccauuagcggggacgacugcguggugaagccccucgaugaccgcuuugcguccgcgcugacggcacugaaugacaugggcaaaguccggaaggacauccagcaaugggagcccagccgcggguggaacgacuggacccaggugccguuuugcagucaccauuuccacgagcucguuaugaaggauggccggguccugguggugcccugccgcagccaggaugaguuaaucgggcgggcccgcauuucccagggcgccggcuggagccucaaggagaccgccugccuggggaaguccuacgcgcagauguggacguuaauguauuuccaccggcgcgaccucagacuggcugccaacgcaaucugcagcgccguucccucccacugggugcccacgagccgcaccaccugguccauccacgcgaagcacgaguggaugacuacugaggauaugcuggcuguguggaaccgggucuggauccaggagaacccguggauggaagacaagacgcucguggaaagcugggaagaggugcccuaccuuggcaaacgcgaggaccaguggugugggagccugaucggucucacgucccgggcgacaugggccaagaacauccagaccgcgauuaaccaaguccggagccugauugggaaugaggaguacacggacuacaugcccuccaugaagcgcuuccggaaggaggaggaggaggccggcgugcugugguga

SEQ ID NO: 25162 - RNA, 9876 nt, Artificial Sequence
  derived and/or modified CDS sequence (opt11) from DENV-2__EU482551__SS-prME
acugcgggagugauaauaaugcuaaucccgacggcuauggcguuccaccuaaccacacggaacggcgaaccacacaugauaguaggacggcaggaaaaagggaaaagccuacucuucaaaaccgaagacggcguaaacauguguacguugauggcaauagaccucggcgaacuaugcgaagacacaaucacauacaaaugucccuuacuccgccaaaaugaaccggaagauauagacugcuggugcaacuccacaagcacauggguaacauacgggacuugcacgaccacaggggaacacagaagagagaaaagaucgguagcacugguaccgcacgucgggauggggcuggaaacaagaacggaaaccuggaugagcucugagggcgcguggaaacacgugcagcggaucgagacuuggaucuuacggcacccaggcuucaccacaauggcagcaauacucgcauacaccauaggcaccacucauuuccagcggguacucauauuuauccuacugacagccgucgcgccgaguaugacgaugcgaugcauagggaucucaaaucgggacuuuguagaaggugugucagguggcagcuggguagacauuguacuagaacaugggucgugcgugaccacaauggccaaaaacaaacccacccuagacuucgaacugaucaaaaccgaagcaaaacaaccggcgacauugcgaaaauacuguaucgaggcgaaacugacuaacaccaccacugaaagcagaugcccuacgcagggugaaccgucacuaaacgaagaacaagauaaaagguucauuugcaaacacagcauggucgaccgaggguggggaaauggaugcggccuuuucggaaaaggaggaauagucacgugcgcgauguucacuuguaaaaagaacauggaggggaaagucgucuugccagaaaaucuggaauacaccauagucauaaccccgcauagcggggaggaacacgcagugggaaacgacaccggcaaacacgguaaggaaauaaaaauaacaccacagucauccauaacagaagcggagcuuacaggauacgggacugucacuauggagugcaguccacgcacugguuuagacuuuaacgaaaugguacugcuccagauggaggacaaggccuggcugguccacaggcaaugguucuuagaccucccguuacccugguuacccggugcagacacccagggcucuaacuggauccagaaagaaacacuugugacguuuaaaaacccacacgccaagaaacaggacguagucguccuagguucucaagagggagccaugcacaccgcguuaaccggcgcuacagaaauccaaaugagcuccgggaaccuauuauucacaggccaccugaagugcaggcuaaggauggacaagcuacaauuaaagggaaugagcuauucuaugugcaccggcaaguucaaaaucgugaaggaaauugcagaaacccaacaugggacgaucgucauacggguacaauacgagggggacgggucacccugcaagauccccuucgagauaauggaccuugaaaagcggcacgucuuaggucgcuuaauaacaguaaaccccaucgugacagagaaggauucaccuguaaacaucgaagcggaaccacccuuuggagauagcuauaucauaauuggaguagagccaggucaacucaagcucaacugguucaagaaaggaagcagcaucggccagauguucgaaacaacgaugaggggcgcaaaaagaauggcgauauuaggagauaccgcuugggacuuuggcucgcuagggggcguguucacaucgauuggcaaagcacuacaccaaguauucggggcgauauauggagccgcauuuagcggaguaagcuggacaaugaaaauacuaauaggggugaucauaaccuggaucgguaugaacucgcgcagcaccagccucucugucagucuagucuuaguggguauagucacacucuaccuggguguuauggugcaagcggacaccggaugcguuguuagcuggaaaaacaaggaacuaaaguguggcaguggcauauucaucacugauaacgugcacacuuggaccgaacaauacaaguuccaaccagaaagcccgucaaagcuagcaucggccauccagaaggcacacgaagaggguauaugcgguauacgaagcguaacucgucuagagaacuugauguggaaacaaaucacgccagagcucaaccacauccuaucggaaaacgaagucaaacuuacaauaaugacaggggacauuaagggcaucaugcaagccggcaaacgaucuuugagaccacaaccgacggaauugaaguacaguuggaaaaccuggggaaaggcgaaaauguuaagcacggagagccacaaucaaaccuuccugaucgacgggccggagaccgcagaaugcccgaacacuaaucgggccuggaacagucuggaaguagaggacuacggguucggcguauucaguacaaacauaugguuaaaacuccgagaaaagcaggauguauucugcgacuccaaacucaugagcgcagcgauuaaagauaaucgagccguacaugcagacaugggauacuggauugaauccgcccugaacgauacauggaaaauggagaaagccucuuucaucgaaauaaaaagcugccacuggccgaagucacacacacucuggagcaacgggguccucgaauccgaaaugaucaucccgaagaauuucgcgggaccggucucgcagcauaacuaccgaccgggauaccacacacagaccgcugggccauggcaccucggcaaacuagaaauggacuucgauuuuugcgaagggaccacggugguagucacagaagacugugguaaccgaggacccucgcugaggacuaccacggcuaguggcaaacuaauaacggaauggugcugccgcucgugcacucuaccgccccuccgguaucgcggcgaagacggguguugguacggaauggagauucggccacuaaaggaaaaggaggagaaccucgucaacagucucgugaccgccggacacggacaaaucgacaauuucucacucggcguauuaggcauggcgcuauuccuagaagagaugcugcgaacccgggugggaaccaagcaugcgauccuccucgucgcagucucauuugucacacucauaacgggcaacaugagcuucagagaccucggacgggucaugguaaugguaggcgcgacuaugacagacgacauuggaaugggggugaccuaucuggcucuccucgccgcguucaagguccgcccaacauucgcggccgggcugcugcugcgcaaacuaacgagcaaggaacuaaugauggccaccauagggauugccuuacucagccaguccaccauacccgagacaauacuugaacuaaccgacgcccuagcgcucggaaugaugguacucaaaaucguucguaauauggaaaaguaccaacuagcggucaccauuauggccauauccugcguucccaaugccgugauccuccaaaacgccuggaaggucuccuguaccauccuagcggcagugucaguaaguccccuccuccuuacguccagccagcagaaagcagacuggaucccacucgcacucacaauaaagggccugaacccaaccgcaauauuccugacgacgcugagccgaacaucuaagaaacgcucguggccccuaaacgaggcagugauggcaguuggcauggucaguauccuagcgagcagucuauuaaagaacgacaucccgaugaccgggccacucguggcugggggccuccugaccguuuguuacgucuuaacagggcgcagcgcggaccuggaacuugagaaggcggcggacgucaagugggaagaucaagcagaaauaagcgggagcagucccauauuaagcauaacgauaucugaggacggcuccaugagcauaaagaacgaggaagaagaacauacacuaaccauccugauacgcacaggucuccucguaauaagugguguguucccgguuagcauucccauuacagcggcagccugguaccucugggaagucaagaaacagagggcgggggucuuaugggaugucccaagucccccacccguaggaaaagccgaacuggaggacggagcguaccggaucaaacaacgagggaucuucgguuauagccagauaggagcaggcguguacaaagagggcaccuuucacaccauguggcacguaacccgcggggccguccugaugcacagagguaaacggauagaaccgagcugggccgacgugaagaaagaccugauaagcuacggcgguggauggaaacuagaaggcgaauggaaagaaggcgaagaaguacaggugcucgcauuagaaccaggcaaaaacccacgugcgguccaaacuaaaccuggacuguucaaaacuaacacaggcacaauaggagcgguuucacucgacuuuucacccggaacuagcgggucaccuauagucgaccggaagggaaaggugguaggucuguacgggaacgguguagucacacgcaguggggccuaugucucagccaucgcacaaacggaaaaauccauagaagauaacccagagaucgaggacgacaucuuccggaagaagcggcugacgauuauggaccuacaucccggcgcaggcaaaaccaagcgauaccuaccggcaauaguaagggaggcuaucaagcggggacugcgaacacugauauuggcaccaacacggguggucgcggcagagauggaggaggcacugcgcggucuaccaauacgcuaucagacccccgcaauacgggcggaacacacagggagagaaaucguugaccuaaugugccacgcaacguucacaaugagauuacuaagcccaguacgaguuccaaauuacaaccuaaucaucauggacgaagcgcacuucacggacccggcgagcauugcggcgcgcggauauaucagcacaagagucgagaugggcgaggccgcaggcauauucaugacagccacuccaccagggucaagagaccccuuuccacagucaaacgcuccaauuauggacgaagaaagagaaauacccgaacgcucuuggaacagcggccacgaaugggucacugacuucaaaggcaaaacagucugguucguaccuucgauaaaggcgggaaacgacaucgccgccugccugcggaagaacggaaagaaagucauccaacuaucgcgcaaaacauuugauagcgaauauguuaaaacacgggcaaacgacugggacuucgucgugacaaccgacaucagcgaaaugggagcgaauuuuagggcggagaggguaaucgaccccaggcgguguaugaaaccagugaucuuaacggacggcgaagaacgagugauauuagcaggccccaugcccguaacccacuccucagcugcucagaggaggggccggauaggcaggaaucccaaaaaugaaaaugaccaguacaucuauaugggggagccacuugagaaugacgaagacugcgcacacuggaaagaagccaaaaugcugcucgacaacaucaacacucccgaaggaauaauccccucaauguucgaacccgaaagagaaaaagucgacgccauagacggcgaauaucggcucaggggagaggcgcgaaaaacauuugucgaccucaugcgcagaggagauuuaccgguaugguuagcguaccgaguggcagccgaggguaucaacuacgcugacaggagguggugcuuugacggcaucaaaaauaaccaaauauuggaggaaaacgucgaaguggaaauauggacgaaagagggggagaggaagaaacucaaaccacgcugguuagacgcgcggauauauucggauccacucgcgcuuaaagaauuuaaagaguucgccgcagggaggaaaagucugacgcuaaaccuaaucacagaaaugggccgccuaccaacguucaugacccaaaaggccagagacgcccuagacaaccucgcuguucuccacacggccgaaguuggaggcagagcguacaaccaugcacuaagcgaacugcccgagacauuagaaacauuacucuuacugacgcuccuugccacggucaccgggggcauuuucuuguuucuaaugagcggcaaaggaaucgggaaaaugacgcuaggcaugugcugcauuaucaccgcaucuauccuacugugguaugcgcaaauccaaccccacuggaucgcagccucaauuauccuagaguucuuuuuaaucgugcugcucaucccagaaccggaaaaacaacggacgccacaagacaaccaacugacauacguagucaucgccauauuaacugugguugcggcaacaauggcaaacgaaaugggcuuccuagagaaaacaaagaaggaccugggacuuggaagcauuacaacccaagaaucugaauccaacauacuugacauagaccuccgacccgccuccgccuggaccuuauaugccguagcgacuaccuucguaacgccaaugcugcgucauuccauagagaauagcagugucaauguaagccucacggcgauagcaaaccaagcaacggugcugaugggccuaggccgcggauggccgcucagcaaaauggacauaggagugccacuccuagccauagggugcuacagccaaguaaacccaauuacccuaacugcugcucuccuacuccugguugcucacuaugcgaucauaggacccggacuucaagcaaaagcgacaagggaggcgcagaaacgcacagcagcugggauaaugaaaaacccaacggucgacggaauaacaguaauugaccuggaacccauccccuacgacccaaaauucgaaaaacaauuaggacaaguaaugcugcuaguauuaugcgugacucagguacuaaugaugagaacgaccugggcgcugugcgaggcacuaacccuugcuacgggccccaucagcacacuaugggaaggcaaccccggaagauucuggaacaccaccaucgccgucucaauggcaaacaucuuucggggaucauaccuggcgggcgccggucuauuauuuucaauaaugaaaaauacaacaaacacgagaaggggcacaggaaauauaggagagacguugggugagaaauggaaaucucgccucaacgcgcucggaaaaagugaguuccagauauacaagaagucagggauacaagaaguggaucguacacuugccaaagaggggaucaagcgcggcgagacagaccaucacgccgugagccggggaucggccaaauugcggugguucguugagagaaacauggugacgccggagggaaaagucgucgaccuaggaugcggaaggggcggguggaguuacuacuguggagggcugaagaauguccgcgaaguaaaaggucuuaccaaaggggguccuggccacgaggagccaaucccaaugagcaccuacggcuggaaccuugugcgacugcaaagugguguggacguauuuuucacucccccugaaaagugcgacacacuguuaugugacaucggagaguccucaccgaauccaaccaucgaggcaggacguacccuucgaguacucaaccuugucgaaaacuggcuaaacaauaacacacaguuuugcgucaaaguucuaaacccguacaugccaucgguuauugagaaaauggagacucuacaacggaaauauggaggugcccuuguccggaacccccugagucgaaacagcacucacgaaauguauuggguaagcaaugcgaccggaaauauagucucgagcgucaacaugauuucacguaugcuaauaaaccgauucaccaugaagcacaagaaagcgacauacgaacccgauguagaccucggaagcggcacacgaaauaucgguaucgaaaacgaaauaccuaaccuagacaucaucgggaagagaaucgagaagauaaaacaggaacacgagacuagcuggcacuacgaccaagaucacccuuacaagacgugggcguaccaugggucauacgagacuaaacagacaggaucugcaagcaguauggugaacgggguggucaaacuccucacgaaaccaugggaugugguaccuauggugacacagauggcgaugacggacacaacgcccuucggacagcaacgugucuucaaagagaaaguggauacccgcacacaggaacccaaagaggggacaaagaagcuaaugcggauaacugcagagugguuauggaaggaguuaggcaagaagaaaacaccccgaaugugcacgcgugaggaguucacacgcaaggugaggaguaacgccgcucugggcgccauauucacggacgagaacaaguggaaaucggcccgagaggccguagaagacuccagauucugggaacuuguggaucgggaacgaaacuuacaccuagaaggaaagugcgagacgugugucuauaauaugauggggaagcgugagaagaaacuaggcgaguucggcaaggccaaaggaucgcgugcgauaugguacauguggcucggcgcaagauuccuagaauuugaggcacugggauuucuaaacgaagaucacugguucagccgugguaauagucuguccggcguggaaggagagggacuccauaaacugggauacauacugcgcgacgucucaaagaaagaagggggagcaauguaugccgacgacacggcggguugggacacaagaaucacacucgaggaccucaaaaaugaggagauggugacgaaccauaugaaaggagaacacaagaaacucgccgaagcaauauucaaacucacguaccaaaacaaggucguuagggugcaacgacccacaccccgggggacaguaauggauaucauuucaaggaaagaccagcgaggaagcggccagguagggacauauggacucaacacuuucaccaauauggaagcgcaacuaauaaggcaaauggagggagaaggaaucuucaaaagcauccagcggcuaacaguaacggaagaaauugcgguccagaacuggcuagcacgcguaggaagggaacgacuauccagaauggccauaucgggagacgauugcguugugaagccccuagacgauagguucgcuagcgcuuugacagcgcuaaacgacauggguaaggugcgcaaagacauccaacaaugggaaccaagcagaggcuggaacgacuggacccagguucccuuuugcucacaccacuuccacgagcuaguaaugaaggacggucgaaugcucguaguaccuugccguaaucaagacgaguuaaucggaagggcacggauuucucaaggagcaggcuggagucugaaagagacugcgugucucgggaaaagcuacgcucaaauguggacccucauguacuuucaucggcgcgaccugcguuuagccgcaaacgcaaucugcagugcgguccccagccacuggguaccaaccaguagaacaacuuggagcauccacgccaaacacgaauggaugacaacggaagacauguuggcaguauggaaccgggucuggauccaagaaaacccauggauggaagacaagacacccguagaaagcugggaggaggucccuuaucugggcaagcgcgaagaucaguggugcgguuccuuaauaggguuaacaagucgagccacgugggcaaagaacauacaaacggcgauaaaccaggugcgcagccugauuggcaacgaagaguacacggauuacaugccaagcaugaagcgauuuaggaaagaagaggaagaagcagggguccuaugguga

SEQ ID NO: 25163 - RNA, 9876 nt, Artificial Sequence
  derived and/or modified CDS sequence (opt11) from DENV-2__EU482552__SS-prME
acggccggggugauaaucauguuaauccccaccgccauggcguuccaccuuaccaccaggaacggggaaccccacaugauugucggucggcaggagaaagggaagucacugcuguuuaaaaccgaggacggcgugaacaugugcacucucauggccaucgacuugggcgagcugugcgaggacaccaucaccuauaagugcccccucuuacggcagaacgagcccgaagacaucgacugcuggugcaacaguacgagcacuugggugaccuacggaaccugcaccacuacgggcgaacaccgaagggaaaagcgguccgucgcucucgugccccacguugggaugggccucgagacccggaccgaaaccuggaugagcagcgaaggugcguggaagcacguccaacggaucgagaccuggauccugcgccacccgggcuucacgaucauggccgcgauauuagccuacacaauugggaccacucauuuccagcgggcccucaucuucauccugcugaccgccgucgcgcccagcaugaccaugcggugcauaggcaucuccaaccgugacuuuguugagggcgucagcggaggcuccuggguggacaucgugcuagagcaugggagcugcgucacuacgauggcgaagaacaagcccacgcuggacuucgaguugaucaagaccgaagccaagcagccugccaccuugcgcaaguacugcauugaggcgaagcugacaaacaccaccaccgagucccggugcccgacacaaggcgagcccagccugaacgaagaacaggauaagcgcuucaucugcaagcacuccaugguggaccgaggcugggggaauggcugcgggcuauuuggcaaaggagggaucguaaccugcgcaauguucacgugcaagaagaacauggagggcaaggucgugcugcccgagaaccuggaguacaccaucgugaucacuccccacagcggggaggagcacgccguaggcaacgacaccgggaagcauggcaaagagauaaagauuaccccgcaauccuccaucacggaggcggagcuaaccggguacggcaccgugaccauggaguguagcccccguacagggcuggacuucaacgagauggugcugcuccagauggaggacaaggccuggcugguucacagacagugguuucuggaccucccccuccccuggcugccgggggcugacacacagggcagcaacuggauccagaaggagacgcucgugaccuucaaaaacccccacgcgaagaagcaggauguugucgugcucgggagucaagaaggggccaugcacaccgcccugaccggggcuacggagauccagaugucaucaggcaaucuccuguucaccggccauuuaaaaugccgcuugcggauggacaagcugcagcugaaagguaugaguuacucgaugugcaccggaaaauucaagaucgucaaagagauugccgagacccagcacgggacgaucguaauccgcguccaauacgagggggacggcucccccugcaagauccccuucgagaucauggaccuugaaaagcggcacguccugggccgccugauaaccgugaauccgaucgugacggaaaaggacagccccgucaacaucgaggcggagccgcccuucggcgacuccuauaucaucaucgggguagagcccggacagcucaagcugaacugguuuaagaaggggagcucuauaggacagauguucgaaaccacgaugcgcggcgccaagcggauggccauccugggggacaccgccugggauuucgguucacucgguggcguguucacauccaccgggaaagcccugcaucagguauucggggcgaucuacggcgcggccuucucugggguauccuggacgaugaagauccugaucggcgucaucaucacuuggaucgggaugaacagccgcuccaccucacugagugugagccuggugcucgugggcgucgugacccuguauuuagggguuaugguacaggccgacacgggcugcguggugucguggaagaacaaggagcugaaguguggcuccgggaucuucaucacggacaacguacacaccuggacugagcaguauaaguuccagcccgagucccccucuaagcuagcguccgccauccaaaaggcccacgaggagggcaucuguggcauccgguccgugacgcgcuuagagaaccugauguggaagcaaaucacccccgagcugaaccauauccugagcgagaacgaaguaaagcugaccaucaugaccggcgacaucaaagggaucaugcaggccgggaaaaggucacugcgcccgcaacccacugagcugaaguacuccuggaagacaugggguaaagccaagaugcugaguacagagucgcacaaccagaccuuccugauugacgggcccgagacugcggagugcccuaacaccaaccgugccuggaacucccucgaggucgaggacuacggcuucggaguguuuuccaccaacaucuggcugaagcugcgcgagaagcaggacguguucugcgacagcaaacucaugagcgccgccauaaaagacaacagagcgguccacgcagacaugggcuacuggaucgagucagcccugaacgacaccuggaagauggagaaggccagcuucaucgagaucaaauccugccacuggcccaagagccauacgcuguggucuaacgguguguuggaguccgagaugauuauaccaaagaacuucgccgggcccguaucccagcacaacuaccggccgggcuaccacacgcagacggccggaccguggcaucugggcaagcucgagauggacuucgacuucugcgaggggacgaccgucguagugacggaggacuguggcaaccgagggcccagccuccgcacuaccaccgcuagcgggaagcugaucacggagugguguugccggucgugcacccuacccccucugcguuaccggggcgaggacggcugcugguacggcauggagauacggccccugaaggagaaggaggagaaccuggucaacucccuggugacagccggauacggccaaauagacaacuucagccuuggcgugcuagguauggcguuguuccuggaggagaugcugaggacccgaguaggcaccaaacacgcgauccucuuaguggcggugagcuucgucacucugaucacggggaacaugucauuccgagaccucggcagggugauggugauggucggggccaccaugacggacgacaucggcaugggcgugaccuaccucgcccugcucgccgccuucaaggugagacccaccuucgccgcgggacugcuguugcggaagcugacuagcaaggaacugaugauggccacaauuggcaucgcccuccugagccagagcaccauccccgagaccauccuggaguuaaccgaugcccuugcgcuggggaugauggugcucaagaucguccgaaacauggagaaguaccagcuggcagugacgaucauggccauuuccugcgucccgaacgcugugauccugcagaaugccuggaaggugucaugcaccauccucgcggccguauccgugucgccccuucugcucaccuccucgcagcaaaaggccgauuggaucccacuggcccugaccauuaagggauuaaaccccacggcuauauuucugaccacccugagccggaccagcaagaaacgguccuggccccucaacgaagccauaauggccgucggcauggucagcauccuagccuccagcuugcucaagaaugacauccccaugacggggccccugguugccggcgggcugcucacuguuugcuacgugcugaccggccgcagcgccgacuuagaacuggaacgcgccgccgacguuaagugggaggaccaggccgagaucuccggguccuccccaaucuuaagcaucaccaucuccgaggacggcagcauguccaucaagaacgaggaggaggagcacacccuuacaaucuuaauccggaccggccugcuggucaucagcgggguguucccggugagcauccccauuacggccgcggccugguaucucugggaggucaagaaacaacgcgccggcguguuaugggacgugcccagcccgccacccguagggaaagccgagcuggaggacggcgccuaccggaucaagcagcgcgggaucuuuggauacucgcagauuggugcgggcguguacaaggagggcaccuuccauacgauguggcacgugacccgcggggccguccucaugcaccgcgggaaacggaucgagccaagcugggcagacgugaaaaaggaccuaauauccuacgguggaggcuggaagcuggagggugaauggaaggaaggugaagaggugcagguccucgcccuggaacccgggaagaauccccgcgccguacagaccaagccaggccuuuucaagaccaacacugggacaauuggcgccgugagccucgacuucucgcccggcaccagcgggucccccaucgucgaccgaaaaggcaaggugguggggcucuacggcaacggugucguuacccgcagcggggccuacguguccgcaaucgcccagacggagaaaagcauugaagauaacccagagaucgaggacgacaucuuucgcaaaaagcgcuugacuauaauggaccuccaccccggcgcugggaagaccaagcgguaccugcccgccaucguucgcgaggccaucaagcggggccugcgcacccugauccucgcaccgacucgcguggucgccgcggagauggaggaggcccugcgggggcugcccauccgcuaccagacccccgccauccgggccgaacacacaggucgggagauugucgaccucaugugucacgccaccuucacgaugcgacugcugagccccgugcgcgucccgaauuacaacuugaucaucauggacgaggcgcacuucacggaccccgccuccaucgccgccaggggcuacaucaguacccgcguagaaaugggggaggcagcgggcaucuucaugaccgcgacaccgccugggucccgggacccguuuccacagagcaacgcccccauuauggacgaggagcgcgaaauccccgaacgguccuggaacagcggccacgagugggugaccgacuucaaggggaagaccgugugguucgugccauccaucaaggccggcaaugacaucgcggcaugccugcgcaagaacggaaagaaggugauccagcugagccgcaaaaccuucgacucugaguacgugaagacgcgugccaacgauugggacuucgugguuaccaccgacaucagcgagaugggagccaacuuucgugccgagcgcguuaucgacccgcggcgcugcaugaagccggucauccuuacggacggcgaggagcgggugauccuagcggggcccaugccggugacgcacuccagcgcugcccagcgccguggccggaucgggcggaacccaaagaaugagaacgaccaguauaucuauaugggcgagcccuuagagaacgacgaggacugcgcccacuggaaggaggccaaaaugcuccuggacaauaucaacaccccagagggcaucauccccuccauguucgagcccgagcgggagaaggucgaugcgaucgacggggaauaccgccuacgcggcgaggccagaaagaccuucguggacuugaugcguagaggggaccuccccguguggcucgccuaccguguugccgccgaagggaucaauuaugcggaccgccgguggugcuucgacgggaucaaaaacaaccagauccucgaggagaacguagagguggagauauggaccaaggaaggugaacgcaaaaaguuaaagcccagauggcuggacgcgcgcaucuauagcgacccccucgccuuaaaggaguucaaggaguucgcagccggccguaagucuuugacauuaaaccuaauaaccgagauggggcgccugcccacauuuaugacgcagaaggcacgggacgcgcucgacaaccuggccgucuugcacacggccgaagugggcgggcgcgcauacaaucacgcgcucucugagcugcccgagacccuggagacccuguuacugcuaacucugcuggccacggucacuggcggaaucuuucuauuccugauguccgggaagggcaucggaaagaugacccugggcaugugcuguauuauuacggccucgauccugcugugguacgcccagauacagccgcauuggauagcugccuccaucauacuggaguucuuccucaucgugcuguuaauccccgagccggagaagcaacggacgccccaggacaaccagcuaacguacguggucaucgccauccugacugugguggcagcaaccauggcgaacgagaugggauuccuggagaagaccaagaaagauuuaggccugggcucaaucacgacacaggagagcgagaguaacauccuggauauugacuuaagaccugcaagcgccuggacguuauacgccguggcuacuacguuugugacccccaugcugagacacuccaucgagaacuccuccgugaacgucagccucaccgcuaucgccaaccaggccaccguccugauggggcugggccgcgguuggccccucuccaaaauggacauuggcguuccucugcuggccaucggaugcuacucacaggugaauccgaucacacucaccgcggcucugcuuuugcuuguggcccacuacgccaucaucggccccggccuucaggccaaggcgaccagagaggcacaaaagcggaccgcggccggcaucaugaaaaaccccacaguggacggcaucaccgucaucgaccucgaacccaucccguacgacccaaaguucgagaagcagcugggccagguaaugcuucucgugcuuugcguaacucagguccuuaugaugagaaccacgugggcccucugcgaggcgcugaccuuagccaccggacccaucucaacccucugggaaggaaaccccggcagguucuggaacacgacgauugccgucagcauggccaauaucuuccgcggcuccuaccuggcaggggcaggucuccucuucagcaucaugaagaauaccaccaacacgcggagggggacgggcaauaucggcgagacccugggggaaaaguggaaguccagauugaacgcacuugggaaaagcgaguuccagaucuacaagaaauccgguauucaggaagucgaccgcacucuagccaaggaggggaucaagcgcggagagacggaccaccacgccgugagccgcggcuccgcgaaacugcggugguucguugagcggaacauggucaccccggaaggcaaagugguagaccucgggugcggccgcggcggguggagcuacuauugcggcgggcugaagaacguucgcgaagugaagggacugacaaagggcggccccgggcacgaggagccgauccccaugucgaccuacggcuggaaccuggugcggcugcagagcggagucgacguguucuucaccccucccgagaagugugacacccucuuaugugacaucggugagagcucccccaaucccaccaucgaggccggccgcaccuugcggguacugaaccucgucgaaaacuggcugaacaacaacacccaguucugcgugaaggugcugaauccguauaugcccuccgucauugagaagauggagacguugcagcgaaaguacgggggcgcucuggugcggaauccccugucccgcaacuccacccaugagauguacuggguguccaacgccacggggaacaucgucagcuccgugaacaugauaagccgcaugcugaucaaccgcuucaccaugaagcauaagaaagccacauaugagccggacguggaccucggcuccgggacucgcaacauuggcaucgagaacgaaauucccaaccuggacauaaucgggaagcgcaucgagaagauaaaacaagagcacgagaccagcuggcauuacgaccaggaccacccguauaagaccugggcguaccacggguccuacgagacgaagcagaccgggagcgccuccaguauggucaacggggugguuaaacuucugacaaagccuugggacgucgugccgauggugacccaaauggcgaugacggauaccacccccuuuggccagcagcgcguuuucaaggagaagguggacacacgcacacaggagcccaaggaggggaccaagaagcugaugcgcaucacugccgaguggcuauggaaagagcuggguaagaagaagacgccgcguaugugcacgcgcgaggaguucaccaggaagguacgcuccaacgccgcgcugggagccaucuucaccgaugagaacaaguggaaauccgcccgugaggccgucgaggacucccgguuuugggaacugguggaccgggagcgcaaccuccaccuggaagggaagugcgagaccugcguuuacaacaugauggggaaaagggagaaaaagcugggggaguucgggaaagccaagggcagccgcgcgaucugguacauguggcucggggcccgguuucuggaguucgaagcccugggcuuccucaacgaggaccacugguucucccgcgggaacuccuugagcggcguggagggggagggacugcacaaguuaggcuacaucuugcgggacgugagcaagaaggagggcggggcgauguacgcggacgacacggcgggcugggacacccgcaucacccuggaggaccucaagaacgaagaaaugguuaccaaucacaugaagggagaacacaagaaacuugccgaggcuaucuucaaguuaacauaucagaauaagguggugcggguccagcgaccgacgccccggggaaccgugauggacaucaucagucggaaggaucagcgcggaucuggccagguggggaccuacggucuuaacacguucaccaacauggaggcacaacugauccggcaaauggagggggaggguaucuucaagagcauucaacggcugaccgucacugaagaaaucgcugugcaaaacuggcucgcgcgugugggcagggagcgacugucccgcauggccauaagcggggaugacugcguagugaagccccuggacgaccgguucgcgagugcccucaccgcgcugaacgacaugggcaaggugcgaaaggacauucagcaaugggagccuagccggggcuggaacgacuggacccaggucccauuuugcucccaccauuuccacgagcuggucaugaaggacggccgcgugcucgucgugcccugccguaaccaggaugagcugaucgggcgcgccaggaucagucagggggcaggcuggucacugaaggagaccgcaugcuuaggcaagaguuacgcccagauguggacccugauguacuuccaucggcgggaccugcguuuggccgccaacgccaucugcuccgccgugcccagccauugggugcccacuucccggacgacauggagcauccacgccaagcacgaguggaugaccaccgaggacaugcuggcaguuuggaaccgcguguggauccaggagaacccguggauggaggacaagacucccguggaguccugggaagagguaccauacuuaggcaaacgcgaggaucaguggugcgggagccucaucggccugaccuccagggcgacgugggccaagaacauccagaccgcaaucaaccaggugcgguccuugaucgggaaugaggaguauacagacuacaugcccagcaugaagcgguucaggaaggaggaggaggaggcggguguccucugguga

SEQ ID NO: 25164 - RNA, 9876 nt, Artificial Sequence
  derived and/or modified CDS sequence (opt11) from DENV-2__EU482554__SS-prME
accgcgggggugauaauuaugcuuauaccgacggcaauggcauuccaccuaacgacccguaauggagaaccacacaugauagucggacgacaagaaaaaggaaaaucgcuacucuucaaaacugaagacggaguaaacaugugcacccugauggcaaucgaccuaggggaauugugcgaagauacuaucacauacaaauguccccuguuaaggcagaacgaacccgaagacaucgacugcugguguaauucgaccucgacgugggucacuuaugggacgugcacgacgaccggggaacaccggcgagaaaaacgguccguagcucucgucccucauguugggaugggcuuagaaacuaggaccgaaaccuggaugagcagcgaaggggcauggaaacacguccagagaauagaaacguggauccuccgccauccaggauucacgauaauggcggcaauccucgcuuacacaauaggaaccacgcacuuucagagggcgcuaauauuuauacuccuuacggcuguggcccccagcaugaccaugcgcugcaucggcaucagcaaccgugacuucgucgaaggagucucuggagggucaugggucgacauaguccuggaacacggcucauguguaacgacaauggccaaaaacaaacccacgcuagauuucgagcugauuaaaaccgaagcaaaacaaccugccacccucaggaaauacugcauagaggcgaaacuaacuaacaccacaacugagucgcgaugcccaacccaaggagaaccgagcuuaaacgaagaacaggacaagagauucaucuguaaacauaguauggucgacaggggcuggggcaacggaugcggccucuucggcaagggcggcauagucaccugugcgauguucaccuguaagaaaaauauggagggcacgguaguacuaccagagaaucuggaguacacaaucgucaucacgccucauuccggcgaagaacaugccgugggcaacgacaccggcaagcacgggaaagagaucaagauaacaccacaaagcucuauaacagaagccgaacugacgggcuaugggaccgucacgauggaaugcucucccagaacggggcuagacuucaacgaaauggugcuacuacaaauggaagacaaggcguggcucguccaccgacaaugguuccuagaucuaccucuaccauggcucccgggggcugacacacaaggcagcaauuggauucaaaaggagacauuaguaacuuucaagaauccgcacgccaagaaacaggacgucguagugcugggaagccaagaaggagcgaugcacaccgcccucacaggcgcaaccgagauccagaugucaagcggaaaccucuuauucacugggcaucugaaaugcagacuacggauggauaaauuacagcugaaggguauguccuauuccauguguacagguaaauuuaaaauaguaaaagaaaucgcggaaacacagcacggcacaauagucauccgaguacaauaugaaggugacgggagcccaugcaaaaucccauucgagauaauggaccucgagaaaagguacguacuaggacgucuaaucaccguaaauccgauagugacagagaaagacagcccaguaaacauugaggcggaaccacccuucggggacaguuacauaauaauaggcguugaaccgggacagcugaaacuaaauugguucaagaaaggguccuccaucggccaaauguucgagaccaccaugaggggagcuaagcgaauggccauacucggcgauaccgcuugggacuucgggagucucggaggagucuucaccaguaucggaaaggcacugcaccaggucuucggggccaucuauggagcagcuuucucaggagugucuuggacaaugaagauacucaucggagucauaaucaccuggaucggcaugaacaguagguccaccagccucucggucagccucguacuugucggcgucgucacauuauaccucggcgucaugguccaagcggauagcggauguguagugucguggaaaaacaaagaacuuaagugcgggucuggaaucuucaucacagacaacguccacaccuggacugagcaauacaaguuucagccugaaagcccauccaaacucgccucagcgauacagaaagcgcacgaggaaggcauuugcgggauacgcagcgucacccgccucgaaaaucuaauguggaaacagaucacaccagaauuaaaucacauccucucggaaaaugaaguaaagcugaccauuaugaccggagacauaaagggaaucaugcaggcggggaaaaggucguugcgcccacaaccaaccgagcucaaguacucguggaaaaccugggggaaggcaaagauguuaucaacggaaucccacaaccagaccuuucucauagacggccccgagacggccgaaugcccaaacacaaaccgagcauggaacaguuuggaggucgaagacuaugguuuuggcgucuucucaaccaacaucuggcuuaagcucagggagaaacaagacgucuucugcgauagcaaacucaugucugcugccaucaaggacaaccgcgcuguucacgcugauaugggguacuggauugagucagcgcuaaacgacacguggaagauggagaaagcaucauucaucgaagucaagaguugccacuggcccaaaucacauacucuguggucaaacggcguccuagagagugagaugaucauccccaagaacuucgccgguccagucagccaacacaauuaccgccccggcuaucacacacagaccgcaggaccauggcaccucgggaagcuagaaauggacuucgacuucugugagggcacuaccgucguggugacagaagacuguggaaacagaggaccuucuuuaagaacaaccacagcaucgggcaaauugaucaccgaguggugcugccgaagcugcacacuaccuccauuacguuaccguggagaagacggaugcugguaugggauggaaauuagaccauuaaaggagaaagaagaaaaccucguuaacagucucgucacagccggccacggacaaauagacaacuucucccuagggguccugggaauggcccuauuccucgaagaaaugcuccggacccgcguuggcacaaaacacgcaauccuccugguagccguuucguuugucacccuaauaacaggaaacauguccuuccgagaccuaggccgagucaugguaaugguuggugccaccaugacagaugacaucgggaugggaguaacuuaccuggccuuacuagcagccuuuaaggugcgccccacauucgcagcggggcuccuccuacggaaacugacaucaaaagagcuuaugauggcaaccauagggauagcccuucugucacaaagcacgaucccggagacgauauuggaacucacagacgcccuagcgcuaggcaugauggugcugaagauagugaggaacauggaaaaguaccagcuagcaguaacaauaauggcgauucuaugcgucccuaacgcgguuauauugcaaaacgcauggaagguaagcugcacgauauuagccgccguauccguuaguccacuacugcuaaccagcucucagcaaaaggcggacuggaucccgcuggcccuaacaaucaaaggcuugaaccccacagcaaucuucuugacuacacuauccaggaccagcaagaaaagauccuggccccuaaaugaggccguaauggcgguaggaauggugagcauccucgcuucaucccuucuaaagaacgacaucccgaugacuggaccgcuggucgcugggggucuucuaacaguaugcuauguccuuacagggcgguccgcggaccucgaacuagaaagagccgcagauguaaaaugggaggaucaagccgagaucagugguagcagccccauccuaucgaucaccauaagcgaggacggguccauguccaucaagaaugaagaggaggaacaaacacugaccauacucaucagaacgggccuccuagucauaagcggcguguucccuguaagcauccccaucacagcagcagccugguaccuaugggaaguuaagaaacaacgggcaggaguccuuugggacgugcccaguccaccacccgugggaaaagcagaguuagaagacggcgccuacaggauaaaacaaaggggcauauuuggauauucgcagaucggggccgggguguacaaagaggggacauuccacacgauguggcacgugaccagaggagcaguccuuaugcaccgugggaaaagaauagagcccagcugggcagacguaaagaaagaucucaucucauacggggguggguggaaacuagaaggagaguggaaagaaggggaagagguccaaguccuggcccucgaacccggcaaaaacccgagagccguucagacgaagccaggucuuuucaagaccaacacgggaacuaucggagcugucagccuagauuuuagccccgguacaagugggagccccaucgucgaccggaaagggaaagugguaggauuauacgggaacggcgucgugacccgaagcggagcauacgucagcgcgaucgcacaaaccgaaaagaguauagaagacaaccccgaaaucgaggaugauauuuucagaaagaaaaggcugaccaucauggacuuacaccccggagcggguaaaacuaaacgauacuugccugcgauaguccgcgaagcuauaaagcgcggccuaagaacauugauccuagcacccacaaggguaguagcggcagagauggaggaggcucuaaggggauugccgauucgguaccaaacaccagcaauccgcgccgagcacacaggccgggaaauuguagaucucaugugccaugcaaccuucacaaugcgacuccuaucccccgucagagucccaaacuacaacuugauaauaauggacgaggcccacuucacagacccggcaucaaucgccgcccgaggcuacauuucaacgcguguagagaugggcgaagcugcuggcauauuuaugacagcgacaccgcccgggucucgagaucccuucccacaaaguaaugccccgauaauggaugaagaacgagaaauaccggagagaaguuggaauagcgggcacgaaugggucacagauuucaaaggcaagacgguaugguucgugcccucaauaaaggccggaaacgacaucgcggcaugccuuagaaagaacgggaagaaaguaauacaacuuucaagaaaaaccuucgacagugaauacgucaaaacgcgcgcaaacgacugggacuucgucguaacgacagacauauccgaaaugggcgcaaauuuccgagcugagagaguaaucgacccccgccgcuguaugaaaccaguaauccugacugacggggaggaacgcgucauucucgccggcccgaugccuguuacccacaguagcgccgcccaaagacgaggaagaauaggacgaaaccccaagaacgaaaaugaccaguauaucuacaugggcgaaccacuggagaacgacgaggacugugcccauuggaaggaagcgaaaaugcuacuagauaacauaaacacccccgaaggcaucauaccaagcauguuugaaccugaacgagagaaaguagacgcgauagacggcgaauaucgccugcguggcgaagcacgcaaaacauucguggaucugaugcguagaggagauuuaccaguguggcucgcguaccgcguggcggccgaaggaaucaacuaugccgaccggagaugguguuucgacggaaucaaaaacaaccaaauacuagaggagaacguugaaguggaaauauggaccaaagagggugaaagaaagaaacucaagcccagguggcuggacgcaaggaucuacucggacccguuagcccugaaagaauuuaaagaguuugcagcgggaagaaagucacucacauugaaccucaucaccgaaaugggccgccuacccaccuuuaugacacaaaaagcucgggacgcuuuggacaaccuggcgguacuacacacagcagaaguaggagggagagcauacaaccacgcacucagugaacugccagaaacguuagagacacuacuucuucucacccuacuugcgacagugaccggcgguauauucuuguuucuaaugagcggaaaggggauaggcaagaugacacucggaaugugcugcaucaucacagccucgauacugcugugguacgcacaaauucagccucacuggauagccgcauccaucauacuugaguucuuucuaaucguacuccuaauaccggaacccgagaagcaacguacuccacaggauaaucaguuaacauacguagucaucgcgauacucacagucguagcugcgaccauggcuaacgagaugggauuucucgagaaaaccaagaaagaccuaggccuagguuccaucaucacacaagaguccgagagcaacauucucgacaucgaccugcgccccgcgagcgccuggacucuguacgccguggcgacgacguuugucacgccgaugcuccgacacucaauagagaauagcagcgucaacguaagccuaacagccaucgcgaaccaagcgacaguacugaugggacucggaagggguuggccccuuucaaaaauggauaucgggguaccgcuccucgcgauugguugcuacagccaggugaacccaaucacccuuacagcagcucugcuccugcucguggcgcacuacgccaucauaggcccagggcuacaagcaaaggccacccgcgaggcacagaagcgggccgcggccggcauuaugaaaaauccaacggucgacgguauuaccgucauugaccucgaaccaaucccauacgaucccaaguucgaaaaacaacucggccaggugaugcuccuagugcucugcgucacacaagugcuaaugaugcggaccacaugggcgcuuugcgaagcccuaacauuggcaacaggcccaauaagcacccuaugggaaggcaacccuggacgauucuggaauaccaccauagcggugagcauggcgaacauauuccgaggauccuaccucgcuggagccggccugcuauucagcauaaugaagaacacaaccaacacacgucggggaaccggcaacauuggcgagacgcucggcgaaaaauggaagagucgacuaaaugcgcuaggaaaauccgaguuccagauuuauaaaaagucuggcauacaagaagucgacaggacccuagcaaaagagggaaucaaacgcggggaaaccgaccaccacgcggucucgagaggaucggcaaagcuccgcugguucgucgagcgaaacauggugacaccagaaggaaaggugguggaccucggcugcggacgcggaggguggagcuauuacugcggaggacucaaaaacgugcgcgaaguuaaaggccucacaaagggaggccccggacaugaggaaccaauaccgaugucuacauauggcuggaaucuaguccggcugcagaguggcguggacguauucuuuacacccccggaaaaaugcgauacccuacuaugugacauaggggaauccucacccaaucccacaaucgaagcggggaggaccuuaagagucuuaaaccucgucgagaauuggcucaacaacaacacccaguucugcauuaagguacuaaacccuuacaugcccucagucauugaaaagauggagacacugcagaggaaguauggcggcgcccuaguucgcaauccgcucaguagaaacaguacgcacgaaauguacuggguguccaacgccacagggaacaucgugagcuccgugaauaugauaucccguaugcuaauuaaccgcuucacgaugaaacacaagaaagcuacguaugagcccgacguagaccuggguuccggaacgaggaacauaggaauagagaaugaaauuccaaauuuggacauuaucggaaaaaggauagagaaaauaaagcaagagcaugaaacaaguuggcacuaugaccaggaucaccccuauaagacuugggccuaucacggauccuacgaaacaaagcagacuggaagugcgucuucgauggugaacggcgugguacggcuccugaccaaaccuugggacguagugcccaugguaacacagauggcgaugaccgauacgaccccguuuggacagcaacgcgucuucaaagaaaaaguggacacaagaacgcaagagccaaaagaaggaacgaaaaaguugaugcgcaucacagcagaauggcuauggaaggaguuaggcaagaagaaaaccccacgaauguguacccgggaagaguucacgcguaaagugagauccaacgcagcacuaggcgccauauuuacggaugaaaacaaauggaaaagugcccgcgaagccguagaggauagcagguucugggagcuaguggaccgcgagcguaaucugcaccucgaaggcaaaugcgagacgugcguauacaacaugaugggcaagcgagagaagaaacuaggagaguucgguaaagcgaagggguccagggcgaucugguacauguggcuaggggcgcgcuuccucgaguucgaagcacuaggauuucugaaugaagaccacugguuuagccgagguaauagucucagcggcguagagggagaagggcugcauaaacuugguuacauucugcgagacguaucgaagaaagaaggcggggcaauguacgcggaugacacggcugggugggauacacggauaacucuggaggaccucaagaacgaggaaauggucacgaaccacaugaagggggaacacaagaaacuagccgaagccauauuuaagcugacauaccagaacaaaguugugagaguucagcgacccacgccucgcgggaccguaauggauauaauaagcaggaaggaucagagagggagcggacagguaggcaccuauggccuaaacaccuucacaaacauggaagcacaguuaauacgacaaauggagggcgaaggaauauucaagucaauacagcacuugacuguaacagaagaaauugccguacagaacuggcuagccagggucgggcgggaacggcugagccgcauggccauuucaggagacgauugcguagucaaaccacuagacgaucguuucgccagcgcacuaacagcgcucaaugacaugggaaaggugaggaaagacauccagcagugggagccuagcagggguuggaacgacuggacacaaguaccguuuugcucgcaucacuuccacgaacucgugaugaaagacgggcgcguucucguugugccgugcagaagucaggacgaacuaauaggcagagcacggaucucgcagggggccggcuggucccuaaaggaaacugcgugccuuggaaaaagcuacgcacagauguggacccuaauguacuuucaucguagagaccuccgacuggcagcgaaugccauaugcagcgcagucccgagccacugggucccgacaagccgaacaaccuggaguauccacgcgaagcacgaauggaugacaacggaggacauguuagccgucuggaaucggguauggauacaggaaaaccccuggauggaagacaaaacgcuaguagaaucuugggaagaagugccguaccucggcaaacgcgaggaccaauggugcggcucgcucauuggacugaccucgcgggcaacgugggcaaagaauauacaaaccgccaucaaccaggugcgcucucucauuggcaacgaggaauacacggacuauaugcccagcaugaagcgauucaggaaggaagaagaagaagccggaguuuuaugguag

SEQ ID NO: 25165 - RNA, 9876 nt, Artificial Sequence
  derived and/or modified CDS sequence (opt11) from DENV-2__EU482556__SS-prME
acggcuggcgugaucaucaugcuaauccccaccgccauggcguuccaccugacgacccggaacggggagccccauaugauagucggccgacaggagaaggggaagucccugcuguuuaagacggaagacggcgugaacaugugcacccugauggccaucgaccugggggagcuaugugaggacaccaucacuuacaagugcccccuccugcgccagaacgagcccgaggacaucgacugcuggugcaauagcaccagcaccugggugacuuacgggaccugcaccaccacaggagagcaccggagagagaaacgauccgucgcucuggucccccacgugggcaugggccucgagaccagaacggagaccuggaugucuagugagggggccuggaagcacguacaacggaucgaaacguggaucuugagacauccuggauucacuaucauggccgcgauccuggcguauaccaucgggacuacgcacuuccagcgggccuuaaucuucauccugcugaccgccguggcccccagcaugaccaugcgaugcaucggcaucaguaaccgggacuucguagagggcgucagcgggggcuccuggguugacauaguacucgagcacgggagcugcgucaccaccauggccaagaacaaaccaacccuggacuucgagcugaucaagacagaggcgaaacagccugcuacccuccgcaaauacuguaucgaggcgaaacugacgaacaccaccaccgagucgcguuguccuacucagggcgagcccucccugaacgaagagcaggauaagcgcuucaucuguaaacacucuaugguggaccggggcugggggaacggcugcggucucuucggcaaaggcgggaucgugaccugcgcgauguuuacgugcaagaagaacauggagggaaaggucguucugcccgagaaccuagaguauaccaucgugauuacgccccauuccggggaagagcacgccgucgguaacgacaccgggaagcacggcaaagaaaucaagauaaccccgcaguccagcaucaccgaggccgagcucaccggguacggcacgguuaccauggagugcagcccccgaaccggccuggugagccacgagaugguccugcuccagauggaagacaaggccuggcuggugcaccgacaaugguuccuggaccucccccugcccuggcuaccaggugcagacacccagggguccaacuggauccagaaggagacgcucgugaccuucaagaacccccacgcgaaaaagcaggaugucgugguccuggggagccaggagggcgccaugcacacagcccugaccggugccacggagauccagaugagcuccggaaaccuacuguucaccggccaccugaagugccgccuccggauggacaagcuccagcucaaggguaugucuuacucgauguguacuggcaaguuuaaaaucgugaaggagaucgcugaaacccagcacggaacuaucguaauccgcguccaguacgagggcgacgguagccccugcaaaauaccauucgagaucauggaccucgagaagcggcauguguuggggcgccugaucaccgugaaccccauugugacggagaaggacuccccugugaacaucgaggcggagccgcccuucggcgacagcuauauuaucauaggagucgagccuggccagcuuaagcugaacugguucaagaagggguccagcaucggacaaauguucgagaccacgaugcgcggcgccaagcguauggcgguucuaggagauacagcaugggacuucgguagucucggggggguguucaccagcauugggaaggcccugcaccagguguuuggcgcgauuuacggcgcugccuucuccggggugagcuggaccaugaagauccugauuggcgugaucauaacuuggaucggaaugaacucccgcagcacgucccucagcgugucccuaguucuggugggcguggugacccuguaccucggggugauggugcaggccgacaccggcuguguugugucauggaagaacaaggaguugaaguguggaucugggaucuucaucacggauaacgugcacacguggacggagcaguacaaauuucagcccgagagccccucuaagcuggcuuccgcaauucagaaggcccacgaagaggguauuugcgguauccggucagucacccgccucgagaaccugauguggaagcagauaacgcccgagcugaaccacauccucuccgaaaaugaggugaagcugaccaucaugacgggcgacaucaaggggaucaugcaggcgggcaagcggagccugcgcccgcagcccaccgagcucaaauacaguuggaagacguggggcaaggcuaaaaugcugagcaccgagucccacaaucagacuuuccugaucgaugggcccgagaccgcggagugcccgaacacgaaccgggccuggaacucacucgagguggaagacuacgguuucggggucuucuccaccaacaucugguuaaagcugcgggagaagcaggacguauucugugauaguaagcucauguccgcagccaucaaagacaaccgugccgugcacgcggacaugggcuauuggauagagagcgcccugaaugacacuuggaagauggagaaggccuccuucaucgagaucaagucuugccacuggcccaaaucgcacacccuauggagcaauggcguccucgagucugaaaugaucauccccaagaauuucgccgggcccgugagccagcacaacuaccggccgggauaccacacccagacugcagggcccuggcaccugggcaagcuugagauggacuucgacuucugcgaagggacaaccguggucgugaccgaggacugcggcaaucggggucccagccuccgcacgaccaccgcaagcgggaagcugauaaccgagugguguugccggucgugcacgcugccuccgcuccgguaucggggggaggacggcugcugguauggcauggagauccgccccuuaaaggagaaagaggagaaccuugugaauucccucguuacagcagggcacggucagauagacaacuucagccucggcgugcuggggauggcacucuuccuggaggagaugcuccggacccgagugggcaccaagcacgccauccuccuggucgcgguguccuucgucacgcugauaaccgggaacauguccuuucgggaccucggccgcgucauggugauggugggcgccaccaugaccgacgacaucggcaugggcgucacguaucuggcccugcucgccgccuucaaggugcgccccacauucgccgcaggucuguuacuacggaagcugacguccaaagagcugaugauggccacuauuggcauagcgcuccugagccaguccacgauucccgagaccauacucgaacucacagacgcccuggcgcuggggaugauggugcucaaaaucguccgcaacauggagaaguaccagcuggcugugaccaucauggccaucagcugcgugccgaacgccgucaucuugcagaacgcauggaagguguccugcacgauccucgcggccgucagcgugagcccccugcugcucacaaguucccagcagaaggccgacuggauuccccuagcccugacaaucaagggacuuaaccccacggcgaucuuccugacuacccugagccggaccuccaagaagcgcagcuggccguugaacgaggccgugauggccgucggcaugguguccauccuggcaagcagcuuacucaagaacgacauucccaugacugggccccugguggccggcgggcugcucaccgucugcuauguacugaccggucggucggcagaccuggaacucgagcgcgccgcggaugugaagugggaggaccaagcagaaauaagcggguccagccccauucuguccaucaccaucagcgaggacggcuccaugagcaucaaaaacgaagaagaagaacacacacugacgauccucauccggacgggccuguuggucaucagugggguguucccgguuagcaucccuaucaccgccgcggcgugguaucucugggaggucaaaaaacagcgggccggcguucuuugggaugugcccucaccaccgcccgucgggaaggccgagcuggaggauggcgccuaucgcaucaagcagcgcggaauuuucggcuacagccagauuggcgcagggguauacaaggaaggcaccuuccacacgauguggcacgugacgaggggggccguacuuaugcaccgcggcaagcggaucgagccguccugggcggauguaaagaaggaccugaucuccuacgggggcggguggaagcuggagggggaguggaaggagggcgaagagguccaggucuuagcacucgaaccggggaagaaccccagagccgugcaaaccaaacccggccuguuuaagacuaauaccgguacgaucggcgcgguuucgcucgacuucagcccuggcaccagugguucccccaucgucgaccggaaaggaaaggucguggggcuguacggcaacggcgucguuacacgaucgggggccuaugugagcgccaucgcacagaccgagaaguccaucgaagacaaccccgagaucgaggacgacaucuuucggaagaaacgccuuacgaucauggacuuacacccuggcgcgggaaagaccaaacgcuaccugcccgcaaucguacgcgaagccaucaagcggggccugcgcacccugauccucgccccgaccaggguaguagccgcggagauggaggaggcucuucgggggcuucccauucgcuaucagacgcccgccauccgggccgagcacacuggccgcgagaucgucgaccucaugugccacgccaccuucacaaugcggcuguugucccccguacgcgugccgaacuacaaccucaucaucauggacgaggcgcauuucacggacccugccuccaucgccgcccggggcuacaucuccacccgcgucgagaugggggaggcggcgggcauauucaugaccgccacgccgcccgggucccgugacccguucccccaguccaacgcccccaucauggacgaagagcgugagauucccgagcgaaguuggaauuccggccacgaaugggucacggacuucaagggcaagaccgugugguucgucccguccaucaaggccgguaacgacaucgcggcgugcuugcgcaagaacggcaaaaagguuauacagcugucccggaagacuuucgacagcgaguacgugaaaacucgcgccaacgauugggacuucgucgugacgaccgacauuuccgagaugggggccaauuucagggccgagcgcgugaucgacccucggcguugcaugaagccagucauuuuaaccgauggcgaggagcgggugauacuggcggggcccaugccggugacacauagcuccgccgcacaacgccgaggccggaucggacgcaaccccaagaacgagaaugaccaguauaucuacaugggcgagccucuggaaaacgacgaggacugcgcgcacuggaaggaggccaaaaugcuccuggacaacaucaacacgcccgagggcaucauccccagcauguucgagcccgagcgggagaaggucgacgcgaucgacggggaguacaggcugcggggcgaggcccgcaagacauuuguggaccucaugcggcgcggggaccugcccguguggcuggccuauagaguugccgcugaaggaaucaacuacgcggaccgccgguggugcuuugacgguaucaagaacaaccaaauccucgaggagaauguggaggucgagaucuggaccaaggaaggugagcgcaagaagcugaagccgcgguggcuggacgcucgcaucuacucagacccccucgcacugaaggaauuuaaagaguucgcggcgggccgcaagucccugacccuaaaucugauuacugagaugggccgccugccgacacucaugacccagaaggcccgggacgcccuggacaaucuagccgugcuccacaccgcugagguaggugggcgugcguacaaccacgcccuguccgagcugcccgagacguuagagacacugcuucuccugacccugcucgccaccgucacgggaggcaucuuucuguuccugaugucagguaaggguaucggaaaaaugacauuggggaugugcugcaucaucacugcauccauccuccugugguacgcgcagauccagccgcacuggauagcggcuagcaucauacucgaguucuucuugaucguucugcucauccccgagccugagaagcaacggacgccccaggauaaccagcugaccuauguggucaucgcaaucuuaacgguaguugcagccaccauggcgaacgagaugggcuuccucgagaagaccaaaaaggaccugggccugggaagcauuacuacgcaagaauccgagagcaacauacucgacaucgaccugcgcccagccuccgccuggacucuguacgccguggcgaccacuuucguuacgcccaugcugcggcacagcaucgagaacuccagcguaaacgugucccugaccgcgaucgccaaucaggcuaccgugcugauggggcucggccgcggguggccccuaagcaagauggacaucggugugccucugcucgccaucgggugcuacucccaagucaacccgauaacacugacugcugcccugcucuuacucgucgcccacuacgccaucaucggaccuggcuuacaggccaaggcgacccgcgaggcucagaagcggaccgccgccgggaucaugaagaauccgacuguggacggaauaacggucaucgacuuggagcccauuccuuacgaccccaaguucgagaagcaguugggccaggugaugcuccuggugcugugugucacccagguguuaaugaugcgcaccaccugggcccugugcgaggcgcugacacuugcaaccggcccgauuucgacccugugggaggggaaccccggcagauucuggaacaccacgaucgcugugucgauggcaaacaucuuccgcggcucuuaccuugcaggggcgggccuccuguucuccaucaugaagaacaccaccaacacccggcggggaacggguaacaucggagagacacugggggagaaguggaagucccgccuaaaugcccugggcaagucagaauuccaaaucuacaagaaguccgggauccaggaggucgaccgcacgcucgcgaaggagggaaucaagcgcggagaaaccgaccaucaugccgugucccgcggcagcgcgaaacuucggugguucguggagcgcaacauggucacgccggagggcaagguaguggaucugggguguggccgcggcggcugguccuacuacugcggagggcugaagaacguccgcgagguaaagggacucaccaaaggcggucccgggcacgaggagcccaucccgaugucaaccuacggcuggaaccuggugcggcugcaaaguggcgucgacgucuucuucaccccgcccgagaagugugauacgcugcugugcgacauuggcgagaguagccccaaccccaccaucgaagcggguagaacacugagggugcugaaccuggucgagaacuggcugaacaacaacacccaguucugcgugaaggugcucaacccuuacaugccuuccgucaucgaaaagauggagacccugcagagaaaguacgggggcgcccuggugcggaacccccugagccgcaacuccacgcacgagauguacugggugagcaacgcuaccgggaauaucgucaguucaguaaacaugaucucccgcaugcucauaaaucguuucaccaugaagcauaagaaagccacauacgaaccggacguggaccugggcagcgggacgcggaacaucggcaucgaaaacgagauccccaaccuggacaucaucggcaaacggauagagaagaucaagcaggaacacgagaccaguuggcacuacgaucaggaccacccauacaagacaugggcguaccaugggagcuacgaaacuaaacagacgggcuccgccagcuccauggucaacgggguggugaagcuccugacuaagcccugggacguugugccgaugguuacccagauggcuaugacugacacgaccccauucggccagcagcgcgucuucaaagagaagguggauacccgaacucaagagcccaaggagggcacgaagaagcuaaugcgcaucaccgccgaauggcucuggaaggagcuggggaagaaaaagacgccgcggaugugcacccgcgaagaauucacuaggaagguccggagcaacgccgcgcuaggggccauauucacggacgagaacaaguggaaguccgcccgugaggcuguggaagacucccgcuuuugggagcucguggaccgggagcgcaauuuacaccuggaaggaaagugcgagaccugugucuauaacaugaugggcaagcgggagaaaaaacucggagaguucggaaaagcuaagggcucucgcgcgauaugguacauguggcugggcgcucgguuccuggaguucgaggcauuaggcuuccucaacgaggaccauugguuuucacgugggaacagccuguccggcgucgagggggagggccuucacaagcuggguuauauccugcgggacguaagcaagaaagaggggggggcuauguacgcagacgauaccgccgggugggacacgcgcaucacucucgaagaccugaagaacgaggagaugguaacuaaccacaugaaaggagagcacaagaagcuagccgaggccaucuuuaagcucaccuaucagaacaagguuguccgcguccagcggccaacgccccgcgggaccgugauggacaucaucagccggaaggaccagcgcggcagcggucaggucgggacauacggccugaacaccuucacgaauauggaagcucagcugauccggcaaauggagggggaaggcauuuucaaguccauccagcgcuuaaccgugaccgaggaaaucgcgguacagaauuggcuggugcgggucggucgcgagcggcugagccgcauggccgugucgggggacgauugcgugguuaagccccucgacgaccgguucgccagcgcccuaaccgcccugaacgacauggguaaagugcgcaaggacauccagcaaugggaacccucccgaggguggaaugacuggacgcagguacccuucugcagccaccacuuccaugaguuagucaugaaggacggccgcguuuugguggucccgugucggaaccaggaugaacugaucgggcgggcgagaaucucccagggcgcuggcuggagccuuaaggagaccgccugccuggggaaguccuacgcccaaauguggacccugauguacuuccaccgccgggaccuccggcuugcugcaaacgccaucugcagcgccguacccucccauuggguucccaccagucggaccacgugguccauucacgccaaacacgaauggaugaccaccgaagacaugcuggcgguauggaaccgcguguggauccaggagaacccguggauggaggacaaaacgcccguggagagcugggaagaaguccccuaccugggcaagcgcgaggaccaguggugcgggagccuaaucggucuuacuucccgcgcgaccugggcaaagaacauccagaccgccauuaaccaggugcguucacucaucgggaacgaggaguauacagacuacaugcccuccaugaagagauuccgcaaggaagaggaggaagccggugucuuaugguga

SEQ ID NO: 25166 - RNA, 9876 nt, Artificial Sequence
  derived and/or modified CDS sequence (opt11) from DENV-2__EU529693__SS-prME
acugccggggugauuauuaugcugauccccaccgccauggcguuucaccucaccacgcgaaacggggaaccccacaugaucguaggccgccaggagaaggguaaaucccugcuuuuuaagaccgaggacggugugaacaugugcacguuaauggccaucgaccugggugagcugugugaggacacuaucacguacaagugcccccuccuacggcagaacgagcccgaggacauugacugcuggugcaacucgacaaguaccugggugaccuacgggaccugcaccacaacgggcgagcacaggcgggagaagcgauccgucgcccuugugccccaugugggcaugggccucgagacccgcacagagaccuggaugagcagcgagggugccuggaagcacguccagcggaucgagaccuggauccuacgccacccgggcuucacuacuauggccgcgauccuggcuuauaccaucgggaccacccacuuccagcgggcauugaucuucauucuacuuaccgccguggcuccaagcaugaccaugcgcugcaucggcauuuccaaccgagacuucguggagggcgucagcgggggcucuugggucgacauuguucuggaacacgggaguugugugacgacuauggccaagaauaagccuaccuuggauuuugagcuuauuaagacggaggccaagcagccagccacgcuccgaaaguacuguauugaggccaagcugaccaacacaacgacagagucccggugcccaacccagggggagcccagccuaaacgaggagcaggacaaacguuucaucugcaagcacuccaugguugaccgggguugggggaauggcugcggccuguucggcaaaggcggcauugugaccugcgcgauguuuacgugcaagaagaacauggaggggaaggugguguuacccgaaaaccuggaguacacgaucguaaucacgccccacucuggggaggagcacgccgucggaaacgacaccggcaaacaugguaaggaaaucaaaaucaccccgcaauccagcauuaccgaggcugagcucacgggauacggcaccgugaccauggagugcagcccccggacgggccuggauuucaacgagauggugcugcuacaaauggaggacaaggcuugguuagugcaccgacaaugguucuuagacuugccccugcccuggcuuccgggggccgacacgcagggcagcaacuggauccagaaagagacccucgugaccuucaagaacccccacgcgaaaaagcaggacguugucgugcuuggaucccaagagggagcgaugcacaccgcccugaccggggccaccgagauccagaugucuagcggaaaccuccuguuuacggggcaccugaagugccgccuucgaauggacaagcugcagcugaaggggauguccuacucuaugugcaccggcaaguucaaaauagucaaagagauugccgagacgcagcacgggaccaucgucaucagaguucaguacgagggagaugguuccccaugcaaaauccccuucgagaucauggaccuagaaaaacggcacguccucgggcgccuaaucaccgugaacccgauagugacagagaaggacucucccgucaacauagaggcggagccgccauucggcgacucguacaucaucauuggugucgagccaggccaacucaagcugaacugguuuaagaaggggagcuccaucggacaaauguucgaaacgaccaugcguggcgccaagagaauggcuauccugggggacacagcaugggacuuugggucgcucgggggcguuuucacuuccaucgggaaggcacuucaccaggucuucggcgccauauacggcgcagccuucagcggggugaguuggacgaugaaaauccugaucggcgugaucauaaccuggaucggcaugaacucacgcuccaccagucucuccgucagccucguguuggucgguaucgucacccuguaccucggggugauggugcaggcugacacgggcugcguuguaagcuggaagaacaaggagcuuaaaugcggcagcgggauauucaucaccgacaauguccacaccuggacagagcaguacaaguuccagcccgaguccccuagcaaacuggcguccgccauacagaaagcccacgaagaaggaaucugcgggauccggagugugacuaggcuugagaaccugauguggaagcagaucaccccggagcugaaccacauccucagcgagaacgaggugaaacugaccauuaugacuggcgacaucaagggaauaaugcaagccgguaagagauccuugcgcccucagcccacggagcucaaguacagcuggaagaccuggggcaaggccaagaugcuguccaccgagagccauaaccagaccuuucugaucgacgggccugaaacggcggagugcccuaacacuaaccgggccuggaacuccuuagagguggaagacuacggcuucgggguuuucaguaccaacaucuggcuuaaguuaagagagaagcaggacguuuucugcgacuccaagcucaugagcgccgccauaaaggauaaucgggcuguucaugcugacaugggcuacuggaucgaguccgcgcugaacgauaccuggaaaauggagaaggcgagcuucaucgagauuaaguccugccauuggcccaagucgcacacccuauggucuaacggcgucuuagaaucugagaugaucauucccaagaacuucgccggucccguaucccagcauaacuaccguccgggauaccacacacagaccgccgggcccuggcaccuggggaagcuggagauggacuuugacuucugugaggggaccaccgugguugucacggaagacugugguaaccggggcccuagccuccgcacgaccaccgccagcggaaaacugaucacggaauggugcugccggucuuguacccugcccccuuugcgguacaggggcgaggacgggugcugguacggcauggagauacgccccuuaaaggagaaggaggagaaucuggugaacagccucgucacagccgggcacggccagaucgacaacuuuucccugggcgugcuggggauggcccuuuuccuggaggagaugcugcggacgcgcguaggcacgaagcacgcaauccugcugguagcgguuagcuucgugacccugaucaccgggaacauguccuuuagagaccucggucgcgucauggugauggugggugcuaccaugacggaugacaucggcauggguguuaccuaucuagcccuguuggcggccuucaaggugcgcccgacguuugcggccggacugcugcuccggaaacugacgagcaaagagcugaugauggcuacuaucgguaucgcacuacuaucccagaguacuaucccagagacgauccuagagcucacggacgcgcuagcguugggcaugauggugcucaagaucgugcgcaacauggagaaguaucagcuggccgugacgauuauggccaucuccugcgugccgaacgcagucauccuucaaaacgcuuggaaggugagcuguaccauccuggcggcaguguccgucucgccccugcugcugacauccagccagcaaaaggcugacuggaucccacuggcacugacaaucaagggucucaaccccacggcgaucuuccugaccaccuugucacguacgucgaagaagcgcucguggccgcucaacgaggccgugauggccgucgggaugguguccauccuggcuuccagcuugcugaaaaaugacauccccaugacggggccgcuaguggccggcggccuacugacagucugcuaugugcugacgggccggagcgcggaccuggagcucgagcgagccgccgauguuaagugggaggaccaggcggagaucagugggagcucgcccauccugagcaucaccaucucagaggacggcagcauguccaucaagaacgaggaggaggagcacacgcugacgauacucauccggaccggcuugcuggucaucagcgguguguuccccguguccauccccaucaccgccgcggccugguaccuuugggaggucaaaaagcagcgcgccggcguccucugggacgugcccagcccgccgcccgucggaaaggccgagcuggaggacggcgccuaccggaucaagcagcgugggaucuucggcuacucccaaauuggcgcuggggucuacaaggaggggaccuuccacacaauguggcaugugaccagaggagccguccucaugcaccgcggcaaacggauugagccaagcugggccgacgucaagaaggaccuuaucuccuaugggggcggcuggaagcucgagggcgaguggaaggagggcgaggaggugcaaguacucgcccuagagccagguaagaacccgcgcgccgugcagaccaagcccggacucuuuaagaccaauaccgggaccaucggcgcgguuagccucgacuucucccccggaaccagcggaucccccaucgucgaccggaagggcaagguugugggucuguacggcaacggggucgugacccgcagcggugccuacguaucggcaaucgcccagacggaaaaguccauugaggacaacccugagauagaggacgauauuuuccguaagaagcgucugacgauuauggaucuccaccccggugcggggaagaccaaacgguaccugcccgccauagugcgcgaagccaucaagcgggggcugcgcacguugauacucgcgccgacgagagugguggcugccgaaauggaagaggcccugcgggggcugcccauccgcuaucaaacccccgccauccgugccgaacacaccggccgggagaucgucgaucuaaugugucacgcaacuuucaccaugcgguugcugagccccguccgcgugccgaacuacaaccucauuauuauggacgaggcgcauuucacggaccccgccuccaucgccgcacggggguacaucuccacccgcgucgaaaugggcgaggccgcggguaucuucaugaccgccacgccgcccgggucccgagacccguuuccucagagcaaugcgcccaucauggaugaggagcgcgagauucccgagcggaguuggaacagcggccacgagugggugacggacuuuaaggggaagaccgugugguucgucccguccauaaaagcagggaacgacaucgcggccugccuucgcaagaacggcaagaaggugauucagcuaagcagaaagaccuucgacucugaauacgugaagacgagggccaacgacugggacuucgucgugaccacugacaucucagaaaugggagccaacuuccgggccgaacgcgugaucgacccccggcgcuguaugaagcccguaauccucaccgacggugaggagagagugauacuggccgggcccaugccugugacgcauuccagcgcagcccagcgccgcggccgaaucgggcgaaaccccaaaaacgagaacgaucaguacauuuacaugggcgagccacuagagaacgacgaggacugcgcccacuggaaggaggcgaagaugcuacuugacaauauuaacacucccgaggguauuaucccgucgauguucgagccugagcgggagaaggucgacgcgaucgacggggaauaccgccugcguggcgaagcccgcaagacuuuuguggaccugaugcggcgcggggaccugcccguguggcuagccuaccgagucgccgcugagggcauaaacuacgcggaucgccgguggugcuuugacgggaucaaaaacaaccaaauccuggaggagaacguggaggucgagaucuggacaaaagagggugagcgaaagaaacugaaaccgagaugguuggacgcccggaucuacagcgacccccucgcgcugaaggaguuuaaagaguuugcggcuggccguaaaucccuaacgcucaacuugaucacagaaauggggagacugcccaccuuuaugacgcagaaggcccgggacgcccucgacaaucuagccguccugcacaccgcugaagugggcgggcgcgcuuacaaccacgcccucagcgaacugcccgaaacccuggaaacacucuugcuuuuaacccugcuggccacggucaccggcggcauuuuccucuuccugauguccgggaagggcaucgggaaaaugacacugggcaugugcugcaucauuacggccaguauccuccugugguacgcacagauacagccgcacuggaucgcggccagcaucauccuggaguucuuccucauugugcugcugauccccgagccagagaagcagcggacgccccaggacaaccagcucacguacguggucaucgccaucuuaaccgugguggccgcgaccauggcgaacgaaaugggauuccuggaaaagaccaagaaggaccuuggccugggcagcauaacgacccaggagagcgaguccaauauacuggacaucgaccuacgaccugcgucggccuggacgcuguaugccguggccaccacguucgugacucccaugcugcgccacuccaucgagaacucauccgugaacguuucacuuaccgcgauagcuaaccaggccaccgugcucauggggcugggccgcggguggccauuguccaaaauggacaucggcgugccccugcuggccaucggguguuacagccaggucaacccgaucacucuuaccgccgccuuacugcucuuaguggcccacuaugcaaucaucggccccggccuccaggccaaggcgaccagagaggcccagaagcgcaccgccgccggaauaaugaagaaucccacgguugacggcaucacugugaucgaccuagagccuauuccguacgaccccaaauucgagaagcaacugggccaggugaugcugcucgugcugugcgucacccagguguugaugaugagaaccacgugggcccucugcgaggcguuaacucuggccaccggcccgaucagcacacucugggaggggaaccccggccguuucuggaacacuaccaucgcagugagcauggcgaauauauuccgcggcaguuaccuggccggggcgggccuccuguucagcaucaugaagaacaccaccaacacgcggagggggaccggcaacaucggggagacccuaggagaaaaguggaagucgcgacugaacgcacucggaaagagcgaguuccaaaucuacaagaaaucagggauucaagaggucgaccggacccucgcaaaagaggguauuaagagaggggaaacugaccaccacgccgugucacgcggcuccgcaaagcugcggugguucguggagcgcaauauggucacgccagagggcaaggugguggaccucgggugcggccgcggcggguggagcuauuacuguggcggguugaagaauguccgagaggugaagggccugaccaagggcggucccgggcacgaggaacccaucccgauguccacguacggauggaaucuugugcggcugcagagcgguguggaugucuucuucacgccgcccgaaaagugugacacccugcuaugcgacaucggcgagucuucccccaaucccacuaucgaagccggccggacucugcgggugcugaaccuagucgagaacuggcugaacaacaauacccaguuuugcgucaaggugcucaacccguacaugccaagcguuaucgagaagauggaaacguugcagcgcaaauacgggggcgcucucgugcggaauccuuuaucccgcaacucuacucaugaaauguacuggguaucaaaugcaacagggaacauagucagcucuguuaacaugaucagccgcaugcugauaaaccgcuucaccaugaagcacaagaaggcgacguacgagccggacguggaccucggcagcgggacgagaaacaucgguauugagaaugagaucccuaacuuggacaucaucggaaagcgaaucgaaaagauaaagcaggagcacgagacgagcuggcacuacgaccaggaccacccguauaagaccugggcguaccacgguaguuacgagacuaagcaaaccgguucggccaguagcauggucaacggggucgugaaauuacucaccaagcccugggacgugguaccuauggugacccagauggccaugacggacaccacccccuucggccagcaacgcgucuucaaggagaagguggacacucggacgcaggagcccaaggaggguacuaagaagcuaaugcgcaucaccgccgaguggcuguggaaggagcucggaaagaagaaaacgcccaggaugugcacucgcgaggaguucaccaggaaggugcguuccaacgccgcgcugggagcuaucuuuacagacgagaacaaguggaagucugcucgggaagcggucgaggacucgcgcuucugggagcugguggaucgugagcgcaaccuacaucuggaggggaagugcgagaccugcgucuacaauaugaugggcaagcgggagaagaagcugggagaguucggcaaggcaaagggcagccgcgcaauaugguacaugugguuaggggcccgguuccuggaguucgaagcacugggcuuccucaaugaggaccacugguucucccgcgguaauagccuaagcggcguggagggggaggguuuacacaaacucggcuauaucuuacgggacgugaguaagaaggagggcggggccauguacgcggacgauacggcggggugggacacccgcaucacccuggaggaucucaagaaugaggagauggucaccaaccauaugaagggcgagcacaaaaagcuggcggaagcuauauucaagcugacuuaccagaacaagguggugcggguccagcguccgacuccacgggggacggugauggacaucaucagccggaaggaucagcgcgguuccggccaggucgggacguacggccucaauacguucaccaacauggaggcgcaacucaucaggcagauggaaggagaggggauuuucaagagcauucaacgccugacggucacugaggagaucgcggugcagaacuggcucgcacgcguuggacgcgagcggcugucccguauggccaucucaggggacgacugcguagugaagccccuggacgaccgguuugccagcgcccucacggcgcugaacgacaugggcaaggugcgcaaggacauacagcagugggagcccucacgaggcuggaacgauuggacucaggucccguucugcagccaccacuuccacgagcuagugaugaaggacggccguaugcuuguagucccgugcaggaaccaggacgaauugaucgggcgcgcccgcauuagccagggcgcaggcuggucucugaaggaaaccgcuugcuuaggcaaguccuacgcccagauguggaccuuaauguacuuccaucgcagggaucuacgucucgcagccaacgccaucugcuccgcggugccgagccacugggugccuacuucccggacgacguggagcauccacgccaagcacgaauggaugacaacagaggauaugcuggcagucuggaacagaguauggauacaggagaauccguggauggaggacaagacacccguggaauccugggaggagguuccguaccuuggcaagcgcgaggaccaauggugcgggagccucaucggacucaccagccgggcaacuugggcgaaaaacauccagacggccaucaaccagguccgaucccugaucgggaacgaagaauacacagauuacaugcccagcaugaagagauucagaaaggaggaggaggaggcugguguacucugguga

SEQ ID NO: 25167 - RNA, 9876 nt, Artificial Sequence
  derived and/or modified CDS sequence (opt11) from DENV-2__EU482557__SS-prME
accgccggcgugaucaucaugcugaucccaaccgccauggcguuccaccucaccacccgcaauggggagccccacaugauugugggccggcaggagaagggcaagucccuccuguucaagaccgaagacggcgugaauaugugcacccuuauggccauugaccugggggagcugugugaggauaccaucaccuacaaaugcccccuucugcgucagaacgaaccagaagacaucgacugcuggugcaauagcaccagcaccugggugaccuacgggaccugcaccaccaccggcgagcaucggagagagaagagauccgucgcgcuugugccccacguggguaugggucucgagacccggacugagacauggaugagcucggagggggcauggaaacacguucagcggauugaaaccuggauccugcgccaccccggcuucaccaucauggccgcgauccucgccuacaccaucgggaccacccacuuucagcgggcccuaaucuucauccuguuaaccgccguagcgcccagcaugacuaugcgcuguauuggcaucuccaaccgagacuucguggagggcgucagcgggggcuccuggguagacaucgugcucgagcaugggagcugcgucacaacgauggccaagaauaagcccacccuggacuucgaacugaucaagaccgaggccaagcagccggccacguuacgaaaguacugcaucgaggcaaagcugacgaauacuaccaccgaguccaggugcccgacccaaggcgagccgucucugaaugaggagcaggacaagcgcuuuauaugcaagcacuccaugguagacagaggcugggggaacggcuguggccuguucggcaagggagggaucgugaccugcgcaauguucacaugcaagaaaaacauggagggcaaggucguucugcccgagaaccuggaguacaccaucguaauuacgccacacucuggcgaggagcacgccguagguaaugacacagggaagcacggcaaggagaucaagauuaccccgcaguccagcaucacagaggcagagcucaccggguacggcacgguaacaauggagugcaguccacggaccgggcuugacuucaacgagaugguuuugcuccaaauggaggauaaggccuggcugguccaucggcagugguuccuugaccucccacugcccuggcugccgggggccgacacccagggcagcaauuggauccagaaggaaacgcuugugaccuucaagaauccccacgcgaagaaacaggacgugguuguucuggggucgcaggaaggggcgaugcauaccgcccugacuggggccacggagauccagaugucgucuggaaaccuccuguucaccggccaccugaagugccgccuccggauggacaagcugcagcugaaggggaugaguuacagcaugugcaccggaaaguucaagaucgucaaggaaauugcggagacccaacacgguacgauagugaucagggugcaauacgaaggcgauggcucacccugcaagauccccuucgagaucauggaccucgagaaacggcauguccuggggcgauugaucacggugaacccuauagucacggaaaaggacagcccagucaauauugaggcagagccccccuuuggcgacucauacaucaucaucgggguggaaccgggccagcucaagcugaacugguuuaagaaggggagcucaaucggccagauguuugagacgacgaugagaggcgccaaacggauggccauccugggggacaccgccugggacuucggcagccucgggggcguguuuacgucgaucgggaaggccuuacaucaggucuucggcgcgaucuauggcgccgccuucagcggggugucauggaccaugaagaucuugaucggcguuaucaucacguggauagggaugaauagccguuccaccagccuguccgucagccucgugcuggucggcguugucacccuguaccucgggguuaugguccaggccgacuccgggugcguggugagcuggaagaacaaggaacugaaaugcggcucggggaucuucaucaccgacaacguccauacguggaccgagcaguacaaguuccagccagaaagccccagcaagcuggcguccgccauccaaaaggcccacgaggagggcauaugugggauccggagcgugacccgccucgaaaacuuaauguggaagcaaaucaccccggagcugaaccacaucuuauccgaaaaugaggugaaguuaacaaucaugaccggcgacaucaaggggauuaugcaagccgggaagaggagcuuacgcccgcagccuaccgaacucaaauacuccuggaagacuuggggcaaggccaagaugcuuagcacggagucccacaaccagacuuuccugaucgacggucccgagaccgcggaaugcccgaacacuaaccgggccuggaauagccucgaggucgaggacuacggauucgggguauucaguacgaacaucuggcugaagcugcgagagaagcaggacguguucugcgacagcaagcucauguccgccgccauuaaggauaaccgggcuguccacgcggacaugggauacuggauugaaagcgcacucaacgacacuuggaagauggagaaagcauccuucaucgaagugaaaaguugccacuggcccaagucucacaccuuaugguccaacggcguguuggaguccgagaugaucaucccgaagaacuucgccgggccugugagccagcacaacuaccgcccaggcuaccacacccaaaccgccgggcccuggcaccugggcaagcuggaaauggacuucgacuucugcgaggggacgaccguggugguuacggaggacugcggcaaccguggcccaagccuccgaacaacaacagcguccgggaaguugaucacugaguggugcugcagaagcugcacacugcccccacuccgcuaccggggcgaggaugggugcugguacgggauggagauucgcccucugaaggagaaggaggaaaaccuggugaacucguuagugacggccgggcacggccagaucgauaacuucagucugggcguucuggggauggcccuuuuucucgaggaaaugcugcgaacccgcguuggcaccaaacacgcuaucuuacugguggcggucuccuuugugacuuuaaucaccgggaacaugagcuuccgggaccucggccgcgugauggucauggugggcgccaccaugacggaugacauuggcaugggugugaccuaucuggcccuacucgccgccuucaagguccgccccacguuugcggcgggguuauugcuccguaagcuaacgucuaaggagcugaugauggccaccaucggcaucgcccuccuaucccaauccaccauccccgagacuauccuggagcucaccgacgcccuggcgcugggcaugaugguacucaagaucgugcgaaacauggagaaguaccagcuggcugucaccaucauggccaucucuuguguaccgaacgcagugauccugcaaaacgcuuggaaggucuccugcacaauccucgcggccgugagcgucagcccgcugcuccucacaagcagucaacagaaagcggacuggauuccccucgcccugaccauaaagggccucaacccgaccgcaauauuucugaccacgcugucgcgaaccucaaagaaacgcagcuggccgcuuaacgaggcggugauggccgugggcauggucuccauccuggccagcucgcugcucaagaacgacaucccaaugacggggccccugguagccggcggacugcucacugugugcuacguacugacgggccgguccgcggaccuggagcucgagcgcgcugccgaugugaagugggaggaccaggccgagaucagcggauccucccccauccuuaguaucaccauuagcgaggacggcuccaugucgauaaaaaacgaagaggaagagcacacgcugacaaucuuaauacgcacugguuuacuugugauuucgggggucuuccccgugagcaucccgauaaccgcagcggcaugguaccucugggagguuaagaagcagcgcgccgguguucugugggacgugcccucgccgccgcccguagggaaggccgagcuggaggacggcgccuaccggaucaaacagcgcgggaucuucggcuauucccaaaucggcgcgggcgucuacaaggagggcaccuuccacaccauguggcacgugaccagaggggcggugcucaugcaccgcggcaagcgcaucgaacccuccugggcagacguuaagaaggaccugaucucauacgggggaggauggaagcuggaaggggaguggaaggagggcgaagagguucaggugcucgcgcucgagccaggaaagaacccccgcgccgugcagacaaagcccgggcuguucaagaccaacaccgggaccaucggcgcggugucccucgacuucagccccgguacaucagggagccccauugucgaccggaagggcaagguaguggggcucuacggcaacggcgugguuacccgcuccggcgccuacgugucugcuaucgcccaaacggaaaaaucgaucgaggauaacccggagaucgaggacgauaucuuccguaagaagcgccugaccauuauggaccuccaccccggcgcggguaagacgaaacgguaccugcccgcuaucgugcgcgaggccaucaagcguggccugcgcacccugauucucgccccgacccgcgucguggccgcggagauggaggaggcccugcggggucucccuauccgcuaccagacccccgccaucagagcagagcacacaggacgcgaaaucguggaccucaugugccacgcgacguucaccaugcggcuguugucccccguucgcgugccgaacuacaaccucaucauuauggaugaggcgcacuuuacugaccccgccaguauagcugcccggggcuacaucuccacgcgcgucgagaugggggaagcagcgggaaucuucaugaccgccacaccgcccgguucgcgggacccguucccccaguccaacgcccccaucauggacgaagagcgcgagauccccgagcggagcuggaacucuggacacgagugggucaccgacuuuaaggggaaaacggugugguucgugccgagcaucaaggcuggaaacgacauagccgccugccugcgcaaaaacggcaaaaaggucauccagcugucucggaaaacguucgacagcgaguacgugaagacccgcgcaaaugacugggauuucguggucacgacggacaucuccgagaugggugccaauuuccgggccgaacgcgugaucgacccucggcgcugcaugaaacccguaauccugaccgacggcgaggagcgggugauucuggcggggccgaugccggugacccacagcuccgcugcccagaggagaggccggaucggucgcaaccccaaaaacgagaacgaucaguacaucuacaugggagagccccuggagaacgacgaggacugcgcccacuggaaggaggcgaagaugcuccuggacaacaucaauacccccgaggggaucaucccgagcauguuugagccagagcgggagaagguagacgcgauagauggggaguaccgccugcgaggcgaggcccgcaaaacguuugucgaucucaugcggagaggggaccugccgguguggcuugccuacagaguggcggccgagggcaucaacuacgcggacagacggugguguuucgacggaaucaagaauaaccagauccuagaggagaacgucgagguggaaauuuggaccaaggagggggagcgcaagaaguugaagccucgauggcuggacgcccgcaucuacuccgacccccucgcccugaaggaguucaaggaguucgccgcaggccgcaagucgcugacucucaaccugaucacagagaugggucgccuacccacguucaugacccagaaagcccgggacgcgcucgacaaccuggccguccugcauaccgccgagguaggcgggcgugcuuacaaucacgcccuuucagaacuacccgagacccuggagacccucuuacuacucacccugcuggccacagugacagguggcaucuuucucuuccugaugagcgggaaggggauagggaagaugacgcugggcaugugcugcaucaucaccgcuucuauccuccugugguacgcucagauccagccgcacuggaucgcggccagcaucauacuggaguucuuccugaucguccuguuaauacccgagccggagaagcagcggacgccccaggacaaccaacucaccuacguggucaucgccauucugaccgucguggccgcgacgauggcaaacgagauggguuucuuggagaagaccaagaaggaccucggccugggcucaauuaccacccaggaguccgaaagcaacauucuggacauugaccuacgcccggcuucagccuggacucuguacgccguggccaccaccuuuguuacaccaaugcugcgacacuccaucgagaacuccucagugaacgugucccucacggccaucgccaaccaggcaaccguuuugauggggcuuggccguggauggccccugagcaagauggacauuggcgucccguugcuggcuaucggcugcuacucccaggucaacccgauaacccucaccgcggccuugcugcuucuggucgcccacuaugcgaucaucggccccggccuccaggcaaaagcgacgcgugaggcacagaagcgaaccgcugcagggaucaugaagaacccgaccguggacggcaucaccgugauagaccucgagcccauuccguacgacccuaaguucgagaaacaacugggucaggucaugcuucucgugcucugcgugacgcagguucugaugaugagaaccaccugggccuuaugcgaggcgcugacccuggccacgggccccauuagcacccucugggaggggaaccccggccgguucuggaacacuaccauagcugugucuauggccaauaucuuccgcggcagcuacuuggccggggcgggacuucuauucuccaucaugaagaacacgacuaacacccggcgcgggaccgguaacauuggcgagacgcugggggagaaguggaagucacgucuaaacgcccucggcaaauccgaguuccagaucuacaagaaguccgggauacaagagguggaccgcaccuuagccaaggagggcauaaagcgcggggagaccgaccaccaugccgucucccgcggcagcgcgaaacugcguugguucgucgagcguaacauggugacaccggagggcaaagucguggaccucgggugcggucgcggcgggugguccuacuacugcggcggacucaagaacgugcgcgagguaaaggggcugacgaaagggggucccggucacgaggaacccauacccaugagcaccuacggcuggaacuuggugcggcugcaguccggaguggacgucuucuucaccccgcccgagaagugugacacccuuuuaugcgacaucggcgagucuucucccaaccccacgaucgaggccggcaggacucuucgggugcugaaucucguggagaauuggcugaacaauaacacccaguuuugcaucaaaguccugaacccguacaugcccuccgugaucgagaagauggagacccuccagcgaaaguacgggggcgcccuggugcggaaccccuugagccgcaacuccacccaugagauguauugggucagcaacgcgacggguaacauaguauccagcgugaacaugauuucccgcaugcugauaaaccgguucaccaugaaacacaagaaggcgacauacgaaccggacgucgaccuaggcagugggacacgcaauaucggcaucgagaacgagauccccaaccuugacaucaucggcaagcggaucgaaaagaucaagcaggagcacgagacguccuggcauuacgaucaggaucaccccuacaagacaugggcguaucacggcagcuacgagacaaagcagaccggauccgccuccuccauggugaacggggugguaaagcuacucacgaagcccugggacguggugccgaugguuacccagauggccaugaccgacacgacccccuucgggcagcagcggguguucaaggagaaggucgauacccggacccaggagccuaaggagggcaccaagaaguugaugcgcaucacggccgaguggcucuggaaagaacucgggaagaaaaagacuccccggaugugcacccgggaggaguucacccggaagguucgcagcaacgccgccuuaggugccaucuucacggacgagaacaaguggaaauccgcccgggaagccguggaggacucgcgcuucugggagcuagucgaucgggagcggaaccuccaccuggaggggaagugcgagaccugcguguacaacaugauggguaagcgggagaagaaacucggugaguucggcaaggccaagggcucccgcgccaucugguacauguggcucggggcccgguuccuggaauucgaggcacugggcuuccugaacgaggaucacugguucagccgcggaaauagccuguccggcguggagggggagggccuacacaagcucggcuacauccugcgugacgucuccaagaaagaaggcggugccauguacgcggacgacacagcagggugggacacccgcaucacguuagaggaccucaagaacgaggaaauggugaccaaccauaugaagggugagcacaagaagcuggccgaggccaucuucaagcugaccuaccagaacaagguaguccggguccagcgccccacgccgcgggggacggugauggacauuaucucacggaaggaccagcggggcuccggccaggucggaacguacggcuuaaacacguucacgaacauggaggcccagcugaucaggcagauggagggggagggcauuuucaaauccauccagagguuaaccgugaccgaggaaauagcgguccagaauuggcuggcccgggucggccgcgagcggcugucacgcauggccaucuccggggacgacuguguggucaagccccuggacgacagguuugccagcgccuugacggcgcugaacgacaugggcaagguccggaaagacauucaacaaugggagccgagccguggguggaaugacuggacccaggugccauucugcucacaccauuuccacgaacuugugaugaaggauggaagaguccucgugguccccugccggaaccaggacgagcucaucggucgcgcccgaaucucccaaggggccggcuggucccugaaggaaacggccugccuggggaaguccuacgcccagauguggacacuuauguacuuccaucgccgggaccuucgccucgcggccaacgccaucuguuccgccguccccucccauugggugcccaccagcaggacgaccugguccauccacgccaaacacgaguggaugacgacggaggacaugcuggcgguguggaacagaguguggauucaggagaacccguggauggaggacaaaacccccguggagucgugggaggaggugcccuaccugggaaaaagagaagaccaguggugcgggagccuuaucggacugaccuccagagccacuugggccaaaaacauccagacagcuaucaaccaaguacgcagcuugauugggaacgaggaauauacggacuacaugcccucuaugaagcgguucagaaaggaggaggaggaggcgggcguguugugguga

SEQ ID NO: 25168 - RNA, 9876 nt, Artificial Sequence
  derived and/or modified CDS sequence (opt11) from DENV-2__EU482560__SS-prME
accgccggcgucaucguuaugcucauuccgaccgucauggcuuuccaccucaccacccguaacggugaaccccacaugaucgugggccggcaggagaaggggaagucccugcuguuuaagaccgaagacgguaucaauaugugcacccugauggcuauugaucugggggaacugugcgaggacaccaucacguauaagugcccgcuuuuaaagcagaacgagccagaggacauagacugcuggugcaacagcacgagcacauggguuaccuaugggaccuguacgaccaccggggagcacagacgggagaagcgcagcguggcccuggugccucacgucgguaugggccucgagaccagaaccgagaccuggaugagcagcgagggggcauggaagcacgugcagcgcaucgagacguggauucugaggcaucccgguuuuaccaucauggccgccauccuggcguacaccaucgggaccacgcacuuccagcgcgcccucaucuucauacugcucaccgccguugcaccgagcaugacuaugcggugcaucggcaucucuaaccgcgacuuugucgaaggcguguccgggggcuccuggguggacaucgugcucgaacacggcagcugcgugacuacgauggccaagaacaagcccacccuggacuucgaauuaaucaagaccgaggccaagcagccugccaccuugcggaaauacugcaucgaggccaaacugacgaacacuaccaccgaaagccgcugcccgacgcagggcgaacccagccugaaugaggaacaggacaagcgguucaucugcaagcacuccaugguggacaggggcugggggaacgggugcgggcuauuuggcaaaggcgggaucgugaccugcgcuauguucacgugcaagaagaauauggagggaaagguagugcagccggaaaaccuugaguacacgauugugaucacgccccacucuggggaggagcacgcgguaggcaaugacaccggaaagcacggcaaggagauaaagauuaccccgcaguccagcaucacugaggccgagcucaccggguauggcacugugaccauggaaugcaguccccgaaccggccucgauuucaacgagauggugcuccugcagauggaggacaaggccugguuagugcaccgccagugguuccuggaccugccgcuccccuggcugccgggggcugacacacagggcagcaacuggauucagaaggagacccuugugaccuucaagaacccccaugccaagaagcaagacgucgugguccucgggucccaggaaggcgcgaugcacaccgcccugaccggggcgacggagauccagaugagcagcggcaacuugcuguucaccggccaccugaagugucggcugcgcauggacaagcuucaguugaaggguaugucguacagcaugugcaccgguaaguuuaaaaucguuaaggagaucgcggagacccagcacgggacgaucgucaucagggugcaguacgagggcgacggcucccccugcaagauacccuucgagaucacagauuuagagaagcgccacguuuuggggcggcugauuacuguuaacccuaucgucaccgagaaggacagccccgugaauaucgaggccgaaccgcccuuuggcgacucguacauaauuauugggguggagccgggccaacugaagcucaacugguucaagaagggcucauccauuggccagauguucgaaacgacaaugaggggcgcgaagcguauggccauccugggagacacggcuugggacuucggcagccuugggggcgucuucaccuccaucggcaaggcucuccaucagguguucggggccauuuacggcgcggcuuucucggggguguccuggacgaugaagaucuuaauagguguuaucauaacuuggauuggcaugaacagccgguccaccagccugucugugagucucguacucgucggcguggucacccuuuaucugggagccauggugcaggccgacagcggauguguggugagcuggaagaauaaggagcucaagugcggcuccgguauauucaucacggacaaugugcacaccuggaccgaacaauacaaauuccagcccgagucgcccagcaagcuggcuuccgccauucagaaggcccaugaggagggaaucugcgggauccgcuccgugacccggcuagaaaaucucauguggaagcaaaucacgcccgaacugaaccacauccuguccgagaacgagguaaagcuuacuauaaugacaggcgacauaaaggggaucaugcaagccggcaagcgcagccugcggccgcagcccaccgaacugaaguacuccuggaagacguggggcaaggcgaagauguuaagcacagagucgcacaaccaaaccuuccuuaucgacgggcccgagaccgcggagugcccgaacacgaaccgggcauggaacagccuggaggucgaggacuacggguuugggguuuuuaccacaaacaucuggcucaaacugagggagaagcaagacgccuucugcgacuccaagcugaugagugccgcgaucaaggacaaucgcgcugugcacgccgacaugggcuacuggaucgaguccgcucugaacgacaccuggaagauggagaaagccagcuucauagaggucaaauccugccacuggcccaagagccauacacuauggucgaacggcguucuggagagcgagaugauuauccccaagaacuucgccgggcccgugucccagcauaaccaucggccgggauaucacacgcagaccgcgggacccuggcaccucgguaaguuagagauggacuucgauuucugcgaggguaccaccgucguggugacagaggauuguggcaaccguggccccucacugcgcacgaccacagccagcgggaaguuaaucacggaguggugcugccgcuccuguacccuacccccgcuacgguacagaggcgaggacgguugcugguacgguauggagauuagacccuugaaggagaaagaggagaaucuggucaacucacuggugaccgccgggcacggccaaaucgacaauuucucccucggcguccugggaauggcccuguuccucgaggagaugcugcgcacccgggucgguacgaagcacgcgauacugcucguggcagugagccuggucacccugaucacuggaaauaugucauuucgcgaccucggccgggugauggugaugguuggagccaccaugacagacgacaucggcaugggcguuaccuaucuggcauugcucgccgcguucaaagugcgccccaccuucgccgccggacuacugcuccgcaaguugaccagcaaggagcuuaugauggccaccaucggcauugcccuccugucccagucuaccauccccgaaaccauccuugagcucacagaugcgcuggcgcuggggaugauggucuuaaaaauugugcgcaacauggagaaguaccaacuggccgugacaauuauggcaaucuccugcgucccgaacgccguaauccugcagaacgcguggaaggugucgugcaccauccuugccgccgucuccgugagcccccugcuuuuaacguccagccagcaaaaagccgacuggaucccgcuggcgcuuacuaucaagggcuugaaccccacggccaucuuccugaccacccugucccguaccuccaagaagcgguccuggccgcuuaacgaggcuaucauggccguggguauggucagcauccuggccagcagccuuuugaaaaacgacaucccaaugacggggccccugguggcgggggggcugcucaccgucugcuacgugcugaccggccgcagcgcagacuuggaacucgagcgggccgccgacgugaagugggaggaccaggcagagauauccgggagcucccccauucugagcaucaccaucuccgaggacggcagcauguccaucaagaacgaggaagaggagcagacuuugaccauccugauccgcaccggccugcuagucaucagcgggguuuucccgguguccauccccaucaccgcggcggccugguaccucugggaggucaagaagcagcgggcuggcgugcugugggaugugcccagcccgccacccgucgaaaaggccgagcuagaagacggggccuaccgcauaaagcagcggggcuuccucggguacagucagaucggcgccggcguguacaaggaagggacguuccacacgauguggcacguuacucgcggagccguccugaugcaccgggggaagcgcauagaacccagcugggcagacgugaaaaaggaccucaucuccuauggagggggcuggaaguuagagggcgaguggaaggagggggaggaagugcagguguuggcccuggagcccggcaagaauccccgggcggugcagaccaagccggggaucuucaagaccaacacgggcaccauuggggccgugagccucgacuucucccccggcaccagcggaagccccaucgucgaccgcaaggggaagguugugggccuguacgggaauggggucgucacccggagcggcgccuacguauccgcgaucgcgcagaccgaaaaguccauugagaacaaccccgagaucgaagaugacauuuuccgcaagaagaggcugaccaucauggaccuucauccuggggccggcaagaccaaacgcuaucugccugccaucguucgggaagcuauaaagcgcgggcugcggacccugauucucgccccgacgcgcgugguggcggccgaaauggaggaggcacugcgcggacugccgauccgguaccagacacccgccauccgcgccgagcacaccgggcgggaaaucgucgaccucaugugccacgcuaccuucacaaugaggcuacugucucccgugcgggugcccaacuacaaccucaucaucauggaugaggcccacuucaccgaucccgcgucuaucgcagcccgcggcuacaucagcacccgggucgagaugggcgaggcggcagggaucuucaugaccgccaccccgcccggcucgcgcgacccuuucccccagagcaacgcccccaucauggacgaggagcgggagauacccgagcgcucuuggaacagugggcacgaguggguaaccgacuucaaggguaaaacugugugguuugucccguccaucaaggcgggcaacgacaucgccgcuugccugcggaagaacggcaagaaggugauccaacucagcaggaagaccuucgacucugaguacguuaagacgcgagccaacgacugggacuucgucgugaccacugacaucucagagaugggcgccaacuuuaaggccgaacgcgugauugauccucggaggugcaugaagcccgucaucuugacagacggggaggagcgggugauucuggcgggacccaugccagucacgcacucgagcgccgcccagcgccgggggcgcaucggccgcaacccaaagaacgagaaugaccaguauaucuacaugggggagccccuggagaaugacgaggauugcgcccacuggaaagaggcgaaaauguuacuggacaacaucaacaccccagagggaaucaucccguccauguucgaacccgaacgcgagaaagucgacgcaaucgauggcgaguaccgccuacgcggggaggcccgcaagaccuucguggaccucaugaggaggggcgaccugccagugugguuagccuauaaggucgcagcagaggggauuaacuacgccgaccggaaauggugcuucgauggcaucaagaacaaccaaauccucgaggagaacguagagguggaaaucuggacuaaggagggggagcgcaagaagcucaaaccgcgaugguuagacgccagaaucuacucggaccccuuggcgcuaaaggaguucaaagaguuugcggccggccggaagucccugacgcucaaccuuauuaccgagauggggcgacugcccacguucaugacccagaaggcccguaaugcccuagacaaccuggccguccugcacacggccgaggcaggaggucgcgccuacaaucacgcccucagcgaguuaccggagacccuggagaccuuacuucugcucaccuugcuggccacgguuaccgggggcaucuucuuguuccucauguccggcaaggggaucggaaaaaugacuuugggaaugugcugcauaaucaccgcaagcauccuccugugguacgcccaaauccagccgcacuggaucgccgccuccaucauccucgaguucuuccucaucgugcugcuaauccccgaaccugagaagcaacggaccccccaggacaaccagcucacguauguggugauagccauccugaccgucguggcggcuaccauggccaaugagaugggcuuccucgagaaaaccaagaaggacuugggucuuggcagcauuacgacccaggagagugaguccaacauccuggauaucgaccuacgcccugccagcgccuggacgcuguaugcuguggccaccacguucgucaccccuaugcugcgacacuccaucgagaacucguccguuaacgugagcuuaacagccaucgccaaucaggcgacgguccugaugggccuggggaagggcuggccccucagcaaaauggacaucggggugccccugcuggccauugggugcuacagccaggucaacccgaucacucucaccgccgcucugcugcuccuggucgcccacuacgcuaucaucggcccgggcuugcaggccaaggccaccagagaagcacagaaacgggccgcggccggcaucaugaagaacccgacaguggacgggaucacgguaaucgaccucgaacccaucccuuacgaucccaaguucgaaaagcagcugggccaggucauguuacucauccuauguguuacccaggugcugaugaugcgcaccacaugggcccucugcgaagcacugacgcuagcgaccggcccuaucuccacccucugggaaggcaacccugggcgguuuuggaacaccacgaucgcggucagcauggccaacaucuucagaggcuccuaccuggccggggccgggcucuuauucagcauaaugaaaaauacgaccaauacccggcggggcacggggaauaucggagagacgcucggcgaaaaguggaagucgcgccuuaaugcgcucgggaagucugaguuccaaauauacaagaaauccgguauccaggagguggaccggacccuggccaaggaagguaucaaaagaggugagaccgaccaucacgccgucucacgggguucugcaaaauugcgaugguucgucgagcggaauauggucacgccggaaggcaagguugucgaucucggcugcgggcguggcggguggucguacuauuguggcgggcuuaagaacgugcgggaggugaagggccugacgaagggcggccccggccaugaggagccaauaccgauguccaccuacggguggaauuugguuagacugcagagcggcguggacguguucuucacuccgccugaaaagugcgacacguuacucugcgacaucggggagagcuccccgaacccuacgaucgaggccgggcguacccuacgcguacugaaccucguggagaacuggcugaacaauaacacccaguucugcaucaaggugcuuaacccguauaugcccagcgucaucgagaagauggagacccuccagcggaaauaugggggcgcgcuggucaggaacccccugucccggaacagcacgcacgaaauguauugggucuccaaugccaccgguaacauugucagcagugugaacaugauaagccgaaugcugaucaaccgguucaccaugaagcacaaaaaggccaccuacgagccggacguagaucuagguuccggcacuaggaacaucgguauugaaucugagauccccaaccuggacauuauuggcaagcggaucgagaagaucaagcaggagcacgagaccuccuggcacuacgaccaggaucaccccuacaagaccugggccuaccacggcucguacgagaccaagcaaacgggguccgccagcaguauggucaacggcguugugcgccugcucacaaagccuugggacgucgugccgaugguuacucagauggcgaugaccgacaccacgcccuucggucaacagcgcgucuucaaggagaagguggacacccggacccaggagccuaaagagggcaccaagaagcugaugaagauuaccgccgaguggcuguggaaggagcucggcaagaagaagaccccucgggugugcacccgggaggaauuuacuagaaagguccggaguaacgccgccuuaggcgccaucuucacggacgagaacaaguggaaguccgcgcgcgaggccguggaggauggccgguucugggagcugguugaccgcgaacggaaccuccaccucgaggggaaaugugagacgugcgucuacaacaugaugggcaagcgagagaagaaguugggggaguuuggcaaggcaaaggguagccgcgcaaucugguauauguggcucggggcgcguuuucuggaguucgaagccuugggcuuccucaaugaggaucacugguuuucucgggggaacucguuguccggaguggagggcgagggcuuacaucgccugggcuacauccugagagacgugggcaagaaggagggcggggccauguacgccgacgacaccgcgggcugggacacgagaaucacccuggaggaccucaagaacgaggagauggugacuaaccacaugaagggggagcacaaaaagcuggcggaggccauauucaagcugaccuaccagaacaaggugguccgggugcagcgcccgaccccgcgggggacagucauggacaucaucucccgucgggaucaacgugggagcgggcaggucggcaccuacgggcuuaacaccuucaccaacauggaggcgcaacugauccgccagauggagggcgagggcaucuucaaguccauucagcaccugaccgccacugaggagaucgccgugcagaauuggcucgcgcggguuggacgcgagcggcuuagccgcauggccauaucgggcgacgacugcguagugaagcccaucgacgaccgguucgccagcgcccugacugcccucaacgauaugggcaaggugcgcaaggacauccagcaaugggaacccucgagaggcuggaacgacuggacgcagguuccguucugcagccaccacuuccacgagcuggugaugaaggauggccgcguguuggucgugcccugccggaaccaggacgagcuaaucggccgcgcgcgcauaucccagggcgcaggcuggagccugaaggagaccgccugcuugggcaaguccuacgcacagauguggaccuugauguacuuucaucggagagaccugaggcuggcagcgaaugccauaugcagcgcggugcccucccacuggguccccacaucacggaccacgugguccauccacgcgaagcacgaguggaugacuacugaagauaugcucgccguguggaaucgcguguggauucaagagaaucccuggauggaggacaaaacccccguagagagcugggaggaggugcccuaccuggguaagcgggaggaccaauggugcggcucccuaaucgggcugacgagccgcgcuaccugggccaagaacauccagaccgcuaucagccaggugcggucgcugaucggcaacgaggaguacaccgacuacaugccgagcaugaagcgcuuccgccgggaagaggaagaagcuggaguccugugguga

SEQ ID NO: 25169 - RNA, 9876 nt, Artificial Sequence
  derived and/or modified CDS sequence (opt11) from DENV-2__EU482561__SS-prME
accgccggcgugaucaucaugcugauccccacugcuauggcguuccaccucacuacacggaauggcgagccccacaugaucgugggccgucaagagaaagggaagucccugcuguucaaaacagaggacgggguaaauaugugcacccugauggcgauugaccugggggagcugugcgaggacacaauaaccuacaaaugcccccuccugcgccagaaugagcccgaggacauagacuguuggugcaacucaaccucaaccugggucaccuacgggaccuguaccaccacuggcgagcaccgccgagagaaacggucggucgcccuggugccccacguggggaugggccucgaaacccggaccgagaccuggaugucgagcgagggggccuggaagcacguacagaggaucgagaccuggauccugcgccacccgggcuucacaauuauggccgcgauacuagccuacaccaucgggaccacgcacuuccagcgggcccucaucuucauccuacugaccgcgguggcgccuagcaugacgaugcgcugcaucgggaucucuaacagggacuucguggagggcguuagcggcggguccuggguugauaucgugcucgagcacgggucuugcgucacaacgauggccaagaacaagcccacccuggacuuugagcuuaucaagaccgaggccaaacagcccgcuacccucagaaaguacugcaucgaggccaagcugacgaacaccacgaccgagagccgguguccgacgcagggggagcccagccuuaaugaggagcaggacaagcgcuucgucuguaagcacagcauggucgaccggggcugggggaacggcuguggccucuucgguaagggcggcaucguaaccugcgcgauguuuaccugcaaaaagaacauggagggaaaggucguccucccggaaaaucuugaguauaccaucguuauaacgccccacuccggggaggagcacgcugugggaaaugacaccgggaagcacggcaaggagaucaagauuaccccgcaguccagcaucaccgaggccgaguuaacgggguauggaacgguuaccauggaaugcagcccccggaccggccuggauuucaacgagaugguacugcuacagauggaggacaaagccuggcucgugcaucggcagugguuccuggaccucccucugcccuggcugccgggggccgacacacagggcucgaacuggauccagaaggaaacgcuggucaccuuuaagaacccacacgcgaagaagcaggacgucgucguccuggggucccaggagggcgccaugcacacagcacugaccggcgccacggagauccaaaugagcucaggcaauuugcuguucaccggccaccugaagugccgccuccgaauggauaagcugcagcugaagggcauguccuacagcaugugcaccgguaaauucaagaucgugaaggaaauagccgagacacagcacgggacgauugugauccgaguucaguaugagggggacggcucccccuguaagauucccuuugagaucauggaccucgagaaacggcaugugcuggggcggcugaucacagugaacccgaucguggcagagaaggacagccccguuaacaucgaggccgagccgcccuucggcgauaguuacauaaucauugggguugagccgggccagcucaagcugaacugguucaagaaggggagcuccaucggccagauguucgagacaaccaugcgaggcgccaagcggauggccauccugggagacacggccugggacuucggcagccucggcggcgucuucaccuccaucggcaaggcucugcaccagguauucggugcgaucuacggcgccgcuuucagcggggugaguuggaccaugaagauacugaucggcgucauuaucaccuggauugggaugaacagccgcucaacgagucucuccgugagccuggugcuggucggcguugugacccucuauuuaggcgcgaugguccaagccgauuccgguugcguggugucauggaaauccaaggagcugaagugcggcucugguaucuucaucaccgauaacguccacaccuggaccgaacaguacaaauuucagccugagagcccguccaaguuagcaagcgccauccagaaggcacacgaggaggguaucugcggcauccguuccgugacccgccucgagaaucuaauguggaaacagaucacaccagagcugaaucauauccucagcgagaacgaggugaagcugaccaucaugaccggcgacaucaaggggaucaugcaggcuggaaagcguuccuugagaccacagcccaccgagcucaaguacaguuggaaaaccuggggcaaggccaagaugcugucaaccgagucucacaaccagacguuccugaucgacgggcccgagaccgccgaguguccgaacaccaaccgggccuggaacucccucgaggucgaggacuaugguuucgggguguuuaccacuaacaucuggcuuaagcugcgcgagaagcaggacguguucugcgacagcaagcucauguccgccgcgaucaaggacaaccgggccguccacgccgauaugggcuacuggauagaauccgcccugaacgacaccuggaagauggagaaggccucuuucaucgaggucaagagcugucacuggcccaagucccacacgcucuggucaaacggcgucuuagaguccgagaugaucauccccaagaacuucgcggggcccgugucucagcacaacuaccgcccgggcuaccacacccagaccgccgggcccuggcaccugggcaaacuggagauggacuucgacuuuugcgagggaacgaccgugguggucaccgaggacuguggcaaccggggaccaagccuccgcacgacgaccgccuccgguaagcugaucaccgaauggugcugucggagcugcacgcugcccccgcuccguuaccggggugaggacggguguugguauggcauggagauccgcccgcugaaagagaaggaggagaacuuagugaacucccucgugacggccggacauggccagaucgacaacuucucacugggcguacuggguauggcccucuuccuggaagagauguuacggacccgggugggcaccaagcacgccaugcuccugguagucgugucguucgugacccucauuacggggaauaugagcuuucgggaccucggccgcgucauggugauggugggggcgaccaugacugaugacauaggcaugggcaucaccuaccuggcccugcucgccgcguucaaagucaggcccacguucgccgcggggcuacugcuccggaagcuaaccagcaaagaacugaugauggccaccaucggaauugcccuccugucgcagaguaccauccccgagacgauccuugaacucacagacgcgcuggccuugggcaugauggugcuaaagaucgugcgcaacauggagaaauaucagcuagccgucaccauaauggccauaagcugcgugccgaacgcugugauacugcagaacgcguggaagguguccugcaccauccucgccgcagugagcgucagcccccuacuguuaacgagcucccagcagaaggccgacuggaucccgcuggcgcugacaauuaagggccucaaccccaccgccaucuuccugaccacgcugucgaggaccaguaaaaagcgcuccuggccacuuaacgaggcuaucauggccgugggcauggucuccauccuggccuccagucugcucaagaacgacaucccgaugacuggcccccugguagcaggggguuugcucaccgugugcuacgugcugacgggccguuccgccgaccuggagcucgaacgagcggcagacgucaagugggaggaccaggcagaaaucuccggaucuagcccaauucucuccauaaccaucagcgaagacggcuccaugagcaucaagaacgaggaggaggagcagacccugaccauacuuauccggaccggccugcuggugaucuccggcgucuuccccgucucgaucccuauaacugcggccgccugguacuugugggaggugaaaaagcagcgcgcaggcgugcugugggacguacccagcccgccgcccguggggaaggcagagcuggaagacggggcuuaccggaucaagcagcgcggaauccucggcuacagccagaucggugccgggguguacaaggagggcacauuccacaccauguggcacgucacccgcggggcggugcucaugcaccgcggcaaacguaucgagccuuccugggccgacgugaagaaagaccugauuagcuacggugggggcuggaaacucgaaggcgaauggaaggagggggaggaggugcaagugcuggcccuggaacccggcaagaacccacgcgcugugcagacgaagccuggccucuucaagaccaauacugggaccaucggcgcugucucccuggacuucagcccggguacguccgggagccccaucgucgaccggaaaggcaagguggucgggcuguacggcaauggcguggugacccgcuccggggccuacgucagcgccaucgcgcagaccgagaaguccaucgaggacaaucccgagaucgaggacgacauauuucguaagaagcgccucaccaucauggaucuccaccccggcgcagggaagacgaagcguuaucugcccgcaauaguucgcgaggccaucaagcguggccugcggacccucauccuggccccaacccgcgugguggcggccgagauggaagaggcacugcgggggcuccccauccguuaccaaacacccgccauccgggccgaacacacgggccgcgagaucguggaucugaugugccacgccaccuucaccaugcggcugcuaagccccgugcgcgucccgaacuauaaccugauuauaauggacgaggcccacuuuaccgacccagcgucuaucgccgcccggggcuacaucuccacgcgcguugagaugggggaagcggcuggcauauucaugacggccacaccacccgggagccgggacccguucccccaguccaacgcgcccaucauggacgaggaacgcgagauccccgagcggagcuggaacuccggccacgaguggguaaccgacuucaagggcaagacggucugguucgugccgagcauuaaggcgggcaaugacaucgccgccugccugcgcaagaacggcaagaaagugauccagcucucgcggaagaccuucgacagugaguacgucaaaacucgcgccaacgacugggacuucguagucaccacggauauuuccgagaugggggccaacuucaaagcugagcgggucauagacccccgacggugcaugaagccaguaauuuuaacagacggcgaggagcgcgugauccuggccgggcccaugccggucacucacagcuccgccgcccaacggcgcggcagaaucggacggaaccccaagaacgaaaacgaucaauacaucuacaugggcgagccccuagagaacgaugaggacugcgcccacuggaaagaggcgaagaugcugcuggacaacaucaauacccccgagggcaucaucccgagcauguucgagccggagcgggagaagguugaugccaucgauggggaguaccggcuccgcggcgaggcccggaaaacguucguggaccugaugcggcgcggggaucugcccgucuggcucgcguaucgcgucgcagcggagggcaucaacuacgcugaucggcgcugguguuuugaugggaucaagaacaaccagaucuuagaggagaacgucgaagucgagaucuggaccaaggagggcgagcggaagaagcugaaaccucgcuggcucgacgcccggaucuauuccgacccccuggcguuaaaggaguucaaggaguucgcggcuggucggaagucucugaccuugaaccugaucaccgagauggggcggcuccccacguucaugacgcagaaggcccgcgacgcccuugauaaccuggccgugcuccacaccgcggaggccggagggagagcuuacaaccacgcccuguccgagcugcccgagacgcucgagacucugcuccuccugacacuccucgcaaccgucaccgggggcauuuuccuguuucugaugagcgggaagggcaucgggaaaaugacgcucggcauguguugcauaauuacugcaucuauccuucugugguacgcucagauucagccucacuggaucgccgccagcaucauccuugaguucuuucugauagugcuguuaauccccgagccggagaagcagcgaacgccucaggauaaccagcugaccuacgugguaaucgccauucugacugugguggcggccacuauggccaacgagaugggguuccuagagaagaccaagaaggaccuuggccugggcagcaucgcgacccaagaguccgagagcaacauacucgauaucgaccugcggccagccuccgcguggacgcuguacgccgucgccacgaccuuugucaccccaaugcuccgccacagcaucgaaaacucuagcgugaacgucucccugaccgccauagcaaaccaggcgacgguucugauggggcucggcaagggauggcccuuaagcaagauggacauuggugugccccugcuagccauugguugcuauucccagguuaacccgaucacccugaccgcugcccuguuacugcugguggcgcacuacgccaucaucggccccgggcuccaggcaaaggccacccgugaagcccagaaacgcgcggccgccggaauuaugaagaaucccacgguggacggcaucacuguaaucgaccuggagcccaucccguacgaccccaaguucgagaaacagcucgggcaggucaugcucuugaucuuaugcgugacacaaguccuuaugaugcgcaccacuugggcccugugcgaggcguugaccuuagcgaccggcccaaucagcacccuaugggaggggaacccuggccgguucuggaacacgaccaucgcaguguccauggcuaacaucuuccgcggcagcuaucuagcaggggcgggccuccuguucuccauaaugaagaacaccaccaacacacgucgcgggaccggcaacauuggcgagacccugggggagaaauggaagucccggcucaacgcccugggcaagucugaguuccagaucuacaagaaguccgggauccaagaaguggaccgcacccuggccaaggagggcauaaagcgcggcgaaacggaccaccacgcagucucucgcggcagugcuaagcuccggugguucguugagcgcaacaugguuaccccggaaggcaaagugguggaccuggggugcggccggggcggaugguccuauuacugcggcgggcugaagaacguccgcgaggucaaggggcucacgaaaggcgggccaggacacgaggaaccuauucccaugagcacguacggcuggaaccuggugagacugcagagcgggguggacgucuucuucacuccgcccgagaagugcgauacgcuccugugugacaucggugagucaagccccaacccgacaauagaggcuggcagaacccuacgggugcucaacuuaguggagaacuggcugaacaacaacacgcaauucuguaucaagguccuuaauccguacaugcccaguguaauagagaagauggagacccugcaacgcaaauacggcggggcacucguucggaacccacuuucacgcaacuccacccacgagauguauuggguuucaaacgccaccgggaacaucguguccagcgugaauaugauaucccggaugcucaucaaccgcuucacaaugaagcacaaaaaggccacguaugagcccgacgucgaccucggcuccgggacccgcaacauuggcauugaguccgagauacccaacuuagauaucaucggcaagcggaucgaaaagaucaagcaagagcacgagacgagcuggcacuacgaccaggaccacccguacaagaccugggccuaccacggguccuacgagacgaagcaaaccggcagcgcgaguucgauggugaacggggugguccgccuucuuaccaagccuugggacguggugccgauggucacccaaauggccaugaccgacaccacccccuucggccagcaacggguguucaaggagaaaguggacacccggacacaggagccuaaggagggcaccaagaagcugaugaagauuacggccgaguggcucuggaaggaacucgggaagaaaaagacgccacggaugugcacucgagaggaauuuacccggaaggucagauccaacgccgccuugggcgcgaucuucaccgacgagaacaaauggaaguccgcccgggaggcgguggaggacucccgcuucugggagcucaucgaccgggagcgcaaucugcaccuugaggggaaaugcgagaccugcguguacaacaugaugggcaaacgggagaaaaagcucggggaguucgguaaggccaagggcucccgagcgauuugguacaugugguugggggcccgguuccuggaguucgaggcgcucggcuucuuaaaugaggaccacugguuuucccggggaaacuccuuaagcggcgucgaaggggaaggccuacaccggcugggcuacauccugcgagacguauccaaaaaggaggguggggccauguacgccgacgacacugcagggugggauacccggaucacccucgaggaccugaagaacgaggagaugguaaccaaucacaugaagggggagcacaagaagcuggccgaggccaucuucaagcucacguaucagaacaagguggugcgcguccagcguccgacaccccgggggaccgucauggauaucaucagccgccgggaucagcgcggcuccggucagguggggaccuacggccugaacacguucaccaacauggaggcacagcugauccgacagauggagggggagggcaucuucaagagcauacagcauuuaaccgucacugaggagaucgccgugcagaacuggcucgcgagggugggccgggagagacugagccggauggccaucagcggggacgauugcgugguaaagccccuugacgaccgcuucgccucagcccugacggcccuuaacgacaugggcaaggugcggaaggacauccagcagugggaacccucacgcggguggaacgacuggacucaggucccguucugcucacaucacuuccacgagcucaucaugaaggauggacgggugcuggugguaccgugccgcaaccaggacgagcugaucgguagggcgaggauaagccagggugcgggguggucccucaaggagaccgccugccuggggaaaagcuacgcgcaaauguggacucugauguacuuccaccggcgcgaccugcgguuggccgcgaacgccaucugcuccgccgugcccagccacuggguuccuacuuccagaacaaccuggagcauccacgccaagcacgaguggaugaccaccgaggacauguuggcagucuggaaucgaguuuggauacaggagaacccguggauggaggacaagacgccuguggaaagcugggaagagguuccauaccuaggaaagcgcgaggaucaguggugcgguucccucaucggccugacuagccgcgcuaccugggccaagaacauccagaccgcaauuaaccaggugaggagccucaucgggaacgaagaguacacggacuacaugccaagcaugaagcgcuuucggcgcgaggaggaggaggccggcgugcugugguga

SEQ ID NO: 25170 - RNA, 9876 nt, Artificial Sequence
  derived and/or modified CDS sequence (opt11) from DENV-2__EU569703__SS-prME
acggccggcgugauuaucaugcugauccccaccgccauggcguuccaccucaccacacggaacggggaaccccauaugaucguaggucggcaggagaaggggaagucccuauuguucaagacagaggacggugugaacauguguacgcucauggccauagacuuaggggagcuuugugaggauaccaucaccuauaagugcccacuccugcgucagaacgaaccugaagacaucgauuguuggugcaacucuaccucgaccugggugacuuaugggaccugcaccacaacgggcgagcaccggcgcgagaagcggagugucgcccuggugccacauguggguaugggccucgaaacacggaccgaaaccuggaugucgagcgagggggccuggaagcacguacagcggauugaaacuuggauccugaggcacccgggcuuuaccauaauggccgcgauccuggcguacacgaucgggacgacccauuuccagcgggcccucaucuucauccuccugaccgccguggcgcccagcaugaccaugcgcugcauagggaucuccaaccgcgacuuuguugagggcgucucaggugguuccugggucgacauuguacuagagcacgggaguugcgucaccacgauggccaagaacaagccaacccuggacuucgagcugaucaagaccgaggccaagcagccagccacccuccgcaaguauugcaucgaggccaagcugacuaauaccaccacggaaucccguugcccuacccagggagagccuagucugaacgaagagcaggacaagagauucauuugcaaacacuccauggucgacaggggcuggggaaacggcugcggcuuauucggaaagggggggaucguaaccugcgcgauguucacgugcaagaagaacauggagggcaaggucgugcugcccgaaaaccuggaguacaccaucgugauaacgccacacagcggugaggagcacgcggugggcaacgacacggggaaacauggcaaagagaucaagaucacaccucaguccagcauuacugaggcggagcucacaggguacggaacggucaccauggaguguagcccccggaccggccuggacuucaacgagaugguguuacuccaaauggaggauaaggcauggcugguccaccggcagugguuccuggaccucccccugcccugguugccuggugccgacacacaaggcagcaacuggauccagaaggaaacgcuggugacauuuaagaacccacacgcaaagaaacaggacgucguugugcucgggucccaggaaggggcaaugcacaccgcccuuacaggggccacggagauucagaugagcagcggcaacuugcuuuuuacaggccaccugaagugucgccuucgcauggacaagcugcagcugaaggggaugucuuacucaaugugcacaggcaaauuuaagaucgucaaagagaucgccgagacccagcacgggacgaucgucauacgcgugcaguacgagggagauggcucaccauguaagauucccuucgagaucauggaccuggaaaagcggcacguccugggccgccugaucacugugaacccgaucgugaccgaaaaggacagcccugucaacaucgaggcggaaccaccauucggcgacuccuacaucaucauagggguggaaccagggcaacugaaacugaacugguuuaagaaaggauccuccaucggccagauguucgagaccacgaugcgcggcgccaagagaauggccauccugggggauaccgcuugggacuucggcucucuuggugguguguucacuucuaucgggaaagcgcugcaccagguguuuggcgcgaucuacggcgccgcguuuagcgggguguccuggaccaugaagauccugauaggcguuaucaucacguggaucgggaugaacucucgcucaacuagucucagcguguccuuggugcuggugggcgucgugacccuguaccucggggucaugguucaagccgacuccgguugcguggugucguggaagaacaaggagcugaagugugguuccggaaucuucauaacugacaacguucacacuuggacggagcaauacaaguuccagcccgagucacccagcaagcuugcgucagccauacagaaggcccacgaggaggggaucugcgggauccgguccguuacgcgccuugagaaccugauguggaaacagaucacacccgaguugaaccacauauuauccgagaaugaggugaaguuaaccauaaugaccggcgacauaaaggggauaaugcaggcggguaagaggucucuccgcccucagccuacggagcuaaaguacuccuggaagaccuggggcaaggcaaagauguuaagcacggagucucauaaccagaccuuucugauagacgggcccgagacggcggaaugcccgaauacaaaucgcgccuggaacagccucgagguggaggacuacgguuucggggucuuuuccacgaacauuuggcuaaagcugcgcgaaaagcaagacguauucugcgacagcaaacucaugagugccgccaucaaggacaaucgagccguucaugcagacaugggcuacuggaucgagagcgcccugaacgacacuuggaaaauggagaaggccuccuucauugaggucaaaagcugccacuggcccaagucucacacccuguggagcaauggcgugcucgagagugaaaugaucaucccgaagaacuucgcggggcccgugagccagcacaacuaccgcccgggauaccacacacagaccgccggaccguggcaccugggcaagcuggagauggauuuugacuucugcgagggcacaacagugguggugacggaggauugcggaaaucggggccccucacuccggaccaccaccgcguccgggaagcugaucaccgaguggugcugccggagcugcacgcugccgccgcuccgcuaccggggggaggacgggugcugguacggcauggagauccgcccccugaaagagaaagaggaaaaccuagugaacucgcucgugacugcugggcacggucagaucgauaauuuuucguugggcguccuuggcauggcccucuuuuuagaggagaugcugcggacccgcguaggcacuaagcaugccauuuugcugguagcggucucguucgugacacugaucacugggaauaugucuuuuagggaccucggucgcgugaugguaaugguaggggcuaccaugaccgacgauaucgguauggggguuaccuaccuugcccugcucgcagccuucaaggugcgccccacguucgcggcagggcuguuacucaggaagcuuaccucaaaggaguuaaugauggccacgauuggcauagcucuccugagccagagcaccaucccugaaacgauauuggagcucacggacgcacuugcgcuggggaugaugguacuuaagaucguucgcaacauggagaaauaccagcuggcggucacuauuauggccauuagcugcgucccgaacgcgguuaucuuacagaaugcguggaaggucuccugcaccauccuugcugccgucucugucuccccccuguugcucacgucaucccagcagaaggcagacuggaucccccucgcccugaccaucaaaggccugaaccccaccgcgaucuuucuuaccacgcugagccggaccaguaagaagcgcagcuggccgcucaacgaggccgugauggccguggguauggucaguauacuggccucuucccugcuuaaaaacgacauacccaugaccggaccgcugguggcugguggccuccucaccguguguuacguucuaacgggucgauccgcggacuuagagcucgagcgcgccgccgauguaaagugggaggaccaggccgagaucagcggaaguuccccaauucuguccaucaccaucagcgaggacgggucgaugagcauuaaaaaugaggaggaagagcauacccugacgaucuugauccggacgggcuuacugguaaucuccggggucuucccgguuagcauuccuauaaccgcugcggccugguaccucugggaggugaagaagcagcgcgcaggcguccugugggacguucccagcccgccucccguggggaaggccgagcuggaggacggcgccuacagaauuaaacagagggggaucuuuggcuacagccagaucggcgcaggggucuacaaggaaggcaccuuucacacuauguggcaugugacccgcggcgccgugcucaugcaccgcgggaagcggaucgaacccuccugggccgacgucaagaaggaucugaucagcuacgggggcggguggaagcuugagggugaauggaaggagggcgaggagguccaagugcuagcauuggaaccaggcaagaacccccgcgccguccagacgaagcccggucuuuuuaagacaaacaccgggaccauuggagcuguguccuuagacuucagccccggcacaucagggucacccaucguggacaggaagggcaaggucgugggucuguacgguaaugguguaguaacccgcucaggagccuacgugagcgcuauugcccaaaccgagaagagcauagaggacaacccugagaucgaggacgacauuuuccggaagaagcgccugacaauuauggauuugcacccaggggcggggaagaccaagcgauaccuuccagccauagucagggaagccaucaagcggggccugcggacccuuauccucgccccgacccgcgucguggccgcggaaauggaggaggcucugcgggggcugcccauccgcuaccagacccccgccauccgggccgagcacacgggccgcgagauaguggacuuaaugugccaugccaccuucaccaugcgccuguuaucuccuguccgugugccgaacuacaacuuaaucaucauggacgaggcgcacuucaccgacccugcgucgaucgccgccagggguuacaucuccacgcgcguggagaugggggaggccgccggcaucuucaugacagccaccccgccugguagccgugacccguucccccaauccaacgcacccauaauggacgaagaacgcgagaucccagaaagauccuggaacuccggccaugaguggguaaccgacuucaaggggaaaacggugugguucgugccgagcauuaaggccggcaaugacaucgcugccugccugcgcaagaauggcaagaaggugauccagcugucccgaaagaccuuugacagcgaguaugugaaaacccgcgccaaugacugggacuucguggucacaacggacaucuccgagaugggggcgaacuuccgggcagaacgugugaucgacccgcggcgcugcaugaagccugugauccuuaccgacggcgaagagcgggucauccuggcuggccccaugccggugacccauagcagcgccgcacagcgccggggccggauaggacgcaacccgaaaaacgagaacgaccaguacaucuacaugggcgagccucucgagaacgacgaagacugcgcccacuggaaggaggcaaagaugcuccuggacaacaucaacacgcccgagggcauaauaccgagcauguucgaacccgaacgggaaaagguggacgcgauagacggggaauaccgccugcguggcgaggcccggaagacuuucgucgaucucaugcgacgcggcgaccugcccguguggcucgccuaccggguggccgccgaggguauaaacuacgcggaccgcagauggugcuucgacgggaucaagaauaaccagauccucgaggagaacgucgagguggagaucuggaccaaagagggcgagcgcaaaaagcugaagccgagauggcuggacgcacgcaucuacuccgauccccuugcccugaaggaguucaaagaguucgccgcuggccgaaagucacugacccucaaccugaucacugaaaugggccgccuaccuaccuucaugacacagaaggccagggacgcauuagacaaccuggcgguguugcauaccgccgaggugggugggcgggcguacaaccacgccuuauccgagcuccccgagacccuggagacgcuccuucuguuaacgcugcuggcgaccgugaccggaggcauuuuccucuuucugaugagcgggaaggggaucggaaagaugacgcuuggcaugugcugcaucaucaccgccaguauccugcugugguacgcccagauccagccccauuggauugcggcuagcaucauccuggaguucuuccuaaucguccugcugauccccgagccggaaaagcagagaacgccccaggacaaccagcucaccuacguugucaucgccauccugacugucguggccgccacgauggcgaacgaaaugggguuccuggagaagaccaagaaggaccucggccugggcagcaucaccacccaggaguccgagagcaacaucuuggacauagaccuacggccggccuccgccuggacgcuguacgccguggcuacuaccuucgucaccccuaugcugagacacucaauugagaacaguagcgucaacgugucccucacggcuauagccaaccaggcaacuguccugaugggucugggccgcggauggccacucucaaagauggacaucggcgugcccuuguuagccaucgggugcuacagccaagucaauccaaucacccucaccgcggccuugcugcugcuggucgcgcacuacgcuaucaucggccccggcuugcaggccaaagcaacgcgagaggcccagaagcgcgccgccgccgggauaaugaaaaaccccaccguggacgguaucacggugauugauuuagagcccaucccguacgauccaaaauucgagaagcaacugggacagguuaugcugcucguuuugugcgugacccagguccugaugaugagaaccaccugggcacugugugaagcccugacuuuggccaccggccccauuuccacgcucugggaggggaacccaggcagauucuggaacaccaccaucgccgugagcauggccaacaucuuccgcggcagcuaccuggccggggccggccuccucuucuccaucaugaagaacaccacgaacacccggagggggacugggaacaucggcgagacccugggugagaaguggaaaucccggcugaacgcgcucggcaaguccgaguuucagauauacaagaagucugggauccaggaaguugaucgcacucuggcgaaagagggcauuaagcgcggggagaccgaccaccaugcagugucccgcggcagcgcaaagcugcgaugguuuguggagcgcaacauggucaccccggaaggcaaagucguagaucucgggugcggccgcggcggguggucauacuacugcggcggucugaaaaacgugcgcgaagucaaggggcuuaccaagggcggccccggucacgaggagcccauucccaugucaacguacggcuggaacuuaguucggcugcagagcggcgucgacguauucuucacuccgcccgaaaaaugcgacacauuauuaugugacaucggagaguccagccccaaccccacgaucgaggcgggccguacccugcggguucugaaccucguggagaacuggcugaacaacaacacccaguucugcaucaagguccugaacccguacaugcccucgguuaucgaaaagauggagacucuccaacgcaaguauggcggcgcacugguucgcaacccgcuaagccgcaacuccacccacgagauguacugggucagcaacgcaaccgggaacauuguguccagcgugaauaugaucucccgaaugcuaaucaaccgguuuacgaugaaacacaagaaggcgaccuacgagccggacgucgaccucgggucggguacccgcaacauuggcaucgagaacgagauccccaaucuggacaucauaggcaaacggaucgagaagaucaagcaagagcaugagacauccuggcauuacgaccaggaccacccuuacaagacgugggccuaccacgggagcuacgaaaccaaacagaccggcuccgccaguuccauggugaacggggugguccgccugcuuaccaagcccugggacgugguuccgaugguaacgcagauggccaugacggacacuacccccuucggacaacagcggguguucaaggagaagguugacacgagaacgcaggaacccaaggagggcaccaagaaauuaaugcggauaaccgccgagugguuguggaaggagcuagggaagaagaagacacccaggaugugcacucgggaggaguuuacccggaaggucagaucaaacgcagcccuaggagccaucuucaccgacgagaacaaguggaagucagcccgcgaggccguugaggauagccgguucugggagcuggucgaucgcgagaggaaccuccaccucgaggggaagugugagacaugcguguacaacaugaugggcaagcgcgagaagaagcuaggugaguucgguaaggccaagggcaguagagccaucugguacauguggcucggggcccgcuuucuggaguucgaggccuugggguuccucaacgaagaccauugguuuucccggggcaacagccuuuccggcgucgagggagagggccugcacaaacugggcuacauccugcgugacgugagcaaaaaggagggcggagcaauguacgcggaugacaccgccgggugggauacccggauuacacuggaagaccucaagaacgaggagauggucacgaaccacaugaagggugagcacaagaagcuggccgaggcgauauucaagcugaccuaucagaacaaggugguccgcguacagcgcccaacgccccggggcacggucauggacaucaucucccgcaaggaccagcgggguucgggccaggucggcacguacgggcucaacaccuucaccaauauggaggcgcagcugaucaggcaaauggaaggagaggggaucuucaaaaguauucagaggcuuacgguaacagaggaaaucgccgugcagaacuggcucgccagggucggccgggaacggcugagccguauggccaucuccggggacgacugcguggucaagccccuggacgaccgcuucgccagcgcguuaacugcccugaacgacauggggaagguccggaaggacauccaacagugggagcccucccgcggcuggaacgacuggacccagguaccguuuuguagccaucacuuccacgaguuagugaugaaggacggccggguccucguggucccgugccgcaaccaagaugagcugaucgggcgggcgcgcauaucccagggcgccgguuggagccuaaaggaaaccgccugccucggcaagucauaugcgcagauguggacacuaauguacuuccaucggagagacuugaggcucgcggccaaugccaucuguagcgccgugcccagccauuggguucccacuagccgcaccacaugguccauccacgcuaagcaugaauggaugaccacggaggacaugcuggcaguguggaaccgagucuggauucaggagaauccguggauggaagacaagacacccguagagucaugggaagaggugccguaccucggcaagcgggaggaccaguggugcgggagccucauaggcuuaacuucccgcgccaccugggcaaagaacauccagacggcgauaaaccagguccgaucccugaucgggaacgaggaguacaccgacuacaugcccucuaugaagagauuccggaaggaggaggaggaggccggcgugcucugguga
